United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 62

SEQ ID NO: 2814124 - RNA, 23 nt, Human
uacaguaacuuuauguguaaaua

SEQ ID NO: 2814125 - RNA, 22 nt, Human
uacaggcgugagccaccgugcc

SEQ ID NO: 2814126 - RNA, 14 nt, Human
uacaggcccugcuc

SEQ ID NO: 2814127 - RNA, 15 nt, Human
uacaggcccugcucc

SEQ ID NO: 2814128 - RNA, 16 nt, Human
uacaggcccugcuccu

SEQ ID NO: 2814129 - RNA, 19 nt, Human
uacaggcccugcuccugca

SEQ ID NO: 2814130 - RNA, 15 nt, Human
uacaggcuccugcca

SEQ ID NO: 2814131 - RNA, 14 nt, Human
uacaggcuccugcc

SEQ ID NO: 2814132 - RNA, 13 nt, Human
aauggagaggaac

SEQ ID NO: 2814133 - RNA, 21 nt, Human
aauggacuuauuucuucaaau

SEQ ID NO: 2814134 - RNA, 20 nt, Human
aauggagauucaguuuucau

SEQ ID NO: 2814135 - RNA, 13 nt, Human
uacaccacacaca

SEQ ID NO: 2814136 - RNA, 14 nt, Human
uacaccacacacaa

SEQ ID NO: 2814137 - RNA, 16 nt, Human
uacaccacacacaaca

SEQ ID NO: 2814138 - RNA, 17 nt, Human
uacaccacacacaacag

SEQ ID NO: 2814139 - RNA, 18 nt, Human
uacaccacacacaacagc

SEQ ID NO: 2814140 - RNA, 19 nt, Human
uacaccacacacaacagcc

SEQ ID NO: 2814141 - RNA, 21 nt, Human
uacaccacacacaacagccaa

SEQ ID NO: 2814142 - RNA, 22 nt, Human
uacaccacacacaacagccaac

SEQ ID NO: 2814143 - RNA, 23 nt, Human
uacaccacacacaacagccaaca

SEQ ID NO: 2814144 - RNA, 17 nt, Human
aauggacuuuggaagca

SEQ ID NO: 2814145 - RNA, 16 nt, Human
uacacauuuuuaaauu

SEQ ID NO: 2814146 - RNA, 17 nt, Human
uacacauuuuuaaauug

SEQ ID NO: 2814147 - RNA, 19 nt, Human
uacacauuuuuaaauuguu

SEQ ID NO: 2814148 - RNA, 20 nt, Human
uacacauuuuuaaauuguua

SEQ ID NO: 2814149 - RNA, 23 nt, Human
uacacauuuuuaaauuguuagcu

SEQ ID NO: 2814150 - RNA, 16 nt, Human
uacaccauauacuguu

SEQ ID NO: 2814151 - RNA, 17 nt, Human
aaugugaugauguaauu

SEQ ID NO: 2814152 - RNA, 18 nt, Human
aaugugaugauguaauug

SEQ ID NO: 2814153 - RNA, 20 nt, Human
aaugugaugauguaauugac

SEQ ID NO: 2814154 - RNA, 14 nt, Human
aaugugaucuaugu

SEQ ID NO: 2814155 - RNA, 19 nt, Human
aaugugaucuauguuucau

SEQ ID NO: 2814156 - RNA, 22 nt, Human
aaugugaucuauguuucaucuu

SEQ ID NO: 2814157 - RNA, 21 nt, Human
aauguggcuugagaaauaugg

SEQ ID NO: 2814158 - RNA, 16 nt, Human
aauguggcuugagaaa

SEQ ID NO: 2814159 - RNA, 12 nt, Human
aauguggcuuga

SEQ ID NO: 2814160 - RNA, 14 nt, Human
aauguggcuccugg

SEQ ID NO: 2814161 - RNA, 13 nt, Human
aaugugauguucu

SEQ ID NO: 2814162 - RNA, 21 nt, Human
aaugugaguuuggucuggacu

SEQ ID NO: 2814163 - RNA, 23 nt, Human
aaugugaguuuggucuggacuga

SEQ ID NO: 2814164 - RNA, 21 nt, Human
aauguauuuauuuaaaagauu

SEQ ID NO: 2814165 - RNA, 13 nt, Human
aauguauuuguuc

SEQ ID NO: 2814166 - RNA, 14 nt, Human
aauguauuuguuca

SEQ ID NO: 2814167 - RNA, 15 nt, Human
aauguauuuguucau

SEQ ID NO: 2814168 - RNA, 17 nt, Human
aauguauuuguucaugu

SEQ ID NO: 2814169 - RNA, 18 nt, Human
aauguauuuguucauguu

SEQ ID NO: 2814170 - RNA, 19 nt, Human
aauguauuuguucauguuu

SEQ ID NO: 2814171 - RNA, 20 nt, Human
aauguauuuguucauguuug

SEQ ID NO: 2814172 - RNA, 21 nt, Human
aauguauuuguucauguuugg

SEQ ID NO: 2814173 - RNA, 15 nt, Human
aauguacugagauuu

SEQ ID NO: 2814174 - RNA, 19 nt, Human
aauguauguaauguguggu

SEQ ID NO: 2814175 - RNA, 19 nt, Human
aauguauugaacuuggaaa

SEQ ID NO: 2814176 - RNA, 18 nt, Human
aauguauugaacuuggaa

SEQ ID NO: 2814177 - RNA, 13 nt, Human
uacagagcugugg

SEQ ID NO: 2814178 - RNA, 21 nt, Human
uacauagugcauuguuucugu

SEQ ID NO: 2814179 - RNA, 22 nt, Human
uacauagugcauuguuucugug

SEQ ID NO: 2814180 - RNA, 21 nt, Human
uacauagauuuauuuuucagu

SEQ ID NO: 2814181 - RNA, 22 nt, Human
uacauagauuuauuuuucaguu

SEQ ID NO: 2814182 - RNA, 17 nt, Human
uacauauuugagacuag

SEQ ID NO: 2814183 - RNA, 15 nt, Human
uacauauucuuuaaa

SEQ ID NO: 2814184 - RNA, 15 nt, Human
aauguaccuucuuuc

SEQ ID NO: 2814185 - RNA, 21 nt, Human
aauguaccuucuuucacucug

SEQ ID NO: 2814186 - RNA, 12 nt, Human
aauguacugaga

SEQ ID NO: 2814187 - RNA, 16 nt, Human
uacauauuuguggaau

SEQ ID NO: 2814188 - RNA, 17 nt, Human
uacauauuuguggaaua

SEQ ID NO: 2814189 - RNA, 17 nt, Human
uacauauuuauuuucuu

SEQ ID NO: 2814190 - RNA, 12 nt, Human
uacauaguguaa

SEQ ID NO: 2814191 - RNA, 17 nt, Human
uacauauguagacuaua

SEQ ID NO: 2814192 - RNA, 19 nt, Human
uacauauguagacuauaua

SEQ ID NO: 2814193 - RNA, 20 nt, Human
uacauauguagacuauauac

SEQ ID NO: 2814194 - RNA, 21 nt, Human
uacauauguagacuauauaca

SEQ ID NO: 2814195 - RNA, 22 nt, Human
uacauauguagacuauauacau

SEQ ID NO: 2814196 - RNA, 23 nt, Human
uacauauguagacuauauacaug

SEQ ID NO: 2814197 - RNA, 14 nt, Human
uacauauucuuuaa

SEQ ID NO: 2814198 - RNA, 15 nt, Human
uacauaguuuuaaac

SEQ ID NO: 2814199 - RNA, 19 nt, Human
uacauaguuuuaaacucau

SEQ ID NO: 2814200 - RNA, 21 nt, Human
uacauaguuuuaaacucauuu

SEQ ID NO: 2814201 - RNA, 20 nt, Human
aauacaaaaauuagccgggc

SEQ ID NO: 2814202 - RNA, 14 nt, Human
aauacaaaaauuug

SEQ ID NO: 2814203 - RNA, 17 nt, Human
aauaauuuuuauauuua

SEQ ID NO: 2814204 - RNA, 19 nt, Human
aauaauuuuuauauuuaau

SEQ ID NO: 2814205 - RNA, 22 nt, Human
aauaauuuuuauauuuaauuau

SEQ ID NO: 2814206 - RNA, 21 nt, Human
aauacaaaaaauuagccgggc

SEQ ID NO: 2814207 - RNA, 18 nt, Human
aauacaaaaaucagccag

SEQ ID NO: 2814208 - RNA, 21 nt, Human
aauacaaaaaucagccagaca

SEQ ID NO: 2814209 - RNA, 23 nt, Human
aauacaaaaaucagccagacaug

SEQ ID NO: 2814210 - RNA, 21 nt, Human
uaaauaaacuuuuuuucaaug

SEQ ID NO: 2814211 - RNA, 22 nt, Human
uaaauaaacuuuuuuucaaugu

SEQ ID NO: 2814212 - RNA, 23 nt, Human
uaaauaaacuuuuuuucaaugug

SEQ ID NO: 2814213 - RNA, 14 nt, Human
aauacaacaaagga

SEQ ID NO: 2814214 - RNA, 16 nt, Human
aauacaaaaggcucca

SEQ ID NO: 2814215 - RNA, 22 nt, Human
aauacaacauguagcugaguuu

SEQ ID NO: 2814216 - RNA, 18 nt, Human
uaaauaagauucuaacgg

SEQ ID NO: 2814217 - RNA, 16 nt, Human
uaaauaaucuuacucu

SEQ ID NO: 2814218 - RNA, 17 nt, Human
uaaauaaugcuucagau

SEQ ID NO: 2814219 - RNA, 18 nt, Human
uaaauaaugcuucagaua

SEQ ID NO: 2814220 - RNA, 16 nt, Human
uaaauaaaucauuaau

SEQ ID NO: 2814221 - RNA, 13 nt, Human
uaaauaagauucu

SEQ ID NO: 2814222 - RNA, 14 nt, Human
uaaauaagauucua

SEQ ID NO: 2814223 - RNA, 15 nt, Human
uaaauaagauucuaa

SEQ ID NO: 2814224 - RNA, 21 nt, Human
uaaauacauacggucagguuu

SEQ ID NO: 2814225 - RNA, 22 nt, Human
uaaauaccucaaccuaugguau

SEQ ID NO: 2814226 - RNA, 17 nt, Human
uaaauaccagacacgua

SEQ ID NO: 2814227 - RNA, 18 nt, Human
uaaauaccagacugcagg

SEQ ID NO: 2814228 - RNA, 12 nt, Human
uaaauaccagga

SEQ ID NO: 2814229 - RNA, 14 nt, Human
uaaauaccaggauu

SEQ ID NO: 2814230 - RNA, 12 nt, Human
uaaauaccauug

SEQ ID NO: 2814231 - RNA, 17 nt, Human
uaaauaccauugacaca

SEQ ID NO: 2814232 - RNA, 21 nt, Human
aauaauuuuaagaaaucaaag

SEQ ID NO: 2814233 - RNA, 16 nt, Human
aauaauuucuaauguu

SEQ ID NO: 2814234 - RNA, 15 nt, Human
aauaauuucucuaca

SEQ ID NO: 2814235 - RNA, 12 nt, Human
aauaauuuuaaa

SEQ ID NO: 2814236 - RNA, 13 nt, Human
aauaauuuuaaaa

SEQ ID NO: 2814237 - RNA, 14 nt, Human
aauaauuuuaaaaa

SEQ ID NO: 2814238 - RNA, 17 nt, Human
aauaauuuuaaaaaugg

SEQ ID NO: 2814239 - RNA, 16 nt, Human
aauaauuuuaaacaaa

SEQ ID NO: 2814240 - RNA, 13 nt, Human
aauaauuucuaau

SEQ ID NO: 2814241 - RNA, 15 nt, Human
aauaauuucuaaugu

SEQ ID NO: 2814242 - RNA, 13 nt, Human
aauaauuuaacua

SEQ ID NO: 2814243 - RNA, 18 nt, Human
aauaauuuaacuacccuu

SEQ ID NO: 2814244 - RNA, 23 nt, Human
aauaauuuaacuacccuuaauua

SEQ ID NO: 2814245 - RNA, 16 nt, Human
aauaacugugaaguuu

SEQ ID NO: 2814246 - RNA, 14 nt, Human
aauaacugugaagu

SEQ ID NO: 2814247 - RNA, 20 nt, Human
aauaacugugaaguuuacau

SEQ ID NO: 2814248 - RNA, 13 nt, Human
aauaacuucaguc

SEQ ID NO: 2814249 - RNA, 14 nt, Human
aauaacuucagucc

SEQ ID NO: 2814250 - RNA, 15 nt, Human
aauaacuucaguccu

SEQ ID NO: 2814251 - RNA, 21 nt, Human
aauaacuucaguccugcucca

SEQ ID NO: 2814252 - RNA, 24 nt, Human
aauaacuucaguccugcuccagaa

SEQ ID NO: 2814253 - RNA, 15 nt, Human
aauaacuucugaccu

SEQ ID NO: 2814254 - RNA, 13 nt, Human
aauaagaauagaa

SEQ ID NO: 2814255 - RNA, 15 nt, Human
aauaagaaaguuuca

SEQ ID NO: 2814256 - RNA, 15 nt, Human
aauaagaagcaaaua

SEQ ID NO: 2814257 - RNA, 12 nt, Human
aauaagaaggua

SEQ ID NO: 2814258 - RNA, 14 nt, Human
aauaagaaugauuu

SEQ ID NO: 2814259 - RNA, 15 nt, Human
aauaagaauggaaaa

SEQ ID NO: 2814260 - RNA, 18 nt, Human
aauaagaauagaaauaaa

SEQ ID NO: 2814261 - RNA, 18 nt, Human
aauaauuauuuauuuaau

SEQ ID NO: 2814262 - RNA, 15 nt, Human
aauaauucauauucu

SEQ ID NO: 2814263 - RNA, 17 nt, Human
aauaauucauauucuuc

SEQ ID NO: 2814264 - RNA, 19 nt, Human
aauaauucauauucuucau

SEQ ID NO: 2814265 - RNA, 14 nt, Human
aauaauucuaaauc

SEQ ID NO: 2814266 - RNA, 20 nt, Human
aauaauuaugaguuugcuua

SEQ ID NO: 2814267 - RNA, 15 nt, Human
aauaagagaaagaaa

SEQ ID NO: 2814268 - RNA, 17 nt, Human
aauaagacauaacguuu

SEQ ID NO: 2814269 - RNA, 14 nt, Human
aauaagagaaagaa

SEQ ID NO: 2814270 - RNA, 18 nt, Human
uaaauagaguauaugcac

SEQ ID NO: 2814271 - RNA, 18 nt, Human
uaaauagaguuugcuauu

SEQ ID NO: 2814272 - RNA, 11 nt, Human
uaaauagagca

SEQ ID NO: 2814273 - RNA, 12 nt, Human
uaaauagagcaa

SEQ ID NO: 2814274 - RNA, 19 nt, Human
uaaauagagcaauuacaag

SEQ ID NO: 2814275 - RNA, 16 nt, Human
uaaauacuguguggaa

SEQ ID NO: 2814276 - RNA, 17 nt, Human
uaaauacuguguggaac

SEQ ID NO: 2814277 - RNA, 21 nt, Human
uaaauacuguguggaacuuuu

SEQ ID NO: 2814278 - RNA, 16 nt, Human
uaaaucuauuuauuaa

SEQ ID NO: 2814279 - RNA, 20 nt, Human
uaaaucugcuggaguuucau

SEQ ID NO: 2814280 - RNA, 18 nt, Human
uaaaucuauuuauuaaua

SEQ ID NO: 2814281 - RNA, 19 nt, Human
uaaaucuauuuauuaauau

SEQ ID NO: 2814282 - RNA, 20 nt, Human
uaaaucuauuuauuaauauu

SEQ ID NO: 2814283 - RNA, 14 nt, Human
uaaaucucuaauau

SEQ ID NO: 2814284 - RNA, 15 nt, Human
uaaaucucuaauaug

SEQ ID NO: 2814285 - RNA, 18 nt, Human
uaaaucucuaauauggca

SEQ ID NO: 2814286 - RNA, 19 nt, Human
uaaaucuuaaaaaguuguu

SEQ ID NO: 2814287 - RNA, 21 nt, Human
uaaaucuguucugggcucuuu

SEQ ID NO: 2814288 - RNA, 14 nt, Human
uaaaucuuuuacaa

SEQ ID NO: 2814289 - RNA, 16 nt, Human
uaaaugcauaaaugca

SEQ ID NO: 2814290 - RNA, 14 nt, Human
uaaaugcauuauag

SEQ ID NO: 2814291 - RNA, 11 nt, Human
uaaaugccaca

SEQ ID NO: 2814292 - RNA, 12 nt, Human
uaaaugccacac

SEQ ID NO: 2814293 - RNA, 15 nt, Human
uaaaugccacacacc

SEQ ID NO: 2814294 - RNA, 12 nt, Human
uaaaugcagccc

SEQ ID NO: 2814295 - RNA, 13 nt, Human
uaaaugcagccca

SEQ ID NO: 2814296 - RNA, 14 nt, Human
uaaaugcagcccau

SEQ ID NO: 2814297 - RNA, 19 nt, Human
uaaaugcagcccauuucuc

SEQ ID NO: 2814298 - RNA, 21 nt, Human
uaaaugcagcccauuucucca

SEQ ID NO: 2814299 - RNA, 23 nt, Human
uaaaugcagcccauuucuccaga

SEQ ID NO: 2814300 - RNA, 23 nt, Human
uaaauguuaugacuauguaaacu

SEQ ID NO: 2814301 - RNA, 22 nt, Human
uaaauguuaugacuauguaaac

SEQ ID NO: 2814302 - RNA, 17 nt, Human
uaaauuuugaguucuac

SEQ ID NO: 2814303 - RNA, 15 nt, Human
uaaauguuauuucug

SEQ ID NO: 2814304 - RNA, 16 nt, Human
uaaauguuauuucugc

SEQ ID NO: 2814305 - RNA, 21 nt, Human
uaaauguuauuucugcaaaca

SEQ ID NO: 2814306 - RNA, 13 nt, Human
uaaauguucuaug

SEQ ID NO: 2814307 - RNA, 22 nt, Human
uaaauguucuaugguuaugaaa

SEQ ID NO: 2814308 - RNA, 18 nt, Human
uaaauuaaagccuuuagu

SEQ ID NO: 2814309 - RNA, 19 nt, Human
uaaauuaaagccuuuagua

SEQ ID NO: 2814310 - RNA, 20 nt, Human
uaaauuaaagccuuuaguau

SEQ ID NO: 2814311 - RNA, 16 nt, Human
aauaaauugcuccuug

SEQ ID NO: 2814312 - RNA, 20 nt, Human
aauaaauugcuccuugacau

SEQ ID NO: 2814313 - RNA, 12 nt, Human
aauaacacacau

SEQ ID NO: 2814314 - RNA, 15 nt, Human
aauaacacacagcua

SEQ ID NO: 2814315 - RNA, 13 nt, Human
aauaacauuaccu

SEQ ID NO: 2814316 - RNA, 14 nt, Human
aauaacauuaccuu

SEQ ID NO: 2814317 - RNA, 15 nt, Human
aauaacauuaccuua

SEQ ID NO: 2814318 - RNA, 20 nt, Human
aauaacauuaccuuacugug

SEQ ID NO: 2814319 - RNA, 22 nt, Human
aauaaauuguuuggcuuccucc

SEQ ID NO: 2814320 - RNA, 15 nt, Human
aauaaauuuauauga

SEQ ID NO: 2814321 - RNA, 18 nt, Human
aauaaauuuauaugaaaa

SEQ ID NO: 2814322 - RNA, 13 nt, Human
aauaacaaugugc

SEQ ID NO: 2814323 - RNA, 13 nt, Human
aauaacaauguua

SEQ ID NO: 2814324 - RNA, 19 nt, Human
aauaacaaugugcucucgg

SEQ ID NO: 2814325 - RNA, 14 nt, Human
aauaacaauguuaa

SEQ ID NO: 2814326 - RNA, 15 nt, Human
aauaacaauguuaag

SEQ ID NO: 2814327 - RNA, 20 nt, Human
aauaacaauguuaaggaaac

SEQ ID NO: 2814328 - RNA, 24 nt, Human
aauaacaauguuaaggaaacucuu

SEQ ID NO: 2814329 - RNA, 13 nt, Human
aauaacugugaag

SEQ ID NO: 2814330 - RNA, 19 nt, Human
aauaacucuguggcauuau

SEQ ID NO: 2814331 - RNA, 19 nt, Human
aauaaccuuccauacauuu

SEQ ID NO: 2814332 - RNA, 21 nt, Human
aauaaaucauuaauacucuuc

SEQ ID NO: 2814333 - RNA, 15 nt, Human
aauaaauggaaauca

SEQ ID NO: 2814334 - RNA, 11 nt, Human
aauaaaucuuu

SEQ ID NO: 2814335 - RNA, 15 nt, Human
aauaaaucuuuggaa

SEQ ID NO: 2814336 - RNA, 16 nt, Human
aauaaaucuuuggaaa

SEQ ID NO: 2814337 - RNA, 22 nt, Human
aauaaaaccuuucaaauuucac

SEQ ID NO: 2814338 - RNA, 21 nt, Human
aauaaaaccuuucaaauuuca

SEQ ID NO: 2814339 - RNA, 16 nt, Human
aauaaaaccuuucaaa

SEQ ID NO: 2814340 - RNA, 15 nt, Human
aauaaaaccuuucaa

SEQ ID NO: 2814341 - RNA, 23 nt, Human
aauaaaaccuuucaaauuucaca

SEQ ID NO: 2814342 - RNA, 13 nt, Human
aauaaaaagugac

SEQ ID NO: 2814343 - RNA, 19 nt, Human
aauaaaaagugacacagca

SEQ ID NO: 2814344 - RNA, 20 nt, Human
aauaaaaagugacacagcag

SEQ ID NO: 2814345 - RNA, 13 nt, Human
aauaaaacaaagg

SEQ ID NO: 2814346 - RNA, 14 nt, Human
aauaaaacaaaggg

SEQ ID NO: 2814347 - RNA, 21 nt, Human
aauaaaacagcugucucuaac

SEQ ID NO: 2814348 - RNA, 14 nt, Human
aauaaaacauuaug

SEQ ID NO: 2814349 - RNA, 14 nt, Human
aauaaaaccuuuca

SEQ ID NO: 2814350 - RNA, 13 nt, Human
aauaaaaccuuuc

SEQ ID NO: 2814351 - RNA, 12 nt, Human
aauaaaaccuuu

SEQ ID NO: 2814352 - RNA, 13 nt, Human
aauaaaaccagcu

SEQ ID NO: 2814353 - RNA, 14 nt, Human
aaguuuuuguauua

SEQ ID NO: 2814354 - RNA, 12 nt, Human
uaaaguauuuuu

SEQ ID NO: 2814355 - RNA, 21 nt, Human
uaaaguauuuuuauaaauaua

SEQ ID NO: 2814356 - RNA, 23 nt, Human
uaaaguauuuuuauaaauauaag

SEQ ID NO: 2814357 - RNA, 21 nt, Human
uaaaguauguaaaguauguaa

SEQ ID NO: 2814358 - RNA, 22 nt, Human
uaaaguauguaaaguauguaaa

SEQ ID NO: 2814359 - RNA, 13 nt, Human
uaaaguauguaaa

SEQ ID NO: 2814360 - RNA, 15 nt, Human
uaaaguauguaaaca

SEQ ID NO: 2814361 - RNA, 16 nt, Human
uaaaguauguaaacag

SEQ ID NO: 2814362 - RNA, 22 nt, Human
uaaaguauguaaacaggagaca

SEQ ID NO: 2814363 - RNA, 15 nt, Human
uaaaguacuugagug

SEQ ID NO: 2814364 - RNA, 21 nt, Human
uaaaguacuugaguguaaugu

SEQ ID NO: 2814365 - RNA, 13 nt, Human
uaaaguagaagag

SEQ ID NO: 2814366 - RNA, 18 nt, Human
uaaaguagaagaggguuu

SEQ ID NO: 2814367 - RNA, 18 nt, Human
uaaaguauagagagaagu

SEQ ID NO: 2814368 - RNA, 19 nt, Human
uaaaguauagagagaaguu

SEQ ID NO: 2814369 - RNA, 20 nt, Human
uaaaguauagagagaaguuc

SEQ ID NO: 2814370 - RNA, 19 nt, Human
uaaaguauauauagaaucu

SEQ ID NO: 2814371 - RNA, 14 nt, Human
uaaagguguauuua

SEQ ID NO: 2814372 - RNA, 13 nt, Human
uaaagguggauuu

SEQ ID NO: 2814373 - RNA, 19 nt, Human
uaaagguggccacaaauuc

SEQ ID NO: 2814374 - RNA, 14 nt, Human
uaaagggccugccu

SEQ ID NO: 2814375 - RNA, 15 nt, Human
uaaagggccugccug

SEQ ID NO: 2814376 - RNA, 16 nt, Human
uaaagggccugccugg

SEQ ID NO: 2814377 - RNA, 18 nt, Human
uaaaggggucugaaauuu

SEQ ID NO: 2814378 - RNA, 19 nt, Human
guuuugaagcuacugugug

SEQ ID NO: 2814379 - RNA, 19 nt, Human
uaaagguccacaggucuag

SEQ ID NO: 2814380 - RNA, 20 nt, Human
uaaagguccacaggucuaga

SEQ ID NO: 2814381 - RNA, 22 nt, Human
guuuucuuaaggugaggccugu

SEQ ID NO: 2814382 - RNA, 21 nt, Human
uaaagguccacaggucuagac

SEQ ID NO: 2814383 - RNA, 22 nt, Human
uaaagguccacaggucuagacu

SEQ ID NO: 2814384 - RNA, 13 nt, Human
guuuugaaaagcu

SEQ ID NO: 2814385 - RNA, 14 nt, Human
guuuugaaaagcua

SEQ ID NO: 2814386 - RNA, 15 nt, Human
guuuugaaaagcuau

SEQ ID NO: 2814387 - RNA, 21 nt, Human
guuuugaaaagcuauuagcca

SEQ ID NO: 2814388 - RNA, 18 nt, Human
guuuugaagcuacugugu

SEQ ID NO: 2814389 - RNA, 14 nt, Human
guuuucuuugaaug

SEQ ID NO: 2814390 - RNA, 20 nt, Human
guuuucuuugcaaaguauug

SEQ ID NO: 2814391 - RNA, 15 nt, Human
guuuucuuguugcuu

SEQ ID NO: 2814392 - RNA, 18 nt, Human
guuuucuuguugcuuugu

SEQ ID NO: 2814393 - RNA, 19 nt, Human
guuuucuuguugcuuuguu

SEQ ID NO: 2814394 - RNA, 20 nt, Human
guuuucuuguugcuuuguug

SEQ ID NO: 2814395 - RNA, 22 nt, Human
guuuucuuguugcuuuguugca

SEQ ID NO: 2814396 - RNA, 22 nt, Human
guuuugaaaaccuaaaagacag

SEQ ID NO: 2814397 - RNA, 19 nt, Human
guuuucuuccuuguaaauu

SEQ ID NO: 2814398 - RNA, 12 nt, Human
guuuucuuccuu

SEQ ID NO: 2814399 - RNA, 15 nt, Human
guuuucuuucuuuaa

SEQ ID NO: 2814400 - RNA, 16 nt, Human
guuuucuuucuuuaaa

SEQ ID NO: 2814401 - RNA, 17 nt, Human
guuuucuuucuuuaaau

SEQ ID NO: 2814402 - RNA, 20 nt, Human
guuuucuuucuuuaaauguu

SEQ ID NO: 2814403 - RNA, 14 nt, Human
aauaucuuguguug

SEQ ID NO: 2814404 - RNA, 18 nt, Human
aauaugaacccuuuguuu

SEQ ID NO: 2814405 - RNA, 20 nt, Human
aauaugaacccuuuguuucu

SEQ ID NO: 2814406 - RNA, 21 nt, Human
aauaugaacccuuuguuucuu

SEQ ID NO: 2814407 - RNA, 16 nt, Human
aauaugaguacaaaug

SEQ ID NO: 2814408 - RNA, 17 nt, Human
aauaugaguacaaaugc

SEQ ID NO: 2814409 - RNA, 19 nt, Human
aauaugaguacaaaugccu

SEQ ID NO: 2814410 - RNA, 21 nt, Human
aauaugaguacaaaugccuua

SEQ ID NO: 2814411 - RNA, 20 nt, Human
aauaugaaucugcucacuuu

SEQ ID NO: 2814412 - RNA, 12 nt, Human
aauaugaaguua

SEQ ID NO: 2814413 - RNA, 19 nt, Human
aauaugaaguuacuuucuu

SEQ ID NO: 2814414 - RNA, 23 nt, Human
aauaugaaguuacuuucuuaaug

SEQ ID NO: 2814415 - RNA, 15 nt, Human
aauaucuauuaauau

SEQ ID NO: 2814416 - RNA, 16 nt, Human
aauaucuauuaauaua

SEQ ID NO: 2814417 - RNA, 13 nt, Human
aauaucugaaaug

SEQ ID NO: 2814418 - RNA, 15 nt, Human
aauaucugaacauuu

SEQ ID NO: 2814419 - RNA, 19 nt, Human
aauaucugaacauuuacua

SEQ ID NO: 2814420 - RNA, 21 nt, Human
aauaucugaacauuuacuaca

SEQ ID NO: 2814421 - RNA, 12 nt, Human
aauaucugaagc

SEQ ID NO: 2814422 - RNA, 18 nt, Human
aauaucuucagcucuuuu

SEQ ID NO: 2814423 - RNA, 19 nt, Human
aauaucuuugugauaauuu

SEQ ID NO: 2814424 - RNA, 20 nt, Human
aauaucuuugugauaauuua

SEQ ID NO: 2814425 - RNA, 21 nt, Human
aauaucuuugugauaauuuaa

SEQ ID NO: 2814426 - RNA, 22 nt, Human
aauaucuuugugauaauuuaag

SEQ ID NO: 2814427 - RNA, 14 nt, Human
aauaucuuuuaugu

SEQ ID NO: 2814428 - RNA, 15 nt, Human
aauaucuuuuauguu

SEQ ID NO: 2814429 - RNA, 18 nt, Human
aauaucuuuuauguuuga

SEQ ID NO: 2814430 - RNA, 19 nt, Human
aauaucuuuuauguuugaa

SEQ ID NO: 2814431 - RNA, 20 nt, Human
aauaucuuuuauguuugaau

SEQ ID NO: 2814432 - RNA, 21 nt, Human
aauaucuuuuauguuugaaua

SEQ ID NO: 2814433 - RNA, 23 nt, Human
aauaucuuuuauguuugaauaug

SEQ ID NO: 2814434 - RNA, 14 nt, Human
aauaucuauuaaua

SEQ ID NO: 2814435 - RNA, 14 nt, Human
aauaucuaauauau

SEQ ID NO: 2814436 - RNA, 12 nt, Human
aauaucuaaagu

SEQ ID NO: 2814437 - RNA, 14 nt, Human
aauaucuaaaguua

SEQ ID NO: 2814438 - RNA, 15 nt, Human
aauaucuaaaguuau

SEQ ID NO: 2814439 - RNA, 16 nt, Human
aauaucuaaaguuaua

SEQ ID NO: 2814440 - RNA, 20 nt, Human
aauaucuaaaguuauauuuc

SEQ ID NO: 2814441 - RNA, 20 nt, Human
aauaucuaauauauaugaau

SEQ ID NO: 2814442 - RNA, 21 nt, Human
aauaucuaauauauaugaaua

SEQ ID NO: 2814443 - RNA, 22 nt, Human
aauaucuaauauauaugaauaa

SEQ ID NO: 2814444 - RNA, 17 nt, Human
uaagaaucagaguagaa

SEQ ID NO: 2814445 - RNA, 18 nt, Human
uaagaaucagaguagaaa

SEQ ID NO: 2814446 - RNA, 19 nt, Human
uaagaaucagaguagaaau

SEQ ID NO: 2814447 - RNA, 20 nt, Human
uaagaaucagaguagaaaua

SEQ ID NO: 2814448 - RNA, 21 nt, Human
uaagaaucagaguagaaauaa

SEQ ID NO: 2814449 - RNA, 12 nt, Human
uaaccugugucu

SEQ ID NO: 2814450 - RNA, 21 nt, Human
uaagacaugcacuaugaggaa

SEQ ID NO: 2814451 - RNA, 19 nt, Human
uaagacauguaacgaaaca

SEQ ID NO: 2814452 - RNA, 22 nt, Human
uaagacauugggucuauuccag

SEQ ID NO: 2814453 - RNA, 17 nt, Human
uaagaccaccaccucag

SEQ ID NO: 2814454 - RNA, 18 nt, Human
uaagaccaccaccucaga

SEQ ID NO: 2814455 - RNA, 14 nt, Human
uaagaccuacuguu

SEQ ID NO: 2814456 - RNA, 16 nt, Human
uaagaccuacuguucu

SEQ ID NO: 2814457 - RNA, 17 nt, Human
uaagaccuacuguucua

SEQ ID NO: 2814458 - RNA, 18 nt, Human
uaagaccuacuguucuaa

SEQ ID NO: 2814459 - RNA, 19 nt, Human
uaagaccuacuguucuaaa

SEQ ID NO: 2814460 - RNA, 20 nt, Human
uaagaccuacuguucuaaag

SEQ ID NO: 2814461 - RNA, 21 nt, Human
uaagaccuacuguucuaaagc

SEQ ID NO: 2814462 - RNA, 22 nt, Human
uaagaccuacuguucuaaagcu

SEQ ID NO: 2814463 - RNA, 17 nt, Human
uaagaaugguugccuua

SEQ ID NO: 2814464 - RNA, 18 nt, Human
uaagaauguugguuuacu

SEQ ID NO: 2814465 - RNA, 19 nt, Human
uaagaauguugguuuacuu

SEQ ID NO: 2814466 - RNA, 21 nt, Human
uaagaauguugguuuacuuuc

SEQ ID NO: 2814467 - RNA, 19 nt, Human
uaagacaugauuuccuuga

SEQ ID NO: 2814468 - RNA, 14 nt, Human
uaagaauggaaaag

SEQ ID NO: 2814469 - RNA, 17 nt, Human
uaagaauggaaaagaga

SEQ ID NO: 2814470 - RNA, 17 nt, Human
uaagacauuuuuggaag

SEQ ID NO: 2814471 - RNA, 21 nt, Human
uaagacaugauuuccuugaau

SEQ ID NO: 2814472 - RNA, 20 nt, Human
uaagacaugauuuccuugaa

SEQ ID NO: 2814473 - RNA, 16 nt, Human
uaacuaaauuugauac

SEQ ID NO: 2814474 - RNA, 17 nt, Human
uaacuaaauuugauacu

SEQ ID NO: 2814475 - RNA, 18 nt, Human
uaacuaaauuugauacuu

SEQ ID NO: 2814476 - RNA, 20 nt, Human
uaacuaaauuugauacuuau

SEQ ID NO: 2814477 - RNA, 21 nt, Human
uaacuaaauuugauacuuaua

SEQ ID NO: 2814478 - RNA, 22 nt, Human
uaacuaaauuugauacuuauau

SEQ ID NO: 2814479 - RNA, 15 nt, Human
uaacuacaaaugauc

SEQ ID NO: 2814480 - RNA, 12 nt, Human
uaacuacauuua

SEQ ID NO: 2814481 - RNA, 13 nt, Human
uaacuacauuuau

SEQ ID NO: 2814482 - RNA, 14 nt, Human
uaacuacauuuaug

SEQ ID NO: 2814483 - RNA, 18 nt, Human
uaacuacccuuaauuacu

SEQ ID NO: 2814484 - RNA, 20 nt, Human
uaacuacccuuaauuacuua

SEQ ID NO: 2814485 - RNA, 22 nt, Human
uaacuacccuuaauuacuuaaa

SEQ ID NO: 2814486 - RNA, 15 nt, Human
uaacuacuaguuuuu

SEQ ID NO: 2814487 - RNA, 22 nt, Human
uaacuacuauauugauuguccu

SEQ ID NO: 2814488 - RNA, 14 nt, Human
aauauuguuuuucu

SEQ ID NO: 2814489 - RNA, 18 nt, Human
aauauuguuuuucuuucu

SEQ ID NO: 2814490 - RNA, 14 nt, Human
aauauuuaaaaaug

SEQ ID NO: 2814491 - RNA, 15 nt, Human
aauauuuaaaaaugu

SEQ ID NO: 2814492 - RNA, 17 nt, Human
aauauuuaaaaaugucu

SEQ ID NO: 2814493 - RNA, 20 nt, Human
aauauuguugacaacuguga

SEQ ID NO: 2814494 - RNA, 12 nt, Human
aauauuuaaaca

SEQ ID NO: 2814495 - RNA, 14 nt, Human
aauauuuaaacagc

SEQ ID NO: 2814496 - RNA, 16 nt, Human
aauauuuaaacagcag

SEQ ID NO: 2814497 - RNA, 17 nt, Human
aauauuucugcuuucuu

SEQ ID NO: 2814498 - RNA, 20 nt, Human
aauauugcuuuggucauaug

SEQ ID NO: 2814499 - RNA, 18 nt, Human
aauauuguguugugaaug

SEQ ID NO: 2814500 - RNA, 15 nt, Human
aauauuguuucuuua

SEQ ID NO: 2814501 - RNA, 19 nt, Human
aauauuguuucuuuaucac

SEQ ID NO: 2814502 - RNA, 16 nt, Human
aauauuguugacaacu

SEQ ID NO: 2814503 - RNA, 22 nt, Human
aauauuguugacaacugugacu

SEQ ID NO: 2814504 - RNA, 18 nt, Human
aauauuguuguauaauuu

SEQ ID NO: 2814505 - RNA, 19 nt, Human
aauauuguuguauaauuuc

SEQ ID NO: 2814506 - RNA, 23 nt, Human
aauauuguuguauaauuucgaga

SEQ ID NO: 2814507 - RNA, 16 nt, Human
aauauuuucagccuac

SEQ ID NO: 2814508 - RNA, 13 nt, Human
aauauuuucagua

SEQ ID NO: 2814509 - RNA, 14 nt, Human
aauauuuucaguaa

SEQ ID NO: 2814510 - RNA, 14 nt, Human
aaucacuugaaccc

SEQ ID NO: 2814511 - RNA, 16 nt, Human
aaucacuugauucaua

SEQ ID NO: 2814512 - RNA, 18 nt, Human
aaucacuugauucauaaa

SEQ ID NO: 2814513 - RNA, 21 nt, Human
aaucacuugauucauaaagau

SEQ ID NO: 2814514 - RNA, 13 nt, Human
aaucacuuugucu

SEQ ID NO: 2814515 - RNA, 16 nt, Human
aaucacuuugucuaac

SEQ ID NO: 2814516 - RNA, 23 nt, Human
aaucacuuugucuaacucagaau

SEQ ID NO: 2814517 - RNA, 13 nt, Human
aaucagaaauuuu

SEQ ID NO: 2814518 - RNA, 14 nt, Human
aaucagaaauuuuu

SEQ ID NO: 2814519 - RNA, 14 nt, Human
aaucacuguuuuua

SEQ ID NO: 2814520 - RNA, 16 nt, Human
aaucacuguuuuuaga

SEQ ID NO: 2814521 - RNA, 22 nt, Human
aaucacuguuuuuagacaccuu

SEQ ID NO: 2814522 - RNA, 17 nt, Human
aaucacuuaacauuccu

SEQ ID NO: 2814523 - RNA, 18 nt, Human
aaucacuuaacauuccua

SEQ ID NO: 2814524 - RNA, 19 nt, Human
aaucacuuaacauuccuaa

SEQ ID NO: 2814525 - RNA, 20 nt, Human
aauaugauuuuuuaaaagaa

SEQ ID NO: 2814526 - RNA, 21 nt, Human
aauaugauuuuuuaaaagaaa

SEQ ID NO: 2814527 - RNA, 22 nt, Human
aauaugauuuuuuaaaagaaau

SEQ ID NO: 2814528 - RNA, 23 nt, Human
aauaugauuuuuuaaaagaaauu

SEQ ID NO: 2814529 - RNA, 11 nt, Human
aauaugaugac

SEQ ID NO: 2814530 - RNA, 14 nt, Human
aauaucaaucaagc

SEQ ID NO: 2814531 - RNA, 23 nt, Human
aauaucauuuauuuuuuacauua

SEQ ID NO: 2814532 - RNA, 13 nt, Human
aauaucauuuauu

SEQ ID NO: 2814533 - RNA, 17 nt, Human
aauauccaggucaacag

SEQ ID NO: 2814534 - RNA, 20 nt, Human
aauauccaggucaacagaau

SEQ ID NO: 2814535 - RNA, 21 nt, Human
aauauccaggucaacagaaug

SEQ ID NO: 2814536 - RNA, 22 nt, Human
aauauccaggucaacagaauga

SEQ ID NO: 2814537 - RNA, 23 nt, Human
aauauccaggucaacagaaugaa

SEQ ID NO: 2814538 - RNA, 24 nt, Human
aauauccaggucaacagaaugaaa

SEQ ID NO: 2814539 - RNA, 18 nt, Human
aauauauguauuauuuau

SEQ ID NO: 2814540 - RNA, 14 nt, Human
aauauauguauuau

SEQ ID NO: 2814541 - RNA, 15 nt, Human
aauauauuaccagca

SEQ ID NO: 2814542 - RNA, 20 nt, Human
aauauauuaccagcaagaau

SEQ ID NO: 2814543 - RNA, 22 nt, Human
aauauauuaccagcaagaauaa

SEQ ID NO: 2814544 - RNA, 23 nt, Human
aauauauuaccagcaagaauaaa

SEQ ID NO: 2814545 - RNA, 15 nt, Human
aauaguauuugagag

SEQ ID NO: 2814546 - RNA, 23 nt, Human
aauaguaugaguaaugcuuaagg

SEQ ID NO: 2814547 - RNA, 12 nt, Human
aauauauguauu

SEQ ID NO: 2814548 - RNA, 21 nt, Human
aauauauguauuauuuauaau

SEQ ID NO: 2814549 - RNA, 13 nt, Human
aauauauguauuu

SEQ ID NO: 2814550 - RNA, 14 nt, Human
aauauauguauuuu

SEQ ID NO: 2814551 - RNA, 22 nt, Human
aauauauguauuuuuauauaau

SEQ ID NO: 2814552 - RNA, 13 nt, Human
aauauauggcauu

SEQ ID NO: 2814553 - RNA, 14 nt, Human
aauauauggcauuu

SEQ ID NO: 2814554 - RNA, 16 nt, Human
aauauauggcauuugc

SEQ ID NO: 2814555 - RNA, 17 nt, Human
aauauauggcauuugca

SEQ ID NO: 2814556 - RNA, 18 nt, Human
aauauauggcauuugcag

SEQ ID NO: 2814557 - RNA, 22 nt, Human
aauauauggcauuugcagauuu

SEQ ID NO: 2814558 - RNA, 16 nt, Human
uaacauaauuuguaca

SEQ ID NO: 2814559 - RNA, 15 nt, Human
uaacauaauaaauua

SEQ ID NO: 2814560 - RNA, 17 nt, Human
uaacauaauaaauuaaa

SEQ ID NO: 2814561 - RNA, 19 nt, Human
uaacauaauuuguacauau

SEQ ID NO: 2814562 - RNA, 16 nt, Human
uaaccugcaaaaucug

SEQ ID NO: 2814563 - RNA, 22 nt, Human
uaaccugacugguuaacagcag

SEQ ID NO: 2814564 - RNA, 13 nt, Human
aauaggagaggau

SEQ ID NO: 2814565 - RNA, 15 nt, Human
aauaggagaggauga

SEQ ID NO: 2814566 - RNA, 20 nt, Human
aauaggagaggaugagagcc

SEQ ID NO: 2814567 - RNA, 23 nt, Human
aauaggagaggaugagagcccag

SEQ ID NO: 2814568 - RNA, 16 nt, Human
aauaggcauuaacaca

SEQ ID NO: 2814569 - RNA, 22 nt, Human
aauaggcauuaacacaaaggag

SEQ ID NO: 2814570 - RNA, 15 nt, Human
aauaggggauauuua

SEQ ID NO: 2814571 - RNA, 16 nt, Human
aauaggggauauuuaa

SEQ ID NO: 2814572 - RNA, 21 nt, Human
aauagcugcccauuucgugag

SEQ ID NO: 2814573 - RNA, 14 nt, Human
aauagcuuguauag

SEQ ID NO: 2814574 - RNA, 19 nt, Human
aauagcuuguauaguguaa

SEQ ID NO: 2814575 - RNA, 13 nt, Human
aauaggaaacaag

SEQ ID NO: 2814576 - RNA, 11 nt, Human
aauaggaauaa

SEQ ID NO: 2814577 - RNA, 17 nt, Human
aauagcuuuuauuguau

SEQ ID NO: 2814578 - RNA, 14 nt, Human
aauagcugggacua

SEQ ID NO: 2814579 - RNA, 13 nt, Human
aauagcugggacu

SEQ ID NO: 2814580 - RNA, 23 nt, Human
aauagccacugcauaccaaccug

SEQ ID NO: 2814581 - RNA, 15 nt, Human
aauagaucuuagggu

SEQ ID NO: 2814582 - RNA, 16 nt, Human
aauagaugcugacugu

SEQ ID NO: 2814583 - RNA, 12 nt, Human
aauagaugucuu

SEQ ID NO: 2814584 - RNA, 14 nt, Human
aauagaugucuuuu

SEQ ID NO: 2814585 - RNA, 16 nt, Human
aauagaugucuuuuau

SEQ ID NO: 2814586 - RNA, 23 nt, Human
aauagccacauuuggaauacuuu

SEQ ID NO: 2814587 - RNA, 22 nt, Human
aauagccacauuuggaauacuu

SEQ ID NO: 2814588 - RNA, 20 nt, Human
aauagccacauuuggaauac

SEQ ID NO: 2814589 - RNA, 11 nt, Human
aauagauucuc

SEQ ID NO: 2814590 - RNA, 12 nt, Human
aauagauucucu

SEQ ID NO: 2814591 - RNA, 23 nt, Human
aauagacacuccccgaagucuuu

SEQ ID NO: 2814592 - RNA, 22 nt, Human
aauagacacuccccgaagucuu

SEQ ID NO: 2814593 - RNA, 22 nt, Human
aauagaguuugcuauuagagca

SEQ ID NO: 2814594 - RNA, 19 nt, Human
uaaauuuugaguucuacau

SEQ ID NO: 2814595 - RNA, 18 nt, Human
uaaauuuugaguucuaca

SEQ ID NO: 2814596 - RNA, 20 nt, Human
uaaauuuugucuuuaacuca

SEQ ID NO: 2814597 - RNA, 13 nt, Human
uaaauuuuguaau

SEQ ID NO: 2814598 - RNA, 14 nt, Human
uaaauuuuguaaug

SEQ ID NO: 2814599 - RNA, 15 nt, Human
uaaauuuuguaauga

SEQ ID NO: 2814600 - RNA, 22 nt, Human
uagccuugcccggauucuggga

SEQ ID NO: 2814601 - RNA, 16 nt, Human
uagccuuuggcucugg

SEQ ID NO: 2814602 - RNA, 18 nt, Human
uagccuuuggcucuggag

SEQ ID NO: 2814603 - RNA, 21 nt, Human
uagccuuuacauggacagaau

SEQ ID NO: 2814604 - RNA, 22 nt, Human
uagccuuuacauggacagaauu

SEQ ID NO: 2814605 - RNA, 23 nt, Human
uagccuuuacauggacagaauuu

SEQ ID NO: 2814606 - RNA, 18 nt, Human
acaaugaagauaaaaaga

SEQ ID NO: 2814607 - RNA, 14 nt, Human
acaauaugugagug

SEQ ID NO: 2814608 - RNA, 18 nt, Human
acaaucuggaagaaaaaa

SEQ ID NO: 2814609 - RNA, 12 nt, Human
acaaucucuuaa

SEQ ID NO: 2814610 - RNA, 13 nt, Human
acaaucucuuaaa

SEQ ID NO: 2814611 - RNA, 14 nt, Human
acaaucucuuaaau

SEQ ID NO: 2814612 - RNA, 16 nt, Human
acaaugaacacuuaua

SEQ ID NO: 2814613 - RNA, 16 nt, Human
uagcuaucagaagacc

SEQ ID NO: 2814614 - RNA, 13 nt, Human
uagcuauuacugu

SEQ ID NO: 2814615 - RNA, 14 nt, Human
uagcuauuacuguc

SEQ ID NO: 2814616 - RNA, 15 nt, Human
uagcuauuacugucu

SEQ ID NO: 2814617 - RNA, 21 nt, Human
uagcuaucagaagaccacaaa

SEQ ID NO: 2814618 - RNA, 16 nt, Human
uagcuaugugaccuug

SEQ ID NO: 2814619 - RNA, 23 nt, Human
uagcuacaggaagcaccccaugc

SEQ ID NO: 2814620 - RNA, 19 nt, Human
uagcuacccaaaagagaaa

SEQ ID NO: 2814621 - RNA, 20 nt, Human
uagcuacccaaaagagaaaa

SEQ ID NO: 2814622 - RNA, 21 nt, Human
uagcuacccaaaagagaaaaa

SEQ ID NO: 2814623 - RNA, 21 nt, Human
uagcuuacaagccagcuggag

SEQ ID NO: 2814624 - RNA, 16 nt, Human
uagcuuaccagaagcu

SEQ ID NO: 2814625 - RNA, 15 nt, Human
uagcuuaccugacac

SEQ ID NO: 2814626 - RNA, 16 nt, Human
uagcuuaccugacaca

SEQ ID NO: 2814627 - RNA, 19 nt, Human
uagcuuaccugacacaaga

SEQ ID NO: 2814628 - RNA, 16 nt, Human
uagcucaggugucccu

SEQ ID NO: 2814629 - RNA, 23 nt, Human
uagcucaagagaaaaguugacac

SEQ ID NO: 2814630 - RNA, 18 nt, Human
acaagccuggcaacacac

SEQ ID NO: 2814631 - RNA, 20 nt, Human
acaagccugguaggaaaggg

SEQ ID NO: 2814632 - RNA, 22 nt, Human
acaagagccugaucucuuccug

SEQ ID NO: 2814633 - RNA, 13 nt, Human
acaaguuccaugg

SEQ ID NO: 2814634 - RNA, 16 nt, Human
acaauagguaaagcua

SEQ ID NO: 2814635 - RNA, 21 nt, Human
acaauauaaccacaaagcaca

SEQ ID NO: 2814636 - RNA, 10 nt, Human
acaauauaua

SEQ ID NO: 2814637 - RNA, 15 nt, Human
acaauauauaaaaau

SEQ ID NO: 2814638 - RNA, 16 nt, Human
acaauauauaaaaaua

SEQ ID NO: 2814639 - RNA, 17 nt, Human
acaauauauaaaaauau

SEQ ID NO: 2814640 - RNA, 18 nt, Human
acaauauauaaaaauaua

SEQ ID NO: 2814641 - RNA, 23 nt, Human
acaauauauagcuggcaagaaug

SEQ ID NO: 2814642 - RNA, 12 nt, Human
acaauaucauau

SEQ ID NO: 2814643 - RNA, 15 nt, Human
acaauaucauaucau

SEQ ID NO: 2814644 - RNA, 17 nt, Human
acaauaucauaucauca

SEQ ID NO: 2814645 - RNA, 14 nt, Human
acaauauugaacuu

SEQ ID NO: 2814646 - RNA, 20 nt, Human
acaaucucggcucacugcau

SEQ ID NO: 2814647 - RNA, 18 nt, Human
acaaucucggcucacugc

SEQ ID NO: 2814648 - RNA, 18 nt, Human
acaauaguaaccugggua

SEQ ID NO: 2814649 - RNA, 15 nt, Human
acaaguuuuucuguc

SEQ ID NO: 2814650 - RNA, 16 nt, Human
acaaguuuuucuguca

SEQ ID NO: 2814651 - RNA, 22 nt, Human
acaaguuuuucugucaagaaga

SEQ ID NO: 2814652 - RNA, 14 nt, Human
acaaguuuuaaaua

SEQ ID NO: 2814653 - RNA, 15 nt, Human
acaaguuuuaaugua

SEQ ID NO: 2814654 - RNA, 15 nt, Human
acaauaaaacauuau

SEQ ID NO: 2814655 - RNA, 13 nt, Human
acaauaaaagcuu

SEQ ID NO: 2814656 - RNA, 19 nt, Human
uagaugcauguugaccaug

SEQ ID NO: 2814657 - RNA, 14 nt, Human
acaaaugucuauca

SEQ ID NO: 2814658 - RNA, 13 nt, Human
acaaaugugaaga

SEQ ID NO: 2814659 - RNA, 15 nt, Human
acaaauugagacagu

SEQ ID NO: 2814660 - RNA, 14 nt, Human
acaaauugcacaga

SEQ ID NO: 2814661 - RNA, 20 nt, Human
acaaauugcacagaaguccu

SEQ ID NO: 2814662 - RNA, 14 nt, Human
acaaauguaaacau

SEQ ID NO: 2814663 - RNA, 17 nt, Human
acaaauguaaacauuuu

SEQ ID NO: 2814664 - RNA, 18 nt, Human
acaaauguaaacauuuuc

SEQ ID NO: 2814665 - RNA, 16 nt, Human
acaacagccaacagcu

SEQ ID NO: 2814666 - RNA, 17 nt, Human
acaacagccaacagcua

SEQ ID NO: 2814667 - RNA, 24 nt, Human
acaacagccaacagcuacaacagc

SEQ ID NO: 2814668 - RNA, 18 nt, Human
acaacagcucgauccaaa

SEQ ID NO: 2814669 - RNA, 20 nt, Human
acaacagcucgauccaaauu

SEQ ID NO: 2814670 - RNA, 22 nt, Human
acaacagcucgauccaaauugu

SEQ ID NO: 2814671 - RNA, 13 nt, Human
acaagacacagug

SEQ ID NO: 2814672 - RNA, 16 nt, Human
acaacauccauguccu

SEQ ID NO: 2814673 - RNA, 17 nt, Human
acaacauccauguccua

SEQ ID NO: 2814674 - RNA, 19 nt, Human
acaacauccauguccuaug

SEQ ID NO: 2814675 - RNA, 22 nt, Human
acaacauccauguccuaugugu

SEQ ID NO: 2814676 - RNA, 23 nt, Human
acaacauccauguccuaugugug

SEQ ID NO: 2814677 - RNA, 17 nt, Human
acaaaugcaugaacaag

SEQ ID NO: 2814678 - RNA, 18 nt, Human
acaaaugcaugaacaagu

SEQ ID NO: 2814679 - RNA, 19 nt, Human
acaaaugccuuaaaaugga

SEQ ID NO: 2814680 - RNA, 20 nt, Human
acaaaugccuuaaaauggaa

SEQ ID NO: 2814681 - RNA, 17 nt, Human
acaaaugcuauuaaagu

SEQ ID NO: 2814682 - RNA, 17 nt, Human
uagcaaggucauuucuu

SEQ ID NO: 2814683 - RNA, 19 nt, Human
uagcaaggucauuucuuca

SEQ ID NO: 2814684 - RNA, 24 nt, Human
uagcaagauugcuuaaaauagcaa

SEQ ID NO: 2814685 - RNA, 13 nt, Human
uagcaagcuggcc

SEQ ID NO: 2814686 - RNA, 14 nt, Human
uagcaagcuggccu

SEQ ID NO: 2814687 - RNA, 15 nt, Human
uagcaagcuggccuc

SEQ ID NO: 2814688 - RNA, 16 nt, Human
uagcaagcuggccucu

SEQ ID NO: 2814689 - RNA, 20 nt, Human
uagcaagauugcuuaaaaua

SEQ ID NO: 2814690 - RNA, 18 nt, Human
uagcaagacacaucccua

SEQ ID NO: 2814691 - RNA, 12 nt, Human
uagcaacaggaa

SEQ ID NO: 2814692 - RNA, 17 nt, Human
uagcaacuuuuguguaa

SEQ ID NO: 2814693 - RNA, 13 nt, Human
uagcaacuuuugu

SEQ ID NO: 2814694 - RNA, 17 nt, Human
uagcaagacacaucccu

SEQ ID NO: 2814695 - RNA, 12 nt, Human
uagcaagacaca

SEQ ID NO: 2814696 - RNA, 17 nt, Human
acaagcgugagccacug

SEQ ID NO: 2814697 - RNA, 14 nt, Human
acaagauuuagaaa

SEQ ID NO: 2814698 - RNA, 16 nt, Human
acaagauuuagaaaaa

SEQ ID NO: 2814699 - RNA, 18 nt, Human
acaagauuuccuugugca

SEQ ID NO: 2814700 - RNA, 20 nt, Human
acaagauuuccuugugcaaa

SEQ ID NO: 2814701 - RNA, 17 nt, Human
acaagcccccccuucca

SEQ ID NO: 2814702 - RNA, 18 nt, Human
acaagcccccccuuccac

SEQ ID NO: 2814703 - RNA, 14 nt, Human
acaagcccccccuu

SEQ ID NO: 2814704 - RNA, 19 nt, Human
acaagagcuuaacagugug

SEQ ID NO: 2814705 - RNA, 18 nt, Human
acaagagcuuaacagugu

SEQ ID NO: 2814706 - RNA, 22 nt, Human
acaagaguuuauuuccaaauaa

SEQ ID NO: 2814707 - RNA, 16 nt, Human
acaagagguacagggu

SEQ ID NO: 2814708 - RNA, 19 nt, Human
acaagagguacaggguuuu

SEQ ID NO: 2814709 - RNA, 15 nt, Human
acaagauauuguaca

SEQ ID NO: 2814710 - RNA, 16 nt, Human
acaagauauuguacau

SEQ ID NO: 2814711 - RNA, 17 nt, Human
acaagauauuguacaua

SEQ ID NO: 2814712 - RNA, 18 nt, Human
acaagauauuguacauaa

SEQ ID NO: 2814713 - RNA, 19 nt, Human
acaagauauuguacauaaa

SEQ ID NO: 2814714 - RNA, 22 nt, Human
acaagauauuguacauaaaaga

SEQ ID NO: 2814715 - RNA, 18 nt, Human
acaagaguuuauuuccaa

SEQ ID NO: 2814716 - RNA, 19 nt, Human
acaagaccaccacuucgaa

SEQ ID NO: 2814717 - RNA, 14 nt, Human
acaagacacaguga

SEQ ID NO: 2814718 - RNA, 14 nt, Human
aauuuuuguaauuu

SEQ ID NO: 2814719 - RNA, 15 nt, Human
aauuuuuugguacaa

SEQ ID NO: 2814720 - RNA, 16 nt, Human
aauuuuuugguacaaa

SEQ ID NO: 2814721 - RNA, 20 nt, Human
aauuuuuugguacaaaaaua

SEQ ID NO: 2814722 - RNA, 21 nt, Human
aauuuuuugguacaaaaauaa

SEQ ID NO: 2814723 - RNA, 19 nt, Human
aauuuuuuguucuucagag

SEQ ID NO: 2814724 - RNA, 20 nt, Human
aauuuuuuguucuucagaga

SEQ ID NO: 2814725 - RNA, 16 nt, Human
aauuuuuuugucuuua

SEQ ID NO: 2814726 - RNA, 20 nt, Human
aauuuuuuuuaguauuuauu

SEQ ID NO: 2814727 - RNA, 15 nt, Human
aauuuuuuuuaguau

SEQ ID NO: 2814728 - RNA, 23 nt, Human
aauuuuuuuuaguauuuauuuau

SEQ ID NO: 2814729 - RNA, 13 nt, Human
aauuuuuuuucau

SEQ ID NO: 2814730 - RNA, 16 nt, Human
aauuuuuuuuacauuu

SEQ ID NO: 2814731 - RNA, 12 nt, Human
aauuuuuuuuac

SEQ ID NO: 2814732 - RNA, 13 nt, Human
aauuuuuaagcaa

SEQ ID NO: 2814733 - RNA, 20 nt, Human
aauuuuuaaauguaaaacau

SEQ ID NO: 2814734 - RNA, 20 nt, Human
aauuuuugccuucauuaccu

SEQ ID NO: 2814735 - RNA, 17 nt, Human
aauuuuugccuucauua

SEQ ID NO: 2814736 - RNA, 16 nt, Human
aauuuuugccuucauu

SEQ ID NO: 2814737 - RNA, 17 nt, Human
aauuuguuugaaaucuu

SEQ ID NO: 2814738 - RNA, 19 nt, Human
aauuuuuaaaaauacacuu

SEQ ID NO: 2814739 - RNA, 13 nt, Human
uacuuuuuccugg

SEQ ID NO: 2814740 - RNA, 12 nt, Human
uacuuuuucuaa

SEQ ID NO: 2814741 - RNA, 13 nt, Human
uacuuuuucuaau

SEQ ID NO: 2814742 - RNA, 14 nt, Human
uacuuuuucuaaug

SEQ ID NO: 2814743 - RNA, 16 nt, Human
uacuuuuucuaaugag

SEQ ID NO: 2814744 - RNA, 17 nt, Human
uacuuuuucuuuuguaa

SEQ ID NO: 2814745 - RNA, 18 nt, Human
uacuuuuucuuuuguaag

SEQ ID NO: 2814746 - RNA, 21 nt, Human
uacuuuuaaacagugagccug

SEQ ID NO: 2814747 - RNA, 21 nt, Human
uacuuuguggaccaauuauug

SEQ ID NO: 2814748 - RNA, 22 nt, Human
uacuuuguggaccaauuauuga

SEQ ID NO: 2814749 - RNA, 12 nt, Human
uacuuuuuucca

SEQ ID NO: 2814750 - RNA, 13 nt, Human
uacuuuuuguuau

SEQ ID NO: 2814751 - RNA, 13 nt, Human
uacuuuuugugaa

SEQ ID NO: 2814752 - RNA, 15 nt, Human
uacuuuuugugaaga

SEQ ID NO: 2814753 - RNA, 20 nt, Human
aauuugcacuaaaucagaga

SEQ ID NO: 2814754 - RNA, 15 nt, Human
aauuugcauuaaauu

SEQ ID NO: 2814755 - RNA, 17 nt, Human
aauuugcauuaaauuca

SEQ ID NO: 2814756 - RNA, 21 nt, Human
aauuugcauuaaauucacaaa

SEQ ID NO: 2814757 - RNA, 18 nt, Human
aauuugcauuaaauucac

SEQ ID NO: 2814758 - RNA, 19 nt, Human
aauuugguuuaaaaauaca

SEQ ID NO: 2814759 - RNA, 20 nt, Human
aauuugcccugggaaacccc

SEQ ID NO: 2814760 - RNA, 23 nt, Human
aauuugcauuaaauucacaaacu

SEQ ID NO: 2814761 - RNA, 17 nt, Human
uagaugcgcagccccau

SEQ ID NO: 2814762 - RNA, 19 nt, Human
uagaugcgcagccccaucu

SEQ ID NO: 2814763 - RNA, 19 nt, Human
uagaucauuuguucuggga

SEQ ID NO: 2814764 - RNA, 12 nt, Human
uagaucuucuga

SEQ ID NO: 2814765 - RNA, 13 nt, Human
uagaucuucugaa

SEQ ID NO: 2814766 - RNA, 14 nt, Human
uagaucuucugaaa

SEQ ID NO: 2814767 - RNA, 15 nt, Human
uagaucuucugaaau

SEQ ID NO: 2814768 - RNA, 16 nt, Human
uagaucuucugaaaug

SEQ ID NO: 2814769 - RNA, 16 nt, Human
uagaugaaguuuuaca

SEQ ID NO: 2814770 - RNA, 16 nt, Human
uagauagguaaauacc

SEQ ID NO: 2814771 - RNA, 17 nt, Human
uagauaguuagaaccug

SEQ ID NO: 2814772 - RNA, 13 nt, Human
uagauagggcugg

SEQ ID NO: 2814773 - RNA, 23 nt, Human
uagauagggcugggcaaggaaaa

SEQ ID NO: 2814774 - RNA, 13 nt, Human
acaaauauucaga

SEQ ID NO: 2814775 - RNA, 14 nt, Human
acaaauauucagaa

SEQ ID NO: 2814776 - RNA, 12 nt, Human
acaaauaugcaa

SEQ ID NO: 2814777 - RNA, 23 nt, Human
acaaauauuuauuuucuuucugu

SEQ ID NO: 2814778 - RNA, 22 nt, Human
acaaauauuuauuuucuuucug

SEQ ID NO: 2814779 - RNA, 18 nt, Human
acaaauauuuauuuucuu

SEQ ID NO: 2814780 - RNA, 12 nt, Human
acaaauauuuau

SEQ ID NO: 2814781 - RNA, 11 nt, Human
acaaauaugca

SEQ ID NO: 2814782 - RNA, 14 nt, Human
acaaauauaagauu

SEQ ID NO: 2814783 - RNA, 12 nt, Human
acaaauauauug

SEQ ID NO: 2814784 - RNA, 15 nt, Human
acaaauauauuguua

SEQ ID NO: 2814785 - RNA, 21 nt, Human
acaaauaucuuguguuguccu

SEQ ID NO: 2814786 - RNA, 22 nt, Human
acaaauaucuuguguuguccuu

SEQ ID NO: 2814787 - RNA, 19 nt, Human
acaaauaugcaaaagguuc

SEQ ID NO: 2814788 - RNA, 16 nt, Human
acaaauaugcuaauuu

SEQ ID NO: 2814789 - RNA, 17 nt, Human
acaaauaugcuaauuug

SEQ ID NO: 2814790 - RNA, 18 nt, Human
acaaauaugcuaauuugg

SEQ ID NO: 2814791 - RNA, 20 nt, Human
acaaauagugcaacuaugaa

SEQ ID NO: 2814792 - RNA, 15 nt, Human
acaaauauaaaucuu

SEQ ID NO: 2814793 - RNA, 16 nt, Human
acaaagucuuuggggu

SEQ ID NO: 2814794 - RNA, 18 nt, Human
acaaagugagacagucca

SEQ ID NO: 2814795 - RNA, 15 nt, Human
acaaaguuguaugug

SEQ ID NO: 2814796 - RNA, 15 nt, Human
acaaagcgugcacaa

SEQ ID NO: 2814797 - RNA, 13 nt, Human
acaaagcuguuaa

SEQ ID NO: 2814798 - RNA, 14 nt, Human
acaaagcuguuaaa

SEQ ID NO: 2814799 - RNA, 17 nt, Human
acaaagcuguuaaacug

SEQ ID NO: 2814800 - RNA, 18 nt, Human
acaaagcuguuaaacugu

SEQ ID NO: 2814801 - RNA, 19 nt, Human
acaaagcuguuaaacuguu

SEQ ID NO: 2814802 - RNA, 20 nt, Human
acaaagcuguuaaacuguua

SEQ ID NO: 2814803 - RNA, 19 nt, Human
acaaaggaagugcccccuc

SEQ ID NO: 2814804 - RNA, 14 nt, Human
aauuuuuguaaauc

SEQ ID NO: 2814805 - RNA, 11 nt, Human
acaaaacuucu

SEQ ID NO: 2814806 - RNA, 12 nt, Human
acaaaacuucuu

SEQ ID NO: 2814807 - RNA, 13 nt, Human
acaaaacuucuug

SEQ ID NO: 2814808 - RNA, 17 nt, Human
acaaaacuucuugucag

SEQ ID NO: 2814809 - RNA, 18 nt, Human
acaaaacuucuugucaga

SEQ ID NO: 2814810 - RNA, 19 nt, Human
acaaaacuucuugucagac

SEQ ID NO: 2814811 - RNA, 20 nt, Human
acaaaacuucuugucagaca

SEQ ID NO: 2814812 - RNA, 15 nt, Human
acaaaagaaaagacu

SEQ ID NO: 2814813 - RNA, 20 nt, Human
acaaaagaaaagacuuguaa

SEQ ID NO: 2814814 - RNA, 15 nt, Human
acaaaagaaauaccu

SEQ ID NO: 2814815 - RNA, 16 nt, Human
acaaaagaaauaccuu

SEQ ID NO: 2814816 - RNA, 18 nt, Human
acaaaagaaauaccuuga

SEQ ID NO: 2814817 - RNA, 19 nt, Human
aauuuuuuuuuccuagccc

SEQ ID NO: 2814818 - RNA, 20 nt, Human
aauuuuuuuuguuguuucag

SEQ ID NO: 2814819 - RNA, 21 nt, Human
aauuuuuuuuguuguuucagu

SEQ ID NO: 2814820 - RNA, 22 nt, Human
aauuuuuuuuguuguuucagug

SEQ ID NO: 2814821 - RNA, 23 nt, Human
aauuuuuuuuguuguuucaguga

SEQ ID NO: 2814822 - RNA, 20 nt, Human
aauuuuuuuuucauagagau

SEQ ID NO: 2814823 - RNA, 23 nt, Human
acaaaacuacaugagaacaaaca

SEQ ID NO: 2814824 - RNA, 17 nt, Human
acaaaacuacaugagaa

SEQ ID NO: 2814825 - RNA, 10 nt, Human
acaaaacuau

SEQ ID NO: 2814826 - RNA, 14 nt, Human
acaaaacuauacuu

SEQ ID NO: 2814827 - RNA, 15 nt, Human
acaaaacuauacuug

SEQ ID NO: 2814828 - RNA, 16 nt, Human
acaaaacuauacuuga

SEQ ID NO: 2814829 - RNA, 17 nt, Human
acaaaacuauacuugaa

SEQ ID NO: 2814830 - RNA, 21 nt, Human
acaaaacuauacuugaacaaa

SEQ ID NO: 2814831 - RNA, 18 nt, Human
acaaagcccuuccauguc

SEQ ID NO: 2814832 - RNA, 23 nt, Human
acaaaagaggagcacuuccaaaa

SEQ ID NO: 2814833 - RNA, 13 nt, Human
acaaaagaugaaa

SEQ ID NO: 2814834 - RNA, 19 nt, Human
acaaagccaaacucugcca

SEQ ID NO: 2814835 - RNA, 17 nt, Human
uacuuauuuuugacagu

SEQ ID NO: 2814836 - RNA, 22 nt, Human
uacuuccaccucgggcacauuu

SEQ ID NO: 2814837 - RNA, 19 nt, Human
uacuuauuuuugacagugu

SEQ ID NO: 2814838 - RNA, 20 nt, Human
uacuuccccuuccuaauucc

SEQ ID NO: 2814839 - RNA, 18 nt, Human
uacuuccccuuccuaauu

SEQ ID NO: 2814840 - RNA, 15 nt, Human
uacuuccccuuccua

SEQ ID NO: 2814841 - RNA, 14 nt, Human
uacuuccccuuccu

SEQ ID NO: 2814842 - RNA, 18 nt, Human
uacuucuccacccugcuc

SEQ ID NO: 2814843 - RNA, 13 nt, Human
uacuucuccaccc

SEQ ID NO: 2814844 - RNA, 16 nt, Human
uacuuccuccucccca

SEQ ID NO: 2814845 - RNA, 15 nt, Human
uacuuccugaguggc

SEQ ID NO: 2814846 - RNA, 22 nt, Human
uacuuccugaguggccagggaa

SEQ ID NO: 2814847 - RNA, 17 nt, Human
uacuucgucuucuaauu

SEQ ID NO: 2814848 - RNA, 18 nt, Human
uacuucgucuucuaauuu

SEQ ID NO: 2814849 - RNA, 14 nt, Human
uacuuccuccuccc

SEQ ID NO: 2814850 - RNA, 23 nt, Human
uacuuccugugacuucagcucug

SEQ ID NO: 2814851 - RNA, 21 nt, Human
uacuuauauuucccuaaaaua

SEQ ID NO: 2814852 - RNA, 14 nt, Human
uacuuauauuuucg

SEQ ID NO: 2814853 - RNA, 16 nt, Human
uacuuauauuuucgua

SEQ ID NO: 2814854 - RNA, 17 nt, Human
uacuuauauuuucguau

SEQ ID NO: 2814855 - RNA, 20 nt, Human
uacuuauauuuucguaugaa

SEQ ID NO: 2814856 - RNA, 22 nt, Human
uacuuauauuuucguaugaaaa

SEQ ID NO: 2814857 - RNA, 23 nt, Human
uacuuauauuuucguaugaaaau

SEQ ID NO: 2814858 - RNA, 20 nt, Human
aauuugauugauuugaagaa

SEQ ID NO: 2814859 - RNA, 17 nt, Human
aauuugauugauuugaa

SEQ ID NO: 2814860 - RNA, 15 nt, Human
aauuugauuucuauu

SEQ ID NO: 2814861 - RNA, 20 nt, Human
uacuuaucauccacauuguu

SEQ ID NO: 2814862 - RNA, 15 nt, Human
uacuuaucccugccc

SEQ ID NO: 2814863 - RNA, 17 nt, Human
uacuuaucccugcccau

SEQ ID NO: 2814864 - RNA, 18 nt, Human
uacuuaucccugcccauu

SEQ ID NO: 2814865 - RNA, 21 nt, Human
uacuuaucccugcccauuuca

SEQ ID NO: 2814866 - RNA, 23 nt, Human
uacuuaucccugcccauuucaua

SEQ ID NO: 2814867 - RNA, 23 nt, Human
aauuugaaaacauaaucugcaaa

SEQ ID NO: 2814868 - RNA, 21 nt, Human
aauuucuucacuguugaaaau

SEQ ID NO: 2814869 - RNA, 12 nt, Human
aauuugauugau

SEQ ID NO: 2814870 - RNA, 20 nt, Human
aauuugauugacugcccauu

SEQ ID NO: 2814871 - RNA, 18 nt, Human
aauuugauuaacaaauau

SEQ ID NO: 2814872 - RNA, 16 nt, Human
aauuugauugauuuga

SEQ ID NO: 2814873 - RNA, 15 nt, Human
aauuugauugauuug

SEQ ID NO: 2814874 - RNA, 14 nt, Human
aauuugauugauuu

SEQ ID NO: 2814875 - RNA, 13 nt, Human
aauuugauugauu

SEQ ID NO: 2814876 - RNA, 22 nt, Human
aauuugcacaucuuggcuaugu

SEQ ID NO: 2814877 - RNA, 15 nt, Human
uacuucugcuacaua

SEQ ID NO: 2814878 - RNA, 20 nt, Human
uacuucuccacccugcucuc

SEQ ID NO: 2814879 - RNA, 15 nt, Human
uacuugaaaaaguaa

SEQ ID NO: 2814880 - RNA, 16 nt, Human
uacuucuuugcuuugc

SEQ ID NO: 2814881 - RNA, 13 nt, Human
uacuugaacaaaa

SEQ ID NO: 2814882 - RNA, 14 nt, Human
uacuugaacaaaag

SEQ ID NO: 2814883 - RNA, 15 nt, Human
uacuugaacaaaagg

SEQ ID NO: 2814884 - RNA, 19 nt, Human
uacuugaacaaaaggguca

SEQ ID NO: 2814885 - RNA, 20 nt, Human
uacuuuccuuuccccagccc

SEQ ID NO: 2814886 - RNA, 17 nt, Human
uacuuucguacauuggc

SEQ ID NO: 2814887 - RNA, 19 nt, Human
uacuuuccuuuccccagcc

SEQ ID NO: 2814888 - RNA, 12 nt, Human
uacuuucccuug

SEQ ID NO: 2814889 - RNA, 15 nt, Human
uacuuucccuugcuu

SEQ ID NO: 2814890 - RNA, 23 nt, Human
uacuuucccuugcuuuucccucu

SEQ ID NO: 2814891 - RNA, 14 nt, Human
uacuuugucugaaa

SEQ ID NO: 2814892 - RNA, 16 nt, Human
uacuuugucugaaaaa

SEQ ID NO: 2814893 - RNA, 18 nt, Human
uacuuucuuaaugugacc

SEQ ID NO: 2814894 - RNA, 15 nt, Human
aauuuacuuuacaca

SEQ ID NO: 2814895 - RNA, 15 nt, Human
aauuuaguuauugau

SEQ ID NO: 2814896 - RNA, 21 nt, Human
aauuuagugaucuuagcauag

SEQ ID NO: 2814897 - RNA, 23 nt, Human
aauuuagugaucuuagcauagcu

SEQ ID NO: 2814898 - RNA, 20 nt, Human
aauuuaguaaauguuaucuu

SEQ ID NO: 2814899 - RNA, 12 nt, Human
aauuuacuauau

SEQ ID NO: 2814900 - RNA, 13 nt, Human
aauuuacuauaua

SEQ ID NO: 2814901 - RNA, 15 nt, Human
aauuuacuauauaua

SEQ ID NO: 2814902 - RNA, 16 nt, Human
aauuuacuauauauau

SEQ ID NO: 2814903 - RNA, 19 nt, Human
aauuuacuauauauauaug

SEQ ID NO: 2814904 - RNA, 16 nt, Human
aauuuaccugauuucu

SEQ ID NO: 2814905 - RNA, 15 nt, Human
aauuuacacugccau

SEQ ID NO: 2814906 - RNA, 14 nt, Human
aauuuaaauauaau

SEQ ID NO: 2814907 - RNA, 20 nt, Human
aauuggaagcugcccugccc

SEQ ID NO: 2814908 - RNA, 20 nt, Human
aauuggaacagaauguuuua

SEQ ID NO: 2814909 - RNA, 16 nt, Human
aauuggaacaaaguga

SEQ ID NO: 2814910 - RNA, 17 nt, Human
aauuggaacaaagugaa

SEQ ID NO: 2814911 - RNA, 17 nt, Human
aauugcuuuuuuaaaua

SEQ ID NO: 2814912 - RNA, 20 nt, Human
aauuuaaauauaauucugua

SEQ ID NO: 2814913 - RNA, 23 nt, Human
aauuuaaauauaauucuguaaau

SEQ ID NO: 2814914 - RNA, 18 nt, Human
aauuggaccauccuauuu

SEQ ID NO: 2814915 - RNA, 19 nt, Human
aauuggacuuucaaaauua

SEQ ID NO: 2814916 - RNA, 16 nt, Human
aauuuaaauauaauuc

SEQ ID NO: 2814917 - RNA, 19 nt, Human
aauuuaaauauaauucugu

SEQ ID NO: 2814918 - RNA, 21 nt, Human
aauuuaacuacccuuaauuac

SEQ ID NO: 2814919 - RNA, 23 nt, Human
aauuuaacuacccuuaauuacuu

SEQ ID NO: 2814920 - RNA, 21 nt, Human
aauuuaacuagacacagauaa

SEQ ID NO: 2814921 - RNA, 23 nt, Human
aauuuaagagcaguccauuucua

SEQ ID NO: 2814922 - RNA, 13 nt, Human
aauuuaaauguua

SEQ ID NO: 2814923 - RNA, 11 nt, Human
aauuuaaauuu

SEQ ID NO: 2814924 - RNA, 15 nt, Human
aauuuaaauuuaaag

SEQ ID NO: 2814925 - RNA, 17 nt, Human
aauuuaaauuuaaagau

SEQ ID NO: 2814926 - RNA, 18 nt, Human
aauuuaaauuuaaagaua

SEQ ID NO: 2814927 - RNA, 11 nt, Human
aauuuaaaugu

SEQ ID NO: 2814928 - RNA, 15 nt, Human
aauuuaagcuuaagc

SEQ ID NO: 2814929 - RNA, 14 nt, Human
aauuuaaguaucuu

SEQ ID NO: 2814930 - RNA, 14 nt, Human
aauuuaagugcgug

SEQ ID NO: 2814931 - RNA, 19 nt, Human
aauuuauuaguuaauauau

SEQ ID NO: 2814932 - RNA, 14 nt, Human
aauuucucaucaca

SEQ ID NO: 2814933 - RNA, 20 nt, Human
aauuucuucacuguugaaaa

SEQ ID NO: 2814934 - RNA, 14 nt, Human
aauuucuucaaaau

SEQ ID NO: 2814935 - RNA, 16 nt, Human
aauuucuucaaaaugu

SEQ ID NO: 2814936 - RNA, 19 nt, Human
aauuucuucaaaauguaua

SEQ ID NO: 2814937 - RNA, 17 nt, Human
aauuucuugguaagaag

SEQ ID NO: 2814938 - RNA, 23 nt, Human
aauuucuucuccuggaguugcau

SEQ ID NO: 2814939 - RNA, 21 nt, Human
aauuucuugcucuaucucuca

SEQ ID NO: 2814940 - RNA, 24 nt, Human
aauuucuugcucuaucucucaaaa

SEQ ID NO: 2814941 - RNA, 20 nt, Human
aauuucuugguaagaagccg

SEQ ID NO: 2814942 - RNA, 11 nt, Human
aauuucuuguu

SEQ ID NO: 2814943 - RNA, 15 nt, Human
aauuucuuguuucuc

SEQ ID NO: 2814944 - RNA, 22 nt, Human
aauuucuagccugcacuuugau

SEQ ID NO: 2814945 - RNA, 17 nt, Human
aauuuauacaauaucau

SEQ ID NO: 2814946 - RNA, 17 nt, Human
aauuuaucacacuucug

SEQ ID NO: 2814947 - RNA, 21 nt, Human
aauuuauaccuaccugugugg

SEQ ID NO: 2814948 - RNA, 14 nt, Human
aauuuauaugaaaa

SEQ ID NO: 2814949 - RNA, 16 nt, Human
aauuuauauguauauu

SEQ ID NO: 2814950 - RNA, 14 nt, Human
aauuuaucaaagca

SEQ ID NO: 2814951 - RNA, 15 nt, Human
aauuuaucaaagcau

SEQ ID NO: 2814952 - RNA, 16 nt, Human
aauuuaucaaagcaua

SEQ ID NO: 2814953 - RNA, 22 nt, Human
aauuuaucaaagcauagauguu

SEQ ID NO: 2814954 - RNA, 19 nt, Human
aauuuauuacuuguugcaa

SEQ ID NO: 2814955 - RNA, 17 nt, Human
aauuuauuaguuaauau

SEQ ID NO: 2814956 - RNA, 18 nt, Human
aauuuauuaguuaauaua

SEQ ID NO: 2814957 - RNA, 15 nt, Human
aauuuauuaaaauga

SEQ ID NO: 2814958 - RNA, 15 nt, Human
aauuuauaaaguacc

SEQ ID NO: 2814959 - RNA, 12 nt, Human
aauuuauaauuc

SEQ ID NO: 2814960 - RNA, 13 nt, Human
aauuuauaauuca

SEQ ID NO: 2814961 - RNA, 17 nt, Human
aauuuauaauucaguau

SEQ ID NO: 2814962 - RNA, 15 nt, Human
aauuuauacaauauc

SEQ ID NO: 2814963 - RNA, 14 nt, Human
aauuuauaaaauua

SEQ ID NO: 2814964 - RNA, 15 nt, Human
aauuuauaaaauuag

SEQ ID NO: 2814965 - RNA, 16 nt, Human
aauuuauaaaauuaga

SEQ ID NO: 2814966 - RNA, 18 nt, Human
aauuuauaaaauuagaaa

SEQ ID NO: 2814967 - RNA, 21 nt, Human
aauuuauaaaauuagaaagca

SEQ ID NO: 2814968 - RNA, 12 nt, Human
aauugagcacaa

SEQ ID NO: 2814969 - RNA, 19 nt, Human
aauugagaugauuaaaaug

SEQ ID NO: 2814970 - RNA, 12 nt, Human
aauugagacagu

SEQ ID NO: 2814971 - RNA, 23 nt, Human
aauugagaaaaauauauacuaaa

SEQ ID NO: 2814972 - RNA, 19 nt, Human
aauugagaaaaauauauac

SEQ ID NO: 2814973 - RNA, 19 nt, Human
uacuguacauaaacaauga

SEQ ID NO: 2814974 - RNA, 21 nt, Human
uacuguacauaaacaaugaug

SEQ ID NO: 2814975 - RNA, 12 nt, Human
uacuguacaaua

SEQ ID NO: 2814976 - RNA, 14 nt, Human
uacuguacaauaaa

SEQ ID NO: 2814977 - RNA, 15 nt, Human
uacuguacaauaaaa

SEQ ID NO: 2814978 - RNA, 18 nt, Human
uacuguacaauaaaaaca

SEQ ID NO: 2814979 - RNA, 16 nt, Human
uacuguaauuccucaa

SEQ ID NO: 2814980 - RNA, 15 nt, Human
uacuguaauuccuca

SEQ ID NO: 2814981 - RNA, 13 nt, Human
uacuguaauuccu

SEQ ID NO: 2814982 - RNA, 21 nt, Human
aauugcacaauauugaacuuu

SEQ ID NO: 2814983 - RNA, 18 nt, Human
aauugcacagaaguccug

SEQ ID NO: 2814984 - RNA, 19 nt, Human
aauugcacagaaguccugu

SEQ ID NO: 2814985 - RNA, 20 nt, Human
aauugcacagaaguccugua

SEQ ID NO: 2814986 - RNA, 22 nt, Human
aauugcacagaaguccuguaug

SEQ ID NO: 2814987 - RNA, 18 nt, Human
aauugcaaaucuugaaau

SEQ ID NO: 2814988 - RNA, 14 nt, Human
aauugcaaaucuug

SEQ ID NO: 2814989 - RNA, 23 nt, Human
aauugauuugcauugaacacaaa

SEQ ID NO: 2814990 - RNA, 11 nt, Human
aauugcauuga

SEQ ID NO: 2814991 - RNA, 13 nt, Human
aauugcagacugu

SEQ ID NO: 2814992 - RNA, 20 nt, Human
aauugcagauaacuuugacu

SEQ ID NO: 2814993 - RNA, 15 nt, Human
aauugcauaaagcau

SEQ ID NO: 2814994 - RNA, 16 nt, Human
aauugcauaaagcaua

SEQ ID NO: 2814995 - RNA, 21 nt, Human
aauugauuucuuuucuuccug

SEQ ID NO: 2814996 - RNA, 22 nt, Human
aauugauuucuuuucuuccugg

SEQ ID NO: 2814997 - RNA, 13 nt, Human
aauugauuugcau

SEQ ID NO: 2814998 - RNA, 22 nt, Human
aauugauuugcauugaacacaa

SEQ ID NO: 2814999 - RNA, 20 nt, Human
aauugauuugcauugaacac

SEQ ID NO: 2815000 - RNA, 16 nt, Human
aauugauuugcauuga

SEQ ID NO: 2815001 - RNA, 14 nt, Human
aauugauuugcauu

SEQ ID NO: 2815002 - RNA, 15 nt, Human
uacugacccuggggc

SEQ ID NO: 2815003 - RNA, 17 nt, Human
uacugacccuggggcug

SEQ ID NO: 2815004 - RNA, 19 nt, Human
uacugacccuggggcuggc

SEQ ID NO: 2815005 - RNA, 22 nt, Human
uacugacccuggggcuggcuuu

SEQ ID NO: 2815006 - RNA, 20 nt, Human
uacugaaagguuacccugua

SEQ ID NO: 2815007 - RNA, 22 nt, Human
uacucucacacugguucucaau

SEQ ID NO: 2815008 - RNA, 20 nt, Human
uacucuaugccccaaauaua

SEQ ID NO: 2815009 - RNA, 14 nt, Human
uacucuagaugaag

SEQ ID NO: 2815010 - RNA, 14 nt, Human
uacucuagauaccu

SEQ ID NO: 2815011 - RNA, 21 nt, Human
uacucuagauaccuaaaacau

SEQ ID NO: 2815012 - RNA, 16 nt, Human
uacucuuucuguauau

SEQ ID NO: 2815013 - RNA, 13 nt, Human
uacugaaagccuu

SEQ ID NO: 2815014 - RNA, 14 nt, Human
uacugaaacagauu

SEQ ID NO: 2815015 - RNA, 15 nt, Human
uacucuuucuguaua

SEQ ID NO: 2815016 - RNA, 14 nt, Human
uacucuuucuguau

SEQ ID NO: 2815017 - RNA, 13 nt, Human
uacucuuucugua

SEQ ID NO: 2815018 - RNA, 20 nt, Human
uacugagaaaagccucucca

SEQ ID NO: 2815019 - RNA, 12 nt, Human
uacugggccuua

SEQ ID NO: 2815020 - RNA, 22 nt, Human
uacugggccuuagugggccagg

SEQ ID NO: 2815021 - RNA, 23 nt, Human
uacugggccuuagugggccaggg

SEQ ID NO: 2815022 - RNA, 14 nt, Human
uacugggugucauu

SEQ ID NO: 2815023 - RNA, 15 nt, Human
uacugggugucauuu

SEQ ID NO: 2815024 - RNA, 17 nt, Human
uacugggugucauuuca

SEQ ID NO: 2815025 - RNA, 20 nt, Human
uacugggugucauuucauuc

SEQ ID NO: 2815026 - RNA, 22 nt, Human
uacugggugucauuucauucca

SEQ ID NO: 2815027 - RNA, 23 nt, Human
uacugggugucauuucauuccau

SEQ ID NO: 2815028 - RNA, 23 nt, Human
uacuguaauaauaccucaauguu

SEQ ID NO: 2815029 - RNA, 20 nt, Human
uacuaaaaguucuucuccaa

SEQ ID NO: 2815030 - RNA, 12 nt, Human
uacuaaaauaua

SEQ ID NO: 2815031 - RNA, 13 nt, Human
uacuaaaauauau

SEQ ID NO: 2815032 - RNA, 13 nt, Human
uacuagaaugcuu

SEQ ID NO: 2815033 - RNA, 14 nt, Human
uacuagaaugcuua

SEQ ID NO: 2815034 - RNA, 16 nt, Human
uacgucugacaggcaa

SEQ ID NO: 2815035 - RNA, 17 nt, Human
uacgugacccucugcug

SEQ ID NO: 2815036 - RNA, 21 nt, Human
uacgugacccucugcugaaga

SEQ ID NO: 2815037 - RNA, 22 nt, Human
uacgugacccucugcugaagac

SEQ ID NO: 2815038 - RNA, 13 nt, Human
uacuauuuagaua

SEQ ID NO: 2815039 - RNA, 18 nt, Human
uacuauuuucuacaauua

SEQ ID NO: 2815040 - RNA, 19 nt, Human
uacuauuuucuacaauuaa

SEQ ID NO: 2815041 - RNA, 17 nt, Human
uacuauuuugacaguua

SEQ ID NO: 2815042 - RNA, 20 nt, Human
uacuagcuuuucaaacaaga

SEQ ID NO: 2815043 - RNA, 23 nt, Human
uacuagcuuuucaaacaagaaug

SEQ ID NO: 2815044 - RNA, 21 nt, Human
uacuauuuaaagccuccucau

SEQ ID NO: 2815045 - RNA, 22 nt, Human
uacuauuuaaagccuccucauc

SEQ ID NO: 2815046 - RNA, 12 nt, Human
uacuauuuaaag

SEQ ID NO: 2815047 - RNA, 19 nt, Human
uacuauuuaaagccuccuc

SEQ ID NO: 2815048 - RNA, 15 nt, Human
uacgucugacaggca

SEQ ID NO: 2815049 - RNA, 13 nt, Human
uacggacaccccc

SEQ ID NO: 2815050 - RNA, 14 nt, Human
uacggacacccccu

SEQ ID NO: 2815051 - RNA, 12 nt, Human
uacgcuuuucuu

SEQ ID NO: 2815052 - RNA, 17 nt, Human
uacgcuuuucuuuguua

SEQ ID NO: 2815053 - RNA, 19 nt, Human
uacggaccagguauagaga

SEQ ID NO: 2815054 - RNA, 19 nt, Human
uacggaucaucaacaagau

SEQ ID NO: 2815055 - RNA, 21 nt, Human
uacgcucuccuuucuuucuaa

SEQ ID NO: 2815056 - RNA, 13 nt, Human
uacgcuggugcug

SEQ ID NO: 2815057 - RNA, 14 nt, Human
uacgcuggugcuga

SEQ ID NO: 2815058 - RNA, 19 nt, Human
uacgcucuccuuucuuucu

SEQ ID NO: 2815059 - RNA, 15 nt, Human
uacgcucuccuuucu

SEQ ID NO: 2815060 - RNA, 15 nt, Human
uacgcuuugauucau

SEQ ID NO: 2815061 - RNA, 12 nt, Human
uacgcuuuguca

SEQ ID NO: 2815062 - RNA, 20 nt, Human
uacgcuuugucacacaaaaa

SEQ ID NO: 2815063 - RNA, 14 nt, Human
uacgcuuugauuca

SEQ ID NO: 2815064 - RNA, 13 nt, Human
uacgcucuccuuu

SEQ ID NO: 2815065 - RNA, 17 nt, Human
aauugaccaucugcuuu

SEQ ID NO: 2815066 - RNA, 18 nt, Human
aauugaccaucugcuuuu

SEQ ID NO: 2815067 - RNA, 19 nt, Human
aauugaccaucugcuuuua

SEQ ID NO: 2815068 - RNA, 24 nt, Human
uacgcuccaucgcugucaucucag

SEQ ID NO: 2815069 - RNA, 23 nt, Human
aauguguguauucuuaaaaugca

SEQ ID NO: 2815070 - RNA, 18 nt, Human
aauguguguauguguauu

SEQ ID NO: 2815071 - RNA, 21 nt, Human
aauguguguauguguauuuau

SEQ ID NO: 2815072 - RNA, 16 nt, Human
aauguguggccugcac

SEQ ID NO: 2815073 - RNA, 16 nt, Human
aaugugugguggccuc

SEQ ID NO: 2815074 - RNA, 21 nt, Human
aaugugugguggccucagcug

SEQ ID NO: 2815075 - RNA, 19 nt, Human
aaugugugccauagaguuu

SEQ ID NO: 2815076 - RNA, 12 nt, Human
aauguguguaug

SEQ ID NO: 2815077 - RNA, 13 nt, Human
aauguguguaugu

SEQ ID NO: 2815078 - RNA, 13 nt, Human
aaugugugaaaaa

SEQ ID NO: 2815079 - RNA, 22 nt, Human
aaugugugaaaaagaugccaau

SEQ ID NO: 2815080 - RNA, 19 nt, Human
aauguguaucggaugcuuu

SEQ ID NO: 2815081 - RNA, 19 nt, Human
aauguguacaauguacaca

SEQ ID NO: 2815082 - RNA, 14 nt, Human
aauguguccuaucu

SEQ ID NO: 2815083 - RNA, 19 nt, Human
aauguguccuaucuaucuu

SEQ ID NO: 2815084 - RNA, 23 nt, Human
aauguguccuaucuaucuuccaa

SEQ ID NO: 2815085 - RNA, 18 nt, Human
aaugugguuucaaucuaa

SEQ ID NO: 2815086 - RNA, 17 nt, Human
aaugugguuuuccugaa

SEQ ID NO: 2815087 - RNA, 23 nt, Human
aauguguaaagaucuacaugaau

SEQ ID NO: 2815088 - RNA, 15 nt, Human
aauguggucucagga

SEQ ID NO: 2815089 - RNA, 16 nt, Human
aauguggucucaggau

SEQ ID NO: 2815090 - RNA, 14 nt, Human
aaugugggcagaga

SEQ ID NO: 2815091 - RNA, 20 nt, Human
aauguggccuaaaaaugcaa

SEQ ID NO: 2815092 - RNA, 13 nt, Human
aaugugggcacug

SEQ ID NO: 2815093 - RNA, 15 nt, Human
acacaccucaccaga

SEQ ID NO: 2815094 - RNA, 13 nt, Human
acacacgcacgca

SEQ ID NO: 2815095 - RNA, 17 nt, Human
acacaccuuuaaguaga

SEQ ID NO: 2815096 - RNA, 14 nt, Human
acacacgcacgcac

SEQ ID NO: 2815097 - RNA, 15 nt, Human
acacacgcacgcaca

SEQ ID NO: 2815098 - RNA, 16 nt, Human
acacacgcacgcacac

SEQ ID NO: 2815099 - RNA, 17 nt, Human
acacacgcacgcacaca

SEQ ID NO: 2815100 - RNA, 13 nt, Human
acacacccugagg

SEQ ID NO: 2815101 - RNA, 14 nt, Human
acacacccugaggu

SEQ ID NO: 2815102 - RNA, 12 nt, Human
acacacauagau

SEQ ID NO: 2815103 - RNA, 12 nt, Human
acacacaugcac

SEQ ID NO: 2815104 - RNA, 13 nt, Human
acacacaugcaca

SEQ ID NO: 2815105 - RNA, 14 nt, Human
acacacaugcacac

SEQ ID NO: 2815106 - RNA, 17 nt, Human
acacacaugcacacaca

SEQ ID NO: 2815107 - RNA, 21 nt, Human
acacacagguggugucacugu

SEQ ID NO: 2815108 - RNA, 23 nt, Human
acacacagguggugucacugucc

SEQ ID NO: 2815109 - RNA, 21 nt, Human
acacacauauaaacaucacac

SEQ ID NO: 2815110 - RNA, 12 nt, Human
acacacauacac

SEQ ID NO: 2815111 - RNA, 19 nt, Human
acacacagcucuguccugg

SEQ ID NO: 2815112 - RNA, 12 nt, Human
acacacagcucc

SEQ ID NO: 2815113 - RNA, 20 nt, Human
acacacagcuaacacacagc

SEQ ID NO: 2815114 - RNA, 13 nt, Human
acacacacauaca

SEQ ID NO: 2815115 - RNA, 12 nt, Human
acacacagcucu

SEQ ID NO: 2815116 - RNA, 11 nt, Human
acacacagcuc

SEQ ID NO: 2815117 - RNA, 11 nt, Human
acacacacaua

SEQ ID NO: 2815118 - RNA, 16 nt, Human
acaaugguuuuuaaau

SEQ ID NO: 2815119 - RNA, 18 nt, Human
acaaugguuuuuaaauuu

SEQ ID NO: 2815120 - RNA, 14 nt, Human
acaauguacacacu

SEQ ID NO: 2815121 - RNA, 23 nt, Human
acaauguagauggccucuuacua

SEQ ID NO: 2815122 - RNA, 18 nt, Human
acacaacuauuuuuccaa

SEQ ID NO: 2815123 - RNA, 19 nt, Human
acaauguauuuauuuaaaa

SEQ ID NO: 2815124 - RNA, 14 nt, Human
acaauguauuuauu

SEQ ID NO: 2815125 - RNA, 17 nt, Human
acaauguauuuauuuaa

SEQ ID NO: 2815126 - RNA, 22 nt, Human
acacaagaagaagggcacccua

SEQ ID NO: 2815127 - RNA, 16 nt, Human
acacacacacgcacgc

SEQ ID NO: 2815128 - RNA, 22 nt, Human
acaaugguguuauuugaaacuu

SEQ ID NO: 2815129 - RNA, 14 nt, Human
acacacacagaugu

SEQ ID NO: 2815130 - RNA, 13 nt, Human
acacacacagaaa

SEQ ID NO: 2815131 - RNA, 13 nt, Human
acacacacacgca

SEQ ID NO: 2815132 - RNA, 14 nt, Human
acacacacacgcac

SEQ ID NO: 2815133 - RNA, 17 nt, Human
acaauggggauguugug

SEQ ID NO: 2815134 - RNA, 18 nt, Human
acaauggcagaacaggug

SEQ ID NO: 2815135 - RNA, 17 nt, Human
acaaugcugauuuggug

SEQ ID NO: 2815136 - RNA, 13 nt, Human
acaaugcagcaag

SEQ ID NO: 2815137 - RNA, 22 nt, Human
acaaugcagcaaggcccugcug

SEQ ID NO: 2815138 - RNA, 15 nt, Human
uagcuuauuauugaa

SEQ ID NO: 2815139 - RNA, 13 nt, Human
acacacucagugc

SEQ ID NO: 2815140 - RNA, 14 nt, Human
acacacucagugca

SEQ ID NO: 2815141 - RNA, 12 nt, Human
acacacugaaag

SEQ ID NO: 2815142 - RNA, 14 nt, Human
acacacugaaagcu

SEQ ID NO: 2815143 - RNA, 18 nt, Human
acacacgcacgcacacac

SEQ ID NO: 2815144 - RNA, 22 nt, Human
acacagcucuucuccaggcugu

SEQ ID NO: 2815145 - RNA, 22 nt, Human
acacagcugagagacuuuuaau

SEQ ID NO: 2815146 - RNA, 11 nt, Human
acacagcuguu

SEQ ID NO: 2815147 - RNA, 18 nt, Human
acacagcuguucuucugu

SEQ ID NO: 2815148 - RNA, 11 nt, Human
acacagugagu

SEQ ID NO: 2815149 - RNA, 19 nt, Human
acacagucuuggcucacug

SEQ ID NO: 2815150 - RNA, 15 nt, Human
acacagucaaaauaa

SEQ ID NO: 2815151 - RNA, 18 nt, Human
acacagucaaaauaauuc

SEQ ID NO: 2815152 - RNA, 19 nt, Human
acacagucaaaauaauucu

SEQ ID NO: 2815153 - RNA, 23 nt, Human
acacagucaaaauaauucuaaau

SEQ ID NO: 2815154 - RNA, 17 nt, Human
acacagugaccauacua

SEQ ID NO: 2815155 - RNA, 20 nt, Human
uagguugccaauaauacacu

SEQ ID NO: 2815156 - RNA, 14 nt, Human
uaguaauagagcaa

SEQ ID NO: 2815157 - RNA, 16 nt, Human
uaguaaguaauuaugc

SEQ ID NO: 2815158 - RNA, 17 nt, Human
uaguaaguaauuaugca

SEQ ID NO: 2815159 - RNA, 21 nt, Human
uaguaaguaauuaugcacuaa

SEQ ID NO: 2815160 - RNA, 17 nt, Human
uaguaaguucagcacuu

SEQ ID NO: 2815161 - RNA, 18 nt, Human
uaguaaguucagcacuug

SEQ ID NO: 2815162 - RNA, 20 nt, Human
uaguaaguuuuucuucauga

SEQ ID NO: 2815163 - RNA, 16 nt, Human
uaguaagaaaacauca

SEQ ID NO: 2815164 - RNA, 11 nt, Human
uagguuucaaa

SEQ ID NO: 2815165 - RNA, 14 nt, Human
uagguuucaaagau

SEQ ID NO: 2815166 - RNA, 19 nt, Human
uaguaacuucuuauggaau

SEQ ID NO: 2815167 - RNA, 22 nt, Human
uagucuucucaaauuagaaagu

SEQ ID NO: 2815168 - RNA, 20 nt, Human
uaguaauagagcaaaauuga

SEQ ID NO: 2815169 - RNA, 15 nt, Human
uaguacugcucuugu

SEQ ID NO: 2815170 - RNA, 13 nt, Human
uaguacugcucuu

SEQ ID NO: 2815171 - RNA, 14 nt, Human
uaguacuguguacu

SEQ ID NO: 2815172 - RNA, 18 nt, Human
uaguacuguguacuguau

SEQ ID NO: 2815173 - RNA, 13 nt, Human
uaguagagacagg

SEQ ID NO: 2815174 - RNA, 15 nt, Human
uaguagacacacuau

SEQ ID NO: 2815175 - RNA, 10 nt, Human
uaguccuugg

SEQ ID NO: 2815176 - RNA, 13 nt, Human
uaguccuuggcau

SEQ ID NO: 2815177 - RNA, 14 nt, Human
uaguccuuggcaua

SEQ ID NO: 2815178 - RNA, 13 nt, Human
uagucuaguguag

SEQ ID NO: 2815179 - RNA, 16 nt, Human
uagucuaguguaguau

SEQ ID NO: 2815180 - RNA, 19 nt, Human
acacuaaccacgcuggacc

SEQ ID NO: 2815181 - RNA, 17 nt, Human
acacuaaccacgcugga

SEQ ID NO: 2815182 - RNA, 16 nt, Human
acacuaaccacgcugg

SEQ ID NO: 2815183 - RNA, 14 nt, Human
acacuacaccacac

SEQ ID NO: 2815184 - RNA, 15 nt, Human
acacuacaccacaca

SEQ ID NO: 2815185 - RNA, 16 nt, Human
acacuacaccacacac

SEQ ID NO: 2815186 - RNA, 17 nt, Human
acacuacaccacacaca

SEQ ID NO: 2815187 - RNA, 21 nt, Human
acacuacaccacacacaacag

SEQ ID NO: 2815188 - RNA, 15 nt, Human
uauaacuaacagcau

SEQ ID NO: 2815189 - RNA, 17 nt, Human
uauaacgugauacauuu

SEQ ID NO: 2815190 - RNA, 15 nt, Human
uauaaccccagcucc

SEQ ID NO: 2815191 - RNA, 16 nt, Human
uauaacccuguuacaa

SEQ ID NO: 2815192 - RNA, 19 nt, Human
uauaacccuguuacaaagc

SEQ ID NO: 2815193 - RNA, 15 nt, Human
uauaaccauaugaua

SEQ ID NO: 2815194 - RNA, 18 nt, Human
uauaacuaguccuuuacu

SEQ ID NO: 2815195 - RNA, 14 nt, Human
uauaacuaguccuu

SEQ ID NO: 2815196 - RNA, 23 nt, Human
acacuaauuccuuucuauccuac

SEQ ID NO: 2815197 - RNA, 14 nt, Human
acacuacauuagaa

SEQ ID NO: 2815198 - RNA, 20 nt, Human
acacuaccagcguauauaua

SEQ ID NO: 2815199 - RNA, 14 nt, Human
acacuacugagaau

SEQ ID NO: 2815200 - RNA, 13 nt, Human
acaccucccagga

SEQ ID NO: 2815201 - RNA, 21 nt, Human
acaccccucaguugugcagcu

SEQ ID NO: 2815202 - RNA, 12 nt, Human
acaccucccagg

SEQ ID NO: 2815203 - RNA, 19 nt, Human
acaccucccaggagacagu

SEQ ID NO: 2815204 - RNA, 23 nt, Human
acacccagccucaguccuccccu

SEQ ID NO: 2815205 - RNA, 17 nt, Human
acacccagccucagucc

SEQ ID NO: 2815206 - RNA, 20 nt, Human
acacccagccucaguccucc

SEQ ID NO: 2815207 - RNA, 13 nt, Human
acacccagccuca

SEQ ID NO: 2815208 - RNA, 14 nt, Human
acacccagccucag

SEQ ID NO: 2815209 - RNA, 16 nt, Human
acacccagccucaguc

SEQ ID NO: 2815210 - RNA, 12 nt, Human
acacccagccuc

SEQ ID NO: 2815211 - RNA, 17 nt, Human
acacccacucagcuccg

SEQ ID NO: 2815212 - RNA, 16 nt, Human
acaccuugacagggca

SEQ ID NO: 2815213 - RNA, 15 nt, Human
acaccuugacagggc

SEQ ID NO: 2815214 - RNA, 14 nt, Human
acaccuugacaggg

SEQ ID NO: 2815215 - RNA, 18 nt, Human
acaccuucuuauuauaua

SEQ ID NO: 2815216 - RNA, 19 nt, Human
acaccuucuuauuauauau

SEQ ID NO: 2815217 - RNA, 21 nt, Human
acaccuucuuauuauauauau

SEQ ID NO: 2815218 - RNA, 14 nt, Human
acaccugcccugcc

SEQ ID NO: 2815219 - RNA, 13 nt, Human
acaccugcccugc

SEQ ID NO: 2815220 - RNA, 19 nt, Human
uauaaaauaguuguccaua

SEQ ID NO: 2815221 - RNA, 19 nt, Human
uauaaaauauaaacaaaga

SEQ ID NO: 2815222 - RNA, 18 nt, Human
uauaaaauauaaacaaag

SEQ ID NO: 2815223 - RNA, 21 nt, Human
uauaaaaauagauaauuaaaa

SEQ ID NO: 2815224 - RNA, 13 nt, Human
uauaaaaauauau

SEQ ID NO: 2815225 - RNA, 16 nt, Human
uauaaaaauauauaua

SEQ ID NO: 2815226 - RNA, 14 nt, Human
uaguuuucuuguug

SEQ ID NO: 2815227 - RNA, 19 nt, Human
uaguuuucuuguugcuuug

SEQ ID NO: 2815228 - RNA, 13 nt, Human
uaguuauuuugca

SEQ ID NO: 2815229 - RNA, 16 nt, Human
uaguuauaguuucaga

SEQ ID NO: 2815230 - RNA, 15 nt, Human
uaguuauauaauugu

SEQ ID NO: 2815231 - RNA, 12 nt, Human
uaguguucuguu

SEQ ID NO: 2815232 - RNA, 15 nt, Human
uaguguucuguuugu

SEQ ID NO: 2815233 - RNA, 20 nt, Human
uaguuuuuacagcuguguua

SEQ ID NO: 2815234 - RNA, 17 nt, Human
uaguuuuuguaauuuau

SEQ ID NO: 2815235 - RNA, 16 nt, Human
acacaugcuaggaugc

SEQ ID NO: 2815236 - RNA, 12 nt, Human
uauaaaaugugc

SEQ ID NO: 2815237 - RNA, 21 nt, Human
uauaaaaugugcagaugcaau

SEQ ID NO: 2815238 - RNA, 15 nt, Human
uauaaaauuaagcaa

SEQ ID NO: 2815239 - RNA, 12 nt, Human
acacaugcacac

SEQ ID NO: 2815240 - RNA, 13 nt, Human
acacaugcacaca

SEQ ID NO: 2815241 - RNA, 15 nt, Human
acacaugcacacaca

SEQ ID NO: 2815242 - RNA, 14 nt, Human
acacauggaaaccc

SEQ ID NO: 2815243 - RNA, 18 nt, Human
acacauggaaacccauag

SEQ ID NO: 2815244 - RNA, 19 nt, Human
acacauggaaacccauagg

SEQ ID NO: 2815245 - RNA, 13 nt, Human
acacauuguuauu

SEQ ID NO: 2815246 - RNA, 14 nt, Human
acacauuguuauuu

SEQ ID NO: 2815247 - RNA, 22 nt, Human
acacauuguuauuuucagugau

SEQ ID NO: 2815248 - RNA, 23 nt, Human
acacauuagauuuuauuuuacua

SEQ ID NO: 2815249 - RNA, 13 nt, Human
acacccagcccac

SEQ ID NO: 2815250 - RNA, 12 nt, Human
acacccagccca

SEQ ID NO: 2815251 - RNA, 11 nt, Human
acacauuugua

SEQ ID NO: 2815252 - RNA, 12 nt, Human
acacauuuguac

SEQ ID NO: 2815253 - RNA, 13 nt, Human
acacauuuguaca

SEQ ID NO: 2815254 - RNA, 15 nt, Human
acacauuuguacaga

SEQ ID NO: 2815255 - RNA, 18 nt, Human
acacauuuguacagaauu

SEQ ID NO: 2815256 - RNA, 15 nt, Human
acacccacucagcuc

SEQ ID NO: 2815257 - RNA, 13 nt, Human
acacuccagugcc

SEQ ID NO: 2815258 - RNA, 13 nt, Human
acacuccuugcau

SEQ ID NO: 2815259 - RNA, 14 nt, Human
acacuccuugcauc

SEQ ID NO: 2815260 - RNA, 17 nt, Human
acacuccagccugagca

SEQ ID NO: 2815261 - RNA, 16 nt, Human
acacuccagccugagc

SEQ ID NO: 2815262 - RNA, 15 nt, Human
acacuccagccugag

SEQ ID NO: 2815263 - RNA, 14 nt, Human
acacuccagccuga

SEQ ID NO: 2815264 - RNA, 12 nt, Human
acacuccagccu

SEQ ID NO: 2815265 - RNA, 16 nt, Human
acacucugcagacugc

SEQ ID NO: 2815266 - RNA, 19 nt, Human
acacucugccagcaaagag

SEQ ID NO: 2815267 - RNA, 15 nt, Human
acacucuccuugcag

SEQ ID NO: 2815268 - RNA, 17 nt, Human
acacucuccuugcaguu

SEQ ID NO: 2815269 - RNA, 18 nt, Human
acacucuccuugcaguuc

SEQ ID NO: 2815270 - RNA, 22 nt, Human
acacucuccuugcaguucuuga

SEQ ID NO: 2815271 - RNA, 23 nt, Human
acacucuccuugcaguucuugag

SEQ ID NO: 2815272 - RNA, 14 nt, Human
acacucucuggaag

SEQ ID NO: 2815273 - RNA, 23 nt, Human
acacucucuggaagcccuggaga

SEQ ID NO: 2815274 - RNA, 14 nt, Human
uauaagucacaaag

SEQ ID NO: 2815275 - RNA, 15 nt, Human
uauaagucacaaaga

SEQ ID NO: 2815276 - RNA, 15 nt, Human
uauaagguuuuaagu

SEQ ID NO: 2815277 - RNA, 18 nt, Human
uauaaguaacuuuauucu

SEQ ID NO: 2815278 - RNA, 22 nt, Human
uauaaguaacuuuauucuugaa

SEQ ID NO: 2815279 - RNA, 20 nt, Human
uauaagguguuuucugugua

SEQ ID NO: 2815280 - RNA, 21 nt, Human
uauaagguguuuucuguguaa

SEQ ID NO: 2815281 - RNA, 22 nt, Human
uauaagguguuuucuguguaac

SEQ ID NO: 2815282 - RNA, 23 nt, Human
uauaagguguuuucuguguaacc

SEQ ID NO: 2815283 - RNA, 16 nt, Human
uauaaguagcaggcca

SEQ ID NO: 2815284 - RNA, 20 nt, Human
acacucaccaugaagcgaaa

SEQ ID NO: 2815285 - RNA, 14 nt, Human
acacucagaccuga

SEQ ID NO: 2815286 - RNA, 19 nt, Human
acacucagaccugaauucu

SEQ ID NO: 2815287 - RNA, 21 nt, Human
acacucuuuugcuuuauucca

SEQ ID NO: 2815288 - RNA, 13 nt, Human
acacugaaaaauu

SEQ ID NO: 2815289 - RNA, 14 nt, Human
acacugaaaaauua

SEQ ID NO: 2815290 - RNA, 16 nt, Human
acacugaaaaauuaua

SEQ ID NO: 2815291 - RNA, 20 nt, Human
acacucugggcuccagagug

SEQ ID NO: 2815292 - RNA, 22 nt, Human
acacucuucuaugacccagcau

SEQ ID NO: 2815293 - RNA, 15 nt, Human
uauauuuaaugauaa

SEQ ID NO: 2815294 - RNA, 15 nt, Human
uauauuuaacaagau

SEQ ID NO: 2815295 - RNA, 20 nt, Human
uauauuuaagcaacaucuuu

SEQ ID NO: 2815296 - RNA, 13 nt, Human
uauauuuaaacuc

SEQ ID NO: 2815297 - RNA, 14 nt, Human
uauauuuaaacuca

SEQ ID NO: 2815298 - RNA, 13 nt, Human
uauauuauuuggc

SEQ ID NO: 2815299 - RNA, 14 nt, Human
uauauuauuuggca

SEQ ID NO: 2815300 - RNA, 22 nt, Human
uauauuauuuggcaguuuggua

SEQ ID NO: 2815301 - RNA, 12 nt, Human
uauauucaacca

SEQ ID NO: 2815302 - RNA, 13 nt, Human
uauauucaaccau

SEQ ID NO: 2815303 - RNA, 14 nt, Human
uauauucaaccaug

SEQ ID NO: 2815304 - RNA, 21 nt, Human
uauauucaaccauggacuuua

SEQ ID NO: 2815305 - RNA, 14 nt, Human
uauauucauauauu

SEQ ID NO: 2815306 - RNA, 18 nt, Human
uauauucccaauagcaac

SEQ ID NO: 2815307 - RNA, 15 nt, Human
uauauuccuaaacua

SEQ ID NO: 2815308 - RNA, 15 nt, Human
acagacacaggcccg

SEQ ID NO: 2815309 - RNA, 17 nt, Human
acagacacaggcccggc

SEQ ID NO: 2815310 - RNA, 22 nt, Human
acagacacaggcccggcuccag

SEQ ID NO: 2815311 - RNA, 18 nt, Human
acagacacaggcccggcu

SEQ ID NO: 2815312 - RNA, 21 nt, Human
acagacuggaagcacagcuuc

SEQ ID NO: 2815313 - RNA, 19 nt, Human
acagacuggaagcacagcu

SEQ ID NO: 2815314 - RNA, 17 nt, Human
acagacuggaagcacag

SEQ ID NO: 2815315 - RNA, 16 nt, Human
acacuguuguuuaguu

SEQ ID NO: 2815316 - RNA, 20 nt, Human
acacuuguauaaauguauau

SEQ ID NO: 2815317 - RNA, 20 nt, Human
acacuuguuccagcucuuug

SEQ ID NO: 2815318 - RNA, 19 nt, Human
acacuuguuccagcucuuu

SEQ ID NO: 2815319 - RNA, 19 nt, Human
acacuugugauuauaaaau

SEQ ID NO: 2815320 - RNA, 22 nt, Human
acacuugugauuauaaaauuaa

SEQ ID NO: 2815321 - RNA, 17 nt, Human
acagaaacaaaaacacu

SEQ ID NO: 2815322 - RNA, 12 nt, Human
acagaaacaaaa

SEQ ID NO: 2815323 - RNA, 11 nt, Human
acacuuuuaug

SEQ ID NO: 2815324 - RNA, 15 nt, Human
acacuuuucaccucc

SEQ ID NO: 2815325 - RNA, 19 nt, Human
acacuuuucaccuccuuca

SEQ ID NO: 2815326 - RNA, 15 nt, Human
acacuuuggaccuua

SEQ ID NO: 2815327 - RNA, 19 nt, Human
acagaaacacugccuuuuu

SEQ ID NO: 2815328 - RNA, 15 nt, Human
acagaaaccuuuuua

SEQ ID NO: 2815329 - RNA, 20 nt, Human
acagaaaccuuuuuaaaaau

SEQ ID NO: 2815330 - RNA, 18 nt, Human
acagaaacgcauccagca

SEQ ID NO: 2815331 - RNA, 14 nt, Human
acagaaacacugcc

SEQ ID NO: 2815332 - RNA, 13 nt, Human
acagaaacacugc

SEQ ID NO: 2815333 - RNA, 12 nt, Human
acagaaacacug

SEQ ID NO: 2815334 - RNA, 21 nt, Human
acacugaaagcucuguugcaa

SEQ ID NO: 2815335 - RNA, 18 nt, Human
acagaaacacugccuuuu

SEQ ID NO: 2815336 - RNA, 15 nt, Human
acagaaacacugccu

SEQ ID NO: 2815337 - RNA, 17 nt, Human
acagaaaccuauccuca

SEQ ID NO: 2815338 - RNA, 22 nt, Human
acagaaaccuauccucacugcc

SEQ ID NO: 2815339 - RNA, 12 nt, Human
acacuuucucuu

SEQ ID NO: 2815340 - RNA, 16 nt, Human
acacuuugccuccugu

SEQ ID NO: 2815341 - RNA, 19 nt, Human
acacuuugccuccugugua

SEQ ID NO: 2815342 - RNA, 20 nt, Human
acacuuugccuccuguguac

SEQ ID NO: 2815343 - RNA, 23 nt, Human
acacuuugccuccuguguacugu

SEQ ID NO: 2815344 - RNA, 23 nt, Human
acacuuguugauuaauggaaaug

SEQ ID NO: 2815345 - RNA, 20 nt, Human
acacuuguugauuaauggaa

SEQ ID NO: 2815346 - RNA, 13 nt, Human
acagccgcagccu

SEQ ID NO: 2815347 - RNA, 19 nt, Human
acagccgauucaccugagc

SEQ ID NO: 2815348 - RNA, 20 nt, Human
acagccgcagccucccucug

SEQ ID NO: 2815349 - RNA, 23 nt, Human
uaucuuggugaauuuuuuuuucc

SEQ ID NO: 2815350 - RNA, 13 nt, Human
uaucuuguguugu

SEQ ID NO: 2815351 - RNA, 16 nt, Human
uaucuuguguuguccu

SEQ ID NO: 2815352 - RNA, 18 nt, Human
uaucuuguguuguccuuu

SEQ ID NO: 2815353 - RNA, 15 nt, Human
uaucuuguuccaagg

SEQ ID NO: 2815354 - RNA, 13 nt, Human
uaugaaauaaaga

SEQ ID NO: 2815355 - RNA, 14 nt, Human
uaugaaagauugug

SEQ ID NO: 2815356 - RNA, 17 nt, Human
uaugaaagauugugggg

SEQ ID NO: 2815357 - RNA, 23 nt, Human
uaugaaagauggcugugccucug

SEQ ID NO: 2815358 - RNA, 20 nt, Human
uaugaaagauggcugugccu

SEQ ID NO: 2815359 - RNA, 22 nt, Human
uaugaaagauggcugugccucu

SEQ ID NO: 2815360 - RNA, 19 nt, Human
uaugaaagaauauauuuau

SEQ ID NO: 2815361 - RNA, 23 nt, Human
uaugaaagaauauauuuauuuaa

SEQ ID NO: 2815362 - RNA, 15 nt, Human
uaucuuuaagaaaaa

SEQ ID NO: 2815363 - RNA, 23 nt, Human
uaucuuucgugauaaacuuugcu

SEQ ID NO: 2815364 - RNA, 22 nt, Human
acagauggcacuuugaaggggc

SEQ ID NO: 2815365 - RNA, 18 nt, Human
acagaugccuuuuuugua

SEQ ID NO: 2815366 - RNA, 19 nt, Human
acagaugccuuuuuuguag

SEQ ID NO: 2815367 - RNA, 22 nt, Human
acagaugccccagagcuguuua

SEQ ID NO: 2815368 - RNA, 21 nt, Human
acagaugccccagagcuguuu

SEQ ID NO: 2815369 - RNA, 22 nt, Human
acagaugugggcuuugauuucc

SEQ ID NO: 2815370 - RNA, 19 nt, Human
acagauguucccccaucuc

SEQ ID NO: 2815371 - RNA, 21 nt, Human
acagauguucgguuuuuuucc

SEQ ID NO: 2815372 - RNA, 15 nt, Human
acagauucacacugu

SEQ ID NO: 2815373 - RNA, 19 nt, Human
acagauucacacugucugg

SEQ ID NO: 2815374 - RNA, 13 nt, Human
acagauucagucu

SEQ ID NO: 2815375 - RNA, 14 nt, Human
acagauucagucuu

SEQ ID NO: 2815376 - RNA, 15 nt, Human
acagauucagucuug

SEQ ID NO: 2815377 - RNA, 17 nt, Human
acagauucagucuugcc

SEQ ID NO: 2815378 - RNA, 18 nt, Human
acagauucagucuugccu

SEQ ID NO: 2815379 - RNA, 19 nt, Human
acagauucagucuugccuu

SEQ ID NO: 2815380 - RNA, 17 nt, Human
acagauucacacugucu

SEQ ID NO: 2815381 - RNA, 16 nt, Human
acagauucacacuguc

SEQ ID NO: 2815382 - RNA, 13 nt, Human
acagcaaaccaag

SEQ ID NO: 2815383 - RNA, 14 nt, Human
acagcaaaccaaga

SEQ ID NO: 2815384 - RNA, 15 nt, Human
acagcaaaccaagag

SEQ ID NO: 2815385 - RNA, 16 nt, Human
acagcaaaccaagaga

SEQ ID NO: 2815386 - RNA, 17 nt, Human
acagcaaaccaagagau

SEQ ID NO: 2815387 - RNA, 18 nt, Human
acagcaaaccaagagauu

SEQ ID NO: 2815388 - RNA, 21 nt, Human
acagcaaaccaagagauugcu

SEQ ID NO: 2815389 - RNA, 23 nt, Human
acagcaaaccaagagauugcuaa

SEQ ID NO: 2815390 - RNA, 19 nt, Human
acagaugccccagagcugu

SEQ ID NO: 2815391 - RNA, 18 nt, Human
acagaugccccagagcug

SEQ ID NO: 2815392 - RNA, 17 nt, Human
acagaugccccagagcu

SEQ ID NO: 2815393 - RNA, 16 nt, Human
acagaugccccagagc

SEQ ID NO: 2815394 - RNA, 14 nt, Human
acagaugccccaga

SEQ ID NO: 2815395 - RNA, 13 nt, Human
acagaugccccag

SEQ ID NO: 2815396 - RNA, 14 nt, Human
acagauagagaguu

SEQ ID NO: 2815397 - RNA, 15 nt, Human
acagauaauaauggg

SEQ ID NO: 2815398 - RNA, 21 nt, Human
acagauaauaauggguuucuu

SEQ ID NO: 2815399 - RNA, 22 nt, Human
acagauaauaauggguuucuuu

SEQ ID NO: 2815400 - RNA, 14 nt, Human
acagauaaucagug

SEQ ID NO: 2815401 - RNA, 15 nt, Human
acagauacacacaca

SEQ ID NO: 2815402 - RNA, 13 nt, Human
acagauacauuuc

SEQ ID NO: 2815403 - RNA, 12 nt, Human
acagauaccaua

SEQ ID NO: 2815404 - RNA, 15 nt, Human
uaucccggcugcccu

SEQ ID NO: 2815405 - RNA, 24 nt, Human
uauauuuauaacucaucauaaaau

SEQ ID NO: 2815406 - RNA, 23 nt, Human
uauauuuauaacucaucauaaaa

SEQ ID NO: 2815407 - RNA, 22 nt, Human
uauauuuauaacucaucauaaa

SEQ ID NO: 2815408 - RNA, 11 nt, Human
uauauuuaaug

SEQ ID NO: 2815409 - RNA, 21 nt, Human
uauauuuauaacucaucauaa

SEQ ID NO: 2815410 - RNA, 16 nt, Human
uauauuuaaugcauua

SEQ ID NO: 2815411 - RNA, 19 nt, Human
uauauuuaaugcauuaaac

SEQ ID NO: 2815412 - RNA, 22 nt, Human
uauauuuaaugcauuaaaccug

SEQ ID NO: 2815413 - RNA, 15 nt, Human
uauauuuaauuauua

SEQ ID NO: 2815414 - RNA, 13 nt, Human
uaucccugcccau

SEQ ID NO: 2815415 - RNA, 10 nt, Human
uaucccuucc

SEQ ID NO: 2815416 - RNA, 16 nt, Human
uaucccggcugcccuu

SEQ ID NO: 2815417 - RNA, 15 nt, Human
uauccuacaacaaga

SEQ ID NO: 2815418 - RNA, 19 nt, Human
uauccuacaacaagaguuu

SEQ ID NO: 2815419 - RNA, 17 nt, Human
uauccuagcacaugcuu

SEQ ID NO: 2815420 - RNA, 19 nt, Human
uauccuagcacaugcuuca

SEQ ID NO: 2815421 - RNA, 20 nt, Human
uauccuagcacaugcuucaa

SEQ ID NO: 2815422 - RNA, 22 nt, Human
uauccuagcacaugcuucaaua

SEQ ID NO: 2815423 - RNA, 24 nt, Human
uauccuagcacaugcuucaauagu

SEQ ID NO: 2815424 - RNA, 13 nt, Human
uauccuauuucag

SEQ ID NO: 2815425 - RNA, 14 nt, Human
uauccuauuucagu

SEQ ID NO: 2815426 - RNA, 13 nt, Human
uauccucacugcc

SEQ ID NO: 2815427 - RNA, 16 nt, Human
uauccucacugcccuc

SEQ ID NO: 2815428 - RNA, 17 nt, Human
uauccuacuuccccuuc

SEQ ID NO: 2815429 - RNA, 14 nt, Human
uauccuacuucccc

SEQ ID NO: 2815430 - RNA, 16 nt, Human
uaucucacuugugcca

SEQ ID NO: 2815431 - RNA, 19 nt, Human
acagaggaaacaauauuua

SEQ ID NO: 2815432 - RNA, 23 nt, Human
acagaggaaacaauauuuauaaa

SEQ ID NO: 2815433 - RNA, 19 nt, Human
acagaggaagaauuuguua

SEQ ID NO: 2815434 - RNA, 20 nt, Human
acagaggaagaauuuguuau

SEQ ID NO: 2815435 - RNA, 22 nt, Human
acagagcugucacuuuugcucc

SEQ ID NO: 2815436 - RNA, 12 nt, Human
acagagcugugg

SEQ ID NO: 2815437 - RNA, 22 nt, Human
acagagcuguggaggauugcua

SEQ ID NO: 2815438 - RNA, 17 nt, Human
acagagauugaacucca

SEQ ID NO: 2815439 - RNA, 20 nt, Human
acagagauugaacuccaaga

SEQ ID NO: 2815440 - RNA, 20 nt, Human
acagagcacuagguucaauu

SEQ ID NO: 2815441 - RNA, 22 nt, Human
acagagcacuagguucaauucc

SEQ ID NO: 2815442 - RNA, 20 nt, Human
uaucucuauuuaauauuuau

SEQ ID NO: 2815443 - RNA, 17 nt, Human
uaucucuauuuaauauu

SEQ ID NO: 2815444 - RNA, 18 nt, Human
uaucucuauuuaauauuu

SEQ ID NO: 2815445 - RNA, 16 nt, Human
uaucucuauuuaauau

SEQ ID NO: 2815446 - RNA, 12 nt, Human
uaucucucugug

SEQ ID NO: 2815447 - RNA, 13 nt, Human
uaucucucugugc

SEQ ID NO: 2815448 - RNA, 15 nt, Human
uaucucugaagcaug

SEQ ID NO: 2815449 - RNA, 16 nt, Human
uaucucugaagcaugu

SEQ ID NO: 2815450 - RNA, 17 nt, Human
uaucucugaagcauguu

SEQ ID NO: 2815451 - RNA, 23 nt, Human
uaucucugaagcauguuucaugu

SEQ ID NO: 2815452 - RNA, 18 nt, Human
uaucucugaagcauguuu

SEQ ID NO: 2815453 - RNA, 23 nt, Human
uaucucugugugcacaaauauuu

SEQ ID NO: 2815454 - RNA, 18 nt, Human
uaucucugugugcacaaa

SEQ ID NO: 2815455 - RNA, 17 nt, Human
uaucucugugugcacaa

SEQ ID NO: 2815456 - RNA, 16 nt, Human
uaucucugugugcaca

SEQ ID NO: 2815457 - RNA, 11 nt, Human
uaucucugugu

SEQ ID NO: 2815458 - RNA, 18 nt, Human
acaugcuaggaugcggaa

SEQ ID NO: 2815459 - RNA, 14 nt, Human
ucaaauaaaaauaa

SEQ ID NO: 2815460 - RNA, 23 nt, Human
ucaaauaaaacuagugacagcuu

SEQ ID NO: 2815461 - RNA, 22 nt, Human
ucaaaguuuugaaaagcuauua

SEQ ID NO: 2815462 - RNA, 17 nt, Human
ucaaauaaguauuuaua

SEQ ID NO: 2815463 - RNA, 20 nt, Human
ucaaauaaguauuuauaaua

SEQ ID NO: 2815464 - RNA, 18 nt, Human
ucaaauaaguauuuauaa

SEQ ID NO: 2815465 - RNA, 19 nt, Human
ucaaauaaguauuuauaau

SEQ ID NO: 2815466 - RNA, 15 nt, Human
ucaaagccacacucu

SEQ ID NO: 2815467 - RNA, 15 nt, Human
ucaaagccacauuau

SEQ ID NO: 2815468 - RNA, 17 nt, Human
ucaaagccacauuauuu

SEQ ID NO: 2815469 - RNA, 18 nt, Human
ucaaagccacauuauuuc

SEQ ID NO: 2815470 - RNA, 20 nt, Human
ucaaagccacauuauuucua

SEQ ID NO: 2815471 - RNA, 21 nt, Human
ucaaagccacauuauuucuag

SEQ ID NO: 2815472 - RNA, 14 nt, Human
ucaaagcauagaug

SEQ ID NO: 2815473 - RNA, 16 nt, Human
ucaaacacugcaggca

SEQ ID NO: 2815474 - RNA, 14 nt, Human
ucaaacacugcagg

SEQ ID NO: 2815475 - RNA, 10 nt, Human
ucaaagcaga

SEQ ID NO: 2815476 - RNA, 19 nt, Human
ucaaaauuguuuaaaaauu

SEQ ID NO: 2815477 - RNA, 22 nt, Human
ucaaaauuguuuaaaaauucuu

SEQ ID NO: 2815478 - RNA, 22 nt, Human
ucaaaauguuaucuucucaagu

SEQ ID NO: 2815479 - RNA, 14 nt, Human
ucaaaauuaaaucu

SEQ ID NO: 2815480 - RNA, 15 nt, Human
ucaaaauuaaaucug

SEQ ID NO: 2815481 - RNA, 19 nt, Human
ucaaacaaacucucugaac

SEQ ID NO: 2815482 - RNA, 15 nt, Human
ucaaacaacacuggu

SEQ ID NO: 2815483 - RNA, 17 nt, Human
ucaaacaacacuggugu

SEQ ID NO: 2815484 - RNA, 13 nt, Human
ucaaacaagaaug

SEQ ID NO: 2815485 - RNA, 14 nt, Human
ucaaacaagaaugu

SEQ ID NO: 2815486 - RNA, 14 nt, Human
ucaaacacaaaugc

SEQ ID NO: 2815487 - RNA, 12 nt, Human
ucaaacacugca

SEQ ID NO: 2815488 - RNA, 15 nt, Human
ucaaacacaaaugca

SEQ ID NO: 2815489 - RNA, 16 nt, Human
ucaaacacaaaugcag

SEQ ID NO: 2815490 - RNA, 17 nt, Human
ucaaacacaaaugcagg

SEQ ID NO: 2815491 - RNA, 22 nt, Human
ucaaaguuuccuaaucagaaau

SEQ ID NO: 2815492 - RNA, 13 nt, Human
ucaaaguuuugaa

SEQ ID NO: 2815493 - RNA, 14 nt, Human
ucaaaguuuugaaa

SEQ ID NO: 2815494 - RNA, 15 nt, Human
ucaaaguuuugaaaa

SEQ ID NO: 2815495 - RNA, 17 nt, Human
ucaaaguuuugaaaagc

SEQ ID NO: 2815496 - RNA, 18 nt, Human
ucaaaguuuugaaaagcu

SEQ ID NO: 2815497 - RNA, 19 nt, Human
ucaaaguuuugaaaagcua

SEQ ID NO: 2815498 - RNA, 20 nt, Human
ucaaaguuuugaaaagcuau

SEQ ID NO: 2815499 - RNA, 15 nt, Human
ucaaagcuuuuucca

SEQ ID NO: 2815500 - RNA, 17 nt, Human
ucaaagggacggucagu

SEQ ID NO: 2815501 - RNA, 19 nt, Human
ucaaagggacggucaguuu

SEQ ID NO: 2815502 - RNA, 16 nt, Human
ucaaagcuuuuuccag

SEQ ID NO: 2815503 - RNA, 19 nt, Human
ucaaagcucacaccaaauu

SEQ ID NO: 2815504 - RNA, 15 nt, Human
ucaaagccagggucu

SEQ ID NO: 2815505 - RNA, 12 nt, Human
ucaaagcauuua

SEQ ID NO: 2815506 - RNA, 18 nt, Human
ucaaaagaaaaggcaaaa

SEQ ID NO: 2815507 - RNA, 22 nt, Human
uauuuuugaaaggcauguuccu

SEQ ID NO: 2815508 - RNA, 17 nt, Human
ucaaaacuugguauuuu

SEQ ID NO: 2815509 - RNA, 21 nt, Human
uauuuuuauauuuaguuauag

SEQ ID NO: 2815510 - RNA, 21 nt, Human
uauuuuuauacucuuccuauu

SEQ ID NO: 2815511 - RNA, 20 nt, Human
uauuuuucuacauuauugcu

SEQ ID NO: 2815512 - RNA, 12 nt, Human
uauuuuuaucca

SEQ ID NO: 2815513 - RNA, 14 nt, Human
uauuuuucucauga

SEQ ID NO: 2815514 - RNA, 17 nt, Human
uauuugugcuauaguau

SEQ ID NO: 2815515 - RNA, 18 nt, Human
uauuugugcuauaguauu

SEQ ID NO: 2815516 - RNA, 21 nt, Human
uauuugugcuauaguauuuga

SEQ ID NO: 2815517 - RNA, 22 nt, Human
uauuuuuauaaauauaagccuu

SEQ ID NO: 2815518 - RNA, 17 nt, Human
uauuuuuauacaaaccu

SEQ ID NO: 2815519 - RNA, 19 nt, Human
uauuuuuagacucaucaau

SEQ ID NO: 2815520 - RNA, 18 nt, Human
uauuuuuauauaauaucu

SEQ ID NO: 2815521 - RNA, 19 nt, Human
uauuuuuauauaauaucua

SEQ ID NO: 2815522 - RNA, 22 nt, Human
uauuuuuauauaauaucuaaag

SEQ ID NO: 2815523 - RNA, 23 nt, Human
uauuuuuauauaauaucuaaagu

SEQ ID NO: 2815524 - RNA, 13 nt, Human
uauuuguguauuu

SEQ ID NO: 2815525 - RNA, 15 nt, Human
uauuuguguauuuaa

SEQ ID NO: 2815526 - RNA, 12 nt, Human
uauuuguggaau

SEQ ID NO: 2815527 - RNA, 14 nt, Human
uauuuguggaauaa

SEQ ID NO: 2815528 - RNA, 13 nt, Human
uauuuguguaaua

SEQ ID NO: 2815529 - RNA, 14 nt, Human
uauuuguguaauag

SEQ ID NO: 2815530 - RNA, 17 nt, Human
uauuuguguauuuaaca

SEQ ID NO: 2815531 - RNA, 18 nt, Human
uauuuguguauuuaacag

SEQ ID NO: 2815532 - RNA, 17 nt, Human
uauuuguguaauagaaa

SEQ ID NO: 2815533 - RNA, 12 nt, Human
ucaaaauaaaaa

SEQ ID NO: 2815534 - RNA, 15 nt, Human
ucaaaaguuggacua

SEQ ID NO: 2815535 - RNA, 17 nt, Human
ucaaaaguuggacuaaa

SEQ ID NO: 2815536 - RNA, 18 nt, Human
ucaaaaguuggacuaaau

SEQ ID NO: 2815537 - RNA, 20 nt, Human
ucaaaaguuggacuaaaugc

SEQ ID NO: 2815538 - RNA, 22 nt, Human
ucaaaaguuccaagagucuaaa

SEQ ID NO: 2815539 - RNA, 13 nt, Human
ucaaaagcauuua

SEQ ID NO: 2815540 - RNA, 17 nt, Human
ucaaaagcauuuaucau

SEQ ID NO: 2815541 - RNA, 15 nt, Human
ucaaaagcuggauua

SEQ ID NO: 2815542 - RNA, 13 nt, Human
ucaaaagacaugu

SEQ ID NO: 2815543 - RNA, 17 nt, Human
ucaaaagacauguugua

SEQ ID NO: 2815544 - RNA, 21 nt, Human
ucaaaagacauguuguaaauu

SEQ ID NO: 2815545 - RNA, 20 nt, Human
ucaaaagagaaaaacaaaac

SEQ ID NO: 2815546 - RNA, 23 nt, Human
ucaaaauaaaaagugacacagca

SEQ ID NO: 2815547 - RNA, 13 nt, Human
ucaaaauaauucu

SEQ ID NO: 2815548 - RNA, 14 nt, Human
ucaaaauagaaaag

SEQ ID NO: 2815549 - RNA, 15 nt, Human
ucaaaauagaaaagu

SEQ ID NO: 2815550 - RNA, 19 nt, Human
ucaaaauagaaaaguuauu

SEQ ID NO: 2815551 - RNA, 20 nt, Human
ucaaaauaaaaagugacaca

SEQ ID NO: 2815552 - RNA, 21 nt, Human
ucaaaauaaaaagugacacag

SEQ ID NO: 2815553 - RNA, 15 nt, Human
ucaaaauauuacuca

SEQ ID NO: 2815554 - RNA, 14 nt, Human
ucaaaaugucuaag

SEQ ID NO: 2815555 - RNA, 20 nt, Human
ucaaaauguuaucuucucaa

SEQ ID NO: 2815556 - RNA, 21 nt, Human
ucaaaauguuaucuucucaag

SEQ ID NO: 2815557 - RNA, 19 nt, Human
ucaaaaugcuuuuuauuuc

SEQ ID NO: 2815558 - RNA, 13 nt, Human
ucaaaauguauau

SEQ ID NO: 2815559 - RNA, 14 nt, Human
ucaaaauguauaua

SEQ ID NO: 2815560 - RNA, 22 nt, Human
ucaaaauguauauauuuagugc

SEQ ID NO: 2815561 - RNA, 17 nt, Human
ucaaaaugcuuuuuauu

SEQ ID NO: 2815562 - RNA, 12 nt, Human
ucaaaaugcuuu

SEQ ID NO: 2815563 - RNA, 16 nt, Human
ucaaaauccaaaaaga

SEQ ID NO: 2815564 - RNA, 18 nt, Human
ucaaaauauuuguacaua

SEQ ID NO: 2815565 - RNA, 19 nt, Human
ucaaaauauuuguacauag

SEQ ID NO: 2815566 - RNA, 18 nt, Human
ucaaaauauuuuuaaaag

SEQ ID NO: 2815567 - RNA, 19 nt, Human
ucaaaauauuuuuaaaaga

SEQ ID NO: 2815568 - RNA, 20 nt, Human
ucaaaauauuuuuaaaagau

SEQ ID NO: 2815569 - RNA, 23 nt, Human
ucaaaauauuuuuaaaagaucuu

SEQ ID NO: 2815570 - RNA, 17 nt, Human
ucaaaauauuuguacau

SEQ ID NO: 2815571 - RNA, 16 nt, Human
ucaaaauauuuguaca

SEQ ID NO: 2815572 - RNA, 12 nt, Human
ucaaaauauuua

SEQ ID NO: 2815573 - RNA, 13 nt, Human
ucaaaauauuuaa

SEQ ID NO: 2815574 - RNA, 14 nt, Human
ucaaaauauuuaaa

SEQ ID NO: 2815575 - RNA, 15 nt, Human
ucaaaauauuuaaaa

SEQ ID NO: 2815576 - RNA, 19 nt, Human
ucaaaauauuuaaaaaugu

SEQ ID NO: 2815577 - RNA, 20 nt, Human
ucaaaauauuuaaaaauguc

SEQ ID NO: 2815578 - RNA, 21 nt, Human
ucaaaauauuuaaaaaugucu

SEQ ID NO: 2815579 - RNA, 22 nt, Human
ucaaaauauuuaaaaaugucuu

SEQ ID NO: 2815580 - RNA, 23 nt, Human
ucaaaauauuuaaaaaugucuug

SEQ ID NO: 2815581 - RNA, 23 nt, Human
ucaaaauccaaaaagaaaugaug

SEQ ID NO: 2815582 - RNA, 16 nt, Human
ucaaaauccuuccaaa

SEQ ID NO: 2815583 - RNA, 18 nt, Human
ucaaaauccuuccaaaga

SEQ ID NO: 2815584 - RNA, 19 nt, Human
ucaaaauccuuccaaagaa

SEQ ID NO: 2815585 - RNA, 12 nt, Human
ucaaaaugcuuc

SEQ ID NO: 2815586 - RNA, 17 nt, Human
ucaagaugucagacugg

SEQ ID NO: 2815587 - RNA, 13 nt, Human
ucaagagcugccc

SEQ ID NO: 2815588 - RNA, 16 nt, Human
ucaagagcugcccucc

SEQ ID NO: 2815589 - RNA, 15 nt, Human
ucaagagcacacuug

SEQ ID NO: 2815590 - RNA, 17 nt, Human
ucaaggcuuauauucaa

SEQ ID NO: 2815591 - RNA, 18 nt, Human
ucaaggcuuauauucaac

SEQ ID NO: 2815592 - RNA, 20 nt, Human
ucaaggcuuauauucaacca

SEQ ID NO: 2815593 - RNA, 14 nt, Human
ucaaggcuucaguc

SEQ ID NO: 2815594 - RNA, 17 nt, Human
ucaaggcuucagucuca

SEQ ID NO: 2815595 - RNA, 14 nt, Human
ucaaggcuuccacu

SEQ ID NO: 2815596 - RNA, 18 nt, Human
ucaagaugucagacuggc

SEQ ID NO: 2815597 - RNA, 17 nt, Human
ucaagggcuuacuauuu

SEQ ID NO: 2815598 - RNA, 18 nt, Human
ucaagggcuuacuauuuc

SEQ ID NO: 2815599 - RNA, 15 nt, Human
ucaagggacaaggac

SEQ ID NO: 2815600 - RNA, 13 nt, Human
ucaaggggucacu

SEQ ID NO: 2815601 - RNA, 14 nt, Human
ucaaggggucacuu

SEQ ID NO: 2815602 - RNA, 12 nt, Human
ucaaguauuugg

SEQ ID NO: 2815603 - RNA, 12 nt, Human
ucaaguauuuug

SEQ ID NO: 2815604 - RNA, 20 nt, Human
ucaaguauuuuguguuugga

SEQ ID NO: 2815605 - RNA, 21 nt, Human
ucaaguagcugggauuuuaaa

SEQ ID NO: 2815606 - RNA, 16 nt, Human
ucaagggugcgucugg

SEQ ID NO: 2815607 - RNA, 19 nt, Human
ucaagacuggaaggugggg

SEQ ID NO: 2815608 - RNA, 20 nt, Human
ucaagacuggaaggugggga

SEQ ID NO: 2815609 - RNA, 14 nt, Human
ucaagacauagcau

SEQ ID NO: 2815610 - RNA, 20 nt, Human
ucaagacauagcauccaagu

SEQ ID NO: 2815611 - RNA, 21 nt, Human
ucaagacauagcauccaagug

SEQ ID NO: 2815612 - RNA, 21 nt, Human
ucaagaaagcuucaaacugca

SEQ ID NO: 2815613 - RNA, 23 nt, Human
ucaagaagcaggcuacacugaca

SEQ ID NO: 2815614 - RNA, 14 nt, Human
ucaagaagaaaaag

SEQ ID NO: 2815615 - RNA, 18 nt, Human
ucaagaagaaaaagguuu

SEQ ID NO: 2815616 - RNA, 15 nt, Human
ucaacaucuuuuaca

SEQ ID NO: 2815617 - RNA, 14 nt, Human
ucaacaugaaacac

SEQ ID NO: 2815618 - RNA, 15 nt, Human
ucaacaugaaacacc

SEQ ID NO: 2815619 - RNA, 23 nt, Human
ucaagaaacugaggaauuuucuu

SEQ ID NO: 2815620 - RNA, 22 nt, Human
ucaagaaacugaggaauuuucu

SEQ ID NO: 2815621 - RNA, 20 nt, Human
ucaagaaacugaggaauuuu

SEQ ID NO: 2815622 - RNA, 18 nt, Human
ucaagaaacugaggaauu

SEQ ID NO: 2815623 - RNA, 17 nt, Human
ucaagaaacugaggaau

SEQ ID NO: 2815624 - RNA, 13 nt, Human
ucaagaaacugag

SEQ ID NO: 2815625 - RNA, 12 nt, Human
ucaagaaacuga

SEQ ID NO: 2815626 - RNA, 13 nt, Human
ucaacaucacuga

SEQ ID NO: 2815627 - RNA, 15 nt, Human
ucaacaucacugaaa

SEQ ID NO: 2815628 - RNA, 17 nt, Human
ucaacaucacugaaacc

SEQ ID NO: 2815629 - RNA, 14 nt, Human
ucaacauccugcca

SEQ ID NO: 2815630 - RNA, 15 nt, Human
ucaacauccugccag

SEQ ID NO: 2815631 - RNA, 16 nt, Human
ucaacauccugccagc

SEQ ID NO: 2815632 - RNA, 17 nt, Human
ucaacauccugccagcc

SEQ ID NO: 2815633 - RNA, 18 nt, Human
ucaacauccugccagccc

SEQ ID NO: 2815634 - RNA, 20 nt, Human
ucaacauccugccagcccca

SEQ ID NO: 2815635 - RNA, 23 nt, Human
ucaacauaacccacuugucacug

SEQ ID NO: 2815636 - RNA, 19 nt, Human
acauguccuaauucuucug

SEQ ID NO: 2815637 - RNA, 20 nt, Human
acauguccuaauucuucugu

SEQ ID NO: 2815638 - RNA, 22 nt, Human
acauguccuaauucuucugucc

SEQ ID NO: 2815639 - RNA, 22 nt, Human
acauuaaauuuuuuuuacauuu

SEQ ID NO: 2815640 - RNA, 12 nt, Human
acauuaaauguc

SEQ ID NO: 2815641 - RNA, 13 nt, Human
acauuaaaugucu

SEQ ID NO: 2815642 - RNA, 14 nt, Human
acauuaaaugucuu

SEQ ID NO: 2815643 - RNA, 17 nt, Human
acauuaaaugucuuaua

SEQ ID NO: 2815644 - RNA, 16 nt, Human
acaugcuggccagccu

SEQ ID NO: 2815645 - RNA, 19 nt, Human
acaugcuggccagccuggg

SEQ ID NO: 2815646 - RNA, 14 nt, Human
acaugcugaagcca

SEQ ID NO: 2815647 - RNA, 17 nt, Human
acaugcugaagccaaag

SEQ ID NO: 2815648 - RNA, 19 nt, Human
acauuagauuuuauuuuac

SEQ ID NO: 2815649 - RNA, 14 nt, Human
acauuaguaaaugu

SEQ ID NO: 2815650 - RNA, 15 nt, Human
acauuaguaaauguc

SEQ ID NO: 2815651 - RNA, 16 nt, Human
acauuaguaaaugucu

SEQ ID NO: 2815652 - RNA, 17 nt, Human
acauuaguaaaugucuu

SEQ ID NO: 2815653 - RNA, 18 nt, Human
acauuaguaaaugucuuu

SEQ ID NO: 2815654 - RNA, 19 nt, Human
acauuaguaaaugucuuug

SEQ ID NO: 2815655 - RNA, 20 nt, Human
acauuaguaaaugucuuugu

SEQ ID NO: 2815656 - RNA, 21 nt, Human
acauuaguaaaugucuuugua

SEQ ID NO: 2815657 - RNA, 22 nt, Human
acauuaguaaaugucuuuguaa

SEQ ID NO: 2815658 - RNA, 23 nt, Human
acauuaguaaaugucuuuguaag

SEQ ID NO: 2815659 - RNA, 24 nt, Human
acauuaguaaaugucuuuguaagu

SEQ ID NO: 2815660 - RNA, 11 nt, Human
acauuauaaac

SEQ ID NO: 2815661 - RNA, 14 nt, Human
acauuauaaacgcu

SEQ ID NO: 2815662 - RNA, 15 nt, Human
acauuauaaacgcuu

SEQ ID NO: 2815663 - RNA, 15 nt, Human
acauucaugccuggc

SEQ ID NO: 2815664 - RNA, 15 nt, Human
acauucagcugaggu

SEQ ID NO: 2815665 - RNA, 20 nt, Human
acauucagcugagguucauu

SEQ ID NO: 2815666 - RNA, 21 nt, Human
acauucagcugagguucauua

SEQ ID NO: 2815667 - RNA, 22 nt, Human
acauucagcugagguucauuac

SEQ ID NO: 2815668 - RNA, 12 nt, Human
acauucaauguu

SEQ ID NO: 2815669 - RNA, 13 nt, Human
acauuaagaaugu

SEQ ID NO: 2815670 - RNA, 14 nt, Human
acauuaagaauguu

SEQ ID NO: 2815671 - RNA, 15 nt, Human
acauuaagaauguug

SEQ ID NO: 2815672 - RNA, 19 nt, Human
acauuaagaauguugguuu

SEQ ID NO: 2815673 - RNA, 18 nt, Human
acauuagcaguuugcuuu

SEQ ID NO: 2815674 - RNA, 22 nt, Human
acauuagcaguuugcuuuguau

SEQ ID NO: 2815675 - RNA, 16 nt, Human
acauucaugccuggcu

SEQ ID NO: 2815676 - RNA, 16 nt, Human
acauuccaagacucua

SEQ ID NO: 2815677 - RNA, 19 nt, Human
acauucugauuuggaaaaa

SEQ ID NO: 2815678 - RNA, 18 nt, Human
ucaacagcuaugcuggua

SEQ ID NO: 2815679 - RNA, 23 nt, Human
ucaacaggggcgugaggucccag

SEQ ID NO: 2815680 - RNA, 16 nt, Human
ucaacagcuaugcugg

SEQ ID NO: 2815681 - RNA, 22 nt, Human
ucaacagauuauuuuggaaagu

SEQ ID NO: 2815682 - RNA, 18 nt, Human
ucaacacucccuucccau

SEQ ID NO: 2815683 - RNA, 23 nt, Human
ucaacacuaccagcguauauaua

SEQ ID NO: 2815684 - RNA, 15 nt, Human
ucaacaccccugugu

SEQ ID NO: 2815685 - RNA, 14 nt, Human
ucaacaauaaaaca

SEQ ID NO: 2815686 - RNA, 15 nt, Human
ucaacaauaaaacau

SEQ ID NO: 2815687 - RNA, 20 nt, Human
acaugaucuguuuuucacca

SEQ ID NO: 2815688 - RNA, 14 nt, Human
ucaacaauuugggc

SEQ ID NO: 2815689 - RNA, 22 nt, Human
ucaacaauuugggcuuccuguu

SEQ ID NO: 2815690 - RNA, 14 nt, Human
ucaacagaagcauu

SEQ ID NO: 2815691 - RNA, 15 nt, Human
ucaacagaagcauuu

SEQ ID NO: 2815692 - RNA, 18 nt, Human
ucaacagaagcauuugua

SEQ ID NO: 2815693 - RNA, 20 nt, Human
ucaacagaagcauuuguauu

SEQ ID NO: 2815694 - RNA, 21 nt, Human
ucaacagaagcauuuguauuu

SEQ ID NO: 2815695 - RNA, 22 nt, Human
ucaacagaagcauuuguauuuu

SEQ ID NO: 2815696 - RNA, 12 nt, Human
ucaacagaauga

SEQ ID NO: 2815697 - RNA, 13 nt, Human
ucaacagaaugaa

SEQ ID NO: 2815698 - RNA, 14 nt, Human
ucaacagaaugaaa

SEQ ID NO: 2815699 - RNA, 15 nt, Human
ucaacagaaugaaaa

SEQ ID NO: 2815700 - RNA, 19 nt, Human
ucaacagaaugaaaaauga

SEQ ID NO: 2815701 - RNA, 22 nt, Human
ucaacagaaugaaaaaugaaag

SEQ ID NO: 2815702 - RNA, 23 nt, Human
ucaacagaaugaaaaaugaaaga

SEQ ID NO: 2815703 - RNA, 12 nt, Human
acaguuuuaugc

SEQ ID NO: 2815704 - RNA, 13 nt, Human
acaguuuuaugcu

SEQ ID NO: 2815705 - RNA, 16 nt, Human
acaguuuuaugcucuu

SEQ ID NO: 2815706 - RNA, 19 nt, Human
acaguuuuaugcucuuuuu

SEQ ID NO: 2815707 - RNA, 20 nt, Human
acaguuuuaugcucuuuuuu

SEQ ID NO: 2815708 - RNA, 14 nt, Human
acaguuugucacau

SEQ ID NO: 2815709 - RNA, 23 nt, Human
acaguuuugucagucuuucuuag

SEQ ID NO: 2815710 - RNA, 13 nt, Human
acaguuuugagaa

SEQ ID NO: 2815711 - RNA, 20 nt, Human
acaguuuugagaacguaaag

SEQ ID NO: 2815712 - RNA, 21 nt, Human
acauacccuggccgcccccug

SEQ ID NO: 2815713 - RNA, 14 nt, Human
acauacggucaggu

SEQ ID NO: 2815714 - RNA, 20 nt, Human
acauacggucagguuuaaca

SEQ ID NO: 2815715 - RNA, 21 nt, Human
acauacggucagguuuaacau

SEQ ID NO: 2815716 - RNA, 22 nt, Human
acauacggucagguuuaacauu

SEQ ID NO: 2815717 - RNA, 20 nt, Human
acauaccuggguauguguag

SEQ ID NO: 2815718 - RNA, 16 nt, Human
acauaccuuuuauuuu

SEQ ID NO: 2815719 - RNA, 14 nt, Human
acauacgaaacaca

SEQ ID NO: 2815720 - RNA, 17 nt, Human
acauacgaaacacaaac

SEQ ID NO: 2815721 - RNA, 15 nt, Human
acauaccagcuuaga

SEQ ID NO: 2815722 - RNA, 19 nt, Human
acaguuuuuaacucuacug

SEQ ID NO: 2815723 - RNA, 20 nt, Human
acauacaguuuuaugcucuu

SEQ ID NO: 2815724 - RNA, 20 nt, Human
acauacccuggccgcccccu

SEQ ID NO: 2815725 - RNA, 18 nt, Human
acauacuggccuggacug

SEQ ID NO: 2815726 - RNA, 19 nt, Human
acauacuggccuggacugu

SEQ ID NO: 2815727 - RNA, 22 nt, Human
acauacuuucauccugacucug

SEQ ID NO: 2815728 - RNA, 17 nt, Human
acauagaaaguucaugg

SEQ ID NO: 2815729 - RNA, 23 nt, Human
acauacuuucauccugacucugc

SEQ ID NO: 2815730 - RNA, 18 nt, Human
uaugaagaaacgcaacaa

SEQ ID NO: 2815731 - RNA, 18 nt, Human
uauuuccauucaacaaga

SEQ ID NO: 2815732 - RNA, 22 nt, Human
uauuuccaguguucuaugaaca

SEQ ID NO: 2815733 - RNA, 18 nt, Human
uauuucauuuuuugcauc

SEQ ID NO: 2815734 - RNA, 14 nt, Human
uaugaaauaaagaa

SEQ ID NO: 2815735 - RNA, 19 nt, Human
uaugaaauaaagaaauugc

SEQ ID NO: 2815736 - RNA, 15 nt, Human
uauuucccuccccug

SEQ ID NO: 2815737 - RNA, 20 nt, Human
uauuucccuccccuggggac

SEQ ID NO: 2815738 - RNA, 21 nt, Human
uauuucccauuugugccagag

SEQ ID NO: 2815739 - RNA, 15 nt, Human
uauuucccuaaaaua

SEQ ID NO: 2815740 - RNA, 16 nt, Human
uauuucccuaaaauac

SEQ ID NO: 2815741 - RNA, 19 nt, Human
uauuucccuaaaauacauu

SEQ ID NO: 2815742 - RNA, 20 nt, Human
uauuucccuaaaauacauuu

SEQ ID NO: 2815743 - RNA, 21 nt, Human
uauuucccuaaaauacauuua

SEQ ID NO: 2815744 - RNA, 15 nt, Human
uauuucgaaagcugc

SEQ ID NO: 2815745 - RNA, 18 nt, Human
uauuuccuggauguuugg

SEQ ID NO: 2815746 - RNA, 19 nt, Human
uauuucuagggcugggaaa

SEQ ID NO: 2815747 - RNA, 17 nt, Human
uauuucuaguccaaaau

SEQ ID NO: 2815748 - RNA, 21 nt, Human
uauuucuaguccaaaauuaca

SEQ ID NO: 2815749 - RNA, 18 nt, Human
acaguugcagcccuugug

SEQ ID NO: 2815750 - RNA, 19 nt, Human
acaguugccaccaccucug

SEQ ID NO: 2815751 - RNA, 20 nt, Human
acaguugccaccaccucugu

SEQ ID NO: 2815752 - RNA, 21 nt, Human
acaguugccaccaccucugug

SEQ ID NO: 2815753 - RNA, 22 nt, Human
acaguugccaccaccucugugg

SEQ ID NO: 2815754 - RNA, 23 nt, Human
acaguugccaccaccucuguggc

SEQ ID NO: 2815755 - RNA, 16 nt, Human
acaguuggccuucaga

SEQ ID NO: 2815756 - RNA, 17 nt, Human
acaguugucuagagaua

SEQ ID NO: 2815757 - RNA, 20 nt, Human
acaguugucuagagauauau

SEQ ID NO: 2815758 - RNA, 22 nt, Human
acaguuucuuagcuuuuuaauu

SEQ ID NO: 2815759 - RNA, 15 nt, Human
acaguuugaacaaaa

SEQ ID NO: 2815760 - RNA, 16 nt, Human
acaguuugaugucauu

SEQ ID NO: 2815761 - RNA, 20 nt, Human
acaguuugaugucauuaaug

SEQ ID NO: 2815762 - RNA, 14 nt, Human
acaguuugcucuag

SEQ ID NO: 2815763 - RNA, 13 nt, Human
acaguuuguaaau

SEQ ID NO: 2815764 - RNA, 16 nt, Human
acaguuuguaaauguu

SEQ ID NO: 2815765 - RNA, 17 nt, Human
acaguuuguaaauguua

SEQ ID NO: 2815766 - RNA, 18 nt, Human
acaguuuguaaauguuau

SEQ ID NO: 2815767 - RNA, 19 nt, Human
acaguuuguaaauguuauu

SEQ ID NO: 2815768 - RNA, 22 nt, Human
acaguuuguaaauguuauuucu

SEQ ID NO: 2815769 - RNA, 12 nt, Human
acaguuucuuag

SEQ ID NO: 2815770 - RNA, 14 nt, Human
acaguuucuuagcu

SEQ ID NO: 2815771 - RNA, 16 nt, Human
acaguuucuuagcuuu

SEQ ID NO: 2815772 - RNA, 17 nt, Human
acaguuucuuagcuuuu

SEQ ID NO: 2815773 - RNA, 18 nt, Human
acaguuucuuagcuuuuu

SEQ ID NO: 2815774 - RNA, 20 nt, Human
acaguuucuuagcuuuuuaa

SEQ ID NO: 2815775 - RNA, 15 nt, Human
acaguuuaucaugaa

SEQ ID NO: 2815776 - RNA, 16 nt, Human
acaguuuaucaugaag

SEQ ID NO: 2815777 - RNA, 17 nt, Human
acaguuuaucaugaagc

SEQ ID NO: 2815778 - RNA, 18 nt, Human
acaguuuaucaugaagcc

SEQ ID NO: 2815779 - RNA, 19 nt, Human
acaguuuaucaugaagccu

SEQ ID NO: 2815780 - RNA, 20 nt, Human
acaguuuaucaugaagccug

SEQ ID NO: 2815781 - RNA, 22 nt, Human
acaguuuaucaugaagccugug

SEQ ID NO: 2815782 - RNA, 22 nt, Human
acauauuccauguuuggaagac

SEQ ID NO: 2815783 - RNA, 15 nt, Human
acauauuuguggaau

SEQ ID NO: 2815784 - RNA, 16 nt, Human
acauauuuguggaaua

SEQ ID NO: 2815785 - RNA, 17 nt, Human
acauauuuguggaauaa

SEQ ID NO: 2815786 - RNA, 19 nt, Human
acauauuuguggaauaaug

SEQ ID NO: 2815787 - RNA, 17 nt, Human
acauauuuuauuaagaa

SEQ ID NO: 2815788 - RNA, 19 nt, Human
acauauuuuauuaagaacu

SEQ ID NO: 2815789 - RNA, 13 nt, Human
acauauuuucugu

SEQ ID NO: 2815790 - RNA, 15 nt, Human
acauauuuuuuauau

SEQ ID NO: 2815791 - RNA, 19 nt, Human
acauauuuuuuauaucugg

SEQ ID NO: 2815792 - RNA, 21 nt, Human
acauauuuuuuauaucuggaa

SEQ ID NO: 2815793 - RNA, 22 nt, Human
acauauuuuuuauaucuggaau

SEQ ID NO: 2815794 - RNA, 19 nt, Human
acaucuauuuuggauugua

SEQ ID NO: 2815795 - RNA, 18 nt, Human
acaucuauuuuggauugu

SEQ ID NO: 2815796 - RNA, 17 nt, Human
acaucacuguucaugcu

SEQ ID NO: 2815797 - RNA, 14 nt, Human
acaucuaugauaua

SEQ ID NO: 2815798 - RNA, 12 nt, Human
acaucagauaag

SEQ ID NO: 2815799 - RNA, 23 nt, Human
acaucuauuuuggauuguauauu

SEQ ID NO: 2815800 - RNA, 20 nt, Human
acaucucaggggccagagga

SEQ ID NO: 2815801 - RNA, 19 nt, Human
acaucucaggggccagagg

SEQ ID NO: 2815802 - RNA, 13 nt, Human
acaucacaggaca

SEQ ID NO: 2815803 - RNA, 13 nt, Human
acaucacacacac

SEQ ID NO: 2815804 - RNA, 13 nt, Human
acaucacagcagc

SEQ ID NO: 2815805 - RNA, 14 nt, Human
acaucacagcagcc

SEQ ID NO: 2815806 - RNA, 20 nt, Human
acaucaccgacgcgucuccu

SEQ ID NO: 2815807 - RNA, 21 nt, Human
acaucaccgacgcgucuccug

SEQ ID NO: 2815808 - RNA, 23 nt, Human
acaucaccgacgcgucuccuguu

SEQ ID NO: 2815809 - RNA, 22 nt, Human
acaucacuauccaugcaccaaa

SEQ ID NO: 2815810 - RNA, 22 nt, Human
acaucaccgacgcgucuccugu

SEQ ID NO: 2815811 - RNA, 16 nt, Human
acaucacucugcugcu

SEQ ID NO: 2815812 - RNA, 19 nt, Human
acaucacucugcugcuuag

SEQ ID NO: 2815813 - RNA, 23 nt, Human
acaucacugaaaccuuuaagaaa

SEQ ID NO: 2815814 - RNA, 14 nt, Human
acaucacugcuuga

SEQ ID NO: 2815815 - RNA, 21 nt, Human
acaucacugcuugaugaagca

SEQ ID NO: 2815816 - RNA, 22 nt, Human
acaucacugcuugaugaagcaa

SEQ ID NO: 2815817 - RNA, 19 nt, Human
acaucacuuguacaaaaua

SEQ ID NO: 2815818 - RNA, 16 nt, Human
acaucacuuguacaaa

SEQ ID NO: 2815819 - RNA, 15 nt, Human
acaucacuuguacaa

SEQ ID NO: 2815820 - RNA, 13 nt, Human
acaucuugcucug

SEQ ID NO: 2815821 - RNA, 24 nt, Human
acaucuuccauuuccauguccccu

SEQ ID NO: 2815822 - RNA, 16 nt, Human
acaucuucagcaaaua

SEQ ID NO: 2815823 - RNA, 13 nt, Human
acaucuggcuuau

SEQ ID NO: 2815824 - RNA, 17 nt, Human
acaucuggcuuauuuua

SEQ ID NO: 2815825 - RNA, 18 nt, Human
acaucuggcuuauuuuaa

SEQ ID NO: 2815826 - RNA, 19 nt, Human
acaucuggcuuauuuuaau

SEQ ID NO: 2815827 - RNA, 20 nt, Human
acaucuggcuuauuuuaaug

SEQ ID NO: 2815828 - RNA, 21 nt, Human
acaucuggcuuauuuuaaugu

SEQ ID NO: 2815829 - RNA, 20 nt, Human
acaucucuuugaugucauau

SEQ ID NO: 2815830 - RNA, 22 nt, Human
acaucucugcacccuggggccu

SEQ ID NO: 2815831 - RNA, 12 nt, Human
acaucucucccc

SEQ ID NO: 2815832 - RNA, 21 nt, Human
acaucucuccccaacccuagg

SEQ ID NO: 2815833 - RNA, 15 nt, Human
acaucucugaaagca

SEQ ID NO: 2815834 - RNA, 18 nt, Human
acaucucugaaagcacag

SEQ ID NO: 2815835 - RNA, 19 nt, Human
acaucuugcucugcugaca

SEQ ID NO: 2815836 - RNA, 18 nt, Human
acaucuugcucugcugac

SEQ ID NO: 2815837 - RNA, 21 nt, Human
acaucuugcucugcugacaga

SEQ ID NO: 2815838 - RNA, 18 nt, Human
uauuuggucucuauuuca

SEQ ID NO: 2815839 - RNA, 21 nt, Human
uauuugguuuggccaucucug

SEQ ID NO: 2815840 - RNA, 15 nt, Human
acauagauauuuuca

SEQ ID NO: 2815841 - RNA, 16 nt, Human
acauagauauuuucac

SEQ ID NO: 2815842 - RNA, 18 nt, Human
acauagauauuuucacaa

SEQ ID NO: 2815843 - RNA, 14 nt, Human
acauagagguauau

SEQ ID NO: 2815844 - RNA, 16 nt, Human
acauagagguauauug

SEQ ID NO: 2815845 - RNA, 18 nt, Human
acauagagguauauugga

SEQ ID NO: 2815846 - RNA, 20 nt, Human
acauagagguauauuggaag

SEQ ID NO: 2815847 - RNA, 21 nt, Human
acauagagguauauuggaaga

SEQ ID NO: 2815848 - RNA, 22 nt, Human
acauagagugacuccaagaaca

SEQ ID NO: 2815849 - RNA, 14 nt, Human
acauagcccauccc

SEQ ID NO: 2815850 - RNA, 18 nt, Human
acauagcccaucccugcc

SEQ ID NO: 2815851 - RNA, 19 nt, Human
acauagcccaucccugccu

SEQ ID NO: 2815852 - RNA, 14 nt, Human
acauagauuaaugg

SEQ ID NO: 2815853 - RNA, 18 nt, Human
acauagauuaauggcacu

SEQ ID NO: 2815854 - RNA, 19 nt, Human
acauagauuaauggcacug

SEQ ID NO: 2815855 - RNA, 20 nt, Human
acauagauuaauggcacuga

SEQ ID NO: 2815856 - RNA, 22 nt, Human
acauagauuuauuuuucaguuc

SEQ ID NO: 2815857 - RNA, 20 nt, Human
acauagcauccaaguggcau

SEQ ID NO: 2815858 - RNA, 21 nt, Human
acauagcuacccaaaagagaa

SEQ ID NO: 2815859 - RNA, 22 nt, Human
acauagcuacccaaaagagaaa

SEQ ID NO: 2815860 - RNA, 22 nt, Human
acauagcccaucccugccuggu

SEQ ID NO: 2815861 - RNA, 21 nt, Human
acauagcuuacaagccagcug

SEQ ID NO: 2815862 - RNA, 14 nt, Human
acauauacacacac

SEQ ID NO: 2815863 - RNA, 15 nt, Human
acauauacacacaca

SEQ ID NO: 2815864 - RNA, 22 nt, Human
acauagugcauuguuucugugg

SEQ ID NO: 2815865 - RNA, 15 nt, Human
acauaguuauuuauu

SEQ ID NO: 2815866 - RNA, 17 nt, Human
acauaguucuccaguug

SEQ ID NO: 2815867 - RNA, 23 nt, Human
acauaguucuccaguuguaugga

SEQ ID NO: 2815868 - RNA, 17 nt, Human
acauaguuuuaaacuca

SEQ ID NO: 2815869 - RNA, 19 nt, Human
acauaguuuuaaacucauu

SEQ ID NO: 2815870 - RNA, 20 nt, Human
acauaguuuuaaacucauuu

SEQ ID NO: 2815871 - RNA, 21 nt, Human
acauaguuuuaaacucauuuu

SEQ ID NO: 2815872 - RNA, 12 nt, Human
acauaguguaau

SEQ ID NO: 2815873 - RNA, 20 nt, Human
acauauaaacaucacacaca

SEQ ID NO: 2815874 - RNA, 13 nt, Human
acauauaaaauaa

SEQ ID NO: 2815875 - RNA, 22 nt, Human
acauauaaaauaaugcaaagaa

SEQ ID NO: 2815876 - RNA, 17 nt, Human
acauaguaaguucagca

SEQ ID NO: 2815877 - RNA, 20 nt, Human
acauaguaaguucagcacuu

SEQ ID NO: 2815878 - RNA, 22 nt, Human
acauaguaaguucagcacuugu

SEQ ID NO: 2815879 - RNA, 16 nt, Human
acauagugaugguucc

SEQ ID NO: 2815880 - RNA, 21 nt, Human
acauagugaugguuccccugu

SEQ ID NO: 2815881 - RNA, 17 nt, Human
acauaucgcugacuuca

SEQ ID NO: 2815882 - RNA, 16 nt, Human
acauauaccuauaaug

SEQ ID NO: 2815883 - RNA, 19 nt, Human
acauauaccuauaaugugu

SEQ ID NO: 2815884 - RNA, 20 nt, Human
acauauaccuauaaugugug

SEQ ID NO: 2815885 - RNA, 21 nt, Human
acauauaccuauaaugugugu

SEQ ID NO: 2815886 - RNA, 22 nt, Human
acauauaccuauaaugugugua

SEQ ID NO: 2815887 - RNA, 23 nt, Human
acauauaccuauaauguguguau

SEQ ID NO: 2815888 - RNA, 16 nt, Human
acauauagaaugcaga

SEQ ID NO: 2815889 - RNA, 14 nt, Human
acauauauauuaca

SEQ ID NO: 2815890 - RNA, 16 nt, Human
acauauauuauuuauu

SEQ ID NO: 2815891 - RNA, 21 nt, Human
acauauauuuuuaaaaaauga

SEQ ID NO: 2815892 - RNA, 22 nt, Human
acauauauuuuuaaaaaaugaa

SEQ ID NO: 2815893 - RNA, 23 nt, Human
acauauggacucugcacaugaau

SEQ ID NO: 2815894 - RNA, 19 nt, Human
acauaugcaccuugugucu

SEQ ID NO: 2815895 - RNA, 20 nt, Human
acauaugcaccuugugucug

SEQ ID NO: 2815896 - RNA, 15 nt, Human
acauaugcaccuugu

SEQ ID NO: 2815897 - RNA, 16 nt, Human
acauaugcaccuugug

SEQ ID NO: 2815898 - RNA, 17 nt, Human
acauaugcaccuugugu

SEQ ID NO: 2815899 - RNA, 18 nt, Human
acauaugcaccuuguguc

SEQ ID NO: 2815900 - RNA, 14 nt, Human
acauaugacuugau

SEQ ID NO: 2815901 - RNA, 15 nt, Human
acauaugauuucacu

SEQ ID NO: 2815902 - RNA, 22 nt, Human
acauaugauuucacuagaaaag

SEQ ID NO: 2815903 - RNA, 13 nt, Human
acauauuuaacug

SEQ ID NO: 2815904 - RNA, 14 nt, Human
acauauuuaacugg

SEQ ID NO: 2815905 - RNA, 15 nt, Human
acauauuuaacuggu

SEQ ID NO: 2815906 - RNA, 18 nt, Human
acauauuuaacuggugca

SEQ ID NO: 2815907 - RNA, 20 nt, Human
acauauuuaacuggugcacu

SEQ ID NO: 2815908 - RNA, 12 nt, Human
acauauuuaaug

SEQ ID NO: 2815909 - RNA, 13 nt, Human
acauauuuaaugu

SEQ ID NO: 2815910 - RNA, 14 nt, Human
acauauuuaauguu

SEQ ID NO: 2815911 - RNA, 15 nt, Human
acauauuuaauguuu

SEQ ID NO: 2815912 - RNA, 16 nt, Human
acauauuuaauguuuu

SEQ ID NO: 2815913 - RNA, 17 nt, Human
acauauuuaauguuuua

SEQ ID NO: 2815914 - RNA, 20 nt, Human
acauauuuaauguuuuaaau

SEQ ID NO: 2815915 - RNA, 21 nt, Human
acauauuuaauguuuuaaaug

SEQ ID NO: 2815916 - RNA, 19 nt, Human
acauauuuauauaacguga

SEQ ID NO: 2815917 - RNA, 13 nt, Human
acauaugugaaua

SEQ ID NO: 2815918 - RNA, 13 nt, Human
acauauguaaaau

SEQ ID NO: 2815919 - RNA, 14 nt, Human
acauauguaaaaua

SEQ ID NO: 2815920 - RNA, 16 nt, Human
acauauguaaacauaa

SEQ ID NO: 2815921 - RNA, 16 nt, Human
acauauguacauaaau

SEQ ID NO: 2815922 - RNA, 16 nt, Human
acauauguagacuaua

SEQ ID NO: 2815923 - RNA, 17 nt, Human
acauauguagacuauau

SEQ ID NO: 2815924 - RNA, 20 nt, Human
acauauguagacuauauaca

SEQ ID NO: 2815925 - RNA, 23 nt, Human
acauauguagacuauauacaugu

SEQ ID NO: 2815926 - RNA, 18 nt, Human
accaggcuugccugcagg

SEQ ID NO: 2815927 - RNA, 12 nt, Human
accaggccuggg

SEQ ID NO: 2815928 - RNA, 16 nt, Human
accagaaaaugagggc

SEQ ID NO: 2815929 - RNA, 16 nt, Human
accagcccuggggcug

SEQ ID NO: 2815930 - RNA, 17 nt, Human
accagcccuggggcugg

SEQ ID NO: 2815931 - RNA, 18 nt, Human
accagcccuggggcuggg

SEQ ID NO: 2815932 - RNA, 20 nt, Human
accagcccuggggcugggcc

SEQ ID NO: 2815933 - RNA, 18 nt, Human
accagcccuugagggaga

SEQ ID NO: 2815934 - RNA, 22 nt, Human
accagcccuugagggagaacuu

SEQ ID NO: 2815935 - RNA, 14 nt, Human
accagccuccaugc

SEQ ID NO: 2815936 - RNA, 19 nt, Human
accagccuccaugcugccu

SEQ ID NO: 2815937 - RNA, 20 nt, Human
accagccuccaugcugccuc

SEQ ID NO: 2815938 - RNA, 21 nt, Human
accagccuccaugcugccucc

SEQ ID NO: 2815939 - RNA, 19 nt, Human
ucaccucuggacuggcuag

SEQ ID NO: 2815940 - RNA, 13 nt, Human
ucaccucuguaau

SEQ ID NO: 2815941 - RNA, 18 nt, Human
ucaccucuggacuggcua

SEQ ID NO: 2815942 - RNA, 13 nt, Human
accaggcuguguc

SEQ ID NO: 2815943 - RNA, 14 nt, Human
ucaccuccuucaau

SEQ ID NO: 2815944 - RNA, 15 nt, Human
ucaccuccuucaauu

SEQ ID NO: 2815945 - RNA, 13 nt, Human
ucaccucucccac

SEQ ID NO: 2815946 - RNA, 16 nt, Human
ucaccucuaacacgca

SEQ ID NO: 2815947 - RNA, 18 nt, Human
ucaccucuacccaaaccc

SEQ ID NO: 2815948 - RNA, 23 nt, Human
ucaccucuacccaaacccuaggu

SEQ ID NO: 2815949 - RNA, 19 nt, Human
accaggcuugccugcaggc

SEQ ID NO: 2815950 - RNA, 19 nt, Human
ucaccugagucacccuacc

SEQ ID NO: 2815951 - RNA, 11 nt, Human
ucaccugcaaa

SEQ ID NO: 2815952 - RNA, 21 nt, Human
ucaccugcaaagcucuguggc

SEQ ID NO: 2815953 - RNA, 21 nt, Human
ucaccuucguuuacuaugccu

SEQ ID NO: 2815954 - RNA, 20 nt, Human
ucacuacccuauucucucuu

SEQ ID NO: 2815955 - RNA, 15 nt, Human
ucacuagcuuugccu

SEQ ID NO: 2815956 - RNA, 14 nt, Human
ucacuagaauggau

SEQ ID NO: 2815957 - RNA, 17 nt, Human
ucacuagaauggauaaa

SEQ ID NO: 2815958 - RNA, 19 nt, Human
ucacuagaauggauaaaau

SEQ ID NO: 2815959 - RNA, 21 nt, Human
ucaccuuccaggaccccuggg

SEQ ID NO: 2815960 - RNA, 12 nt, Human
ucaccuucccuu

SEQ ID NO: 2815961 - RNA, 13 nt, Human
ucaccuucccuug

SEQ ID NO: 2815962 - RNA, 16 nt, Human
ucaccuucccuugcca

SEQ ID NO: 2815963 - RNA, 23 nt, Human
ucaccuguuacugaaagugguuu

SEQ ID NO: 2815964 - RNA, 14 nt, Human
ucacuccagccugg

SEQ ID NO: 2815965 - RNA, 19 nt, Human
ucacuauguugcccaggca

SEQ ID NO: 2815966 - RNA, 17 nt, Human
ucacuauguugcccagg

SEQ ID NO: 2815967 - RNA, 18 nt, Human
ucacuauguugcccaggc

SEQ ID NO: 2815968 - RNA, 14 nt, Human
ucacucccagucca

SEQ ID NO: 2815969 - RNA, 14 nt, Human
ucacuccccaagga

SEQ ID NO: 2815970 - RNA, 17 nt, Human
ucacuccccaaggaaga

SEQ ID NO: 2815971 - RNA, 18 nt, Human
ucacuccccaaggaagag

SEQ ID NO: 2815972 - RNA, 21 nt, Human
ucacuccccaugccacguucc

SEQ ID NO: 2815973 - RNA, 23 nt, Human
ucacuccggugugccugcagccc

SEQ ID NO: 2815974 - RNA, 22 nt, Human
ucacuccggugugccugcagcc

SEQ ID NO: 2815975 - RNA, 21 nt, Human
ucacuccggugugccugcagc

SEQ ID NO: 2815976 - RNA, 20 nt, Human
ucacuccggugugccugcag

SEQ ID NO: 2815977 - RNA, 19 nt, Human
ucacuccggugugccugca

SEQ ID NO: 2815978 - RNA, 17 nt, Human
ucacuccggugugccug

SEQ ID NO: 2815979 - RNA, 14 nt, Human
ucacuccggugugc

SEQ ID NO: 2815980 - RNA, 13 nt, Human
accacuucgaaac

SEQ ID NO: 2815981 - RNA, 15 nt, Human
accacuucuuuuaua

SEQ ID NO: 2815982 - RNA, 17 nt, Human
accacuucuuuuauaac

SEQ ID NO: 2815983 - RNA, 16 nt, Human
accacuucuuuuauaa

SEQ ID NO: 2815984 - RNA, 13 nt, Human
accacuucauucu

SEQ ID NO: 2815985 - RNA, 14 nt, Human
accacuucauucug

SEQ ID NO: 2815986 - RNA, 14 nt, Human
accacuuccagggg

SEQ ID NO: 2815987 - RNA, 23 nt, Human
accacuuccaggggaaccugcca

SEQ ID NO: 2815988 - RNA, 15 nt, Human
accacuuccuuuaaa

SEQ ID NO: 2815989 - RNA, 20 nt, Human
accacuuccaggggaaccug

SEQ ID NO: 2815990 - RNA, 18 nt, Human
accacugcacuccagccu

SEQ ID NO: 2815991 - RNA, 23 nt, Human
accacugcucugaugaagaggag

SEQ ID NO: 2815992 - RNA, 17 nt, Human
accacugcucugaugaa

SEQ ID NO: 2815993 - RNA, 15 nt, Human
accacugcucugaug

SEQ ID NO: 2815994 - RNA, 17 nt, Human
accagaauugugcaaau

SEQ ID NO: 2815995 - RNA, 21 nt, Human
accagaauugugcaaauggaa

SEQ ID NO: 2815996 - RNA, 13 nt, Human
accagaagggaaa

SEQ ID NO: 2815997 - RNA, 16 nt, Human
accagacaaggaaaua

SEQ ID NO: 2815998 - RNA, 23 nt, Human
accagacaaggaaauacccuucu

SEQ ID NO: 2815999 - RNA, 16 nt, Human
accagagcccaccuug

SEQ ID NO: 2816000 - RNA, 14 nt, Human
accagagcccaccu

SEQ ID NO: 2816001 - RNA, 12 nt, Human
accagagcccac

SEQ ID NO: 2816002 - RNA, 16 nt, Human
accagacucgccaaca

SEQ ID NO: 2816003 - RNA, 17 nt, Human
accagacucgccaacau

SEQ ID NO: 2816004 - RNA, 20 nt, Human
accagacucgccaacauggu

SEQ ID NO: 2816005 - RNA, 13 nt, Human
accagacugcagg

SEQ ID NO: 2816006 - RNA, 14 nt, Human
accagacugcaggu

SEQ ID NO: 2816007 - RNA, 16 nt, Human
accagacugcagguug

SEQ ID NO: 2816008 - RNA, 14 nt, Human
accagacaccuuga

SEQ ID NO: 2816009 - RNA, 17 nt, Human
ucaauuuuugucucaga

SEQ ID NO: 2816010 - RNA, 19 nt, Human
ucaauuuuugucucagaag

SEQ ID NO: 2816011 - RNA, 13 nt, Human
ucaauuuugacuu

SEQ ID NO: 2816012 - RNA, 18 nt, Human
ucaauuuugacuuaaugu

SEQ ID NO: 2816013 - RNA, 14 nt, Human
ucaauuuuuaggaa

SEQ ID NO: 2816014 - RNA, 12 nt, Human
ucacaaauaaua

SEQ ID NO: 2816015 - RNA, 13 nt, Human
ucacaaauaauag

SEQ ID NO: 2816016 - RNA, 16 nt, Human
accaauugguuaaucu

SEQ ID NO: 2816017 - RNA, 13 nt, Human
accaauugugcug

SEQ ID NO: 2816018 - RNA, 14 nt, Human
accaauugugcugc

SEQ ID NO: 2816019 - RNA, 15 nt, Human
accaauugugcugcc

SEQ ID NO: 2816020 - RNA, 16 nt, Human
accaauugugcugcca

SEQ ID NO: 2816021 - RNA, 17 nt, Human
accaauugugcugccau

SEQ ID NO: 2816022 - RNA, 18 nt, Human
accaauugugcugccauu

SEQ ID NO: 2816023 - RNA, 20 nt, Human
accaauuguguccugaaaau

SEQ ID NO: 2816024 - RNA, 18 nt, Human
accaauuuacacugccau

SEQ ID NO: 2816025 - RNA, 14 nt, Human
ucaagaaccuggaa

SEQ ID NO: 2816026 - RNA, 14 nt, Human
accaauuauugaua

SEQ ID NO: 2816027 - RNA, 17 nt, Human
accaauuauugauauau

SEQ ID NO: 2816028 - RNA, 23 nt, Human
accaauuauugauauauauuaua

SEQ ID NO: 2816029 - RNA, 14 nt, Human
accacacccagccu

SEQ ID NO: 2816030 - RNA, 15 nt, Human
accacacccagccuc

SEQ ID NO: 2816031 - RNA, 16 nt, Human
accacacccagccuca

SEQ ID NO: 2816032 - RNA, 17 nt, Human
accacacccagccucag

SEQ ID NO: 2816033 - RNA, 22 nt, Human
accacacccagccucaguccuc

SEQ ID NO: 2816034 - RNA, 14 nt, Human
accacaaaaauuga

SEQ ID NO: 2816035 - RNA, 16 nt, Human
accaauuuuuuguucu

SEQ ID NO: 2816036 - RNA, 18 nt, Human
accaauuuuuuguucuuc

SEQ ID NO: 2816037 - RNA, 23 nt, Human
accaauuuuuuguucuucagaga

SEQ ID NO: 2816038 - RNA, 18 nt, Human
accacaaaaaaauaccuc

SEQ ID NO: 2816039 - RNA, 16 nt, Human
accacacuggacuccg

SEQ ID NO: 2816040 - RNA, 13 nt, Human
accacacuggacu

SEQ ID NO: 2816041 - RNA, 13 nt, Human
accacaccuggcu

SEQ ID NO: 2816042 - RNA, 14 nt, Human
accacaccuggcua

SEQ ID NO: 2816043 - RNA, 17 nt, Human
ucaauuccugggcccca

SEQ ID NO: 2816044 - RNA, 12 nt, Human
ucaauucucaaa

SEQ ID NO: 2816045 - RNA, 20 nt, Human
ucaauucuguagguuaaaaa

SEQ ID NO: 2816046 - RNA, 23 nt, Human
ucaauucuguagguuaaaaaaau

SEQ ID NO: 2816047 - RNA, 13 nt, Human
ucaauuccugggc

SEQ ID NO: 2816048 - RNA, 17 nt, Human
accacacccuguacugu

SEQ ID NO: 2816049 - RNA, 24 nt, Human
accacacccagccucaguccuccc

SEQ ID NO: 2816050 - RNA, 18 nt, Human
accacacccggcuaauuu

SEQ ID NO: 2816051 - RNA, 13 nt, Human
accacacccugua

SEQ ID NO: 2816052 - RNA, 14 nt, Human
accacacuccagcu

SEQ ID NO: 2816053 - RNA, 20 nt, Human
ucaagugaucugcccaccuc

SEQ ID NO: 2816054 - RNA, 17 nt, Human
ucaagugauccucccac

SEQ ID NO: 2816055 - RNA, 17 nt, Human
ucaagugauucucaugc

SEQ ID NO: 2816056 - RNA, 18 nt, Human
ucaagucaaucauuucuc

SEQ ID NO: 2816057 - RNA, 21 nt, Human
ucaagucauggcagguacagu

SEQ ID NO: 2816058 - RNA, 17 nt, Human
ucaccccggcaggcccu

SEQ ID NO: 2816059 - RNA, 18 nt, Human
ucaccccggcaggcccug

SEQ ID NO: 2816060 - RNA, 19 nt, Human
ucaccccggcaggcccugc

SEQ ID NO: 2816061 - RNA, 20 nt, Human
ucaccccggcaggcccugca

SEQ ID NO: 2816062 - RNA, 21 nt, Human
ucaccccggcaggcccugcag

SEQ ID NO: 2816063 - RNA, 22 nt, Human
ucaccccggcaggcccugcagu

SEQ ID NO: 2816064 - RNA, 23 nt, Human
ucaccccggcaggcccugcagug

SEQ ID NO: 2816065 - RNA, 12 nt, Human
ucaccccauccc

SEQ ID NO: 2816066 - RNA, 21 nt, Human
ucaccccaguggccacucagc

SEQ ID NO: 2816067 - RNA, 13 nt, Human
ucaccccacccuu

SEQ ID NO: 2816068 - RNA, 12 nt, Human
ucaccccagggc

SEQ ID NO: 2816069 - RNA, 15 nt, Human
ucaccccagggccug

SEQ ID NO: 2816070 - RNA, 13 nt, Human
ucaccccagggcc

SEQ ID NO: 2816071 - RNA, 21 nt, Human
ucaccccagggccugagccug

SEQ ID NO: 2816072 - RNA, 20 nt, Human
ucaccccagggccugagccu

SEQ ID NO: 2816073 - RNA, 19 nt, Human
ucaccccagggccugagcc

SEQ ID NO: 2816074 - RNA, 16 nt, Human
ucaccccagggccuga

SEQ ID NO: 2816075 - RNA, 12 nt, Human
ucaccccacccu

SEQ ID NO: 2816076 - RNA, 22 nt, Human
ucaccccaaguagucugcucac

SEQ ID NO: 2816077 - RNA, 23 nt, Human
ucaccccaaguagucugcucaca

SEQ ID NO: 2816078 - RNA, 12 nt, Human
ucaccccagagc

SEQ ID NO: 2816079 - RNA, 13 nt, Human
ucaccccagagcc

SEQ ID NO: 2816080 - RNA, 14 nt, Human
ucaccccagagcca

SEQ ID NO: 2816081 - RNA, 17 nt, Human
ucaccccagagccacac

SEQ ID NO: 2816082 - RNA, 18 nt, Human
ucaccccagagccacaca

SEQ ID NO: 2816083 - RNA, 19 nt, Human
ucaccccagagccacacau

SEQ ID NO: 2816084 - RNA, 21 nt, Human
ucaccaguguccccuccacug

SEQ ID NO: 2816085 - RNA, 17 nt, Human
ucaccaguguccccucc

SEQ ID NO: 2816086 - RNA, 20 nt, Human
ucaccaguguccccuccacu

SEQ ID NO: 2816087 - RNA, 22 nt, Human
ucaccaguggccuuaccccugc

SEQ ID NO: 2816088 - RNA, 13 nt, Human
ucaccaguguccc

SEQ ID NO: 2816089 - RNA, 17 nt, Human
ucacccaugaagacagg

SEQ ID NO: 2816090 - RNA, 17 nt, Human
ucacccaggccuauguu

SEQ ID NO: 2816091 - RNA, 19 nt, Human
ucacccaggcuggagugca

SEQ ID NO: 2816092 - RNA, 18 nt, Human
ucaccagcugcugcucug

SEQ ID NO: 2816093 - RNA, 13 nt, Human
ucacaugaccuga

SEQ ID NO: 2816094 - RNA, 20 nt, Human
ucacaugaccugaucacuag

SEQ ID NO: 2816095 - RNA, 15 nt, Human
ucacaucuuggcaca

SEQ ID NO: 2816096 - RNA, 21 nt, Human
ucacaucgcuucuguguaucu

SEQ ID NO: 2816097 - RNA, 14 nt, Human
ucacaucuuaugcu

SEQ ID NO: 2816098 - RNA, 13 nt, Human
ucacaucuuuuaa

SEQ ID NO: 2816099 - RNA, 18 nt, Human
ucacaucuuuuaagacaa

SEQ ID NO: 2816100 - RNA, 19 nt, Human
ucacaucuuuuaagacaaa

SEQ ID NO: 2816101 - RNA, 15 nt, Human
ucacauaucugucau

SEQ ID NO: 2816102 - RNA, 12 nt, Human
ucacauaucugu

SEQ ID NO: 2816103 - RNA, 20 nt, Human
ucacaaauccuaaaagaagc

SEQ ID NO: 2816104 - RNA, 22 nt, Human
ucacaaauuucacuuauaccug

SEQ ID NO: 2816105 - RNA, 16 nt, Human
ucacaacaaccugguc

SEQ ID NO: 2816106 - RNA, 22 nt, Human
ucacacgucuggcuucacagau

SEQ ID NO: 2816107 - RNA, 16 nt, Human
ucacaguguuuacacu

SEQ ID NO: 2816108 - RNA, 17 nt, Human
ucacaguguugcccagg

SEQ ID NO: 2816109 - RNA, 13 nt, Human
ucacaguguguuu

SEQ ID NO: 2816110 - RNA, 17 nt, Human
ucacacgggggcagcug

SEQ ID NO: 2816111 - RNA, 18 nt, Human
ucacacgggggcagcuga

SEQ ID NO: 2816112 - RNA, 16 nt, Human
ucacacgaccggggcc

SEQ ID NO: 2816113 - RNA, 13 nt, Human
ucacacuauuuua

SEQ ID NO: 2816114 - RNA, 21 nt, Human
ucacacucaguugugacuaac

SEQ ID NO: 2816115 - RNA, 22 nt, Human
accauuugcauggcuccagaaa

SEQ ID NO: 2816116 - RNA, 16 nt, Human
accauuugcuacugua

SEQ ID NO: 2816117 - RNA, 18 nt, Human
accauuugcuacuguaca

SEQ ID NO: 2816118 - RNA, 19 nt, Human
accauuugcuacuguacau

SEQ ID NO: 2816119 - RNA, 22 nt, Human
accauuuccucagcuuaucucu

SEQ ID NO: 2816120 - RNA, 11 nt, Human
acccacugcuc

SEQ ID NO: 2816121 - RNA, 10 nt, Human
acccacugcu

SEQ ID NO: 2816122 - RNA, 15 nt, Human
accauuuuauaaagu

SEQ ID NO: 2816123 - RNA, 17 nt, Human
accauuuuauaaagugc

SEQ ID NO: 2816124 - RNA, 13 nt, Human
acccacucagcuc

SEQ ID NO: 2816125 - RNA, 17 nt, Human
acccacgauuuucucca

SEQ ID NO: 2816126 - RNA, 18 nt, Human
acccacgauuuucuccag

SEQ ID NO: 2816127 - RNA, 19 nt, Human
acccacgauuuucuccagc

SEQ ID NO: 2816128 - RNA, 20 nt, Human
acccacgauuuucuccagcu

SEQ ID NO: 2816129 - RNA, 14 nt, Human
acccacguggcugc

SEQ ID NO: 2816130 - RNA, 18 nt, Human
acccacuauccuucguga

SEQ ID NO: 2816131 - RNA, 11 nt, Human
acccacugcuu

SEQ ID NO: 2816132 - RNA, 15 nt, Human
acccacugcucuggu

SEQ ID NO: 2816133 - RNA, 14 nt, Human
acccacugcucugg

SEQ ID NO: 2816134 - RNA, 13 nt, Human
acccacugcucug

SEQ ID NO: 2816135 - RNA, 17 nt, Human
acccagaccccaggcug

SEQ ID NO: 2816136 - RNA, 21 nt, Human
accaugguuaagaguccaaga

SEQ ID NO: 2816137 - RNA, 17 nt, Human
accaugguuaagagucc

SEQ ID NO: 2816138 - RNA, 19 nt, Human
accaugguuaagaguccaa

SEQ ID NO: 2816139 - RNA, 23 nt, Human
ucacucuuauugcccacgcugga

SEQ ID NO: 2816140 - RNA, 21 nt, Human
ucacucuuauugcccacgcug

SEQ ID NO: 2816141 - RNA, 15 nt, Human
ucacuccuaccuggu

SEQ ID NO: 2816142 - RNA, 17 nt, Human
accauucacaauaaaag

SEQ ID NO: 2816143 - RNA, 19 nt, Human
accauucacaauaaaagcu

SEQ ID NO: 2816144 - RNA, 20 nt, Human
accauucacaauaaaagcuu

SEQ ID NO: 2816145 - RNA, 23 nt, Human
accauucagaucacugaauuuau

SEQ ID NO: 2816146 - RNA, 13 nt, Human
accauuaaaacug

SEQ ID NO: 2816147 - RNA, 16 nt, Human
accauuaaaacugcuu

SEQ ID NO: 2816148 - RNA, 17 nt, Human
accauuaaaacugcuuu

SEQ ID NO: 2816149 - RNA, 18 nt, Human
accauuaaaacugcuuuu

SEQ ID NO: 2816150 - RNA, 19 nt, Human
accauuaaaacugcuuuuu

SEQ ID NO: 2816151 - RNA, 20 nt, Human
accauuaaaacugcuuuuuu

SEQ ID NO: 2816152 - RNA, 13 nt, Human
accauugacacau

SEQ ID NO: 2816153 - RNA, 22 nt, Human
accauugacacauccgccuuuu

SEQ ID NO: 2816154 - RNA, 14 nt, Human
ucagaaggcuucau

SEQ ID NO: 2816155 - RNA, 19 nt, Human
ucagaaguuucucagcucc

SEQ ID NO: 2816156 - RNA, 14 nt, Human
ucagaagacacuga

SEQ ID NO: 2816157 - RNA, 13 nt, Human
acccagccucagu

SEQ ID NO: 2816158 - RNA, 17 nt, Human
acccagccucaguccuc

SEQ ID NO: 2816159 - RNA, 17 nt, Human
ucagaagagaggggaag

SEQ ID NO: 2816160 - RNA, 17 nt, Human
ucagaagaguugugcac

SEQ ID NO: 2816161 - RNA, 20 nt, Human
ucagaagccugaggcuggga

SEQ ID NO: 2816162 - RNA, 15 nt, Human
ucagaagccugaggc

SEQ ID NO: 2816163 - RNA, 13 nt, Human
ucagaagccugag

SEQ ID NO: 2816164 - RNA, 16 nt, Human
ucagaagccucugggu

SEQ ID NO: 2816165 - RNA, 14 nt, Human
acccagaggaggca

SEQ ID NO: 2816166 - RNA, 23 nt, Human
acccagaggaggcagaauaagaa

SEQ ID NO: 2816167 - RNA, 21 nt, Human
acccagccgccaucagcccaa

SEQ ID NO: 2816168 - RNA, 12 nt, Human
acccagccucag

SEQ ID NO: 2816169 - RNA, 18 nt, Human
ucagagccugcaguuauu

SEQ ID NO: 2816170 - RNA, 15 nt, Human
ucagagccugcaguu

SEQ ID NO: 2816171 - RNA, 14 nt, Human
ucagagccugcagu

SEQ ID NO: 2816172 - RNA, 13 nt, Human
ucagagccugcag

SEQ ID NO: 2816173 - RNA, 12 nt, Human
ucagagccugca

SEQ ID NO: 2816174 - RNA, 16 nt, Human
ucagagaggccuuuug

SEQ ID NO: 2816175 - RNA, 14 nt, Human
ucagaauguaaaag

SEQ ID NO: 2816176 - RNA, 18 nt, Human
ucagaauguaaaagaacu

SEQ ID NO: 2816177 - RNA, 16 nt, Human
ucagaaucuuuguuaa

SEQ ID NO: 2816178 - RNA, 17 nt, Human
ucagaaucuuuguuaag

SEQ ID NO: 2816179 - RNA, 19 nt, Human
ucagaaugcuauugaaaau

SEQ ID NO: 2816180 - RNA, 13 nt, Human
ucagcauuucuuu

SEQ ID NO: 2816181 - RNA, 19 nt, Human
ucagcauuucuuuucuggc

SEQ ID NO: 2816182 - RNA, 22 nt, Human
ucagcauuucuuuucuggccaa

SEQ ID NO: 2816183 - RNA, 18 nt, Human
ucagagcugacacaggau

SEQ ID NO: 2816184 - RNA, 23 nt, Human
ucagcauucucacuccuaccugg

SEQ ID NO: 2816185 - RNA, 23 nt, Human
accauuugaaguguaccugugua

SEQ ID NO: 2816186 - RNA, 14 nt, Human
ucagagcugacaca

SEQ ID NO: 2816187 - RNA, 14 nt, Human
ucagagcuccucug

SEQ ID NO: 2816188 - RNA, 21 nt, Human
ucagagcuaagggugggugcu

SEQ ID NO: 2816189 - RNA, 23 nt, Human
ucagagcuaagggugggugcuca

SEQ ID NO: 2816190 - RNA, 22 nt, Human
ucagagaggccuuuuggaaugu

SEQ ID NO: 2816191 - RNA, 21 nt, Human
ucagagaggccuuuuggaaug

SEQ ID NO: 2816192 - RNA, 14 nt, Human
ucagccauguacag

SEQ ID NO: 2816193 - RNA, 15 nt, Human
ucagccauguacaga

SEQ ID NO: 2816194 - RNA, 18 nt, Human
ucagccaggagcugucac

SEQ ID NO: 2816195 - RNA, 19 nt, Human
ucagccaggagcugucacc

SEQ ID NO: 2816196 - RNA, 21 nt, Human
ucagccggcguggcaaauaua

SEQ ID NO: 2816197 - RNA, 22 nt, Human
ucagccggcguggcaaauauaa

SEQ ID NO: 2816198 - RNA, 23 nt, Human
acccagcgagcccugguggcagu

SEQ ID NO: 2816199 - RNA, 19 nt, Human
acccagcgagcccuggugg

SEQ ID NO: 2816200 - RNA, 16 nt, Human
ucagcccaagaugcuu

SEQ ID NO: 2816201 - RNA, 24 nt, Human
acccagcgagcccugguggcagug

SEQ ID NO: 2816202 - RNA, 23 nt, Human
acccagcgggcagguucugccug

SEQ ID NO: 2816203 - RNA, 20 nt, Human
acccaggauuugcugggaga

SEQ ID NO: 2816204 - RNA, 19 nt, Human
acccaggcuggagugcagu

SEQ ID NO: 2816205 - RNA, 12 nt, Human
acccaggcuggg

SEQ ID NO: 2816206 - RNA, 20 nt, Human
acccaggcuggagugcagug

SEQ ID NO: 2816207 - RNA, 13 nt, Human
acccaggcugggc

SEQ ID NO: 2816208 - RNA, 14 nt, Human
acccaggcugggca

SEQ ID NO: 2816209 - RNA, 20 nt, Human
acccaggcugggcaaggagg

SEQ ID NO: 2816210 - RNA, 22 nt, Human
acccaggcugggcaaggaggcc

SEQ ID NO: 2816211 - RNA, 18 nt, Human
acccaggcuggagugcag

SEQ ID NO: 2816212 - RNA, 17 nt, Human
acccaggccuauguuga

SEQ ID NO: 2816213 - RNA, 11 nt, Human
acccaggcucc

SEQ ID NO: 2816214 - RNA, 15 nt, Human
acccaggcuccgccc

SEQ ID NO: 2816215 - RNA, 16 nt, Human
acccaggcuccgcccu

SEQ ID NO: 2816216 - RNA, 19 nt, Human
acccaggcuccgcccuuag

SEQ ID NO: 2816217 - RNA, 20 nt, Human
acccaggcuccgcccuuagu

SEQ ID NO: 2816218 - RNA, 21 nt, Human
acccaggcuccgcccuuaguc

SEQ ID NO: 2816219 - RNA, 23 nt, Human
acccaggcuccgcccuuaguccc

SEQ ID NO: 2816220 - RNA, 13 nt, Human
accccacccuucc

SEQ ID NO: 2816221 - RNA, 20 nt, Human
accccacccucccuggagug

SEQ ID NO: 2816222 - RNA, 15 nt, Human
accccacccuguuug

SEQ ID NO: 2816223 - RNA, 16 nt, Human
accccacccuguuugg

SEQ ID NO: 2816224 - RNA, 19 nt, Human
accccacccuguuuggauu

SEQ ID NO: 2816225 - RNA, 16 nt, Human
accccacccucccugg

SEQ ID NO: 2816226 - RNA, 17 nt, Human
accccacccucccugga

SEQ ID NO: 2816227 - RNA, 18 nt, Human
accccacccucccuggag

SEQ ID NO: 2816228 - RNA, 14 nt, Human
acccagggccugca

SEQ ID NO: 2816229 - RNA, 15 nt, Human
accccacccucccug

SEQ ID NO: 2816230 - RNA, 13 nt, Human
acccagggccugc

SEQ ID NO: 2816231 - RNA, 12 nt, Human
acccagggccug

SEQ ID NO: 2816232 - RNA, 22 nt, Human
acccagggaacagccacucccc

SEQ ID NO: 2816233 - RNA, 13 nt, Human
acccagggaacag

SEQ ID NO: 2816234 - RNA, 19 nt, Human
accccacccuuccccuccu

SEQ ID NO: 2816235 - RNA, 19 nt, Human
accccacccucccuggagu

SEQ ID NO: 2816236 - RNA, 16 nt, Human
accccacgccuuaucc

SEQ ID NO: 2816237 - RNA, 12 nt, Human
accccaccugca

SEQ ID NO: 2816238 - RNA, 13 nt, Human
accccaccugcag

SEQ ID NO: 2816239 - RNA, 14 nt, Human
accccaccugcagg

SEQ ID NO: 2816240 - RNA, 13 nt, Human
accccaggcccac

SEQ ID NO: 2816241 - RNA, 15 nt, Human
accccaggcccacuc

SEQ ID NO: 2816242 - RNA, 16 nt, Human
accccaggcccacuca

SEQ ID NO: 2816243 - RNA, 18 nt, Human
accccaggcccacucagg

SEQ ID NO: 2816244 - RNA, 19 nt, Human
accccaggcccacucaggg

SEQ ID NO: 2816245 - RNA, 17 nt, Human
accccagcugugagccu

SEQ ID NO: 2816246 - RNA, 18 nt, Human
accccagcugugagccuu

SEQ ID NO: 2816247 - RNA, 19 nt, Human
accccagcugugagccuug

SEQ ID NO: 2816248 - RNA, 20 nt, Human
accccagcugugagccuugg

SEQ ID NO: 2816249 - RNA, 21 nt, Human
accccagcugugagccuuggc

SEQ ID NO: 2816250 - RNA, 22 nt, Human
accccagcugugagccuuggcu

SEQ ID NO: 2816251 - RNA, 16 nt, Human
acccccaaauuuucuu

SEQ ID NO: 2816252 - RNA, 23 nt, Human
accccaggcuggacaugcugacu

SEQ ID NO: 2816253 - RNA, 10 nt, Human
accccagggc

SEQ ID NO: 2816254 - RNA, 17 nt, Human
acccccacaccucaguu

SEQ ID NO: 2816255 - RNA, 15 nt, Human
acccccacaccucag

SEQ ID NO: 2816256 - RNA, 20 nt, Human
ucagcuuuuugucuuuucug

SEQ ID NO: 2816257 - RNA, 9 nt, Human
ucaggaaac

SEQ ID NO: 2816258 - RNA, 12 nt, Human
ucaggaaagaau

SEQ ID NO: 2816259 - RNA, 14 nt, Human
ucaggaaagaauag

SEQ ID NO: 2816260 - RNA, 20 nt, Human
ucaggaaagaauagaaagaa

SEQ ID NO: 2816261 - RNA, 23 nt, Human
ucaggaaagaauagaaagaaagu

SEQ ID NO: 2816262 - RNA, 20 nt, Human
ucagcuuguaaauagcucag

SEQ ID NO: 2816263 - RNA, 14 nt, Human
ucagcucacuguuc

SEQ ID NO: 2816264 - RNA, 18 nt, Human
ucagcucagcgccagccu

SEQ ID NO: 2816265 - RNA, 23 nt, Human
ucagcuuccuacccacaccucug

SEQ ID NO: 2816266 - RNA, 20 nt, Human
ucagcuucuauccuugacuu

SEQ ID NO: 2816267 - RNA, 14 nt, Human
ucagcggggacagc

SEQ ID NO: 2816268 - RNA, 19 nt, Human
ucagcuacugauuuuugug

SEQ ID NO: 2816269 - RNA, 19 nt, Human
ucagcuacuuaagagaaau

SEQ ID NO: 2816270 - RNA, 18 nt, Human
ucagcuagcuuuuaggaa

SEQ ID NO: 2816271 - RNA, 13 nt, Human
ucagcucacgcuu

SEQ ID NO: 2816272 - RNA, 21 nt, Human
ucagcucacgcuucacaguga

SEQ ID NO: 2816273 - RNA, 20 nt, Human
ucagcuauuuacugccaaag

SEQ ID NO: 2816274 - RNA, 20 nt, Human
ucagcuaucaguaggcuaau

SEQ ID NO: 2816275 - RNA, 19 nt, Human
ucagcuauuuacugccaaa

SEQ ID NO: 2816276 - RNA, 16 nt, Human
ucagcucacugcaacc

SEQ ID NO: 2816277 - RNA, 13 nt, Human
ucagcucacugca

SEQ ID NO: 2816278 - RNA, 14 nt, Human
acccccaccccaca

SEQ ID NO: 2816279 - RNA, 12 nt, Human
acccccacccca

SEQ ID NO: 2816280 - RNA, 14 nt, Human
accccccgugggcu

SEQ ID NO: 2816281 - RNA, 11 nt, Human
accccccucug

SEQ ID NO: 2816282 - RNA, 11 nt, Human
accccuguccc

SEQ ID NO: 2816283 - RNA, 21 nt, Human
accccugucccaugcaggccc

SEQ ID NO: 2816284 - RNA, 22 nt, Human
accccugucccaugcaggcccu

SEQ ID NO: 2816285 - RNA, 12 nt, Human
accccccuguuc

SEQ ID NO: 2816286 - RNA, 14 nt, Human
accccccuguucua

SEQ ID NO: 2816287 - RNA, 15 nt, Human
accccccuguucuaa

SEQ ID NO: 2816288 - RNA, 17 nt, Human
accccccuguucuaagg

SEQ ID NO: 2816289 - RNA, 19 nt, Human
accccccuguucuaagggg

SEQ ID NO: 2816290 - RNA, 15 nt, Human
accccuucgcuccug

SEQ ID NO: 2816291 - RNA, 14 nt, Human
accccuucgcuccu

SEQ ID NO: 2816292 - RNA, 15 nt, Human
accccuguccucacu

SEQ ID NO: 2816293 - RNA, 16 nt, Human
accccuguccucacug

SEQ ID NO: 2816294 - RNA, 17 nt, Human
accccuguccucacugc

SEQ ID NO: 2816295 - RNA, 18 nt, Human
accccuguccucacugcu

SEQ ID NO: 2816296 - RNA, 19 nt, Human
accccuguccucacugcuc

SEQ ID NO: 2816297 - RNA, 21 nt, Human
accccuguccucacugcuccc

SEQ ID NO: 2816298 - RNA, 16 nt, Human
accccuucgcuccugu

SEQ ID NO: 2816299 - RNA, 14 nt, Human
ucagcgccuggccu

SEQ ID NO: 2816300 - RNA, 19 nt, Human
ucagcggcgaccgcccucc

SEQ ID NO: 2816301 - RNA, 16 nt, Human
uccaucuaaacugccc

SEQ ID NO: 2816302 - RNA, 23 nt, Human
uccaucucuauauaaaaacaaaa

SEQ ID NO: 2816303 - RNA, 14 nt, Human
uccaucucucaucc

SEQ ID NO: 2816304 - RNA, 16 nt, Human
uccaucucucauccuc

SEQ ID NO: 2816305 - RNA, 18 nt, Human
uccaucucucauccucca

SEQ ID NO: 2816306 - RNA, 23 nt, Human
uccaucucccgaauucgcuguua

SEQ ID NO: 2816307 - RNA, 20 nt, Human
uccaucuccuauaaucuguc

SEQ ID NO: 2816308 - RNA, 21 nt, Human
uccaucuccuauaaucuguca

SEQ ID NO: 2816309 - RNA, 22 nt, Human
uccaucuccuauaaucugucaa

SEQ ID NO: 2816310 - RNA, 18 nt, Human
uccaucuaaacugccccc

SEQ ID NO: 2816311 - RNA, 14 nt, Human
uccaucucugacuu

SEQ ID NO: 2816312 - RNA, 22 nt, Human
uccauuuacaaacuacuugauu

SEQ ID NO: 2816313 - RNA, 14 nt, Human
ucccaaagugcugg

SEQ ID NO: 2816314 - RNA, 13 nt, Human
ucccaaagugcug

SEQ ID NO: 2816315 - RNA, 21 nt, Human
ucccaaguagcugggauuaca

SEQ ID NO: 2816316 - RNA, 23 nt, Human
ucccaaguagcugggauuacagg

SEQ ID NO: 2816317 - RNA, 13 nt, Human
ucccaaguccaca

SEQ ID NO: 2816318 - RNA, 20 nt, Human
ucccaaguagcugggauuac

SEQ ID NO: 2816319 - RNA, 18 nt, Human
ucccaaagugcugagauu

SEQ ID NO: 2816320 - RNA, 19 nt, Human
ucccaaagugcugagauua

SEQ ID NO: 2816321 - RNA, 20 nt, Human
ucccaaagugcugagauuac

SEQ ID NO: 2816322 - RNA, 23 nt, Human
ucccaaagugcugagauuacagg

SEQ ID NO: 2816323 - RNA, 15 nt, Human
ucccaaacgccuccc

SEQ ID NO: 2816324 - RNA, 21 nt, Human
ucccaaacgccuccccugccc

SEQ ID NO: 2816325 - RNA, 20 nt, Human
uccauuucgccccucauuua

SEQ ID NO: 2816326 - RNA, 14 nt, Human
uccauuuauauaug

SEQ ID NO: 2816327 - RNA, 15 nt, Human
uccauuuauauauga

SEQ ID NO: 2816328 - RNA, 16 nt, Human
uccauuuauauaugaa

SEQ ID NO: 2816329 - RNA, 17 nt, Human
uccauuuauauaugaaa

SEQ ID NO: 2816330 - RNA, 18 nt, Human
uccauuuauauaugaaaa

SEQ ID NO: 2816331 - RNA, 19 nt, Human
uccauuuauauaugaaaac

SEQ ID NO: 2816332 - RNA, 21 nt, Human
uccauuuauauaugaaaacua

SEQ ID NO: 2816333 - RNA, 23 nt, Human
uccauuuauauaugaaaacuaua

SEQ ID NO: 2816334 - RNA, 12 nt, Human
uccauuugagga

SEQ ID NO: 2816335 - RNA, 17 nt, Human
acgguuugaagccugga

SEQ ID NO: 2816336 - RNA, 14 nt, Human
acguacugucugau

SEQ ID NO: 2816337 - RNA, 16 nt, Human
acgugggagacaagaa

SEQ ID NO: 2816338 - RNA, 11 nt, Human
acgugggagac

SEQ ID NO: 2816339 - RNA, 24 nt, Human
acguagcuucuaccaugaacagaa

SEQ ID NO: 2816340 - RNA, 11 nt, Human
acguguagugu

SEQ ID NO: 2816341 - RNA, 15 nt, Human
acguguaguguccau

SEQ ID NO: 2816342 - RNA, 16 nt, Human
acguguaguguccauu

SEQ ID NO: 2816343 - RNA, 20 nt, Human
acguguaguguccauuuugu

SEQ ID NO: 2816344 - RNA, 18 nt, Human
acgugguuggggcccugc

SEQ ID NO: 2816345 - RNA, 14 nt, Human
acguucggggcaug

SEQ ID NO: 2816346 - RNA, 13 nt, Human
acgugucuuccac

SEQ ID NO: 2816347 - RNA, 19 nt, Human
acgugucuuccacuuugca

SEQ ID NO: 2816348 - RNA, 13 nt, Human
ucccacacccugg

SEQ ID NO: 2816349 - RNA, 11 nt, Human
ucccacacagg

SEQ ID NO: 2816350 - RNA, 13 nt, Human
ucccaaucagcac

SEQ ID NO: 2816351 - RNA, 22 nt, Human
ucccaauagcaacguagcuucu

SEQ ID NO: 2816352 - RNA, 17 nt, Human
ucccaagugccagucuu

SEQ ID NO: 2816353 - RNA, 19 nt, Human
ucccaaguuuccauagcaa

SEQ ID NO: 2816354 - RNA, 21 nt, Human
ucccaaguuuccauagcaaca

SEQ ID NO: 2816355 - RNA, 22 nt, Human
ucccaaguuuccauagcaacag

SEQ ID NO: 2816356 - RNA, 23 nt, Human
ucccaaguuuccauagcaacagg

SEQ ID NO: 2816357 - RNA, 23 nt, Human
acgggagcuggggagaggaaaga

SEQ ID NO: 2816358 - RNA, 18 nt, Human
ucccacccccacccccag

SEQ ID NO: 2816359 - RNA, 17 nt, Human
acggugucuuguucugu

SEQ ID NO: 2816360 - RNA, 20 nt, Human
acggugucuuguucugucac

SEQ ID NO: 2816361 - RNA, 22 nt, Human
acggugucuuguucugucacuc

SEQ ID NO: 2816362 - RNA, 14 nt, Human
acgguuaacuguaa

SEQ ID NO: 2816363 - RNA, 21 nt, Human
acgguucaguuucuucugcgc

SEQ ID NO: 2816364 - RNA, 14 nt, Human
acgggcugcccugc

SEQ ID NO: 2816365 - RNA, 18 nt, Human
acgggcaugggcacuccc

SEQ ID NO: 2816366 - RNA, 23 nt, Human
ucccaguaccuccugucucuggc

SEQ ID NO: 2816367 - RNA, 17 nt, Human
ucccaguaccuccuguc

SEQ ID NO: 2816368 - RNA, 14 nt, Human
ucccaucaaaacuc

SEQ ID NO: 2816369 - RNA, 21 nt, Human
ucccauauuggcauggauuuc

SEQ ID NO: 2816370 - RNA, 20 nt, Human
ucccaucacguguacuggcu

SEQ ID NO: 2816371 - RNA, 23 nt, Human
ucccaucacguguacuggcuccu

SEQ ID NO: 2816372 - RNA, 20 nt, Human
ucccaguccaaauguccucc

SEQ ID NO: 2816373 - RNA, 23 nt, Human
ucccaguccccagcccuucacau

SEQ ID NO: 2816374 - RNA, 14 nt, Human
uccccaccccuacc

SEQ ID NO: 2816375 - RNA, 15 nt, Human
uccccaccccuaccc

SEQ ID NO: 2816376 - RNA, 19 nt, Human
uccccaccccuaccccugg

SEQ ID NO: 2816377 - RNA, 21 nt, Human
uccccaccccuaccccuggcu

SEQ ID NO: 2816378 - RNA, 23 nt, Human
uccccaccccuaccccuggcugu

SEQ ID NO: 2816379 - RNA, 13 nt, Human
ucccauccccugg

SEQ ID NO: 2816380 - RNA, 15 nt, Human
ucccauccccuggac

SEQ ID NO: 2816381 - RNA, 22 nt, Human
ucccaucauuacccuucccugc

SEQ ID NO: 2816382 - RNA, 23 nt, Human
ucccaucauuacccuucccugca

SEQ ID NO: 2816383 - RNA, 19 nt, Human
uccccaucuucuaaaccca

SEQ ID NO: 2816384 - RNA, 13 nt, Human
uccccauggagcc

SEQ ID NO: 2816385 - RNA, 14 nt, Human
uccccaucuucuaa

SEQ ID NO: 2816386 - RNA, 16 nt, Human
uccccaugcagacaug

SEQ ID NO: 2816387 - RNA, 20 nt, Human
uccccaugccacguuccaca

SEQ ID NO: 2816388 - RNA, 21 nt, Human
uccccaugccacguuccacag

SEQ ID NO: 2816389 - RNA, 22 nt, Human
uccccaugccacguuccacagu

SEQ ID NO: 2816390 - RNA, 13 nt, Human
uccccaugccugu

SEQ ID NO: 2816391 - RNA, 16 nt, Human
uccccaugccuguggc

SEQ ID NO: 2816392 - RNA, 17 nt, Human
uccccaugccuguggcu

SEQ ID NO: 2816393 - RNA, 18 nt, Human
uccccaugccuguggcug

SEQ ID NO: 2816394 - RNA, 19 nt, Human
uccccaugccuguggcugc

SEQ ID NO: 2816395 - RNA, 20 nt, Human
uccccaugccuguggcugcg

SEQ ID NO: 2816396 - RNA, 15 nt, Human
uccccauggagccag

SEQ ID NO: 2816397 - RNA, 16 nt, Human
uccccauggagccagc

SEQ ID NO: 2816398 - RNA, 21 nt, Human
uccccauuagagucagccuuc

SEQ ID NO: 2816399 - RNA, 19 nt, Human
uccccauuagagucagccu

SEQ ID NO: 2816400 - RNA, 17 nt, Human
uccccaugucucgacuc

SEQ ID NO: 2816401 - RNA, 15 nt, Human
uccccacccuccugg

SEQ ID NO: 2816402 - RNA, 16 nt, Human
uccccacccuccuggc

SEQ ID NO: 2816403 - RNA, 22 nt, Human
uccccacccuccuggccucaga

SEQ ID NO: 2816404 - RNA, 21 nt, Human
ucccccaacccccaccccaca

SEQ ID NO: 2816405 - RNA, 13 nt, Human
acuacauuuuuuc

SEQ ID NO: 2816406 - RNA, 14 nt, Human
acuacauuuuuuca

SEQ ID NO: 2816407 - RNA, 21 nt, Human
acuaccaagaggcccugucug

SEQ ID NO: 2816408 - RNA, 20 nt, Human
acuacccaaaacaagccugg

SEQ ID NO: 2816409 - RNA, 22 nt, Human
acuacauugaguagacacauuu

SEQ ID NO: 2816410 - RNA, 11 nt, Human
acuacauuuau

SEQ ID NO: 2816411 - RNA, 13 nt, Human
acuacauuuauga

SEQ ID NO: 2816412 - RNA, 18 nt, Human
acuacccuauucucucuu

SEQ ID NO: 2816413 - RNA, 15 nt, Human
acuacccuuaauuac

SEQ ID NO: 2816414 - RNA, 16 nt, Human
acuacccuuaauuacu

SEQ ID NO: 2816415 - RNA, 14 nt, Human
uccccauuccuacc

SEQ ID NO: 2816416 - RNA, 14 nt, Human
uccccauucuuccu

SEQ ID NO: 2816417 - RNA, 22 nt, Human
uccccauucuuccuaguuuucu

SEQ ID NO: 2816418 - RNA, 17 nt, Human
uccccauucuuccuagu

SEQ ID NO: 2816419 - RNA, 12 nt, Human
ucccccaaaguu

SEQ ID NO: 2816420 - RNA, 17 nt, Human
ucccccaaaguucacaa

SEQ ID NO: 2816421 - RNA, 22 nt, Human
ucccccaacauauaaaauaaug

SEQ ID NO: 2816422 - RNA, 15 nt, Human
ucccccaacccccac

SEQ ID NO: 2816423 - RNA, 14 nt, Human
ucccccaaccccca

SEQ ID NO: 2816424 - RNA, 20 nt, Human
ucccccaacccccaccccac

SEQ ID NO: 2816425 - RNA, 19 nt, Human
ucccccaacccccacccca

SEQ ID NO: 2816426 - RNA, 17 nt, Human
ucccccaacccccaccc

SEQ ID NO: 2816427 - RNA, 16 nt, Human
ucccccaacccccacc

SEQ ID NO: 2816428 - RNA, 24 nt, Human
ucccagccaccccgggcucucugc

SEQ ID NO: 2816429 - RNA, 20 nt, Human
ucccagccaccccgggcucu

SEQ ID NO: 2816430 - RNA, 14 nt, Human
ucccagccaccccg

SEQ ID NO: 2816431 - RNA, 13 nt, Human
ucccagccacccc

SEQ ID NO: 2816432 - RNA, 12 nt, Human
ucccagccaccc

SEQ ID NO: 2816433 - RNA, 17 nt, Human
ucccagcugugcucugg

SEQ ID NO: 2816434 - RNA, 11 nt, Human
ucccagcccaa

SEQ ID NO: 2816435 - RNA, 16 nt, Human
ucccagcccaauccag

SEQ ID NO: 2816436 - RNA, 18 nt, Human
ucccagcccaauccaggu

SEQ ID NO: 2816437 - RNA, 12 nt, Human
ucccagcaccug

SEQ ID NO: 2816438 - RNA, 15 nt, Human
ucccagcaccugccu

SEQ ID NO: 2816439 - RNA, 13 nt, Human
ucccagcacuuug

SEQ ID NO: 2816440 - RNA, 16 nt, Human
acguugagccccugga

SEQ ID NO: 2816441 - RNA, 17 nt, Human
acuaacaggauauuuaa

SEQ ID NO: 2816442 - RNA, 12 nt, Human
acuaaccacgcu

SEQ ID NO: 2816443 - RNA, 13 nt, Human
acguuccacaguu

SEQ ID NO: 2816444 - RNA, 14 nt, Human
acuaaccaaaucuc

SEQ ID NO: 2816445 - RNA, 19 nt, Human
acuacaaaucaaguauuug

SEQ ID NO: 2816446 - RNA, 13 nt, Human
acuacaaaucaag

SEQ ID NO: 2816447 - RNA, 11 nt, Human
acuacaaauca

SEQ ID NO: 2816448 - RNA, 15 nt, Human
acuacaggcacccac

SEQ ID NO: 2816449 - RNA, 11 nt, Human
acuacaggcac

SEQ ID NO: 2816450 - RNA, 16 nt, Human
acuacagaccugcuuu

SEQ ID NO: 2816451 - RNA, 17 nt, Human
acuacagaccugcuuuu

SEQ ID NO: 2816452 - RNA, 18 nt, Human
acuacagaccugcuuuuu

SEQ ID NO: 2816453 - RNA, 19 nt, Human
acuacagaccugcuuuuug

SEQ ID NO: 2816454 - RNA, 23 nt, Human
acuacagaccugcuuuuugaaau

SEQ ID NO: 2816455 - RNA, 17 nt, Human
acuacagcuaugaagaa

SEQ ID NO: 2816456 - RNA, 18 nt, Human
acuacagcuaugaagaaa

SEQ ID NO: 2816457 - RNA, 19 nt, Human
acuacagcucuuaaaugua

SEQ ID NO: 2816458 - RNA, 19 nt, Human
uccccucccuggcucccau

SEQ ID NO: 2816459 - RNA, 16 nt, Human
uccccucccuggcucc

SEQ ID NO: 2816460 - RNA, 15 nt, Human
uccccucccuggcuc

SEQ ID NO: 2816461 - RNA, 20 nt, Human
uccccuugucugaacuggag

SEQ ID NO: 2816462 - RNA, 23 nt, Human
uccccuuggcagguccuggccag

SEQ ID NO: 2816463 - RNA, 17 nt, Human
ucccgaguagcugggac

SEQ ID NO: 2816464 - RNA, 16 nt, Human
ucccgaguagcuggga

SEQ ID NO: 2816465 - RNA, 18 nt, Human
ucccgaguagcugggacu

SEQ ID NO: 2816466 - RNA, 20 nt, Human
ucccgaguagcugagauuau

SEQ ID NO: 2816467 - RNA, 15 nt, Human
ucccgaguagcuggg

SEQ ID NO: 2816468 - RNA, 15 nt, Human
ucccgaguacagucu

SEQ ID NO: 2816469 - RNA, 16 nt, Human
ucccgaguacagucug

SEQ ID NO: 2816470 - RNA, 18 nt, Human
ucccgaguacagucugua

SEQ ID NO: 2816471 - RNA, 20 nt, Human
ucccgaauagcugggacuac

SEQ ID NO: 2816472 - RNA, 21 nt, Human
acucacauuuauucugcucac

SEQ ID NO: 2816473 - RNA, 21 nt, Human
acucaccagccccacugccag

SEQ ID NO: 2816474 - RNA, 20 nt, Human
acucaccagccccacugcca

SEQ ID NO: 2816475 - RNA, 14 nt, Human
acucaccagcccca

SEQ ID NO: 2816476 - RNA, 23 nt, Human
acucaccagccccacugccagca

SEQ ID NO: 2816477 - RNA, 22 nt, Human
acucaccagccccacugccagc

SEQ ID NO: 2816478 - RNA, 17 nt, Human
acucaccaguguccccu

SEQ ID NO: 2816479 - RNA, 19 nt, Human
acucaccaguguccccucc

SEQ ID NO: 2816480 - RNA, 23 nt, Human
acucaccaguguccccuccacug

SEQ ID NO: 2816481 - RNA, 13 nt, Human
acucaccaucugu

SEQ ID NO: 2816482 - RNA, 15 nt, Human
acucaccaucugugc

SEQ ID NO: 2816483 - RNA, 18 nt, Human
acucaccaugaagcgaaa

SEQ ID NO: 2816484 - RNA, 19 nt, Human
acuacuaguuuuuacuuuu

SEQ ID NO: 2816485 - RNA, 21 nt, Human
acuacuaguuuuuacuuuuau

SEQ ID NO: 2816486 - RNA, 13 nt, Human
acuacuauucaaa

SEQ ID NO: 2816487 - RNA, 15 nt, Human
uccccuacggaccag

SEQ ID NO: 2816488 - RNA, 16 nt, Human
uccccuacggaccagg

SEQ ID NO: 2816489 - RNA, 14 nt, Human
acucaccaucugug

SEQ ID NO: 2816490 - RNA, 21 nt, Human
uccccuauggaauuuauaauu

SEQ ID NO: 2816491 - RNA, 13 nt, Human
uccccucccuggc

SEQ ID NO: 2816492 - RNA, 17 nt, Human
uccccuccccugcugca

SEQ ID NO: 2816493 - RNA, 15 nt, Human
uccccuccccugcug

SEQ ID NO: 2816494 - RNA, 16 nt, Human
uccccuccccugcugc

SEQ ID NO: 2816495 - RNA, 11 nt, Human
uccccuccccc

SEQ ID NO: 2816496 - RNA, 19 nt, Human
uccccucccccaccccugc

SEQ ID NO: 2816497 - RNA, 20 nt, Human
uccccucccccaccccugcu

SEQ ID NO: 2816498 - RNA, 21 nt, Human
uccccucccccaccccugcug

SEQ ID NO: 2816499 - RNA, 13 nt, Human
uccccuccccugc

SEQ ID NO: 2816500 - RNA, 14 nt, Human
uccccuccccugcu

SEQ ID NO: 2816501 - RNA, 13 nt, Human
uccccucacagcc

SEQ ID NO: 2816502 - RNA, 14 nt, Human
uccccucacagccu

SEQ ID NO: 2816503 - RNA, 13 nt, Human
uccccucccagag

SEQ ID NO: 2816504 - RNA, 19 nt, Human
ucccucccaccucugugac

SEQ ID NO: 2816505 - RNA, 21 nt, Human
ucccucccaccucugugaccu

SEQ ID NO: 2816506 - RNA, 14 nt, Human
ucccuccccuucuc

SEQ ID NO: 2816507 - RNA, 15 nt, Human
ucccuccccuucucu

SEQ ID NO: 2816508 - RNA, 13 nt, Human
ucccuccagcaca

SEQ ID NO: 2816509 - RNA, 14 nt, Human
ucccuccagcacaa

SEQ ID NO: 2816510 - RNA, 17 nt, Human
ucccuccagcacaaaca

SEQ ID NO: 2816511 - RNA, 22 nt, Human
ucccuccagcacaaacacaagg

SEQ ID NO: 2816512 - RNA, 13 nt, Human
ucccucccaccuc

SEQ ID NO: 2816513 - RNA, 14 nt, Human
ucccucccaccucu

SEQ ID NO: 2816514 - RNA, 15 nt, Human
ucccucccaccucug

SEQ ID NO: 2816515 - RNA, 16 nt, Human
ucccucccaccucugu

SEQ ID NO: 2816516 - RNA, 22 nt, Human
ucccggcugcccuuucugggca

SEQ ID NO: 2816517 - RNA, 18 nt, Human
ucccggcugcccuuucug

SEQ ID NO: 2816518 - RNA, 15 nt, Human
ucccggcugcccuuu

SEQ ID NO: 2816519 - RNA, 14 nt, Human
ucccggcugcccuu

SEQ ID NO: 2816520 - RNA, 13 nt, Human
ucccggcugcccu

SEQ ID NO: 2816521 - RNA, 18 nt, Human
ucccugacucucugugac

SEQ ID NO: 2816522 - RNA, 17 nt, Human
ucccugacucucuguga

SEQ ID NO: 2816523 - RNA, 20 nt, Human
ucccugacucucugugaccu

SEQ ID NO: 2816524 - RNA, 16 nt, Human
ucccugacucucugug

SEQ ID NO: 2816525 - RNA, 19 nt, Human
ucccugaagccagccuucu

SEQ ID NO: 2816526 - RNA, 20 nt, Human
ucccugagagugucucugau

SEQ ID NO: 2816527 - RNA, 23 nt, Human
acucaccuggggcugcuggccug

SEQ ID NO: 2816528 - RNA, 14 nt, Human
acucaccuggggcu

SEQ ID NO: 2816529 - RNA, 18 nt, Human
acucaccuggggcugcug

SEQ ID NO: 2816530 - RNA, 19 nt, Human
acucaccuggggcugcugg

SEQ ID NO: 2816531 - RNA, 20 nt, Human
acucaccuggggcugcuggc

SEQ ID NO: 2816532 - RNA, 12 nt, Human
acucaccugggg

SEQ ID NO: 2816533 - RNA, 16 nt, Human
ucccugauugaccugc

SEQ ID NO: 2816534 - RNA, 17 nt, Human
ucccugauugaccugcu

SEQ ID NO: 2816535 - RNA, 18 nt, Human
ucccugauugaccugcuc

SEQ ID NO: 2816536 - RNA, 19 nt, Human
ucccugauugaccugcucc

SEQ ID NO: 2816537 - RNA, 20 nt, Human
ucccugauugaccugcuccg

SEQ ID NO: 2816538 - RNA, 23 nt, Human
ucccugauugaccugcuccgcug

SEQ ID NO: 2816539 - RNA, 22 nt, Human
acucacuggggccuacagcuuu

SEQ ID NO: 2816540 - RNA, 12 nt, Human
acucacugaagc

SEQ ID NO: 2816541 - RNA, 13 nt, Human
acucacugaagcc

SEQ ID NO: 2816542 - RNA, 14 nt, Human
acucacugaagccu

SEQ ID NO: 2816543 - RNA, 15 nt, Human
acucacugaagccug

SEQ ID NO: 2816544 - RNA, 16 nt, Human
acucacugaagccugc

SEQ ID NO: 2816545 - RNA, 18 nt, Human
acucacugaagccugcgu

SEQ ID NO: 2816546 - RNA, 19 nt, Human
acucacugaagccugcguu

SEQ ID NO: 2816547 - RNA, 13 nt, Human
acucauugaaaug

SEQ ID NO: 2816548 - RNA, 14 nt, Human
acucauugaaaugu

SEQ ID NO: 2816549 - RNA, 15 nt, Human
acucauugaaauguc

SEQ ID NO: 2816550 - RNA, 16 nt, Human
acucauugaaauguca

SEQ ID NO: 2816551 - RNA, 19 nt, Human
acucauugaaaugucacgu

SEQ ID NO: 2816552 - RNA, 15 nt, Human
acucauucuucugua

SEQ ID NO: 2816553 - RNA, 13 nt, Human
acucauuccugua

SEQ ID NO: 2816554 - RNA, 16 nt, Human
ucccugagcaggaaag

SEQ ID NO: 2816555 - RNA, 14 nt, Human
acucacugucaaug

SEQ ID NO: 2816556 - RNA, 13 nt, Human
acuccagccuggg

SEQ ID NO: 2816557 - RNA, 14 nt, Human
acuccagccugggc

SEQ ID NO: 2816558 - RNA, 23 nt, Human
acuccuccuccaaaggcccccua

SEQ ID NO: 2816559 - RNA, 11 nt, Human
acuccuccucu

SEQ ID NO: 2816560 - RNA, 12 nt, Human
acuccuccucuu

SEQ ID NO: 2816561 - RNA, 13 nt, Human
acuccuccucuuu

SEQ ID NO: 2816562 - RNA, 15 nt, Human
acuccuccucuuucu

SEQ ID NO: 2816563 - RNA, 16 nt, Human
acuccuccucuuucuc

SEQ ID NO: 2816564 - RNA, 18 nt, Human
acuccuccucuuucucuc

SEQ ID NO: 2816565 - RNA, 19 nt, Human
acuccuccucuuucucucc

SEQ ID NO: 2816566 - RNA, 21 nt, Human
acuccuccucuuucucucccc

SEQ ID NO: 2816567 - RNA, 22 nt, Human
acuccuccucuuucucucccca

SEQ ID NO: 2816568 - RNA, 15 nt, Human
acuccuccuuucucc

SEQ ID NO: 2816569 - RNA, 20 nt, Human
acuccagccugagcaacaga

SEQ ID NO: 2816570 - RNA, 19 nt, Human
acuccagccugagcaacag

SEQ ID NO: 2816571 - RNA, 15 nt, Human
acuccagccugagca

SEQ ID NO: 2816572 - RNA, 14 nt, Human
acuccagccugagc

SEQ ID NO: 2816573 - RNA, 13 nt, Human
acuccagccugag

SEQ ID NO: 2816574 - RNA, 19 nt, Human
acuccugacagucuugugc

SEQ ID NO: 2816575 - RNA, 21 nt, Human
acuccugacagucuugugcuu

SEQ ID NO: 2816576 - RNA, 15 nt, Human
acuccugacagucuu

SEQ ID NO: 2816577 - RNA, 21 nt, Human
acuccuccuccaaaggccccc

SEQ ID NO: 2816578 - RNA, 22 nt, Human
acuccuccuccaaaggcccccu

SEQ ID NO: 2816579 - RNA, 13 nt, Human
acuccucugucca

SEQ ID NO: 2816580 - RNA, 14 nt, Human
acuccucuguccag

SEQ ID NO: 2816581 - RNA, 14 nt, Human
ucccuggggugggg

SEQ ID NO: 2816582 - RNA, 19 nt, Human
ucccugucuuuacuccuca

SEQ ID NO: 2816583 - RNA, 23 nt, Human
ucccugucuuuacuccucacacu

SEQ ID NO: 2816584 - RNA, 14 nt, Human
ucccugucuuuccu

SEQ ID NO: 2816585 - RNA, 17 nt, Human
ucccugucuuuccuaag

SEQ ID NO: 2816586 - RNA, 20 nt, Human
ucccugucuuuccuaagacc

SEQ ID NO: 2816587 - RNA, 23 nt, Human
ucccugucuuuccuaagaccugg

SEQ ID NO: 2816588 - RNA, 12 nt, Human
ucccugugaggg

SEQ ID NO: 2816589 - RNA, 17 nt, Human
ucccuuuccuuccaucc

SEQ ID NO: 2816590 - RNA, 14 nt, Human
ucccuuuccuucca

SEQ ID NO: 2816591 - RNA, 10 nt, Human
ucccuuaccc

SEQ ID NO: 2816592 - RNA, 19 nt, Human
ucccuuuccuuccaucccu

SEQ ID NO: 2816593 - RNA, 18 nt, Human
ucccuuuccuuccauccc

SEQ ID NO: 2816594 - RNA, 23 nt, Human
ucccuuuccuuccaucccuaccc

SEQ ID NO: 2816595 - RNA, 16 nt, Human
ucccuuuccuuccuaa

SEQ ID NO: 2816596 - RNA, 17 nt, Human
ucccuuuccuuccuaau

SEQ ID NO: 2816597 - RNA, 18 nt, Human
ucccuuaaaauagaaaua

SEQ ID NO: 2816598 - RNA, 20 nt, Human
ucccuguguccaccuguggg

SEQ ID NO: 2816599 - RNA, 22 nt, Human
ucccuguguccaccugugggug

SEQ ID NO: 2816600 - RNA, 14 nt, Human
uccuacuuccccuu

SEQ ID NO: 2816601 - RNA, 20 nt, Human
uccuaacaaaagaugaaagc

SEQ ID NO: 2816602 - RNA, 17 nt, Human
uccuaacugaagagaca

SEQ ID NO: 2816603 - RNA, 18 nt, Human
uccuaacugaagagacag

SEQ ID NO: 2816604 - RNA, 14 nt, Human
uccuaacuuuucaa

SEQ ID NO: 2816605 - RNA, 13 nt, Human
uccuaagaaauau

SEQ ID NO: 2816606 - RNA, 15 nt, Human
uccuaagaaauaugu

SEQ ID NO: 2816607 - RNA, 18 nt, Human
uccuaagaaauaugugag

SEQ ID NO: 2816608 - RNA, 19 nt, Human
uccuaagaaauaugugaga

SEQ ID NO: 2816609 - RNA, 20 nt, Human
uccuaagaaauaugugagau

SEQ ID NO: 2816610 - RNA, 23 nt, Human
uccuaagaaauaugugagauuuu

SEQ ID NO: 2816611 - RNA, 13 nt, Human
uccuaagaagcuu

SEQ ID NO: 2816612 - RNA, 15 nt, Human
uccuaagaagcuucu

SEQ ID NO: 2816613 - RNA, 16 nt, Human
uccuaagaagcuucua

SEQ ID NO: 2816614 - RNA, 19 nt, Human
uccuaagaagcuucuaaua

SEQ ID NO: 2816615 - RNA, 22 nt, Human
uccuaagaagcuucuaauaaau

SEQ ID NO: 2816616 - RNA, 13 nt, Human
uccuaagacacaa

SEQ ID NO: 2816617 - RNA, 16 nt, Human
uccuaagacacaaaug

SEQ ID NO: 2816618 - RNA, 19 nt, Human
uccuaagacacaaaugcau

SEQ ID NO: 2816619 - RNA, 15 nt, Human
uccuaagaccugggg

SEQ ID NO: 2816620 - RNA, 16 nt, Human
uccuaagaccuggggu

SEQ ID NO: 2816621 - RNA, 18 nt, Human
uccuaagaccugggguug

SEQ ID NO: 2816622 - RNA, 18 nt, Human
uccuaaagagaguauuuu

SEQ ID NO: 2816623 - RNA, 17 nt, Human
uccgguagggaggcagc

SEQ ID NO: 2816624 - RNA, 18 nt, Human
uccgguagggaggcagcc

SEQ ID NO: 2816625 - RNA, 19 nt, Human
uccgguagggaggcagccu

SEQ ID NO: 2816626 - RNA, 19 nt, Human
ucccuuucugcuuguguua

SEQ ID NO: 2816627 - RNA, 20 nt, Human
ucccuuuuuauaucccauuu

SEQ ID NO: 2816628 - RNA, 21 nt, Human
uccggcuugaccuguuucucu

SEQ ID NO: 2816629 - RNA, 20 nt, Human
accuaccacucacaugacac

SEQ ID NO: 2816630 - RNA, 15 nt, Human
accuacccauacacc

SEQ ID NO: 2816631 - RNA, 14 nt, Human
accuaccaucaggg

SEQ ID NO: 2816632 - RNA, 12 nt, Human
accuaccacaug

SEQ ID NO: 2816633 - RNA, 16 nt, Human
accuaccaccacgccc

SEQ ID NO: 2816634 - RNA, 20 nt, Human
accuaccaccacgcccggcu

SEQ ID NO: 2816635 - RNA, 15 nt, Human
accuaccacaugcca

SEQ ID NO: 2816636 - RNA, 14 nt, Human
accuaguacugccc

SEQ ID NO: 2816637 - RNA, 19 nt, Human
accucaaaaugucuaagau

SEQ ID NO: 2816638 - RNA, 16 nt, Human
accucaaacuaucugg

SEQ ID NO: 2816639 - RNA, 20 nt, Human
accucaaacuaucuggccau

SEQ ID NO: 2816640 - RNA, 14 nt, Human
accuaccaaaaugg

SEQ ID NO: 2816641 - RNA, 20 nt, Human
accuacauauuccauguuug

SEQ ID NO: 2816642 - RNA, 21 nt, Human
accuaauucgaugaaggcugc

SEQ ID NO: 2816643 - RNA, 22 nt, Human
accuaauucgaugaaggcugcc

SEQ ID NO: 2816644 - RNA, 16 nt, Human
accuacacacugucau

SEQ ID NO: 2816645 - RNA, 23 nt, Human
accuacacacugucaugcuucau

SEQ ID NO: 2816646 - RNA, 13 nt, Human
accuaaugaaagu

SEQ ID NO: 2816647 - RNA, 21 nt, Human
accuaaugaaagugaugacau

SEQ ID NO: 2816648 - RNA, 22 nt, Human
accuaaugaaagugaugacaua

SEQ ID NO: 2816649 - RNA, 13 nt, Human
ucaggaacagaag

SEQ ID NO: 2816650 - RNA, 16 nt, Human
ucaggaacagaaggau

SEQ ID NO: 2816651 - RNA, 14 nt, Human
ucaggaacagaagg

SEQ ID NO: 2816652 - RNA, 20 nt, Human
accgcgacuaauuucaaaau

SEQ ID NO: 2816653 - RNA, 15 nt, Human
accgcgucuggugac

SEQ ID NO: 2816654 - RNA, 18 nt, Human
ucaggaacagcuauggga

SEQ ID NO: 2816655 - RNA, 17 nt, Human
accgcgacuaauuucaa

SEQ ID NO: 2816656 - RNA, 16 nt, Human
accgcgacuaauuuca

SEQ ID NO: 2816657 - RNA, 15 nt, Human
accgcucaccuagag

SEQ ID NO: 2816658 - RNA, 17 nt, Human
accgcucaccuagagcc

SEQ ID NO: 2816659 - RNA, 18 nt, Human
accgcucaccuagagcca

SEQ ID NO: 2816660 - RNA, 19 nt, Human
accgcucaccuagagccag

SEQ ID NO: 2816661 - RNA, 12 nt, Human
accgcuccaggu

SEQ ID NO: 2816662 - RNA, 18 nt, Human
ucagcuuuuugucuuuuc

SEQ ID NO: 2816663 - RNA, 16 nt, Human
accuaaagguguauuu

SEQ ID NO: 2816664 - RNA, 20 nt, Human
accuaaagguguauuuaaac

SEQ ID NO: 2816665 - RNA, 18 nt, Human
accuaacauuauuuauuc

SEQ ID NO: 2816666 - RNA, 22 nt, Human
accuaaaaggaaaucucacccc

SEQ ID NO: 2816667 - RNA, 21 nt, Human
accuaaaaggaaaucucaccc

SEQ ID NO: 2816668 - RNA, 19 nt, Human
accuaaacgguucaguuuc

SEQ ID NO: 2816669 - RNA, 13 nt, Human
ucaugaagcccaa

SEQ ID NO: 2816670 - RNA, 11 nt, Human
ucaugaagccu

SEQ ID NO: 2816671 - RNA, 12 nt, Human
ucaugaagccug

SEQ ID NO: 2816672 - RNA, 13 nt, Human
ucaugaagccugu

SEQ ID NO: 2816673 - RNA, 15 nt, Human
ucaugaagccugugg

SEQ ID NO: 2816674 - RNA, 16 nt, Human
ucaugaagccugugga

SEQ ID NO: 2816675 - RNA, 16 nt, Human
ucaugaaucugcaaug

SEQ ID NO: 2816676 - RNA, 13 nt, Human
ucaucuauaaaga

SEQ ID NO: 2816677 - RNA, 23 nt, Human
ucaucuauaaagaagaacuugca

SEQ ID NO: 2816678 - RNA, 22 nt, Human
ucaucuauaguugauauguuuu

SEQ ID NO: 2816679 - RNA, 17 nt, Human
ucaucuaugaggaaagg

SEQ ID NO: 2816680 - RNA, 15 nt, Human
ucaucuauucaagca

SEQ ID NO: 2816681 - RNA, 21 nt, Human
ucaucuauucaagcacuuaca

SEQ ID NO: 2816682 - RNA, 12 nt, Human
ucaucuauuuug

SEQ ID NO: 2816683 - RNA, 13 nt, Human
ucaucuauuuuga

SEQ ID NO: 2816684 - RNA, 14 nt, Human
ucaucuauuuugau

SEQ ID NO: 2816685 - RNA, 17 nt, Human
ucaucuauuuugaugca

SEQ ID NO: 2816686 - RNA, 18 nt, Human
ucaucuauuuugaugcag

SEQ ID NO: 2816687 - RNA, 19 nt, Human
ucaucuauuuugaugcagc

SEQ ID NO: 2816688 - RNA, 20 nt, Human
ucaucuauuuugaugcagca

SEQ ID NO: 2816689 - RNA, 23 nt, Human
ucaucuauuuugaugcagcauuu

SEQ ID NO: 2816690 - RNA, 12 nt, Human
ucaugaagccca

SEQ ID NO: 2816691 - RNA, 17 nt, Human
ucauccuuggucuuugu

SEQ ID NO: 2816692 - RNA, 20 nt, Human
ucauccuuggucuuuguauc

SEQ ID NO: 2816693 - RNA, 21 nt, Human
ucauccuuggucuuuguaucu

SEQ ID NO: 2816694 - RNA, 13 nt, Human
ucauccuccagua

SEQ ID NO: 2816695 - RNA, 21 nt, Human
ucauccuccaguaccuugcuu

SEQ ID NO: 2816696 - RNA, 11 nt, Human
ucauccuccug

SEQ ID NO: 2816697 - RNA, 12 nt, Human
ucauccuccugg

SEQ ID NO: 2816698 - RNA, 13 nt, Human
ucauccuccugga

SEQ ID NO: 2816699 - RNA, 14 nt, Human
ucauccuccuggaa

SEQ ID NO: 2816700 - RNA, 15 nt, Human
ucauccuccuggaac

SEQ ID NO: 2816701 - RNA, 16 nt, Human
ucauccuccuggaacc

SEQ ID NO: 2816702 - RNA, 22 nt, Human
ucauccuccuggaaccuugcug

SEQ ID NO: 2816703 - RNA, 23 nt, Human
ucauccuccuggaaccuugcugu

SEQ ID NO: 2816704 - RNA, 16 nt, Human
ucauccugacucugcc

SEQ ID NO: 2816705 - RNA, 17 nt, Human
ucauccugacucugccc

SEQ ID NO: 2816706 - RNA, 19 nt, Human
ucauccugacucugccccc

SEQ ID NO: 2816707 - RNA, 20 nt, Human
ucauccugacucugcccccu

SEQ ID NO: 2816708 - RNA, 12 nt, Human
ucauccugcagg

SEQ ID NO: 2816709 - RNA, 13 nt, Human
ucauccugcaggc

SEQ ID NO: 2816710 - RNA, 15 nt, Human
ucauccugccuucau

SEQ ID NO: 2816711 - RNA, 17 nt, Human
ucauccugccuucaugg

SEQ ID NO: 2816712 - RNA, 23 nt, Human
ucauccugccuucauggaacuca

SEQ ID NO: 2816713 - RNA, 11 nt, Human
ucauccuggcu

SEQ ID NO: 2816714 - RNA, 15 nt, Human
ucauccugugcucgg

SEQ ID NO: 2816715 - RNA, 22 nt, Human
accucccuguucaaggccccug

SEQ ID NO: 2816716 - RNA, 13 nt, Human
accucccuuccga

SEQ ID NO: 2816717 - RNA, 18 nt, Human
accucccuuccgacccuc

SEQ ID NO: 2816718 - RNA, 22 nt, Human
accucccuuccgacccucuggg

SEQ ID NO: 2816719 - RNA, 13 nt, Human
accucccugaccc

SEQ ID NO: 2816720 - RNA, 17 nt, Human
accucccugacccgucu

SEQ ID NO: 2816721 - RNA, 12 nt, Human
accucccugccc

SEQ ID NO: 2816722 - RNA, 13 nt, Human
accucccugccca

SEQ ID NO: 2816723 - RNA, 14 nt, Human
accucccugcccag

SEQ ID NO: 2816724 - RNA, 15 nt, Human
accucccugcccagg

SEQ ID NO: 2816725 - RNA, 18 nt, Human
accucccugcccaggccg

SEQ ID NO: 2816726 - RNA, 21 nt, Human
accucccugcccaggccggcc

SEQ ID NO: 2816727 - RNA, 12 nt, Human
accuccugccuc

SEQ ID NO: 2816728 - RNA, 13 nt, Human
accuccugccucg

SEQ ID NO: 2816729 - RNA, 16 nt, Human
accucaaccaaugcca

SEQ ID NO: 2816730 - RNA, 17 nt, Human
accucaaccauccuggc

SEQ ID NO: 2816731 - RNA, 21 nt, Human
accucaaccauccuggcugcg

SEQ ID NO: 2816732 - RNA, 14 nt, Human
accucccucuuguu

SEQ ID NO: 2816733 - RNA, 18 nt, Human
accucccucuuguuuugu

SEQ ID NO: 2816734 - RNA, 22 nt, Human
accucccucuuguuuuguuugu

SEQ ID NO: 2816735 - RNA, 23 nt, Human
accucccucuuguuuuguuuguc

SEQ ID NO: 2816736 - RNA, 11 nt, Human
accucccuccc

SEQ ID NO: 2816737 - RNA, 12 nt, Human
ucaucccuuucc

SEQ ID NO: 2816738 - RNA, 13 nt, Human
ucaucccuuucca

SEQ ID NO: 2816739 - RNA, 14 nt, Human
ucaucccuuuccag

SEQ ID NO: 2816740 - RNA, 17 nt, Human
ucaucccuaaugcugca

SEQ ID NO: 2816741 - RNA, 18 nt, Human
ucaucccuaaugcugcag

SEQ ID NO: 2816742 - RNA, 15 nt, Human
ucauccuauuguuga

SEQ ID NO: 2816743 - RNA, 11 nt, Human
ucauccccuua

SEQ ID NO: 2816744 - RNA, 23 nt, Human
accuccugccucgaacuggcugc

SEQ ID NO: 2816745 - RNA, 20 nt, Human
ucaucccauuaaucauuucc

SEQ ID NO: 2816746 - RNA, 21 nt, Human
ucaucccauuaaucauuuccc

SEQ ID NO: 2816747 - RNA, 22 nt, Human
ucaucccauuaaucauuucccc

SEQ ID NO: 2816748 - RNA, 22 nt, Human
ucaucccaucuaagcugcagcu

SEQ ID NO: 2816749 - RNA, 17 nt, Human
ucaucccaugagacccu

SEQ ID NO: 2816750 - RNA, 12 nt, Human
ucauccccaggg

SEQ ID NO: 2816751 - RNA, 17 nt, Human
ucauccccucacuugcc

SEQ ID NO: 2816752 - RNA, 21 nt, Human
ucauccccaggggucccagcc

SEQ ID NO: 2816753 - RNA, 14 nt, Human
ucauccccaguccc

SEQ ID NO: 2816754 - RNA, 15 nt, Human
ucauccccaguccca

SEQ ID NO: 2816755 - RNA, 20 nt, Human
ucauccccaggggucccagc

SEQ ID NO: 2816756 - RNA, 14 nt, Human
accugaccucuugc

SEQ ID NO: 2816757 - RNA, 15 nt, Human
accugaccucuugcu

SEQ ID NO: 2816758 - RNA, 16 nt, Human
accugaccucuugcug

SEQ ID NO: 2816759 - RNA, 17 nt, Human
accugaccucuugcugu

SEQ ID NO: 2816760 - RNA, 18 nt, Human
accugaccucuugcuguc

SEQ ID NO: 2816761 - RNA, 19 nt, Human
accugaccucuugcugucu

SEQ ID NO: 2816762 - RNA, 20 nt, Human
accugaccucuugcugucuc

SEQ ID NO: 2816763 - RNA, 21 nt, Human
accugaccucuugcugucucu

SEQ ID NO: 2816764 - RNA, 22 nt, Human
accugaccucuugcugucucug

SEQ ID NO: 2816765 - RNA, 12 nt, Human
accugaaaagua

SEQ ID NO: 2816766 - RNA, 21 nt, Human
accugaaaaaaaguuuacaag

SEQ ID NO: 2816767 - RNA, 14 nt, Human
accugaaauuccaa

SEQ ID NO: 2816768 - RNA, 15 nt, Human
accugaaauuccaaa

SEQ ID NO: 2816769 - RNA, 20 nt, Human
accugacugguuaacagcag

SEQ ID NO: 2816770 - RNA, 12 nt, Human
accucucacucc

SEQ ID NO: 2816771 - RNA, 13 nt, Human
accucucacuccc

SEQ ID NO: 2816772 - RNA, 16 nt, Human
accucucacuccccau

SEQ ID NO: 2816773 - RNA, 16 nt, Human
accucuccauccugcu

SEQ ID NO: 2816774 - RNA, 13 nt, Human
accucucccaggg

SEQ ID NO: 2816775 - RNA, 11 nt, Human
accucucccac

SEQ ID NO: 2816776 - RNA, 12 nt, Human
accucucccacg

SEQ ID NO: 2816777 - RNA, 15 nt, Human
accucucccacggga

SEQ ID NO: 2816778 - RNA, 17 nt, Human
accucuuuaaguauuga

SEQ ID NO: 2816779 - RNA, 22 nt, Human
accucuuuaaguauugauucug

SEQ ID NO: 2816780 - RNA, 12 nt, Human
accucuugcugu

SEQ ID NO: 2816781 - RNA, 13 nt, Human
accucuugcuguc

SEQ ID NO: 2816782 - RNA, 14 nt, Human
accucuugcugucu

SEQ ID NO: 2816783 - RNA, 15 nt, Human
accucuugcugucuc

SEQ ID NO: 2816784 - RNA, 16 nt, Human
accucuugcugucucu

SEQ ID NO: 2816785 - RNA, 17 nt, Human
accucuugcugucucug

SEQ ID NO: 2816786 - RNA, 18 nt, Human
accucuugcugucucugc

SEQ ID NO: 2816787 - RNA, 20 nt, Human
accucuugcugucucugcuc

SEQ ID NO: 2816788 - RNA, 24 nt, Human
accucuugcugucucugcucgccc

SEQ ID NO: 2816789 - RNA, 15 nt, Human
accugaaaaaaaguu

SEQ ID NO: 2816790 - RNA, 18 nt, Human
accugaaaaaaaguuuac

SEQ ID NO: 2816791 - RNA, 19 nt, Human
accugaaaaaaaguuuaca

SEQ ID NO: 2816792 - RNA, 22 nt, Human
accugaggucgggaguuggaga

SEQ ID NO: 2816793 - RNA, 23 nt, Human
accugaggucgggaguuggagac

SEQ ID NO: 2816794 - RNA, 23 nt, Human
accugagucacccuaccugugcc

SEQ ID NO: 2816795 - RNA, 22 nt, Human
accugagucacccuaccugugc

SEQ ID NO: 2816796 - RNA, 18 nt, Human
accugaucacuagccugu

SEQ ID NO: 2816797 - RNA, 23 nt, Human
accugcacuggggagcccgucuc

SEQ ID NO: 2816798 - RNA, 18 nt, Human
accugcaucuaagcccau

SEQ ID NO: 2816799 - RNA, 17 nt, Human
accugcaucuuuagugc

SEQ ID NO: 2816800 - RNA, 19 nt, Human
accugcaggccaagagcag

SEQ ID NO: 2816801 - RNA, 17 nt, Human
accugcaggcugagcca

SEQ ID NO: 2816802 - RNA, 23 nt, Human
accugcaggcugagccacucucu

SEQ ID NO: 2816803 - RNA, 15 nt, Human
accugcaggccaaga

SEQ ID NO: 2816804 - RNA, 18 nt, Human
accuccuugucacuuuau

SEQ ID NO: 2816805 - RNA, 19 nt, Human
accuccuugucacuuuauu

SEQ ID NO: 2816806 - RNA, 13 nt, Human
accuccugggcua

SEQ ID NO: 2816807 - RNA, 23 nt, Human
ucauugcugagccucugcucccc

SEQ ID NO: 2816808 - RNA, 14 nt, Human
ucauugcuguagga

SEQ ID NO: 2816809 - RNA, 17 nt, Human
ucauugcugagccucug

SEQ ID NO: 2816810 - RNA, 22 nt, Human
ucauugcugagccucugcuccc

SEQ ID NO: 2816811 - RNA, 17 nt, Human
accuccugucucuggcc

SEQ ID NO: 2816812 - RNA, 13 nt, Human
accuccuguggaa

SEQ ID NO: 2816813 - RNA, 14 nt, Human
accuccuguggaac

SEQ ID NO: 2816814 - RNA, 15 nt, Human
accuccuguggaacc

SEQ ID NO: 2816815 - RNA, 20 nt, Human
accuccuguggaacccagca

SEQ ID NO: 2816816 - RNA, 21 nt, Human
accuccuguggaacccagcag

SEQ ID NO: 2816817 - RNA, 15 nt, Human
accuccugucucugg

SEQ ID NO: 2816818 - RNA, 16 nt, Human
accuccugucucuggc

SEQ ID NO: 2816819 - RNA, 15 nt, Human
ucauugcugagccuc

SEQ ID NO: 2816820 - RNA, 16 nt, Human
ucauugcugagccucu

SEQ ID NO: 2816821 - RNA, 15 nt, Human
ucauugauuuccugu

SEQ ID NO: 2816822 - RNA, 17 nt, Human
ucauugauuuccugugu

SEQ ID NO: 2816823 - RNA, 18 nt, Human
ucauugauuuccuguguc

SEQ ID NO: 2816824 - RNA, 19 nt, Human
ucauugauuuccuguguca

SEQ ID NO: 2816825 - RNA, 14 nt, Human
ucauugccugugua

SEQ ID NO: 2816826 - RNA, 16 nt, Human
ucauugccuguguaug

SEQ ID NO: 2816827 - RNA, 22 nt, Human
ucauugccuguguauggaaaaa

SEQ ID NO: 2816828 - RNA, 23 nt, Human
ucauugccuguguauggaaaaac

SEQ ID NO: 2816829 - RNA, 11 nt, Human
ucauugaaaug

SEQ ID NO: 2816830 - RNA, 12 nt, Human
ucauugaaaugu

SEQ ID NO: 2816831 - RNA, 14 nt, Human
ucauugaaauguca

SEQ ID NO: 2816832 - RNA, 17 nt, Human
ucauugaaaugucacgu

SEQ ID NO: 2816833 - RNA, 12 nt, Human
ucauucuucugu

SEQ ID NO: 2816834 - RNA, 15 nt, Human
ucauucuuguuuucu

SEQ ID NO: 2816835 - RNA, 21 nt, Human
ucauucuuccaagcugagagu

SEQ ID NO: 2816836 - RNA, 13 nt, Human
ucauucugcauug

SEQ ID NO: 2816837 - RNA, 16 nt, Human
ucauucugcauugcua

SEQ ID NO: 2816838 - RNA, 19 nt, Human
ucauucugcauugcuagau

SEQ ID NO: 2816839 - RNA, 22 nt, Human
ucauucugcauugcuagauaaa

SEQ ID NO: 2816840 - RNA, 16 nt, Human
ucauucugugaucauu

SEQ ID NO: 2816841 - RNA, 17 nt, Human
ucauuacucuuaaggaa

SEQ ID NO: 2816842 - RNA, 14 nt, Human
ucauuacugggccu

SEQ ID NO: 2816843 - RNA, 15 nt, Human
ucauuacugggccuu

SEQ ID NO: 2816844 - RNA, 13 nt, Human
ucauuacuugauu

SEQ ID NO: 2816845 - RNA, 15 nt, Human
ucauuacuugauuaa

SEQ ID NO: 2816846 - RNA, 21 nt, Human
ucauuacuugauuaagauuuu

SEQ ID NO: 2816847 - RNA, 16 nt, Human
ucauucucgugaguca

SEQ ID NO: 2816848 - RNA, 13 nt, Human
ucaugaugcaguc

SEQ ID NO: 2816849 - RNA, 15 nt, Human
ucaugaugcagucuc

SEQ ID NO: 2816850 - RNA, 16 nt, Human
ucaugaugcagucucc

SEQ ID NO: 2816851 - RNA, 17 nt, Human
ucaugaugcagucuccu

SEQ ID NO: 2816852 - RNA, 19 nt, Human
ucaugaugcagucuccucu

SEQ ID NO: 2816853 - RNA, 20 nt, Human
ucaugaugcagucuccucuu

SEQ ID NO: 2816854 - RNA, 21 nt, Human
ucaugaugcagucuccucuuu

SEQ ID NO: 2816855 - RNA, 22 nt, Human
ucaugaugcagucuccucuuua

SEQ ID NO: 2816856 - RNA, 23 nt, Human
ucaugaugcagucuccucuuuaa

SEQ ID NO: 2816857 - RNA, 15 nt, Human
ucaugaugcuagcca

SEQ ID NO: 2816858 - RNA, 15 nt, Human
ucauuacccuucccu

SEQ ID NO: 2816859 - RNA, 19 nt, Human
ucauuacccuucccugcac

SEQ ID NO: 2816860 - RNA, 21 nt, Human
ucauuacccuucccugcacua

SEQ ID NO: 2816861 - RNA, 22 nt, Human
ucauuaccuuuuaccagcuuuu

SEQ ID NO: 2816862 - RNA, 23 nt, Human
ucauuaccuuuuaccagcuuuua

SEQ ID NO: 2816863 - RNA, 20 nt, Human
ucauuaccuuuuuugauaaa

SEQ ID NO: 2816864 - RNA, 14 nt, Human
ucauuaauucuaua

SEQ ID NO: 2816865 - RNA, 14 nt, Human
ucauuacaaauggu

SEQ ID NO: 2816866 - RNA, 13 nt, Human
ucauuaauucuau

SEQ ID NO: 2816867 - RNA, 14 nt, Human
ucauuaauguguug

SEQ ID NO: 2816868 - RNA, 16 nt, Human
uccagggaagcuggcc

SEQ ID NO: 2816869 - RNA, 14 nt, Human
uccagggaagcugg

SEQ ID NO: 2816870 - RNA, 21 nt, Human
uccaggcuguaucccaugagc

SEQ ID NO: 2816871 - RNA, 12 nt, Human
uccagggaagcu

SEQ ID NO: 2816872 - RNA, 20 nt, Human
uccaggcuuuguacagagug

SEQ ID NO: 2816873 - RNA, 14 nt, Human
acgagaccccggcu

SEQ ID NO: 2816874 - RNA, 17 nt, Human
uccagggaagcuggccg

SEQ ID NO: 2816875 - RNA, 20 nt, Human
acgagaugggaaggcacagg

SEQ ID NO: 2816876 - RNA, 14 nt, Human
uccaggcuguaucc

SEQ ID NO: 2816877 - RNA, 21 nt, Human
uccaggccgcgcccuuucccc

SEQ ID NO: 2816878 - RNA, 20 nt, Human
uccaggccgcgcccuuuccc

SEQ ID NO: 2816879 - RNA, 18 nt, Human
uccaggccgcgcccuuuc

SEQ ID NO: 2816880 - RNA, 14 nt, Human
uccaggccugcagc

SEQ ID NO: 2816881 - RNA, 20 nt, Human
uccaggccugcagcaggagu

SEQ ID NO: 2816882 - RNA, 15 nt, Human
uccaggcccgucugu

SEQ ID NO: 2816883 - RNA, 16 nt, Human
uccaggcccgucuguc

SEQ ID NO: 2816884 - RNA, 17 nt, Human
uccaggcccgucugucc

SEQ ID NO: 2816885 - RNA, 18 nt, Human
uccaggcccgucugucca

SEQ ID NO: 2816886 - RNA, 19 nt, Human
uccaggcccgucuguccau

SEQ ID NO: 2816887 - RNA, 20 nt, Human
uccaggcccgucuguccauc

SEQ ID NO: 2816888 - RNA, 22 nt, Human
uccaggcccgucuguccaucug

SEQ ID NO: 2816889 - RNA, 23 nt, Human
uccaggcccgucuguccaucugc

SEQ ID NO: 2816890 - RNA, 17 nt, Human
uccaggcccaacuguga

SEQ ID NO: 2816891 - RNA, 14 nt, Human
uccaggcaggcuaa

SEQ ID NO: 2816892 - RNA, 16 nt, Human
uccagagaguggcucc

SEQ ID NO: 2816893 - RNA, 17 nt, Human
uccagagaguggcuccu

SEQ ID NO: 2816894 - RNA, 15 nt, Human
uccagagaguggcuc

SEQ ID NO: 2816895 - RNA, 18 nt, Human
uccaggcacaggaugcug

SEQ ID NO: 2816896 - RNA, 22 nt, Human
uccaggcacaggaugcuguguu

SEQ ID NO: 2816897 - RNA, 15 nt, Human
uccaggcaccaucuc

SEQ ID NO: 2816898 - RNA, 16 nt, Human
accuucaauuccuggg

SEQ ID NO: 2816899 - RNA, 22 nt, Human
accuuauuugcuaaucaaagcc

SEQ ID NO: 2816900 - RNA, 19 nt, Human
accuggguauguguaggca

SEQ ID NO: 2816901 - RNA, 18 nt, Human
accuuaugagaaacugca

SEQ ID NO: 2816902 - RNA, 14 nt, Human
uccacucccaggca

SEQ ID NO: 2816903 - RNA, 19 nt, Human
uccacucccaggcagcccu

SEQ ID NO: 2816904 - RNA, 15 nt, Human
uccaccuucccaugc

SEQ ID NO: 2816905 - RNA, 16 nt, Human
uccaccuucccaugcc

SEQ ID NO: 2816906 - RNA, 18 nt, Human
uccaccuucccaugcccu

SEQ ID NO: 2816907 - RNA, 19 nt, Human
uccaccuucccaugcccug

SEQ ID NO: 2816908 - RNA, 17 nt, Human
uccaccuuucagcccac

SEQ ID NO: 2816909 - RNA, 18 nt, Human
uccaccuuucagcccacg

SEQ ID NO: 2816910 - RNA, 20 nt, Human
uccaccuuucagcccacguc

SEQ ID NO: 2816911 - RNA, 16 nt, Human
uccacuggacuugagc

SEQ ID NO: 2816912 - RNA, 12 nt, Human
uccacuggacuu

SEQ ID NO: 2816913 - RNA, 10 nt, Human
uccacuggac

SEQ ID NO: 2816914 - RNA, 13 nt, Human
uccacugccucug

SEQ ID NO: 2816915 - RNA, 16 nt, Human
uccacugccucugccu

SEQ ID NO: 2816916 - RNA, 17 nt, Human
uccacugccucugccuu

SEQ ID NO: 2816917 - RNA, 18 nt, Human
uccacugccucugccuua

SEQ ID NO: 2816918 - RNA, 19 nt, Human
uccacugccucugccuuag

SEQ ID NO: 2816919 - RNA, 13 nt, Human
uccacugccuucg

SEQ ID NO: 2816920 - RNA, 15 nt, Human
uccacugccuucgau

SEQ ID NO: 2816921 - RNA, 22 nt, Human
uccacugccuucgauacaccgg

SEQ ID NO: 2816922 - RNA, 14 nt, Human
uccagacccggcug

SEQ ID NO: 2816923 - RNA, 17 nt, Human
uccacuggacuugagcu

SEQ ID NO: 2816924 - RNA, 16 nt, Human
uccacugggcacaacu

SEQ ID NO: 2816925 - RNA, 18 nt, Human
uccagaauuuggaaaucc

SEQ ID NO: 2816926 - RNA, 22 nt, Human
uccagaauuuggaaauccuagu

SEQ ID NO: 2816927 - RNA, 18 nt, Human
uccagacccggcugcgug

SEQ ID NO: 2816928 - RNA, 15 nt, Human
uccagacccggcugc

SEQ ID NO: 2816929 - RNA, 19 nt, Human
uccagacccggcugcgugg

SEQ ID NO: 2816930 - RNA, 22 nt, Human
uccagacugcuuccaauuuucu

SEQ ID NO: 2816931 - RNA, 14 nt, Human
uccagacuuccuug

SEQ ID NO: 2816932 - RNA, 23 nt, Human
uccagacugcuuccaauuuucug

SEQ ID NO: 2816933 - RNA, 19 nt, Human
uccagacuuccuugagaca

SEQ ID NO: 2816934 - RNA, 20 nt, Human
uccagacuuccuugagacac

SEQ ID NO: 2816935 - RNA, 14 nt, Human
uccaaccuaaccug

SEQ ID NO: 2816936 - RNA, 16 nt, Human
uccaaccuaaccugug

SEQ ID NO: 2816937 - RNA, 17 nt, Human
uccaaccuaaccugugu

SEQ ID NO: 2816938 - RNA, 18 nt, Human
uccaaccuaaccuguguc

SEQ ID NO: 2816939 - RNA, 19 nt, Human
uccaaccuaaccugugucu

SEQ ID NO: 2816940 - RNA, 21 nt, Human
uccaaccuaaccugugucugc

SEQ ID NO: 2816941 - RNA, 14 nt, Human
uccaacugcaacuc

SEQ ID NO: 2816942 - RNA, 13 nt, Human
uccaacuccagca

SEQ ID NO: 2816943 - RNA, 12 nt, Human
uccaacuccagc

SEQ ID NO: 2816944 - RNA, 14 nt, Human
uccaacuccagcaa

SEQ ID NO: 2816945 - RNA, 13 nt, Human
uccaacuccagga

SEQ ID NO: 2816946 - RNA, 20 nt, Human
uccaagcuggucccacucag

SEQ ID NO: 2816947 - RNA, 16 nt, Human
uccaagcuggucccac

SEQ ID NO: 2816948 - RNA, 18 nt, Human
uccaacuguguucauuag

SEQ ID NO: 2816949 - RNA, 16 nt, Human
uccaagaaagaugaau

SEQ ID NO: 2816950 - RNA, 20 nt, Human
uccaacuguauauauuccca

SEQ ID NO: 2816951 - RNA, 19 nt, Human
uccaacuguguucauuaga

SEQ ID NO: 2816952 - RNA, 18 nt, Human
uccaacuuauguuuuuaa

SEQ ID NO: 2816953 - RNA, 20 nt, Human
uccaacuuauguuuuuaaau

SEQ ID NO: 2816954 - RNA, 19 nt, Human
uccaaggaaaccacagcug

SEQ ID NO: 2816955 - RNA, 21 nt, Human
uccaagcuggucccacucagu

SEQ ID NO: 2816956 - RNA, 17 nt, Human
uccaagucucaguggcu

SEQ ID NO: 2816957 - RNA, 15 nt, Human
uccaagguuuaaaga

SEQ ID NO: 2816958 - RNA, 16 nt, Human
uccaagguuuaaagag

SEQ ID NO: 2816959 - RNA, 19 nt, Human
uccaagguuuaaagagucu

SEQ ID NO: 2816960 - RNA, 20 nt, Human
uccaagguuuaaagagucua

SEQ ID NO: 2816961 - RNA, 20 nt, Human
uccaaggaaaccacagcugc

SEQ ID NO: 2816962 - RNA, 15 nt, Human
uccaagguucccuug

SEQ ID NO: 2816963 - RNA, 16 nt, Human
uccaagguucccuugu

SEQ ID NO: 2816964 - RNA, 13 nt, Human
uccaagguuuaaa

SEQ ID NO: 2816965 - RNA, 14 nt, Human
uccaagguuuaaag

SEQ ID NO: 2816966 - RNA, 18 nt, Human
uccaaucccaccaacccu

SEQ ID NO: 2816967 - RNA, 22 nt, Human
uccaagguuuaaagagucuaga

SEQ ID NO: 2816968 - RNA, 22 nt, Human
uccaauccuggcucuguggcuu

SEQ ID NO: 2816969 - RNA, 15 nt, Human
uccaaucucaaggaa

SEQ ID NO: 2816970 - RNA, 17 nt, Human
uccaaucucaaggaauc

SEQ ID NO: 2816971 - RNA, 19 nt, Human
uccaaucucaaggaaucuu

SEQ ID NO: 2816972 - RNA, 15 nt, Human
uccaacccaugauga

SEQ ID NO: 2816973 - RNA, 21 nt, Human
accugccagccuggcuucugg

SEQ ID NO: 2816974 - RNA, 18 nt, Human
accugccagccuggcuuc

SEQ ID NO: 2816975 - RNA, 16 nt, Human
accugccagccuggcu

SEQ ID NO: 2816976 - RNA, 22 nt, Human
uccaacccaugaugagcuccuc

SEQ ID NO: 2816977 - RNA, 17 nt, Human
uccaaccccccaccugc

SEQ ID NO: 2816978 - RNA, 21 nt, Human
accugcauuuguauguguccc

SEQ ID NO: 2816979 - RNA, 15 nt, Human
accugccagccuggc

SEQ ID NO: 2816980 - RNA, 14 nt, Human
accugccagccugg

SEQ ID NO: 2816981 - RNA, 16 nt, Human
accuuaaacaccccuc

SEQ ID NO: 2816982 - RNA, 22 nt, Human
accuuaaacaccccucaguugu

SEQ ID NO: 2816983 - RNA, 21 nt, Human
accuggucacaggacucugcc

SEQ ID NO: 2816984 - RNA, 17 nt, Human
accuguuuuuuuuucau

SEQ ID NO: 2816985 - RNA, 18 nt, Human
accuguuuuuuuuucauu

SEQ ID NO: 2816986 - RNA, 18 nt, Human
accuguuuucgcaccuac

SEQ ID NO: 2816987 - RNA, 21 nt, Human
accuguuuaugagaugcuggu

SEQ ID NO: 2816988 - RNA, 15 nt, Human
accuguuucucugcc

SEQ ID NO: 2816989 - RNA, 22 nt, Human
accuggguucccuuuccuucca

SEQ ID NO: 2816990 - RNA, 17 nt, Human
accuggguucccuuucc

SEQ ID NO: 2816991 - RNA, 16 nt, Human
accugguacccuccug

SEQ ID NO: 2816992 - RNA, 18 nt, Human
accugguacccuccuggc

SEQ ID NO: 2816993 - RNA, 19 nt, Human
accugguacccuccuggcu

SEQ ID NO: 2816994 - RNA, 17 nt, Human
accugguacucccucuc

SEQ ID NO: 2816995 - RNA, 21 nt, Human
accugguacucccucucagga

SEQ ID NO: 2816996 - RNA, 15 nt, Human
uccacccaggagccc

SEQ ID NO: 2816997 - RNA, 14 nt, Human
uccacccaggagcc

SEQ ID NO: 2816998 - RNA, 12 nt, Human
uccacccaggag

SEQ ID NO: 2816999 - RNA, 19 nt, Human
uccacccaccucagccucc

SEQ ID NO: 2817000 - RNA, 18 nt, Human
uccacccaccucagccuc

SEQ ID NO: 2817001 - RNA, 17 nt, Human
uccacccaccucagccu

SEQ ID NO: 2817002 - RNA, 17 nt, Human
uccaaguccaauaagac

SEQ ID NO: 2817003 - RNA, 21 nt, Human
acugcauguaccauuugcaug

SEQ ID NO: 2817004 - RNA, 21 nt, Human
acugcauggagacgcauuucg

SEQ ID NO: 2817005 - RNA, 15 nt, Human
acugcauuauucucu

SEQ ID NO: 2817006 - RNA, 20 nt, Human
acugcauuauucucuuuuau

SEQ ID NO: 2817007 - RNA, 19 nt, Human
acugccucgaaacacagaa

SEQ ID NO: 2817008 - RNA, 17 nt, Human
acugccucgaaacacag

SEQ ID NO: 2817009 - RNA, 21 nt, Human
acugcauugacuuucaguaaa

SEQ ID NO: 2817010 - RNA, 12 nt, Human
acugccugggcu

SEQ ID NO: 2817011 - RNA, 11 nt, Human
acugccugggc

SEQ ID NO: 2817012 - RNA, 13 nt, Human
acugccuguauac

SEQ ID NO: 2817013 - RNA, 14 nt, Human
acugccuguauacu

SEQ ID NO: 2817014 - RNA, 15 nt, Human
acugccuguauacuu

SEQ ID NO: 2817015 - RNA, 16 nt, Human
acugccuguauacuuu

SEQ ID NO: 2817016 - RNA, 17 nt, Human
acugccuguauacuuua

SEQ ID NO: 2817017 - RNA, 18 nt, Human
acugccuguauacuuuag

SEQ ID NO: 2817018 - RNA, 19 nt, Human
acugccuguauacuuuagu

SEQ ID NO: 2817019 - RNA, 20 nt, Human
acugccuguauacuuuagua

SEQ ID NO: 2817020 - RNA, 17 nt, Human
acugccugauggaccug

SEQ ID NO: 2817021 - RNA, 20 nt, Human
acugccugauggaccuguca

SEQ ID NO: 2817022 - RNA, 10 nt, Human
acugccucug

SEQ ID NO: 2817023 - RNA, 11 nt, Human
acugccucugc

SEQ ID NO: 2817024 - RNA, 12 nt, Human
acugccucugcc

SEQ ID NO: 2817025 - RNA, 13 nt, Human
acugccucugcca

SEQ ID NO: 2817026 - RNA, 14 nt, Human
acugccucugccac

SEQ ID NO: 2817027 - RNA, 15 nt, Human
acugccucugccaca

SEQ ID NO: 2817028 - RNA, 13 nt, Human
acugccucugccu

SEQ ID NO: 2817029 - RNA, 15 nt, Human
acugccucugccuua

SEQ ID NO: 2817030 - RNA, 18 nt, Human
acugccucugccuuagag

SEQ ID NO: 2817031 - RNA, 22 nt, Human
acugccucugccuuagaggagc

SEQ ID NO: 2817032 - RNA, 14 nt, Human
acugccucuuccuc

SEQ ID NO: 2817033 - RNA, 15 nt, Human
acugccucuuccucc

SEQ ID NO: 2817034 - RNA, 22 nt, Human
acugcauaccaaccugggcaau

SEQ ID NO: 2817035 - RNA, 20 nt, Human
acugcauaccaaccugggca

SEQ ID NO: 2817036 - RNA, 17 nt, Human
uccuagagaacgcagcc

SEQ ID NO: 2817037 - RNA, 18 nt, Human
uccuagagaacgcagccc

SEQ ID NO: 2817038 - RNA, 19 nt, Human
uccuagagaacgcagcccu

SEQ ID NO: 2817039 - RNA, 23 nt, Human
uccuagagaacgcagcccuagag

SEQ ID NO: 2817040 - RNA, 23 nt, Human
acugcauccuccgccucccgggu

SEQ ID NO: 2817041 - RNA, 20 nt, Human
acugcauccuccgccucccg

SEQ ID NO: 2817042 - RNA, 17 nt, Human
acugcauccuccgccuc

SEQ ID NO: 2817043 - RNA, 14 nt, Human
acugcguucugcaa

SEQ ID NO: 2817044 - RNA, 20 nt, Human
acugcguucugcaagcauca

SEQ ID NO: 2817045 - RNA, 18 nt, Human
acugcuccccagcccugg

SEQ ID NO: 2817046 - RNA, 19 nt, Human
acugcuccccagcccuggc

SEQ ID NO: 2817047 - RNA, 20 nt, Human
acugcuccccagcccuggcu

SEQ ID NO: 2817048 - RNA, 21 nt, Human
acugcuccccagcccuggcuc

SEQ ID NO: 2817049 - RNA, 20 nt, Human
acugcucccuaagccagccu

SEQ ID NO: 2817050 - RNA, 21 nt, Human
acugcucccuaagccagccug

SEQ ID NO: 2817051 - RNA, 23 nt, Human
acugcucccuaagccagccuggu

SEQ ID NO: 2817052 - RNA, 14 nt, Human
acugcuggcugccu

SEQ ID NO: 2817053 - RNA, 15 nt, Human
acugcuggcugccuu

SEQ ID NO: 2817054 - RNA, 23 nt, Human
acugcucccugaagccagccuuc

SEQ ID NO: 2817055 - RNA, 15 nt, Human
acugcucccugaagc

SEQ ID NO: 2817056 - RNA, 16 nt, Human
acugcucccugaagcc

SEQ ID NO: 2817057 - RNA, 17 nt, Human
acugcucccugaagcca

SEQ ID NO: 2817058 - RNA, 18 nt, Human
acugcucccugaagccag

SEQ ID NO: 2817059 - RNA, 19 nt, Human
acugcucccugaagccagc

SEQ ID NO: 2817060 - RNA, 20 nt, Human
acugcucccugaagccagcc

SEQ ID NO: 2817061 - RNA, 21 nt, Human
acugcucccugaagccagccu

SEQ ID NO: 2817062 - RNA, 22 nt, Human
acugcucccugaagccagccuu

SEQ ID NO: 2817063 - RNA, 19 nt, Human
acugcugggacuggccagg

SEQ ID NO: 2817064 - RNA, 18 nt, Human
acugcugggacuggccag

SEQ ID NO: 2817065 - RNA, 13 nt, Human
acugcugggacug

SEQ ID NO: 2817066 - RNA, 17 nt, Human
acugcuuacuuaugcca

SEQ ID NO: 2817067 - RNA, 19 nt, Human
acuggcaauugucuauuua

SEQ ID NO: 2817068 - RNA, 13 nt, Human
acuggcauuuuau

SEQ ID NO: 2817069 - RNA, 14 nt, Human
acuggcauuuuaua

SEQ ID NO: 2817070 - RNA, 18 nt, Human
acuggcauuuuauagaca

SEQ ID NO: 2817071 - RNA, 23 nt, Human
acuggcauuuuauagacacccug

SEQ ID NO: 2817072 - RNA, 19 nt, Human
acuggaguucuaugcucuc

SEQ ID NO: 2817073 - RNA, 13 nt, Human
acuggaguucuau

SEQ ID NO: 2817074 - RNA, 15 nt, Human
acuggaguucuaugc

SEQ ID NO: 2817075 - RNA, 14 nt, Human
acugcuuuuggccu

SEQ ID NO: 2817076 - RNA, 15 nt, Human
acugcuuuuggccug

SEQ ID NO: 2817077 - RNA, 17 nt, Human
acugcuuuuggccugga

SEQ ID NO: 2817078 - RNA, 22 nt, Human
acugcuuugggauuuaauuucc

SEQ ID NO: 2817079 - RNA, 23 nt, Human
acugcuuugggauuuaauuucca

SEQ ID NO: 2817080 - RNA, 13 nt, Human
ucgcuaugugcac

SEQ ID NO: 2817081 - RNA, 21 nt, Human
ucgcucccacauucugaugag

SEQ ID NO: 2817082 - RNA, 16 nt, Human
acuggcugugugaccu

SEQ ID NO: 2817083 - RNA, 21 nt, Human
acuggcugugugaccuuaggc

SEQ ID NO: 2817084 - RNA, 14 nt, Human
ucgcgcucugcuca

SEQ ID NO: 2817085 - RNA, 15 nt, Human
ucgcgcucugcucag

SEQ ID NO: 2817086 - RNA, 16 nt, Human
ucgcggcggagcuggc

SEQ ID NO: 2817087 - RNA, 18 nt, Human
ucgcggcggagcuggccc

SEQ ID NO: 2817088 - RNA, 19 nt, Human
ucgcggcggagcuggcccc

SEQ ID NO: 2817089 - RNA, 20 nt, Human
ucgcggcggagcuggccccg

SEQ ID NO: 2817090 - RNA, 18 nt, Human
ucgcucaaucaagaaaau

SEQ ID NO: 2817091 - RNA, 18 nt, Human
ucgcuauugucaccaggg

SEQ ID NO: 2817092 - RNA, 20 nt, Human
ucgcgugcccucgcugcuuc

SEQ ID NO: 2817093 - RNA, 16 nt, Human
ucgcgugcccucgcug

SEQ ID NO: 2817094 - RNA, 18 nt, Human
ucgcgugcccucgcugcu

SEQ ID NO: 2817095 - RNA, 14 nt, Human
ucgagcuuggggca

SEQ ID NO: 2817096 - RNA, 21 nt, Human
ucgcuacuggcauaguuucau

SEQ ID NO: 2817097 - RNA, 22 nt, Human
ucgcgaugggaaccgauggugg

SEQ ID NO: 2817098 - RNA, 17 nt, Human
ucgcgcccgccccugca

SEQ ID NO: 2817099 - RNA, 19 nt, Human
ucgcgcccgccccugcagc

SEQ ID NO: 2817100 - RNA, 14 nt, Human
ucgagacugcaaug

SEQ ID NO: 2817101 - RNA, 23 nt, Human
uccuuuagcgcccaguugggugg

SEQ ID NO: 2817102 - RNA, 22 nt, Human
uccuuuagcgcccaguugggug

SEQ ID NO: 2817103 - RNA, 23 nt, Human
uccuuucucagccgcuucugacu

SEQ ID NO: 2817104 - RNA, 14 nt, Human
uccuuucucagccg

SEQ ID NO: 2817105 - RNA, 11 nt, Human
uccuuucuauc

SEQ ID NO: 2817106 - RNA, 16 nt, Human
uccuuucugccgaccc

SEQ ID NO: 2817107 - RNA, 13 nt, Human
uccuuucugugcc

SEQ ID NO: 2817108 - RNA, 16 nt, Human
uccuuucugugcccua

SEQ ID NO: 2817109 - RNA, 17 nt, Human
uccuuucugugcccuac

SEQ ID NO: 2817110 - RNA, 13 nt, Human
uccuuucuccagg

SEQ ID NO: 2817111 - RNA, 15 nt, Human
uccuuucuccaggac

SEQ ID NO: 2817112 - RNA, 17 nt, Human
uccuuucuccaggacca

SEQ ID NO: 2817113 - RNA, 13 nt, Human
uccuuucucuuuc

SEQ ID NO: 2817114 - RNA, 15 nt, Human
uccuuucucuuucuc

SEQ ID NO: 2817115 - RNA, 23 nt, Human
uccuuucucuuucucucuucccu

SEQ ID NO: 2817116 - RNA, 15 nt, Human
uccuuucuuucuaac

SEQ ID NO: 2817117 - RNA, 13 nt, Human
ucgagaccagccu

SEQ ID NO: 2817118 - RNA, 17 nt, Human
ucgagaccagccuggcc

SEQ ID NO: 2817119 - RNA, 16 nt, Human
ucgagaccagccuggc

SEQ ID NO: 2817120 - RNA, 14 nt, Human
ucgagaccagccug

SEQ ID NO: 2817121 - RNA, 15 nt, Human
ucgagaccagccugg

SEQ ID NO: 2817122 - RNA, 18 nt, Human
ucgagaccagccuggcca

SEQ ID NO: 2817123 - RNA, 19 nt, Human
ucgagaccagccuggccaa

SEQ ID NO: 2817124 - RNA, 18 nt, Human
ucgagaccagccugggca

SEQ ID NO: 2817125 - RNA, 15 nt, Human
ucgaaugaaaagaca

SEQ ID NO: 2817126 - RNA, 15 nt, Human
ucgaauuaauagcuu

SEQ ID NO: 2817127 - RNA, 15 nt, Human
ucgaauuaagaauau

SEQ ID NO: 2817128 - RNA, 20 nt, Human
ucgaaucuacuaauuccaca

SEQ ID NO: 2817129 - RNA, 12 nt, Human
ucgacuuuucuu

SEQ ID NO: 2817130 - RNA, 14 nt, Human
ucgacuuuucuuaa

SEQ ID NO: 2817131 - RNA, 16 nt, Human
ucgaauuaauagcuuu

SEQ ID NO: 2817132 - RNA, 21 nt, Human
ucgaauuaauagcuuuuauug

SEQ ID NO: 2817133 - RNA, 13 nt, Human
uccuugucacugg

SEQ ID NO: 2817134 - RNA, 15 nt, Human
uccuuguccacccac

SEQ ID NO: 2817135 - RNA, 16 nt, Human
uccuuguccacccacc

SEQ ID NO: 2817136 - RNA, 13 nt, Human
uccuuguggcaga

SEQ ID NO: 2817137 - RNA, 14 nt, Human
uccuuguggcagag

SEQ ID NO: 2817138 - RNA, 15 nt, Human
uccuuguggcagagg

SEQ ID NO: 2817139 - RNA, 12 nt, Human
uccuugugcaaa

SEQ ID NO: 2817140 - RNA, 23 nt, Human
uccuugugcaaaauauuugacua

SEQ ID NO: 2817141 - RNA, 18 nt, Human
uccuuguggccugggccu

SEQ ID NO: 2817142 - RNA, 19 nt, Human
uccuuguggccugggccuc

SEQ ID NO: 2817143 - RNA, 15 nt, Human
uccuucucugaacac

SEQ ID NO: 2817144 - RNA, 18 nt, Human
uccuucucugaacacagg

SEQ ID NO: 2817145 - RNA, 20 nt, Human
uccuucucugaacacaggca

SEQ ID NO: 2817146 - RNA, 21 nt, Human
uccuucucugaacacaggcag

SEQ ID NO: 2817147 - RNA, 22 nt, Human
uccuucucugaacacaggcagc

SEQ ID NO: 2817148 - RNA, 23 nt, Human
uccuucucugaacacaggcagcu

SEQ ID NO: 2817149 - RNA, 12 nt, Human
uccuucucccuu

SEQ ID NO: 2817150 - RNA, 14 nt, Human
uccuucuccacccc

SEQ ID NO: 2817151 - RNA, 19 nt, Human
uccuuccuugcuguccuag

SEQ ID NO: 2817152 - RNA, 23 nt, Human
uccuuccuuguuacccaugaaaa

SEQ ID NO: 2817153 - RNA, 17 nt, Human
uccuucguaucccgagu

SEQ ID NO: 2817154 - RNA, 23 nt, Human
uccuucguaucccgagucuggga

SEQ ID NO: 2817155 - RNA, 21 nt, Human
uccuucgugaacauccccucc

SEQ ID NO: 2817156 - RNA, 23 nt, Human
uccuucgugaacauccccuccca

SEQ ID NO: 2817157 - RNA, 17 nt, Human
uccuuuaaauccuucca

SEQ ID NO: 2817158 - RNA, 22 nt, Human
uccuuguuucaaacacaaaugc

SEQ ID NO: 2817159 - RNA, 16 nt, Human
uccuuuaaaaaaauuu

SEQ ID NO: 2817160 - RNA, 22 nt, Human
uccuuuaaaaaaauuuaagugc

SEQ ID NO: 2817161 - RNA, 15 nt, Human
uccuuuaaaaaagaa

SEQ ID NO: 2817162 - RNA, 18 nt, Human
uccuuuaaaaaagaaaag

SEQ ID NO: 2817163 - RNA, 16 nt, Human
uccuuuaaagaugaac

SEQ ID NO: 2817164 - RNA, 14 nt, Human
uccuuguuguuggu

SEQ ID NO: 2817165 - RNA, 13 nt, Human
uccuuguuucaaa

SEQ ID NO: 2817166 - RNA, 14 nt, Human
uccuuguuucaaac

SEQ ID NO: 2817167 - RNA, 13 nt, Human
uccuuguuuauca

SEQ ID NO: 2817168 - RNA, 20 nt, Human
uccuuguuuaucagauacau

SEQ ID NO: 2817169 - RNA, 21 nt, Human
uccuuguuuaucagauacauc

SEQ ID NO: 2817170 - RNA, 23 nt, Human
uccuuguuuaucagauacaucac

SEQ ID NO: 2817171 - RNA, 19 nt, Human
uccuuuagcgcccaguugg

SEQ ID NO: 2817172 - RNA, 15 nt, Human
uccuuuagcgcccag

SEQ ID NO: 2817173 - RNA, 14 nt, Human
uccuuuacguguuu

SEQ ID NO: 2817174 - RNA, 16 nt, Human
uccuuuacguguuuaa

SEQ ID NO: 2817175 - RNA, 13 nt, Human
uccuuuacuuucc

SEQ ID NO: 2817176 - RNA, 15 nt, Human
uccuuuacuuucccu

SEQ ID NO: 2817177 - RNA, 17 nt, Human
uccuuuacuuucccuug

SEQ ID NO: 2817178 - RNA, 18 nt, Human
uccuuuacuuucccuugc

SEQ ID NO: 2817179 - RNA, 20 nt, Human
uccuuuacuuucccuugcuu

SEQ ID NO: 2817180 - RNA, 21 nt, Human
uccuuuaauuuuuuacuauuu

SEQ ID NO: 2817181 - RNA, 12 nt, Human
uccuuuacaaaa

SEQ ID NO: 2817182 - RNA, 15 nt, Human
uccuuuacaaaagaa

SEQ ID NO: 2817183 - RNA, 21 nt, Human
uccuuuacaaaagaaauaccu

SEQ ID NO: 2817184 - RNA, 22 nt, Human
uccuuuacaaaagaaauaccuu

SEQ ID NO: 2817185 - RNA, 21 nt, Human
uccuuuaaaaaaauuuaagug

SEQ ID NO: 2817186 - RNA, 19 nt, Human
uccuuguuacccaugaaaa

SEQ ID NO: 2817187 - RNA, 21 nt, Human
uccuuuaauuaagacugaaaa

SEQ ID NO: 2817188 - RNA, 13 nt, Human
uccuuccaggccc

SEQ ID NO: 2817189 - RNA, 12 nt, Human
uccuuccaccuc

SEQ ID NO: 2817190 - RNA, 21 nt, Human
uccuuccaggcccccaccacu

SEQ ID NO: 2817191 - RNA, 16 nt, Human
uccuuccaggccccca

SEQ ID NO: 2817192 - RNA, 13 nt, Human
uccuuccaugaaa

SEQ ID NO: 2817193 - RNA, 17 nt, Human
uccuuccaucccuaccc

SEQ ID NO: 2817194 - RNA, 16 nt, Human
uccuuccaucccuacc

SEQ ID NO: 2817195 - RNA, 22 nt, Human
uccuucccaaguaagaggcugg

SEQ ID NO: 2817196 - RNA, 17 nt, Human
acuggccccugggucag

SEQ ID NO: 2817197 - RNA, 14 nt, Human
acuggccucugcug

SEQ ID NO: 2817198 - RNA, 22 nt, Human
acuggccauuugccaauuuucc

SEQ ID NO: 2817199 - RNA, 19 nt, Human
acuggccccggaucagagc

SEQ ID NO: 2817200 - RNA, 20 nt, Human
acuggccccggaucagagca

SEQ ID NO: 2817201 - RNA, 21 nt, Human
acuggccccggaucagagcag

SEQ ID NO: 2817202 - RNA, 14 nt, Human
acuggccccugggu

SEQ ID NO: 2817203 - RNA, 15 nt, Human
acuggccccuggguc

SEQ ID NO: 2817204 - RNA, 12 nt, Human
acuggccccugg

SEQ ID NO: 2817205 - RNA, 13 nt, Human
acuggccccuggg

SEQ ID NO: 2817206 - RNA, 12 nt, Human
ucuaaagcucug

SEQ ID NO: 2817207 - RNA, 14 nt, Human
ucuaaagcucugac

SEQ ID NO: 2817208 - RNA, 12 nt, Human
ucuaagcugcag

SEQ ID NO: 2817209 - RNA, 14 nt, Human
ucuaagcugcagcu

SEQ ID NO: 2817210 - RNA, 15 nt, Human
ucuaagcugcagcuu

SEQ ID NO: 2817211 - RNA, 17 nt, Human
ucuaagcugcagcuucc

SEQ ID NO: 2817212 - RNA, 18 nt, Human
ucuaagcugcagcuuccu

SEQ ID NO: 2817213 - RNA, 19 nt, Human
ucuaagcugcagcuuccug

SEQ ID NO: 2817214 - RNA, 17 nt, Human
ucuaaggaccugaaauu

SEQ ID NO: 2817215 - RNA, 21 nt, Human
ucuaaggaccugaaauuccaa

SEQ ID NO: 2817216 - RNA, 19 nt, Human
ucuaaggaugucacagggc

SEQ ID NO: 2817217 - RNA, 23 nt, Human
ucuaaggaccugaaauuccaaag

SEQ ID NO: 2817218 - RNA, 23 nt, Human
ucuaaggaugucacagggccaac

SEQ ID NO: 2817219 - RNA, 20 nt, Human
ucuaaggaugucacagggcc

SEQ ID NO: 2817220 - RNA, 18 nt, Human
ucuaaggccuaggauucu

SEQ ID NO: 2817221 - RNA, 19 nt, Human
ucuaaggccuaggauucua

SEQ ID NO: 2817222 - RNA, 20 nt, Human
ucuaaggccuaggauucuaa

SEQ ID NO: 2817223 - RNA, 23 nt, Human
ucuaaggcucugagagucuagau

SEQ ID NO: 2817224 - RNA, 16 nt, Human
ucuaaggcuguuugcu

SEQ ID NO: 2817225 - RNA, 14 nt, Human
ucuaagggggaggg

SEQ ID NO: 2817226 - RNA, 22 nt, Human
ucuaaggcucugagagucuaga

SEQ ID NO: 2817227 - RNA, 20 nt, Human
ucuaagguccgguguucuaa

SEQ ID NO: 2817228 - RNA, 21 nt, Human
ucuaaggccuaggauucuaaa

SEQ ID NO: 2817229 - RNA, 22 nt, Human
ucuaaggccuaggauucuaaaa

SEQ ID NO: 2817230 - RNA, 13 nt, Human
ucuaaggcucuga

SEQ ID NO: 2817231 - RNA, 14 nt, Human
ucuaaggcucugag

SEQ ID NO: 2817232 - RNA, 15 nt, Human
ucuaaggcucugaga

SEQ ID NO: 2817233 - RNA, 16 nt, Human
ucuaaggcucugagag

SEQ ID NO: 2817234 - RNA, 17 nt, Human
ucuaaggcucugagagu

SEQ ID NO: 2817235 - RNA, 20 nt, Human
ucuaaggcucugagagucua

SEQ ID NO: 2817236 - RNA, 20 nt, Human
ucuacauaaguaauucaaga

SEQ ID NO: 2817237 - RNA, 17 nt, Human
ucuacauaaguaauuca

SEQ ID NO: 2817238 - RNA, 22 nt, Human
ucuaagguccgguguucuaaga

SEQ ID NO: 2817239 - RNA, 23 nt, Human
ucuaagguccgguguucuaagau

SEQ ID NO: 2817240 - RNA, 22 nt, Human
ucuacauaaguaauucaagaaa

SEQ ID NO: 2817241 - RNA, 20 nt, Human
ucuaccaagcuauccuggcu

SEQ ID NO: 2817242 - RNA, 18 nt, Human
ucuaccauuucagagagg

SEQ ID NO: 2817243 - RNA, 15 nt, Human
ucuaccauuucagag

SEQ ID NO: 2817244 - RNA, 14 nt, Human
ucuaccauuucaga

SEQ ID NO: 2817245 - RNA, 19 nt, Human
ucuaccaugaacagaaaac

SEQ ID NO: 2817246 - RNA, 20 nt, Human
ucuaccagugcaggcuggcc

SEQ ID NO: 2817247 - RNA, 21 nt, Human
ucuaccagugcaggcuggcca

SEQ ID NO: 2817248 - RNA, 22 nt, Human
ucuaccagugcaggcuggccag

SEQ ID NO: 2817249 - RNA, 23 nt, Human
ucuaccagugcaggcuggccagc

SEQ ID NO: 2817250 - RNA, 20 nt, Human
acuguuaccuaaaguauuuu

SEQ ID NO: 2817251 - RNA, 20 nt, Human
ucuacccaagggcagaaagu

SEQ ID NO: 2817252 - RNA, 14 nt, Human
ucuacccaaacccu

SEQ ID NO: 2817253 - RNA, 16 nt, Human
ucuacccaaacccuag

SEQ ID NO: 2817254 - RNA, 22 nt, Human
ucuacccaaacccuagguuccc

SEQ ID NO: 2817255 - RNA, 19 nt, Human
acuguuaugaaauaaagaa

SEQ ID NO: 2817256 - RNA, 23 nt, Human
acuguuaugaaauaaagaaauug

SEQ ID NO: 2817257 - RNA, 20 nt, Human
acuguuagaaaauggacacu

SEQ ID NO: 2817258 - RNA, 13 nt, Human
acuguuagcacug

SEQ ID NO: 2817259 - RNA, 14 nt, Human
acuguuagcacugu

SEQ ID NO: 2817260 - RNA, 15 nt, Human
acuguuagcacuguu

SEQ ID NO: 2817261 - RNA, 16 nt, Human
acuguuagcacuguug

SEQ ID NO: 2817262 - RNA, 17 nt, Human
acuguuagcacuguuga

SEQ ID NO: 2817263 - RNA, 18 nt, Human
acuguuagcacuguugau

SEQ ID NO: 2817264 - RNA, 21 nt, Human
acuguuagcacuguugaugua

SEQ ID NO: 2817265 - RNA, 13 nt, Human
acuguuagcuuuu

SEQ ID NO: 2817266 - RNA, 20 nt, Human
acuguuagcuuuuuaaaaca

SEQ ID NO: 2817267 - RNA, 21 nt, Human
acuguuagcuuuuuaaaacau

SEQ ID NO: 2817268 - RNA, 13 nt, Human
acuguucuaaagc

SEQ ID NO: 2817269 - RNA, 14 nt, Human
acuguucuaaagcu

SEQ ID NO: 2817270 - RNA, 16 nt, Human
acuguucuaaagcucu

SEQ ID NO: 2817271 - RNA, 17 nt, Human
acuguucuaaagcucug

SEQ ID NO: 2817272 - RNA, 18 nt, Human
acuguucuaaagcucuga

SEQ ID NO: 2817273 - RNA, 21 nt, Human
acuguucuaaagcucugacau

SEQ ID NO: 2817274 - RNA, 18 nt, Human
acuguucucccuucggug

SEQ ID NO: 2817275 - RNA, 20 nt, Human
acuguuguaacuaggcucag

SEQ ID NO: 2817276 - RNA, 21 nt, Human
acuuaauacuaccuugaaaau

SEQ ID NO: 2817277 - RNA, 19 nt, Human
acuuaauacuaccuugaaa

SEQ ID NO: 2817278 - RNA, 18 nt, Human
acuuaauacuaccuugaa

SEQ ID NO: 2817279 - RNA, 17 nt, Human
acuuaauacuaccuuga

SEQ ID NO: 2817280 - RNA, 14 nt, Human
acuguugcccaggc

SEQ ID NO: 2817281 - RNA, 13 nt, Human
acuguugcccagg

SEQ ID NO: 2817282 - RNA, 12 nt, Human
acuguugcccag

SEQ ID NO: 2817283 - RNA, 13 nt, Human
acuguucuguguc

SEQ ID NO: 2817284 - RNA, 15 nt, Human
acuguucugugucuu

SEQ ID NO: 2817285 - RNA, 16 nt, Human
acuguucugugucuuu

SEQ ID NO: 2817286 - RNA, 17 nt, Human
acuguucugugucuuuc

SEQ ID NO: 2817287 - RNA, 18 nt, Human
acuguugcccaggcuggc

SEQ ID NO: 2817288 - RNA, 17 nt, Human
acuguugcccaggcugg

SEQ ID NO: 2817289 - RNA, 15 nt, Human
acuuaauagaaacau

SEQ ID NO: 2817290 - RNA, 14 nt, Human
acuuaauagaaaca

SEQ ID NO: 2817291 - RNA, 21 nt, Human
acuuaccuaagugacauuugu

SEQ ID NO: 2817292 - RNA, 12 nt, Human
acuuacuauuuu

SEQ ID NO: 2817293 - RNA, 22 nt, Human
acuuacuaaaauauauauagaa

SEQ ID NO: 2817294 - RNA, 17 nt, Human
acuuacuaaaauauaua

SEQ ID NO: 2817295 - RNA, 14 nt, Human
acuuaccauuugcu

SEQ ID NO: 2817296 - RNA, 21 nt, Human
acuuacauucucuaauaagaa

SEQ ID NO: 2817297 - RNA, 18 nt, Human
acuuagugacaaaauaga

SEQ ID NO: 2817298 - RNA, 22 nt, Human
acuuagaaggauugaacuucuu

SEQ ID NO: 2817299 - RNA, 15 nt, Human
acuuacuuuuguaaa

SEQ ID NO: 2817300 - RNA, 15 nt, Human
acuuagaaagcaggg

SEQ ID NO: 2817301 - RNA, 16 nt, Human
acuuagaaauugcauu

SEQ ID NO: 2817302 - RNA, 16 nt, Human
acuuagaaagcagggg

SEQ ID NO: 2817303 - RNA, 19 nt, Human
acuuagaaagcaggggcua

SEQ ID NO: 2817304 - RNA, 23 nt, Human
acuuauaagugaagugauacuau

SEQ ID NO: 2817305 - RNA, 19 nt, Human
acuuauaaaucauauugau

SEQ ID NO: 2817306 - RNA, 20 nt, Human
acuuauaaaucauauugaug

SEQ ID NO: 2817307 - RNA, 13 nt, Human
acuuauaaggugu

SEQ ID NO: 2817308 - RNA, 22 nt, Human
acuuauaagguguuuucugugu

SEQ ID NO: 2817309 - RNA, 23 nt, Human
acuuauaagguguuuucugugua

SEQ ID NO: 2817310 - RNA, 11 nt, Human
acuuauaccug

SEQ ID NO: 2817311 - RNA, 14 nt, Human
acuucagcucuguu

SEQ ID NO: 2817312 - RNA, 12 nt, Human
acuuauauugaa

SEQ ID NO: 2817313 - RNA, 13 nt, Human
acuuauauugaag

SEQ ID NO: 2817314 - RNA, 16 nt, Human
acuuauauugaagaca

SEQ ID NO: 2817315 - RNA, 18 nt, Human
acuuauaguacaugauaa

SEQ ID NO: 2817316 - RNA, 17 nt, Human
acuuauaguacaugaua

SEQ ID NO: 2817317 - RNA, 15 nt, Human
acuuauaguacauga

SEQ ID NO: 2817318 - RNA, 14 nt, Human
acuuauaguacaug

SEQ ID NO: 2817319 - RNA, 15 nt, Human
acugucacucauugc

SEQ ID NO: 2817320 - RNA, 24 nt, Human
acugucacucauugcugagccucu

SEQ ID NO: 2817321 - RNA, 15 nt, Human
acugucacuguuccu

SEQ ID NO: 2817322 - RNA, 23 nt, Human
acugucacucauugcugagccuc

SEQ ID NO: 2817323 - RNA, 17 nt, Human
acuguccuacccacccu

SEQ ID NO: 2817324 - RNA, 23 nt, Human
acuguccuacccacccuccuuuc

SEQ ID NO: 2817325 - RNA, 18 nt, Human
acuguccuacccacccuc

SEQ ID NO: 2817326 - RNA, 12 nt, Human
acugucccuccu

SEQ ID NO: 2817327 - RNA, 13 nt, Human
acugucccuccug

SEQ ID NO: 2817328 - RNA, 14 nt, Human
acugucccuccugg

SEQ ID NO: 2817329 - RNA, 15 nt, Human
acugucccuccuggu

SEQ ID NO: 2817330 - RNA, 16 nt, Human
acugucccuccuggug

SEQ ID NO: 2817331 - RNA, 17 nt, Human
acugucccuccuggugu

SEQ ID NO: 2817332 - RNA, 21 nt, Human
acugucccuccuggugucacc

SEQ ID NO: 2817333 - RNA, 12 nt, Human
acuguggaggaa

SEQ ID NO: 2817334 - RNA, 15 nt, Human
acuguggaggaagga

SEQ ID NO: 2817335 - RNA, 16 nt, Human
acuguggaggaaggau

SEQ ID NO: 2817336 - RNA, 17 nt, Human
acuguggaggaaggauu

SEQ ID NO: 2817337 - RNA, 17 nt, Human
acugugguaaaugccac

SEQ ID NO: 2817338 - RNA, 18 nt, Human
acugugguaaaugccaca

SEQ ID NO: 2817339 - RNA, 15 nt, Human
acuguggguguguga

SEQ ID NO: 2817340 - RNA, 20 nt, Human
acugugggugugugacucuu

SEQ ID NO: 2817341 - RNA, 15 nt, Human
acuguguaauauaaa

SEQ ID NO: 2817342 - RNA, 21 nt, Human
acuguguaauauaaaagaucu

SEQ ID NO: 2817343 - RNA, 22 nt, Human
acuguguaauauaaaagaucuu

SEQ ID NO: 2817344 - RNA, 14 nt, Human
acuguguacauaau

SEQ ID NO: 2817345 - RNA, 23 nt, Human
acuguguacauaaugcuuaauuu

SEQ ID NO: 2817346 - RNA, 22 nt, Human
acuguguacuguauagacaguu

SEQ ID NO: 2817347 - RNA, 19 nt, Human
acuguguaaaauguaaugc

SEQ ID NO: 2817348 - RNA, 23 nt, Human
acuguguacaguaaauggcuuau

SEQ ID NO: 2817349 - RNA, 12 nt, Human
acuguguauaga

SEQ ID NO: 2817350 - RNA, 18 nt, Human
acugugucauaaacagau

SEQ ID NO: 2817351 - RNA, 21 nt, Human
ucgguaaguugaauggccugc

SEQ ID NO: 2817352 - RNA, 19 nt, Human
ucgggcaggggcuggaggg

SEQ ID NO: 2817353 - RNA, 15 nt, Human
ucgggcaccagccag

SEQ ID NO: 2817354 - RNA, 16 nt, Human
ucgggcaccagccagc

SEQ ID NO: 2817355 - RNA, 17 nt, Human
ucgggcaccagccagcg

SEQ ID NO: 2817356 - RNA, 17 nt, Human
ucggcuuuucucagcug

SEQ ID NO: 2817357 - RNA, 18 nt, Human
ucggcucacugcauccuc

SEQ ID NO: 2817358 - RNA, 16 nt, Human
acuguguguaauuguu

SEQ ID NO: 2817359 - RNA, 17 nt, Human
acuguguguaauuguuc

SEQ ID NO: 2817360 - RNA, 13 nt, Human
acuguguggaacu

SEQ ID NO: 2817361 - RNA, 13 nt, Human
ucggcucugggug

SEQ ID NO: 2817362 - RNA, 14 nt, Human
ucggcucugggugg

SEQ ID NO: 2817363 - RNA, 19 nt, Human
ucggcuccccauguguccu

SEQ ID NO: 2817364 - RNA, 12 nt, Human
ucggucaccuug

SEQ ID NO: 2817365 - RNA, 13 nt, Human
ucggucaccuugu

SEQ ID NO: 2817366 - RNA, 22 nt, Human
ucgguggagacuaucagcccaa

SEQ ID NO: 2817367 - RNA, 19 nt, Human
ucgguuuuuuuccuguuuc

SEQ ID NO: 2817368 - RNA, 17 nt, Human
ucguuugaaucacagua

SEQ ID NO: 2817369 - RNA, 12 nt, Human
ucguuucuguau

SEQ ID NO: 2817370 - RNA, 13 nt, Human
ucguuucuguaua

SEQ ID NO: 2817371 - RNA, 18 nt, Human
ucuaaaaaacagaggcca

SEQ ID NO: 2817372 - RNA, 18 nt, Human
ucuaaaaagauuagcaag

SEQ ID NO: 2817373 - RNA, 14 nt, Human
ucuaaaaacaccaa

SEQ ID NO: 2817374 - RNA, 13 nt, Human
ucguuuuccaaac

SEQ ID NO: 2817375 - RNA, 20 nt, Human
ucguuuuccaaacugacuca

SEQ ID NO: 2817376 - RNA, 18 nt, Human
ucguuuuuauauuaaugu

SEQ ID NO: 2817377 - RNA, 11 nt, Human
ucuaaaacucc

SEQ ID NO: 2817378 - RNA, 12 nt, Human
ucuaaaagcacc

SEQ ID NO: 2817379 - RNA, 16 nt, Human
ucuaaaagcagaaaau

SEQ ID NO: 2817380 - RNA, 17 nt, Human
ucuaaaagcagaaaaua

SEQ ID NO: 2817381 - RNA, 22 nt, Human
ucuaaaagaauauucagagaau

SEQ ID NO: 2817382 - RNA, 12 nt, Human
ucuaaaagacuu

SEQ ID NO: 2817383 - RNA, 13 nt, Human
ucuaaaagacuuc

SEQ ID NO: 2817384 - RNA, 22 nt, Human
ucuaaaaauaaaccaaaggaca

SEQ ID NO: 2817385 - RNA, 13 nt, Human
ucuaaaaguguca

SEQ ID NO: 2817386 - RNA, 21 nt, Human
ucuaaaagugucaccuuuucu

SEQ ID NO: 2817387 - RNA, 15 nt, Human
ucuaaaaucuuauag

SEQ ID NO: 2817388 - RNA, 18 nt, Human
ucuaaaaucuuauaguuc

SEQ ID NO: 2817389 - RNA, 19 nt, Human
ucuaaaaucuuauaguucu

SEQ ID NO: 2817390 - RNA, 22 nt, Human
ucuaaaaucuuauaguucuagg

SEQ ID NO: 2817391 - RNA, 18 nt, Human
ucuaaagauggaguuucu

SEQ ID NO: 2817392 - RNA, 23 nt, Human
ucuaaaaucuuauaguucuaggc

SEQ ID NO: 2817393 - RNA, 19 nt, Human
ucuaaagauggaguuucua

SEQ ID NO: 2817394 - RNA, 20 nt, Human
ucuaaagauggaguuucuaa

SEQ ID NO: 2817395 - RNA, 21 nt, Human
ucuaaagauggaguuucuaag

SEQ ID NO: 2817396 - RNA, 22 nt, Human
ucuaaagauggaguuucuaagg

SEQ ID NO: 2817397 - RNA, 23 nt, Human
ucuaaagauggaguuucuaaggu

SEQ ID NO: 2817398 - RNA, 13 nt, Human
ucuaaagauucua

SEQ ID NO: 2817399 - RNA, 15 nt, Human
ucuaaagauucuaua

SEQ ID NO: 2817400 - RNA, 16 nt, Human
ucuaaagauucuauag

SEQ ID NO: 2817401 - RNA, 20 nt, Human
ucuaaagauucuauaguucu

SEQ ID NO: 2817402 - RNA, 22 nt, Human
ucuaaagauucuauaguucuag

SEQ ID NO: 2817403 - RNA, 23 nt, Human
ucuaaagauucuauaguucuaga

SEQ ID NO: 2817404 - RNA, 14 nt, Human
agaaaggaacauuu

SEQ ID NO: 2817405 - RNA, 23 nt, Human
ucugaagucacaucacaggacac

SEQ ID NO: 2817406 - RNA, 22 nt, Human
ucugaagucacaucacaggaca

SEQ ID NO: 2817407 - RNA, 20 nt, Human
ucugaagucacaucacagga

SEQ ID NO: 2817408 - RNA, 17 nt, Human
ucugaagucacaucaca

SEQ ID NO: 2817409 - RNA, 12 nt, Human
ucugaagcaugu

SEQ ID NO: 2817410 - RNA, 13 nt, Human
ucugaagcauguu

SEQ ID NO: 2817411 - RNA, 14 nt, Human
ucugaagcauguuu

SEQ ID NO: 2817412 - RNA, 21 nt, Human
ucugaagcauguuucauguuu

SEQ ID NO: 2817413 - RNA, 16 nt, Human
ucugaagcccucccag

SEQ ID NO: 2817414 - RNA, 15 nt, Human
ucugaagcauguuuc

SEQ ID NO: 2817415 - RNA, 20 nt, Human
ucugaagcauguuucauguu

SEQ ID NO: 2817416 - RNA, 22 nt, Human
agaaaucccuguuuaauauuua

SEQ ID NO: 2817417 - RNA, 18 nt, Human
agaaauccugcaaugaaa

SEQ ID NO: 2817418 - RNA, 12 nt, Human
ucugaacuuugg

SEQ ID NO: 2817419 - RNA, 13 nt, Human
ucugaacuuugga

SEQ ID NO: 2817420 - RNA, 15 nt, Human
ucugaacuuuggaga

SEQ ID NO: 2817421 - RNA, 17 nt, Human
ucugaacuuuggagagu

SEQ ID NO: 2817422 - RNA, 14 nt, Human
ucugaacuuuggga

SEQ ID NO: 2817423 - RNA, 15 nt, Human
ucugaacuuugggaa

SEQ ID NO: 2817424 - RNA, 16 nt, Human
ucugaacuuugggaag

SEQ ID NO: 2817425 - RNA, 21 nt, Human
ucugaacuuugggaagccuuu

SEQ ID NO: 2817426 - RNA, 18 nt, Human
ucugaagucacugcacag

SEQ ID NO: 2817427 - RNA, 15 nt, Human
ucugaagucacugca

SEQ ID NO: 2817428 - RNA, 16 nt, Human
ucugaagucacugcac

SEQ ID NO: 2817429 - RNA, 17 nt, Human
ucugaauuugcccuggg

SEQ ID NO: 2817430 - RNA, 18 nt, Human
ucugaauuugcccuggga

SEQ ID NO: 2817431 - RNA, 19 nt, Human
ucugaauuugcccugggaa

SEQ ID NO: 2817432 - RNA, 20 nt, Human
ucugaauuugcccugggaaa

SEQ ID NO: 2817433 - RNA, 13 nt, Human
ucugaagcaaggc

SEQ ID NO: 2817434 - RNA, 21 nt, Human
ucugaccugcaggccaagagc

SEQ ID NO: 2817435 - RNA, 15 nt, Human
ucugaccuucagcuc

SEQ ID NO: 2817436 - RNA, 21 nt, Human
ucugaccuucagcucacgcuu

SEQ ID NO: 2817437 - RNA, 22 nt, Human
ucugacgcaaaaccacuuuccu

SEQ ID NO: 2817438 - RNA, 13 nt, Human
ucugacggcccug

SEQ ID NO: 2817439 - RNA, 14 nt, Human
ucugacggcccugc

SEQ ID NO: 2817440 - RNA, 15 nt, Human
ucugacggcccugca

SEQ ID NO: 2817441 - RNA, 16 nt, Human
ucugacggcccugcaa

SEQ ID NO: 2817442 - RNA, 17 nt, Human
ucugacggcccugcaau

SEQ ID NO: 2817443 - RNA, 19 nt, Human
ucugaccugcaggccaaga

SEQ ID NO: 2817444 - RNA, 17 nt, Human
ucugaccugcaggccaa

SEQ ID NO: 2817445 - RNA, 16 nt, Human
ucugaccugcaggcca

SEQ ID NO: 2817446 - RNA, 12 nt, Human
ucugacaagggc

SEQ ID NO: 2817447 - RNA, 13 nt, Human
ucugacaagggcu

SEQ ID NO: 2817448 - RNA, 16 nt, Human
ucugacaagggcugac

SEQ ID NO: 2817449 - RNA, 20 nt, Human
ucugacaagggcugaccugc

SEQ ID NO: 2817450 - RNA, 23 nt, Human
ucugacaagggcugaccugccuc

SEQ ID NO: 2817451 - RNA, 15 nt, Human
ucugaccugcaggcc

SEQ ID NO: 2817452 - RNA, 16 nt, Human
ucugacaacagacuuc

SEQ ID NO: 2817453 - RNA, 15 nt, Human
ucugacaacagacuu

SEQ ID NO: 2817454 - RNA, 14 nt, Human
ucugacaaacugug

SEQ ID NO: 2817455 - RNA, 17 nt, Human
agaaaucaaagagagaa

SEQ ID NO: 2817456 - RNA, 13 nt, Human
agaaauauauaua

SEQ ID NO: 2817457 - RNA, 15 nt, Human
agaaauauauauaca

SEQ ID NO: 2817458 - RNA, 16 nt, Human
agaaauauauauacau

SEQ ID NO: 2817459 - RNA, 17 nt, Human
agaaauauauauacaua

SEQ ID NO: 2817460 - RNA, 18 nt, Human
agaaauauauauacauau

SEQ ID NO: 2817461 - RNA, 19 nt, Human
agaaauauauauacauaug

SEQ ID NO: 2817462 - RNA, 20 nt, Human
agaaauauauauacauaugu

SEQ ID NO: 2817463 - RNA, 18 nt, Human
agaaaucaguaauauuua

SEQ ID NO: 2817464 - RNA, 19 nt, Human
agaaaucccuguuuaauau

SEQ ID NO: 2817465 - RNA, 16 nt, Human
agaaauccauaucuua

SEQ ID NO: 2817466 - RNA, 21 nt, Human
agaaauccauaucuuaaagaa

SEQ ID NO: 2817467 - RNA, 18 nt, Human
agaaauauaauaaaaugu

SEQ ID NO: 2817468 - RNA, 20 nt, Human
agaaauauaauaaaaugugu

SEQ ID NO: 2817469 - RNA, 20 nt, Human
agaaagcugguaaacuauuu

SEQ ID NO: 2817470 - RNA, 16 nt, Human
agaaagcugugaacag

SEQ ID NO: 2817471 - RNA, 22 nt, Human
agaaagcugugaacaggcuggg

SEQ ID NO: 2817472 - RNA, 16 nt, Human
agaaagcugguaaacu

SEQ ID NO: 2817473 - RNA, 19 nt, Human
agaaagcugguaaacuauu

SEQ ID NO: 2817474 - RNA, 16 nt, Human
agaaaggaaaaccuga

SEQ ID NO: 2817475 - RNA, 20 nt, Human
agaaaggaaaaccugaagac

SEQ ID NO: 2817476 - RNA, 14 nt, Human
agaaagcugacauu

SEQ ID NO: 2817477 - RNA, 22 nt, Human
agaaacuuuuaucuauucugag

SEQ ID NO: 2817478 - RNA, 23 nt, Human
agaaacuuuuaucuauucugaga

SEQ ID NO: 2817479 - RNA, 12 nt, Human
agaaacuuuugu

SEQ ID NO: 2817480 - RNA, 13 nt, Human
agaaacuuuugua

SEQ ID NO: 2817481 - RNA, 15 nt, Human
agaaacuuuuguaaa

SEQ ID NO: 2817482 - RNA, 16 nt, Human
agaaacuuuuguaaag

SEQ ID NO: 2817483 - RNA, 17 nt, Human
agaaacuuuuguaaaga

SEQ ID NO: 2817484 - RNA, 23 nt, Human
agaaacuuuuguaaagaaauuua

SEQ ID NO: 2817485 - RNA, 15 nt, Human
agaaacuuuauacau

SEQ ID NO: 2817486 - RNA, 16 nt, Human
agaaacuuuauacauu

SEQ ID NO: 2817487 - RNA, 18 nt, Human
agaaacuuuauacauuag

SEQ ID NO: 2817488 - RNA, 22 nt, Human
agaaacuuuauacauuaguaaa

SEQ ID NO: 2817489 - RNA, 15 nt, Human
ucugcagcccugaga

SEQ ID NO: 2817490 - RNA, 13 nt, Human
ucugcagccuuga

SEQ ID NO: 2817491 - RNA, 12 nt, Human
ucugcagcugcc

SEQ ID NO: 2817492 - RNA, 13 nt, Human
ucugcagcugccg

SEQ ID NO: 2817493 - RNA, 14 nt, Human
ucugcagcugccgg

SEQ ID NO: 2817494 - RNA, 14 nt, Human
agaaauuauuuaau

SEQ ID NO: 2817495 - RNA, 16 nt, Human
agaaauuauuuaauaa

SEQ ID NO: 2817496 - RNA, 17 nt, Human
agaaauuauuuaauaaa

SEQ ID NO: 2817497 - RNA, 14 nt, Human
ucugacuacuuugc

SEQ ID NO: 2817498 - RNA, 13 nt, Human
ucugacuaauuag

SEQ ID NO: 2817499 - RNA, 15 nt, Human
ucugacuaauuaggc

SEQ ID NO: 2817500 - RNA, 12 nt, Human
ucugaguuaugu

SEQ ID NO: 2817501 - RNA, 19 nt, Human
ucugagagcaaagugaccu

SEQ ID NO: 2817502 - RNA, 19 nt, Human
ucugaguugccaagacaaa

SEQ ID NO: 2817503 - RNA, 21 nt, Human
ucugaguugccaagacaaauc

SEQ ID NO: 2817504 - RNA, 15 nt, Human
ucugaguuucauucu

SEQ ID NO: 2817505 - RNA, 20 nt, Human
ucugaguuucauucuccugc

SEQ ID NO: 2817506 - RNA, 22 nt, Human
ucugaguuucauucuccugccu

SEQ ID NO: 2817507 - RNA, 15 nt, Human
ucugauuagcuuugu

SEQ ID NO: 2817508 - RNA, 16 nt, Human
ucugauuagcuuugug

SEQ ID NO: 2817509 - RNA, 17 nt, Human
ucugauuagcuuugugu

SEQ ID NO: 2817510 - RNA, 18 nt, Human
ucugauuagcuuuguguu

SEQ ID NO: 2817511 - RNA, 21 nt, Human
ucugauuagcuuuguguuugg

SEQ ID NO: 2817512 - RNA, 14 nt, Human
ucugaugucucuaa

SEQ ID NO: 2817513 - RNA, 20 nt, Human
ucugaugucucuaaagcacu

SEQ ID NO: 2817514 - RNA, 24 nt, Human
ucugaguuucauucuccugccugu

SEQ ID NO: 2817515 - RNA, 13 nt, Human
ucugauggcuucu

SEQ ID NO: 2817516 - RNA, 15 nt, Human
ucugauggcuucucc

SEQ ID NO: 2817517 - RNA, 18 nt, Human
ucugauggcuucuccagg

SEQ ID NO: 2817518 - RNA, 23 nt, Human
ucugaugcaagcaagaaacacug

SEQ ID NO: 2817519 - RNA, 18 nt, Human
ucugauggaccuucuaga

SEQ ID NO: 2817520 - RNA, 19 nt, Human
ucugauggaccuucuagaa

SEQ ID NO: 2817521 - RNA, 17 nt, Human
agaaacuaauugacuuu

SEQ ID NO: 2817522 - RNA, 19 nt, Human
agaaacucaaugcacaaca

SEQ ID NO: 2817523 - RNA, 15 nt, Human
agaaacgucuucuaa

SEQ ID NO: 2817524 - RNA, 21 nt, Human
agaaacgaguuggugucuuuc

SEQ ID NO: 2817525 - RNA, 18 nt, Human
agaaaccuuuuuaaaaau

SEQ ID NO: 2817526 - RNA, 21 nt, Human
agaaacgucuucuaaacuucc

SEQ ID NO: 2817527 - RNA, 19 nt, Human
agaaacgcaacaagaaacu

SEQ ID NO: 2817528 - RNA, 15 nt, Human
agaaacgcauccagc

SEQ ID NO: 2817529 - RNA, 18 nt, Human
agaaacgcauccagcaag

SEQ ID NO: 2817530 - RNA, 18 nt, Human
agaaacgucuucuaaacu

SEQ ID NO: 2817531 - RNA, 16 nt, Human
agaaacgucuucuaaa

SEQ ID NO: 2817532 - RNA, 17 nt, Human
agaaaccuuaauaugug

SEQ ID NO: 2817533 - RNA, 12 nt, Human
agaaacacugcc

SEQ ID NO: 2817534 - RNA, 11 nt, Human
agaaacacugc

SEQ ID NO: 2817535 - RNA, 15 nt, Human
agaaacacugccuuu

SEQ ID NO: 2817536 - RNA, 14 nt, Human
agaaacacuugaac

SEQ ID NO: 2817537 - RNA, 15 nt, Human
agaaacacuuucucu

SEQ ID NO: 2817538 - RNA, 12 nt, Human
agaaacagaaga

SEQ ID NO: 2817539 - RNA, 13 nt, Human
agaaacacugccu

SEQ ID NO: 2817540 - RNA, 14 nt, Human
agaaacagauacca

SEQ ID NO: 2817541 - RNA, 15 nt, Human
agaaacagauaccau

SEQ ID NO: 2817542 - RNA, 16 nt, Human
agaaacagauaccaua

SEQ ID NO: 2817543 - RNA, 21 nt, Human
agaaacagauaccauacucau

SEQ ID NO: 2817544 - RNA, 11 nt, Human
agaaacagcuu

SEQ ID NO: 2817545 - RNA, 15 nt, Human
agaaacagcuuucaa

SEQ ID NO: 2817546 - RNA, 16 nt, Human
agaaacagcuuucaag

SEQ ID NO: 2817547 - RNA, 17 nt, Human
agaaacagcuuucaagu

SEQ ID NO: 2817548 - RNA, 19 nt, Human
agaaacagcuuucaagugc

SEQ ID NO: 2817549 - RNA, 20 nt, Human
agaaacagcuuucaagugcc

SEQ ID NO: 2817550 - RNA, 20 nt, Human
agaaaaagcuccuguccucc

SEQ ID NO: 2817551 - RNA, 19 nt, Human
agaaaacuuuaaaaaauau

SEQ ID NO: 2817552 - RNA, 20 nt, Human
agaaaacuuuaaaaaauauu

SEQ ID NO: 2817553 - RNA, 22 nt, Human
agaaaacuuuaaaaaauauuua

SEQ ID NO: 2817554 - RNA, 20 nt, Human
agaaaagaacguauuuuaaa

SEQ ID NO: 2817555 - RNA, 9 nt, Human
agaaaagag

SEQ ID NO: 2817556 - RNA, 13 nt, Human
agaaaagagaaga

SEQ ID NO: 2817557 - RNA, 14 nt, Human
agaaaagagaagaa

SEQ ID NO: 2817558 - RNA, 15 nt, Human
agaaaagagaagaag

SEQ ID NO: 2817559 - RNA, 15 nt, Human
ucucuugagcuggcc

SEQ ID NO: 2817560 - RNA, 14 nt, Human
ucucuugagcuggc

SEQ ID NO: 2817561 - RNA, 17 nt, Human
ucucuugagcuggccuc

SEQ ID NO: 2817562 - RNA, 16 nt, Human
ucucuugagcuggccu

SEQ ID NO: 2817563 - RNA, 18 nt, Human
ucucuugaggccaggagu

SEQ ID NO: 2817564 - RNA, 21 nt, Human
ucucuuuaaugucacaggcag

SEQ ID NO: 2817565 - RNA, 20 nt, Human
ucucuuuaaugucacaggca

SEQ ID NO: 2817566 - RNA, 13 nt, Human
ucucuugcuuucu

SEQ ID NO: 2817567 - RNA, 21 nt, Human
ucucuuuaagggcaugccuug

SEQ ID NO: 2817568 - RNA, 22 nt, Human
ucucuuuaagggcaugccuugu

SEQ ID NO: 2817569 - RNA, 14 nt, Human
ucucuuuaaaaugc

SEQ ID NO: 2817570 - RNA, 23 nt, Human
ucucuugggaacugaacucacuu

SEQ ID NO: 2817571 - RNA, 16 nt, Human
ucucuugggaacugaa

SEQ ID NO: 2817572 - RNA, 22 nt, Human
ucucuugccgaggagccaggca

SEQ ID NO: 2817573 - RNA, 14 nt, Human
ucucuggaugccug

SEQ ID NO: 2817574 - RNA, 15 nt, Human
ucucuggaugccuga

SEQ ID NO: 2817575 - RNA, 11 nt, Human
ucucugcugua

SEQ ID NO: 2817576 - RNA, 19 nt, Human
ucucugcuggcccagccaa

SEQ ID NO: 2817577 - RNA, 16 nt, Human
ucucugcuggcccagc

SEQ ID NO: 2817578 - RNA, 15 nt, Human
ucucugcuggcccag

SEQ ID NO: 2817579 - RNA, 14 nt, Human
ucucugcuggccca

SEQ ID NO: 2817580 - RNA, 12 nt, Human
ucucugcuggcc

SEQ ID NO: 2817581 - RNA, 12 nt, Human
ucucugcugccg

SEQ ID NO: 2817582 - RNA, 13 nt, Human
ucucugcugccgc

SEQ ID NO: 2817583 - RNA, 11 nt, Human
ucucugcugcc

SEQ ID NO: 2817584 - RNA, 18 nt, Human
ucucucccucucccuguc

SEQ ID NO: 2817585 - RNA, 11 nt, Human
ucucucccugc

SEQ ID NO: 2817586 - RNA, 15 nt, Human
ucucucccugccaga

SEQ ID NO: 2817587 - RNA, 22 nt, Human
ucucucccugccagaggggaag

SEQ ID NO: 2817588 - RNA, 21 nt, Human
ucucucccuccccugccauuu

SEQ ID NO: 2817589 - RNA, 20 nt, Human
ucucuccuguaagccaaaga

SEQ ID NO: 2817590 - RNA, 14 nt, Human
ucucuccugcggga

SEQ ID NO: 2817591 - RNA, 23 nt, Human
ucucucauccuccaguaccuugc

SEQ ID NO: 2817592 - RNA, 16 nt, Human
ucucucaauaugcuua

SEQ ID NO: 2817593 - RNA, 19 nt, Human
acuuucucuucauacuuuu

SEQ ID NO: 2817594 - RNA, 20 nt, Human
ucucucaauaugcuuacaaa

SEQ ID NO: 2817595 - RNA, 13 nt, Human
acuugaacaaaag

SEQ ID NO: 2817596 - RNA, 15 nt, Human
acuugaacaaaaggg

SEQ ID NO: 2817597 - RNA, 16 nt, Human
acuugaacaaaagggu

SEQ ID NO: 2817598 - RNA, 17 nt, Human
acuugaacaaaaggguc

SEQ ID NO: 2817599 - RNA, 18 nt, Human
acuugaacaaaaggguca

SEQ ID NO: 2817600 - RNA, 20 nt, Human
acuugaacaaaagggucaga

SEQ ID NO: 2817601 - RNA, 21 nt, Human
acuugaacaaaagggucagag

SEQ ID NO: 2817602 - RNA, 17 nt, Human
acuugaacaaaaucugu

SEQ ID NO: 2817603 - RNA, 19 nt, Human
acuugaacaaaaucuguug

SEQ ID NO: 2817604 - RNA, 16 nt, Human
acuucuccacccugcu

SEQ ID NO: 2817605 - RNA, 15 nt, Human
acuucuccacccugc

SEQ ID NO: 2817606 - RNA, 21 nt, Human
acuugagcgugaaucuguauc

SEQ ID NO: 2817607 - RNA, 19 nt, Human
acuugagauguaugaaggc

SEQ ID NO: 2817608 - RNA, 21 nt, Human
acuugagauguaugaaggcuu

SEQ ID NO: 2817609 - RNA, 22 nt, Human
acuugagauguaugaaggcuuu

SEQ ID NO: 2817610 - RNA, 22 nt, Human
acuugaagucuaaaagcagaaa

SEQ ID NO: 2817611 - RNA, 19 nt, Human
acuugaauaauaguaugag

SEQ ID NO: 2817612 - RNA, 17 nt, Human
acuuggcuacacaggga

SEQ ID NO: 2817613 - RNA, 18 nt, Human
acuugucacugacacaaa

SEQ ID NO: 2817614 - RNA, 20 nt, Human
acuugucacugacacaaagg

SEQ ID NO: 2817615 - RNA, 21 nt, Human
acuugucacugacacaaagga

SEQ ID NO: 2817616 - RNA, 22 nt, Human
acuugucacugacacaaaggaa

SEQ ID NO: 2817617 - RNA, 14 nt, Human
acuugucacuugca

SEQ ID NO: 2817618 - RNA, 15 nt, Human
acuugucacuugcau

SEQ ID NO: 2817619 - RNA, 16 nt, Human
acuugucacuugcaug

SEQ ID NO: 2817620 - RNA, 17 nt, Human
acuugucacuugcaugu

SEQ ID NO: 2817621 - RNA, 18 nt, Human
acuugucacuugcauguc

SEQ ID NO: 2817622 - RNA, 13 nt, Human
acuugucauguga

SEQ ID NO: 2817623 - RNA, 18 nt, Human
acuuguggacacagcucu

SEQ ID NO: 2817624 - RNA, 17 nt, Human
acuuguggacacagcuc

SEQ ID NO: 2817625 - RNA, 16 nt, Human
acuuguggacacagcu

SEQ ID NO: 2817626 - RNA, 12 nt, Human
acuugccugggu

SEQ ID NO: 2817627 - RNA, 14 nt, Human
acuugccuggguca

SEQ ID NO: 2817628 - RNA, 21 nt, Human
acuugccuuccuaagccugug

SEQ ID NO: 2817629 - RNA, 24 nt, Human
acuugccuuccuaagccuguggcu

SEQ ID NO: 2817630 - RNA, 13 nt, Human
acuugccuggguc

SEQ ID NO: 2817631 - RNA, 14 nt, Human
acuugcgcagaaaa

SEQ ID NO: 2817632 - RNA, 14 nt, Human
acuugcuacccuga

SEQ ID NO: 2817633 - RNA, 18 nt, Human
acuuggcaucagcuggcg

SEQ ID NO: 2817634 - RNA, 15 nt, Human
acuuggcaacagaag

SEQ ID NO: 2817635 - RNA, 16 nt, Human
acuuggcaacagaagc

SEQ ID NO: 2817636 - RNA, 16 nt, Human
acuucuaaaugaagug

SEQ ID NO: 2817637 - RNA, 15 nt, Human
acuucuaaaugaagu

SEQ ID NO: 2817638 - RNA, 18 nt, Human
acuucgucuucuaauuuc

SEQ ID NO: 2817639 - RNA, 15 nt, Human
acuucgucuucuaau

SEQ ID NO: 2817640 - RNA, 19 nt, Human
acuucgucuucuaauuuca

SEQ ID NO: 2817641 - RNA, 20 nt, Human
acuucgucuucuaauuucaa

SEQ ID NO: 2817642 - RNA, 14 nt, Human
acuucuccacccug

SEQ ID NO: 2817643 - RNA, 15 nt, Human
acuucucaucacaca

SEQ ID NO: 2817644 - RNA, 16 nt, Human
acuucucaucacacac

SEQ ID NO: 2817645 - RNA, 17 nt, Human
acuucucaucacacaca

SEQ ID NO: 2817646 - RNA, 18 nt, Human
acuucucaucacacacau

SEQ ID NO: 2817647 - RNA, 19 nt, Human
acuucucaucacacacaug

SEQ ID NO: 2817648 - RNA, 11 nt, Human
acuucuaauau

SEQ ID NO: 2817649 - RNA, 15 nt, Human
acuucuaauauauuu

SEQ ID NO: 2817650 - RNA, 22 nt, Human
acuucuaauauauuuuuauauu

SEQ ID NO: 2817651 - RNA, 15 nt, Human
acuucuaauaucauu

SEQ ID NO: 2817652 - RNA, 16 nt, Human
acuucuaauaucauuc

SEQ ID NO: 2817653 - RNA, 12 nt, Human
ucucacucuguc

SEQ ID NO: 2817654 - RNA, 23 nt, Human
ucucacucugcccccccccccca

SEQ ID NO: 2817655 - RNA, 20 nt, Human
ucucacuccuuuuggugugu

SEQ ID NO: 2817656 - RNA, 23 nt, Human
ucucacuccuuuugguguguugg

SEQ ID NO: 2817657 - RNA, 20 nt, Human
ucucacucuaggaguucagu

SEQ ID NO: 2817658 - RNA, 18 nt, Human
ucucacuccuaccuggua

SEQ ID NO: 2817659 - RNA, 16 nt, Human
acuucgggcuguguaa

SEQ ID NO: 2817660 - RNA, 17 nt, Human
acuucgggcuguguaaa

SEQ ID NO: 2817661 - RNA, 20 nt, Human
acuuccuuuaaagaugaacu

SEQ ID NO: 2817662 - RNA, 14 nt, Human
acuuccuugagaca

SEQ ID NO: 2817663 - RNA, 22 nt, Human
acuuccuugagacacggagccc

SEQ ID NO: 2817664 - RNA, 22 nt, Human
acuuccuuacuaagcauagcaa

SEQ ID NO: 2817665 - RNA, 15 nt, Human
acuuccugugacuuc

SEQ ID NO: 2817666 - RNA, 15 nt, Human
ucucacuaaacuuua

SEQ ID NO: 2817667 - RNA, 17 nt, Human
ucucacuaaacuuuacc

SEQ ID NO: 2817668 - RNA, 21 nt, Human
ucucacgggcaugggcacucc

SEQ ID NO: 2817669 - RNA, 22 nt, Human
ucucacgggcaugggcacuccc

SEQ ID NO: 2817670 - RNA, 23 nt, Human
ucucacgggcaugggcacucccu

SEQ ID NO: 2817671 - RNA, 13 nt, Human
ucucacuaaacuu

SEQ ID NO: 2817672 - RNA, 14 nt, Human
ucucaccucugugc

SEQ ID NO: 2817673 - RNA, 19 nt, Human
ucucaccucugugccucug

SEQ ID NO: 2817674 - RNA, 16 nt, Human
ucucacagcacaugcu

SEQ ID NO: 2817675 - RNA, 17 nt, Human
ucucacagcacaugcug

SEQ ID NO: 2817676 - RNA, 20 nt, Human
ucucacagcacaugcuggcc

SEQ ID NO: 2817677 - RNA, 23 nt, Human
ucucacagcacaugcuggccagc

SEQ ID NO: 2817678 - RNA, 16 nt, Human
ucucacagaugugacu

SEQ ID NO: 2817679 - RNA, 11 nt, Human
ucucacagcac

SEQ ID NO: 2817680 - RNA, 23 nt, Human
ucucacacugguucucaaugaaa

SEQ ID NO: 2817681 - RNA, 22 nt, Human
ucucacacugguucucaaugaa

SEQ ID NO: 2817682 - RNA, 21 nt, Human
ucucacacugguucucaauga

SEQ ID NO: 2817683 - RNA, 20 nt, Human
ucucacacugguucucaaug

SEQ ID NO: 2817684 - RNA, 19 nt, Human
ucucacacugguucucaau

SEQ ID NO: 2817685 - RNA, 14 nt, Human
acuucaggcucuuc

SEQ ID NO: 2817686 - RNA, 13 nt, Human
acuucagcucugu

SEQ ID NO: 2817687 - RNA, 13 nt, Human
ucuauuucacuua

SEQ ID NO: 2817688 - RNA, 13 nt, Human
acuuguuauugug

SEQ ID NO: 2817689 - RNA, 15 nt, Human
acuuguuauugugaa

SEQ ID NO: 2817690 - RNA, 16 nt, Human
acuuguuauugugaau

SEQ ID NO: 2817691 - RNA, 17 nt, Human
acuuguuauugugaaug

SEQ ID NO: 2817692 - RNA, 19 nt, Human
acuuguuauugugaaugau

SEQ ID NO: 2817693 - RNA, 20 nt, Human
acuuguuauugugaaugauu

SEQ ID NO: 2817694 - RNA, 16 nt, Human
acuuguuccagcucuu

SEQ ID NO: 2817695 - RNA, 15 nt, Human
acuuguuccagcucu

SEQ ID NO: 2817696 - RNA, 16 nt, Human
ucuccucucagccccu

SEQ ID NO: 2817697 - RNA, 14 nt, Human
ucuccuccccuucc

SEQ ID NO: 2817698 - RNA, 16 nt, Human
ucuccuccccuugaau

SEQ ID NO: 2817699 - RNA, 18 nt, Human
ucuccuccccacccgccc

SEQ ID NO: 2817700 - RNA, 12 nt, Human
ucuccucccagg

SEQ ID NO: 2817701 - RNA, 12 nt, Human
ucuccuccccaa

SEQ ID NO: 2817702 - RNA, 15 nt, Human
ucuccuccccacccg

SEQ ID NO: 2817703 - RNA, 16 nt, Human
acuuucucugccauca

SEQ ID NO: 2817704 - RNA, 12 nt, Human
acuuuaaaagug

SEQ ID NO: 2817705 - RNA, 12 nt, Human
acuuuaagagag

SEQ ID NO: 2817706 - RNA, 14 nt, Human
acuuuaagagagaa

SEQ ID NO: 2817707 - RNA, 15 nt, Human
acuuuaagagagaaa

SEQ ID NO: 2817708 - RNA, 16 nt, Human
acuuuaagagagaaau

SEQ ID NO: 2817709 - RNA, 17 nt, Human
acuuuaagagagaaauc

SEQ ID NO: 2817710 - RNA, 23 nt, Human
acuuuaagagagaaaucugaaaa

SEQ ID NO: 2817711 - RNA, 13 nt, Human
ucuccaucuguca

SEQ ID NO: 2817712 - RNA, 17 nt, Human
ucuccauggcaucuucg

SEQ ID NO: 2817713 - RNA, 19 nt, Human
ucucccacuagacaagucc

SEQ ID NO: 2817714 - RNA, 18 nt, Human
ucucccacuccagcgcug

SEQ ID NO: 2817715 - RNA, 15 nt, Human
ucucccagaauccca

SEQ ID NO: 2817716 - RNA, 17 nt, Human
ucucccagaaucccagc

SEQ ID NO: 2817717 - RNA, 18 nt, Human
ucucccagaaucccagcc

SEQ ID NO: 2817718 - RNA, 19 nt, Human
ucucccagaaucccagccg

SEQ ID NO: 2817719 - RNA, 12 nt, Human
ucucccacccug

SEQ ID NO: 2817720 - RNA, 14 nt, Human
ucucccacccugua

SEQ ID NO: 2817721 - RNA, 14 nt, Human
ucucccacguggga

SEQ ID NO: 2817722 - RNA, 15 nt, Human
ucucccacgugggag

SEQ ID NO: 2817723 - RNA, 16 nt, Human
ucucccacgugggaga

SEQ ID NO: 2817724 - RNA, 16 nt, Human
ucuccuagggcuaugg

SEQ ID NO: 2817725 - RNA, 16 nt, Human
ucuccuauaaucuguc

SEQ ID NO: 2817726 - RNA, 17 nt, Human
ucuccuauaaucuguca

SEQ ID NO: 2817727 - RNA, 18 nt, Human
ucuccuauaaucugucaa

SEQ ID NO: 2817728 - RNA, 19 nt, Human
ucuccuauaaucugucaaa

SEQ ID NO: 2817729 - RNA, 14 nt, Human
ucuccuacuccuga

SEQ ID NO: 2817730 - RNA, 16 nt, Human
ucuccuacuccugacu

SEQ ID NO: 2817731 - RNA, 20 nt, Human
ucuccguuuauuauaaacug

SEQ ID NO: 2817732 - RNA, 13 nt, Human
ucuccccacacua

SEQ ID NO: 2817733 - RNA, 11 nt, Human
ucuccccacac

SEQ ID NO: 2817734 - RNA, 10 nt, Human
ucuccccaca

SEQ ID NO: 2817735 - RNA, 20 nt, Human
ucuccccaacccccauucuc

SEQ ID NO: 2817736 - RNA, 22 nt, Human
ucuccccaacccccauucucau

SEQ ID NO: 2817737 - RNA, 23 nt, Human
ucuccccaacccccauucucauc

SEQ ID NO: 2817738 - RNA, 22 nt, Human
ucuccccaacccuagguucccu

SEQ ID NO: 2817739 - RNA, 19 nt, Human
ucuccccaaugagacuugc

SEQ ID NO: 2817740 - RNA, 23 nt, Human
ucuccccaaugagacuugccuuc

SEQ ID NO: 2817741 - RNA, 16 nt, Human
ucuccaggcuguaucc

SEQ ID NO: 2817742 - RNA, 19 nt, Human
ucuccaggucucacgggca

SEQ ID NO: 2817743 - RNA, 19 nt, Human
ucuccaguauccacuuugc

SEQ ID NO: 2817744 - RNA, 21 nt, Human
ucuccaucacccucuuccugu

SEQ ID NO: 2817745 - RNA, 20 nt, Human
ucuccaucacccucuuccug

SEQ ID NO: 2817746 - RNA, 21 nt, Human
ucuccagugcuguccaugcuu

SEQ ID NO: 2817747 - RNA, 11 nt, Human
ucuccaggcug

SEQ ID NO: 2817748 - RNA, 19 nt, Human
ucucaggcuggugggaggg

SEQ ID NO: 2817749 - RNA, 19 nt, Human
ucucauuccaacagugagu

SEQ ID NO: 2817750 - RNA, 17 nt, Human
ucucauuccaacaguga

SEQ ID NO: 2817751 - RNA, 14 nt, Human
ucucauuccguugu

SEQ ID NO: 2817752 - RNA, 18 nt, Human
ucucauuccguugucugu

SEQ ID NO: 2817753 - RNA, 20 nt, Human
ucucauuccguugucugugg

SEQ ID NO: 2817754 - RNA, 21 nt, Human
ucucauuccguugucugugga

SEQ ID NO: 2817755 - RNA, 12 nt, Human
ucucauucuugu

SEQ ID NO: 2817756 - RNA, 13 nt, Human
ucucauucuuguu

SEQ ID NO: 2817757 - RNA, 15 nt, Human
acuuguggacacagc

SEQ ID NO: 2817758 - RNA, 13 nt, Human
ucucagccuccca

SEQ ID NO: 2817759 - RNA, 15 nt, Human
ucucagccuuacauu

SEQ ID NO: 2817760 - RNA, 20 nt, Human
ucucagccuuacauuuguga

SEQ ID NO: 2817761 - RNA, 12 nt, Human
ucucagccuccc

SEQ ID NO: 2817762 - RNA, 13 nt, Human
ucucagcuuugag

SEQ ID NO: 2817763 - RNA, 16 nt, Human
ucucagcuccaggugg

SEQ ID NO: 2817764 - RNA, 21 nt, Human
ucucagcuccagguggcucug

SEQ ID NO: 2817765 - RNA, 19 nt, Human
ucucagcuuugagaagccu

SEQ ID NO: 2817766 - RNA, 18 nt, Human
ucucaggcuggugggagg

SEQ ID NO: 2817767 - RNA, 20 nt, Human
agacacacuaucauaguuaa

SEQ ID NO: 2817768 - RNA, 11 nt, Human
agacacacaca

SEQ ID NO: 2817769 - RNA, 10 nt, Human
agacacacac

SEQ ID NO: 2817770 - RNA, 17 nt, Human
agacacaggcccggcuc

SEQ ID NO: 2817771 - RNA, 22 nt, Human
agacacaggcccggcuccaggc

SEQ ID NO: 2817772 - RNA, 21 nt, Human
agacacaggcccggcuccagg

SEQ ID NO: 2817773 - RNA, 20 nt, Human
agacacaggcccggcuccag

SEQ ID NO: 2817774 - RNA, 19 nt, Human
agacacaggcccggcucca

SEQ ID NO: 2817775 - RNA, 20 nt, Human
agacacaacuauuuuuccaa

SEQ ID NO: 2817776 - RNA, 19 nt, Human
agacacaacuauuuuucca

SEQ ID NO: 2817777 - RNA, 12 nt, Human
ucuguuucaagg

SEQ ID NO: 2817778 - RNA, 23 nt, Human
ucuguuucaaggcacucuagauu

SEQ ID NO: 2817779 - RNA, 12 nt, Human
agacaccaaagu

SEQ ID NO: 2817780 - RNA, 18 nt, Human
agacacgccuuccccuca

SEQ ID NO: 2817781 - RNA, 22 nt, Human
agacacgccuuccccucagcca

SEQ ID NO: 2817782 - RNA, 14 nt, Human
agacagaacuugaa

SEQ ID NO: 2817783 - RNA, 17 nt, Human
agacagaaccccuacau

SEQ ID NO: 2817784 - RNA, 17 nt, Human
agacagaacuugaaugu

SEQ ID NO: 2817785 - RNA, 23 nt, Human
agacacaggcccggcuccaggcu

SEQ ID NO: 2817786 - RNA, 19 nt, Human
agacaccuugacagggcac

SEQ ID NO: 2817787 - RNA, 22 nt, Human
agacaccuugacagggcacacc

SEQ ID NO: 2817788 - RNA, 13 nt, Human
agacacauuuaag

SEQ ID NO: 2817789 - RNA, 14 nt, Human
agacacauuuaagg

SEQ ID NO: 2817790 - RNA, 22 nt, Human
ucuuacuuuccuuuccccagcc

SEQ ID NO: 2817791 - RNA, 23 nt, Human
ucuuacuuuccuuuccccagccc

SEQ ID NO: 2817792 - RNA, 13 nt, Human
ucuuagaaaugaa

SEQ ID NO: 2817793 - RNA, 15 nt, Human
ucuuauuauauauau

SEQ ID NO: 2817794 - RNA, 23 nt, Human
ucuuauuauauauauaauauaua

SEQ ID NO: 2817795 - RNA, 14 nt, Human
ucuuacuaauguaa

SEQ ID NO: 2817796 - RNA, 15 nt, Human
ucuuacuaauguaaa

SEQ ID NO: 2817797 - RNA, 16 nt, Human
ucuuacuaauguaaaa

SEQ ID NO: 2817798 - RNA, 20 nt, Human
ucuuacuaauguaaaaugau

SEQ ID NO: 2817799 - RNA, 21 nt, Human
ucuuacuaauguaaaaugauu

SEQ ID NO: 2817800 - RNA, 21 nt, Human
ucuuaccuguaugucuccagu

SEQ ID NO: 2817801 - RNA, 23 nt, Human
ucuuaccuguaugucuccaguau

SEQ ID NO: 2817802 - RNA, 10 nt, Human
ucuuaauuuu

SEQ ID NO: 2817803 - RNA, 15 nt, Human
ucuuacgaauauuuu

SEQ ID NO: 2817804 - RNA, 15 nt, Human
ucuuacccaauuucc

SEQ ID NO: 2817805 - RNA, 16 nt, Human
ucuuacccaauuuccc

SEQ ID NO: 2817806 - RNA, 22 nt, Human
ucuuacccuguacauauguaaa

SEQ ID NO: 2817807 - RNA, 14 nt, Human
ucuuacugauaauu

SEQ ID NO: 2817808 - RNA, 16 nt, Human
ucuuacugauaauuuu

SEQ ID NO: 2817809 - RNA, 15 nt, Human
ucuuacuccuccucu

SEQ ID NO: 2817810 - RNA, 16 nt, Human
ucuuacuccuccucuu

SEQ ID NO: 2817811 - RNA, 17 nt, Human
ucuuacuccuccucuuu

SEQ ID NO: 2817812 - RNA, 18 nt, Human
ucuuacuccuccucuuuc

SEQ ID NO: 2817813 - RNA, 19 nt, Human
ucuuacuccuccucuuucu

SEQ ID NO: 2817814 - RNA, 20 nt, Human
ucuuacuccuccucuuucuc

SEQ ID NO: 2817815 - RNA, 21 nt, Human
ucuuacuccuccucuuucucu

SEQ ID NO: 2817816 - RNA, 18 nt, Human
ucuuacuguaccuguucc

SEQ ID NO: 2817817 - RNA, 23 nt, Human
ucuuacuuacuaaaauauauaua

SEQ ID NO: 2817818 - RNA, 16 nt, Human
ucuuacuugagccuuu

SEQ ID NO: 2817819 - RNA, 17 nt, Human
ucuuacuugagccuuua

SEQ ID NO: 2817820 - RNA, 17 nt, Human
agacagucaccccagga

SEQ ID NO: 2817821 - RNA, 15 nt, Human
agacaguccagccug

SEQ ID NO: 2817822 - RNA, 17 nt, Human
agacaguccagccugga

SEQ ID NO: 2817823 - RNA, 15 nt, Human
agacagugcacauga

SEQ ID NO: 2817824 - RNA, 16 nt, Human
agacagugcacaugaa

SEQ ID NO: 2817825 - RNA, 17 nt, Human
agacagugcacaugaac

SEQ ID NO: 2817826 - RNA, 14 nt, Human
agacaguucaagaa

SEQ ID NO: 2817827 - RNA, 15 nt, Human
agacaguucaagaaa

SEQ ID NO: 2817828 - RNA, 13 nt, Human
agacaguuucuua

SEQ ID NO: 2817829 - RNA, 14 nt, Human
agacaguuucuuag

SEQ ID NO: 2817830 - RNA, 20 nt, Human
ucuuaauuauuauuuguguu

SEQ ID NO: 2817831 - RNA, 14 nt, Human
ucuuacacauacag

SEQ ID NO: 2817832 - RNA, 16 nt, Human
ucuuacacauacaguu

SEQ ID NO: 2817833 - RNA, 23 nt, Human
ucuuacacauacaguuuuaugcu

SEQ ID NO: 2817834 - RNA, 17 nt, Human
ucuuacacugccuguau

SEQ ID NO: 2817835 - RNA, 22 nt, Human
ucuuacacugccuguauacuuu

SEQ ID NO: 2817836 - RNA, 23 nt, Human
ucuuacacugccuguauacuuua

SEQ ID NO: 2817837 - RNA, 17 nt, Human
ucuuaauuucuaucuug

SEQ ID NO: 2817838 - RNA, 17 nt, Human
ucuguauugugcugauu

SEQ ID NO: 2817839 - RNA, 20 nt, Human
ucugugaaguaguucuguuu

SEQ ID NO: 2817840 - RNA, 23 nt, Human
ucuguauuuaugugugaggagcu

SEQ ID NO: 2817841 - RNA, 13 nt, Human
ucuguauuucaug

SEQ ID NO: 2817842 - RNA, 15 nt, Human
ucuguauuucaugug

SEQ ID NO: 2817843 - RNA, 18 nt, Human
ucuguauuucauguggcu

SEQ ID NO: 2817844 - RNA, 13 nt, Human
ucugucccagguu

SEQ ID NO: 2817845 - RNA, 17 nt, Human
ucugucccacuuggcau

SEQ ID NO: 2817846 - RNA, 21 nt, Human
ucugucccacuuggcaucagc

SEQ ID NO: 2817847 - RNA, 13 nt, Human
ucuguccaucugc

SEQ ID NO: 2817848 - RNA, 14 nt, Human
ucuguccaucugcc

SEQ ID NO: 2817849 - RNA, 15 nt, Human
ucuguccaucugccc

SEQ ID NO: 2817850 - RNA, 16 nt, Human
ucuguccaucugcccg

SEQ ID NO: 2817851 - RNA, 17 nt, Human
ucuguccaucugcccgc

SEQ ID NO: 2817852 - RNA, 18 nt, Human
ucuguccaucugcccgcc

SEQ ID NO: 2817853 - RNA, 19 nt, Human
ucuguccauuuauccacag

SEQ ID NO: 2817854 - RNA, 18 nt, Human
ucuguacgucugacaggc

SEQ ID NO: 2817855 - RNA, 13 nt, Human
ucuguauguauua

SEQ ID NO: 2817856 - RNA, 14 nt, Human
ucuguauguauuag

SEQ ID NO: 2817857 - RNA, 17 nt, Human
ucuguauguauuaguga

SEQ ID NO: 2817858 - RNA, 22 nt, Human
ucuguauguauuagugauauuu

SEQ ID NO: 2817859 - RNA, 14 nt, Human
ucuguacuuccuga

SEQ ID NO: 2817860 - RNA, 12 nt, Human
ucuguacuuggu

SEQ ID NO: 2817861 - RNA, 15 nt, Human
ucuguauauacuuuu

SEQ ID NO: 2817862 - RNA, 16 nt, Human
ucuguauauauauaua

SEQ ID NO: 2817863 - RNA, 15 nt, Human
ucuguauauacaaua

SEQ ID NO: 2817864 - RNA, 14 nt, Human
ucuguucuugcuac

SEQ ID NO: 2817865 - RNA, 20 nt, Human
ucuguuuauggccacauuua

SEQ ID NO: 2817866 - RNA, 23 nt, Human
ucuguuuauggccacauuuaaua

SEQ ID NO: 2817867 - RNA, 19 nt, Human
ucuguucugcacacagcac

SEQ ID NO: 2817868 - RNA, 16 nt, Human
ucuguucuguuucaag

SEQ ID NO: 2817869 - RNA, 18 nt, Human
ucuguucugcacacagca

SEQ ID NO: 2817870 - RNA, 17 nt, Human
ucuguucugcacacagc

SEQ ID NO: 2817871 - RNA, 22 nt, Human
ucuguggguccgauaauaucuu

SEQ ID NO: 2817872 - RNA, 19 nt, Human
ucugugggcgggcccagca

SEQ ID NO: 2817873 - RNA, 20 nt, Human
ucugugggcgggcccagcac

SEQ ID NO: 2817874 - RNA, 19 nt, Human
ucuguggaugccagggccg

SEQ ID NO: 2817875 - RNA, 18 nt, Human
ucuguggauggucauugc

SEQ ID NO: 2817876 - RNA, 22 nt, Human
ucuguggaccacugcaugagcu

SEQ ID NO: 2817877 - RNA, 21 nt, Human
ucuguggcuucccaugucuuu

SEQ ID NO: 2817878 - RNA, 15 nt, Human
ucugugccccaugcc

SEQ ID NO: 2817879 - RNA, 14 nt, Human
ucugugccccaugc

SEQ ID NO: 2817880 - RNA, 17 nt, Human
ucugugaugagcugauc

SEQ ID NO: 2817881 - RNA, 14 nt, Human
ucugugaugagcug

SEQ ID NO: 2817882 - RNA, 13 nt, Human
ucugugacccacu

SEQ ID NO: 2817883 - RNA, 16 nt, Human
ucugugacccacuucu

SEQ ID NO: 2817884 - RNA, 23 nt, Human
ucugugacccacuucucaucaca

SEQ ID NO: 2817885 - RNA, 13 nt, Human
ucugugaccucag

SEQ ID NO: 2817886 - RNA, 14 nt, Human
ucugugaccucagg

SEQ ID NO: 2817887 - RNA, 15 nt, Human
ucugugaccucaggc

SEQ ID NO: 2817888 - RNA, 16 nt, Human
ucugugaccucaggca

SEQ ID NO: 2817889 - RNA, 12 nt, Human
ucugugcauucu

SEQ ID NO: 2817890 - RNA, 19 nt, Human
ucugugcacgcaguggccu

SEQ ID NO: 2817891 - RNA, 21 nt, Human
ucugugcacgcaguggccuuc

SEQ ID NO: 2817892 - RNA, 18 nt, Human
agaauguuuuacugugaa

SEQ ID NO: 2817893 - RNA, 16 nt, Human
agaauguugguuuacu

SEQ ID NO: 2817894 - RNA, 17 nt, Human
agaauguugguuuacuu

SEQ ID NO: 2817895 - RNA, 19 nt, Human
agaauguugguuuacuuuc

SEQ ID NO: 2817896 - RNA, 20 nt, Human
agaauguugguuuacuuuca

SEQ ID NO: 2817897 - RNA, 21 nt, Human
agaauguugguuuacuuucaa

SEQ ID NO: 2817898 - RNA, 23 nt, Human
agaauguugguuuacuuucaaau

SEQ ID NO: 2817899 - RNA, 19 nt, Human
agaauguuuuacugugaaa

SEQ ID NO: 2817900 - RNA, 14 nt, Human
agaauuagauuaua

SEQ ID NO: 2817901 - RNA, 11 nt, Human
agaauuagcuu

SEQ ID NO: 2817902 - RNA, 15 nt, Human
agaauuagcuuuuuc

SEQ ID NO: 2817903 - RNA, 16 nt, Human
agaauuagcuuuuuca

SEQ ID NO: 2817904 - RNA, 22 nt, Human
agaauuagcuuuuucauccccu

SEQ ID NO: 2817905 - RNA, 17 nt, Human
agaauuagugccagaau

SEQ ID NO: 2817906 - RNA, 19 nt, Human
agaauuagugccagaauuu

SEQ ID NO: 2817907 - RNA, 21 nt, Human
agaauuagugccagaauuuua

SEQ ID NO: 2817908 - RNA, 22 nt, Human
agaauuagugccagaauuuuag

SEQ ID NO: 2817909 - RNA, 15 nt, Human
agaauguuagagcac

SEQ ID NO: 2817910 - RNA, 16 nt, Human
agaauguuagagcaca

SEQ ID NO: 2817911 - RNA, 18 nt, Human
agaauguuagagcacagu

SEQ ID NO: 2817912 - RNA, 16 nt, Human
agaauguguuucaaac

SEQ ID NO: 2817913 - RNA, 18 nt, Human
agaauguguuucaaacug

SEQ ID NO: 2817914 - RNA, 22 nt, Human
agaauguguuucaaacuguaaa

SEQ ID NO: 2817915 - RNA, 15 nt, Human
agaaauuugauuucu

SEQ ID NO: 2817916 - RNA, 19 nt, Human
agaaauuucagguuguugg

SEQ ID NO: 2817917 - RNA, 17 nt, Human
agaaauuucugugaaac

SEQ ID NO: 2817918 - RNA, 21 nt, Human
agaaauuucugugaaaccugu

SEQ ID NO: 2817919 - RNA, 13 nt, Human
agaacccagggcu

SEQ ID NO: 2817920 - RNA, 14 nt, Human
agaacccagggcuc

SEQ ID NO: 2817921 - RNA, 18 nt, Human
agaacccagggcucugcc

SEQ ID NO: 2817922 - RNA, 19 nt, Human
agaacccagggcucugccc

SEQ ID NO: 2817923 - RNA, 20 nt, Human
agaacccagggcucugcccc

SEQ ID NO: 2817924 - RNA, 21 nt, Human
agaacccagggcucugcccca

SEQ ID NO: 2817925 - RNA, 22 nt, Human
agaacccagggcucugccccag

SEQ ID NO: 2817926 - RNA, 14 nt, Human
agaaccgagcaaag

SEQ ID NO: 2817927 - RNA, 15 nt, Human
agaaccgagcaaaga

SEQ ID NO: 2817928 - RNA, 16 nt, Human
agaaccgagcaaagau

SEQ ID NO: 2817929 - RNA, 20 nt, Human
agaacccuuggcuugcccac

SEQ ID NO: 2817930 - RNA, 19 nt, Human
agaaccccuacaugaaaca

SEQ ID NO: 2817931 - RNA, 17 nt, Human
agaaccccuacaugaaa

SEQ ID NO: 2817932 - RNA, 16 nt, Human
agaaauuugauuucua

SEQ ID NO: 2817933 - RNA, 22 nt, Human
ucuggggucuuuuuaugcauuu

SEQ ID NO: 2817934 - RNA, 19 nt, Human
ucuggggugcugccugaau

SEQ ID NO: 2817935 - RNA, 15 nt, Human
ucugggguccccagg

SEQ ID NO: 2817936 - RNA, 19 nt, Human
ucugggguccccagggcug

SEQ ID NO: 2817937 - RNA, 22 nt, Human
ucuggggaaagacacugccugg

SEQ ID NO: 2817938 - RNA, 21 nt, Human
ucuggggaaagacacugccug

SEQ ID NO: 2817939 - RNA, 23 nt, Human
ucuggggaaagacacugccuggg

SEQ ID NO: 2817940 - RNA, 20 nt, Human
ucuggggaaagacacugccu

SEQ ID NO: 2817941 - RNA, 15 nt, Human
ucugggucagugguc

SEQ ID NO: 2817942 - RNA, 22 nt, Human
ucuggguuccuuccucugagcc

SEQ ID NO: 2817943 - RNA, 23 nt, Human
ucuggguuccuuccucugagccu

SEQ ID NO: 2817944 - RNA, 13 nt, Human
ucugggcuccaga

SEQ ID NO: 2817945 - RNA, 14 nt, Human
ucugggcucuuucc

SEQ ID NO: 2817946 - RNA, 19 nt, Human
ucugggcuagguagaaaaa

SEQ ID NO: 2817947 - RNA, 20 nt, Human
ucugggcuagguagaaaaag

SEQ ID NO: 2817948 - RNA, 15 nt, Human
ucugggcuauggaca

SEQ ID NO: 2817949 - RNA, 16 nt, Human
ucugggcuauggacac

SEQ ID NO: 2817950 - RNA, 17 nt, Human
ucugggcuauggacaca

SEQ ID NO: 2817951 - RNA, 18 nt, Human
ucugggcuauggacacag

SEQ ID NO: 2817952 - RNA, 21 nt, Human
ucugggcuauggacacagggu

SEQ ID NO: 2817953 - RNA, 22 nt, Human
ucugggcugcuacccagaaauc

SEQ ID NO: 2817954 - RNA, 17 nt, Human
ucugggcugcuacccag

SEQ ID NO: 2817955 - RNA, 17 nt, Human
agaauuaacagagauug

SEQ ID NO: 2817956 - RNA, 12 nt, Human
agagacagaaug

SEQ ID NO: 2817957 - RNA, 20 nt, Human
agagacaaacaccucccagg

SEQ ID NO: 2817958 - RNA, 13 nt, Human
agagacaaaauau

SEQ ID NO: 2817959 - RNA, 19 nt, Human
agagacaaacaccucccag

SEQ ID NO: 2817960 - RNA, 23 nt, Human
agagaauuucuaccauuucagag

SEQ ID NO: 2817961 - RNA, 22 nt, Human
agagaauuucuaccauuucaga

SEQ ID NO: 2817962 - RNA, 21 nt, Human
agagacaaacaccucccagga

SEQ ID NO: 2817963 - RNA, 18 nt, Human
agagacaaacuguaaaaa

SEQ ID NO: 2817964 - RNA, 20 nt, Human
agagacaaacuguaaaaaau

SEQ ID NO: 2817965 - RNA, 22 nt, Human
agagacaaacuguaaaaaaugu

SEQ ID NO: 2817966 - RNA, 15 nt, Human
agagaaaaacaaauu

SEQ ID NO: 2817967 - RNA, 13 nt, Human
agagaaaaacaaa

SEQ ID NO: 2817968 - RNA, 16 nt, Human
agagaauuagauuaua

SEQ ID NO: 2817969 - RNA, 12 nt, Human
agagaauuggcu

SEQ ID NO: 2817970 - RNA, 14 nt, Human
agagaauuggcuca

SEQ ID NO: 2817971 - RNA, 15 nt, Human
agagaauuggcucaa

SEQ ID NO: 2817972 - RNA, 13 nt, Human
agacuuuuguaca

SEQ ID NO: 2817973 - RNA, 14 nt, Human
agacuuuuguacau

SEQ ID NO: 2817974 - RNA, 22 nt, Human
agacuuuuguacaucuggcuua

SEQ ID NO: 2817975 - RNA, 12 nt, Human
agacuuucuguu

SEQ ID NO: 2817976 - RNA, 14 nt, Human
agacuuucuuuaaa

SEQ ID NO: 2817977 - RNA, 21 nt, Human
agacuuucuuuaaauuauguu

SEQ ID NO: 2817978 - RNA, 16 nt, Human
agacuuuaggcuuuca

SEQ ID NO: 2817979 - RNA, 17 nt, Human
agacuuuaggcuuucag

SEQ ID NO: 2817980 - RNA, 20 nt, Human
agacuuuaggcuuucagcuu

SEQ ID NO: 2817981 - RNA, 22 nt, Human
agacuuuaggcuuucagcuuac

SEQ ID NO: 2817982 - RNA, 16 nt, Human
agagaaaaaaaaaaua

SEQ ID NO: 2817983 - RNA, 18 nt, Human
agagaaaaaaaaaauagu

SEQ ID NO: 2817984 - RNA, 15 nt, Human
agacuuuuuucuagu

SEQ ID NO: 2817985 - RNA, 19 nt, Human
agacuuuuuuuaaauagua

SEQ ID NO: 2817986 - RNA, 18 nt, Human
agacuuguaugaaagaug

SEQ ID NO: 2817987 - RNA, 15 nt, Human
agacugguccugugu

SEQ ID NO: 2817988 - RNA, 17 nt, Human
agacugguccugugugc

SEQ ID NO: 2817989 - RNA, 18 nt, Human
agacugguccugugugca

SEQ ID NO: 2817990 - RNA, 23 nt, Human
agacucgauucauauugaauaua

SEQ ID NO: 2817991 - RNA, 19 nt, Human
agacucgccaacaugguga

SEQ ID NO: 2817992 - RNA, 14 nt, Human
agacuuccuugaga

SEQ ID NO: 2817993 - RNA, 16 nt, Human
agacuuccuugagaca

SEQ ID NO: 2817994 - RNA, 19 nt, Human
agacuucccugaauguauu

SEQ ID NO: 2817995 - RNA, 15 nt, Human
agacuucccugaaug

SEQ ID NO: 2817996 - RNA, 13 nt, Human
agacuuccaaaga

SEQ ID NO: 2817997 - RNA, 15 nt, Human
agacuuccaaagaau

SEQ ID NO: 2817998 - RNA, 17 nt, Human
agacuuccaaagaaugu

SEQ ID NO: 2817999 - RNA, 16 nt, Human
agacuucccuaacacu

SEQ ID NO: 2818000 - RNA, 21 nt, Human
agacuuacuuuacucauuuuu

SEQ ID NO: 2818001 - RNA, 21 nt, Human
agacuucauugucccucuuca

SEQ ID NO: 2818002 - RNA, 19 nt, Human
agacuuacuuuacucauuu

SEQ ID NO: 2818003 - RNA, 20 nt, Human
agacuuacuuuacucauuuu

SEQ ID NO: 2818004 - RNA, 14 nt, Human
agacuuacucuaag

SEQ ID NO: 2818005 - RNA, 15 nt, Human
agacuuacucuaaga

SEQ ID NO: 2818006 - RNA, 16 nt, Human
agacuuacucuaagau

SEQ ID NO: 2818007 - RNA, 18 nt, Human
agacuuacucuaagaucu

SEQ ID NO: 2818008 - RNA, 15 nt, Human
agacuuacuauuaca

SEQ ID NO: 2818009 - RNA, 23 nt, Human
agacuuaauagaaacauugaaga

SEQ ID NO: 2818010 - RNA, 18 nt, Human
agacuguagccuggauau

SEQ ID NO: 2818011 - RNA, 17 nt, Human
agacuuaauagaaacau

SEQ ID NO: 2818012 - RNA, 16 nt, Human
ucuuuauacuguaauu

SEQ ID NO: 2818013 - RNA, 15 nt, Human
ucuuuauagugcaca

SEQ ID NO: 2818014 - RNA, 17 nt, Human
ucuuuauagugcacaaa

SEQ ID NO: 2818015 - RNA, 21 nt, Human
ucuuuauagugcacaaaauga

SEQ ID NO: 2818016 - RNA, 16 nt, Human
ucuuuauauacaauaa

SEQ ID NO: 2818017 - RNA, 17 nt, Human
ucuuuauauacaauaau

SEQ ID NO: 2818018 - RNA, 18 nt, Human
ucuuuauauacaauaaug

SEQ ID NO: 2818019 - RNA, 21 nt, Human
ucuuuauauacaauaauggaa

SEQ ID NO: 2818020 - RNA, 14 nt, Human
ucuuucuuccucug

SEQ ID NO: 2818021 - RNA, 22 nt, Human
ucuuucugcagaaacagaaagg

SEQ ID NO: 2818022 - RNA, 21 nt, Human
ucuuucugcagaaacagaaag

SEQ ID NO: 2818023 - RNA, 13 nt, Human
ucuuucuggaguc

SEQ ID NO: 2818024 - RNA, 20 nt, Human
agacucgauucauauugaau

SEQ ID NO: 2818025 - RNA, 20 nt, Human
agacuccuugagagaccagg

SEQ ID NO: 2818026 - RNA, 17 nt, Human
ucuuucuuccucugcug

SEQ ID NO: 2818027 - RNA, 15 nt, Human
ucuuucuuccucugc

SEQ ID NO: 2818028 - RNA, 16 nt, Human
ucuuucuuccucugcu

SEQ ID NO: 2818029 - RNA, 20 nt, Human
ucuuuaaugucacaggcagg

SEQ ID NO: 2818030 - RNA, 14 nt, Human
ucuuguaaaugugu

SEQ ID NO: 2818031 - RNA, 17 nt, Human
ucuuguaaauguguugg

SEQ ID NO: 2818032 - RNA, 18 nt, Human
ucuuguaaauguguugga

SEQ ID NO: 2818033 - RNA, 22 nt, Human
ucuuguaaauguguuggacaaa

SEQ ID NO: 2818034 - RNA, 17 nt, Human
ucuuguaaggcuuugau

SEQ ID NO: 2818035 - RNA, 18 nt, Human
ucuuguaaggcuuugauu

SEQ ID NO: 2818036 - RNA, 17 nt, Human
ucuuguaauauuuugua

SEQ ID NO: 2818037 - RNA, 19 nt, Human
ucuuguaauauuuuguauu

SEQ ID NO: 2818038 - RNA, 22 nt, Human
ucuugguuucucucuacagugc

SEQ ID NO: 2818039 - RNA, 22 nt, Human
ucuuuaaugucacaggcagguc

SEQ ID NO: 2818040 - RNA, 16 nt, Human
ucuuuaggucuuugua

SEQ ID NO: 2818041 - RNA, 17 nt, Human
ucuuuaggucuuuguaa

SEQ ID NO: 2818042 - RNA, 21 nt, Human
ucuuuaggucuuuguaagaac

SEQ ID NO: 2818043 - RNA, 22 nt, Human
ucuuuaauuucugucagaaugc

SEQ ID NO: 2818044 - RNA, 17 nt, Human
ucuugguuggcuggccu

SEQ ID NO: 2818045 - RNA, 17 nt, Human
ucuugauaccccccucu

SEQ ID NO: 2818046 - RNA, 20 nt, Human
ucuugauaccccccucuguc

SEQ ID NO: 2818047 - RNA, 21 nt, Human
ucuugauaccccccucugucu

SEQ ID NO: 2818048 - RNA, 22 nt, Human
ucuugauaccccccucugucuu

SEQ ID NO: 2818049 - RNA, 13 nt, Human
ucuugguguuaaa

SEQ ID NO: 2818050 - RNA, 17 nt, Human
ucuugguguuaaaacac

SEQ ID NO: 2818051 - RNA, 22 nt, Human
ucuuauugcaaaauagcauuug

SEQ ID NO: 2818052 - RNA, 14 nt, Human
ucuuauuuugugga

SEQ ID NO: 2818053 - RNA, 12 nt, Human
ucuuauuuuucu

SEQ ID NO: 2818054 - RNA, 16 nt, Human
ucuucugaauauuuua

SEQ ID NO: 2818055 - RNA, 14 nt, Human
ucuucugacaaacu

SEQ ID NO: 2818056 - RNA, 16 nt, Human
ucuucugacaaacugu

SEQ ID NO: 2818057 - RNA, 17 nt, Human
ucuucugacaaacugug

SEQ ID NO: 2818058 - RNA, 22 nt, Human
ucuucugacaaacuguguacau

SEQ ID NO: 2818059 - RNA, 22 nt, Human
ucuucuguacgucugacaggca

SEQ ID NO: 2818060 - RNA, 21 nt, Human
ucuucuguacgucugacaggc

SEQ ID NO: 2818061 - RNA, 18 nt, Human
ucuucuggcucaaaaaga

SEQ ID NO: 2818062 - RNA, 21 nt, Human
ucuucuggcucaaaaagagaa

SEQ ID NO: 2818063 - RNA, 12 nt, Human
ucuucuggcuca

SEQ ID NO: 2818064 - RNA, 13 nt, Human
ucuucuggcucaa

SEQ ID NO: 2818065 - RNA, 22 nt, Human
ucuucugcuucagccucccgag

SEQ ID NO: 2818066 - RNA, 20 nt, Human
ucuucugcccaauuggagga

SEQ ID NO: 2818067 - RNA, 13 nt, Human
ucuucugccaaga

SEQ ID NO: 2818068 - RNA, 12 nt, Human
ucuucugcucca

SEQ ID NO: 2818069 - RNA, 11 nt, Human
ucuucugcucc

SEQ ID NO: 2818070 - RNA, 17 nt, Human
ucuucugcgccucaggc

SEQ ID NO: 2818071 - RNA, 23 nt, Human
ucuucuguacgucugacaggcaa

SEQ ID NO: 2818072 - RNA, 20 nt, Human
ucuucuguacgucugacagg

SEQ ID NO: 2818073 - RNA, 12 nt, Human
ucuucuuaugca

SEQ ID NO: 2818074 - RNA, 15 nt, Human
agacauuuuaacaag

SEQ ID NO: 2818075 - RNA, 16 nt, Human
agacauuuuaacaaga

SEQ ID NO: 2818076 - RNA, 17 nt, Human
agacauuuuaacaagaa

SEQ ID NO: 2818077 - RNA, 20 nt, Human
agacauuuuaacaagaagau

SEQ ID NO: 2818078 - RNA, 21 nt, Human
agacauuuuaacaagaagaug

SEQ ID NO: 2818079 - RNA, 22 nt, Human
agacauuuuaacaagaagauga

SEQ ID NO: 2818080 - RNA, 23 nt, Human
agacauuuuaacaagaagaugaa

SEQ ID NO: 2818081 - RNA, 22 nt, Human
agacauuuuuccguuugcuuuu

SEQ ID NO: 2818082 - RNA, 20 nt, Human
agacauuuguuauuuuggaa

SEQ ID NO: 2818083 - RNA, 14 nt, Human
agacauuucuuuuc

SEQ ID NO: 2818084 - RNA, 16 nt, Human
agacauuucuuuucuu

SEQ ID NO: 2818085 - RNA, 19 nt, Human
agacauuucuuuucuuuuu

SEQ ID NO: 2818086 - RNA, 20 nt, Human
agacauuucuuuucuuuuua

SEQ ID NO: 2818087 - RNA, 21 nt, Human
agacauuucuuuucuuuuuac

SEQ ID NO: 2818088 - RNA, 22 nt, Human
agacauuucuuuucuuuuuaca

SEQ ID NO: 2818089 - RNA, 23 nt, Human
agacauuucuuuucuuuuuacau

SEQ ID NO: 2818090 - RNA, 20 nt, Human
agacauggcuuucagaaaac

SEQ ID NO: 2818091 - RNA, 21 nt, Human
agacauggcuuucagaaaacg

SEQ ID NO: 2818092 - RNA, 21 nt, Human
agacauggagguucuaaggcc

SEQ ID NO: 2818093 - RNA, 19 nt, Human
agacauggagguucuaagg

SEQ ID NO: 2818094 - RNA, 20 nt, Human
agacauggagguucuaaggc

SEQ ID NO: 2818095 - RNA, 15 nt, Human
agacauggagguucu

SEQ ID NO: 2818096 - RNA, 16 nt, Human
agacauggagguucua

SEQ ID NO: 2818097 - RNA, 17 nt, Human
agacauggagguucuaa

SEQ ID NO: 2818098 - RNA, 15 nt, Human
agacaugauuuccuu

SEQ ID NO: 2818099 - RNA, 22 nt, Human
agacaugauuuccuugaaugug

SEQ ID NO: 2818100 - RNA, 20 nt, Human
agacaugagugcgugcucag

SEQ ID NO: 2818101 - RNA, 13 nt, Human
agacaucuuucuc

SEQ ID NO: 2818102 - RNA, 19 nt, Human
agaccugcuuuuugaaaug

SEQ ID NO: 2818103 - RNA, 20 nt, Human
agaccugcuuuuugaaauga

SEQ ID NO: 2818104 - RNA, 22 nt, Human
agaccugcuuuuugaaaugaaa

SEQ ID NO: 2818105 - RNA, 23 nt, Human
agaccugcuuuuugaaaugaaau

SEQ ID NO: 2818106 - RNA, 13 nt, Human
agaccugccccuc

SEQ ID NO: 2818107 - RNA, 16 nt, Human
agaccugccccuccuc

SEQ ID NO: 2818108 - RNA, 23 nt, Human
agaccugccccuccucucugccc

SEQ ID NO: 2818109 - RNA, 22 nt, Human
agaccugccccuccucucugcc

SEQ ID NO: 2818110 - RNA, 14 nt, Human
agacucacaggaag

SEQ ID NO: 2818111 - RNA, 15 nt, Human
agacucacaggaagg

SEQ ID NO: 2818112 - RNA, 16 nt, Human
agacucacaggaagga

SEQ ID NO: 2818113 - RNA, 22 nt, Human
agacucacaggaaggaggagcc

SEQ ID NO: 2818114 - RNA, 17 nt, Human
agacucaaauguucuaa

SEQ ID NO: 2818115 - RNA, 20 nt, Human
agacucaaauguucuaaguu

SEQ ID NO: 2818116 - RNA, 23 nt, Human
agacucaaauguucuaaguuucu

SEQ ID NO: 2818117 - RNA, 22 nt, Human
agacucaagguggucaguaaau

SEQ ID NO: 2818118 - RNA, 14 nt, Human
agacuauuugcuua

SEQ ID NO: 2818119 - RNA, 13 nt, Human
agacucaaaugcu

SEQ ID NO: 2818120 - RNA, 15 nt, Human
agacucaaauguucu

SEQ ID NO: 2818121 - RNA, 16 nt, Human
agacucaaauguucua

SEQ ID NO: 2818122 - RNA, 17 nt, Human
agacuauuuaaacuuau

SEQ ID NO: 2818123 - RNA, 19 nt, Human
agacuauuuaaacuuauaa

SEQ ID NO: 2818124 - RNA, 22 nt, Human
agacuauuuaaacuuauaaauc

SEQ ID NO: 2818125 - RNA, 15 nt, Human
agacucauucuucug

SEQ ID NO: 2818126 - RNA, 19 nt, Human
agacucauccugaacagca

SEQ ID NO: 2818127 - RNA, 20 nt, Human
agacucauccugaacagcau

SEQ ID NO: 2818128 - RNA, 21 nt, Human
agacucauccugaacagcaug

SEQ ID NO: 2818129 - RNA, 22 nt, Human
agacucauccugaacagcaugg

SEQ ID NO: 2818130 - RNA, 21 nt, Human
agacucaguggggaggggcug

SEQ ID NO: 2818131 - RNA, 16 nt, Human
agacucaucuuacugu

SEQ ID NO: 2818132 - RNA, 17 nt, Human
agacucaucuuacugua

SEQ ID NO: 2818133 - RNA, 14 nt, Human
ucuugauaagacca

SEQ ID NO: 2818134 - RNA, 18 nt, Human
agacucaucuuacuguac

SEQ ID NO: 2818135 - RNA, 22 nt, Human
ucuugauaagaccaccaccuca

SEQ ID NO: 2818136 - RNA, 15 nt, Human
agaccucuccuuccu

SEQ ID NO: 2818137 - RNA, 11 nt, Human
agaccucugga

SEQ ID NO: 2818138 - RNA, 12 nt, Human
agaccucuggau

SEQ ID NO: 2818139 - RNA, 23 nt, Human
agaccucuggauuaggucucugu

SEQ ID NO: 2818140 - RNA, 23 nt, Human
agaccucugugaggaaagcacac

SEQ ID NO: 2818141 - RNA, 14 nt, Human
agaccuccccagcc

SEQ ID NO: 2818142 - RNA, 15 nt, Human
agaccuccccagccc

SEQ ID NO: 2818143 - RNA, 17 nt, Human
agaccuccccagccccu

SEQ ID NO: 2818144 - RNA, 20 nt, Human
agaccuccccagccccuagc

SEQ ID NO: 2818145 - RNA, 23 nt, Human
agaccuccccagccccuagccca

SEQ ID NO: 2818146 - RNA, 16 nt, Human
agaccuauguaagaau

SEQ ID NO: 2818147 - RNA, 20 nt, Human
agaccguccucaccccuguc

SEQ ID NO: 2818148 - RNA, 20 nt, Human
agaccuacuguucuaaagcu

SEQ ID NO: 2818149 - RNA, 21 nt, Human
agaccuacuguucuaaagcuc

SEQ ID NO: 2818150 - RNA, 22 nt, Human
agaccuacuguucuaaagcucu

SEQ ID NO: 2818151 - RNA, 14 nt, Human
agaccgcucucuuu

SEQ ID NO: 2818152 - RNA, 17 nt, Human
agaccgcucucuuuucu

SEQ ID NO: 2818153 - RNA, 22 nt, Human
agaccgcucucuuuucuguacu

SEQ ID NO: 2818154 - RNA, 18 nt, Human
agaccguccucaccccug

SEQ ID NO: 2818155 - RNA, 19 nt, Human
agaccguccucaccccugu

SEQ ID NO: 2818156 - RNA, 13 nt, Human
agaccguccucac

SEQ ID NO: 2818157 - RNA, 14 nt, Human
agaccguccucacc

SEQ ID NO: 2818158 - RNA, 15 nt, Human
agaccguccucaccc

SEQ ID NO: 2818159 - RNA, 16 nt, Human
agaccguccucacccc

SEQ ID NO: 2818160 - RNA, 14 nt, Human
agacccggcugcgu

SEQ ID NO: 2818161 - RNA, 21 nt, Human
agaccccuggcuuuucacugc

SEQ ID NO: 2818162 - RNA, 13 nt, Human
agaccaaaauaaa

SEQ ID NO: 2818163 - RNA, 13 nt, Human
agaccaaacuuca

SEQ ID NO: 2818164 - RNA, 24 nt, Human
agaccaaacuucacucugggcaca

SEQ ID NO: 2818165 - RNA, 15 nt, Human
agaccccuggcuuuu

SEQ ID NO: 2818166 - RNA, 14 nt, Human
agaccccuggcuuu

SEQ ID NO: 2818167 - RNA, 14 nt, Human
agaguuuaacacaa

SEQ ID NO: 2818168 - RNA, 16 nt, Human
agaguugugcacgcag

SEQ ID NO: 2818169 - RNA, 18 nt, Human
agaguugccccgucucug

SEQ ID NO: 2818170 - RNA, 23 nt, Human
agaguugccccgucucuguucca

SEQ ID NO: 2818171 - RNA, 12 nt, Human
agagucugucuc

SEQ ID NO: 2818172 - RNA, 21 nt, Human
agagucuuccacuucaaugca

SEQ ID NO: 2818173 - RNA, 13 nt, Human
agaguccucacuc

SEQ ID NO: 2818174 - RNA, 12 nt, Human
agaguccuauuu

SEQ ID NO: 2818175 - RNA, 14 nt, Human
agagucagaucuuu

SEQ ID NO: 2818176 - RNA, 12 nt, Human
ugaaugugucag

SEQ ID NO: 2818177 - RNA, 18 nt, Human
ugaauguggcuugagaaa

SEQ ID NO: 2818178 - RNA, 15 nt, Human
ugaaugugggcacug

SEQ ID NO: 2818179 - RNA, 16 nt, Human
ugaaugugggcacugg

SEQ ID NO: 2818180 - RNA, 21 nt, Human
ugaaugugggcacuggcccag

SEQ ID NO: 2818181 - RNA, 15 nt, Human
ugaauguggucucag

SEQ ID NO: 2818182 - RNA, 16 nt, Human
ugaauguggucucagg

SEQ ID NO: 2818183 - RNA, 18 nt, Human
agagucagccuucccccu

SEQ ID NO: 2818184 - RNA, 21 nt, Human
agaguccaagguuuaaagagu

SEQ ID NO: 2818185 - RNA, 19 nt, Human
agaguccaagguuuaaaga

SEQ ID NO: 2818186 - RNA, 16 nt, Human
ugaaugucuaaaauug

SEQ ID NO: 2818187 - RNA, 18 nt, Human
ugaaugucuaaaauuguu

SEQ ID NO: 2818188 - RNA, 23 nt, Human
ugaaugucuuuugaauauuccca

SEQ ID NO: 2818189 - RNA, 15 nt, Human
ugaaugucuuuugaa

SEQ ID NO: 2818190 - RNA, 20 nt, Human
ugaaugugcugaucauuuga

SEQ ID NO: 2818191 - RNA, 20 nt, Human
ugaaugguauggaacucucu

SEQ ID NO: 2818192 - RNA, 13 nt, Human
ugaaugguaugga

SEQ ID NO: 2818193 - RNA, 17 nt, Human
ugaagcaccaagcucaa

SEQ ID NO: 2818194 - RNA, 22 nt, Human
agaucacgccacugcacuccag

SEQ ID NO: 2818195 - RNA, 18 nt, Human
agaucacgccacugcacu

SEQ ID NO: 2818196 - RNA, 17 nt, Human
agaucacgccacugcac

SEQ ID NO: 2818197 - RNA, 20 nt, Human
ugaauuucuucacuguugaa

SEQ ID NO: 2818198 - RNA, 13 nt, Human
ugaauuucuaaaa

SEQ ID NO: 2818199 - RNA, 21 nt, Human
ugaauuucuucacuguugaaa

SEQ ID NO: 2818200 - RNA, 23 nt, Human
ugaauuucuucacuguugaaaau

SEQ ID NO: 2818201 - RNA, 20 nt, Human
ugacacacagcucuguccug

SEQ ID NO: 2818202 - RNA, 19 nt, Human
ugacaaaaaguuuccauau

SEQ ID NO: 2818203 - RNA, 16 nt, Human
ugacaaaaccuaacuu

SEQ ID NO: 2818204 - RNA, 17 nt, Human
ugacaaaaccuaacuug

SEQ ID NO: 2818205 - RNA, 20 nt, Human
ugaauuuuuuuuuccuagcc

SEQ ID NO: 2818206 - RNA, 19 nt, Human
ugaauuuuuuuuuccuagc

SEQ ID NO: 2818207 - RNA, 16 nt, Human
ugaauuuuuuuuuccu

SEQ ID NO: 2818208 - RNA, 15 nt, Human
agaguuuaacacaag

SEQ ID NO: 2818209 - RNA, 22 nt, Human
agaguccccccucccaccucca

SEQ ID NO: 2818210 - RNA, 13 nt, Human
agauaaagugguu

SEQ ID NO: 2818211 - RNA, 20 nt, Human
agauaaauauuugacuugca

SEQ ID NO: 2818212 - RNA, 22 nt, Human
agaguuuaacacaaguccugug

SEQ ID NO: 2818213 - RNA, 14 nt, Human
agauacugcugugu

SEQ ID NO: 2818214 - RNA, 16 nt, Human
agauacugcuguguaa

SEQ ID NO: 2818215 - RNA, 22 nt, Human
agauacugcuguguaaugguua

SEQ ID NO: 2818216 - RNA, 21 nt, Human
agauaacaaugcagcaaggcc

SEQ ID NO: 2818217 - RNA, 16 nt, Human
agaucacgccacugca

SEQ ID NO: 2818218 - RNA, 15 nt, Human
agaucacgccacugc

SEQ ID NO: 2818219 - RNA, 14 nt, Human
agaucacgccacug

SEQ ID NO: 2818220 - RNA, 16 nt, Human
agaucaaggagaggag

SEQ ID NO: 2818221 - RNA, 14 nt, Human
agauauuguacaua

SEQ ID NO: 2818222 - RNA, 15 nt, Human
agauauuguacauaa

SEQ ID NO: 2818223 - RNA, 16 nt, Human
agauauuguacauaaa

SEQ ID NO: 2818224 - RNA, 18 nt, Human
agauauuguacauaaaag

SEQ ID NO: 2818225 - RNA, 19 nt, Human
agauauuguacauaaaaga

SEQ ID NO: 2818226 - RNA, 13 nt, Human
agauauuguucaa

SEQ ID NO: 2818227 - RNA, 19 nt, Human
agauauuguucaaacaaua

SEQ ID NO: 2818228 - RNA, 23 nt, Human
agauauuguucaaacaauaucau

SEQ ID NO: 2818229 - RNA, 23 nt, Human
agauauuuaaguauaaaauacaa

SEQ ID NO: 2818230 - RNA, 20 nt, Human
agauauggagaauugcugaa

SEQ ID NO: 2818231 - RNA, 16 nt, Human
agauaugggaacacug

SEQ ID NO: 2818232 - RNA, 21 nt, Human
agauauuacuacuuaccauuu

SEQ ID NO: 2818233 - RNA, 13 nt, Human
agauauuacuuua

SEQ ID NO: 2818234 - RNA, 14 nt, Human
agauauuacuuuau

SEQ ID NO: 2818235 - RNA, 15 nt, Human
agauauuacuuuauc

SEQ ID NO: 2818236 - RNA, 16 nt, Human
agauauuacuuuauca

SEQ ID NO: 2818237 - RNA, 17 nt, Human
agauauuacuuuaucac

SEQ ID NO: 2818238 - RNA, 22 nt, Human
agauauuacuuuaucacuuuuu

SEQ ID NO: 2818239 - RNA, 14 nt, Human
agauauuauugcuu

SEQ ID NO: 2818240 - RNA, 23 nt, Human
agaugcgucccaagauguugauu

SEQ ID NO: 2818241 - RNA, 20 nt, Human
agaugcuaaaaucccuggau

SEQ ID NO: 2818242 - RNA, 15 nt, Human
agaugcgucccaaga

SEQ ID NO: 2818243 - RNA, 20 nt, Human
agaugcgucccaagauguug

SEQ ID NO: 2818244 - RNA, 22 nt, Human
agaugccuuuuuuguaguuuuu

SEQ ID NO: 2818245 - RNA, 22 nt, Human
agaugcgagcgcuaucuucaca

SEQ ID NO: 2818246 - RNA, 18 nt, Human
agaugcgcagccccaucu

SEQ ID NO: 2818247 - RNA, 19 nt, Human
agaugcgcagccccaucug

SEQ ID NO: 2818248 - RNA, 20 nt, Human
agaugcgcagccccaucugu

SEQ ID NO: 2818249 - RNA, 23 nt, Human
agaugcgcagccccaucugugca

SEQ ID NO: 2818250 - RNA, 17 nt, Human
agaugcagagagccauu

SEQ ID NO: 2818251 - RNA, 19 nt, Human
ugacauuguauguaucuau

SEQ ID NO: 2818252 - RNA, 12 nt, Human
agaugcagagag

SEQ ID NO: 2818253 - RNA, 13 nt, Human
agaugcagagagc

SEQ ID NO: 2818254 - RNA, 14 nt, Human
agaugcagagagcc

SEQ ID NO: 2818255 - RNA, 15 nt, Human
agaugcagagagcca

SEQ ID NO: 2818256 - RNA, 15 nt, Human
agaugcaccagcccu

SEQ ID NO: 2818257 - RNA, 14 nt, Human
agaugcaccagccc

SEQ ID NO: 2818258 - RNA, 16 nt, Human
agaucauucaguguuu

SEQ ID NO: 2818259 - RNA, 14 nt, Human
agauguucccccau

SEQ ID NO: 2818260 - RNA, 14 nt, Human
agauguucgguuuu

SEQ ID NO: 2818261 - RNA, 13 nt, Human
ugacccacugcuu

SEQ ID NO: 2818262 - RNA, 12 nt, Human
ugacccacugcu

SEQ ID NO: 2818263 - RNA, 21 nt, Human
ugacccaaaucucuuccacaa

SEQ ID NO: 2818264 - RNA, 15 nt, Human
agaugcugguuuucu

SEQ ID NO: 2818265 - RNA, 20 nt, Human
agaugcuguaacuuaaaaua

SEQ ID NO: 2818266 - RNA, 22 nt, Human
agaugcuguaacuuaaaauagg

SEQ ID NO: 2818267 - RNA, 16 nt, Human
agaugcugugagucuu

SEQ ID NO: 2818268 - RNA, 20 nt, Human
agaugcugugagucuuuggu

SEQ ID NO: 2818269 - RNA, 15 nt, Human
agaugugauauucua

SEQ ID NO: 2818270 - RNA, 16 nt, Human
agaugugauauucuaa

SEQ ID NO: 2818271 - RNA, 17 nt, Human
agaugugauauucuaag

SEQ ID NO: 2818272 - RNA, 18 nt, Human
agaugugauauucuaaga

SEQ ID NO: 2818273 - RNA, 19 nt, Human
agaugugauauucuaagac

SEQ ID NO: 2818274 - RNA, 20 nt, Human
agaugugauauucuaagacu

SEQ ID NO: 2818275 - RNA, 23 nt, Human
agaugugaugcuugauauuuucu

SEQ ID NO: 2818276 - RNA, 21 nt, Human
agaugugcacccaugggcucu

SEQ ID NO: 2818277 - RNA, 14 nt, Human
agaugugcagcaga

SEQ ID NO: 2818278 - RNA, 15 nt, Human
agaugugcagcagau

SEQ ID NO: 2818279 - RNA, 17 nt, Human
agaugugcagcagauug

SEQ ID NO: 2818280 - RNA, 18 nt, Human
agaugugcagcagauugg

SEQ ID NO: 2818281 - RNA, 22 nt, Human
agaugugcagcagauuggaagg

SEQ ID NO: 2818282 - RNA, 23 nt, Human
agaugugcagcagauuggaagga

SEQ ID NO: 2818283 - RNA, 12 nt, Human
agauguggagcc

SEQ ID NO: 2818284 - RNA, 13 nt, Human
agauguggagcca

SEQ ID NO: 2818285 - RNA, 14 nt, Human
agauguggagccag

SEQ ID NO: 2818286 - RNA, 15 nt, Human
agauguggagccagg

SEQ ID NO: 2818287 - RNA, 16 nt, Human
agauguggagccaggc

SEQ ID NO: 2818288 - RNA, 13 nt, Human
agaugugcaccca

SEQ ID NO: 2818289 - RNA, 15 nt, Human
agaugugcacccaug

SEQ ID NO: 2818290 - RNA, 15 nt, Human
agauguuagacucau

SEQ ID NO: 2818291 - RNA, 19 nt, Human
agauguguugcuauccuga

SEQ ID NO: 2818292 - RNA, 21 nt, Human
agauguggccuuccauuuaua

SEQ ID NO: 2818293 - RNA, 12 nt, Human
agauguuaaaaa

SEQ ID NO: 2818294 - RNA, 21 nt, Human
ugacacacagcucuguccugg

SEQ ID NO: 2818295 - RNA, 19 nt, Human
ugacagccucccaccccca

SEQ ID NO: 2818296 - RNA, 17 nt, Human
ugacagccucccacccc

SEQ ID NO: 2818297 - RNA, 22 nt, Human
ugacagccucccacccccaucu

SEQ ID NO: 2818298 - RNA, 19 nt, Human
ugacacagaaaauguugag

SEQ ID NO: 2818299 - RNA, 18 nt, Human
ugacacagaaaauguuga

SEQ ID NO: 2818300 - RNA, 13 nt, Human
ugacacacuacac

SEQ ID NO: 2818301 - RNA, 15 nt, Human
ugacacacuacacca

SEQ ID NO: 2818302 - RNA, 16 nt, Human
ugacacacuacaccac

SEQ ID NO: 2818303 - RNA, 17 nt, Human
ugacacacuacaccaca

SEQ ID NO: 2818304 - RNA, 18 nt, Human
ugacacacuacaccacac

SEQ ID NO: 2818305 - RNA, 19 nt, Human
ugacacacuacaccacaca

SEQ ID NO: 2818306 - RNA, 20 nt, Human
ugacacacuacaccacacac

SEQ ID NO: 2818307 - RNA, 21 nt, Human
ugacacacuacaccacacaca

SEQ ID NO: 2818308 - RNA, 22 nt, Human
ugacacacuacaccacacacaa

SEQ ID NO: 2818309 - RNA, 20 nt, Human
ugacaggcaaugcuggcugu

SEQ ID NO: 2818310 - RNA, 15 nt, Human
ugacagcugucccug

SEQ ID NO: 2818311 - RNA, 13 nt, Human
ugacagcuguccc

SEQ ID NO: 2818312 - RNA, 19 nt, Human
ugacagcucuuuuugugaa

SEQ ID NO: 2818313 - RNA, 20 nt, Human
ugacagcucuuuuugugaag

SEQ ID NO: 2818314 - RNA, 16 nt, Human
ugacagggcacaccgg

SEQ ID NO: 2818315 - RNA, 11 nt, Human
ugacagggcac

SEQ ID NO: 2818316 - RNA, 18 nt, Human
ugacaggccugaagauau

SEQ ID NO: 2818317 - RNA, 20 nt, Human
ugacagggcacaccgggcac

SEQ ID NO: 2818318 - RNA, 21 nt, Human
ugacaguggccgcccaaggcc

SEQ ID NO: 2818319 - RNA, 16 nt, Human
ugacaguucugaagaa

SEQ ID NO: 2818320 - RNA, 16 nt, Human
ugacaguuuuucuguu

SEQ ID NO: 2818321 - RNA, 17 nt, Human
ugacaguuuuucuguuu

SEQ ID NO: 2818322 - RNA, 13 nt, Human
ugacaguuauuuu

SEQ ID NO: 2818323 - RNA, 19 nt, Human
ugacaguguugaaaauguu

SEQ ID NO: 2818324 - RNA, 16 nt, Human
ugacaguguugaaaau

SEQ ID NO: 2818325 - RNA, 16 nt, Human
ugacauuuaauuuagu

SEQ ID NO: 2818326 - RNA, 18 nt, Human
ugacauuuaauuuaguga

SEQ ID NO: 2818327 - RNA, 23 nt, Human
ugacauuuaauuuagugaucuua

SEQ ID NO: 2818328 - RNA, 21 nt, Human
ugacauuguuggccaaagcca

SEQ ID NO: 2818329 - RNA, 20 nt, Human
ugacauuguuggccaaagcc

SEQ ID NO: 2818330 - RNA, 17 nt, Human
ugacaguucugaagaau

SEQ ID NO: 2818331 - RNA, 22 nt, Human
ugacauuguagagcuucuggca

SEQ ID NO: 2818332 - RNA, 15 nt, Human
agaucaguguaccau

SEQ ID NO: 2818333 - RNA, 21 nt, Human
agaucauccagaaguuccuca

SEQ ID NO: 2818334 - RNA, 17 nt, Human
agaucauggaacacaaa

SEQ ID NO: 2818335 - RNA, 19 nt, Human
agaucauggaacacaaaca

SEQ ID NO: 2818336 - RNA, 16 nt, Human
agaucauaaggcuuca

SEQ ID NO: 2818337 - RNA, 21 nt, Human
agaucaguguaccauuugccu

SEQ ID NO: 2818338 - RNA, 18 nt, Human
agaucaguguaccauuug

SEQ ID NO: 2818339 - RNA, 13 nt, Human
agaucauaaggcu

SEQ ID NO: 2818340 - RNA, 19 nt, Human
agagguuguagugagccca

SEQ ID NO: 2818341 - RNA, 20 nt, Human
agagguuguagugagcccag

SEQ ID NO: 2818342 - RNA, 17 nt, Human
agagguccucuggagcc

SEQ ID NO: 2818343 - RNA, 12 nt, Human
agagguccagcc

SEQ ID NO: 2818344 - RNA, 13 nt, Human
agagguccagccc

SEQ ID NO: 2818345 - RNA, 14 nt, Human
agagguccagccca

SEQ ID NO: 2818346 - RNA, 15 nt, Human
agagguccagcccau

SEQ ID NO: 2818347 - RNA, 16 nt, Human
agagguccagcccauc

SEQ ID NO: 2818348 - RNA, 17 nt, Human
agagguccagcccaucu

SEQ ID NO: 2818349 - RNA, 18 nt, Human
agagguccagcccaucuc

SEQ ID NO: 2818350 - RNA, 19 nt, Human
agagguccacaacacacag

SEQ ID NO: 2818351 - RNA, 18 nt, Human
agagguccucuggagccc

SEQ ID NO: 2818352 - RNA, 17 nt, Human
agagguauuuaucuuua

SEQ ID NO: 2818353 - RNA, 14 nt, Human
agaggucagacuaa

SEQ ID NO: 2818354 - RNA, 18 nt, Human
agagguacuagaaugcuu

SEQ ID NO: 2818355 - RNA, 16 nt, Human
agagguagggcugcca

SEQ ID NO: 2818356 - RNA, 17 nt, Human
agagguacaggguuuuu

SEQ ID NO: 2818357 - RNA, 19 nt, Human
agagguacaggguuuuuac

SEQ ID NO: 2818358 - RNA, 21 nt, Human
agagguacaggguuuuuaccu

SEQ ID NO: 2818359 - RNA, 13 nt, Human
agaggcugaggac

SEQ ID NO: 2818360 - RNA, 12 nt, Human
agaggcugagac

SEQ ID NO: 2818361 - RNA, 16 nt, Human
agaggcugagacagga

SEQ ID NO: 2818362 - RNA, 13 nt, Human
ugaagcaaggaag

SEQ ID NO: 2818363 - RNA, 14 nt, Human
ugaagcaaggaaga

SEQ ID NO: 2818364 - RNA, 20 nt, Human
ugaagcaaggaagauauaca

SEQ ID NO: 2818365 - RNA, 21 nt, Human
ugaagcaaggaagauauacau

SEQ ID NO: 2818366 - RNA, 20 nt, Human
ugaagcaaggcgguggacuu

SEQ ID NO: 2818367 - RNA, 18 nt, Human
ugaagcaauggauauuug

SEQ ID NO: 2818368 - RNA, 21 nt, Human
agaguagauggugaaauuuau

SEQ ID NO: 2818369 - RNA, 22 nt, Human
agaguagauggugaaauuuauu

SEQ ID NO: 2818370 - RNA, 18 nt, Human
agaguagaauugcauuga

SEQ ID NO: 2818371 - RNA, 17 nt, Human
agaguagaauugcauug

SEQ ID NO: 2818372 - RNA, 22 nt, Human
agagguuugacuagaugaugga

SEQ ID NO: 2818373 - RNA, 16 nt, Human
agaguagaauugcauu

SEQ ID NO: 2818374 - RNA, 15 nt, Human
agaguagaauugcau

SEQ ID NO: 2818375 - RNA, 13 nt, Human
agaguagaaauaa

SEQ ID NO: 2818376 - RNA, 14 nt, Human
agaguagaaauaaa

SEQ ID NO: 2818377 - RNA, 15 nt, Human
agaguagaaauaaaa

SEQ ID NO: 2818378 - RNA, 13 nt, Human
agaggcagggucu

SEQ ID NO: 2818379 - RNA, 10 nt, Human
agaggcaggg

SEQ ID NO: 2818380 - RNA, 23 nt, Human
agaggccauggcagaauaaucuu

SEQ ID NO: 2818381 - RNA, 20 nt, Human
agaggccauggcagaauaau

SEQ ID NO: 2818382 - RNA, 16 nt, Human
agaggccauggcagaa

SEQ ID NO: 2818383 - RNA, 15 nt, Human
agaggccauggcaga

SEQ ID NO: 2818384 - RNA, 14 nt, Human
agaggccauggcag

SEQ ID NO: 2818385 - RNA, 19 nt, Human
agaggcuauuauuuucacu

SEQ ID NO: 2818386 - RNA, 19 nt, Human
agaggccaugggccuccug

SEQ ID NO: 2818387 - RNA, 19 nt, Human
agaggcagccccauucugc

SEQ ID NO: 2818388 - RNA, 13 nt, Human
agaggcagcccca

SEQ ID NO: 2818389 - RNA, 24 nt, Human
agaggcagccccauucugccugcc

SEQ ID NO: 2818390 - RNA, 15 nt, Human
agaggcagagagcgg

SEQ ID NO: 2818391 - RNA, 15 nt, Human
agagcuuuuaaaaau

SEQ ID NO: 2818392 - RNA, 16 nt, Human
agagcuuuuaaaaaug

SEQ ID NO: 2818393 - RNA, 23 nt, Human
agagcuuggacuggaugcauguu

SEQ ID NO: 2818394 - RNA, 13 nt, Human
agagcuuggacug

SEQ ID NO: 2818395 - RNA, 14 nt, Human
agagcuuggacugg

SEQ ID NO: 2818396 - RNA, 23 nt, Human
agagcuucuuccaggugcccagc

SEQ ID NO: 2818397 - RNA, 22 nt, Human
agagcuucuuccaggugcccag

SEQ ID NO: 2818398 - RNA, 12 nt, Human
agaggaaaaccc

SEQ ID NO: 2818399 - RNA, 18 nt, Human
agaggaaaacccucaagg

SEQ ID NO: 2818400 - RNA, 12 nt, Human
agaggcagagag

SEQ ID NO: 2818401 - RNA, 13 nt, Human
agaggcagagagc

SEQ ID NO: 2818402 - RNA, 14 nt, Human
agaggcagagagcg

SEQ ID NO: 2818403 - RNA, 23 nt, Human
agaggcagagagcggucucaggc

SEQ ID NO: 2818404 - RNA, 13 nt, Human
agaggcagagccu

SEQ ID NO: 2818405 - RNA, 21 nt, Human
agagcuguuuauggccucagc

SEQ ID NO: 2818406 - RNA, 20 nt, Human
agagcuguuuauggccucag

SEQ ID NO: 2818407 - RNA, 19 nt, Human
agagcuguuuauggccuca

SEQ ID NO: 2818408 - RNA, 21 nt, Human
agagcuuaaugauaauauugu

SEQ ID NO: 2818409 - RNA, 15 nt, Human
agagcuuaacagugu

SEQ ID NO: 2818410 - RNA, 22 nt, Human
agagcuucuguugcugccucau

SEQ ID NO: 2818411 - RNA, 15 nt, Human
agagcuucuuccagg

SEQ ID NO: 2818412 - RNA, 15 nt, Human
agagcuuagccugga

SEQ ID NO: 2818413 - RNA, 18 nt, Human
agagcuuagccuggagca

SEQ ID NO: 2818414 - RNA, 18 nt, Human
agagcuggagccuggugc

SEQ ID NO: 2818415 - RNA, 19 nt, Human
agagcuggagccuggugcc

SEQ ID NO: 2818416 - RNA, 15 nt, Human
agagcuggagccugg

SEQ ID NO: 2818417 - RNA, 17 nt, Human
agagcuggagccuggug

SEQ ID NO: 2818418 - RNA, 12 nt, Human
agagcuggagcc

SEQ ID NO: 2818419 - RNA, 17 nt, Human
agagcuggaccaguggu

SEQ ID NO: 2818420 - RNA, 18 nt, Human
ugaagaaauacugcacuu

SEQ ID NO: 2818421 - RNA, 18 nt, Human
ugaagaaacagauaccau

SEQ ID NO: 2818422 - RNA, 14 nt, Human
ugaacuuuggagag

SEQ ID NO: 2818423 - RNA, 17 nt, Human
ugaacuuugggaagccu

SEQ ID NO: 2818424 - RNA, 18 nt, Human
ugaacuuugggaagccuu

SEQ ID NO: 2818425 - RNA, 21 nt, Human
ugaacuauggacggugcucca

SEQ ID NO: 2818426 - RNA, 17 nt, Human
ugaacuauuucuacaca

SEQ ID NO: 2818427 - RNA, 20 nt, Human
ugaacuauuucuacacagug

SEQ ID NO: 2818428 - RNA, 12 nt, Human
ugaacuccuggc

SEQ ID NO: 2818429 - RNA, 11 nt, Human
ugaacuccugg

SEQ ID NO: 2818430 - RNA, 15 nt, Human
ugaacuccuggccuc

SEQ ID NO: 2818431 - RNA, 14 nt, Human
ugaacuccuggccu

SEQ ID NO: 2818432 - RNA, 14 nt, Human
ugaaccgcacagcu

SEQ ID NO: 2818433 - RNA, 20 nt, Human
ugaaauuuucuagacuuucu

SEQ ID NO: 2818434 - RNA, 18 nt, Human
ugaaauuuucuagacuuu

SEQ ID NO: 2818435 - RNA, 19 nt, Human
ugaaauuuucuagacuuuc

SEQ ID NO: 2818436 - RNA, 17 nt, Human
ugaaccuaugaagcaau

SEQ ID NO: 2818437 - RNA, 20 nt, Human
ugaaccucaccccgaggccc

SEQ ID NO: 2818438 - RNA, 22 nt, Human
ugaaccucaccccgaggcccug

SEQ ID NO: 2818439 - RNA, 23 nt, Human
ugaaccucaccccgaggcccugc

SEQ ID NO: 2818440 - RNA, 14 nt, Human
ugaaccugggaggu

SEQ ID NO: 2818441 - RNA, 13 nt, Human
ugaaccugugagu

SEQ ID NO: 2818442 - RNA, 19 nt, Human
ugaaccugugaguaaauau

SEQ ID NO: 2818443 - RNA, 20 nt, Human
ugaaccugugaguaaauauu

SEQ ID NO: 2818444 - RNA, 23 nt, Human
ugaaccugugaguaaauauugag

SEQ ID NO: 2818445 - RNA, 15 nt, Human
ugaaauaugugaagu

SEQ ID NO: 2818446 - RNA, 12 nt, Human
ugaaauaugcau

SEQ ID NO: 2818447 - RNA, 15 nt, Human
ugaaauaugcucuuu

SEQ ID NO: 2818448 - RNA, 18 nt, Human
ugaaauaugcucuuuugu

SEQ ID NO: 2818449 - RNA, 21 nt, Human
ugaaauaugcucuuuuguuug

SEQ ID NO: 2818450 - RNA, 12 nt, Human
ugaaauaauaga

SEQ ID NO: 2818451 - RNA, 14 nt, Human
ugaaauuguacaua

SEQ ID NO: 2818452 - RNA, 17 nt, Human
ugaaauuguacauauuu

SEQ ID NO: 2818453 - RNA, 23 nt, Human
ugaaauuguacauauuuguggaa

SEQ ID NO: 2818454 - RNA, 22 nt, Human
ugaaauugucuagcagagcagg

SEQ ID NO: 2818455 - RNA, 18 nt, Human
ugaaauugugaacucauu

SEQ ID NO: 2818456 - RNA, 22 nt, Human
ugaaauugugaacucauugcuc

SEQ ID NO: 2818457 - RNA, 14 nt, Human
ugaaauuuaaacau

SEQ ID NO: 2818458 - RNA, 16 nt, Human
ugaaauuuaaacauua

SEQ ID NO: 2818459 - RNA, 18 nt, Human
ugaaauuuaaacauuaaa

SEQ ID NO: 2818460 - RNA, 22 nt, Human
ugaaauuuaaacauuaaaaaug

SEQ ID NO: 2818461 - RNA, 14 nt, Human
ugaaauuucuagcc

SEQ ID NO: 2818462 - RNA, 15 nt, Human
ugaaauuucuagccu

SEQ ID NO: 2818463 - RNA, 16 nt, Human
ugaaauuucuagccug

SEQ ID NO: 2818464 - RNA, 21 nt, Human
ugaaauuucuagccugcacuu

SEQ ID NO: 2818465 - RNA, 17 nt, Human
ugaaauuuuaaacuaua

SEQ ID NO: 2818466 - RNA, 17 nt, Human
ugaaauuuucuagacuu

SEQ ID NO: 2818467 - RNA, 21 nt, Human
ugaaauuuucuagacuuucug

SEQ ID NO: 2818468 - RNA, 20 nt, Human
ugaaauuuucuugauuugag

SEQ ID NO: 2818469 - RNA, 12 nt, Human
ugaaauuuugca

SEQ ID NO: 2818470 - RNA, 16 nt, Human
ugaaauuuugcaaaua

SEQ ID NO: 2818471 - RNA, 18 nt, Human
ugaaauuuugcaaauaua

SEQ ID NO: 2818472 - RNA, 19 nt, Human
ugaaauuuugcaaauauaa

SEQ ID NO: 2818473 - RNA, 20 nt, Human
ugaaauuuugcaaauauaaa

SEQ ID NO: 2818474 - RNA, 22 nt, Human
ugaaauuuugcaaauauaaaca

SEQ ID NO: 2818475 - RNA, 22 nt, Human
ugaaauuuuuaaaaauacacuu

SEQ ID NO: 2818476 - RNA, 17 nt, Human
ugaaaguuugcacugua

SEQ ID NO: 2818477 - RNA, 15 nt, Human
ugaaaguuacccacu

SEQ ID NO: 2818478 - RNA, 22 nt, Human
ugaaaguuacccacugaagccc

SEQ ID NO: 2818479 - RNA, 14 nt, Human
ugaaaguucuugcu

SEQ ID NO: 2818480 - RNA, 14 nt, Human
ugaaaguuguacau

SEQ ID NO: 2818481 - RNA, 15 nt, Human
ugaaaguuguacaug

SEQ ID NO: 2818482 - RNA, 18 nt, Human
ugaaaguuguacaugaaa

SEQ ID NO: 2818483 - RNA, 19 nt, Human
ugaaaguuguacaugaaau

SEQ ID NO: 2818484 - RNA, 20 nt, Human
ugaaaguuuucagaaccucu

SEQ ID NO: 2818485 - RNA, 22 nt, Human
ugaaaguuuugaguagauauua

SEQ ID NO: 2818486 - RNA, 18 nt, Human
ugaaaguuuucagaaccu

SEQ ID NO: 2818487 - RNA, 19 nt, Human
ugaaagugaggaaauaaag

SEQ ID NO: 2818488 - RNA, 15 nt, Human
ugaaagugaugacau

SEQ ID NO: 2818489 - RNA, 16 nt, Human
ugaaagugaugacaua

SEQ ID NO: 2818490 - RNA, 20 nt, Human
ugaaagugaugacauauuuu

SEQ ID NO: 2818491 - RNA, 18 nt, Human
ugaaagugaauaaacuuc

SEQ ID NO: 2818492 - RNA, 21 nt, Human
ugaaagugaauaaacuucagc

SEQ ID NO: 2818493 - RNA, 20 nt, Human
agagcugcccuccuugucca

SEQ ID NO: 2818494 - RNA, 21 nt, Human
agagcugcccuccuuguccac

SEQ ID NO: 2818495 - RNA, 16 nt, Human
agagcugccaucgcug

SEQ ID NO: 2818496 - RNA, 13 nt, Human
agagcugcccucc

SEQ ID NO: 2818497 - RNA, 19 nt, Human
agagcggaggcugugugcc

SEQ ID NO: 2818498 - RNA, 14 nt, Human
agagcggucucagg

SEQ ID NO: 2818499 - RNA, 23 nt, Human
agagcggucucaggcugguggga

SEQ ID NO: 2818500 - RNA, 20 nt, Human
agagcguggcugugcucuca

SEQ ID NO: 2818501 - RNA, 17 nt, Human
agagcgagagucugucu

SEQ ID NO: 2818502 - RNA, 18 nt, Human
agagcaaaauaauuuuaa

SEQ ID NO: 2818503 - RNA, 14 nt, Human
agagauuugucuaa

SEQ ID NO: 2818504 - RNA, 17 nt, Human
agagauuugucuaauug

SEQ ID NO: 2818505 - RNA, 18 nt, Human
agagauuuauauaaaugu

SEQ ID NO: 2818506 - RNA, 21 nt, Human
agagauuuauauaaauguaaa

SEQ ID NO: 2818507 - RNA, 23 nt, Human
agagauuuauauaaauguaaaaa

SEQ ID NO: 2818508 - RNA, 22 nt, Human
agacuugucaagccugugcaaa

SEQ ID NO: 2818509 - RNA, 22 nt, Human
ucuuuggcuccccuguaccuuu

SEQ ID NO: 2818510 - RNA, 14 nt, Human
ucuuuggcuccccu

SEQ ID NO: 2818511 - RNA, 20 nt, Human
agagcacacuuggcccaagu

SEQ ID NO: 2818512 - RNA, 21 nt, Human
agagcaaugcccguaaugcuu

SEQ ID NO: 2818513 - RNA, 17 nt, Human
agagcaaugguuguauu

SEQ ID NO: 2818514 - RNA, 13 nt, Human
agagcacaaacau

SEQ ID NO: 2818515 - RNA, 15 nt, Human
agagcacaaacauuu

SEQ ID NO: 2818516 - RNA, 16 nt, Human
agagcacaaacauuuu

SEQ ID NO: 2818517 - RNA, 17 nt, Human
agagcacaaacauuuuu

SEQ ID NO: 2818518 - RNA, 14 nt, Human
agagcaaaauugau

SEQ ID NO: 2818519 - RNA, 23 nt, Human
agagcaagauccugucuuuaagg

SEQ ID NO: 2818520 - RNA, 18 nt, Human
agagcaccuaguccagug

SEQ ID NO: 2818521 - RNA, 19 nt, Human
agagcaccuaguccaguga

SEQ ID NO: 2818522 - RNA, 21 nt, Human
agagccuucugaugucucuaa

SEQ ID NO: 2818523 - RNA, 22 nt, Human
agagccuucugaugucucuaaa

SEQ ID NO: 2818524 - RNA, 13 nt, Human
agagccagaccaa

SEQ ID NO: 2818525 - RNA, 20 nt, Human
agagcauuuccaacaccaca

SEQ ID NO: 2818526 - RNA, 21 nt, Human
agagccacaaaagaaaagacu

SEQ ID NO: 2818527 - RNA, 11 nt, Human
agagccacaca

SEQ ID NO: 2818528 - RNA, 12 nt, Human
agagccacacau

SEQ ID NO: 2818529 - RNA, 13 nt, Human
agagccacacaug

SEQ ID NO: 2818530 - RNA, 14 nt, Human
agagccacacaugg

SEQ ID NO: 2818531 - RNA, 19 nt, Human
agagcauugaauuggagag

SEQ ID NO: 2818532 - RNA, 20 nt, Human
agagcagaacagaucuuuua

SEQ ID NO: 2818533 - RNA, 20 nt, Human
agagcagaacggagccccag

SEQ ID NO: 2818534 - RNA, 23 nt, Human
agagcagaacggagccccaggcc

SEQ ID NO: 2818535 - RNA, 14 nt, Human
agagcagaggcagc

SEQ ID NO: 2818536 - RNA, 12 nt, Human
agagcagaugca

SEQ ID NO: 2818537 - RNA, 19 nt, Human
agagcaguaccagcgcucu

SEQ ID NO: 2818538 - RNA, 18 nt, Human
agagcaguccauuucuac

SEQ ID NO: 2818539 - RNA, 19 nt, Human
agagcaggcguucagcuca

SEQ ID NO: 2818540 - RNA, 19 nt, Human
agagcagaugcagagagcc

SEQ ID NO: 2818541 - RNA, 14 nt, Human
agagcagaugcaga

SEQ ID NO: 2818542 - RNA, 14 nt, Human
agagcagagaauau

SEQ ID NO: 2818543 - RNA, 15 nt, Human
agagcagaugcagag

SEQ ID NO: 2818544 - RNA, 18 nt, Human
agagcagaugcagagagc

SEQ ID NO: 2818545 - RNA, 14 nt, Human
ugaucacggcucac

SEQ ID NO: 2818546 - RNA, 13 nt, Human
ugaucacggcuca

SEQ ID NO: 2818547 - RNA, 15 nt, Human
ugaucacggcucacu

SEQ ID NO: 2818548 - RNA, 14 nt, Human
ugaucaccugcccu

SEQ ID NO: 2818549 - RNA, 14 nt, Human
ugauacagaacucu

SEQ ID NO: 2818550 - RNA, 15 nt, Human
ugauacagaacucuu

SEQ ID NO: 2818551 - RNA, 20 nt, Human
ugauacagucaacaagccug

SEQ ID NO: 2818552 - RNA, 14 nt, Human
ugauacauaacuaa

SEQ ID NO: 2818553 - RNA, 15 nt, Human
ugauacauaacuaaa

SEQ ID NO: 2818554 - RNA, 16 nt, Human
ugauacauaacuaaau

SEQ ID NO: 2818555 - RNA, 17 nt, Human
ugauacauaacuaaauu

SEQ ID NO: 2818556 - RNA, 19 nt, Human
ugauacauaacuaaauuug

SEQ ID NO: 2818557 - RNA, 22 nt, Human
ugauacauaacuaaauuugaua

SEQ ID NO: 2818558 - RNA, 13 nt, Human
ugauacauaauaa

SEQ ID NO: 2818559 - RNA, 20 nt, Human
ugauacaaauugcagacugu

SEQ ID NO: 2818560 - RNA, 16 nt, Human
ugauacaagauuagaa

SEQ ID NO: 2818561 - RNA, 17 nt, Human
ugauacaagauuagaag

SEQ ID NO: 2818562 - RNA, 17 nt, Human
ugauaccagaagggaaa

SEQ ID NO: 2818563 - RNA, 18 nt, Human
ugauaccagaagggaaag

SEQ ID NO: 2818564 - RNA, 21 nt, Human
ugauaccagaagggaaagcuu

SEQ ID NO: 2818565 - RNA, 16 nt, Human
ugauacaaugaacacu

SEQ ID NO: 2818566 - RNA, 15 nt, Human
ugauaccccccucug

SEQ ID NO: 2818567 - RNA, 21 nt, Human
ugaucaauuauaguuucugag

SEQ ID NO: 2818568 - RNA, 18 nt, Human
ugaucaauuauaguuucu

SEQ ID NO: 2818569 - RNA, 20 nt, Human
ugaucaauuauaguuucuga

SEQ ID NO: 2818570 - RNA, 22 nt, Human
ugaucaauuauaguuucugagg

SEQ ID NO: 2818571 - RNA, 16 nt, Human
ugaucaauuuugacuu

SEQ ID NO: 2818572 - RNA, 16 nt, Human
ugaucacacuauuuua

SEQ ID NO: 2818573 - RNA, 17 nt, Human
ugauaccccccucuguc

SEQ ID NO: 2818574 - RNA, 18 nt, Human
ugauaccccccucugucu

SEQ ID NO: 2818575 - RNA, 19 nt, Human
ugauaccccccucugucuu

SEQ ID NO: 2818576 - RNA, 15 nt, Human
ugauaccccugggga

SEQ ID NO: 2818577 - RNA, 16 nt, Human
ugauaccccuggggaa

SEQ ID NO: 2818578 - RNA, 22 nt, Human
ugauaccccuggggaacauuuc

SEQ ID NO: 2818579 - RNA, 13 nt, Human
agcaucccggagg

SEQ ID NO: 2818580 - RNA, 14 nt, Human
agcaucccggagga

SEQ ID NO: 2818581 - RNA, 19 nt, Human
agcaucccggaggaaaucu

SEQ ID NO: 2818582 - RNA, 20 nt, Human
agcaucccggaggaaaucug

SEQ ID NO: 2818583 - RNA, 20 nt, Human
agcaucccugaggagccagg

SEQ ID NO: 2818584 - RNA, 16 nt, Human
agcauccaaguggcau

SEQ ID NO: 2818585 - RNA, 22 nt, Human
agcaucccaggaucgcaagagc

SEQ ID NO: 2818586 - RNA, 19 nt, Human
agcauccccaaaacaaagu

SEQ ID NO: 2818587 - RNA, 12 nt, Human
agcaucccccaa

SEQ ID NO: 2818588 - RNA, 16 nt, Human
agcaucccccaaaguu

SEQ ID NO: 2818589 - RNA, 20 nt, Human
agcaucccccaaaguucaca

SEQ ID NO: 2818590 - RNA, 13 nt, Human
agcauccugagcc

SEQ ID NO: 2818591 - RNA, 16 nt, Human
agcauccugagccccg

SEQ ID NO: 2818592 - RNA, 17 nt, Human
agcauccugagccccgc

SEQ ID NO: 2818593 - RNA, 19 nt, Human
agcauccugagccccgccc

SEQ ID NO: 2818594 - RNA, 23 nt, Human
agcauccugagccccgcccucuu

SEQ ID NO: 2818595 - RNA, 21 nt, Human
agcaucccuugaccaggccug

SEQ ID NO: 2818596 - RNA, 22 nt, Human
agcaucccuugaccaggccugg

SEQ ID NO: 2818597 - RNA, 23 nt, Human
agcaucccuugaccaggccuggg

SEQ ID NO: 2818598 - RNA, 15 nt, Human
agcauccuaagaaau

SEQ ID NO: 2818599 - RNA, 16 nt, Human
agcauccuaagaaaua

SEQ ID NO: 2818600 - RNA, 17 nt, Human
agcauccuaagaaauau

SEQ ID NO: 2818601 - RNA, 19 nt, Human
agcauccuaagaaauaugu

SEQ ID NO: 2818602 - RNA, 21 nt, Human
agcauccuaagaaauauguga

SEQ ID NO: 2818603 - RNA, 22 nt, Human
agcauccuaagaaauaugugag

SEQ ID NO: 2818604 - RNA, 23 nt, Human
agcauccuaagaaauaugugaga

SEQ ID NO: 2818605 - RNA, 13 nt, Human
agcaucaccucag

SEQ ID NO: 2818606 - RNA, 14 nt, Human
ugaucacagcagcu

SEQ ID NO: 2818607 - RNA, 14 nt, Human
ugaucacgccuggc

SEQ ID NO: 2818608 - RNA, 15 nt, Human
ugaucacgccuggcu

SEQ ID NO: 2818609 - RNA, 16 nt, Human
ugaucacgccuggcua

SEQ ID NO: 2818610 - RNA, 19 nt, Human
agcaucaccucaggccagg

SEQ ID NO: 2818611 - RNA, 16 nt, Human
agcaucaccucaggcc

SEQ ID NO: 2818612 - RNA, 15 nt, Human
agcaucaccucaggc

SEQ ID NO: 2818613 - RNA, 14 nt, Human
agcaucaccucagg

SEQ ID NO: 2818614 - RNA, 13 nt, Human
agcaucaccugcc

SEQ ID NO: 2818615 - RNA, 15 nt, Human
agcaucaccugccug

SEQ ID NO: 2818616 - RNA, 12 nt, Human
agcaucacuccc

SEQ ID NO: 2818617 - RNA, 20 nt, Human
agcaucacuccccaaggaag

SEQ ID NO: 2818618 - RNA, 22 nt, Human
agcaucacuccccaaggaagag

SEQ ID NO: 2818619 - RNA, 20 nt, Human
agcaucaccucaggccaggu

SEQ ID NO: 2818620 - RNA, 17 nt, Human
agcaucagggggaagaa

SEQ ID NO: 2818621 - RNA, 18 nt, Human
agcaucagggggaagaag

SEQ ID NO: 2818622 - RNA, 20 nt, Human
agcaucagggggaagaagca

SEQ ID NO: 2818623 - RNA, 13 nt, Human
ugauaauuuugcu

SEQ ID NO: 2818624 - RNA, 14 nt, Human
agcaucauccugca

SEQ ID NO: 2818625 - RNA, 15 nt, Human
agcauugaaauuaua

SEQ ID NO: 2818626 - RNA, 16 nt, Human
agcauugaaauuauag

SEQ ID NO: 2818627 - RNA, 22 nt, Human
agcauucucacuccuaccuggu

SEQ ID NO: 2818628 - RNA, 19 nt, Human
agcauucucaggcaccagu

SEQ ID NO: 2818629 - RNA, 13 nt, Human
agcauucucccca

SEQ ID NO: 2818630 - RNA, 17 nt, Human
agcauucuccccagugu

SEQ ID NO: 2818631 - RNA, 14 nt, Human
agcauucuggcagu

SEQ ID NO: 2818632 - RNA, 17 nt, Human
agcauucuggcaguuuu

SEQ ID NO: 2818633 - RNA, 15 nt, Human
agcauuccuucuuug

SEQ ID NO: 2818634 - RNA, 16 nt, Human
agcauuccuucuuuga

SEQ ID NO: 2818635 - RNA, 17 nt, Human
agcauuccuucuuugau

SEQ ID NO: 2818636 - RNA, 18 nt, Human
agcauuccuucuuugaua

SEQ ID NO: 2818637 - RNA, 14 nt, Human
agcauucccuccca

SEQ ID NO: 2818638 - RNA, 18 nt, Human
agcauucucacuccuacc

SEQ ID NO: 2818639 - RNA, 20 nt, Human
agcauucucacuccuaccug

SEQ ID NO: 2818640 - RNA, 24 nt, Human
agcauuccuucuuugauaauguua

SEQ ID NO: 2818641 - RNA, 19 nt, Human
agcauuccuucuuugauaa

SEQ ID NO: 2818642 - RNA, 21 nt, Human
agcauuccuucuuugauaaug

SEQ ID NO: 2818643 - RNA, 22 nt, Human
agcauuccuucuuugauaaugu

SEQ ID NO: 2818644 - RNA, 23 nt, Human
agcauuccuucuuugauaauguu

SEQ ID NO: 2818645 - RNA, 14 nt, Human
agcaugggccuggc

SEQ ID NO: 2818646 - RNA, 21 nt, Human
agcauguaauguuaauguuau

SEQ ID NO: 2818647 - RNA, 19 nt, Human
agcaugggccuggccaccu

SEQ ID NO: 2818648 - RNA, 16 nt, Human
agcauggucccugccu

SEQ ID NO: 2818649 - RNA, 17 nt, Human
agcauggucccugccuu

SEQ ID NO: 2818650 - RNA, 15 nt, Human
agcauuaugcaauua

SEQ ID NO: 2818651 - RNA, 16 nt, Human
agcauuaugcaauuag

SEQ ID NO: 2818652 - RNA, 17 nt, Human
agcauuagauuucucau

SEQ ID NO: 2818653 - RNA, 14 nt, Human
agcauucagagagc

SEQ ID NO: 2818654 - RNA, 15 nt, Human
agcauucagagagca

SEQ ID NO: 2818655 - RNA, 16 nt, Human
agcauucagagagcag

SEQ ID NO: 2818656 - RNA, 17 nt, Human
agcauucagagagcagc

SEQ ID NO: 2818657 - RNA, 16 nt, Human
agcauuuuuauuucag

SEQ ID NO: 2818658 - RNA, 17 nt, Human
agcauuuuuauuucaga

SEQ ID NO: 2818659 - RNA, 18 nt, Human
agccaaacauccuacaag

SEQ ID NO: 2818660 - RNA, 15 nt, Human
agccaaacccugucu

SEQ ID NO: 2818661 - RNA, 14 nt, Human
agccaaacccuguc

SEQ ID NO: 2818662 - RNA, 19 nt, Human
agccaaacccaugaggcaa

SEQ ID NO: 2818663 - RNA, 18 nt, Human
agccaaacccaugaggca

SEQ ID NO: 2818664 - RNA, 16 nt, Human
agcauuuuugauuuau

SEQ ID NO: 2818665 - RNA, 18 nt, Human
agcauuuuugauuuaugc

SEQ ID NO: 2818666 - RNA, 20 nt, Human
agcauuuuccagcacuuugc

SEQ ID NO: 2818667 - RNA, 23 nt, Human
agcauuuuagcaauuuauacaau

SEQ ID NO: 2818668 - RNA, 12 nt, Human
agcauuuaucau

SEQ ID NO: 2818669 - RNA, 15 nt, Human
agcauuuaucauucu

SEQ ID NO: 2818670 - RNA, 16 nt, Human
agcauuuaucauucuu

SEQ ID NO: 2818671 - RNA, 13 nt, Human
agcauuuguauuu

SEQ ID NO: 2818672 - RNA, 14 nt, Human
agcauuuguauuuu

SEQ ID NO: 2818673 - RNA, 23 nt, Human
agcauuuggaccaauagcccaca

SEQ ID NO: 2818674 - RNA, 14 nt, Human
agcauuugauaaug

SEQ ID NO: 2818675 - RNA, 15 nt, Human
agcauuugauaauga

SEQ ID NO: 2818676 - RNA, 16 nt, Human
agcauuugauaaugau

SEQ ID NO: 2818677 - RNA, 17 nt, Human
agcauuugauaaugaua

SEQ ID NO: 2818678 - RNA, 19 nt, Human
agcauuugauaaugauaaa

SEQ ID NO: 2818679 - RNA, 22 nt, Human
agcauuugauaaugauaaaaca

SEQ ID NO: 2818680 - RNA, 16 nt, Human
agccacggccaggcca

SEQ ID NO: 2818681 - RNA, 13 nt, Human
ugauuaagauuuu

SEQ ID NO: 2818682 - RNA, 17 nt, Human
ugauuaagauuuuacaa

SEQ ID NO: 2818683 - RNA, 12 nt, Human
ugauuaaggcag

SEQ ID NO: 2818684 - RNA, 13 nt, Human
ugauuaaggcagu

SEQ ID NO: 2818685 - RNA, 17 nt, Human
ugauuaaggcaguacaa

SEQ ID NO: 2818686 - RNA, 18 nt, Human
ugauuaaauaagauucua

SEQ ID NO: 2818687 - RNA, 19 nt, Human
ugauuaaauaagauucuaa

SEQ ID NO: 2818688 - RNA, 20 nt, Human
ugauuaaauaagauucuaac

SEQ ID NO: 2818689 - RNA, 22 nt, Human
ugauuaaauaagauucuaacgg

SEQ ID NO: 2818690 - RNA, 16 nt, Human
ugaugggcacuugaga

SEQ ID NO: 2818691 - RNA, 17 nt, Human
ugauuaaauaagauucu

SEQ ID NO: 2818692 - RNA, 24 nt, Human
ugauggggcaagggcacaaguccu

SEQ ID NO: 2818693 - RNA, 22 nt, Human
ugauggggcccuaauucagcca

SEQ ID NO: 2818694 - RNA, 15 nt, Human
ugauggucuggucua

SEQ ID NO: 2818695 - RNA, 16 nt, Human
ugauggucacuuaaaa

SEQ ID NO: 2818696 - RNA, 20 nt, Human
ugauggucacuuaaaaugug

SEQ ID NO: 2818697 - RNA, 23 nt, Human
ugauggucacuuaaaaugugcag

SEQ ID NO: 2818698 - RNA, 23 nt, Human
ugauggguuaguggauggaaggg

SEQ ID NO: 2818699 - RNA, 19 nt, Human
ugauggguuaguggaugga

SEQ ID NO: 2818700 - RNA, 20 nt, Human
ugaugaucuuugcagacagg

SEQ ID NO: 2818701 - RNA, 19 nt, Human
ugaugaucuuugcagacag

SEQ ID NO: 2818702 - RNA, 23 nt, Human
ugaugaaaugaggucagagccug

SEQ ID NO: 2818703 - RNA, 22 nt, Human
ugaugaaaugaggucagagccu

SEQ ID NO: 2818704 - RNA, 21 nt, Human
ugaugaucuuugcagacaggc

SEQ ID NO: 2818705 - RNA, 22 nt, Human
ugauggcacuuagcuaucagaa

SEQ ID NO: 2818706 - RNA, 20 nt, Human
ugauggcaggauggccuggc

SEQ ID NO: 2818707 - RNA, 22 nt, Human
ugauggcaccacugcacuccag

SEQ ID NO: 2818708 - RNA, 17 nt, Human
ugauggcaauuuuguaa

SEQ ID NO: 2818709 - RNA, 15 nt, Human
ugauggcaauuuugu

SEQ ID NO: 2818710 - RNA, 22 nt, Human
ugaugggcaacccccagccugc

SEQ ID NO: 2818711 - RNA, 21 nt, Human
ugaugggcaacccccagccug

SEQ ID NO: 2818712 - RNA, 15 nt, Human
ugauggcuucuccag

SEQ ID NO: 2818713 - RNA, 13 nt, Human
ugauggcuucucc

SEQ ID NO: 2818714 - RNA, 19 nt, Human
ugaucccaagugccagucu

SEQ ID NO: 2818715 - RNA, 23 nt, Human
agccaccccgggcucucugcugu

SEQ ID NO: 2818716 - RNA, 21 nt, Human
agccaccccgggcucucugcu

SEQ ID NO: 2818717 - RNA, 20 nt, Human
agccaccccgggcucucugc

SEQ ID NO: 2818718 - RNA, 19 nt, Human
agccaccccgggcucucug

SEQ ID NO: 2818719 - RNA, 20 nt, Human
agccaccccagaaaugguga

SEQ ID NO: 2818720 - RNA, 14 nt, Human
agccaccccgggcu

SEQ ID NO: 2818721 - RNA, 18 nt, Human
agccaccccagaaauggu

SEQ ID NO: 2818722 - RNA, 14 nt, Human
ugauccacucgccu

SEQ ID NO: 2818723 - RNA, 18 nt, Human
ugauccacucgccuucau

SEQ ID NO: 2818724 - RNA, 18 nt, Human
ugauccucccaccucagc

SEQ ID NO: 2818725 - RNA, 20 nt, Human
ugauccuaacugaagagaca

SEQ ID NO: 2818726 - RNA, 20 nt, Human
ugauccccaaguggugaaug

SEQ ID NO: 2818727 - RNA, 18 nt, Human
ugauccccaagugugaac

SEQ ID NO: 2818728 - RNA, 13 nt, Human
ugaucccagcacu

SEQ ID NO: 2818729 - RNA, 12 nt, Human
ugaucccagcac

SEQ ID NO: 2818730 - RNA, 20 nt, Human
ugauccucccaccucagccu

SEQ ID NO: 2818731 - RNA, 19 nt, Human
ugauccucccaccucagcc

SEQ ID NO: 2818732 - RNA, 15 nt, Human
ugaucuacaugagga

SEQ ID NO: 2818733 - RNA, 17 nt, Human
agccaccacguccagcu

SEQ ID NO: 2818734 - RNA, 13 nt, Human
agccaccacgccc

SEQ ID NO: 2818735 - RNA, 20 nt, Human
agccacagugagggagaucc

SEQ ID NO: 2818736 - RNA, 22 nt, Human
agccacagugagggagauccca

SEQ ID NO: 2818737 - RNA, 17 nt, Human
agccaccacaccuggcu

SEQ ID NO: 2818738 - RNA, 21 nt, Human
agccacacucugggcuccaga

SEQ ID NO: 2818739 - RNA, 21 nt, Human
agccacacugugggacucuuc

SEQ ID NO: 2818740 - RNA, 15 nt, Human
agccacacccaggca

SEQ ID NO: 2818741 - RNA, 16 nt, Human
agccacagcagcauuu

SEQ ID NO: 2818742 - RNA, 18 nt, Human
agccacagcagcauuuuu

SEQ ID NO: 2818743 - RNA, 20 nt, Human
agccacagcagcauuuuuau

SEQ ID NO: 2818744 - RNA, 20 nt, Human
agccaaugucuccuccccuu

SEQ ID NO: 2818745 - RNA, 14 nt, Human
agccaauguuuucc

SEQ ID NO: 2818746 - RNA, 23 nt, Human
agccaaucccucaccuucugagu

SEQ ID NO: 2818747 - RNA, 16 nt, Human
agccaaugucuccucc

SEQ ID NO: 2818748 - RNA, 16 nt, Human
agccaaacccugucug

SEQ ID NO: 2818749 - RNA, 19 nt, Human
agccacaagaaauuugauu

SEQ ID NO: 2818750 - RNA, 15 nt, Human
agccacaagucuucc

SEQ ID NO: 2818751 - RNA, 16 nt, Human
agccacaagucuucca

SEQ ID NO: 2818752 - RNA, 18 nt, Human
agccacaagucuuccaga

SEQ ID NO: 2818753 - RNA, 19 nt, Human
agccacaaaauaaauguug

SEQ ID NO: 2818754 - RNA, 21 nt, Human
agcaggcguucagcucacugu

SEQ ID NO: 2818755 - RNA, 17 nt, Human
agcaggcgcugugcuau

SEQ ID NO: 2818756 - RNA, 21 nt, Human
agcaggcgcugugcuaucaug

SEQ ID NO: 2818757 - RNA, 21 nt, Human
agcaggcgguggggagagaug

SEQ ID NO: 2818758 - RNA, 14 nt, Human
agcaggcagcgcca

SEQ ID NO: 2818759 - RNA, 16 nt, Human
agcaggcagcgccaag

SEQ ID NO: 2818760 - RNA, 16 nt, Human
agcaggccaaggucug

SEQ ID NO: 2818761 - RNA, 17 nt, Human
agcaggccaaggucuga

SEQ ID NO: 2818762 - RNA, 18 nt, Human
agcaggccaaggucugag

SEQ ID NO: 2818763 - RNA, 22 nt, Human
agcaggccaaggucugagccac

SEQ ID NO: 2818764 - RNA, 20 nt, Human
agcaggcacuugauuccuug

SEQ ID NO: 2818765 - RNA, 21 nt, Human
agcaggauuuuuuuguagaga

SEQ ID NO: 2818766 - RNA, 13 nt, Human
agcaggaguggug

SEQ ID NO: 2818767 - RNA, 18 nt, Human
agcaggaguggugcagac

SEQ ID NO: 2818768 - RNA, 20 nt, Human
agcaggaguggugcagacag

SEQ ID NO: 2818769 - RNA, 21 nt, Human
agcaggaguggugcagacaga

SEQ ID NO: 2818770 - RNA, 15 nt, Human
agcaggaggccaggc

SEQ ID NO: 2818771 - RNA, 14 nt, Human
agcaggaggccagg

SEQ ID NO: 2818772 - RNA, 20 nt, Human
agcaggagauugagaaggag

SEQ ID NO: 2818773 - RNA, 21 nt, Human
agcaggagauugagaaggaga

SEQ ID NO: 2818774 - RNA, 23 nt, Human
agcaggagauugagaaggagaga

SEQ ID NO: 2818775 - RNA, 14 nt, Human
agcaggaaggccug

SEQ ID NO: 2818776 - RNA, 16 nt, Human
agcaggaaggccuggg

SEQ ID NO: 2818777 - RNA, 17 nt, Human
agcaggaaggccugggu

SEQ ID NO: 2818778 - RNA, 13 nt, Human
agcaggaccucug

SEQ ID NO: 2818779 - RNA, 14 nt, Human
agcaggaccucccu

SEQ ID NO: 2818780 - RNA, 16 nt, Human
agcaggaccucccuuc

SEQ ID NO: 2818781 - RNA, 17 nt, Human
agcaggaccucccuucc

SEQ ID NO: 2818782 - RNA, 18 nt, Human
agcaggaccucccuuccg

SEQ ID NO: 2818783 - RNA, 22 nt, Human
agcaggaccucccuuccgaccc

SEQ ID NO: 2818784 - RNA, 22 nt, Human
agcaggaccucugaaacccugg

SEQ ID NO: 2818785 - RNA, 12 nt, Human
agcaggagacga

SEQ ID NO: 2818786 - RNA, 22 nt, Human
agcaggagacgacaggcgagag

SEQ ID NO: 2818787 - RNA, 15 nt, Human
agcaggagagaaauu

SEQ ID NO: 2818788 - RNA, 15 nt, Human
agcaggagauugaga

SEQ ID NO: 2818789 - RNA, 18 nt, Human
agcaggagauugagaagg

SEQ ID NO: 2818790 - RNA, 19 nt, Human
agcaggagauugagaagga

SEQ ID NO: 2818791 - RNA, 22 nt, Human
agcaggaagcauucagagagca

SEQ ID NO: 2818792 - RNA, 20 nt, Human
agcagccaagggaugaaaga

SEQ ID NO: 2818793 - RNA, 16 nt, Human
agcagcagcaggugau

SEQ ID NO: 2818794 - RNA, 13 nt, Human
agcagcagcaggu

SEQ ID NO: 2818795 - RNA, 12 nt, Human
agcagcagcagg

SEQ ID NO: 2818796 - RNA, 13 nt, Human
agcagcaggugau

SEQ ID NO: 2818797 - RNA, 12 nt, Human
agcagcagguga

SEQ ID NO: 2818798 - RNA, 14 nt, Human
agcagcaucuucug

SEQ ID NO: 2818799 - RNA, 15 nt, Human
agcagcaucuucugg

SEQ ID NO: 2818800 - RNA, 13 nt, Human
agcagcauuuuua

SEQ ID NO: 2818801 - RNA, 14 nt, Human
agcagcauuuuuau

SEQ ID NO: 2818802 - RNA, 20 nt, Human
agcagcauuuuuauuucaga

SEQ ID NO: 2818803 - RNA, 17 nt, Human
ugacccacugguuccuu

SEQ ID NO: 2818804 - RNA, 22 nt, Human
ugacccacugguuccuucuucc

SEQ ID NO: 2818805 - RNA, 17 nt, Human
ugacccacuucucauca

SEQ ID NO: 2818806 - RNA, 18 nt, Human
ugacccacuucucaucac

SEQ ID NO: 2818807 - RNA, 19 nt, Human
ugacccacuucucaucaca

SEQ ID NO: 2818808 - RNA, 22 nt, Human
ugacccacuucucaucacacac

SEQ ID NO: 2818809 - RNA, 23 nt, Human
ugacccacuucucaucacacaca

SEQ ID NO: 2818810 - RNA, 17 nt, Human
agcagggaaggccugac

SEQ ID NO: 2818811 - RNA, 16 nt, Human
agcagggaauuucuau

SEQ ID NO: 2818812 - RNA, 16 nt, Human
agcagggaaggccuga

SEQ ID NO: 2818813 - RNA, 12 nt, Human
agcagggaaggc

SEQ ID NO: 2818814 - RNA, 15 nt, Human
agcagggaaggccug

SEQ ID NO: 2818815 - RNA, 14 nt, Human
agcagggaaggccu

SEQ ID NO: 2818816 - RNA, 15 nt, Human
agcagggcucagcgg

SEQ ID NO: 2818817 - RNA, 14 nt, Human
agcagggcucagcg

SEQ ID NO: 2818818 - RNA, 13 nt, Human
agcagggcucagc

SEQ ID NO: 2818819 - RNA, 22 nt, Human
agcagggcucagcggggacagc

SEQ ID NO: 2818820 - RNA, 18 nt, Human
agcagggucgggaaaggc

SEQ ID NO: 2818821 - RNA, 16 nt, Human
agcaggggcuacaaga

SEQ ID NO: 2818822 - RNA, 19 nt, Human
agcaggggcuacaagaggg

SEQ ID NO: 2818823 - RNA, 20 nt, Human
agcaggggcuacaagaggga

SEQ ID NO: 2818824 - RNA, 21 nt, Human
agcaggggcuacaagagggaa

SEQ ID NO: 2818825 - RNA, 16 nt, Human
agcagggucugggcag

SEQ ID NO: 2818826 - RNA, 17 nt, Human
agcagggucugggcagg

SEQ ID NO: 2818827 - RNA, 22 nt, Human
agcaggugauuggaccaggcca

SEQ ID NO: 2818828 - RNA, 20 nt, Human
agcaggugauuggaccaggc

SEQ ID NO: 2818829 - RNA, 19 nt, Human
agcaggugauuggaccagg

SEQ ID NO: 2818830 - RNA, 17 nt, Human
agcaggguguugggaua

SEQ ID NO: 2818831 - RNA, 23 nt, Human
agcaggugauuggaccaggccau

SEQ ID NO: 2818832 - RNA, 16 nt, Human
agcaggcuacacugac

SEQ ID NO: 2818833 - RNA, 22 nt, Human
agcaggcuacacugacacuggu

SEQ ID NO: 2818834 - RNA, 15 nt, Human
agcagggaaacagcu

SEQ ID NO: 2818835 - RNA, 14 nt, Human
agcagggaaacagc

SEQ ID NO: 2818836 - RNA, 13 nt, Human
agcagggaaacag

SEQ ID NO: 2818837 - RNA, 15 nt, Human
agcaggcugugaguu

SEQ ID NO: 2818838 - RNA, 14 nt, Human
agcauagauguuuu

SEQ ID NO: 2818839 - RNA, 16 nt, Human
agcauagcuuauuauu

SEQ ID NO: 2818840 - RNA, 18 nt, Human
agcauagcuuauuauuga

SEQ ID NO: 2818841 - RNA, 20 nt, Human
agcauagcuuauuauugaag

SEQ ID NO: 2818842 - RNA, 22 nt, Human
agcauacaugcaaaaagaaaug

SEQ ID NO: 2818843 - RNA, 13 nt, Human
agcauaaaaacau

SEQ ID NO: 2818844 - RNA, 21 nt, Human
agcauaaaaacauuuuaaaaa

SEQ ID NO: 2818845 - RNA, 14 nt, Human
agcauauagagaug

SEQ ID NO: 2818846 - RNA, 17 nt, Human
ugaguacaaaugccuua

SEQ ID NO: 2818847 - RNA, 21 nt, Human
ugaguacaaaugccuuaaaau

SEQ ID NO: 2818848 - RNA, 23 nt, Human
ugaguacagaguguggacucugg

SEQ ID NO: 2818849 - RNA, 22 nt, Human
agcaguccugccucagccuccg

SEQ ID NO: 2818850 - RNA, 19 nt, Human
agcaguccugccucagccu

SEQ ID NO: 2818851 - RNA, 13 nt, Human
agcaguccaugca

SEQ ID NO: 2818852 - RNA, 15 nt, Human
agcaguccaugcaug

SEQ ID NO: 2818853 - RNA, 15 nt, Human
agcagucccugagac

SEQ ID NO: 2818854 - RNA, 14 nt, Human
agcaguuugcuuug

SEQ ID NO: 2818855 - RNA, 19 nt, Human
agcaguuucuguccugcug

SEQ ID NO: 2818856 - RNA, 20 nt, Human
agcaguuucuguccugcugg

SEQ ID NO: 2818857 - RNA, 18 nt, Human
agcaguuucuguccugcu

SEQ ID NO: 2818858 - RNA, 21 nt, Human
agcaguagaaauaauaugcau

SEQ ID NO: 2818859 - RNA, 14 nt, Human
agcaguacaauaaa

SEQ ID NO: 2818860 - RNA, 15 nt, Human
agcaguacaauaaaa

SEQ ID NO: 2818861 - RNA, 11 nt, Human
agcaguacaug

SEQ ID NO: 2818862 - RNA, 15 nt, Human
agcaguacaugggaa

SEQ ID NO: 2818863 - RNA, 17 nt, Human
agcaguaccagcgcucu

SEQ ID NO: 2818864 - RNA, 22 nt, Human
agcaguagaaauaauaugcauu

SEQ ID NO: 2818865 - RNA, 13 nt, Human
agcaguagacauu

SEQ ID NO: 2818866 - RNA, 14 nt, Human
agcaguagacauuu

SEQ ID NO: 2818867 - RNA, 17 nt, Human
agcaguagacauuuuaa

SEQ ID NO: 2818868 - RNA, 18 nt, Human
agcaguagacauuuuaac

SEQ ID NO: 2818869 - RNA, 20 nt, Human
agcaguagacauuuuaacaa

SEQ ID NO: 2818870 - RNA, 22 nt, Human
agcaguagacauuuuaacaaga

SEQ ID NO: 2818871 - RNA, 23 nt, Human
agcaguagacauuuuaacaagaa

SEQ ID NO: 2818872 - RNA, 17 nt, Human
agcaguaaauuugcuag

SEQ ID NO: 2818873 - RNA, 19 nt, Human
agcaguaaauuugcuagca

SEQ ID NO: 2818874 - RNA, 20 nt, Human
agcaguaaauuugcuagcag

SEQ ID NO: 2818875 - RNA, 17 nt, Human
agcagguuuuucuccuc

SEQ ID NO: 2818876 - RNA, 21 nt, Human
agcaguaaaagaugaaguuuu

SEQ ID NO: 2818877 - RNA, 22 nt, Human
agcagguugaggggcuccugga

SEQ ID NO: 2818878 - RNA, 21 nt, Human
agcagguugaggggcuccugg

SEQ ID NO: 2818879 - RNA, 20 nt, Human
agcagguugaggggcuccug

SEQ ID NO: 2818880 - RNA, 13 nt, Human
agcagguuagaga

SEQ ID NO: 2818881 - RNA, 14 nt, Human
agcagguuagagaa

SEQ ID NO: 2818882 - RNA, 15 nt, Human
ugagugugugugugc

SEQ ID NO: 2818883 - RNA, 16 nt, Human
ugagugugugugugca

SEQ ID NO: 2818884 - RNA, 18 nt, Human
ugagugugugugugcaug

SEQ ID NO: 2818885 - RNA, 18 nt, Human
ugaguguuuaauaaaguu

SEQ ID NO: 2818886 - RNA, 14 nt, Human
ugaguguuucuaug

SEQ ID NO: 2818887 - RNA, 15 nt, Human
ugaguguuucuauga

SEQ ID NO: 2818888 - RNA, 14 nt, Human
ugaguguuuggggg

SEQ ID NO: 2818889 - RNA, 15 nt, Human
ugagugugcugcugu

SEQ ID NO: 2818890 - RNA, 23 nt, Human
ugagugugcugcuguaagaaauc

SEQ ID NO: 2818891 - RNA, 12 nt, Human
ugagugugacag

SEQ ID NO: 2818892 - RNA, 13 nt, Human
ugagugugacagg

SEQ ID NO: 2818893 - RNA, 15 nt, Human
ugagugugacagggc

SEQ ID NO: 2818894 - RNA, 16 nt, Human
ugagugugacagggcc

SEQ ID NO: 2818895 - RNA, 17 nt, Human
ugagugugacagggcca

SEQ ID NO: 2818896 - RNA, 18 nt, Human
ugaguucauacccuguua

SEQ ID NO: 2818897 - RNA, 15 nt, Human
ugaguuacugugcau

SEQ ID NO: 2818898 - RNA, 16 nt, Human
ugaguuacugugcauu

SEQ ID NO: 2818899 - RNA, 17 nt, Human
ugaguuacugugcauug

SEQ ID NO: 2818900 - RNA, 16 nt, Human
ugagugugcauggagg

SEQ ID NO: 2818901 - RNA, 21 nt, Human
ugaguucgaggacuacaacca

SEQ ID NO: 2818902 - RNA, 16 nt, Human
ugauaaguaaaugcua

SEQ ID NO: 2818903 - RNA, 20 nt, Human
ugaguucuacauaaguaauu

SEQ ID NO: 2818904 - RNA, 15 nt, Human
ugaguucuacauaag

SEQ ID NO: 2818905 - RNA, 14 nt, Human
ugauaauagauucu

SEQ ID NO: 2818906 - RNA, 15 nt, Human
ugauaauagauucuc

SEQ ID NO: 2818907 - RNA, 19 nt, Human
ugauaaguuccuuuccuuu

SEQ ID NO: 2818908 - RNA, 23 nt, Human
ugauaaguuccuuuccuuuucuu

SEQ ID NO: 2818909 - RNA, 13 nt, Human
ugauaauaaauug

SEQ ID NO: 2818910 - RNA, 14 nt, Human
ugauaauaaauuga

SEQ ID NO: 2818911 - RNA, 15 nt, Human
ugauaauaaauugaa

SEQ ID NO: 2818912 - RNA, 18 nt, Human
ugauaauaaauugaaauu

SEQ ID NO: 2818913 - RNA, 23 nt, Human
ugauaauaaauugaaauugugaa

SEQ ID NO: 2818914 - RNA, 16 nt, Human
ugauaauaauauuguu

SEQ ID NO: 2818915 - RNA, 17 nt, Human
ugauaauaauauuguuu

SEQ ID NO: 2818916 - RNA, 18 nt, Human
ugauaauaauauuguuuu

SEQ ID NO: 2818917 - RNA, 12 nt, Human
ugagugccuggc

SEQ ID NO: 2818918 - RNA, 14 nt, Human
ugagugccuggcca

SEQ ID NO: 2818919 - RNA, 12 nt, Human
ugagugggagaa

SEQ ID NO: 2818920 - RNA, 15 nt, Human
ugagugggagaaggc

SEQ ID NO: 2818921 - RNA, 17 nt, Human
ugagugggagaaggcag

SEQ ID NO: 2818922 - RNA, 14 nt, Human
ugaguggccaggga

SEQ ID NO: 2818923 - RNA, 15 nt, Human
ugaguggccagggaa

SEQ ID NO: 2818924 - RNA, 17 nt, Human
ugaguggccagggaauc

SEQ ID NO: 2818925 - RNA, 18 nt, Human
ugagucaccaagcccagu

SEQ ID NO: 2818926 - RNA, 22 nt, Human
ugagucacccuaccugugccug

SEQ ID NO: 2818927 - RNA, 16 nt, Human
ugagucacccaugaag

SEQ ID NO: 2818928 - RNA, 20 nt, Human
ugagucacccuaccugugcc

SEQ ID NO: 2818929 - RNA, 15 nt, Human
ugagucagggcccag

SEQ ID NO: 2818930 - RNA, 16 nt, Human
ugagucagggcccaga

SEQ ID NO: 2818931 - RNA, 17 nt, Human
ugagucagggcccagag

SEQ ID NO: 2818932 - RNA, 18 nt, Human
ugagucagggcccagagg

SEQ ID NO: 2818933 - RNA, 22 nt, Human
ugagucagggcccagaggcuga

SEQ ID NO: 2818934 - RNA, 13 nt, Human
ugagucauuuaaa

SEQ ID NO: 2818935 - RNA, 16 nt, Human
ugagucauuuaaaugu

SEQ ID NO: 2818936 - RNA, 23 nt, Human
ugagucauuuaaauguguacaau

SEQ ID NO: 2818937 - RNA, 14 nt, Human
ugagugagccuggc

SEQ ID NO: 2818938 - RNA, 16 nt, Human
ugagugagccuggcuc

SEQ ID NO: 2818939 - RNA, 20 nt, Human
ugagugaugcggcagauuga

SEQ ID NO: 2818940 - RNA, 17 nt, Human
ugagugagccuggcucu

SEQ ID NO: 2818941 - RNA, 19 nt, Human
ugagugagccuggcucuug

SEQ ID NO: 2818942 - RNA, 13 nt, Human
ugccagugugcug

SEQ ID NO: 2818943 - RNA, 19 nt, Human
ugccagugugcugaugggc

SEQ ID NO: 2818944 - RNA, 19 nt, Human
ugccagcuacuuccuccuc

SEQ ID NO: 2818945 - RNA, 17 nt, Human
ugccagcucagucccau

SEQ ID NO: 2818946 - RNA, 23 nt, Human
ugccagccuggcuucuggagccc

SEQ ID NO: 2818947 - RNA, 22 nt, Human
ugccagccuggcuucuggagcc

SEQ ID NO: 2818948 - RNA, 21 nt, Human
ugccagccuggcuucuggagc

SEQ ID NO: 2818949 - RNA, 20 nt, Human
ugccagccuggcuucuggag

SEQ ID NO: 2818950 - RNA, 18 nt, Human
ugccagccuggcuucugg

SEQ ID NO: 2818951 - RNA, 17 nt, Human
ugccagccuggcuucug

SEQ ID NO: 2818952 - RNA, 16 nt, Human
ugccagccuggcuucu

SEQ ID NO: 2818953 - RNA, 22 nt, Human
ugccacagcuggagcucucaaa

SEQ ID NO: 2818954 - RNA, 17 nt, Human
ugccagccccacacagc

SEQ ID NO: 2818955 - RNA, 18 nt, Human
ugccagccccacacagcu

SEQ ID NO: 2818956 - RNA, 15 nt, Human
ugccagccuggcuuc

SEQ ID NO: 2818957 - RNA, 12 nt, Human
ugccagccuggc

SEQ ID NO: 2818958 - RNA, 22 nt, Human
ugccagccugaggcagccacuu

SEQ ID NO: 2818959 - RNA, 14 nt, Human
ugccaagcacugug

SEQ ID NO: 2818960 - RNA, 15 nt, Human
ugccaagcacugugc

SEQ ID NO: 2818961 - RNA, 17 nt, Human
ugccaagcacugugcuc

SEQ ID NO: 2818962 - RNA, 19 nt, Human
ugcauuguuagcacuaggc

SEQ ID NO: 2818963 - RNA, 13 nt, Human
ugcauuguuucug

SEQ ID NO: 2818964 - RNA, 14 nt, Human
ugcauuguuucugu

SEQ ID NO: 2818965 - RNA, 18 nt, Human
ugcauuguuucugugggc

SEQ ID NO: 2818966 - RNA, 18 nt, Human
ugcauugggauuuuagaa

SEQ ID NO: 2818967 - RNA, 15 nt, Human
ugccacagagcgggg

SEQ ID NO: 2818968 - RNA, 14 nt, Human
ugccacagagcggg

SEQ ID NO: 2818969 - RNA, 16 nt, Human
ugccacagagcgggga

SEQ ID NO: 2818970 - RNA, 17 nt, Human
ugccacagaguguagcc

SEQ ID NO: 2818971 - RNA, 18 nt, Human
ugccacagaguguagcca

SEQ ID NO: 2818972 - RNA, 22 nt, Human
ugccacagaguguagccagguc

SEQ ID NO: 2818973 - RNA, 18 nt, Human
ugccaagcucaggaccag

SEQ ID NO: 2818974 - RNA, 22 nt, Human
ugccaagcucaggaccaggcaa

SEQ ID NO: 2818975 - RNA, 14 nt, Human
ugccaagcucagga

SEQ ID NO: 2818976 - RNA, 15 nt, Human
ugccaagcucaggac

SEQ ID NO: 2818977 - RNA, 21 nt, Human
ugccaaggccagaguggccug

SEQ ID NO: 2818978 - RNA, 20 nt, Human
ugccaaggccagaguggccu

SEQ ID NO: 2818979 - RNA, 16 nt, Human
ugccaaggccagagug

SEQ ID NO: 2818980 - RNA, 19 nt, Human
ugccaauauuaaaucugcu

SEQ ID NO: 2818981 - RNA, 16 nt, Human
ugccaaucucaacacc

SEQ ID NO: 2818982 - RNA, 22 nt, Human
ugccaaggccagaguggccugg

SEQ ID NO: 2818983 - RNA, 17 nt, Human
ugccaaggcugaugcag

SEQ ID NO: 2818984 - RNA, 21 nt, Human
ugccaauauuaaaucugcugg

SEQ ID NO: 2818985 - RNA, 16 nt, Human
ugcauggcuccagaaa

SEQ ID NO: 2818986 - RNA, 13 nt, Human
ugcauggagcagg

SEQ ID NO: 2818987 - RNA, 13 nt, Human
ugcauggaggccc

SEQ ID NO: 2818988 - RNA, 16 nt, Human
ugcauggaggcccucc

SEQ ID NO: 2818989 - RNA, 18 nt, Human
ugcauggaggcccuccug

SEQ ID NO: 2818990 - RNA, 11 nt, Human
agccugaggcu

SEQ ID NO: 2818991 - RNA, 18 nt, Human
ugcauggcuccagaaaug

SEQ ID NO: 2818992 - RNA, 19 nt, Human
ugcauggcuccagaaaugu

SEQ ID NO: 2818993 - RNA, 17 nt, Human
agccugaggcugagacu

SEQ ID NO: 2818994 - RNA, 16 nt, Human
agccugaggcagccac

SEQ ID NO: 2818995 - RNA, 21 nt, Human
agccugaggcagccacuucgg

SEQ ID NO: 2818996 - RNA, 17 nt, Human
agccugagucagggccc

SEQ ID NO: 2818997 - RNA, 18 nt, Human
agccugagucagggccca

SEQ ID NO: 2818998 - RNA, 19 nt, Human
agccugagucagggcccag

SEQ ID NO: 2818999 - RNA, 20 nt, Human
agccugagucagggcccaga

SEQ ID NO: 2819000 - RNA, 21 nt, Human
agccugagucagggcccagag

SEQ ID NO: 2819001 - RNA, 23 nt, Human
agccugaguccacgaccuaggca

SEQ ID NO: 2819002 - RNA, 22 nt, Human
ugcauagcagaugguuuccaca

SEQ ID NO: 2819003 - RNA, 21 nt, Human
agccugugcauguaugucuug

SEQ ID NO: 2819004 - RNA, 16 nt, Human
agccugugcaaaaaaa

SEQ ID NO: 2819005 - RNA, 20 nt, Human
agccugugcaaaaaaauuaa

SEQ ID NO: 2819006 - RNA, 21 nt, Human
agccugugcaaaaaaauuaaa

SEQ ID NO: 2819007 - RNA, 16 nt, Human
agccuguaagccugca

SEQ ID NO: 2819008 - RNA, 17 nt, Human
agccuguaagccugcaa

SEQ ID NO: 2819009 - RNA, 18 nt, Human
agccuguaagccugcaag

SEQ ID NO: 2819010 - RNA, 19 nt, Human
agccugucccauggacacu

SEQ ID NO: 2819011 - RNA, 16 nt, Human
agccugucauccuugg

SEQ ID NO: 2819012 - RNA, 21 nt, Human
agccugucauccuuggucuuu

SEQ ID NO: 2819013 - RNA, 22 nt, Human
agccugucauccuuggucuuug

SEQ ID NO: 2819014 - RNA, 21 nt, Human
agccuugccuaaauuuaaugc

SEQ ID NO: 2819015 - RNA, 22 nt, Human
agccuugccuaaauuuaaugcu

SEQ ID NO: 2819016 - RNA, 23 nt, Human
agccuugccuaaauuuaaugcug

SEQ ID NO: 2819017 - RNA, 23 nt, Human
agccuugggaacaugcgugugac

SEQ ID NO: 2819018 - RNA, 16 nt, Human
agccuugggaccccug

SEQ ID NO: 2819019 - RNA, 14 nt, Human
agccuugaacucug

SEQ ID NO: 2819020 - RNA, 18 nt, Human
agccuugaacucugggcu

SEQ ID NO: 2819021 - RNA, 18 nt, Human
agccuucuuccaucccag

SEQ ID NO: 2819022 - RNA, 20 nt, Human
agccuucuuccaucccagga

SEQ ID NO: 2819023 - RNA, 22 nt, Human
agccuucuuccaucccaggaca

SEQ ID NO: 2819024 - RNA, 15 nt, Human
agccuucugaugucu

SEQ ID NO: 2819025 - RNA, 20 nt, Human
agccuuagaagucacacagu

SEQ ID NO: 2819026 - RNA, 18 nt, Human
agccuuaaucagguccuc

SEQ ID NO: 2819027 - RNA, 12 nt, Human
agccuuaauuuu

SEQ ID NO: 2819028 - RNA, 20 nt, Human
agccuuaauuuuuuuuucau

SEQ ID NO: 2819029 - RNA, 14 nt, Human
agccuuacauuugu

SEQ ID NO: 2819030 - RNA, 15 nt, Human
agccuuacauuugug

SEQ ID NO: 2819031 - RNA, 12 nt, Human
agccugugccuc

SEQ ID NO: 2819032 - RNA, 14 nt, Human
agccuguuucuucc

SEQ ID NO: 2819033 - RNA, 18 nt, Human
agccuguuucuuccuguu

SEQ ID NO: 2819034 - RNA, 23 nt, Human
agccuguuucuuccuguuaaugu

SEQ ID NO: 2819035 - RNA, 17 nt, Human
ugcauacugagccaagu

SEQ ID NO: 2819036 - RNA, 14 nt, Human
ugcauacuggacuc

SEQ ID NO: 2819037 - RNA, 19 nt, Human
ugcauacuggacucuucaa

SEQ ID NO: 2819038 - RNA, 20 nt, Human
ugcauacuggacucuucaaa

SEQ ID NO: 2819039 - RNA, 16 nt, Human
ugcauagaacugggua

SEQ ID NO: 2819040 - RNA, 17 nt, Human
ugcauagaacuggguaa

SEQ ID NO: 2819041 - RNA, 22 nt, Human
ugcauagaacuggguaaaugca

SEQ ID NO: 2819042 - RNA, 21 nt, Human
ugcagucagucaugauggcac

SEQ ID NO: 2819043 - RNA, 15 nt, Human
ugcagucaucagaag

SEQ ID NO: 2819044 - RNA, 16 nt, Human
ugcagucaucagaagu

SEQ ID NO: 2819045 - RNA, 21 nt, Human
ugcagucacguggaggagcag

SEQ ID NO: 2819046 - RNA, 19 nt, Human
ugcagucacguggaggagc

SEQ ID NO: 2819047 - RNA, 16 nt, Human
ugcaguaggggaggag

SEQ ID NO: 2819048 - RNA, 18 nt, Human
ugcaguaggggaggagca

SEQ ID NO: 2819049 - RNA, 16 nt, Human
ugcagguuggacccca

SEQ ID NO: 2819050 - RNA, 20 nt, Human
ugcagguuggaccccagaga

SEQ ID NO: 2819051 - RNA, 13 nt, Human
ugcaguauauuuc

SEQ ID NO: 2819052 - RNA, 14 nt, Human
ugcaguauauuucu

SEQ ID NO: 2819053 - RNA, 12 nt, Human
ugcaucuaagcc

SEQ ID NO: 2819054 - RNA, 15 nt, Human
ugcaucuaagcccau

SEQ ID NO: 2819055 - RNA, 16 nt, Human
ugcaucuaagcccaug

SEQ ID NO: 2819056 - RNA, 17 nt, Human
ugcaucuaagcccaugg

SEQ ID NO: 2819057 - RNA, 19 nt, Human
ugcauagagguaccagcaa

SEQ ID NO: 2819058 - RNA, 21 nt, Human
ugcaucucacuggaugcaaag

SEQ ID NO: 2819059 - RNA, 14 nt, Human
ugcaucucaaaauu

SEQ ID NO: 2819060 - RNA, 19 nt, Human
ugcaucucaaaauuauucu

SEQ ID NO: 2819061 - RNA, 13 nt, Human
ugcaucucagccc

SEQ ID NO: 2819062 - RNA, 14 nt, Human
ugcaucucagccca

SEQ ID NO: 2819063 - RNA, 18 nt, Human
ugcaucuuauagcacuuu

SEQ ID NO: 2819064 - RNA, 21 nt, Human
ugcaucuuauagcacuuugaa

SEQ ID NO: 2819065 - RNA, 16 nt, Human
ugcaugaagagaagca

SEQ ID NO: 2819066 - RNA, 18 nt, Human
ugcaugaagagaagcaau

SEQ ID NO: 2819067 - RNA, 20 nt, Human
ugcaugaagagaagcaauuu

SEQ ID NO: 2819068 - RNA, 21 nt, Human
ugcaugaagagaagcaauuuu

SEQ ID NO: 2819069 - RNA, 22 nt, Human
ugcaugaagagaagcaauuuug

SEQ ID NO: 2819070 - RNA, 23 nt, Human
ugcaugaagagaagcaauuuugg

SEQ ID NO: 2819071 - RNA, 15 nt, Human
ugcauggaaaccuga

SEQ ID NO: 2819072 - RNA, 19 nt, Human
ugcauggaaaccugaaaaa

SEQ ID NO: 2819073 - RNA, 14 nt, Human
ugcaugccuggucu

SEQ ID NO: 2819074 - RNA, 18 nt, Human
agccucuuucugucccuu

SEQ ID NO: 2819075 - RNA, 15 nt, Human
agccucuuucugucc

SEQ ID NO: 2819076 - RNA, 13 nt, Human
agccucuggguca

SEQ ID NO: 2819077 - RNA, 23 nt, Human
agccucugggucagugguccaca

SEQ ID NO: 2819078 - RNA, 22 nt, Human
agccucugggucagugguccac

SEQ ID NO: 2819079 - RNA, 23 nt, Human
agccucuuaaagcugccuguagu

SEQ ID NO: 2819080 - RNA, 14 nt, Human
agccucuucugcca

SEQ ID NO: 2819081 - RNA, 20 nt, Human
agccucuucugccaagagag

SEQ ID NO: 2819082 - RNA, 22 nt, Human
agccucuuaaagcugccuguag

SEQ ID NO: 2819083 - RNA, 20 nt, Human
agccucuuaaagcugccugu

SEQ ID NO: 2819084 - RNA, 15 nt, Human
ugcaggucuuuaaau

SEQ ID NO: 2819085 - RNA, 21 nt, Human
ugcaggucuuuaaaucauuuu

SEQ ID NO: 2819086 - RNA, 22 nt, Human
ugcaggucuuuaaaucauuuua

SEQ ID NO: 2819087 - RNA, 19 nt, Human
ugcaggugagcccauggcc

SEQ ID NO: 2819088 - RNA, 21 nt, Human
ugcaggugcuauuguuacucu

SEQ ID NO: 2819089 - RNA, 22 nt, Human
ugcaggugcuauuguuacucuu

SEQ ID NO: 2819090 - RNA, 23 nt, Human
ugcaggugagcccauggcccucc

SEQ ID NO: 2819091 - RNA, 23 nt, Human
ugcaggguucucccucccaccuu

SEQ ID NO: 2819092 - RNA, 13 nt, Human
ugcaggggcucug

SEQ ID NO: 2819093 - RNA, 22 nt, Human
ugcagggggugugucugcucag

SEQ ID NO: 2819094 - RNA, 13 nt, Human
ugcaggggugacg

SEQ ID NO: 2819095 - RNA, 14 nt, Human
ugcaggggugacgg

SEQ ID NO: 2819096 - RNA, 22 nt, Human
ugcaggggugacggcccucauc

SEQ ID NO: 2819097 - RNA, 19 nt, Human
ugcagggggugugucugcu

SEQ ID NO: 2819098 - RNA, 21 nt, Human
ugcaggggcucuggagagaaa

SEQ ID NO: 2819099 - RNA, 16 nt, Human
ugcagggggcuccugg

SEQ ID NO: 2819100 - RNA, 14 nt, Human
ugcaggggcucugg

SEQ ID NO: 2819101 - RNA, 18 nt, Human
ugcaggggcucuggagag

SEQ ID NO: 2819102 - RNA, 19 nt, Human
ugcaggggcucuggagaga

SEQ ID NO: 2819103 - RNA, 21 nt, Human
ugcagacaggcaagcaccucc

SEQ ID NO: 2819104 - RNA, 13 nt, Human
ugcagacaggcaa

SEQ ID NO: 2819105 - RNA, 12 nt, Human
ugcagacaggca

SEQ ID NO: 2819106 - RNA, 21 nt, Human
ugcagacacgccuuccccuca

SEQ ID NO: 2819107 - RNA, 19 nt, Human
ugcagacagaagucuccuc

SEQ ID NO: 2819108 - RNA, 21 nt, Human
ugcagacagaagucuccucaa

SEQ ID NO: 2819109 - RNA, 19 nt, Human
agccuccugaguagcugga

SEQ ID NO: 2819110 - RNA, 23 nt, Human
agccucuccaggcaccaucuccc

SEQ ID NO: 2819111 - RNA, 21 nt, Human
agccucguuggaagaggaaca

SEQ ID NO: 2819112 - RNA, 17 nt, Human
agccucguuuugaugcc

SEQ ID NO: 2819113 - RNA, 16 nt, Human
agccucguuggaagag

SEQ ID NO: 2819114 - RNA, 22 nt, Human
agccucuauccuacaaggccua

SEQ ID NO: 2819115 - RNA, 20 nt, Human
agccucgccgucugugaauu

SEQ ID NO: 2819116 - RNA, 13 nt, Human
agccucgcucugu

SEQ ID NO: 2819117 - RNA, 23 nt, Human
agccucgcucuguuacccagggu

SEQ ID NO: 2819118 - RNA, 16 nt, Human
agccucgaggugccuu

SEQ ID NO: 2819119 - RNA, 18 nt, Human
agccucgaggugccuucu

SEQ ID NO: 2819120 - RNA, 22 nt, Human
agccucgaggugccuucuucag

SEQ ID NO: 2819121 - RNA, 24 nt, Human
ugcaauaaaaaugauacugauggu

SEQ ID NO: 2819122 - RNA, 20 nt, Human
ugcaauaaaauuauuugcag

SEQ ID NO: 2819123 - RNA, 22 nt, Human
ugcaauaaaauuauuugcaggu

SEQ ID NO: 2819124 - RNA, 14 nt, Human
ugcaauauuugaau

SEQ ID NO: 2819125 - RNA, 13 nt, Human
ugcaauauuugua

SEQ ID NO: 2819126 - RNA, 14 nt, Human
ugcaauauuuguaa

SEQ ID NO: 2819127 - RNA, 20 nt, Human
ugcaauauuuguaaggcuug

SEQ ID NO: 2819128 - RNA, 13 nt, Human
ugcaaucauaugu

SEQ ID NO: 2819129 - RNA, 15 nt, Human
ugcaaucauauguga

SEQ ID NO: 2819130 - RNA, 16 nt, Human
ugcaaucauaugugau

SEQ ID NO: 2819131 - RNA, 17 nt, Human
ugcaaucauaugugauc

SEQ ID NO: 2819132 - RNA, 20 nt, Human
ugcaaucauaugugaucugu

SEQ ID NO: 2819133 - RNA, 22 nt, Human
ugcaaucauaugugaucugucu

SEQ ID NO: 2819134 - RNA, 23 nt, Human
ugcaaucauaugugaucugucuu

SEQ ID NO: 2819135 - RNA, 19 nt, Human
ugcaauccugucuuucuga

SEQ ID NO: 2819136 - RNA, 14 nt, Human
ugcaauaucugaag

SEQ ID NO: 2819137 - RNA, 15 nt, Human
ugcaauaucugaagc

SEQ ID NO: 2819138 - RNA, 14 nt, Human
ugcaauauuccuuu

SEQ ID NO: 2819139 - RNA, 16 nt, Human
ugcaaggucuuugguu

SEQ ID NO: 2819140 - RNA, 12 nt, Human
ugcaagguucca

SEQ ID NO: 2819141 - RNA, 13 nt, Human
ugcaagguuccac

SEQ ID NO: 2819142 - RNA, 14 nt, Human
ugcaagguuccaca

SEQ ID NO: 2819143 - RNA, 15 nt, Human
ugcaagguuccacag

SEQ ID NO: 2819144 - RNA, 17 nt, Human
ugcaagguuccacagag

SEQ ID NO: 2819145 - RNA, 18 nt, Human
ugcaagguuccacagagu

SEQ ID NO: 2819146 - RNA, 19 nt, Human
ugcaagguuccacagagua

SEQ ID NO: 2819147 - RNA, 13 nt, Human
ugcaaggcaaaga

SEQ ID NO: 2819148 - RNA, 17 nt, Human
ugcaaggaccaggacuc

SEQ ID NO: 2819149 - RNA, 11 nt, Human
ugcaaggcacu

SEQ ID NO: 2819150 - RNA, 12 nt, Human
ugcaaggcccac

SEQ ID NO: 2819151 - RNA, 13 nt, Human
ugcaaggcccaca

SEQ ID NO: 2819152 - RNA, 14 nt, Human
ugcaaggcccacag

SEQ ID NO: 2819153 - RNA, 16 nt, Human
ugcaaggcccacagga

SEQ ID NO: 2819154 - RNA, 17 nt, Human
ugcaaggcccacaggag

SEQ ID NO: 2819155 - RNA, 17 nt, Human
ugcaaggcacuguacua

SEQ ID NO: 2819156 - RNA, 19 nt, Human
ugcaagcaggacuuugagg

SEQ ID NO: 2819157 - RNA, 15 nt, Human
ugcaagagugauugc

SEQ ID NO: 2819158 - RNA, 17 nt, Human
ugcaagagugauugcag

SEQ ID NO: 2819159 - RNA, 19 nt, Human
ugcaagagugauugcagcu

SEQ ID NO: 2819160 - RNA, 20 nt, Human
ugcaagagugauugcagcuu

SEQ ID NO: 2819161 - RNA, 23 nt, Human
ugcaagccccugcuccagaagau

SEQ ID NO: 2819162 - RNA, 18 nt, Human
ugcaagccugucugagac

SEQ ID NO: 2819163 - RNA, 19 nt, Human
ugcaagccugucugagacu

SEQ ID NO: 2819164 - RNA, 20 nt, Human
ugcaagcuguccagagaaaa

SEQ ID NO: 2819165 - RNA, 12 nt, Human
ugcaaggaagga

SEQ ID NO: 2819166 - RNA, 16 nt, Human
ugcaaggaaggaaaga

SEQ ID NO: 2819167 - RNA, 15 nt, Human
ugcaaggaaggaaag

SEQ ID NO: 2819168 - RNA, 15 nt, Human
ugcaaggaccaggac

SEQ ID NO: 2819169 - RNA, 14 nt, Human
ugcaaggaccagga

SEQ ID NO: 2819170 - RNA, 13 nt, Human
ugcaaggaccagg

SEQ ID NO: 2819171 - RNA, 19 nt, Human
ugcaaggaaggaaagaaag

SEQ ID NO: 2819172 - RNA, 18 nt, Human
ugcaaggacauucuugua

SEQ ID NO: 2819173 - RNA, 13 nt, Human
ugcaacaggcugg

SEQ ID NO: 2819174 - RNA, 13 nt, Human
ugcaacagacaag

SEQ ID NO: 2819175 - RNA, 21 nt, Human
ugcaaagcucuguggccacau

SEQ ID NO: 2819176 - RNA, 14 nt, Human
ugcaaaucuugaaa

SEQ ID NO: 2819177 - RNA, 22 nt, Human
ugcaaaugucagauacaaugua

SEQ ID NO: 2819178 - RNA, 14 nt, Human
ugcaaauuaacagu

SEQ ID NO: 2819179 - RNA, 21 nt, Human
ugcaaaugcuaugagaugcau

SEQ ID NO: 2819180 - RNA, 13 nt, Human
ugcaaauauaaac

SEQ ID NO: 2819181 - RNA, 15 nt, Human
ugcaaauauaaacau

SEQ ID NO: 2819182 - RNA, 16 nt, Human
ugcaaauauaaacauc

SEQ ID NO: 2819183 - RNA, 17 nt, Human
ugcaaauauaaacaucu

SEQ ID NO: 2819184 - RNA, 16 nt, Human
ugcaaagaaaaucaga

SEQ ID NO: 2819185 - RNA, 12 nt, Human
ugcaaagaaaau

SEQ ID NO: 2819186 - RNA, 14 nt, Human
ugcaaaggcuggga

SEQ ID NO: 2819187 - RNA, 12 nt, Human
ugcaaaguauug

SEQ ID NO: 2819188 - RNA, 16 nt, Human
ugcaaaguauuguaaa

SEQ ID NO: 2819189 - RNA, 17 nt, Human
ugcaaaguauuguaaau

SEQ ID NO: 2819190 - RNA, 18 nt, Human
ugcaaaguauuguaaauu

SEQ ID NO: 2819191 - RNA, 20 nt, Human
ugcaaaguauuguaaauuau

SEQ ID NO: 2819192 - RNA, 23 nt, Human
ugcaaaguucccuacuuccugug

SEQ ID NO: 2819193 - RNA, 13 nt, Human
ugcaaaguucugu

SEQ ID NO: 2819194 - RNA, 14 nt, Human
ugcaaaguucugug

SEQ ID NO: 2819195 - RNA, 17 nt, Human
ugcaaaguucuguguuu

SEQ ID NO: 2819196 - RNA, 19 nt, Human
ugcaaaguucuguguuuaa

SEQ ID NO: 2819197 - RNA, 20 nt, Human
ugcaaaguucuguguuuaau

SEQ ID NO: 2819198 - RNA, 22 nt, Human
ugcaaagucaugcaaaggcugg

SEQ ID NO: 2819199 - RNA, 23 nt, Human
ugcaaagucaugcaaaggcuggg

SEQ ID NO: 2819200 - RNA, 21 nt, Human
ugcaaagucaugcaaaggcug

SEQ ID NO: 2819201 - RNA, 20 nt, Human
ugcaaagucaugcaaaggcu

SEQ ID NO: 2819202 - RNA, 21 nt, Human
ugcaaaggguaucaggugcug

SEQ ID NO: 2819203 - RNA, 12 nt, Human
ugcaaaggcugg

SEQ ID NO: 2819204 - RNA, 13 nt, Human
ugcaaaggcuggg

SEQ ID NO: 2819205 - RNA, 22 nt, Human
ugcaaaggucuuuuuaaaccag

SEQ ID NO: 2819206 - RNA, 15 nt, Human
ugcaaaguacaaugu

SEQ ID NO: 2819207 - RNA, 18 nt, Human
ugcaaaguacaauguguu

SEQ ID NO: 2819208 - RNA, 19 nt, Human
ugcaaaguacaauguguuu

SEQ ID NO: 2819209 - RNA, 23 nt, Human
ugcaaaguacaauguguuuuucu

SEQ ID NO: 2819210 - RNA, 17 nt, Human
ugcaaagcccagcuuga

SEQ ID NO: 2819211 - RNA, 15 nt, Human
ugcaaagcccagcuu

SEQ ID NO: 2819212 - RNA, 14 nt, Human
ugcaaagcccagcu

SEQ ID NO: 2819213 - RNA, 18 nt, Human
agccacggccaggccaga

SEQ ID NO: 2819214 - RNA, 17 nt, Human
agccacggccaggccag

SEQ ID NO: 2819215 - RNA, 22 nt, Human
ugauuuaugcauggaaaccuga

SEQ ID NO: 2819216 - RNA, 13 nt, Human
ugauuuaugcaug

SEQ ID NO: 2819217 - RNA, 20 nt, Human
ugauuuauaaaugccauuua

SEQ ID NO: 2819218 - RNA, 16 nt, Human
ugauuuauaguuugua

SEQ ID NO: 2819219 - RNA, 22 nt, Human
ugauuuauaguuuguacaugca

SEQ ID NO: 2819220 - RNA, 17 nt, Human
ugauuugcaauaaaaau

SEQ ID NO: 2819221 - RNA, 23 nt, Human
ugauuugcaaugggauguaugaa

SEQ ID NO: 2819222 - RNA, 15 nt, Human
ugauuugcauauuca

SEQ ID NO: 2819223 - RNA, 12 nt, Human
ugauuugcauug

SEQ ID NO: 2819224 - RNA, 14 nt, Human
ugauuugaguugau

SEQ ID NO: 2819225 - RNA, 22 nt, Human
ugauuugaguugauugagaaga

SEQ ID NO: 2819226 - RNA, 11 nt, Human
ugauuugcaau

SEQ ID NO: 2819227 - RNA, 16 nt, Human
ugauuuccaaguaaua

SEQ ID NO: 2819228 - RNA, 13 nt, Human
ugauuuccccucu

SEQ ID NO: 2819229 - RNA, 19 nt, Human
ugauuugaagaacauguga

SEQ ID NO: 2819230 - RNA, 14 nt, Human
ugauuucacuagaa

SEQ ID NO: 2819231 - RNA, 15 nt, Human
ugauuugcauugaac

SEQ ID NO: 2819232 - RNA, 12 nt, Human
ugauuuggaaaa

SEQ ID NO: 2819233 - RNA, 18 nt, Human
ugauuugcauugaacaca

SEQ ID NO: 2819234 - RNA, 14 nt, Human
ugauuugccacuga

SEQ ID NO: 2819235 - RNA, 21 nt, Human
ugauuugccacugauauucag

SEQ ID NO: 2819236 - RNA, 22 nt, Human
ugauuugccacugauauucaga

SEQ ID NO: 2819237 - RNA, 14 nt, Human
ugauuugcauugaa

SEQ ID NO: 2819238 - RNA, 13 nt, Human
ugauuugcauuga

SEQ ID NO: 2819239 - RNA, 18 nt, Human
ugcacuccagccugggcg

SEQ ID NO: 2819240 - RNA, 20 nt, Human
ugcacuccagccugggcaac

SEQ ID NO: 2819241 - RNA, 15 nt, Human
ugcagaagagggugu

SEQ ID NO: 2819242 - RNA, 20 nt, Human
ugcagaagaggguguguuug

SEQ ID NO: 2819243 - RNA, 20 nt, Human
ugcagaaguucuuaguguug

SEQ ID NO: 2819244 - RNA, 15 nt, Human
ugcacuccagccugg

SEQ ID NO: 2819245 - RNA, 16 nt, Human
ugcacuccagccuggg

SEQ ID NO: 2819246 - RNA, 13 nt, Human
ugcacuccagccu

SEQ ID NO: 2819247 - RNA, 12 nt, Human
ugcacuccagcc

SEQ ID NO: 2819248 - RNA, 17 nt, Human
ugcacuccagccugggc

SEQ ID NO: 2819249 - RNA, 14 nt, Human
ugcacuccagccug

SEQ ID NO: 2819250 - RNA, 14 nt, Human
ugcacucagcucuu

SEQ ID NO: 2819251 - RNA, 22 nt, Human
ugcacccuggggccuggaccug

SEQ ID NO: 2819252 - RNA, 13 nt, Human
ugcacccuucuuu

SEQ ID NO: 2819253 - RNA, 14 nt, Human
ugcacccuucuuuu

SEQ ID NO: 2819254 - RNA, 16 nt, Human
ugcacccuucuuuucu

SEQ ID NO: 2819255 - RNA, 17 nt, Human
ugcacccuucuuuucuc

SEQ ID NO: 2819256 - RNA, 18 nt, Human
ugcacccuucuuuucuca

SEQ ID NO: 2819257 - RNA, 23 nt, Human
ugcacccuucuuuucucaugugu

SEQ ID NO: 2819258 - RNA, 15 nt, Human
ugcacccuggggccu

SEQ ID NO: 2819259 - RNA, 14 nt, Human
ugcacauuuugauu

SEQ ID NO: 2819260 - RNA, 15 nt, Human
ugcacauuuugauuu

SEQ ID NO: 2819261 - RNA, 15 nt, Human
ugcacauucacuuag

SEQ ID NO: 2819262 - RNA, 23 nt, Human
ugcacauucacuuagcagaaccu

SEQ ID NO: 2819263 - RNA, 11 nt, Human
ugcacauuguu

SEQ ID NO: 2819264 - RNA, 12 nt, Human
ugcacauuguuc

SEQ ID NO: 2819265 - RNA, 17 nt, Human
ugcacauuguuguuuuu

SEQ ID NO: 2819266 - RNA, 13 nt, Human
ugcaccagcccuu

SEQ ID NO: 2819267 - RNA, 16 nt, Human
ugcacccaugguacca

SEQ ID NO: 2819268 - RNA, 22 nt, Human
ugcacccaugggcucugacaga

SEQ ID NO: 2819269 - RNA, 12 nt, Human
ugcaccagagca

SEQ ID NO: 2819270 - RNA, 21 nt, Human
ugcaccagagcaaccucucac

SEQ ID NO: 2819271 - RNA, 23 nt, Human
ugcaccagagcaaccucucacuc

SEQ ID NO: 2819272 - RNA, 23 nt, Human
ugcacaugucuuguacaugugua

SEQ ID NO: 2819273 - RNA, 12 nt, Human
agcccuggggcu

SEQ ID NO: 2819274 - RNA, 13 nt, Human
agcccuggggcug

SEQ ID NO: 2819275 - RNA, 14 nt, Human
agcccuggggcugg

SEQ ID NO: 2819276 - RNA, 15 nt, Human
agcccuggggcuggg

SEQ ID NO: 2819277 - RNA, 18 nt, Human
agcccuggggcugggccc

SEQ ID NO: 2819278 - RNA, 22 nt, Human
ugcacaugucuuguacaugugu

SEQ ID NO: 2819279 - RNA, 18 nt, Human
agccccuguggagacugg

SEQ ID NO: 2819280 - RNA, 23 nt, Human
agcccugauguguccucagggag

SEQ ID NO: 2819281 - RNA, 15 nt, Human
agcccccuggccucu

SEQ ID NO: 2819282 - RNA, 16 nt, Human
agcccccuggccucug

SEQ ID NO: 2819283 - RNA, 22 nt, Human
agcccaggccgggguggagcau

SEQ ID NO: 2819284 - RNA, 21 nt, Human
ugcaaugaaagguacuauauu

SEQ ID NO: 2819285 - RNA, 22 nt, Human
ugcaaugaaagguacuauauuu

SEQ ID NO: 2819286 - RNA, 17 nt, Human
agcccccuggccucugu

SEQ ID NO: 2819287 - RNA, 19 nt, Human
agcccccuggccucugugc

SEQ ID NO: 2819288 - RNA, 14 nt, Human
agccccgaggccuu

SEQ ID NO: 2819289 - RNA, 16 nt, Human
agccccgagcuguccc

SEQ ID NO: 2819290 - RNA, 16 nt, Human
agcccccuugacaccg

SEQ ID NO: 2819291 - RNA, 19 nt, Human
agccccgcagaccucccca

SEQ ID NO: 2819292 - RNA, 23 nt, Human
agccccgcagaccuccccagccc

SEQ ID NO: 2819293 - RNA, 14 nt, Human
agccccgcccucuu

SEQ ID NO: 2819294 - RNA, 15 nt, Human
agccccgcccucuuc

SEQ ID NO: 2819295 - RNA, 16 nt, Human
agccccgcccucuucc

SEQ ID NO: 2819296 - RNA, 17 nt, Human
agccccgcccucuuccu

SEQ ID NO: 2819297 - RNA, 18 nt, Human
agccccgcccucuuccug

SEQ ID NO: 2819298 - RNA, 19 nt, Human
agccccgcccucuuccuga

SEQ ID NO: 2819299 - RNA, 20 nt, Human
agccccgcccucuuccugac

SEQ ID NO: 2819300 - RNA, 22 nt, Human
agccccgcccucuuccugacga

SEQ ID NO: 2819301 - RNA, 18 nt, Human
agccccgcgccuccuucc

SEQ ID NO: 2819302 - RNA, 15 nt, Human
agccccgcgccuccu

SEQ ID NO: 2819303 - RNA, 14 nt, Human
agccccuguggaga

SEQ ID NO: 2819304 - RNA, 15 nt, Human
agccccuguggagac

SEQ ID NO: 2819305 - RNA, 14 nt, Human
agccccugguccug

SEQ ID NO: 2819306 - RNA, 13 nt, Human
agccccuggggcc

SEQ ID NO: 2819307 - RNA, 17 nt, Human
agccccuggggccuaga

SEQ ID NO: 2819308 - RNA, 22 nt, Human
agccccuggggccuagacucug

SEQ ID NO: 2819309 - RNA, 21 nt, Human
agccccggcccugggcucgga

SEQ ID NO: 2819310 - RNA, 22 nt, Human
agccccgcagaccuccccagcc

SEQ ID NO: 2819311 - RNA, 14 nt, Human
agccccggcccugg

SEQ ID NO: 2819312 - RNA, 16 nt, Human
agccccggcccugggc

SEQ ID NO: 2819313 - RNA, 18 nt, Human
agccccggcccugggcuc

SEQ ID NO: 2819314 - RNA, 13 nt, Human
agccccuccccca

SEQ ID NO: 2819315 - RNA, 18 nt, Human
agccccucccccaucucc

SEQ ID NO: 2819316 - RNA, 20 nt, Human
agccccucccccaucuccca

SEQ ID NO: 2819317 - RNA, 21 nt, Human
agccccucccccaucucccac

SEQ ID NO: 2819318 - RNA, 14 nt, Human
aggacgccacccag

SEQ ID NO: 2819319 - RNA, 20 nt, Human
aggacgaacauccaaccuuc

SEQ ID NO: 2819320 - RNA, 14 nt, Human
aggaccuugggcca

SEQ ID NO: 2819321 - RNA, 15 nt, Human
aggaccuugggccaa

SEQ ID NO: 2819322 - RNA, 23 nt, Human
aggacacagaugaaacacaaaca

SEQ ID NO: 2819323 - RNA, 15 nt, Human
aggacgccacccagc

SEQ ID NO: 2819324 - RNA, 16 nt, Human
aggacggugcaaccca

SEQ ID NO: 2819325 - RNA, 15 nt, Human
aggacuaggguccug

SEQ ID NO: 2819326 - RNA, 18 nt, Human
aggacuaggguccugggg

SEQ ID NO: 2819327 - RNA, 16 nt, Human
aggacuaggguccugg

SEQ ID NO: 2819328 - RNA, 19 nt, Human
aggacuaggguccugggga

SEQ ID NO: 2819329 - RNA, 22 nt, Human
aggacucacagguuggaagaga

SEQ ID NO: 2819330 - RNA, 18 nt, Human
aggacucagaagccucug

SEQ ID NO: 2819331 - RNA, 13 nt, Human
aggacucagcucc

SEQ ID NO: 2819332 - RNA, 14 nt, Human
aggacucagcuccc

SEQ ID NO: 2819333 - RNA, 17 nt, Human
aggacucagcuccccag

SEQ ID NO: 2819334 - RNA, 18 nt, Human
aggacucagcuccccaga

SEQ ID NO: 2819335 - RNA, 19 nt, Human
aggacucagcuccccagag

SEQ ID NO: 2819336 - RNA, 20 nt, Human
aggacucagcuccccagagu

SEQ ID NO: 2819337 - RNA, 17 nt, Human
aggacucccuccucacc

SEQ ID NO: 2819338 - RNA, 16 nt, Human
aggacucccuccucac

SEQ ID NO: 2819339 - RNA, 15 nt, Human
aggacucccuccuca

SEQ ID NO: 2819340 - RNA, 14 nt, Human
aggacucccuccuc

SEQ ID NO: 2819341 - RNA, 13 nt, Human
aggacucccuccu

SEQ ID NO: 2819342 - RNA, 12 nt, Human
aggacucccucc

SEQ ID NO: 2819343 - RNA, 17 nt, Human
aggacucugaggcucuu

SEQ ID NO: 2819344 - RNA, 14 nt, Human
aggacucugaggcu

SEQ ID NO: 2819345 - RNA, 13 nt, Human
aggacucugaggc

SEQ ID NO: 2819346 - RNA, 19 nt, Human
aggacucccuccucaccuc

SEQ ID NO: 2819347 - RNA, 18 nt, Human
aggacucccuccucaccu

SEQ ID NO: 2819348 - RNA, 23 nt, Human
aggacucccuccucaccucugga

SEQ ID NO: 2819349 - RNA, 15 nt, Human
aggacuccuccccac

SEQ ID NO: 2819350 - RNA, 22 nt, Human
aggacuccuccccacccuccug

SEQ ID NO: 2819351 - RNA, 23 nt, Human
aggacuccuccccacccuccugg

SEQ ID NO: 2819352 - RNA, 14 nt, Human
aggacucgcuugua

SEQ ID NO: 2819353 - RNA, 15 nt, Human
aggacucgcuuguaa

SEQ ID NO: 2819354 - RNA, 16 nt, Human
aggacucgcuuguaaa

SEQ ID NO: 2819355 - RNA, 17 nt, Human
aggacucgcuuguaaau

SEQ ID NO: 2819356 - RNA, 20 nt, Human
aggacucgcuuguaaauacc

SEQ ID NO: 2819357 - RNA, 21 nt, Human
aggacucgcuuguaaauacca

SEQ ID NO: 2819358 - RNA, 22 nt, Human
aggacuuuucuuuguggcuucc

SEQ ID NO: 2819359 - RNA, 19 nt, Human
aggacuuuucuuuguggcu

SEQ ID NO: 2819360 - RNA, 17 nt, Human
aggacuuuucuuugugg

SEQ ID NO: 2819361 - RNA, 17 nt, Human
aggacucugccuccucu

SEQ ID NO: 2819362 - RNA, 18 nt, Human
aggacucugccuccucuu

SEQ ID NO: 2819363 - RNA, 12 nt, Human
aggacucugccu

SEQ ID NO: 2819364 - RNA, 13 nt, Human
aggacucugccuc

SEQ ID NO: 2819365 - RNA, 14 nt, Human
aggacucugccucc

SEQ ID NO: 2819366 - RNA, 16 nt, Human
aggacucugccuccuc

SEQ ID NO: 2819367 - RNA, 17 nt, Human
aggagccccgaggccuu

SEQ ID NO: 2819368 - RNA, 21 nt, Human
aggagcccuuaucugugcuca

SEQ ID NO: 2819369 - RNA, 16 nt, Human
aggagcacaagccaca

SEQ ID NO: 2819370 - RNA, 24 nt, Human
aggagcccacggcuaagaggcugc

SEQ ID NO: 2819371 - RNA, 13 nt, Human
aggagcagcauug

SEQ ID NO: 2819372 - RNA, 14 nt, Human
aggagccccagcua

SEQ ID NO: 2819373 - RNA, 17 nt, Human
aggagccccaucugucu

SEQ ID NO: 2819374 - RNA, 20 nt, Human
aggagcccauacucagccug

SEQ ID NO: 2819375 - RNA, 15 nt, Human
aggagcacagguccc

SEQ ID NO: 2819376 - RNA, 16 nt, Human
aggagcacagguccca

SEQ ID NO: 2819377 - RNA, 17 nt, Human
aggagcacaggucccac

SEQ ID NO: 2819378 - RNA, 22 nt, Human
aggagcaaaggcugagaacacu

SEQ ID NO: 2819379 - RNA, 17 nt, Human
aggagaguagaacagau

SEQ ID NO: 2819380 - RNA, 15 nt, Human
aggagaucagaaaaa

SEQ ID NO: 2819381 - RNA, 16 nt, Human
aggagaucagaaaaau

SEQ ID NO: 2819382 - RNA, 14 nt, Human
aggagaguggccau

SEQ ID NO: 2819383 - RNA, 18 nt, Human
ugcuuuuggucuguguga

SEQ ID NO: 2819384 - RNA, 20 nt, Human
ugcuuuugucuaugggacuc

SEQ ID NO: 2819385 - RNA, 16 nt, Human
ugcuuugggcugcccu

SEQ ID NO: 2819386 - RNA, 22 nt, Human
ugcuuuguuaaaaaaaaaaaga

SEQ ID NO: 2819387 - RNA, 18 nt, Human
ugcuugagcucaggaguu

SEQ ID NO: 2819388 - RNA, 13 nt, Human
ugcuuuguugcac

SEQ ID NO: 2819389 - RNA, 23 nt, Human
aggagcccuuaucugugcucagg

SEQ ID NO: 2819390 - RNA, 17 nt, Human
aggagcacuuccaaaau

SEQ ID NO: 2819391 - RNA, 12 nt, Human
ugcuugaauagc

SEQ ID NO: 2819392 - RNA, 19 nt, Human
ugcuugagaauauugaagu

SEQ ID NO: 2819393 - RNA, 14 nt, Human
ugcuuugggcugcc

SEQ ID NO: 2819394 - RNA, 15 nt, Human
ugcuuugggcugccc

SEQ ID NO: 2819395 - RNA, 13 nt, Human
ugcuuuggaaauc

SEQ ID NO: 2819396 - RNA, 14 nt, Human
ugcuugagcccagg

SEQ ID NO: 2819397 - RNA, 13 nt, Human
ugcuugagcccag

SEQ ID NO: 2819398 - RNA, 16 nt, Human
ugcuugagcccaggag

SEQ ID NO: 2819399 - RNA, 23 nt, Human
ugcuuuuguuccaaugucaaugu

SEQ ID NO: 2819400 - RNA, 15 nt, Human
uggaaaguuuuugua

SEQ ID NO: 2819401 - RNA, 13 nt, Human
uggaaauaaaugu

SEQ ID NO: 2819402 - RNA, 23 nt, Human
uggaaauaaauguaucauagaaa

SEQ ID NO: 2819403 - RNA, 17 nt, Human
uggaaauaauaaaagau

SEQ ID NO: 2819404 - RNA, 15 nt, Human
uggaaauaaauguau

SEQ ID NO: 2819405 - RNA, 13 nt, Human
ugcuuuuugaaau

SEQ ID NO: 2819406 - RNA, 14 nt, Human
ugcuuuuugaaaug

SEQ ID NO: 2819407 - RNA, 15 nt, Human
ugcuuuuugaaauga

SEQ ID NO: 2819408 - RNA, 17 nt, Human
ugcuuuuugaaaugaaa

SEQ ID NO: 2819409 - RNA, 20 nt, Human
ugcuuuuugaaaugaaauuu

SEQ ID NO: 2819410 - RNA, 15 nt, Human
ugcuuuuucaccaga

SEQ ID NO: 2819411 - RNA, 19 nt, Human
ugcuuuuuauuucugcaua

SEQ ID NO: 2819412 - RNA, 18 nt, Human
ugcuuuuuauuucugcau

SEQ ID NO: 2819413 - RNA, 17 nt, Human
ugcuuuuuaaguguuaa

SEQ ID NO: 2819414 - RNA, 15 nt, Human
ugcuuuuuauuucug

SEQ ID NO: 2819415 - RNA, 16 nt, Human
uggaacaaagugaagg

SEQ ID NO: 2819416 - RNA, 20 nt, Human
uggaacaaagugaaggacau

SEQ ID NO: 2819417 - RNA, 13 nt, Human
uggaagagaaauc

SEQ ID NO: 2819418 - RNA, 14 nt, Human
uggaagagaaaucu

SEQ ID NO: 2819419 - RNA, 16 nt, Human
uggaagagaaaucuca

SEQ ID NO: 2819420 - RNA, 12 nt, Human
uggaagagaauc

SEQ ID NO: 2819421 - RNA, 14 nt, Human
uggaagagaaucac

SEQ ID NO: 2819422 - RNA, 13 nt, Human
aggaucagucuga

SEQ ID NO: 2819423 - RNA, 17 nt, Human
aggauauccuuaucaga

SEQ ID NO: 2819424 - RNA, 19 nt, Human
aggauauccuuaucagagc

SEQ ID NO: 2819425 - RNA, 20 nt, Human
aggauauccuuaucagagcu

SEQ ID NO: 2819426 - RNA, 21 nt, Human
aggauauccuuaucagagcua

SEQ ID NO: 2819427 - RNA, 22 nt, Human
aggauauccuuaucagagcuaa

SEQ ID NO: 2819428 - RNA, 23 nt, Human
aggauauccuuaucagagcuaag

SEQ ID NO: 2819429 - RNA, 15 nt, Human
aggaucaugguguaa

SEQ ID NO: 2819430 - RNA, 17 nt, Human
aggaucaguuaacuauu

SEQ ID NO: 2819431 - RNA, 20 nt, Human
aggaucauuuguuggaauga

SEQ ID NO: 2819432 - RNA, 17 nt, Human
aggaucaugguguaaua

SEQ ID NO: 2819433 - RNA, 18 nt, Human
aggaucaugguguaauaa

SEQ ID NO: 2819434 - RNA, 15 nt, Human
aggaucaguuaacua

SEQ ID NO: 2819435 - RNA, 23 nt, Human
aggaucaguuaacuauugcauuu

SEQ ID NO: 2819436 - RNA, 13 nt, Human
aggaucaguuuuu

SEQ ID NO: 2819437 - RNA, 22 nt, Human
aggaucaguuuuuuguuuuaca

SEQ ID NO: 2819438 - RNA, 13 nt, Human
aggaucaucugaa

SEQ ID NO: 2819439 - RNA, 18 nt, Human
aggaucuuuugaacccag

SEQ ID NO: 2819440 - RNA, 13 nt, Human
aggaucuuuugaa

SEQ ID NO: 2819441 - RNA, 21 nt, Human
aggaucauuuguuggaaugaa

SEQ ID NO: 2819442 - RNA, 15 nt, Human
aggauccagccucac

SEQ ID NO: 2819443 - RNA, 22 nt, Human
aggaugaaugaggucccaggca

SEQ ID NO: 2819444 - RNA, 21 nt, Human
aggaugaaugaggucccaggc

SEQ ID NO: 2819445 - RNA, 20 nt, Human
aggaugaaugaggucccagg

SEQ ID NO: 2819446 - RNA, 19 nt, Human
aggaugaaugaggucccag

SEQ ID NO: 2819447 - RNA, 20 nt, Human
aggaugaccuggauaacuua

SEQ ID NO: 2819448 - RNA, 22 nt, Human
aggaucaugguguaauaagaca

SEQ ID NO: 2819449 - RNA, 13 nt, Human
aggaugagagccc

SEQ ID NO: 2819450 - RNA, 14 nt, Human
aggaugagagccca

SEQ ID NO: 2819451 - RNA, 15 nt, Human
aggaugagagcccag

SEQ ID NO: 2819452 - RNA, 16 nt, Human
aggaugagagcccaga

SEQ ID NO: 2819453 - RNA, 17 nt, Human
aggaugagagcccagag

SEQ ID NO: 2819454 - RNA, 18 nt, Human
aggaugagagcccagagg

SEQ ID NO: 2819455 - RNA, 19 nt, Human
aggaugagagcccagaggu

SEQ ID NO: 2819456 - RNA, 20 nt, Human
aggaugagagcccagaggua

SEQ ID NO: 2819457 - RNA, 19 nt, Human
aggauugaacuucuuugaa

SEQ ID NO: 2819458 - RNA, 23 nt, Human
aggaugagagcccagagguaaca

SEQ ID NO: 2819459 - RNA, 20 nt, Human
aggaggcgcccuuggcuucu

SEQ ID NO: 2819460 - RNA, 21 nt, Human
aggaggcgucucgggagagga

SEQ ID NO: 2819461 - RNA, 20 nt, Human
aggaggcucaacaauaaaac

SEQ ID NO: 2819462 - RNA, 13 nt, Human
aggaggcugaggg

SEQ ID NO: 2819463 - RNA, 19 nt, Human
aggaggcugaggcaggagg

SEQ ID NO: 2819464 - RNA, 17 nt, Human
aggaggcugaggcagga

SEQ ID NO: 2819465 - RNA, 14 nt, Human
aggauagcauuuuu

SEQ ID NO: 2819466 - RNA, 14 nt, Human
aggauaguauuuuu

SEQ ID NO: 2819467 - RNA, 16 nt, Human
aggauaguauuuuuau

SEQ ID NO: 2819468 - RNA, 16 nt, Human
aggaggcuggcaggua

SEQ ID NO: 2819469 - RNA, 13 nt, Human
aggaggcuggcag

SEQ ID NO: 2819470 - RNA, 21 nt, Human
uggaagacaggaaaguucaga

SEQ ID NO: 2819471 - RNA, 23 nt, Human
uggaagaggaacagcacugggga

SEQ ID NO: 2819472 - RNA, 16 nt, Human
uggaagcccuggagac

SEQ ID NO: 2819473 - RNA, 22 nt, Human
aggaggaaucaugucaggccug

SEQ ID NO: 2819474 - RNA, 23 nt, Human
aggaggaaucaugucaggccugu

SEQ ID NO: 2819475 - RNA, 17 nt, Human
aggcaagcaccuccugc

SEQ ID NO: 2819476 - RNA, 17 nt, Human
uggagccaauggagacu

SEQ ID NO: 2819477 - RNA, 13 nt, Human
uggagccagcucc

SEQ ID NO: 2819478 - RNA, 11 nt, Human
uggagccaggc

SEQ ID NO: 2819479 - RNA, 12 nt, Human
uggagccaggcg

SEQ ID NO: 2819480 - RNA, 13 nt, Human
uggagccaggcgu

SEQ ID NO: 2819481 - RNA, 15 nt, Human
uggagccaggcgugu

SEQ ID NO: 2819482 - RNA, 22 nt, Human
uggagcaguacaugggaaagga

SEQ ID NO: 2819483 - RNA, 19 nt, Human
uggagcagccuggagaccc

SEQ ID NO: 2819484 - RNA, 18 nt, Human
uggagcaggacucuauuu

SEQ ID NO: 2819485 - RNA, 18 nt, Human
uggagcaggcggugggga

SEQ ID NO: 2819486 - RNA, 22 nt, Human
uggagcaggcgguggggagaga

SEQ ID NO: 2819487 - RNA, 17 nt, Human
uggagcaugggccuggc

SEQ ID NO: 2819488 - RNA, 18 nt, Human
uggagcaugggccuggcc

SEQ ID NO: 2819489 - RNA, 20 nt, Human
aggcaagcaccuccugccuc

SEQ ID NO: 2819490 - RNA, 19 nt, Human
aggcaagcaccuccugccu

SEQ ID NO: 2819491 - RNA, 18 nt, Human
aggcaagcaccuccugcc

SEQ ID NO: 2819492 - RNA, 14 nt, Human
aggcacaauauggg

SEQ ID NO: 2819493 - RNA, 18 nt, Human
aggcaaggcuaugugauu

SEQ ID NO: 2819494 - RNA, 20 nt, Human
aggcaaggcuaugugauuac

SEQ ID NO: 2819495 - RNA, 22 nt, Human
uggacuguuuucucucggcucc

SEQ ID NO: 2819496 - RNA, 15 nt, Human
uggacuuagaaagca

SEQ ID NO: 2819497 - RNA, 16 nt, Human
uggacuuagaaagcag

SEQ ID NO: 2819498 - RNA, 18 nt, Human
uggacuuagaaagcaggg

SEQ ID NO: 2819499 - RNA, 17 nt, Human
uggacuguuuucucucg

SEQ ID NO: 2819500 - RNA, 20 nt, Human
uggacuguuuucucucggcu

SEQ ID NO: 2819501 - RNA, 20 nt, Human
uggacuuagaaagcaggggc

SEQ ID NO: 2819502 - RNA, 21 nt, Human
uggacuuagaaagcaggggcu

SEQ ID NO: 2819503 - RNA, 17 nt, Human
uggacuuauuucuucaa

SEQ ID NO: 2819504 - RNA, 18 nt, Human
uggacuuauuucuucaaa

SEQ ID NO: 2819505 - RNA, 17 nt, Human
aggauugcuacuguccu

SEQ ID NO: 2819506 - RNA, 15 nt, Human
aggauugcuacuguc

SEQ ID NO: 2819507 - RNA, 18 nt, Human
aggauugcuacuguccua

SEQ ID NO: 2819508 - RNA, 17 nt, Human
uggagcaaagugguagg

SEQ ID NO: 2819509 - RNA, 18 nt, Human
uggagcaaagugguaggu

SEQ ID NO: 2819510 - RNA, 18 nt, Human
uggagcaaucacagauga

SEQ ID NO: 2819511 - RNA, 13 nt, Human
uggagcagaccac

SEQ ID NO: 2819512 - RNA, 17 nt, Human
uggagcagaccaccccg

SEQ ID NO: 2819513 - RNA, 11 nt, Human
uggagaaauua

SEQ ID NO: 2819514 - RNA, 15 nt, Human
uggagaaauuauuua

SEQ ID NO: 2819515 - RNA, 17 nt, Human
uggagaaauuauuuaau

SEQ ID NO: 2819516 - RNA, 15 nt, Human
uggagcaaagcugau

SEQ ID NO: 2819517 - RNA, 18 nt, Human
uggacuugaacuuuccug

SEQ ID NO: 2819518 - RNA, 14 nt, Human
aggcauuguuugag

SEQ ID NO: 2819519 - RNA, 12 nt, Human
aggcauuuccua

SEQ ID NO: 2819520 - RNA, 15 nt, Human
aggcaggugccugga

SEQ ID NO: 2819521 - RNA, 13 nt, Human
aggcaggugccug

SEQ ID NO: 2819522 - RNA, 12 nt, Human
aggcagggucuc

SEQ ID NO: 2819523 - RNA, 22 nt, Human
aggcaggucuugaacuccuggc

SEQ ID NO: 2819524 - RNA, 17 nt, Human
aggcagcugccugcucu

SEQ ID NO: 2819525 - RNA, 13 nt, Human
aggcacagcugag

SEQ ID NO: 2819526 - RNA, 14 nt, Human
aggcacagcugagu

SEQ ID NO: 2819527 - RNA, 15 nt, Human
aggcacaggaugcug

SEQ ID NO: 2819528 - RNA, 14 nt, Human
aggcacagcaaacu

SEQ ID NO: 2819529 - RNA, 16 nt, Human
aggcacagcaaacugu

SEQ ID NO: 2819530 - RNA, 20 nt, Human
aggcagcuuuuucucuccca

SEQ ID NO: 2819531 - RNA, 19 nt, Human
aggcaggacaugcugaagc

SEQ ID NO: 2819532 - RNA, 17 nt, Human
aggcaggaagggcagga

SEQ ID NO: 2819533 - RNA, 16 nt, Human
aggcaggaagggcagg

SEQ ID NO: 2819534 - RNA, 20 nt, Human
aggcaggaagggcaggaagg

SEQ ID NO: 2819535 - RNA, 14 nt, Human
aggcaggacaugcu

SEQ ID NO: 2819536 - RNA, 23 nt, Human
aggcagggggaaggugggguccu

SEQ ID NO: 2819537 - RNA, 21 nt, Human
aggcaggccaaggccuucucc

SEQ ID NO: 2819538 - RNA, 22 nt, Human
aggcaggccaaggccuucuccu

SEQ ID NO: 2819539 - RNA, 14 nt, Human
aggcaggccgacug

SEQ ID NO: 2819540 - RNA, 13 nt, Human
aggcaggcauuga

SEQ ID NO: 2819541 - RNA, 14 nt, Human
aggcaggcauugag

SEQ ID NO: 2819542 - RNA, 23 nt, Human
aggcaggcauugaggaagagucu

SEQ ID NO: 2819543 - RNA, 21 nt, Human
aggcaggcaccuagcaauucc

SEQ ID NO: 2819544 - RNA, 23 nt, Human
aggcaggcuaaggcguggagcug

SEQ ID NO: 2819545 - RNA, 18 nt, Human
aggcaggcuaaggcgugg

SEQ ID NO: 2819546 - RNA, 22 nt, Human
aggcaggcuaaggcguggagcu

SEQ ID NO: 2819547 - RNA, 18 nt, Human
uggaguguuauguauuuc

SEQ ID NO: 2819548 - RNA, 17 nt, Human
uggaguguggcugagga

SEQ ID NO: 2819549 - RNA, 16 nt, Human
uggaguggcucgccag

SEQ ID NO: 2819550 - RNA, 19 nt, Human
uggaguggcucgccaggcc

SEQ ID NO: 2819551 - RNA, 14 nt, Human
uggagugggcagag

SEQ ID NO: 2819552 - RNA, 18 nt, Human
uggagugcccacccuggg

SEQ ID NO: 2819553 - RNA, 16 nt, Human
uggaguggagugagag

SEQ ID NO: 2819554 - RNA, 14 nt, Human
uggagugcagugag

SEQ ID NO: 2819555 - RNA, 17 nt, Human
uggagugcaaugacaca

SEQ ID NO: 2819556 - RNA, 16 nt, Human
uggagucuggaguggg

SEQ ID NO: 2819557 - RNA, 17 nt, Human
uggagucuggagugggc

SEQ ID NO: 2819558 - RNA, 18 nt, Human
uggagucuggagugggca

SEQ ID NO: 2819559 - RNA, 19 nt, Human
uggagucuggagugggcag

SEQ ID NO: 2819560 - RNA, 18 nt, Human
uggaggugggagcaggag

SEQ ID NO: 2819561 - RNA, 20 nt, Human
uggaggugggagcaggagau

SEQ ID NO: 2819562 - RNA, 21 nt, Human
uggagguggggcgaggcaggc

SEQ ID NO: 2819563 - RNA, 22 nt, Human
uggagguggggcgaggcaggcc

SEQ ID NO: 2819564 - RNA, 12 nt, Human
uggaggugggag

SEQ ID NO: 2819565 - RNA, 13 nt, Human
uggaggugggagc

SEQ ID NO: 2819566 - RNA, 17 nt, Human
uggaggugggagcagga

SEQ ID NO: 2819567 - RNA, 23 nt, Human
uggaugccugguggcagcugcgg

SEQ ID NO: 2819568 - RNA, 21 nt, Human
uggaugccugguggcagcugc

SEQ ID NO: 2819569 - RNA, 16 nt, Human
uggaguucuugugcca

SEQ ID NO: 2819570 - RNA, 14 nt, Human
uggaguucuugugc

SEQ ID NO: 2819571 - RNA, 15 nt, Human
uggaguucuugugcc

SEQ ID NO: 2819572 - RNA, 12 nt, Human
uggaugccuuga

SEQ ID NO: 2819573 - RNA, 18 nt, Human
uggaugcggccauucaag

SEQ ID NO: 2819574 - RNA, 16 nt, Human
uggaugcuuagaggga

SEQ ID NO: 2819575 - RNA, 21 nt, Human
uggaugcuuagagggauuucu

SEQ ID NO: 2819576 - RNA, 17 nt, Human
uggauuauuuaauaaca

SEQ ID NO: 2819577 - RNA, 18 nt, Human
uggauuauuuaauaacau

SEQ ID NO: 2819578 - RNA, 20 nt, Human
uggauuauuuaauaacauua

SEQ ID NO: 2819579 - RNA, 23 nt, Human
uggauuauuuaauaacauuaccu

SEQ ID NO: 2819580 - RNA, 16 nt, Human
uggauuauuuaauaac

SEQ ID NO: 2819581 - RNA, 17 nt, Human
uggauucauucucauaa

SEQ ID NO: 2819582 - RNA, 23 nt, Human
uggauucauucucauaauuccua

SEQ ID NO: 2819583 - RNA, 14 nt, Human
uggauucauugucu

SEQ ID NO: 2819584 - RNA, 16 nt, Human
uggauucauugucucu

SEQ ID NO: 2819585 - RNA, 17 nt, Human
uggauucauuuauaaga

SEQ ID NO: 2819586 - RNA, 13 nt, Human
uggauucaucagc

SEQ ID NO: 2819587 - RNA, 21 nt, Human
uggcaccacugcacuccagcc

SEQ ID NO: 2819588 - RNA, 19 nt, Human
uggcaccacugcacuccag

SEQ ID NO: 2819589 - RNA, 18 nt, Human
uggcaccacugcacucca

SEQ ID NO: 2819590 - RNA, 11 nt, Human
uggcaccaaag

SEQ ID NO: 2819591 - RNA, 17 nt, Human
uggcaccaaagaugcag

SEQ ID NO: 2819592 - RNA, 19 nt, Human
uggcaccaaagaugcagcc

SEQ ID NO: 2819593 - RNA, 20 nt, Human
uggcaccaaagaugcagccg

SEQ ID NO: 2819594 - RNA, 18 nt, Human
uggcacauuuaagagaca

SEQ ID NO: 2819595 - RNA, 13 nt, Human
uggauuccaugcu

SEQ ID NO: 2819596 - RNA, 15 nt, Human
uggauuccaugcuaa

SEQ ID NO: 2819597 - RNA, 18 nt, Human
uggauucccuuaaacaaa

SEQ ID NO: 2819598 - RNA, 17 nt, Human
uggauucuuauguagca

SEQ ID NO: 2819599 - RNA, 20 nt, Human
uggauucugaggcccugccc

SEQ ID NO: 2819600 - RNA, 19 nt, Human
uggauugcaauaucugaag

SEQ ID NO: 2819601 - RNA, 21 nt, Human
aggcccccucucaggagccau

SEQ ID NO: 2819602 - RNA, 17 nt, Human
aggcccggcuccaggcu

SEQ ID NO: 2819603 - RNA, 15 nt, Human
aggcccggccucuca

SEQ ID NO: 2819604 - RNA, 13 nt, Human
aggcccggcucca

SEQ ID NO: 2819605 - RNA, 14 nt, Human
aggcccggccucuc

SEQ ID NO: 2819606 - RNA, 13 nt, Human
aggcccggccucu

SEQ ID NO: 2819607 - RNA, 13 nt, Human
aggcccacucagg

SEQ ID NO: 2819608 - RNA, 15 nt, Human
aggcccacucagggg

SEQ ID NO: 2819609 - RNA, 14 nt, Human
aggcccaacuguga

SEQ ID NO: 2819610 - RNA, 11 nt, Human
aggcccacaca

SEQ ID NO: 2819611 - RNA, 12 nt, Human
aggcccacacac

SEQ ID NO: 2819612 - RNA, 13 nt, Human
aggcccacacaca

SEQ ID NO: 2819613 - RNA, 14 nt, Human
aggcccacacacag

SEQ ID NO: 2819614 - RNA, 15 nt, Human
aggcccacacacagg

SEQ ID NO: 2819615 - RNA, 16 nt, Human
aggcccacacacaggu

SEQ ID NO: 2819616 - RNA, 12 nt, Human
aggcccacagga

SEQ ID NO: 2819617 - RNA, 13 nt, Human
aggcccacaggag

SEQ ID NO: 2819618 - RNA, 19 nt, Human
aggcccacaggaggcaagc

SEQ ID NO: 2819619 - RNA, 13 nt, Human
aggcccccaccac

SEQ ID NO: 2819620 - RNA, 14 nt, Human
aggcccccaccaca

SEQ ID NO: 2819621 - RNA, 15 nt, Human
aggcccccaccacac

SEQ ID NO: 2819622 - RNA, 16 nt, Human
aggcccccaccacaca

SEQ ID NO: 2819623 - RNA, 17 nt, Human
aggcccccaccacacau

SEQ ID NO: 2819624 - RNA, 18 nt, Human
aggcccccaccacacauc

SEQ ID NO: 2819625 - RNA, 21 nt, Human
aggcccccaccacacauccca

SEQ ID NO: 2819626 - RNA, 22 nt, Human
aggcccccaccacacaucccag

SEQ ID NO: 2819627 - RNA, 23 nt, Human
aggcccccaccacacaucccagc

SEQ ID NO: 2819628 - RNA, 13 nt, Human
aggccagcugccu

SEQ ID NO: 2819629 - RNA, 20 nt, Human
uggcacccggccccugcugg

SEQ ID NO: 2819630 - RNA, 19 nt, Human
uggcacccggccccugcug

SEQ ID NO: 2819631 - RNA, 18 nt, Human
uggcacccggccccugcu

SEQ ID NO: 2819632 - RNA, 15 nt, Human
aggaagagucuuggu

SEQ ID NO: 2819633 - RNA, 22 nt, Human
aggaagauauacaugaaaauuu

SEQ ID NO: 2819634 - RNA, 16 nt, Human
aggaaauaaaaccuuu

SEQ ID NO: 2819635 - RNA, 14 nt, Human
aggaaauaaaaccu

SEQ ID NO: 2819636 - RNA, 20 nt, Human
ugcucuugaccuuguagaga

SEQ ID NO: 2819637 - RNA, 17 nt, Human
aggaaaguguuauuuuu

SEQ ID NO: 2819638 - RNA, 17 nt, Human
aggaaaguucagaguuu

SEQ ID NO: 2819639 - RNA, 21 nt, Human
aggaaaguucagaguuuucug

SEQ ID NO: 2819640 - RNA, 22 nt, Human
aggaaaguucagaguuuucugg

SEQ ID NO: 2819641 - RNA, 21 nt, Human
aggaaaguuuacccaugaaga

SEQ ID NO: 2819642 - RNA, 17 nt, Human
ugcugaggccuccagcu

SEQ ID NO: 2819643 - RNA, 16 nt, Human
ugcugaggcucugacc

SEQ ID NO: 2819644 - RNA, 18 nt, Human
aggaaaggggagaaggga

SEQ ID NO: 2819645 - RNA, 15 nt, Human
ugcugagcuguuuau

SEQ ID NO: 2819646 - RNA, 20 nt, Human
ugcugagccucugcucccca

SEQ ID NO: 2819647 - RNA, 16 nt, Human
ugcugagccucugcuc

SEQ ID NO: 2819648 - RNA, 17 nt, Human
ugcugagccucugcucc

SEQ ID NO: 2819649 - RNA, 12 nt, Human
ugcugagccucu

SEQ ID NO: 2819650 - RNA, 14 nt, Human
ugcugagccucugc

SEQ ID NO: 2819651 - RNA, 16 nt, Human
ugcugagauucuucag

SEQ ID NO: 2819652 - RNA, 15 nt, Human
aggaagccaaauuua

SEQ ID NO: 2819653 - RNA, 16 nt, Human
aggaagccaaauuuau

SEQ ID NO: 2819654 - RNA, 18 nt, Human
aggaagcauucagagagc

SEQ ID NO: 2819655 - RNA, 19 nt, Human
aggaagcauucagagagca

SEQ ID NO: 2819656 - RNA, 18 nt, Human
aggaagcagcuuucccca

SEQ ID NO: 2819657 - RNA, 18 nt, Human
aggaaggauuguaaaaaa

SEQ ID NO: 2819658 - RNA, 16 nt, Human
aggaaggauuguaaaa

SEQ ID NO: 2819659 - RNA, 17 nt, Human
aggaaggauuguaaaaa

SEQ ID NO: 2819660 - RNA, 21 nt, Human
aggaaggaggggaagcugcag

SEQ ID NO: 2819661 - RNA, 14 nt, Human
aggaaggauuguaa

SEQ ID NO: 2819662 - RNA, 15 nt, Human
aggaaggauuguaaa

SEQ ID NO: 2819663 - RNA, 16 nt, Human
aggaauguguggccug

SEQ ID NO: 2819664 - RNA, 16 nt, Human
aggaagcaugagugcu

SEQ ID NO: 2819665 - RNA, 17 nt, Human
aggaauuaaguuaucuu

SEQ ID NO: 2819666 - RNA, 22 nt, Human
aggaauguuuuguagcucuagg

SEQ ID NO: 2819667 - RNA, 20 nt, Human
aggaaggcucuucuccccag

SEQ ID NO: 2819668 - RNA, 21 nt, Human
aggaaggcucuucuccccaga

SEQ ID NO: 2819669 - RNA, 13 nt, Human
aggaaggccuggg

SEQ ID NO: 2819670 - RNA, 14 nt, Human
aggaaggccugggu

SEQ ID NO: 2819671 - RNA, 13 nt, Human
ugcuaugaaugau

SEQ ID NO: 2819672 - RNA, 20 nt, Human
aggaaaccacagcugcugga

SEQ ID NO: 2819673 - RNA, 19 nt, Human
ugcuauuuuuguuuuuaga

SEQ ID NO: 2819674 - RNA, 20 nt, Human
ugcuaucggggaagccagac

SEQ ID NO: 2819675 - RNA, 16 nt, Human
aggaaaccacagcugc

SEQ ID NO: 2819676 - RNA, 17 nt, Human
aggaaaccacagcugcu

SEQ ID NO: 2819677 - RNA, 20 nt, Human
ugcuauccugccaaaaucau

SEQ ID NO: 2819678 - RNA, 16 nt, Human
aggaaaagcugcugac

SEQ ID NO: 2819679 - RNA, 13 nt, Human
aggaaaauuucac

SEQ ID NO: 2819680 - RNA, 14 nt, Human
aggaaacaagugaa

SEQ ID NO: 2819681 - RNA, 17 nt, Human
aggaaacaauauuuaua

SEQ ID NO: 2819682 - RNA, 12 nt, Human
aggaaacaguua

SEQ ID NO: 2819683 - RNA, 13 nt, Human
aggaaaccaacac

SEQ ID NO: 2819684 - RNA, 13 nt, Human
aggaaacaaguga

SEQ ID NO: 2819685 - RNA, 15 nt, Human
aggaaacaacagcuu

SEQ ID NO: 2819686 - RNA, 14 nt, Human
aggaaacaacagcu

SEQ ID NO: 2819687 - RNA, 22 nt, Human
ugcuccaggcaggcuaaggcgu

SEQ ID NO: 2819688 - RNA, 13 nt, Human
ugcuccaggccug

SEQ ID NO: 2819689 - RNA, 14 nt, Human
ugcuccaggccugc

SEQ ID NO: 2819690 - RNA, 16 nt, Human
ugcuccaggccugcag

SEQ ID NO: 2819691 - RNA, 18 nt, Human
ugcuccaggccugcagca

SEQ ID NO: 2819692 - RNA, 20 nt, Human
ugcuccaggccugcagcagg

SEQ ID NO: 2819693 - RNA, 16 nt, Human
ugcuccagggagauuu

SEQ ID NO: 2819694 - RNA, 12 nt, Human
ugcuccaggcag

SEQ ID NO: 2819695 - RNA, 14 nt, Human
ugcuccaggcaggc

SEQ ID NO: 2819696 - RNA, 12 nt, Human
ugcucuccuuuc

SEQ ID NO: 2819697 - RNA, 19 nt, Human
ugcucucgcaccuuuccaa

SEQ ID NO: 2819698 - RNA, 22 nt, Human
ugcucucgcaccuuuccaaagu

SEQ ID NO: 2819699 - RNA, 17 nt, Human
ugcucucucaaauuguc

SEQ ID NO: 2819700 - RNA, 20 nt, Human
ugcucucucaaauugucagc

SEQ ID NO: 2819701 - RNA, 13 nt, Human
ugcucucuguguc

SEQ ID NO: 2819702 - RNA, 17 nt, Human
ugcucugaaaucuccuu

SEQ ID NO: 2819703 - RNA, 18 nt, Human
ugcucugagaagaggagc

SEQ ID NO: 2819704 - RNA, 20 nt, Human
ugcucugagaagaggagccc

SEQ ID NO: 2819705 - RNA, 22 nt, Human
ugcucugagaagaggagcccuc

SEQ ID NO: 2819706 - RNA, 23 nt, Human
ugcucugagaagaggagcccuca

SEQ ID NO: 2819707 - RNA, 15 nt, Human
ugcucugcugacaga

SEQ ID NO: 2819708 - RNA, 14 nt, Human
ugcucugcugacag

SEQ ID NO: 2819709 - RNA, 18 nt, Human
ugcucuuagcugucugcu

SEQ ID NO: 2819710 - RNA, 15 nt, Human
ugcucuuagcugucu

SEQ ID NO: 2819711 - RNA, 23 nt, Human
ugcucuucuguggaccacugcau

SEQ ID NO: 2819712 - RNA, 13 nt, Human
ugcucuucugugg

SEQ ID NO: 2819713 - RNA, 15 nt, Human
ugcucuugaacuccu

SEQ ID NO: 2819714 - RNA, 22 nt, Human
ugcucuugaacuccugaccuca

SEQ ID NO: 2819715 - RNA, 20 nt, Human
ugcucuugaacuccugaccu

SEQ ID NO: 2819716 - RNA, 15 nt, Human
ugcgguccacccagg

SEQ ID NO: 2819717 - RNA, 14 nt, Human
ugcgguccacccag

SEQ ID NO: 2819718 - RNA, 23 nt, Human
ugccuuggggaggacaaaacuuc

SEQ ID NO: 2819719 - RNA, 15 nt, Human
ugccuuuugcagaag

SEQ ID NO: 2819720 - RNA, 16 nt, Human
ugccuuuugcagaaga

SEQ ID NO: 2819721 - RNA, 17 nt, Human
ugccuuuugcagaagag

SEQ ID NO: 2819722 - RNA, 19 nt, Human
ugccuuuugcagaagaggg

SEQ ID NO: 2819723 - RNA, 22 nt, Human
ugccuuuugcagaagagggugu

SEQ ID NO: 2819724 - RNA, 15 nt, Human
ugcuaauuuucucaa

SEQ ID NO: 2819725 - RNA, 17 nt, Human
ugcuaauuuucucaaaa

SEQ ID NO: 2819726 - RNA, 22 nt, Human
ugcuaauuuucucaaaagcauu

SEQ ID NO: 2819727 - RNA, 18 nt, Human
ugcuaauuuauccugaaa

SEQ ID NO: 2819728 - RNA, 15 nt, Human
ugcuaauugcuguug

SEQ ID NO: 2819729 - RNA, 16 nt, Human
ugcuaauugcuguuga

SEQ ID NO: 2819730 - RNA, 17 nt, Human
ugcuaauugcuguugaa

SEQ ID NO: 2819731 - RNA, 18 nt, Human
ugcuaauugcuguugaaa

SEQ ID NO: 2819732 - RNA, 20 nt, Human
ugcuaauugcuguugaaagc

SEQ ID NO: 2819733 - RNA, 21 nt, Human
ugcuaauugcuguugaaagca

SEQ ID NO: 2819734 - RNA, 22 nt, Human
ugcuaauugcuguugaaagcaa

SEQ ID NO: 2819735 - RNA, 23 nt, Human
ugcuaauugcuguugaaagcaaa

SEQ ID NO: 2819736 - RNA, 16 nt, Human
ugcuaauuuaaagaga

SEQ ID NO: 2819737 - RNA, 17 nt, Human
ugcuaauuuaaagagac

SEQ ID NO: 2819738 - RNA, 15 nt, Human
ugcuaauuaaaaagu

SEQ ID NO: 2819739 - RNA, 17 nt, Human
ugcuaauuaaaaaguua

SEQ ID NO: 2819740 - RNA, 13 nt, Human
ugcuaaucuucuu

SEQ ID NO: 2819741 - RNA, 22 nt, Human
ugcuaaucuucuuaugcaauuu

SEQ ID NO: 2819742 - RNA, 20 nt, Human
ugcuaaucuucuuaugcaau

SEQ ID NO: 2819743 - RNA, 13 nt, Human
ugcuaauauuaaa

SEQ ID NO: 2819744 - RNA, 15 nt, Human
ugcuaauauuaaaag

SEQ ID NO: 2819745 - RNA, 16 nt, Human
ugcuaauauuaaaagu

SEQ ID NO: 2819746 - RNA, 16 nt, Human
ugcuaaucaaagccag

SEQ ID NO: 2819747 - RNA, 17 nt, Human
ugcuaaucaaagccagg

SEQ ID NO: 2819748 - RNA, 20 nt, Human
ugcuaaucaaagccaggguc

SEQ ID NO: 2819749 - RNA, 21 nt, Human
ugcuaaucaaagccagggucu

SEQ ID NO: 2819750 - RNA, 15 nt, Human
ugcuaaguguaggau

SEQ ID NO: 2819751 - RNA, 19 nt, Human
ugcuacagaggaaacaaua

SEQ ID NO: 2819752 - RNA, 20 nt, Human
ugcuacagaugauagaggau

SEQ ID NO: 2819753 - RNA, 13 nt, Human
ugcuaccaaagca

SEQ ID NO: 2819754 - RNA, 23 nt, Human
ugcuacccaugacuuuauaugga

SEQ ID NO: 2819755 - RNA, 14 nt, Human
ugcuacauaaauug

SEQ ID NO: 2819756 - RNA, 13 nt, Human
ugcuacccagcca

SEQ ID NO: 2819757 - RNA, 22 nt, Human
agcuguuguacauuuaugauuu

SEQ ID NO: 2819758 - RNA, 23 nt, Human
agcuguuguacauuuaugauuua

SEQ ID NO: 2819759 - RNA, 16 nt, Human
agcuguuguacauuua

SEQ ID NO: 2819760 - RNA, 18 nt, Human
agcuguuguacauuuaug

SEQ ID NO: 2819761 - RNA, 20 nt, Human
agcuguuguacauuuaugau

SEQ ID NO: 2819762 - RNA, 12 nt, Human
agcuguuuaaga

SEQ ID NO: 2819763 - RNA, 18 nt, Human
agcuguuuauagagaaug

SEQ ID NO: 2819764 - RNA, 13 nt, Human
agcuuaacagugu

SEQ ID NO: 2819765 - RNA, 16 nt, Human
agcuguuuaagauggg

SEQ ID NO: 2819766 - RNA, 18 nt, Human
agcuguuuauggccucag

SEQ ID NO: 2819767 - RNA, 17 nt, Human
agcuguuuauggccuca

SEQ ID NO: 2819768 - RNA, 21 nt, Human
agcuguuuauggccucagcug

SEQ ID NO: 2819769 - RNA, 12 nt, Human
agcuguuuaugu

SEQ ID NO: 2819770 - RNA, 13 nt, Human
agcuguuuauguu

SEQ ID NO: 2819771 - RNA, 17 nt, Human
agcuguuuauguuuuua

SEQ ID NO: 2819772 - RNA, 18 nt, Human
agcuguuuauguuuuuau

SEQ ID NO: 2819773 - RNA, 20 nt, Human
agcuguuuauggccucagcu

SEQ ID NO: 2819774 - RNA, 19 nt, Human
agcuguuuauggccucagc

SEQ ID NO: 2819775 - RNA, 15 nt, Human
agcuugcucacaucu

SEQ ID NO: 2819776 - RNA, 17 nt, Human
agcuugcucacaucuug

SEQ ID NO: 2819777 - RNA, 15 nt, Human
agcuugcucccugug

SEQ ID NO: 2819778 - RNA, 16 nt, Human
agcuugcucccugugu

SEQ ID NO: 2819779 - RNA, 17 nt, Human
agcuugcucccuguguc

SEQ ID NO: 2819780 - RNA, 20 nt, Human
agcuugugugcaaaagcagu

SEQ ID NO: 2819781 - RNA, 17 nt, Human
agcuuguucccugucuu

SEQ ID NO: 2819782 - RNA, 19 nt, Human
agcuugugcacaauucugu

SEQ ID NO: 2819783 - RNA, 20 nt, Human
agcuuguauaguguaaaaua

SEQ ID NO: 2819784 - RNA, 18 nt, Human
agcuuguauaguguaaaa

SEQ ID NO: 2819785 - RNA, 17 nt, Human
agcuuguaggagcugag

SEQ ID NO: 2819786 - RNA, 21 nt, Human
agcuuguauaguguaaaauaa

SEQ ID NO: 2819787 - RNA, 17 nt, Human
agcuuguaugcaaugga

SEQ ID NO: 2819788 - RNA, 18 nt, Human
agcuuguaugcaauggau

SEQ ID NO: 2819789 - RNA, 15 nt, Human
agcuugccagaugcu

SEQ ID NO: 2819790 - RNA, 16 nt, Human
agcuugccagaugcug

SEQ ID NO: 2819791 - RNA, 19 nt, Human
agcuugccagaugcugcag

SEQ ID NO: 2819792 - RNA, 22 nt, Human
agcuugaggguugggcuggugu

SEQ ID NO: 2819793 - RNA, 15 nt, Human
agcuuacaagccagc

SEQ ID NO: 2819794 - RNA, 17 nt, Human
agcuuacaagccagcug

SEQ ID NO: 2819795 - RNA, 14 nt, Human
aggaaaagcugcug

SEQ ID NO: 2819796 - RNA, 20 nt, Human
aggaaaagcggacaucagcu

SEQ ID NO: 2819797 - RNA, 23 nt, Human
agcuuuggggugucuuuuuuugg

SEQ ID NO: 2819798 - RNA, 20 nt, Human
aggaaaacugcauggagacg

SEQ ID NO: 2819799 - RNA, 24 nt, Human
aggaaaacugcauggagacgcauu

SEQ ID NO: 2819800 - RNA, 10 nt, Human
aggaaaagaa

SEQ ID NO: 2819801 - RNA, 13 nt, Human
aggaaaagaaaaa

SEQ ID NO: 2819802 - RNA, 14 nt, Human
aggaaaagaaaaaa

SEQ ID NO: 2819803 - RNA, 15 nt, Human
aggaaaagaaaaaaa

SEQ ID NO: 2819804 - RNA, 23 nt, Human
agcuuugcucuuugguagaaaag

SEQ ID NO: 2819805 - RNA, 21 nt, Human
agcuuugcucuuugguagaaa

SEQ ID NO: 2819806 - RNA, 18 nt, Human
agcuuugcucuuugguag

SEQ ID NO: 2819807 - RNA, 19 nt, Human
agcuuuggacccaaggaaa

SEQ ID NO: 2819808 - RNA, 13 nt, Human
agcuuuggcagug

SEQ ID NO: 2819809 - RNA, 19 nt, Human
agcuuugagaagccuucag

SEQ ID NO: 2819810 - RNA, 17 nt, Human
agcuuugagaagccuuc

SEQ ID NO: 2819811 - RNA, 21 nt, Human
agcuuugacuggaggguccau

SEQ ID NO: 2819812 - RNA, 10 nt, Human
agcuuugcuc

SEQ ID NO: 2819813 - RNA, 21 nt, Human
agcuuugcuaccaaagcaccu

SEQ ID NO: 2819814 - RNA, 16 nt, Human
agcuuugcuaccaaag

SEQ ID NO: 2819815 - RNA, 10 nt, Human
agcuuugcua

SEQ ID NO: 2819816 - RNA, 22 nt, Human
agcuuuccccaugucucgacuc

SEQ ID NO: 2819817 - RNA, 21 nt, Human
agcuuucccaaauaaacucua

SEQ ID NO: 2819818 - RNA, 22 nt, Human
agcugcccuccuuguccaccca

SEQ ID NO: 2819819 - RNA, 17 nt, Human
ugcccuguucucuacca

SEQ ID NO: 2819820 - RNA, 19 nt, Human
ugcccuguucucuaccaag

SEQ ID NO: 2819821 - RNA, 15 nt, Human
ugcccuuaaaucaua

SEQ ID NO: 2819822 - RNA, 19 nt, Human
ugccgaccccuaguucccu

SEQ ID NO: 2819823 - RNA, 15 nt, Human
ugccgacagaaggaa

SEQ ID NO: 2819824 - RNA, 13 nt, Human
ugccgacacuguu

SEQ ID NO: 2819825 - RNA, 13 nt, Human
ugccucagccucc

SEQ ID NO: 2819826 - RNA, 12 nt, Human
ugccucagccuc

SEQ ID NO: 2819827 - RNA, 15 nt, Human
ugccgcaaauuguac

SEQ ID NO: 2819828 - RNA, 21 nt, Human
ugccgauauacucuagaugaa

SEQ ID NO: 2819829 - RNA, 14 nt, Human
ugccgaggagccag

SEQ ID NO: 2819830 - RNA, 17 nt, Human
ugccgaggagccaggca

SEQ ID NO: 2819831 - RNA, 21 nt, Human
agcugcaagugacaucucuuu

SEQ ID NO: 2819832 - RNA, 18 nt, Human
agcugcaagugacaucuc

SEQ ID NO: 2819833 - RNA, 15 nt, Human
agcugcaagugacau

SEQ ID NO: 2819834 - RNA, 14 nt, Human
agcugcaccagagc

SEQ ID NO: 2819835 - RNA, 15 nt, Human
agcugcaccagagca

SEQ ID NO: 2819836 - RNA, 16 nt, Human
agcugcaccagagcaa

SEQ ID NO: 2819837 - RNA, 23 nt, Human
agcugcaccagagcaaccucuca

SEQ ID NO: 2819838 - RNA, 23 nt, Human
agcucuguccugggagugagcug

SEQ ID NO: 2819839 - RNA, 21 nt, Human
agcucuguccugggagugagc

SEQ ID NO: 2819840 - RNA, 16 nt, Human
agcucuguccugggag

SEQ ID NO: 2819841 - RNA, 11 nt, Human
agcugcagcuu

SEQ ID NO: 2819842 - RNA, 13 nt, Human
agcugcagcuucc

SEQ ID NO: 2819843 - RNA, 14 nt, Human
agcugcagcuuccu

SEQ ID NO: 2819844 - RNA, 15 nt, Human
agcugcagcuuccug

SEQ ID NO: 2819845 - RNA, 16 nt, Human
agcugcagcuuccugu

SEQ ID NO: 2819846 - RNA, 17 nt, Human
agcugcagcuuccuguc

SEQ ID NO: 2819847 - RNA, 13 nt, Human
agcugcagcuugg

SEQ ID NO: 2819848 - RNA, 14 nt, Human
agcugcagcuuggg

SEQ ID NO: 2819849 - RNA, 16 nt, Human
agcugcaggaaucaaa

SEQ ID NO: 2819850 - RNA, 17 nt, Human
agcugcaggaaucaaaa

SEQ ID NO: 2819851 - RNA, 20 nt, Human
agcugcaggaaucaaaaauu

SEQ ID NO: 2819852 - RNA, 22 nt, Human
agcugcaggaaucaaaaauuga

SEQ ID NO: 2819853 - RNA, 23 nt, Human
agcugcaggaaucaaaaauugaa

SEQ ID NO: 2819854 - RNA, 24 nt, Human
agcugcccacuguuucucuugagc

SEQ ID NO: 2819855 - RNA, 22 nt, Human
agcugcccauuucgugagcccc

SEQ ID NO: 2819856 - RNA, 19 nt, Human
agcugccaucgcugugaug

SEQ ID NO: 2819857 - RNA, 14 nt, Human
agcugccccucucu

SEQ ID NO: 2819858 - RNA, 15 nt, Human
agcugccccucucug

SEQ ID NO: 2819859 - RNA, 16 nt, Human
agcugccccucucugg

SEQ ID NO: 2819860 - RNA, 18 nt, Human
agcugccccucucugggc

SEQ ID NO: 2819861 - RNA, 16 nt, Human
agcugcccuaaauaac

SEQ ID NO: 2819862 - RNA, 22 nt, Human
agcugcccuaaauaacccuuca

SEQ ID NO: 2819863 - RNA, 11 nt, Human
agcugcccucc

SEQ ID NO: 2819864 - RNA, 21 nt, Human
ugccaucaacuacuauucaaa

SEQ ID NO: 2819865 - RNA, 20 nt, Human
ugccauagaguuuaacacaa

SEQ ID NO: 2819866 - RNA, 22 nt, Human
ugccauacuuugucugaaaaau

SEQ ID NO: 2819867 - RNA, 17 nt, Human
ugccauacuuugucuga

SEQ ID NO: 2819868 - RNA, 18 nt, Human
ugccauacuuugucugaa

SEQ ID NO: 2819869 - RNA, 13 nt, Human
ugccauagaguuu

SEQ ID NO: 2819870 - RNA, 18 nt, Human
ugccauagaguuuaacac

SEQ ID NO: 2819871 - RNA, 15 nt, Human
ugccauacuuugucu

SEQ ID NO: 2819872 - RNA, 22 nt, Human
ugccauacaucaguuauucauu

SEQ ID NO: 2819873 - RNA, 23 nt, Human
ugccauacaucaguuauucauuc

SEQ ID NO: 2819874 - RNA, 14 nt, Human
ugccauaauacaaa

SEQ ID NO: 2819875 - RNA, 16 nt, Human
ugccauaauacaaaag

SEQ ID NO: 2819876 - RNA, 16 nt, Human
ugccauagucacaugg

SEQ ID NO: 2819877 - RNA, 21 nt, Human
ugccauagaguuuaacacaag

SEQ ID NO: 2819878 - RNA, 17 nt, Human
ugccauagucaaagaga

SEQ ID NO: 2819879 - RNA, 18 nt, Human
ugccauagucaaagagag

SEQ ID NO: 2819880 - RNA, 24 nt, Human
ugccauagucaaagagaguuuuua

SEQ ID NO: 2819881 - RNA, 15 nt, Human
ugccaucaaacugua

SEQ ID NO: 2819882 - RNA, 17 nt, Human
ugccaucaaacuguaaa

SEQ ID NO: 2819883 - RNA, 18 nt, Human
ugccaucaaacuguaaaa

SEQ ID NO: 2819884 - RNA, 15 nt, Human
agcuccuucuguccu

SEQ ID NO: 2819885 - RNA, 13 nt, Human
agcucccauucua

SEQ ID NO: 2819886 - RNA, 20 nt, Human
agcucccauucuauguguca

SEQ ID NO: 2819887 - RNA, 16 nt, Human
agcuccaucuccacuc

SEQ ID NO: 2819888 - RNA, 13 nt, Human
agcuccaucucca

SEQ ID NO: 2819889 - RNA, 15 nt, Human
agcuccaucuccacu

SEQ ID NO: 2819890 - RNA, 20 nt, Human
agcucuggcuuccagaaaac

SEQ ID NO: 2819891 - RNA, 12 nt, Human
agcucuggcuuc

SEQ ID NO: 2819892 - RNA, 23 nt, Human
agcucugaagucacaucacagga

SEQ ID NO: 2819893 - RNA, 21 nt, Human
agcucugaagucacaucacag

SEQ ID NO: 2819894 - RNA, 14 nt, Human
agcucuguccuggg

SEQ ID NO: 2819895 - RNA, 12 nt, Human
agcucucuguau

SEQ ID NO: 2819896 - RNA, 17 nt, Human
agcucucuguauaaaca

SEQ ID NO: 2819897 - RNA, 18 nt, Human
agcucucuguauaaacau

SEQ ID NO: 2819898 - RNA, 19 nt, Human
agcucucuguauaaacauu

SEQ ID NO: 2819899 - RNA, 21 nt, Human
agcucucuguauaaacauuaa

SEQ ID NO: 2819900 - RNA, 19 nt, Human
agcucucuucaaugacaua

SEQ ID NO: 2819901 - RNA, 16 nt, Human
agcucucuugccgagg

SEQ ID NO: 2819902 - RNA, 21 nt, Human
agcucucuugccgaggagcca

SEQ ID NO: 2819903 - RNA, 16 nt, Human
agcucggggagccuua

SEQ ID NO: 2819904 - RNA, 21 nt, Human
agcuccuucuguccuacucug

SEQ ID NO: 2819905 - RNA, 16 nt, Human
agcuccuucuguccua

SEQ ID NO: 2819906 - RNA, 15 nt, Human
agcucggggagccuu

SEQ ID NO: 2819907 - RNA, 14 nt, Human
agcucgcacccccc

SEQ ID NO: 2819908 - RNA, 19 nt, Human
agcucgcaccccccuguuc

SEQ ID NO: 2819909 - RNA, 20 nt, Human
agcucgcaccccccuguucu

SEQ ID NO: 2819910 - RNA, 21 nt, Human
agcucgcaccccccuguucua

SEQ ID NO: 2819911 - RNA, 22 nt, Human
agcucgcaccccccuguucuaa

SEQ ID NO: 2819912 - RNA, 17 nt, Human
agcucgaauuaagaaua

SEQ ID NO: 2819913 - RNA, 19 nt, Human
agcucgaauuaagaauaug

SEQ ID NO: 2819914 - RNA, 13 nt, Human
agcucgauccaaa

SEQ ID NO: 2819915 - RNA, 16 nt, Human
agcucgauccaaauug

SEQ ID NO: 2819916 - RNA, 22 nt, Human
ugccuguggaagagugugugug

SEQ ID NO: 2819917 - RNA, 11 nt, Human
ugccuguggcu

SEQ ID NO: 2819918 - RNA, 13 nt, Human
ugccuguggcugc

SEQ ID NO: 2819919 - RNA, 14 nt, Human
ugccuguggcugcg

SEQ ID NO: 2819920 - RNA, 15 nt, Human
ugccuguguauggaa

SEQ ID NO: 2819921 - RNA, 14 nt, Human
ugccuguucccauu

SEQ ID NO: 2819922 - RNA, 15 nt, Human
ugccuuaaagaaagu

SEQ ID NO: 2819923 - RNA, 19 nt, Human
ugccuugggcugcuccuca

SEQ ID NO: 2819924 - RNA, 17 nt, Human
ugccuugggcugcuccu

SEQ ID NO: 2819925 - RNA, 16 nt, Human
ugccuugggcugcucc

SEQ ID NO: 2819926 - RNA, 23 nt, Human
ugccuuaauaagaaugguugccu

SEQ ID NO: 2819927 - RNA, 14 nt, Human
ugccuuacacaaag

SEQ ID NO: 2819928 - RNA, 22 nt, Human
agcuguggaggauugcuaucug

SEQ ID NO: 2819929 - RNA, 23 nt, Human
agcugugcucuggacaggcaugu

SEQ ID NO: 2819930 - RNA, 18 nt, Human
agcugugcucuggacagg

SEQ ID NO: 2819931 - RNA, 17 nt, Human
agcugugcucuggacag

SEQ ID NO: 2819932 - RNA, 16 nt, Human
agcugggacuacaggu

SEQ ID NO: 2819933 - RNA, 23 nt, Human
agcugggacuacaggcacccacc

SEQ ID NO: 2819934 - RNA, 20 nt, Human
agcugggacuacaggcaccc

SEQ ID NO: 2819935 - RNA, 17 nt, Human
ugccucugccucugaca

SEQ ID NO: 2819936 - RNA, 20 nt, Human
ugccucugccucugacacac

SEQ ID NO: 2819937 - RNA, 18 nt, Human
ugccucugccucugacac

SEQ ID NO: 2819938 - RNA, 14 nt, Human
ugccucagccuccc

SEQ ID NO: 2819939 - RNA, 17 nt, Human
ugccuccagaagcacug

SEQ ID NO: 2819940 - RNA, 23 nt, Human
ugccugcccaggccccugccacc

SEQ ID NO: 2819941 - RNA, 22 nt, Human
ugccugcccaggccccugccac

SEQ ID NO: 2819942 - RNA, 20 nt, Human
ugccugcccaggccccugcc

SEQ ID NO: 2819943 - RNA, 16 nt, Human
agcugccuguucagcu

SEQ ID NO: 2819944 - RNA, 14 nt, Human
agcugccuguucag

SEQ ID NO: 2819945 - RNA, 18 nt, Human
agcugccuguucagcucc

SEQ ID NO: 2819946 - RNA, 23 nt, Human
ugccuggaagcuuuguccccugc

SEQ ID NO: 2819947 - RNA, 17 nt, Human
agcugcuggcuugcagu

SEQ ID NO: 2819948 - RNA, 12 nt, Human
agcugcugucuu

SEQ ID NO: 2819949 - RNA, 18 nt, Human
agcugcugucuucuggac

SEQ ID NO: 2819950 - RNA, 14 nt, Human
agcugcuggcuugc

SEQ ID NO: 2819951 - RNA, 14 nt, Human
agcugcuggagacu

SEQ ID NO: 2819952 - RNA, 23 nt, Human
agcugcuggagacuccuaggcag

SEQ ID NO: 2819953 - RNA, 13 nt, Human
agcugcugcucug

SEQ ID NO: 2819954 - RNA, 21 nt, Human
ugccuggacauuugccuugcu

SEQ ID NO: 2819955 - RNA, 16 nt, Human
agcuggccucucuagc

SEQ ID NO: 2819956 - RNA, 12 nt, Human
agcuggccugag

SEQ ID NO: 2819957 - RNA, 15 nt, Human
agcuggccuggacag

SEQ ID NO: 2819958 - RNA, 21 nt, Human
agcuggccugagaggggaagc

SEQ ID NO: 2819959 - RNA, 19 nt, Human
agcuggccgugggccuggg

SEQ ID NO: 2819960 - RNA, 14 nt, Human
agcuggccucuacc

SEQ ID NO: 2819961 - RNA, 14 nt, Human
agcuggcucaccuu

SEQ ID NO: 2819962 - RNA, 21 nt, Human
agcuggcgucaugcaaaguca

SEQ ID NO: 2819963 - RNA, 23 nt, Human
agcuggccgaggguccuggcucc

SEQ ID NO: 2819964 - RNA, 18 nt, Human
agcuggccgggagccuga

SEQ ID NO: 2819965 - RNA, 19 nt, Human
agcuggccgggagccugau

SEQ ID NO: 2819966 - RNA, 16 nt, Human
agcuggccgugggccu

SEQ ID NO: 2819967 - RNA, 17 nt, Human
agcuggccgugggccug

SEQ ID NO: 2819968 - RNA, 16 nt, Human
uguaaaggagucaaaa

SEQ ID NO: 2819969 - RNA, 18 nt, Human
uguaaaguauguaaacag

SEQ ID NO: 2819970 - RNA, 13 nt, Human
uguaaagugaaga

SEQ ID NO: 2819971 - RNA, 15 nt, Human
uguaaagugaagaau

SEQ ID NO: 2819972 - RNA, 19 nt, Human
uguaaagugaagaauccuu

SEQ ID NO: 2819973 - RNA, 20 nt, Human
uguaaagugaagaauccuuu

SEQ ID NO: 2819974 - RNA, 21 nt, Human
uguaaagugaagaauccuuuu

SEQ ID NO: 2819975 - RNA, 21 nt, Human
uguaaaggagucaaaacuaca

SEQ ID NO: 2819976 - RNA, 19 nt, Human
uguaaaggagucaaaacua

SEQ ID NO: 2819977 - RNA, 14 nt, Human
uguaaauaaaaaga

SEQ ID NO: 2819978 - RNA, 19 nt, Human
uguaaauaaagaacuagca

SEQ ID NO: 2819979 - RNA, 16 nt, Human
uguaaauagcucaggu

SEQ ID NO: 2819980 - RNA, 15 nt, Human
uguaaauagcucagg

SEQ ID NO: 2819981 - RNA, 16 nt, Human
uguaaauaguauuuga

SEQ ID NO: 2819982 - RNA, 17 nt, Human
aggugauagcauugcuu

SEQ ID NO: 2819983 - RNA, 18 nt, Human
aggugauagcauugcuuu

SEQ ID NO: 2819984 - RNA, 21 nt, Human
uguaaauacuguuuuuaacaa

SEQ ID NO: 2819985 - RNA, 17 nt, Human
ugguuugguuccucucu

SEQ ID NO: 2819986 - RNA, 23 nt, Human
ugguuuggucccugguuuucagu

SEQ ID NO: 2819987 - RNA, 19 nt, Human
ugguuuggccaucucugga

SEQ ID NO: 2819988 - RNA, 20 nt, Human
ugguuuggccaucucuggau

SEQ ID NO: 2819989 - RNA, 20 nt, Human
ugguuugggaauauccaugu

SEQ ID NO: 2819990 - RNA, 14 nt, Human
ugguuaucacacca

SEQ ID NO: 2819991 - RNA, 13 nt, Human
ugguuaugaaaga

SEQ ID NO: 2819992 - RNA, 15 nt, Human
ugguuaugaaagaau

SEQ ID NO: 2819993 - RNA, 18 nt, Human
ugguuaugaaagaauaua

SEQ ID NO: 2819994 - RNA, 19 nt, Human
ugguuaugaaagaauauau

SEQ ID NO: 2819995 - RNA, 20 nt, Human
ugguuaugaaagaauauauu

SEQ ID NO: 2819996 - RNA, 18 nt, Human
ugguuauacaaguucuug

SEQ ID NO: 2819997 - RNA, 17 nt, Human
ugguuucccccuucuac

SEQ ID NO: 2819998 - RNA, 13 nt, Human
ugguuuccugccc

SEQ ID NO: 2819999 - RNA, 12 nt, Human
ugguuuccugcc

SEQ ID NO: 2820000 - RNA, 20 nt, Human
ugguuuccugcccugggagg

SEQ ID NO: 2820001 - RNA, 20 nt, Human
ugguuucccccuucuacauu

SEQ ID NO: 2820002 - RNA, 15 nt, Human
ugguuuccugcccug

SEQ ID NO: 2820003 - RNA, 14 nt, Human
ugguuuccugcccu

SEQ ID NO: 2820004 - RNA, 20 nt, Human
aggugugcucugaucaucca

SEQ ID NO: 2820005 - RNA, 15 nt, Human
aggugugcucugauc

SEQ ID NO: 2820006 - RNA, 17 nt, Human
aggugugaaccaccaca

SEQ ID NO: 2820007 - RNA, 17 nt, Human
agguggggcgaggcagg

SEQ ID NO: 2820008 - RNA, 18 nt, Human
agguggggcgaggcaggc

SEQ ID NO: 2820009 - RNA, 22 nt, Human
agguucuguuuauggccacauu

SEQ ID NO: 2820010 - RNA, 15 nt, Human
agguucuuaaaagug

SEQ ID NO: 2820011 - RNA, 14 nt, Human
agguucucuccucc

SEQ ID NO: 2820012 - RNA, 17 nt, Human
agguucucuccucccca

SEQ ID NO: 2820013 - RNA, 22 nt, Human
agguucucuccuccccaaggag

SEQ ID NO: 2820014 - RNA, 18 nt, Human
agguucucucucacugcc

SEQ ID NO: 2820015 - RNA, 14 nt, Human
agguucugccugcu

SEQ ID NO: 2820016 - RNA, 17 nt, Human
agguucugccugcuuug

SEQ ID NO: 2820017 - RNA, 12 nt, Human
aggugugcucug

SEQ ID NO: 2820018 - RNA, 21 nt, Human
aggugugguguaauuuauaaa

SEQ ID NO: 2820019 - RNA, 16 nt, Human
aggugugugagacuac

SEQ ID NO: 2820020 - RNA, 13 nt, Human
aggugccuggagu

SEQ ID NO: 2820021 - RNA, 17 nt, Human
agguucuagguuucaaa

SEQ ID NO: 2820022 - RNA, 19 nt, Human
agguucuagguuucaaaga

SEQ ID NO: 2820023 - RNA, 23 nt, Human
agguggggcagcuugaggguugg

SEQ ID NO: 2820024 - RNA, 16 nt, Human
agguggggcagcuuga

SEQ ID NO: 2820025 - RNA, 17 nt, Human
aggugccugucccaccc

SEQ ID NO: 2820026 - RNA, 18 nt, Human
aggugccugucccacccc

SEQ ID NO: 2820027 - RNA, 20 nt, Human
aggugauccacccaccucag

SEQ ID NO: 2820028 - RNA, 14 nt, Human
aggugauccaccca

SEQ ID NO: 2820029 - RNA, 23 nt, Human
aggugccacuuuacccaccuaga

SEQ ID NO: 2820030 - RNA, 21 nt, Human
aggugccagccugaggcagcc

SEQ ID NO: 2820031 - RNA, 20 nt, Human
uggugcccuguucucuacca

SEQ ID NO: 2820032 - RNA, 16 nt, Human
aggugauagcauugcu

SEQ ID NO: 2820033 - RNA, 12 nt, Human
uggugccuggcc

SEQ ID NO: 2820034 - RNA, 13 nt, Human
uggugccuccaga

SEQ ID NO: 2820035 - RNA, 13 nt, Human
uggugccuggccu

SEQ ID NO: 2820036 - RNA, 14 nt, Human
uggugccuggccug

SEQ ID NO: 2820037 - RNA, 17 nt, Human
uggugccuggccuggca

SEQ ID NO: 2820038 - RNA, 18 nt, Human
uggugccuggccuggcac

SEQ ID NO: 2820039 - RNA, 19 nt, Human
uggugccuggccuggcaca

SEQ ID NO: 2820040 - RNA, 22 nt, Human
uggugccuggccuggcacacau

SEQ ID NO: 2820041 - RNA, 23 nt, Human
uggugccuggccuggcacacauc

SEQ ID NO: 2820042 - RNA, 24 nt, Human
uggugccuggccuggcacacauca

SEQ ID NO: 2820043 - RNA, 17 nt, Human
uggugcgaucuggguuc

SEQ ID NO: 2820044 - RNA, 16 nt, Human
uggugcuacgccugca

SEQ ID NO: 2820045 - RNA, 16 nt, Human
uggugcgaucuggguu

SEQ ID NO: 2820046 - RNA, 23 nt, Human
uggugcugaguagaugcgcagcc

SEQ ID NO: 2820047 - RNA, 18 nt, Human
uggugcugccacacuuca

SEQ ID NO: 2820048 - RNA, 11 nt, Human
uggugcuggga

SEQ ID NO: 2820049 - RNA, 13 nt, Human
uggugcugggaac

SEQ ID NO: 2820050 - RNA, 18 nt, Human
uggugcucauuuaaauau

SEQ ID NO: 2820051 - RNA, 21 nt, Human
uggugcucaccaugcuuccag

SEQ ID NO: 2820052 - RNA, 13 nt, Human
uggugcugccaca

SEQ ID NO: 2820053 - RNA, 15 nt, Human
ugguggcagcugcgg

SEQ ID NO: 2820054 - RNA, 13 nt, Human
ugguggcagcugc

SEQ ID NO: 2820055 - RNA, 14 nt, Human
ugguggcagcugcg

SEQ ID NO: 2820056 - RNA, 16 nt, Human
ugguggcaagagcccc

SEQ ID NO: 2820057 - RNA, 18 nt, Human
ugguggacaguccuggga

SEQ ID NO: 2820058 - RNA, 17 nt, Human
ugguggacaguccuggg

SEQ ID NO: 2820059 - RNA, 16 nt, Human
ugguggacaguccugg

SEQ ID NO: 2820060 - RNA, 21 nt, Human
ugguggagaggcccggccucu

SEQ ID NO: 2820061 - RNA, 19 nt, Human
uggugcuuccaaauauugu

SEQ ID NO: 2820062 - RNA, 16 nt, Human
uggugcuuaaguucca

SEQ ID NO: 2820063 - RNA, 17 nt, Human
uggugcuuaaguuccag

SEQ ID NO: 2820064 - RNA, 19 nt, Human
uggugcuuaaguuccagca

SEQ ID NO: 2820065 - RNA, 14 nt, Human
ugguuagaaaugca

SEQ ID NO: 2820066 - RNA, 13 nt, Human
ugguuagaaaugc

SEQ ID NO: 2820067 - RNA, 19 nt, Human
uggugucuggauucccagg

SEQ ID NO: 2820068 - RNA, 15 nt, Human
uggugugaaagucag

SEQ ID NO: 2820069 - RNA, 13 nt, Human
uggugucugccug

SEQ ID NO: 2820070 - RNA, 14 nt, Human
uggugucugccugu

SEQ ID NO: 2820071 - RNA, 15 nt, Human
ugguggcacaggccc

SEQ ID NO: 2820072 - RNA, 13 nt, Human
aggugagaaaaaa

SEQ ID NO: 2820073 - RNA, 14 nt, Human
aggugagaaaaaaa

SEQ ID NO: 2820074 - RNA, 15 nt, Human
aggugagaaaaaaac

SEQ ID NO: 2820075 - RNA, 18 nt, Human
aggugacccugaugaaaa

SEQ ID NO: 2820076 - RNA, 20 nt, Human
aggugagcccauggcccucc

SEQ ID NO: 2820077 - RNA, 18 nt, Human
aggugaggagcagagcag

SEQ ID NO: 2820078 - RNA, 13 nt, Human
aggugaggccugu

SEQ ID NO: 2820079 - RNA, 14 nt, Human
aggugaggccuguc

SEQ ID NO: 2820080 - RNA, 17 nt, Human
aggugaggccugucugu

SEQ ID NO: 2820081 - RNA, 20 nt, Human
aggugaggccugucugugac

SEQ ID NO: 2820082 - RNA, 15 nt, Human
aggugacagagugag

SEQ ID NO: 2820083 - RNA, 13 nt, Human
aggugacagagug

SEQ ID NO: 2820084 - RNA, 17 nt, Human
aggucuugaacuccugg

SEQ ID NO: 2820085 - RNA, 21 nt, Human
aggucuucaucgaaucuacua

SEQ ID NO: 2820086 - RNA, 20 nt, Human
aggucuucaucgaaucuacu

SEQ ID NO: 2820087 - RNA, 13 nt, Human
aggugaccccagg

SEQ ID NO: 2820088 - RNA, 14 nt, Human
aggugacaugugaa

SEQ ID NO: 2820089 - RNA, 15 nt, Human
aggugacaugugaaa

SEQ ID NO: 2820090 - RNA, 16 nt, Human
aggugacaugugaaac

SEQ ID NO: 2820091 - RNA, 20 nt, Human
aggugacaugugaaaccuuu

SEQ ID NO: 2820092 - RNA, 22 nt, Human
aggugacagagugagacucugu

SEQ ID NO: 2820093 - RNA, 15 nt, Human
aggugacagcagucg

SEQ ID NO: 2820094 - RNA, 23 nt, Human
aggugaauuaauuaaacauugug

SEQ ID NO: 2820095 - RNA, 15 nt, Human
aggugacacuauagu

SEQ ID NO: 2820096 - RNA, 19 nt, Human
aggugacacuauaguuuaa

SEQ ID NO: 2820097 - RNA, 18 nt, Human
aggugacagaaggaccag

SEQ ID NO: 2820098 - RNA, 19 nt, Human
aggugacagaaggaccagc

SEQ ID NO: 2820099 - RNA, 18 nt, Human
aggucagagccugcaguu

SEQ ID NO: 2820100 - RNA, 17 nt, Human
aggucagagccugcagu

SEQ ID NO: 2820101 - RNA, 15 nt, Human
aggucagagccugca

SEQ ID NO: 2820102 - RNA, 14 nt, Human
aggucagagccugc

SEQ ID NO: 2820103 - RNA, 13 nt, Human
aggucagagccug

SEQ ID NO: 2820104 - RNA, 16 nt, Human
aggucuugaacuccug

SEQ ID NO: 2820105 - RNA, 11 nt, Human
agguccagccc

SEQ ID NO: 2820106 - RNA, 12 nt, Human
agguccagccca

SEQ ID NO: 2820107 - RNA, 14 nt, Human
agguccagcccauc

SEQ ID NO: 2820108 - RNA, 15 nt, Human
agguccagcccaucu

SEQ ID NO: 2820109 - RNA, 16 nt, Human
agguccagcccaucuc

SEQ ID NO: 2820110 - RNA, 23 nt, Human
agguccagcccaucucggagcau

SEQ ID NO: 2820111 - RNA, 14 nt, Human
agguccacaggucu

SEQ ID NO: 2820112 - RNA, 15 nt, Human
agguccacaggucua

SEQ ID NO: 2820113 - RNA, 18 nt, Human
agguccacaggucuagac

SEQ ID NO: 2820114 - RNA, 19 nt, Human
agguccacaggucuagacu

SEQ ID NO: 2820115 - RNA, 20 nt, Human
agguccacaggucuagacua

SEQ ID NO: 2820116 - RNA, 19 nt, Human
agguccacaacacacagau

SEQ ID NO: 2820117 - RNA, 12 nt, Human
aggucaggaaac

SEQ ID NO: 2820118 - RNA, 22 nt, Human
uggucacuuaaaaugugcagua

SEQ ID NO: 2820119 - RNA, 20 nt, Human
uguaguguccauuuugugaa

SEQ ID NO: 2820120 - RNA, 21 nt, Human
uguaguguccauuuugugaag

SEQ ID NO: 2820121 - RNA, 17 nt, Human
uguaucaaacccacgau

SEQ ID NO: 2820122 - RNA, 16 nt, Human
uguaugugccauuuau

SEQ ID NO: 2820123 - RNA, 11 nt, Human
uguaugucugu

SEQ ID NO: 2820124 - RNA, 13 nt, Human
uguaugucuguca

SEQ ID NO: 2820125 - RNA, 14 nt, Human
uguaugucuuggac

SEQ ID NO: 2820126 - RNA, 19 nt, Human
uguaugucuuggacacugu

SEQ ID NO: 2820127 - RNA, 14 nt, Human
uguaugugagagau

SEQ ID NO: 2820128 - RNA, 18 nt, Human
uguaugugagagauucug

SEQ ID NO: 2820129 - RNA, 21 nt, Human
uguaugucagacauccauguu

SEQ ID NO: 2820130 - RNA, 17 nt, Human
uguauguauuagugaua

SEQ ID NO: 2820131 - RNA, 22 nt, Human
uguauccaacaagccagaauca

SEQ ID NO: 2820132 - RNA, 21 nt, Human
uguaucaucuggauaggagcc

SEQ ID NO: 2820133 - RNA, 22 nt, Human
uguaucaugugcuagauuggag

SEQ ID NO: 2820134 - RNA, 17 nt, Human
uguaucauagaaaugua

SEQ ID NO: 2820135 - RNA, 16 nt, Human
uguaucauagaaaugu

SEQ ID NO: 2820136 - RNA, 15 nt, Human
uguaucauagaaaug

SEQ ID NO: 2820137 - RNA, 19 nt, Human
uguaucagaagagagggga

SEQ ID NO: 2820138 - RNA, 20 nt, Human
uguauucuagcuaauguaau

SEQ ID NO: 2820139 - RNA, 17 nt, Human
uguauucccaguuacuu

SEQ ID NO: 2820140 - RNA, 17 nt, Human
uguauuaauaaauagag

SEQ ID NO: 2820141 - RNA, 20 nt, Human
uguauuaauaaauagagcaa

SEQ ID NO: 2820142 - RNA, 22 nt, Human
uguauuaauaaauagagcaauu

SEQ ID NO: 2820143 - RNA, 21 nt, Human
uguauguuauuauauuccgua

SEQ ID NO: 2820144 - RNA, 14 nt, Human
ugucaaaaaaaaaa

SEQ ID NO: 2820145 - RNA, 22 nt, Human
uguauucuagcuaauguaauaa

SEQ ID NO: 2820146 - RNA, 13 nt, Human
ugucaaaacacug

SEQ ID NO: 2820147 - RNA, 14 nt, Human
ugucaaaacacugu

SEQ ID NO: 2820148 - RNA, 15 nt, Human
ugucaaaacacugug

SEQ ID NO: 2820149 - RNA, 16 nt, Human
ugucaaaacacugugg

SEQ ID NO: 2820150 - RNA, 17 nt, Human
ugucaaaacacugugga

SEQ ID NO: 2820151 - RNA, 18 nt, Human
ugucaaaacacuguggaa

SEQ ID NO: 2820152 - RNA, 16 nt, Human
ugucaaaaguuggacu

SEQ ID NO: 2820153 - RNA, 17 nt, Human
ugucaaaaguuggacua

SEQ ID NO: 2820154 - RNA, 20 nt, Human
ugucaaaaguuggacuaaau

SEQ ID NO: 2820155 - RNA, 21 nt, Human
ugucaaaaguuggacuaaaug

SEQ ID NO: 2820156 - RNA, 22 nt, Human
ugucaaaaguuggacuaaaugc

SEQ ID NO: 2820157 - RNA, 16 nt, Human
ugucaagucucugcug

SEQ ID NO: 2820158 - RNA, 16 nt, Human
ugucaagccugugcaa

SEQ ID NO: 2820159 - RNA, 17 nt, Human
ugucaagccugugcaaa

SEQ ID NO: 2820160 - RNA, 18 nt, Human
ugucaagccugugcaaaa

SEQ ID NO: 2820161 - RNA, 20 nt, Human
ugucaagccugugcaaaaaa

SEQ ID NO: 2820162 - RNA, 18 nt, Human
aguauuacuucugcuaca

SEQ ID NO: 2820163 - RNA, 17 nt, Human
aguaugguggcuggguu

SEQ ID NO: 2820164 - RNA, 15 nt, Human
aguauuacuucugcu

SEQ ID NO: 2820165 - RNA, 16 nt, Human
aguaugguggcugggu

SEQ ID NO: 2820166 - RNA, 15 nt, Human
aguaugguggcuggg

SEQ ID NO: 2820167 - RNA, 18 nt, Human
ugucaagucucugcuggc

SEQ ID NO: 2820168 - RNA, 17 nt, Human
ugucaagucucugcugg

SEQ ID NO: 2820169 - RNA, 19 nt, Human
ugucaagucucugcuggcc

SEQ ID NO: 2820170 - RNA, 18 nt, Human
ugucaaguuccuuugggu

SEQ ID NO: 2820171 - RNA, 19 nt, Human
ugucaagugggaucuguca

SEQ ID NO: 2820172 - RNA, 16 nt, Human
aguaguaauagagcaa

SEQ ID NO: 2820173 - RNA, 13 nt, Human
agucaccucuguc

SEQ ID NO: 2820174 - RNA, 13 nt, Human
agucaccuuccag

SEQ ID NO: 2820175 - RNA, 14 nt, Human
agucaccuuccagg

SEQ ID NO: 2820176 - RNA, 20 nt, Human
agucaccuuccaggaccccu

SEQ ID NO: 2820177 - RNA, 13 nt, Human
agucaccuucccu

SEQ ID NO: 2820178 - RNA, 14 nt, Human
agucaccuucccuu

SEQ ID NO: 2820179 - RNA, 15 nt, Human
agucaccuucccuug

SEQ ID NO: 2820180 - RNA, 16 nt, Human
agucaccuucccuugc

SEQ ID NO: 2820181 - RNA, 17 nt, Human
agucaccuucccuugcc

SEQ ID NO: 2820182 - RNA, 18 nt, Human
agucaccuucccuugcca

SEQ ID NO: 2820183 - RNA, 21 nt, Human
agucaccuucccuugccacuu

SEQ ID NO: 2820184 - RNA, 23 nt, Human
agucaccuucccuugccacuuug

SEQ ID NO: 2820185 - RNA, 20 nt, Human
agucacccuaccugugccug

SEQ ID NO: 2820186 - RNA, 15 nt, Human
agucacccuagcccu

SEQ ID NO: 2820187 - RNA, 23 nt, Human
agucacccuagcccucucccucu

SEQ ID NO: 2820188 - RNA, 23 nt, Human
agucacacagugagucgaggaca

SEQ ID NO: 2820189 - RNA, 15 nt, Human
agucacacagugagu

SEQ ID NO: 2820190 - RNA, 16 nt, Human
agucacacgggggcag

SEQ ID NO: 2820191 - RNA, 19 nt, Human
agucacccuaccugugccu

SEQ ID NO: 2820192 - RNA, 19 nt, Human
agucacacgggggcagcug

SEQ ID NO: 2820193 - RNA, 16 nt, Human
agucacacugcuagca

SEQ ID NO: 2820194 - RNA, 19 nt, Human
agucacacugcuagcaaau

SEQ ID NO: 2820195 - RNA, 23 nt, Human
agucacacaguauuacuucugcu

SEQ ID NO: 2820196 - RNA, 14 nt, Human
aguaugguggcugg

SEQ ID NO: 2820197 - RNA, 18 nt, Human
aguauucuugucaaaaaa

SEQ ID NO: 2820198 - RNA, 15 nt, Human
aguauucuugucaaa

SEQ ID NO: 2820199 - RNA, 14 nt, Human
aguaauagagcaaa

SEQ ID NO: 2820200 - RNA, 19 nt, Human
aguaauaggagcuuccagc

SEQ ID NO: 2820201 - RNA, 11 nt, Human
aguaauauaau

SEQ ID NO: 2820202 - RNA, 14 nt, Human
aguaaaacuugcug

SEQ ID NO: 2820203 - RNA, 11 nt, Human
aguaaaagaaa

SEQ ID NO: 2820204 - RNA, 13 nt, Human
aguaaaagaaacc

SEQ ID NO: 2820205 - RNA, 20 nt, Human
aguaaaagaaaccacuucug

SEQ ID NO: 2820206 - RNA, 20 nt, Human
agguuuuuccuuauuugcuu

SEQ ID NO: 2820207 - RNA, 19 nt, Human
agguuuucacauaaaugca

SEQ ID NO: 2820208 - RNA, 23 nt, Human
agguuuuagguucuaaaguucua

SEQ ID NO: 2820209 - RNA, 16 nt, Human
agguuuuagguucuaa

SEQ ID NO: 2820210 - RNA, 17 nt, Human
agguuuuagguucuaaa

SEQ ID NO: 2820211 - RNA, 18 nt, Human
agguuuuagguucuaaag

SEQ ID NO: 2820212 - RNA, 19 nt, Human
agguuuuagguucuaaagu

SEQ ID NO: 2820213 - RNA, 18 nt, Human
uguagagccagggucuca

SEQ ID NO: 2820214 - RNA, 16 nt, Human
uguagagccagggucu

SEQ ID NO: 2820215 - RNA, 17 nt, Human
agguuugucaucagaug

SEQ ID NO: 2820216 - RNA, 23 nt, Human
agguuugucgggcaccagccagc

SEQ ID NO: 2820217 - RNA, 14 nt, Human
uguagagcuucugg

SEQ ID NO: 2820218 - RNA, 19 nt, Human
agguuuuaagugguuugau

SEQ ID NO: 2820219 - RNA, 14 nt, Human
agguuuuaaguugu

SEQ ID NO: 2820220 - RNA, 15 nt, Human
agguuuguguuuucu

SEQ ID NO: 2820221 - RNA, 19 nt, Human
agguuuuaaguuguuugca

SEQ ID NO: 2820222 - RNA, 14 nt, Human
agguuuuagguucu

SEQ ID NO: 2820223 - RNA, 15 nt, Human
agguuuuagguucua

SEQ ID NO: 2820224 - RNA, 15 nt, Human
uguacuuugcuugcu

SEQ ID NO: 2820225 - RNA, 18 nt, Human
uguacuuugcuugcucau

SEQ ID NO: 2820226 - RNA, 22 nt, Human
uguacuuggaguauuggggucu

SEQ ID NO: 2820227 - RNA, 17 nt, Human
uguacuugguccaacug

SEQ ID NO: 2820228 - RNA, 20 nt, Human
uguacuugguccaacugcaa

SEQ ID NO: 2820229 - RNA, 14 nt, Human
uguacuuguuugca

SEQ ID NO: 2820230 - RNA, 19 nt, Human
agguuuacuagcaccugcc

SEQ ID NO: 2820231 - RNA, 15 nt, Human
uguaguauaaagaaa

SEQ ID NO: 2820232 - RNA, 23 nt, Human
uguaguagcguuuuuuaaaugua

SEQ ID NO: 2820233 - RNA, 18 nt, Human
uguaguagcccuuucugu

SEQ ID NO: 2820234 - RNA, 16 nt, Human
uguaguagcguuuuuu

SEQ ID NO: 2820235 - RNA, 22 nt, Human
uguaguagcguuuuuuaaaugu

SEQ ID NO: 2820236 - RNA, 21 nt, Human
uguaguagcguuuuuuaaaug

SEQ ID NO: 2820237 - RNA, 18 nt, Human
uguaggcaucaugcaugu

SEQ ID NO: 2820238 - RNA, 17 nt, Human
uguaggcaucaugcaug

SEQ ID NO: 2820239 - RNA, 18 nt, Human
uguaguaauugacaugug

SEQ ID NO: 2820240 - RNA, 19 nt, Human
uguaguaauugacaugugc

SEQ ID NO: 2820241 - RNA, 11 nt, Human
aguagagacag

SEQ ID NO: 2820242 - RNA, 14 nt, Human
aguagaauugcauu

SEQ ID NO: 2820243 - RNA, 15 nt, Human
aguagaauugcauug

SEQ ID NO: 2820244 - RNA, 19 nt, Human
aguagacaaucauuguuuu

SEQ ID NO: 2820245 - RNA, 15 nt, Human
aguagacacauuuaa

SEQ ID NO: 2820246 - RNA, 18 nt, Human
aguagacacauuuaagga

SEQ ID NO: 2820247 - RNA, 14 nt, Human
aguagacauuuuaa

SEQ ID NO: 2820248 - RNA, 16 nt, Human
aguagacauuuuaaca

SEQ ID NO: 2820249 - RNA, 17 nt, Human
aguagacauuuuaacaa

SEQ ID NO: 2820250 - RNA, 19 nt, Human
aguagacauuuuaacaaga

SEQ ID NO: 2820251 - RNA, 20 nt, Human
aguagacauuuuaacaagaa

SEQ ID NO: 2820252 - RNA, 22 nt, Human
aguagacauuuuaacaagaaga

SEQ ID NO: 2820253 - RNA, 23 nt, Human
aguagacauuuuaacaagaagau

SEQ ID NO: 2820254 - RNA, 15 nt, Human
aguagcccuuucugu

SEQ ID NO: 2820255 - RNA, 21 nt, Human
aguagccauguuaacaugaca

SEQ ID NO: 2820256 - RNA, 22 nt, Human
aguagccauguuaacaugacau

SEQ ID NO: 2820257 - RNA, 20 nt, Human
aguagcccuuucugugugca

SEQ ID NO: 2820258 - RNA, 21 nt, Human
aguagcccuuucugugugcac

SEQ ID NO: 2820259 - RNA, 16 nt, Human
aguagcccuuucugug

SEQ ID NO: 2820260 - RNA, 17 nt, Human
aguagcccuuucugugu

SEQ ID NO: 2820261 - RNA, 19 nt, Human
aguagcccuuucugugugc

SEQ ID NO: 2820262 - RNA, 18 nt, Human
aguagcguuuuuuaaaug

SEQ ID NO: 2820263 - RNA, 19 nt, Human
aguagcguuuuuuaaaugu

SEQ ID NO: 2820264 - RNA, 15 nt, Human
aguaauucaagaaaa

SEQ ID NO: 2820265 - RNA, 18 nt, Human
aguaauguggaagaaaau

SEQ ID NO: 2820266 - RNA, 21 nt, Human
aguaauguggaagaaaauggu

SEQ ID NO: 2820267 - RNA, 23 nt, Human
aguaauguggaagaaaaugguuu

SEQ ID NO: 2820268 - RNA, 17 nt, Human
aguaauguuauuuucuu

SEQ ID NO: 2820269 - RNA, 21 nt, Human
aguaauguuauuuucuucuaa

SEQ ID NO: 2820270 - RNA, 15 nt, Human
aguaaugaucucaaa

SEQ ID NO: 2820271 - RNA, 17 nt, Human
aguaaugcauacagaaa

SEQ ID NO: 2820272 - RNA, 18 nt, Human
aguaaugcauacagaaau

SEQ ID NO: 2820273 - RNA, 20 nt, Human
aguaaugcauacagaaauau

SEQ ID NO: 2820274 - RNA, 13 nt, Human
aguaaugccucug

SEQ ID NO: 2820275 - RNA, 20 nt, Human
aguaaugccucugucuagca

SEQ ID NO: 2820276 - RNA, 20 nt, Human
aguaauauaauggaagagaa

SEQ ID NO: 2820277 - RNA, 13 nt, Human
aguaauauauucu

SEQ ID NO: 2820278 - RNA, 15 nt, Human
aguaauauauucuga

SEQ ID NO: 2820279 - RNA, 22 nt, Human
aguaauauauucugaagcaaca

SEQ ID NO: 2820280 - RNA, 13 nt, Human
aguaaaagacauu

SEQ ID NO: 2820281 - RNA, 13 nt, Human
aguacaguggugc

SEQ ID NO: 2820282 - RNA, 17 nt, Human
aguacauauuuauuuuc

SEQ ID NO: 2820283 - RNA, 19 nt, Human
aguacauauuuauuuucuu

SEQ ID NO: 2820284 - RNA, 21 nt, Human
aguacauauuuauuuucuuuu

SEQ ID NO: 2820285 - RNA, 22 nt, Human
aguacauauuuauuuucuuuug

SEQ ID NO: 2820286 - RNA, 22 nt, Human
aguacaugauaaaugauagaca

SEQ ID NO: 2820287 - RNA, 15 nt, Human
aguaauuaugcacua

SEQ ID NO: 2820288 - RNA, 19 nt, Human
aguaauuaugcacuaaaua

SEQ ID NO: 2820289 - RNA, 21 nt, Human
aguaauuaugcacuaaauaug

SEQ ID NO: 2820290 - RNA, 12 nt, Human
aguaccuccugu

SEQ ID NO: 2820291 - RNA, 22 nt, Human
aguaccuccugucucuggccug

SEQ ID NO: 2820292 - RNA, 16 nt, Human
aguacauuuggagaca

SEQ ID NO: 2820293 - RNA, 18 nt, Human
aguacccaucuaguacuu

SEQ ID NO: 2820294 - RNA, 16 nt, Human
aguacccucucagcuc

SEQ ID NO: 2820295 - RNA, 18 nt, Human
aguacccucucagcucca

SEQ ID NO: 2820296 - RNA, 19 nt, Human
aguacccucucagcuccag

SEQ ID NO: 2820297 - RNA, 15 nt, Human
aggcccuccugugcu

SEQ ID NO: 2820298 - RNA, 17 nt, Human
aggcccuccugugcugg

SEQ ID NO: 2820299 - RNA, 21 nt, Human
aggcccuccugugcuggggga

SEQ ID NO: 2820300 - RNA, 20 nt, Human
aggcccggcuccaggcuccu

SEQ ID NO: 2820301 - RNA, 18 nt, Human
aggcccggcuccaggcuc

SEQ ID NO: 2820302 - RNA, 21 nt, Human
aggcccggcuccaggcuccuu

SEQ ID NO: 2820303 - RNA, 14 nt, Human
aggcccgucugucc

SEQ ID NO: 2820304 - RNA, 15 nt, Human
aggcccgucugucca

SEQ ID NO: 2820305 - RNA, 16 nt, Human
aggcccgucuguccau

SEQ ID NO: 2820306 - RNA, 20 nt, Human
aggcccgucuguccaucugc

SEQ ID NO: 2820307 - RNA, 21 nt, Human
aggcccgucuguccaucugcc

SEQ ID NO: 2820308 - RNA, 23 nt, Human
aggcccgucuguccaucugcccg

SEQ ID NO: 2820309 - RNA, 20 nt, Human
aggcccgcucuacaucuucu

SEQ ID NO: 2820310 - RNA, 19 nt, Human
agggaacgggguccuucaa

SEQ ID NO: 2820311 - RNA, 12 nt, Human
agggaagagcag

SEQ ID NO: 2820312 - RNA, 13 nt, Human
agggaagcuggcc

SEQ ID NO: 2820313 - RNA, 19 nt, Human
agggaagcacugccucccu

SEQ ID NO: 2820314 - RNA, 16 nt, Human
agggaagcuggccgag

SEQ ID NO: 2820315 - RNA, 16 nt, Human
agggaagcuggccuga

SEQ ID NO: 2820316 - RNA, 13 nt, Human
agggaaggacaga

SEQ ID NO: 2820317 - RNA, 14 nt, Human
agggaaggacagaa

SEQ ID NO: 2820318 - RNA, 15 nt, Human
agggaaggacagaaa

SEQ ID NO: 2820319 - RNA, 18 nt, Human
agggaaggacagaaagga

SEQ ID NO: 2820320 - RNA, 23 nt, Human
agggaagcuggccugagagggga

SEQ ID NO: 2820321 - RNA, 17 nt, Human
agggaagcuggccugag

SEQ ID NO: 2820322 - RNA, 12 nt, Human
agggaaggccug

SEQ ID NO: 2820323 - RNA, 16 nt, Human
agggaagacauuucuu

SEQ ID NO: 2820324 - RNA, 16 nt, Human
agggaaggauuuagga

SEQ ID NO: 2820325 - RNA, 12 nt, Human
agggaagggugg

SEQ ID NO: 2820326 - RNA, 16 nt, Human
agggaaguaacaguaa

SEQ ID NO: 2820327 - RNA, 22 nt, Human
agggaaggggacaaggacuagg

SEQ ID NO: 2820328 - RNA, 13 nt, Human
agggaaggggaca

SEQ ID NO: 2820329 - RNA, 14 nt, Human
agggaaggccugac

SEQ ID NO: 2820330 - RNA, 13 nt, Human
agggaaggccuga

SEQ ID NO: 2820331 - RNA, 16 nt, Human
agggaaggccugacuu

SEQ ID NO: 2820332 - RNA, 22 nt, Human
agggaauccaagccuccacagc

SEQ ID NO: 2820333 - RNA, 16 nt, Human
agggaauccccgaagg

SEQ ID NO: 2820334 - RNA, 18 nt, Human
agggaauccccgaaggug

SEQ ID NO: 2820335 - RNA, 20 nt, Human
agggaauccccgaaggugcu

SEQ ID NO: 2820336 - RNA, 23 nt, Human
agggaauccccgaaggugcugga

SEQ ID NO: 2820337 - RNA, 15 nt, Human
agggaauccuccucc

SEQ ID NO: 2820338 - RNA, 16 nt, Human
agggaauccuccucca

SEQ ID NO: 2820339 - RNA, 18 nt, Human
agggaauccuccuccagg

SEQ ID NO: 2820340 - RNA, 15 nt, Human
agggaauccugaccu

SEQ ID NO: 2820341 - RNA, 22 nt, Human
agggaaucuaauauccccaaau

SEQ ID NO: 2820342 - RNA, 13 nt, Human
agggaaugccuga

SEQ ID NO: 2820343 - RNA, 14 nt, Human
agggaaugccugag

SEQ ID NO: 2820344 - RNA, 18 nt, Human
agggaaugccugagugcc

SEQ ID NO: 2820345 - RNA, 21 nt, Human
agggaaugccugagugccugg

SEQ ID NO: 2820346 - RNA, 22 nt, Human
agggaaugccugagugccuggc

SEQ ID NO: 2820347 - RNA, 19 nt, Human
agggaauccaagccuccac

SEQ ID NO: 2820348 - RNA, 16 nt, Human
agggaauccaagccuc

SEQ ID NO: 2820349 - RNA, 15 nt, Human
agggaauccaagccu

SEQ ID NO: 2820350 - RNA, 15 nt, Human
agggaaucacaucuu

SEQ ID NO: 2820351 - RNA, 23 nt, Human
agggaauaaaauccuaagacaca

SEQ ID NO: 2820352 - RNA, 22 nt, Human
agggaaguaacaguaacgcagg

SEQ ID NO: 2820353 - RNA, 15 nt, Human
agggaaguaguccuu

SEQ ID NO: 2820354 - RNA, 15 nt, Human
agggaauuucaggaa

SEQ ID NO: 2820355 - RNA, 16 nt, Human
agggaauuucuaucua

SEQ ID NO: 2820356 - RNA, 22 nt, Human
agggaauuucuaucuaaaugau

SEQ ID NO: 2820357 - RNA, 21 nt, Human
agggaauuucuucaacucccu

SEQ ID NO: 2820358 - RNA, 16 nt, Human
agggaauugcagagua

SEQ ID NO: 2820359 - RNA, 18 nt, Human
agggaggaccacaggugu

SEQ ID NO: 2820360 - RNA, 13 nt, Human
agggaggaccugg

SEQ ID NO: 2820361 - RNA, 14 nt, Human
agggaggaccuggg

SEQ ID NO: 2820362 - RNA, 17 nt, Human
agggaggaccuggggca

SEQ ID NO: 2820363 - RNA, 20 nt, Human
agggaggaccuggggcacag

SEQ ID NO: 2820364 - RNA, 16 nt, Human
ugggacuacaggcacc

SEQ ID NO: 2820365 - RNA, 15 nt, Human
ugggacuacaggcac

SEQ ID NO: 2820366 - RNA, 14 nt, Human
ugggacuacaggca

SEQ ID NO: 2820367 - RNA, 19 nt, Human
agggaggacgggagcuggg

SEQ ID NO: 2820368 - RNA, 12 nt, Human
agggaggaggag

SEQ ID NO: 2820369 - RNA, 14 nt, Human
agggacagagccau

SEQ ID NO: 2820370 - RNA, 14 nt, Human
agggagcagacagg

SEQ ID NO: 2820371 - RNA, 13 nt, Human
agggagcacuggg

SEQ ID NO: 2820372 - RNA, 22 nt, Human
agggagauauuuaaguauaaaa

SEQ ID NO: 2820373 - RNA, 14 nt, Human
agggagauuuugag

SEQ ID NO: 2820374 - RNA, 21 nt, Human
ugggagacaagaaaucccugu

SEQ ID NO: 2820375 - RNA, 12 nt, Human
ugggagacagac

SEQ ID NO: 2820376 - RNA, 13 nt, Human
ugggagacagacc

SEQ ID NO: 2820377 - RNA, 22 nt, Human
ugggagacaagaaaucccuguu

SEQ ID NO: 2820378 - RNA, 14 nt, Human
ugggagagcccagc

SEQ ID NO: 2820379 - RNA, 18 nt, Human
ugggagagcccagccauu

SEQ ID NO: 2820380 - RNA, 14 nt, Human
ugggagagccccug

SEQ ID NO: 2820381 - RNA, 15 nt, Human
ugggagagccccugg

SEQ ID NO: 2820382 - RNA, 16 nt, Human
ugggagagccccuggg

SEQ ID NO: 2820383 - RNA, 18 nt, Human
ugggagagccccuggggc

SEQ ID NO: 2820384 - RNA, 19 nt, Human
ugggagagccccuggggcc

SEQ ID NO: 2820385 - RNA, 23 nt, Human
ugggagagccccuggggccuaga

SEQ ID NO: 2820386 - RNA, 18 nt, Human
ugggagacugcugaguca

SEQ ID NO: 2820387 - RNA, 15 nt, Human
ugggagaaccucagg

SEQ ID NO: 2820388 - RNA, 14 nt, Human
ugggagaaccucag

SEQ ID NO: 2820389 - RNA, 23 nt, Human
ugggagaaccucaggcuuccuug

SEQ ID NO: 2820390 - RNA, 22 nt, Human
ugggagaaccucaggcuuccuu

SEQ ID NO: 2820391 - RNA, 20 nt, Human
ugggacucaaugcacugaca

SEQ ID NO: 2820392 - RNA, 23 nt, Human
ugggacuggccagguuucugccc

SEQ ID NO: 2820393 - RNA, 20 nt, Human
ugggacugagccuggcccau

SEQ ID NO: 2820394 - RNA, 13 nt, Human
agggcccuaccug

SEQ ID NO: 2820395 - RNA, 13 nt, Human
agggcccugcaga

SEQ ID NO: 2820396 - RNA, 12 nt, Human
agggcccugcag

SEQ ID NO: 2820397 - RNA, 22 nt, Human
agggccgaccagaggagccuuu

SEQ ID NO: 2820398 - RNA, 23 nt, Human
agggcucagcggggacagcuccu

SEQ ID NO: 2820399 - RNA, 22 nt, Human
agggcucagcggggacagcucc

SEQ ID NO: 2820400 - RNA, 20 nt, Human
agggcucagcggggacagcu

SEQ ID NO: 2820401 - RNA, 19 nt, Human
agggcucagcggggacagc

SEQ ID NO: 2820402 - RNA, 17 nt, Human
agggccaugccugcccc

SEQ ID NO: 2820403 - RNA, 23 nt, Human
agggcccacuuguauccucuggu

SEQ ID NO: 2820404 - RNA, 15 nt, Human
agggcccacuuguau

SEQ ID NO: 2820405 - RNA, 14 nt, Human
agggccacugaaga

SEQ ID NO: 2820406 - RNA, 23 nt, Human
agggccaguccugccuggccagg

SEQ ID NO: 2820407 - RNA, 22 nt, Human
agggccaguccugccuggccag

SEQ ID NO: 2820408 - RNA, 15 nt, Human
agggccaguggggcc

SEQ ID NO: 2820409 - RNA, 17 nt, Human
agggccaguggggccug

SEQ ID NO: 2820410 - RNA, 19 nt, Human
agggccaguggggccugug

SEQ ID NO: 2820411 - RNA, 20 nt, Human
agggccaguggggccugugg

SEQ ID NO: 2820412 - RNA, 21 nt, Human
agggccaguggggccugugga

SEQ ID NO: 2820413 - RNA, 23 nt, Human
agggccaguggggccuguggaau

SEQ ID NO: 2820414 - RNA, 21 nt, Human
agggccaguccugccuggcca

SEQ ID NO: 2820415 - RNA, 19 nt, Human
agggccaguccugccuggc

SEQ ID NO: 2820416 - RNA, 19 nt, Human
agggcacauuccuugccug

SEQ ID NO: 2820417 - RNA, 20 nt, Human
agggcacauuccuugccugc

SEQ ID NO: 2820418 - RNA, 13 nt, Human
agggcagcugcua

SEQ ID NO: 2820419 - RNA, 12 nt, Human
agggcagcugcu

SEQ ID NO: 2820420 - RNA, 16 nt, Human
agggcacugguggccc

SEQ ID NO: 2820421 - RNA, 21 nt, Human
agggcaccaucacaauacaga

SEQ ID NO: 2820422 - RNA, 21 nt, Human
agggcacccuaguucuaccuc

SEQ ID NO: 2820423 - RNA, 21 nt, Human
agggcacccuguggcccuggc

SEQ ID NO: 2820424 - RNA, 21 nt, Human
agggcacauuccuugccugca

SEQ ID NO: 2820425 - RNA, 14 nt, Human
agggcacugguggc

SEQ ID NO: 2820426 - RNA, 11 nt, Human
agggcaggcau

SEQ ID NO: 2820427 - RNA, 18 nt, Human
agggcaggaaggagagcc

SEQ ID NO: 2820428 - RNA, 16 nt, Human
agggcaggaaggagag

SEQ ID NO: 2820429 - RNA, 21 nt, Human
agggcaggaaggagagccugc

SEQ ID NO: 2820430 - RNA, 19 nt, Human
agggcaggaaggagagccu

SEQ ID NO: 2820431 - RNA, 23 nt, Human
agggcaggaaggagagccugcug

SEQ ID NO: 2820432 - RNA, 23 nt, Human
agggcaugccccggccaccucug

SEQ ID NO: 2820433 - RNA, 13 nt, Human
agggcaugccuug

SEQ ID NO: 2820434 - RNA, 15 nt, Human
agggcaugccuugug

SEQ ID NO: 2820435 - RNA, 16 nt, Human
agggcaugccuugugc

SEQ ID NO: 2820436 - RNA, 22 nt, Human
agggccaccuacaauacaucug

SEQ ID NO: 2820437 - RNA, 23 nt, Human
agggccaccuacaauacaucuga

SEQ ID NO: 2820438 - RNA, 22 nt, Human
agggcaugccacgugggcucau

SEQ ID NO: 2820439 - RNA, 15 nt, Human
agggcaugccccggc

SEQ ID NO: 2820440 - RNA, 20 nt, Human
agggcaugccccggccaccu

SEQ ID NO: 2820441 - RNA, 21 nt, Human
agggcaugccccggccaccuc

SEQ ID NO: 2820442 - RNA, 22 nt, Human
agggcaugccccggccaccucu

SEQ ID NO: 2820443 - RNA, 12 nt, Human
ugggccagggcu

SEQ ID NO: 2820444 - RNA, 13 nt, Human
ugggccagggcug

SEQ ID NO: 2820445 - RNA, 20 nt, Human
ugggccagggcugcccugag

SEQ ID NO: 2820446 - RNA, 21 nt, Human
ugggccagggcugcccugaga

SEQ ID NO: 2820447 - RNA, 22 nt, Human
ugggccagggcugcccugagaa

SEQ ID NO: 2820448 - RNA, 13 nt, Human
ugggccagggucu

SEQ ID NO: 2820449 - RNA, 14 nt, Human
ugggccagggucug

SEQ ID NO: 2820450 - RNA, 19 nt, Human
ugggccagggucuguguga

SEQ ID NO: 2820451 - RNA, 22 nt, Human
ugggccagggucugugugaaug

SEQ ID NO: 2820452 - RNA, 15 nt, Human
ugggcacuggcccag

SEQ ID NO: 2820453 - RNA, 16 nt, Human
ugggcacuggcccagg

SEQ ID NO: 2820454 - RNA, 22 nt, Human
ugggcacugggaugagccgcug

SEQ ID NO: 2820455 - RNA, 15 nt, Human
ugggcacuucccugc

SEQ ID NO: 2820456 - RNA, 16 nt, Human
ugggcacuucccugcu

SEQ ID NO: 2820457 - RNA, 17 nt, Human
ugggcacuucccugcug

SEQ ID NO: 2820458 - RNA, 20 nt, Human
ugggcacuucccugcugccu

SEQ ID NO: 2820459 - RNA, 13 nt, Human
ugggcacuugaga

SEQ ID NO: 2820460 - RNA, 15 nt, Human
ugggcacugggauga

SEQ ID NO: 2820461 - RNA, 16 nt, Human
ugggcacugggaugag

SEQ ID NO: 2820462 - RNA, 14 nt, Human
ugggaggcacagca

SEQ ID NO: 2820463 - RNA, 18 nt, Human
ugggaggcauggcccugg

SEQ ID NO: 2820464 - RNA, 16 nt, Human
ugggaggcauggcccu

SEQ ID NO: 2820465 - RNA, 20 nt, Human
ugggaggccccuucucuccc

SEQ ID NO: 2820466 - RNA, 18 nt, Human
ugggccccccagcucagg

SEQ ID NO: 2820467 - RNA, 19 nt, Human
ugggccccccagcucaggg

SEQ ID NO: 2820468 - RNA, 12 nt, Human
ugggccccagcu

SEQ ID NO: 2820469 - RNA, 22 nt, Human
ugggccccaguuguauuuauuu

SEQ ID NO: 2820470 - RNA, 23 nt, Human
ugggccauguccaaagaggcugc

SEQ ID NO: 2820471 - RNA, 19 nt, Human
ugggccauguccaaagagg

SEQ ID NO: 2820472 - RNA, 18 nt, Human
ugggccauguccaaagag

SEQ ID NO: 2820473 - RNA, 17 nt, Human
ugggccauguccaaaga

SEQ ID NO: 2820474 - RNA, 18 nt, Human
ugggccccaguuguauuu

SEQ ID NO: 2820475 - RNA, 14 nt, Human
ugggccauguccaa

SEQ ID NO: 2820476 - RNA, 20 nt, Human
agggaggcgggggcugcccu

SEQ ID NO: 2820477 - RNA, 18 nt, Human
agggaggcgggggcugcc

SEQ ID NO: 2820478 - RNA, 17 nt, Human
agggaggccaucugggg

SEQ ID NO: 2820479 - RNA, 12 nt, Human
agggaggcagcc

SEQ ID NO: 2820480 - RNA, 13 nt, Human
agggaggcagccu

SEQ ID NO: 2820481 - RNA, 15 nt, Human
agggaggcagccucc

SEQ ID NO: 2820482 - RNA, 16 nt, Human
agggaggcagccucca

SEQ ID NO: 2820483 - RNA, 17 nt, Human
agggaggcagccuccag

SEQ ID NO: 2820484 - RNA, 20 nt, Human
aggggaauguuugccucugc

SEQ ID NO: 2820485 - RNA, 19 nt, Human
aggggaauguuugccucug

SEQ ID NO: 2820486 - RNA, 21 nt, Human
aggggaauguuugccucugcc

SEQ ID NO: 2820487 - RNA, 13 nt, Human
aggggcugacacu

SEQ ID NO: 2820488 - RNA, 23 nt, Human
aggggcuccuggaaaggcucagu

SEQ ID NO: 2820489 - RNA, 14 nt, Human
aggggcuccuggaa

SEQ ID NO: 2820490 - RNA, 13 nt, Human
aggggcuccugga

SEQ ID NO: 2820491 - RNA, 15 nt, Human
aggggcucuggagag

SEQ ID NO: 2820492 - RNA, 17 nt, Human
aggggcucuggagagaa

SEQ ID NO: 2820493 - RNA, 21 nt, Human
aggggcucuggagagaaacaa

SEQ ID NO: 2820494 - RNA, 17 nt, Human
aggggcucucagcucag

SEQ ID NO: 2820495 - RNA, 22 nt, Human
aggggcucucagcucagcgcca

SEQ ID NO: 2820496 - RNA, 13 nt, Human
agggggcuccugg

SEQ ID NO: 2820497 - RNA, 16 nt, Human
agggucucacucuguc

SEQ ID NO: 2820498 - RNA, 15 nt, Human
agggucucacucugu

SEQ ID NO: 2820499 - RNA, 14 nt, Human
agggucucacucug

SEQ ID NO: 2820500 - RNA, 19 nt, Human
agggguuugccauuugaua

SEQ ID NO: 2820501 - RNA, 21 nt, Human
agggguuugccauuugauacc

SEQ ID NO: 2820502 - RNA, 18 nt, Human
agggguuggggugacagu

SEQ ID NO: 2820503 - RNA, 21 nt, Human
agggguuggggugacagucau

SEQ ID NO: 2820504 - RNA, 14 nt, Human
aggggucaaagaaa

SEQ ID NO: 2820505 - RNA, 16 nt, Human
aggggucaaagaaaug

SEQ ID NO: 2820506 - RNA, 23 nt, Human
aggggugacacagacucauccug

SEQ ID NO: 2820507 - RNA, 16 nt, Human
aggggugacggcccuc

SEQ ID NO: 2820508 - RNA, 22 nt, Human
ugguaagaagccgggaacagac

SEQ ID NO: 2820509 - RNA, 17 nt, Human
ugguacaugucuuccau

SEQ ID NO: 2820510 - RNA, 17 nt, Human
ugguaaaguccuuuucu

SEQ ID NO: 2820511 - RNA, 13 nt, Human
ugguaaaugccac

SEQ ID NO: 2820512 - RNA, 19 nt, Human
ugguaaaugccacacaccu

SEQ ID NO: 2820513 - RNA, 18 nt, Human
ugguaacaguucauguuu

SEQ ID NO: 2820514 - RNA, 21 nt, Human
ugguaacaguucauguuugcu

SEQ ID NO: 2820515 - RNA, 17 nt, Human
ugguaacaguucauguu

SEQ ID NO: 2820516 - RNA, 17 nt, Human
ugguacuuuugagugug

SEQ ID NO: 2820517 - RNA, 18 nt, Human
ugguacuuuugagugugu

SEQ ID NO: 2820518 - RNA, 20 nt, Human
ugguacuuuugagugugugu

SEQ ID NO: 2820519 - RNA, 17 nt, Human
ugguagaccaaaauaaa

SEQ ID NO: 2820520 - RNA, 13 nt, Human
ugguagagaugga

SEQ ID NO: 2820521 - RNA, 15 nt, Human
ugguagauuaaauau

SEQ ID NO: 2820522 - RNA, 17 nt, Human
ugguagauuaaauauag

SEQ ID NO: 2820523 - RNA, 18 nt, Human
ugguagauuaaauauaga

SEQ ID NO: 2820524 - RNA, 19 nt, Human
ugguagauuaaauauagau

SEQ ID NO: 2820525 - RNA, 20 nt, Human
ugguagauuaaauauagauu

SEQ ID NO: 2820526 - RNA, 21 nt, Human
ugguaccaaucaugaaucuuu

SEQ ID NO: 2820527 - RNA, 13 nt, Human
ugguaccagcccu

SEQ ID NO: 2820528 - RNA, 14 nt, Human
ugguaccagcccug

SEQ ID NO: 2820529 - RNA, 15 nt, Human
ugguaccagcccugg

SEQ ID NO: 2820530 - RNA, 16 nt, Human
ugguaccagcccuggg

SEQ ID NO: 2820531 - RNA, 18 nt, Human
ugguaccagcccuggggc

SEQ ID NO: 2820532 - RNA, 19 nt, Human
ugguaccagcccuggggcu

SEQ ID NO: 2820533 - RNA, 20 nt, Human
ugguaccagcccuggggcug

SEQ ID NO: 2820534 - RNA, 21 nt, Human
ugguaccagcccuggggcugg

SEQ ID NO: 2820535 - RNA, 15 nt, Human
ugguacccuccuggc

SEQ ID NO: 2820536 - RNA, 16 nt, Human
ugguacccuccuggcu

SEQ ID NO: 2820537 - RNA, 21 nt, Human
ugguacccuccuggcucuuga

SEQ ID NO: 2820538 - RNA, 14 nt, Human
ugguacccucugga

SEQ ID NO: 2820539 - RNA, 15 nt, Human
ugguaccuauuugac

SEQ ID NO: 2820540 - RNA, 21 nt, Human
ugggugagaugcuggagaaga

SEQ ID NO: 2820541 - RNA, 20 nt, Human
ugggugauuccuaagccacu

SEQ ID NO: 2820542 - RNA, 18 nt, Human
ugggugacaagagccuga

SEQ ID NO: 2820543 - RNA, 18 nt, Human
ugggugagaugcuggaga

SEQ ID NO: 2820544 - RNA, 19 nt, Human
ugggugagaugcuggagaa

SEQ ID NO: 2820545 - RNA, 18 nt, Human
ugggucccccucagcaag

SEQ ID NO: 2820546 - RNA, 22 nt, Human
ugggucccccucagcaagcccu

SEQ ID NO: 2820547 - RNA, 16 nt, Human
uggguccgauaauauc

SEQ ID NO: 2820548 - RNA, 18 nt, Human
uggguccgauaauaucuu

SEQ ID NO: 2820549 - RNA, 21 nt, Human
uggguccgauaauaucuuugu

SEQ ID NO: 2820550 - RNA, 14 nt, Human
uggguccugaagaa

SEQ ID NO: 2820551 - RNA, 17 nt, Human
agggugggggccaccug

SEQ ID NO: 2820552 - RNA, 18 nt, Human
agggugggggccaccugc

SEQ ID NO: 2820553 - RNA, 19 nt, Human
agggugggggccaccugcc

SEQ ID NO: 2820554 - RNA, 20 nt, Human
agggugggggccaccugccu

SEQ ID NO: 2820555 - RNA, 21 nt, Human
agggugggggccaccugccug

SEQ ID NO: 2820556 - RNA, 22 nt, Human
agggugggggccaccugccugc

SEQ ID NO: 2820557 - RNA, 23 nt, Human
agggugggggccaccugccugcg

SEQ ID NO: 2820558 - RNA, 16 nt, Human
aggguggugaccucug

SEQ ID NO: 2820559 - RNA, 23 nt, Human
agggguuucagaauuuugcauug

SEQ ID NO: 2820560 - RNA, 15 nt, Human
agggugggugcucag

SEQ ID NO: 2820561 - RNA, 16 nt, Human
agggugggugcucaga

SEQ ID NO: 2820562 - RNA, 17 nt, Human
agggugggugcucagaa

SEQ ID NO: 2820563 - RNA, 18 nt, Human
agggugggugcucagaau

SEQ ID NO: 2820564 - RNA, 20 nt, Human
agggugggugcucagaauaa

SEQ ID NO: 2820565 - RNA, 17 nt, Human
agggucuucccuaccuc

SEQ ID NO: 2820566 - RNA, 15 nt, Human
agggucuucccuacc

SEQ ID NO: 2820567 - RNA, 13 nt, Human
agggucuguguga

SEQ ID NO: 2820568 - RNA, 15 nt, Human
agggucugugugaau

SEQ ID NO: 2820569 - RNA, 18 nt, Human
agggucugugugaaugug

SEQ ID NO: 2820570 - RNA, 17 nt, Human
agggucuguuuggacug

SEQ ID NO: 2820571 - RNA, 19 nt, Human
agggucuguuuggacugca

SEQ ID NO: 2820572 - RNA, 17 nt, Human
agggucugggcaggacu

SEQ ID NO: 2820573 - RNA, 21 nt, Human
agggucugggaaaugagcagg

SEQ ID NO: 2820574 - RNA, 22 nt, Human
agggucugggaaaugagcaggg

SEQ ID NO: 2820575 - RNA, 15 nt, Human
agggcucuaaaaaaa

SEQ ID NO: 2820576 - RNA, 23 nt, Human
agggcucuaaaaaaagccccaaa

SEQ ID NO: 2820577 - RNA, 12 nt, Human
agggcucugccc

SEQ ID NO: 2820578 - RNA, 14 nt, Human
agggcucugcccca

SEQ ID NO: 2820579 - RNA, 15 nt, Human
agggcucugccccag

SEQ ID NO: 2820580 - RNA, 16 nt, Human
agggcucugccccagu

SEQ ID NO: 2820581 - RNA, 18 nt, Human
agggcucugugcugacau

SEQ ID NO: 2820582 - RNA, 14 nt, Human
agggcucugaccag

SEQ ID NO: 2820583 - RNA, 15 nt, Human
agggcucugaccagu

SEQ ID NO: 2820584 - RNA, 16 nt, Human
agggcucucuuaggca

SEQ ID NO: 2820585 - RNA, 15 nt, Human
uggggagaggaaaga

SEQ ID NO: 2820586 - RNA, 15 nt, Human
uggggagaggaacuc

SEQ ID NO: 2820587 - RNA, 20 nt, Human
uggggagaggaacuccuugg

SEQ ID NO: 2820588 - RNA, 22 nt, Human
uggggagaggaacuccuuggcc

SEQ ID NO: 2820589 - RNA, 15 nt, Human
uggggaggacaaaac

SEQ ID NO: 2820590 - RNA, 18 nt, Human
uggggaggacaaaacuuc

SEQ ID NO: 2820591 - RNA, 13 nt, Human
uggggaggaccug

SEQ ID NO: 2820592 - RNA, 23 nt, Human
uggggagcuuggcugagggucug

SEQ ID NO: 2820593 - RNA, 14 nt, Human
uggggagauuugcc

SEQ ID NO: 2820594 - RNA, 18 nt, Human
uggggagcccgucucagu

SEQ ID NO: 2820595 - RNA, 19 nt, Human
uggggagcccgucucagug

SEQ ID NO: 2820596 - RNA, 21 nt, Human
uggggagcccgucucaguguu

SEQ ID NO: 2820597 - RNA, 12 nt, Human
uggggcccuaau

SEQ ID NO: 2820598 - RNA, 19 nt, Human
uggggcccuaauucagcca

SEQ ID NO: 2820599 - RNA, 20 nt, Human
uggggcccuaauucagccau

SEQ ID NO: 2820600 - RNA, 21 nt, Human
uggggcccuaauucagccaug

SEQ ID NO: 2820601 - RNA, 13 nt, Human
uggggccucagac

SEQ ID NO: 2820602 - RNA, 14 nt, Human
uggggccucagacg

SEQ ID NO: 2820603 - RNA, 14 nt, Human
uggggccuccagaa

SEQ ID NO: 2820604 - RNA, 20 nt, Human
uggggccuccagaacucacu

SEQ ID NO: 2820605 - RNA, 11 nt, Human
uggggccugag

SEQ ID NO: 2820606 - RNA, 12 nt, Human
uggggccugaga

SEQ ID NO: 2820607 - RNA, 13 nt, Human
uggggccugagag

SEQ ID NO: 2820608 - RNA, 14 nt, Human
uggggccugagaga

SEQ ID NO: 2820609 - RNA, 16 nt, Human
uggggccugagagaau

SEQ ID NO: 2820610 - RNA, 18 nt, Human
uggggccugagagaauug

SEQ ID NO: 2820611 - RNA, 22 nt, Human
uggggcuccuucuccaccccag

SEQ ID NO: 2820612 - RNA, 12 nt, Human
uggggccugugg

SEQ ID NO: 2820613 - RNA, 15 nt, Human
uggggccuggaccug

SEQ ID NO: 2820614 - RNA, 16 nt, Human
uggggccuggaccugc

SEQ ID NO: 2820615 - RNA, 17 nt, Human
uggggccuggaccugcc

SEQ ID NO: 2820616 - RNA, 19 nt, Human
uggggccuggaccugccuc

SEQ ID NO: 2820617 - RNA, 20 nt, Human
uggggccuggaccugccucc

SEQ ID NO: 2820618 - RNA, 11 nt, Human
uggggccuggc

SEQ ID NO: 2820619 - RNA, 12 nt, Human
uggggccuggca

SEQ ID NO: 2820620 - RNA, 22 nt, Human
ugggguauuggacauagauauu

SEQ ID NO: 2820621 - RNA, 19 nt, Human
uggggucuacacugcaauc

SEQ ID NO: 2820622 - RNA, 23 nt, Human
uggggucucacaguguugcccag

SEQ ID NO: 2820623 - RNA, 21 nt, Human
uggggucucacaguguugccc

SEQ ID NO: 2820624 - RNA, 14 nt, Human
ugggguccagggag

SEQ ID NO: 2820625 - RNA, 20 nt, Human
ugggguccuggagcagacca

SEQ ID NO: 2820626 - RNA, 12 nt, Human
ugggguccccag

SEQ ID NO: 2820627 - RNA, 12 nt, Human
ugggguauuuuu

SEQ ID NO: 2820628 - RNA, 19 nt, Human
ugggguacccacugcucug

SEQ ID NO: 2820629 - RNA, 18 nt, Human
ugggguacccacugcucu

SEQ ID NO: 2820630 - RNA, 17 nt, Human
ugggguacccacugcuc

SEQ ID NO: 2820631 - RNA, 12 nt, Human
uggggcugcugg

SEQ ID NO: 2820632 - RNA, 13 nt, Human
uggggcugcuggc

SEQ ID NO: 2820633 - RNA, 13 nt, Human
uggggcuggcuuu

SEQ ID NO: 2820634 - RNA, 18 nt, Human
uggggcuggcuuuucugu

SEQ ID NO: 2820635 - RNA, 13 nt, Human
aggggaauguuug

SEQ ID NO: 2820636 - RNA, 10 nt, Human
uggggucucu

SEQ ID NO: 2820637 - RNA, 14 nt, Human
aggggaagucccug

SEQ ID NO: 2820638 - RNA, 15 nt, Human
aggggaaccugccau

SEQ ID NO: 2820639 - RNA, 22 nt, Human
aggggaagaaacacuuucucuu

SEQ ID NO: 2820640 - RNA, 14 nt, Human
aggggaaccugcca

SEQ ID NO: 2820641 - RNA, 17 nt, Human
aggggaagcacucgugu

SEQ ID NO: 2820642 - RNA, 12 nt, Human
aggggaagcugc

SEQ ID NO: 2820643 - RNA, 13 nt, Human
aggggaagcugca

SEQ ID NO: 2820644 - RNA, 14 nt, Human
aggggaagcugcag

SEQ ID NO: 2820645 - RNA, 15 nt, Human
aggggaagcugcagc

SEQ ID NO: 2820646 - RNA, 20 nt, Human
aggggaagcugcagcuuggg

SEQ ID NO: 2820647 - RNA, 21 nt, Human
aggggaauaaacuguugaguc

SEQ ID NO: 2820648 - RNA, 14 nt, Human
aggggaacagacug

SEQ ID NO: 2820649 - RNA, 21 nt, Human
aggggaaaccaguguagccuu

SEQ ID NO: 2820650 - RNA, 20 nt, Human
aggggaaaccaguguagccu

SEQ ID NO: 2820651 - RNA, 23 nt, Human
aggggaaaccaguguagccuugc

SEQ ID NO: 2820652 - RNA, 17 nt, Human
aggggaacacugcccuc

SEQ ID NO: 2820653 - RNA, 18 nt, Human
aggggaacacugcccucg

SEQ ID NO: 2820654 - RNA, 13 nt, Human
aggggaaccugcc

SEQ ID NO: 2820655 - RNA, 15 nt, Human
aggggaaaaaaaugu

SEQ ID NO: 2820656 - RNA, 16 nt, Human
aggggaaaaaaauguu

SEQ ID NO: 2820657 - RNA, 17 nt, Human
aggggaaaaaaauguug

SEQ ID NO: 2820658 - RNA, 15 nt, Human
aggggaaaacuguua

SEQ ID NO: 2820659 - RNA, 17 nt, Human
ugggguggccugugugg

SEQ ID NO: 2820660 - RNA, 20 nt, Human
ugggguggccuguguggcca

SEQ ID NO: 2820661 - RNA, 20 nt, Human
uggggugggaggucuugcua

SEQ ID NO: 2820662 - RNA, 19 nt, Human
uggggugagaauugggcgg

SEQ ID NO: 2820663 - RNA, 11 nt, Human
uggggugacag

SEQ ID NO: 2820664 - RNA, 12 nt, Human
uggggugacagu

SEQ ID NO: 2820665 - RNA, 14 nt, Human
uggggugacaguca

SEQ ID NO: 2820666 - RNA, 15 nt, Human
uggggugacagucau

SEQ ID NO: 2820667 - RNA, 16 nt, Human
uggggugacagucauc

SEQ ID NO: 2820668 - RNA, 17 nt, Human
uggggugacagucauca

SEQ ID NO: 2820669 - RNA, 23 nt, Human
uggggugacagucaucaucaggg

SEQ ID NO: 2820670 - RNA, 14 nt, Human
uggggucugacccc

SEQ ID NO: 2820671 - RNA, 13 nt, Human
aguucugaagaau

SEQ ID NO: 2820672 - RNA, 14 nt, Human
uguuuugcacuuuu

SEQ ID NO: 2820673 - RNA, 17 nt, Human
uguuuggacuuuguaua

SEQ ID NO: 2820674 - RNA, 12 nt, Human
uguuuugcacuu

SEQ ID NO: 2820675 - RNA, 13 nt, Human
uguuuugcacuuu

SEQ ID NO: 2820676 - RNA, 20 nt, Human
uguuuugauguuuguggccu

SEQ ID NO: 2820677 - RNA, 14 nt, Human
aguucuguaaaaua

SEQ ID NO: 2820678 - RNA, 16 nt, Human
aguucuggucaaagaa

SEQ ID NO: 2820679 - RNA, 22 nt, Human
aguucuguguuuaauuucuuca

SEQ ID NO: 2820680 - RNA, 20 nt, Human
aguucuguuauauccccugc

SEQ ID NO: 2820681 - RNA, 21 nt, Human
aguucuguuauauccccugcu

SEQ ID NO: 2820682 - RNA, 22 nt, Human
aguucuguuauauccccugcua

SEQ ID NO: 2820683 - RNA, 21 nt, Human
aguucuguuugguguguccca

SEQ ID NO: 2820684 - RNA, 19 nt, Human
aguucuggaaaagaacugu

SEQ ID NO: 2820685 - RNA, 20 nt, Human
uguuuucauggugaaaaugu

SEQ ID NO: 2820686 - RNA, 14 nt, Human
uguuuuauuccugu

SEQ ID NO: 2820687 - RNA, 15 nt, Human
uguuuuauuccugua

SEQ ID NO: 2820688 - RNA, 16 nt, Human
uguuuuauuucauugg

SEQ ID NO: 2820689 - RNA, 18 nt, Human
uguuuuauuucauugguu

SEQ ID NO: 2820690 - RNA, 15 nt, Human
uguuuuccagcuccu

SEQ ID NO: 2820691 - RNA, 17 nt, Human
uguuuuccagcuccuca

SEQ ID NO: 2820692 - RNA, 17 nt, Human
uguuuugaaggcaaaau

SEQ ID NO: 2820693 - RNA, 15 nt, Human
uguuuugaauauuac

SEQ ID NO: 2820694 - RNA, 21 nt, Human
uguuuugaauauuacuccuau

SEQ ID NO: 2820695 - RNA, 12 nt, Human
uguuuugagaac

SEQ ID NO: 2820696 - RNA, 16 nt, Human
uguuuugagaguaaug

SEQ ID NO: 2820697 - RNA, 17 nt, Human
uguuuugaaacucagua

SEQ ID NO: 2820698 - RNA, 17 nt, Human
uguuuugaaaucaaugc

SEQ ID NO: 2820699 - RNA, 22 nt, Human
uguuuugaaaucaaugcaagag

SEQ ID NO: 2820700 - RNA, 11 nt, Human
uguuuucuucu

SEQ ID NO: 2820701 - RNA, 21 nt, Human
uguuuucuuuaaagauguaau

SEQ ID NO: 2820702 - RNA, 16 nt, Human
uguuuucuuucuuuaa

SEQ ID NO: 2820703 - RNA, 20 nt, Human
uguuuucuuucuuuaaaugu

SEQ ID NO: 2820704 - RNA, 21 nt, Human
uguuuucuuucuuuaaauguu

SEQ ID NO: 2820705 - RNA, 22 nt, Human
uguuuucuuucuuuaaauguuu

SEQ ID NO: 2820706 - RNA, 16 nt, Human
uguuuucugacuaauu

SEQ ID NO: 2820707 - RNA, 17 nt, Human
uguuuucugacuaauua

SEQ ID NO: 2820708 - RNA, 12 nt, Human
uguuuucugugu

SEQ ID NO: 2820709 - RNA, 13 nt, Human
uguuuucugugua

SEQ ID NO: 2820710 - RNA, 14 nt, Human
uguuuucuguguaa

SEQ ID NO: 2820711 - RNA, 15 nt, Human
uguuuucuguguaac

SEQ ID NO: 2820712 - RNA, 23 nt, Human
uguuuuaucaugacauguuauau

SEQ ID NO: 2820713 - RNA, 12 nt, Human
uguuuuaucaug

SEQ ID NO: 2820714 - RNA, 23 nt, Human
uguuuuauuauuucuauuaaaua

SEQ ID NO: 2820715 - RNA, 13 nt, Human
uguuugcugcuau

SEQ ID NO: 2820716 - RNA, 14 nt, Human
uguuugcugugaac

SEQ ID NO: 2820717 - RNA, 12 nt, Human
uguuugaugcag

SEQ ID NO: 2820718 - RNA, 14 nt, Human
uguuugcaagcagg

SEQ ID NO: 2820719 - RNA, 18 nt, Human
uguuugcuucauaaauga

SEQ ID NO: 2820720 - RNA, 16 nt, Human
uguuugcuucaccgug

SEQ ID NO: 2820721 - RNA, 14 nt, Human
uguuuggaaacauu

SEQ ID NO: 2820722 - RNA, 20 nt, Human
uguuuggaauguuagaauga

SEQ ID NO: 2820723 - RNA, 20 nt, Human
uguuuauuguugcugguuau

SEQ ID NO: 2820724 - RNA, 14 nt, Human
uguuuauguuuuua

SEQ ID NO: 2820725 - RNA, 14 nt, Human
uguuuauauguguu

SEQ ID NO: 2820726 - RNA, 15 nt, Human
uguuuauauguguug

SEQ ID NO: 2820727 - RNA, 23 nt, Human
uguuuauaaaauauaaacaaaga

SEQ ID NO: 2820728 - RNA, 20 nt, Human
uguuuauaacuauucaguug

SEQ ID NO: 2820729 - RNA, 22 nt, Human
uguuuauaacuauucaguugug

SEQ ID NO: 2820730 - RNA, 15 nt, Human
uguuuauacagcuca

SEQ ID NO: 2820731 - RNA, 16 nt, Human
uguuuauaccuuugcc

SEQ ID NO: 2820732 - RNA, 13 nt, Human
uguuuauagcauu

SEQ ID NO: 2820733 - RNA, 15 nt, Human
uguuuaucagauaca

SEQ ID NO: 2820734 - RNA, 16 nt, Human
uguuuaucagauacau

SEQ ID NO: 2820735 - RNA, 17 nt, Human
uguuuaucagauacauc

SEQ ID NO: 2820736 - RNA, 18 nt, Human
uguuuaucagauacauca

SEQ ID NO: 2820737 - RNA, 19 nt, Human
uguuuaucagauacaucac

SEQ ID NO: 2820738 - RNA, 22 nt, Human
uguuuaucagauacaucacugc

SEQ ID NO: 2820739 - RNA, 23 nt, Human
uguuuaucagauacaucacugcu

SEQ ID NO: 2820740 - RNA, 22 nt, Human
uguuuauaaaauauaaacaaag

SEQ ID NO: 2820741 - RNA, 14 nt, Human
uguugcucccugug

SEQ ID NO: 2820742 - RNA, 15 nt, Human
uguugcucuaggaag

SEQ ID NO: 2820743 - RNA, 17 nt, Human
uguugcucuaggaagac

SEQ ID NO: 2820744 - RNA, 20 nt, Human
uguugcucuaggaagacauu

SEQ ID NO: 2820745 - RNA, 17 nt, Human
uguugcucucugugucu

SEQ ID NO: 2820746 - RNA, 21 nt, Human
uguugcucucugugucugaga

SEQ ID NO: 2820747 - RNA, 19 nt, Human
uguugcccaggcaggucuu

SEQ ID NO: 2820748 - RNA, 15 nt, Human
uguugcaauuaggau

SEQ ID NO: 2820749 - RNA, 20 nt, Human
uguugcaauuaggauuuuga

SEQ ID NO: 2820750 - RNA, 22 nt, Human
uguugcacacccacucagcucc

SEQ ID NO: 2820751 - RNA, 21 nt, Human
uguugcacacccacucagcuc

SEQ ID NO: 2820752 - RNA, 20 nt, Human
uguugcacacccacucagcu

SEQ ID NO: 2820753 - RNA, 18 nt, Human
uguugccuuuaugguuuc

SEQ ID NO: 2820754 - RNA, 22 nt, Human
uguugccuuuuucauuuuccaa

SEQ ID NO: 2820755 - RNA, 21 nt, Human
uguugcgugacacucuccuug

SEQ ID NO: 2820756 - RNA, 24 nt, Human
uguuuauuuauagaguguacuuaa

SEQ ID NO: 2820757 - RNA, 14 nt, Human
uguuuauuuauaga

SEQ ID NO: 2820758 - RNA, 16 nt, Human
uguuuauuucauuuua

SEQ ID NO: 2820759 - RNA, 13 nt, Human
uguuucugugggc

SEQ ID NO: 2820760 - RNA, 14 nt, Human
uguuucugugggcg

SEQ ID NO: 2820761 - RNA, 12 nt, Human
uguuucuguuau

SEQ ID NO: 2820762 - RNA, 13 nt, Human
uguuucuguuauu

SEQ ID NO: 2820763 - RNA, 13 nt, Human
uguuucuuccugc

SEQ ID NO: 2820764 - RNA, 17 nt, Human
uguuucuuccuguuaau

SEQ ID NO: 2820765 - RNA, 18 nt, Human
uguuucuuccuguuaaug

SEQ ID NO: 2820766 - RNA, 21 nt, Human
uguuucuuccuguuaauguau

SEQ ID NO: 2820767 - RNA, 13 nt, Human
uguuucuugcuug

SEQ ID NO: 2820768 - RNA, 14 nt, Human
uguuucuugcuugu

SEQ ID NO: 2820769 - RNA, 15 nt, Human
uguuucuugcuugua

SEQ ID NO: 2820770 - RNA, 16 nt, Human
uguuucuugcuuguac

SEQ ID NO: 2820771 - RNA, 17 nt, Human
uguuucuugcuuguacc

SEQ ID NO: 2820772 - RNA, 19 nt, Human
uguuucuugcuuguaccuc

SEQ ID NO: 2820773 - RNA, 14 nt, Human
uguuucuuguuuau

SEQ ID NO: 2820774 - RNA, 17 nt, Human
uguuucuuguuuauuga

SEQ ID NO: 2820775 - RNA, 17 nt, Human
uguuucuguucaccuuc

SEQ ID NO: 2820776 - RNA, 14 nt, Human
uguuucuguuauua

SEQ ID NO: 2820777 - RNA, 15 nt, Human
uguuucuguuauuaa

SEQ ID NO: 2820778 - RNA, 19 nt, Human
uguuucuguuauuaacaaa

SEQ ID NO: 2820779 - RNA, 22 nt, Human
uguuucuuaacuauaaauaugu

SEQ ID NO: 2820780 - RNA, 13 nt, Human
uguuucuuucuag

SEQ ID NO: 2820781 - RNA, 18 nt, Human
uguuugaggagcauguuu

SEQ ID NO: 2820782 - RNA, 20 nt, Human
uguuugaggagcauguuuug

SEQ ID NO: 2820783 - RNA, 15 nt, Human
uguuucuuuucacau

SEQ ID NO: 2820784 - RNA, 12 nt, Human
uguuucuuugug

SEQ ID NO: 2820785 - RNA, 14 nt, Human
uguuucuuuguguu

SEQ ID NO: 2820786 - RNA, 13 nt, Human
uguuugaaaguag

SEQ ID NO: 2820787 - RNA, 16 nt, Human
uguuugaaaucaucgg

SEQ ID NO: 2820788 - RNA, 13 nt, Human
uguuugaaaucuu

SEQ ID NO: 2820789 - RNA, 21 nt, Human
uguuugaaaugaggucuguuu

SEQ ID NO: 2820790 - RNA, 22 nt, Human
uguuugaaaugaggucuguuua

SEQ ID NO: 2820791 - RNA, 22 nt, Human
uguuugacaaaguuacugauuc

SEQ ID NO: 2820792 - RNA, 15 nt, Human
uguuugaauauggac

SEQ ID NO: 2820793 - RNA, 19 nt, Human
uguuugaauauggacaaga

SEQ ID NO: 2820794 - RNA, 14 nt, Human
aguuuaaccauaug

SEQ ID NO: 2820795 - RNA, 22 nt, Human
aguuuaacacaaguccugugaa

SEQ ID NO: 2820796 - RNA, 13 nt, Human
aguuguuugcaug

SEQ ID NO: 2820797 - RNA, 16 nt, Human
aguuguuuguuuuugc

SEQ ID NO: 2820798 - RNA, 17 nt, Human
aguuguuuguuuuugcu

SEQ ID NO: 2820799 - RNA, 18 nt, Human
aguuguuuguuuuugcuu

SEQ ID NO: 2820800 - RNA, 16 nt, Human
aguugguugugucuuu

SEQ ID NO: 2820801 - RNA, 14 nt, Human
aguuggugagaaac

SEQ ID NO: 2820802 - RNA, 20 nt, Human
aguuggugagaaaccuguau

SEQ ID NO: 2820803 - RNA, 22 nt, Human
aguuggugagaaaccuguaucu

SEQ ID NO: 2820804 - RNA, 23 nt, Human
aguuggugagaaaccuguaucuu

SEQ ID NO: 2820805 - RNA, 24 nt, Human
aguuggugagaaaccuguaucuuu

SEQ ID NO: 2820806 - RNA, 13 nt, Human
aguuggugucuuu

SEQ ID NO: 2820807 - RNA, 14 nt, Human
aguuggugucuuuc

SEQ ID NO: 2820808 - RNA, 21 nt, Human
aguugccuaagcauugccugg

SEQ ID NO: 2820809 - RNA, 16 nt, Human
aguuguaacuuauauu

SEQ ID NO: 2820810 - RNA, 17 nt, Human
aguuguaacuuauauug

SEQ ID NO: 2820811 - RNA, 18 nt, Human
aguuguaacuuauauuga

SEQ ID NO: 2820812 - RNA, 19 nt, Human
aguuguaacuuauauugaa

SEQ ID NO: 2820813 - RNA, 11 nt, Human
aguuguacaug

SEQ ID NO: 2820814 - RNA, 13 nt, Human
aguuguacaugaa

SEQ ID NO: 2820815 - RNA, 15 nt, Human
aguuguacaugaaau

SEQ ID NO: 2820816 - RNA, 22 nt, Human
aguuguacaugaaauuuuugua

SEQ ID NO: 2820817 - RNA, 20 nt, Human
aguugcguggacucugcaca

SEQ ID NO: 2820818 - RNA, 13 nt, Human
aguugcuaaacac

SEQ ID NO: 2820819 - RNA, 15 nt, Human
aguugcuaaacacug

SEQ ID NO: 2820820 - RNA, 16 nt, Human
aguugcuaaacacugc

SEQ ID NO: 2820821 - RNA, 15 nt, Human
aguugcacugauauu

SEQ ID NO: 2820822 - RNA, 20 nt, Human
aguugcacggcugcugaggc

SEQ ID NO: 2820823 - RNA, 15 nt, Human
aguugcacggcugcu

SEQ ID NO: 2820824 - RNA, 16 nt, Human
aguugcacggcugcug

SEQ ID NO: 2820825 - RNA, 17 nt, Human
aguugcacggcugcuga

SEQ ID NO: 2820826 - RNA, 16 nt, Human
aguucuuagcccucua

SEQ ID NO: 2820827 - RNA, 21 nt, Human
aguuggguggaugccuggugg

SEQ ID NO: 2820828 - RNA, 17 nt, Human
aguuggguggaugccug

SEQ ID NO: 2820829 - RNA, 23 nt, Human
aguugggaacuucagauggaccu

SEQ ID NO: 2820830 - RNA, 13 nt, Human
aguuggcuucuaa

SEQ ID NO: 2820831 - RNA, 16 nt, Human
aguuggcuaggacccc

SEQ ID NO: 2820832 - RNA, 18 nt, Human
aguuggcuggaugaaauu

SEQ ID NO: 2820833 - RNA, 16 nt, Human
aguugcguggacucug

SEQ ID NO: 2820834 - RNA, 22 nt, Human
uuaacaacaauaacacugucuc

SEQ ID NO: 2820835 - RNA, 18 nt, Human
uuaacagcaguccuuugu

SEQ ID NO: 2820836 - RNA, 16 nt, Human
uuaacaagaagaugaa

SEQ ID NO: 2820837 - RNA, 17 nt, Human
uuaacaagaagaugaau

SEQ ID NO: 2820838 - RNA, 20 nt, Human
uuaacaagaagaugaauggc

SEQ ID NO: 2820839 - RNA, 13 nt, Human
uuaacagggaggg

SEQ ID NO: 2820840 - RNA, 16 nt, Human
aguuucaauucagugc

SEQ ID NO: 2820841 - RNA, 17 nt, Human
uuaacauaguaaguuca

SEQ ID NO: 2820842 - RNA, 20 nt, Human
uuaacauaguaaguucagca

SEQ ID NO: 2820843 - RNA, 22 nt, Human
uuaacauaguaaguucagcacu

SEQ ID NO: 2820844 - RNA, 17 nt, Human
aguuucaauucagugcu

SEQ ID NO: 2820845 - RNA, 14 nt, Human
aguuucagauauau

SEQ ID NO: 2820846 - RNA, 15 nt, Human
aguuucagauauaua

SEQ ID NO: 2820847 - RNA, 17 nt, Human
aguuucagauauauauc

SEQ ID NO: 2820848 - RNA, 23 nt, Human
aguuucagauauauaucauauug

SEQ ID NO: 2820849 - RNA, 15 nt, Human
aguuucagcuuaaaa

SEQ ID NO: 2820850 - RNA, 17 nt, Human
aguuucagcuuaaaaua

SEQ ID NO: 2820851 - RNA, 21 nt, Human
aguuucagcuuaaaauaaaca

SEQ ID NO: 2820852 - RNA, 22 nt, Human
aguuucagcuuaaaauaaacag

SEQ ID NO: 2820853 - RNA, 18 nt, Human
uuaaauaagauucuaacg

SEQ ID NO: 2820854 - RNA, 15 nt, Human
uuaaauuucuaccgc

SEQ ID NO: 2820855 - RNA, 14 nt, Human
uuaaauuggguuca

SEQ ID NO: 2820856 - RNA, 22 nt, Human
uuaaauuggguucaugaugcag

SEQ ID NO: 2820857 - RNA, 15 nt, Human
uuaaauaauauggcu

SEQ ID NO: 2820858 - RNA, 24 nt, Human
uuaaauaauauggcuaugcuuaaa

SEQ ID NO: 2820859 - RNA, 18 nt, Human
uuaaauaaugcuucagau

SEQ ID NO: 2820860 - RNA, 20 nt, Human
uuaaauaaugcuucagauau

SEQ ID NO: 2820861 - RNA, 13 nt, Human
uuaaauaagauuc

SEQ ID NO: 2820862 - RNA, 14 nt, Human
uuaaauaagauucu

SEQ ID NO: 2820863 - RNA, 15 nt, Human
uuaaauaagauucua

SEQ ID NO: 2820864 - RNA, 16 nt, Human
uuaaauaagauucuaa

SEQ ID NO: 2820865 - RNA, 17 nt, Human
uuaaauaagauucuaac

SEQ ID NO: 2820866 - RNA, 15 nt, Human
uuaaauuuaaagaua

SEQ ID NO: 2820867 - RNA, 18 nt, Human
uuaaauuuaaagauauug

SEQ ID NO: 2820868 - RNA, 13 nt, Human
uuaaauuuguaag

SEQ ID NO: 2820869 - RNA, 14 nt, Human
uuaaauuuguaagu

SEQ ID NO: 2820870 - RNA, 15 nt, Human
uuaaauuuguaaguu

SEQ ID NO: 2820871 - RNA, 17 nt, Human
uuaaauuuguaaguuuc

SEQ ID NO: 2820872 - RNA, 15 nt, Human
uuaaauuuuaauuua

SEQ ID NO: 2820873 - RNA, 21 nt, Human
uuaaauuuguaaguuucaggu

SEQ ID NO: 2820874 - RNA, 19 nt, Human
uuaaauuuguugacaaaau

SEQ ID NO: 2820875 - RNA, 16 nt, Human
uuaaauuuuaagguag

SEQ ID NO: 2820876 - RNA, 17 nt, Human
uuaaauuuuaagguaga

SEQ ID NO: 2820877 - RNA, 16 nt, Human
uuaaauuuuaauuuau

SEQ ID NO: 2820878 - RNA, 17 nt, Human
uuaaauuuuuuuuacau

SEQ ID NO: 2820879 - RNA, 22 nt, Human
uuaacaaacaucacucugcugc

SEQ ID NO: 2820880 - RNA, 23 nt, Human
uuaacaaacaucacucugcugcu

SEQ ID NO: 2820881 - RNA, 21 nt, Human
uuaacaacaauaacacugucu

SEQ ID NO: 2820882 - RNA, 12 nt, Human
uuaacaaauaug

SEQ ID NO: 2820883 - RNA, 18 nt, Human
uuaacaaauaugcuaauu

SEQ ID NO: 2820884 - RNA, 21 nt, Human
uuaacaaauaugcuaauuugg

SEQ ID NO: 2820885 - RNA, 13 nt, Human
uuaacaaaugcua

SEQ ID NO: 2820886 - RNA, 20 nt, Human
uuaacaaaugcuauuaaagu

SEQ ID NO: 2820887 - RNA, 11 nt, Human
uuaacaaaagu

SEQ ID NO: 2820888 - RNA, 16 nt, Human
uuaacaaaaguucccu

SEQ ID NO: 2820889 - RNA, 20 nt, Human
uuaaauuuuuuuuacauuuu

SEQ ID NO: 2820890 - RNA, 19 nt, Human
uuaaauuuuuuuuacauuu

SEQ ID NO: 2820891 - RNA, 18 nt, Human
uuaaauuuuuuuuacauu

SEQ ID NO: 2820892 - RNA, 17 nt, Human
uuaaaggauguuggugu

SEQ ID NO: 2820893 - RNA, 18 nt, Human
uuaaaggcaccaucuaau

SEQ ID NO: 2820894 - RNA, 16 nt, Human
uuaaaggcccagcccc

SEQ ID NO: 2820895 - RNA, 18 nt, Human
uuaaaggcccagccccua

SEQ ID NO: 2820896 - RNA, 20 nt, Human
uuaaaggcccagccccuaga

SEQ ID NO: 2820897 - RNA, 15 nt, Human
uuaaaggaagucagu

SEQ ID NO: 2820898 - RNA, 16 nt, Human
uuaaaaacauagaaaa

SEQ ID NO: 2820899 - RNA, 13 nt, Human
uuaaaaacuagua

SEQ ID NO: 2820900 - RNA, 18 nt, Human
uuaaaaacuaguaguucu

SEQ ID NO: 2820901 - RNA, 22 nt, Human
uuaaaaacuaguaguucucuug

SEQ ID NO: 2820902 - RNA, 13 nt, Human
uuaaaaacuggaa

SEQ ID NO: 2820903 - RNA, 17 nt, Human
uuaaaaagaaacaagau

SEQ ID NO: 2820904 - RNA, 20 nt, Human
uuaaaaagaaacaagaugcu

SEQ ID NO: 2820905 - RNA, 14 nt, Human
uuaaaaagaaaucu

SEQ ID NO: 2820906 - RNA, 13 nt, Human
uuaaaaagauucu

SEQ ID NO: 2820907 - RNA, 18 nt, Human
uuaaaaagauucuuuuuc

SEQ ID NO: 2820908 - RNA, 14 nt, Human
aguuuagugcaucu

SEQ ID NO: 2820909 - RNA, 17 nt, Human
aguuuagugcaucuuug

SEQ ID NO: 2820910 - RNA, 15 nt, Human
uuaaaaaggaacugc

SEQ ID NO: 2820911 - RNA, 19 nt, Human
uuaaaaaggaacugcagca

SEQ ID NO: 2820912 - RNA, 17 nt, Human
uuaaaaugugcaguaau

SEQ ID NO: 2820913 - RNA, 23 nt, Human
uuaaaauuaucaauaucuaauau

SEQ ID NO: 2820914 - RNA, 16 nt, Human
uuaaaauuaugaaucu

SEQ ID NO: 2820915 - RNA, 20 nt, Human
uuaaaauuaugaaucugauu

SEQ ID NO: 2820916 - RNA, 22 nt, Human
uuaaaauuaugaaucugauuuu

SEQ ID NO: 2820917 - RNA, 15 nt, Human
uuaaaauugcuaugu

SEQ ID NO: 2820918 - RNA, 22 nt, Human
uuaccuguuuucgcaccuacca

SEQ ID NO: 2820919 - RNA, 17 nt, Human
uuacaguaugcuugcuc

SEQ ID NO: 2820920 - RNA, 11 nt, Human
uuaccugucac

SEQ ID NO: 2820921 - RNA, 13 nt, Human
uuaccugucacau

SEQ ID NO: 2820922 - RNA, 17 nt, Human
uuaccugucacauugca

SEQ ID NO: 2820923 - RNA, 18 nt, Human
uuaccugucacauugcau

SEQ ID NO: 2820924 - RNA, 19 nt, Human
uuaccugucacauugcauu

SEQ ID NO: 2820925 - RNA, 22 nt, Human
uuaccugucacauugcauucua

SEQ ID NO: 2820926 - RNA, 22 nt, Human
uuaccuguacacugacuugaga

SEQ ID NO: 2820927 - RNA, 16 nt, Human
uuacaguccuucaaaa

SEQ ID NO: 2820928 - RNA, 17 nt, Human
uuacaguccuucaaaau

SEQ ID NO: 2820929 - RNA, 22 nt, Human
uuacauaguuuuaaacucauuu

SEQ ID NO: 2820930 - RNA, 13 nt, Human
uuacaucauuuuu

SEQ ID NO: 2820931 - RNA, 14 nt, Human
uuacaucauuuuug

SEQ ID NO: 2820932 - RNA, 18 nt, Human
uuacaucauuuuuguauc

SEQ ID NO: 2820933 - RNA, 20 nt, Human
uuacaucauuuuuguaucua

SEQ ID NO: 2820934 - RNA, 13 nt, Human
uuacauccuuaaa

SEQ ID NO: 2820935 - RNA, 23 nt, Human
uuaccuguuuucgcaccuaccau

SEQ ID NO: 2820936 - RNA, 19 nt, Human
uuacuauucauuaaauguu

SEQ ID NO: 2820937 - RNA, 21 nt, Human
uuacuauucauuaaauguuug

SEQ ID NO: 2820938 - RNA, 17 nt, Human
uuacuauuuucuacaau

SEQ ID NO: 2820939 - RNA, 21 nt, Human
uuacuauuuucuacaauuaau

SEQ ID NO: 2820940 - RNA, 21 nt, Human
uuacuauuuugacaguuauuu

SEQ ID NO: 2820941 - RNA, 19 nt, Human
uuacugacccuggggcugg

SEQ ID NO: 2820942 - RNA, 13 nt, Human
uuacugauuauuu

SEQ ID NO: 2820943 - RNA, 14 nt, Human
uuacugauaauuuu

SEQ ID NO: 2820944 - RNA, 18 nt, Human
uuagaagauagaugcacu

SEQ ID NO: 2820945 - RNA, 13 nt, Human
uuagaaccuuucu

SEQ ID NO: 2820946 - RNA, 11 nt, Human
uuagacagagu

SEQ ID NO: 2820947 - RNA, 17 nt, Human
uuagacaccuucauuuu

SEQ ID NO: 2820948 - RNA, 14 nt, Human
auaacuuauugcug

SEQ ID NO: 2820949 - RNA, 15 nt, Human
auaacuuauugcuga

SEQ ID NO: 2820950 - RNA, 18 nt, Human
auaacuuauugcugauuu

SEQ ID NO: 2820951 - RNA, 13 nt, Human
auaacuucaaauu

SEQ ID NO: 2820952 - RNA, 16 nt, Human
auaacuucaaauuuuu

SEQ ID NO: 2820953 - RNA, 23 nt, Human
uuacugggccuuagugggccagg

SEQ ID NO: 2820954 - RNA, 15 nt, Human
uuacuggcguggauu

SEQ ID NO: 2820955 - RNA, 16 nt, Human
uuacuggcguggauua

SEQ ID NO: 2820956 - RNA, 22 nt, Human
uuacuggcguggauuaaacuua

SEQ ID NO: 2820957 - RNA, 23 nt, Human
uuacuggcguggauuaaacuuau

SEQ ID NO: 2820958 - RNA, 16 nt, Human
uuacuggcuucucuug

SEQ ID NO: 2820959 - RNA, 15 nt, Human
uuacuguaagacauu

SEQ ID NO: 2820960 - RNA, 17 nt, Human
uuacuguaagacauuag

SEQ ID NO: 2820961 - RNA, 21 nt, Human
auaaauauauauaaagaauau

SEQ ID NO: 2820962 - RNA, 11 nt, Human
auaaaugaagc

SEQ ID NO: 2820963 - RNA, 17 nt, Human
auaaaugaagcagcuuu

SEQ ID NO: 2820964 - RNA, 22 nt, Human
auaaaucuguucugggcucuuu

SEQ ID NO: 2820965 - RNA, 15 nt, Human
auaaaucuuuggaaa

SEQ ID NO: 2820966 - RNA, 13 nt, Human
auaaaucuuaaaa

SEQ ID NO: 2820967 - RNA, 14 nt, Human
auaaaucuuaaaaa

SEQ ID NO: 2820968 - RNA, 13 nt, Human
auaaauaugcagu

SEQ ID NO: 2820969 - RNA, 14 nt, Human
auaaauaugcagug

SEQ ID NO: 2820970 - RNA, 12 nt, Human
auaaaguuagaa

SEQ ID NO: 2820971 - RNA, 16 nt, Human
auaaaguuagaaucua

SEQ ID NO: 2820972 - RNA, 17 nt, Human
auaaaguuagaaucuau

SEQ ID NO: 2820973 - RNA, 22 nt, Human
auaaaguuagaaucuauuuucu

SEQ ID NO: 2820974 - RNA, 17 nt, Human
auaaagugcuuguguaa

SEQ ID NO: 2820975 - RNA, 18 nt, Human
auaaagugcuuguguaau

SEQ ID NO: 2820976 - RNA, 13 nt, Human
auaaaguuucuca

SEQ ID NO: 2820977 - RNA, 12 nt, Human
auaaaguuugcu

SEQ ID NO: 2820978 - RNA, 19 nt, Human
auaaaguuugcuuagaaaa

SEQ ID NO: 2820979 - RNA, 13 nt, Human
auaaauagagcaa

SEQ ID NO: 2820980 - RNA, 14 nt, Human
auaaauagagcaau

SEQ ID NO: 2820981 - RNA, 15 nt, Human
auaaauagaaaagua

SEQ ID NO: 2820982 - RNA, 18 nt, Human
auaaauagaaaaguagac

SEQ ID NO: 2820983 - RNA, 12 nt, Human
auaaauacauac

SEQ ID NO: 2820984 - RNA, 19 nt, Human
auaaauacauacggucagg

SEQ ID NO: 2820985 - RNA, 22 nt, Human
auaaauacauacggucagguuu

SEQ ID NO: 2820986 - RNA, 18 nt, Human
auaaauaauugaaacaau

SEQ ID NO: 2820987 - RNA, 15 nt, Human
uuacagcuuuacaca

SEQ ID NO: 2820988 - RNA, 22 nt, Human
uuacagcuuuacacacacagau

SEQ ID NO: 2820989 - RNA, 17 nt, Human
uuacagcucugacuuua

SEQ ID NO: 2820990 - RNA, 21 nt, Human
uuacagcucugacuuuacacu

SEQ ID NO: 2820991 - RNA, 20 nt, Human
uuacagcuggguggcacugc

SEQ ID NO: 2820992 - RNA, 21 nt, Human
uuacagcuggguggcacugcc

SEQ ID NO: 2820993 - RNA, 14 nt, Human
uuacagcugccugc

SEQ ID NO: 2820994 - RNA, 23 nt, Human
uuacagccaagugccaaaugcuc

SEQ ID NO: 2820995 - RNA, 13 nt, Human
uuacagcugccug

SEQ ID NO: 2820996 - RNA, 14 nt, Human
auaacuaaauuuga

SEQ ID NO: 2820997 - RNA, 15 nt, Human
auaacuaaauuugau

SEQ ID NO: 2820998 - RNA, 16 nt, Human
auaacuaaauuugaua

SEQ ID NO: 2820999 - RNA, 18 nt, Human
auaacuaaauuugauacu

SEQ ID NO: 2821000 - RNA, 19 nt, Human
auaacuaaauuugauacuu

SEQ ID NO: 2821001 - RNA, 20 nt, Human
auaacuaaauuugauacuua

SEQ ID NO: 2821002 - RNA, 21 nt, Human
auaacuaaauuugauacuuau

SEQ ID NO: 2821003 - RNA, 19 nt, Human
auaaaugggaacauuuauu

SEQ ID NO: 2821004 - RNA, 19 nt, Human
auaaauguaaaaauaauaa

SEQ ID NO: 2821005 - RNA, 18 nt, Human
auaaaugaagcagcuuua

SEQ ID NO: 2821006 - RNA, 20 nt, Human
auaaaugaagcagcuuuaaa

SEQ ID NO: 2821007 - RNA, 12 nt, Human
auaaaugagcaa

SEQ ID NO: 2821008 - RNA, 13 nt, Human
auaaauguauaua

SEQ ID NO: 2821009 - RNA, 14 nt, Human
auaaauguauauac

SEQ ID NO: 2821010 - RNA, 15 nt, Human
auaaauguauauaca

SEQ ID NO: 2821011 - RNA, 16 nt, Human
auaaauguauauacac

SEQ ID NO: 2821012 - RNA, 17 nt, Human
auaaauguauauacaca

SEQ ID NO: 2821013 - RNA, 18 nt, Human
auaaauguauauacacau

SEQ ID NO: 2821014 - RNA, 19 nt, Human
auaaauguauauacacaua

SEQ ID NO: 2821015 - RNA, 20 nt, Human
auaaauguauauacacauau

SEQ ID NO: 2821016 - RNA, 21 nt, Human
auaaauguauauacacauaua

SEQ ID NO: 2821017 - RNA, 13 nt, Human
auaaauguaucau

SEQ ID NO: 2821018 - RNA, 21 nt, Human
auaaauguaucauagaaaugu

SEQ ID NO: 2821019 - RNA, 17 nt, Human
auaaauguaucauagaa

SEQ ID NO: 2821020 - RNA, 11 nt, Human
uuaagaagcug

SEQ ID NO: 2821021 - RNA, 13 nt, Human
uuaagaagcuguu

SEQ ID NO: 2821022 - RNA, 14 nt, Human
uuaagaagcuguug

SEQ ID NO: 2821023 - RNA, 16 nt, Human
uuaagaagcuguugua

SEQ ID NO: 2821024 - RNA, 13 nt, Human
uuaagaggcaggg

SEQ ID NO: 2821025 - RNA, 22 nt, Human
uuaagagccauauaaguuugaa

SEQ ID NO: 2821026 - RNA, 12 nt, Human
uuaagaaggcaa

SEQ ID NO: 2821027 - RNA, 18 nt, Human
uuaagaagcuguuguaca

SEQ ID NO: 2821028 - RNA, 20 nt, Human
uuaagaagcuguuguacauu

SEQ ID NO: 2821029 - RNA, 21 nt, Human
uuaagaagcuguuguacauuu

SEQ ID NO: 2821030 - RNA, 22 nt, Human
uuaagaagcuguuguacauuua

SEQ ID NO: 2821031 - RNA, 16 nt, Human
uuaagaggcagggucu

SEQ ID NO: 2821032 - RNA, 15 nt, Human
uuaagaggcaggguc

SEQ ID NO: 2821033 - RNA, 23 nt, Human
uuaagagccauauaaguuugaag

SEQ ID NO: 2821034 - RNA, 17 nt, Human
uuaagagcuaaccaguu

SEQ ID NO: 2821035 - RNA, 23 nt, Human
uuaagaagcuguuguacauuuau

SEQ ID NO: 2821036 - RNA, 20 nt, Human
uuaagaggcagaaaauugca

SEQ ID NO: 2821037 - RNA, 14 nt, Human
uuaaguauaucaug

SEQ ID NO: 2821038 - RNA, 17 nt, Human
uuaaguauaucauguaa

SEQ ID NO: 2821039 - RNA, 15 nt, Human
uuaaguaauguggaa

SEQ ID NO: 2821040 - RNA, 21 nt, Human
uuaaguaauguggaagaaaau

SEQ ID NO: 2821041 - RNA, 16 nt, Human
uuaagugguuugauca

SEQ ID NO: 2821042 - RNA, 17 nt, Human
uuaagugcguguguaga

SEQ ID NO: 2821043 - RNA, 18 nt, Human
uuaagugcguguguagag

SEQ ID NO: 2821044 - RNA, 19 nt, Human
uuaagugcguguguagagu

SEQ ID NO: 2821045 - RNA, 21 nt, Human
uuaagugcguguguagaguua

SEQ ID NO: 2821046 - RNA, 14 nt, Human
auaaaauaaaguau

SEQ ID NO: 2821047 - RNA, 13 nt, Human
auaaaauaaagua

SEQ ID NO: 2821048 - RNA, 19 nt, Human
auaaaagugaaugaaagau

SEQ ID NO: 2821049 - RNA, 21 nt, Human
auaaaagugaaugaaagauua

SEQ ID NO: 2821050 - RNA, 16 nt, Human
auaaaagugcacaccu

SEQ ID NO: 2821051 - RNA, 17 nt, Human
auaaaagggcaaaucug

SEQ ID NO: 2821052 - RNA, 18 nt, Human
auaaaagggcaaaucugc

SEQ ID NO: 2821053 - RNA, 20 nt, Human
auaaaaggggguccguggaa

SEQ ID NO: 2821054 - RNA, 21 nt, Human
aguuucaggugacaugugaaa

SEQ ID NO: 2821055 - RNA, 22 nt, Human
aguuucaggugacaugugaaac

SEQ ID NO: 2821056 - RNA, 11 nt, Human
aguuucaggug

SEQ ID NO: 2821057 - RNA, 14 nt, Human
aguuucaggugaca

SEQ ID NO: 2821058 - RNA, 15 nt, Human
aguuucaggugacau

SEQ ID NO: 2821059 - RNA, 16 nt, Human
aguuucaggugacaug

SEQ ID NO: 2821060 - RNA, 17 nt, Human
aguuucaggugacaugu

SEQ ID NO: 2821061 - RNA, 18 nt, Human
aguuucaggugacaugug

SEQ ID NO: 2821062 - RNA, 20 nt, Human
aguuucaggugacaugugaa

SEQ ID NO: 2821063 - RNA, 16 nt, Human
auaaaauaaaguauau

SEQ ID NO: 2821064 - RNA, 19 nt, Human
auaaaaguuuuacaaaggg

SEQ ID NO: 2821065 - RNA, 11 nt, Human
auaaaaugugc

SEQ ID NO: 2821066 - RNA, 15 nt, Human
auaaaauguguugaa

SEQ ID NO: 2821067 - RNA, 15 nt, Human
auaaaaugucuucaa

SEQ ID NO: 2821068 - RNA, 20 nt, Human
auaaaaugucuucaaggcuu

SEQ ID NO: 2821069 - RNA, 20 nt, Human
auaaaauccuaagacacaaa

SEQ ID NO: 2821070 - RNA, 21 nt, Human
auaaaauccuaagacacaaau

SEQ ID NO: 2821071 - RNA, 12 nt, Human
auaaaaugacua

SEQ ID NO: 2821072 - RNA, 15 nt, Human
auaaaaugacuacuu

SEQ ID NO: 2821073 - RNA, 16 nt, Human
auaaaaugacuacuua

SEQ ID NO: 2821074 - RNA, 19 nt, Human
auaaaaugaggacauguuu

SEQ ID NO: 2821075 - RNA, 18 nt, Human
auaaaaugaggacauguu

SEQ ID NO: 2821076 - RNA, 13 nt, Human
auaaacaaugaaa

SEQ ID NO: 2821077 - RNA, 14 nt, Human
auaaacaaugaugc

SEQ ID NO: 2821078 - RNA, 18 nt, Human
auaaacaaugaugcccug

SEQ ID NO: 2821079 - RNA, 14 nt, Human
auaaaauuuugcuu

SEQ ID NO: 2821080 - RNA, 16 nt, Human
auaaaauuuugcuuuu

SEQ ID NO: 2821081 - RNA, 16 nt, Human
auaaacaaagauucau

SEQ ID NO: 2821082 - RNA, 19 nt, Human
uuaauuuuuuugagacaga

SEQ ID NO: 2821083 - RNA, 14 nt, Human
uuaauuuauaugua

SEQ ID NO: 2821084 - RNA, 20 nt, Human
uuaauuuuuugguacaaaaa

SEQ ID NO: 2821085 - RNA, 16 nt, Human
uuaauuuaggacacau

SEQ ID NO: 2821086 - RNA, 17 nt, Human
uuaauuuaguaaauguu

SEQ ID NO: 2821087 - RNA, 18 nt, Human
uuaauuuaguaaauguua

SEQ ID NO: 2821088 - RNA, 19 nt, Human
uuaauuuaguaaauguuau

SEQ ID NO: 2821089 - RNA, 16 nt, Human
auaaaauuaaagcuga

SEQ ID NO: 2821090 - RNA, 20 nt, Human
uuacaaaacuacaugagaac

SEQ ID NO: 2821091 - RNA, 20 nt, Human
uuacaaaagaaauaccuuga

SEQ ID NO: 2821092 - RNA, 18 nt, Human
uuacaaaacuacaugaga

SEQ ID NO: 2821093 - RNA, 17 nt, Human
uuacaaaacuacaugag

SEQ ID NO: 2821094 - RNA, 13 nt, Human
auaaaauuaugcc

SEQ ID NO: 2821095 - RNA, 15 nt, Human
auaaaauuauuugca

SEQ ID NO: 2821096 - RNA, 16 nt, Human
auaaaauuauuugcag

SEQ ID NO: 2821097 - RNA, 13 nt, Human
auaaaauuagaaa

SEQ ID NO: 2821098 - RNA, 16 nt, Human
auaaaauuagaaagca

SEQ ID NO: 2821099 - RNA, 17 nt, Human
uuaauuccaauuauaug

SEQ ID NO: 2821100 - RNA, 19 nt, Human
uuaauuccaauaugaugac

SEQ ID NO: 2821101 - RNA, 17 nt, Human
uuaauucucuuucaaag

SEQ ID NO: 2821102 - RNA, 13 nt, Human
uuaauuguuguuu

SEQ ID NO: 2821103 - RNA, 18 nt, Human
uuaauuguuuugcacuuu

SEQ ID NO: 2821104 - RNA, 18 nt, Human
uuaauuuaaacaccuccu

SEQ ID NO: 2821105 - RNA, 16 nt, Human
uuaauuguuguuucuu

SEQ ID NO: 2821106 - RNA, 19 nt, Human
uuaauuguuguuucuuucu

SEQ ID NO: 2821107 - RNA, 20 nt, Human
uuaauuguuguuucuuucua

SEQ ID NO: 2821108 - RNA, 22 nt, Human
uuaauuguuguuucuuucuagu

SEQ ID NO: 2821109 - RNA, 19 nt, Human
uuaauuguuuugcacuuuu

SEQ ID NO: 2821110 - RNA, 16 nt, Human
uuaauuuaaagcuuac

SEQ ID NO: 2821111 - RNA, 21 nt, Human
uuaauuuaaagcuuacucugu

SEQ ID NO: 2821112 - RNA, 13 nt, Human
uuaauaaagacag

SEQ ID NO: 2821113 - RNA, 14 nt, Human
uuaauaaagacagg

SEQ ID NO: 2821114 - RNA, 12 nt, Human
uuaauaacaauu

SEQ ID NO: 2821115 - RNA, 22 nt, Human
uuaauaaagacgauuugucagu

SEQ ID NO: 2821116 - RNA, 15 nt, Human
uuaauaaauagagca

SEQ ID NO: 2821117 - RNA, 16 nt, Human
uuaauaaauagagcaa

SEQ ID NO: 2821118 - RNA, 13 nt, Human
uuaaguuccagca

SEQ ID NO: 2821119 - RNA, 19 nt, Human
uuaaguucucaaugugaaa

SEQ ID NO: 2821120 - RNA, 21 nt, Human
uuaauaaagaauuaacagaga

SEQ ID NO: 2821121 - RNA, 14 nt, Human
uuaauaaacuacuc

SEQ ID NO: 2821122 - RNA, 19 nt, Human
uuaauaaacuacucuuuga

SEQ ID NO: 2821123 - RNA, 20 nt, Human
uuaauaaaauaauucuaaag

SEQ ID NO: 2821124 - RNA, 15 nt, Human
agucuuucaugugug

SEQ ID NO: 2821125 - RNA, 17 nt, Human
agucuuucaugugugcc

SEQ ID NO: 2821126 - RNA, 20 nt, Human
agucuuucaugugugccaag

SEQ ID NO: 2821127 - RNA, 20 nt, Human
agucuuucuuagugccugug

SEQ ID NO: 2821128 - RNA, 15 nt, Human
agucuuggcucacug

SEQ ID NO: 2821129 - RNA, 17 nt, Human
agucuugguuucucucu

SEQ ID NO: 2821130 - RNA, 23 nt, Human
agucuugguuucucucuacagug

SEQ ID NO: 2821131 - RNA, 10 nt, Human
agucuuguau

SEQ ID NO: 2821132 - RNA, 11 nt, Human
agucuuguaua

SEQ ID NO: 2821133 - RNA, 15 nt, Human
agucuuguauaacua

SEQ ID NO: 2821134 - RNA, 17 nt, Human
agucuuugguucuaagg

SEQ ID NO: 2821135 - RNA, 18 nt, Human
agucuuugguucuaagga

SEQ ID NO: 2821136 - RNA, 14 nt, Human
agucuuugaagcug

SEQ ID NO: 2821137 - RNA, 17 nt, Human
agucuuugaagcugaaa

SEQ ID NO: 2821138 - RNA, 21 nt, Human
agucuuugaagcugaaaauau

SEQ ID NO: 2821139 - RNA, 12 nt, Human
agucuuuggggu

SEQ ID NO: 2821140 - RNA, 15 nt, Human
agucuuugguucuaa

SEQ ID NO: 2821141 - RNA, 16 nt, Human
agucuuugguucuaag

SEQ ID NO: 2821142 - RNA, 16 nt, Human
agucuugcagcaggau

SEQ ID NO: 2821143 - RNA, 17 nt, Human
agucuucugacaaacug

SEQ ID NO: 2821144 - RNA, 19 nt, Human
agucuucugacaaacugug

SEQ ID NO: 2821145 - RNA, 15 nt, Human
agucuuccaauuaau

SEQ ID NO: 2821146 - RNA, 22 nt, Human
agucuuccaauuaaugcuuuuu

SEQ ID NO: 2821147 - RNA, 15 nt, Human
agucucuucuccacu

SEQ ID NO: 2821148 - RNA, 16 nt, Human
agucucuucuccacug

SEQ ID NO: 2821149 - RNA, 15 nt, Human
agucuuaucaagcag

SEQ ID NO: 2821150 - RNA, 16 nt, Human
agucuuaucaagcagc

SEQ ID NO: 2821151 - RNA, 21 nt, Human
agucuuaucugagcugagcca

SEQ ID NO: 2821152 - RNA, 22 nt, Human
agucuuaucugagcugagccag

SEQ ID NO: 2821153 - RNA, 23 nt, Human
agucuuaucugagcugagccagg

SEQ ID NO: 2821154 - RNA, 17 nt, Human
agucucuucuccacugg

SEQ ID NO: 2821155 - RNA, 22 nt, Human
agucuuagggauuuauuuucaa

SEQ ID NO: 2821156 - RNA, 22 nt, Human
agucuucaacauaacccacuug

SEQ ID NO: 2821157 - RNA, 20 nt, Human
ugugacuauauagagauguu

SEQ ID NO: 2821158 - RNA, 23 nt, Human
ugugacucuuuuuagggccaggc

SEQ ID NO: 2821159 - RNA, 16 nt, Human
ugugagagguuugacu

SEQ ID NO: 2821160 - RNA, 15 nt, Human
ugugagagguuugac

SEQ ID NO: 2821161 - RNA, 13 nt, Human
agucucuucucca

SEQ ID NO: 2821162 - RNA, 14 nt, Human
agucucuucuccac

SEQ ID NO: 2821163 - RNA, 17 nt, Human
agucucucuuaaaguug

SEQ ID NO: 2821164 - RNA, 23 nt, Human
agucucucuuaaaguuggaauuu

SEQ ID NO: 2821165 - RNA, 11 nt, Human
agucucuccug

SEQ ID NO: 2821166 - RNA, 13 nt, Human
agucucuccugua

SEQ ID NO: 2821167 - RNA, 22 nt, Human
agucucuccuguaagccaaaga

SEQ ID NO: 2821168 - RNA, 17 nt, Human
agucucaggagcauggg

SEQ ID NO: 2821169 - RNA, 13 nt, Human
agucucaggagca

SEQ ID NO: 2821170 - RNA, 19 nt, Human
agucucaguggcuucaucu

SEQ ID NO: 2821171 - RNA, 10 nt, Human
agucucaguu

SEQ ID NO: 2821172 - RNA, 18 nt, Human
agucucaguuuguguguc

SEQ ID NO: 2821173 - RNA, 20 nt, Human
agucucaguuugugugucuu

SEQ ID NO: 2821174 - RNA, 21 nt, Human
agucucaguuugugugucuua

SEQ ID NO: 2821175 - RNA, 12 nt, Human
ugugaacuugua

SEQ ID NO: 2821176 - RNA, 15 nt, Human
ugugaacuuguagcu

SEQ ID NO: 2821177 - RNA, 20 nt, Human
ugugaacuuguagcuguaaa

SEQ ID NO: 2821178 - RNA, 21 nt, Human
ugugaacuuguagcuguaaaa

SEQ ID NO: 2821179 - RNA, 17 nt, Human
ugugaaccaccacaccc

SEQ ID NO: 2821180 - RNA, 20 nt, Human
ugugaacaaaagaugcucuu

SEQ ID NO: 2821181 - RNA, 21 nt, Human
ugugaaccaccacacccagcc

SEQ ID NO: 2821182 - RNA, 20 nt, Human
ugugaaccaccacacccagc

SEQ ID NO: 2821183 - RNA, 19 nt, Human
ugugaaccaccacacccag

SEQ ID NO: 2821184 - RNA, 12 nt, Human
ugugaccuagca

SEQ ID NO: 2821185 - RNA, 13 nt, Human
ugugaccucaggc

SEQ ID NO: 2821186 - RNA, 14 nt, Human
ugugaccucaggca

SEQ ID NO: 2821187 - RNA, 17 nt, Human
ugugaccccuccugggg

SEQ ID NO: 2821188 - RNA, 18 nt, Human
ugugaccccuccuggggc

SEQ ID NO: 2821189 - RNA, 19 nt, Human
ugugaccccuccuggggcc

SEQ ID NO: 2821190 - RNA, 21 nt, Human
ugugaccccuccuggggccag

SEQ ID NO: 2821191 - RNA, 23 nt, Human
ugugaccccuccuggggccaggc

SEQ ID NO: 2821192 - RNA, 14 nt, Human
ugugaccugagggc

SEQ ID NO: 2821193 - RNA, 13 nt, Human
ugugaccugaggg

SEQ ID NO: 2821194 - RNA, 20 nt, Human
ugugaccucaggcacuagcc

SEQ ID NO: 2821195 - RNA, 21 nt, Human
ugugaccucaggcacuagccu

SEQ ID NO: 2821196 - RNA, 17 nt, Human
ugugaccuuaggcccgg

SEQ ID NO: 2821197 - RNA, 16 nt, Human
ugugacgcgcaagucu

SEQ ID NO: 2821198 - RNA, 13 nt, Human
ugugaccuucucu

SEQ ID NO: 2821199 - RNA, 14 nt, Human
ugugaccuucucua

SEQ ID NO: 2821200 - RNA, 18 nt, Human
ugugacuauauagagaug

SEQ ID NO: 2821201 - RNA, 22 nt, Human
ugugacuauauagagauguuuu

SEQ ID NO: 2821202 - RNA, 16 nt, Human
ugugacucuaaauucu

SEQ ID NO: 2821203 - RNA, 15 nt, Human
ugugacucuggcuug

SEQ ID NO: 2821204 - RNA, 16 nt, Human
ugugacucuggcuugg

SEQ ID NO: 2821205 - RNA, 17 nt, Human
ugugacucuggcuuggc

SEQ ID NO: 2821206 - RNA, 20 nt, Human
ugugacucuggcuuggccua

SEQ ID NO: 2821207 - RNA, 18 nt, Human
agucacguggaggagcag

SEQ ID NO: 2821208 - RNA, 21 nt, Human
agucacguggaggagcagugc

SEQ ID NO: 2821209 - RNA, 22 nt, Human
ugucagaaugcuauugaaaaug

SEQ ID NO: 2821210 - RNA, 21 nt, Human
ugucagacagaacuugaaugu

SEQ ID NO: 2821211 - RNA, 19 nt, Human
ugucuuggacacuguacaa

SEQ ID NO: 2821212 - RNA, 13 nt, Human
ugucuuguacaug

SEQ ID NO: 2821213 - RNA, 18 nt, Human
ugucuuguaauauuuugu

SEQ ID NO: 2821214 - RNA, 19 nt, Human
ugucuuguaauauuuugua

SEQ ID NO: 2821215 - RNA, 23 nt, Human
ugucagacagaacuugaaugugu

SEQ ID NO: 2821216 - RNA, 14 nt, Human
ugucagacauaaag

SEQ ID NO: 2821217 - RNA, 15 nt, Human
ugucagacauaaagc

SEQ ID NO: 2821218 - RNA, 16 nt, Human
ugucagacauaaagcc

SEQ ID NO: 2821219 - RNA, 17 nt, Human
ugucagacauaaagcca

SEQ ID NO: 2821220 - RNA, 20 nt, Human
ugucagacauaaagccaugu

SEQ ID NO: 2821221 - RNA, 23 nt, Human
ugucagacauccauguuuguaaa

SEQ ID NO: 2821222 - RNA, 15 nt, Human
ugucuuggacacugu

SEQ ID NO: 2821223 - RNA, 13 nt, Human
ugucagacuggcu

SEQ ID NO: 2821224 - RNA, 16 nt, Human
ugucuuguacaugugu

SEQ ID NO: 2821225 - RNA, 17 nt, Human
ugucuuguacaugugua

SEQ ID NO: 2821226 - RNA, 20 nt, Human
ugucuuguacauguguagcc

SEQ ID NO: 2821227 - RNA, 22 nt, Human
ugucuuguacauguguagccug

SEQ ID NO: 2821228 - RNA, 14 nt, Human
ugugaaaugcuggc

SEQ ID NO: 2821229 - RNA, 21 nt, Human
ugugaaagucagaugcccaga

SEQ ID NO: 2821230 - RNA, 22 nt, Human
ugugaaagucagaugcccagag

SEQ ID NO: 2821231 - RNA, 17 nt, Human
ugugaaaguuuugagua

SEQ ID NO: 2821232 - RNA, 20 nt, Human
ugugaaaggaagcuccacug

SEQ ID NO: 2821233 - RNA, 23 nt, Human
ugugaucccaagugccagucuug

SEQ ID NO: 2821234 - RNA, 18 nt, Human
ugugaucccaagugccag

SEQ ID NO: 2821235 - RNA, 13 nt, Human
ugugaucugucuu

SEQ ID NO: 2821236 - RNA, 14 nt, Human
ugugaucugucuug

SEQ ID NO: 2821237 - RNA, 15 nt, Human
ugugaucugucuugu

SEQ ID NO: 2821238 - RNA, 16 nt, Human
ugugaucugucuugua

SEQ ID NO: 2821239 - RNA, 17 nt, Human
ugugaucugucuuguaa

SEQ ID NO: 2821240 - RNA, 18 nt, Human
ugugaucugucuuguaau

SEQ ID NO: 2821241 - RNA, 19 nt, Human
ugugaucugucuuguaaua

SEQ ID NO: 2821242 - RNA, 20 nt, Human
ugugaucugucuuguaauau

SEQ ID NO: 2821243 - RNA, 21 nt, Human
ugugaucuuaauauauuugaa

SEQ ID NO: 2821244 - RNA, 17 nt, Human
ugugaucuuauuuuucu

SEQ ID NO: 2821245 - RNA, 22 nt, Human
ugugaucuuauuuuucuaaacg

SEQ ID NO: 2821246 - RNA, 15 nt, Human
agugaaauggauacu

SEQ ID NO: 2821247 - RNA, 14 nt, Human
agugaaauuucuag

SEQ ID NO: 2821248 - RNA, 17 nt, Human
agugaaauuucuagccu

SEQ ID NO: 2821249 - RNA, 20 nt, Human
agugaaauuucuagccugca

SEQ ID NO: 2821250 - RNA, 19 nt, Human
agugaaagugaggaaauaa

SEQ ID NO: 2821251 - RNA, 21 nt, Human
agugaaagugaggaaauaaag

SEQ ID NO: 2821252 - RNA, 12 nt, Human
agugaaauaaca

SEQ ID NO: 2821253 - RNA, 14 nt, Human
agugaaauaacaaa

SEQ ID NO: 2821254 - RNA, 19 nt, Human
agugaaauaacaaaaugga

SEQ ID NO: 2821255 - RNA, 20 nt, Human
agugaaauaacaaaauggac

SEQ ID NO: 2821256 - RNA, 14 nt, Human
agugaaauaauaga

SEQ ID NO: 2821257 - RNA, 15 nt, Human
ugugaugaacuuucu

SEQ ID NO: 2821258 - RNA, 16 nt, Human
ugugaucuuuuaaagu

SEQ ID NO: 2821259 - RNA, 14 nt, Human
ugugauguauucua

SEQ ID NO: 2821260 - RNA, 14 nt, Human
ugugauugugccua

SEQ ID NO: 2821261 - RNA, 14 nt, Human
ugugauuguggaau

SEQ ID NO: 2821262 - RNA, 17 nt, Human
ugugauuguggaaugga

SEQ ID NO: 2821263 - RNA, 17 nt, Human
ugugauuuagaacugua

SEQ ID NO: 2821264 - RNA, 18 nt, Human
ugugauuuagaacuguau

SEQ ID NO: 2821265 - RNA, 23 nt, Human
ugugauuuagaacuguaugucag

SEQ ID NO: 2821266 - RNA, 16 nt, Human
ugugccaugugccagg

SEQ ID NO: 2821267 - RNA, 12 nt, Human
ugugccaugugc

SEQ ID NO: 2821268 - RNA, 20 nt, Human
ugugccagguuuuuggucug

SEQ ID NO: 2821269 - RNA, 22 nt, Human
ugugccauagaguuuaacacaa

SEQ ID NO: 2821270 - RNA, 21 nt, Human
ugugccauagucacauggccu

SEQ ID NO: 2821271 - RNA, 16 nt, Human
ugugccauagucacau

SEQ ID NO: 2821272 - RNA, 18 nt, Human
ugugccauagucacaugg

SEQ ID NO: 2821273 - RNA, 18 nt, Human
ugugccauagaguuuaac

SEQ ID NO: 2821274 - RNA, 20 nt, Human
ugugccauagaguuuaacac

SEQ ID NO: 2821275 - RNA, 21 nt, Human
ugugccauagaguuuaacaca

SEQ ID NO: 2821276 - RNA, 21 nt, Human
ugugccagggcaaugaugaau

SEQ ID NO: 2821277 - RNA, 18 nt, Human
ugugccagggcaaugaug

SEQ ID NO: 2821278 - RNA, 18 nt, Human
ugugccaauauguauugu

SEQ ID NO: 2821279 - RNA, 20 nt, Human
ugugccacaacgccuggcua

SEQ ID NO: 2821280 - RNA, 22 nt, Human
ugugccacagaguguagccagg

SEQ ID NO: 2821281 - RNA, 16 nt, Human
ugugccaauauguauu

SEQ ID NO: 2821282 - RNA, 17 nt, Human
ugugccaauauguauug

SEQ ID NO: 2821283 - RNA, 23 nt, Human
ugugccagaggaauccuggcagc

SEQ ID NO: 2821284 - RNA, 22 nt, Human
ugugccagaggaauccuggcag

SEQ ID NO: 2821285 - RNA, 21 nt, Human
ugugccagaggaauccuggca

SEQ ID NO: 2821286 - RNA, 20 nt, Human
ugugccagaggaauccuggc

SEQ ID NO: 2821287 - RNA, 11 nt, Human
ugugcuggggg

SEQ ID NO: 2821288 - RNA, 16 nt, Human
ugugcugggggaauga

SEQ ID NO: 2821289 - RNA, 23 nt, Human
ugugcugggggaaugagcccaga

SEQ ID NO: 2821290 - RNA, 24 nt, Human
ugugcugggggaaugagcccagag

SEQ ID NO: 2821291 - RNA, 21 nt, Human
uguggagguacacucuuauag

SEQ ID NO: 2821292 - RNA, 21 nt, Human
uguggaggaaggauuguaaaa

SEQ ID NO: 2821293 - RNA, 13 nt, Human
uguggagggcaca

SEQ ID NO: 2821294 - RNA, 20 nt, Human
uguggaggaaggauuguaaa

SEQ ID NO: 2821295 - RNA, 14 nt, Human
ugugcauuuguaaa

SEQ ID NO: 2821296 - RNA, 18 nt, Human
uguggaggcagugucauu

SEQ ID NO: 2821297 - RNA, 19 nt, Human
uguggaggcagugucauuu

SEQ ID NO: 2821298 - RNA, 19 nt, Human
uguggagggcacauuccuu

SEQ ID NO: 2821299 - RNA, 14 nt, Human
uguggauaacaaag

SEQ ID NO: 2821300 - RNA, 16 nt, Human
uguggauaacaaagau

SEQ ID NO: 2821301 - RNA, 19 nt, Human
uguggcagucccuuauaau

SEQ ID NO: 2821302 - RNA, 16 nt, Human
uguggcagcaggcagc

SEQ ID NO: 2821303 - RNA, 17 nt, Human
ugugcugcuguaagaaa

SEQ ID NO: 2821304 - RNA, 18 nt, Human
ugugcugcuguaagaaau

SEQ ID NO: 2821305 - RNA, 21 nt, Human
ugugcuggauggagcccaggc

SEQ ID NO: 2821306 - RNA, 19 nt, Human
ugugcuggauggagcccag

SEQ ID NO: 2821307 - RNA, 20 nt, Human
ugugcuggauggagcccagg

SEQ ID NO: 2821308 - RNA, 19 nt, Human
ugugcccagcccggaccuu

SEQ ID NO: 2821309 - RNA, 14 nt, Human
ugugccccaugccu

SEQ ID NO: 2821310 - RNA, 19 nt, Human
ugugccccaugccugucca

SEQ ID NO: 2821311 - RNA, 15 nt, Human
ugugccccaugccug

SEQ ID NO: 2821312 - RNA, 23 nt, Human
ugugccccaugccuguccagccu

SEQ ID NO: 2821313 - RNA, 14 nt, Human
agugagggauuauc

SEQ ID NO: 2821314 - RNA, 15 nt, Human
agugagucgaggaca

SEQ ID NO: 2821315 - RNA, 16 nt, Human
agugagggagauccca

SEQ ID NO: 2821316 - RNA, 16 nt, Human
uguggccacuucuguc

SEQ ID NO: 2821317 - RNA, 21 nt, Human
uguggcaucuuugccuugggc

SEQ ID NO: 2821318 - RNA, 17 nt, Human
uguggcaucuuugccuu

SEQ ID NO: 2821319 - RNA, 15 nt, Human
uguggcauugaaaug

SEQ ID NO: 2821320 - RNA, 12 nt, Human
uguggguguagc

SEQ ID NO: 2821321 - RNA, 15 nt, Human
uguggguguagccag

SEQ ID NO: 2821322 - RNA, 20 nt, Human
agugcuguggccugggcaag

SEQ ID NO: 2821323 - RNA, 18 nt, Human
agugcuguggccugggca

SEQ ID NO: 2821324 - RNA, 14 nt, Human
agugcuguggccug

SEQ ID NO: 2821325 - RNA, 17 nt, Human
agugcuguggccugggc

SEQ ID NO: 2821326 - RNA, 16 nt, Human
agugcuguggccuggg

SEQ ID NO: 2821327 - RNA, 15 nt, Human
uguguaaccauuuua

SEQ ID NO: 2821328 - RNA, 23 nt, Human
uguguaaccauuuuauaaagugc

SEQ ID NO: 2821329 - RNA, 19 nt, Human
uguguaaccucuucaccuu

SEQ ID NO: 2821330 - RNA, 21 nt, Human
ugugguguuuccugcaggcca

SEQ ID NO: 2821331 - RNA, 17 nt, Human
ugugguguuagggugca

SEQ ID NO: 2821332 - RNA, 18 nt, Human
ugugguguuagggugcag

SEQ ID NO: 2821333 - RNA, 15 nt, Human
ugugggucuuccagg

SEQ ID NO: 2821334 - RNA, 16 nt, Human
uguggugugagcuuca

SEQ ID NO: 2821335 - RNA, 13 nt, Human
ugugguguaauuu

SEQ ID NO: 2821336 - RNA, 14 nt, Human
ugugguguaauuua

SEQ ID NO: 2821337 - RNA, 20 nt, Human
ugugguguaauuuauaaaau

SEQ ID NO: 2821338 - RNA, 15 nt, Human
uguggugucugccug

SEQ ID NO: 2821339 - RNA, 15 nt, Human
agugcugagauuaca

SEQ ID NO: 2821340 - RNA, 21 nt, Human
agugcugggauuacaggugug

SEQ ID NO: 2821341 - RNA, 16 nt, Human
agugcugcaucuuaua

SEQ ID NO: 2821342 - RNA, 22 nt, Human
agugcugcaucuuauagcacuu

SEQ ID NO: 2821343 - RNA, 20 nt, Human
agugcugagauuacaggcau

SEQ ID NO: 2821344 - RNA, 21 nt, Human
agugcugagauuacaggcaug

SEQ ID NO: 2821345 - RNA, 19 nt, Human
agugcuguccaugcuucuc

SEQ ID NO: 2821346 - RNA, 20 nt, Human
agugcuguccaugcuucuca

SEQ ID NO: 2821347 - RNA, 22 nt, Human
agugcuguccaugcuucucauc

SEQ ID NO: 2821348 - RNA, 20 nt, Human
agugcugggauuacaggugu

SEQ ID NO: 2821349 - RNA, 16 nt, Human
uguguaauagaaaacu

SEQ ID NO: 2821350 - RNA, 20 nt, Human
ugugucuugcaauggcagcc

SEQ ID NO: 2821351 - RNA, 21 nt, Human
ugugucuugcaauggcagccu

SEQ ID NO: 2821352 - RNA, 18 nt, Human
uguguaauagaaaacuga

SEQ ID NO: 2821353 - RNA, 15 nt, Human
uguguguguauguga

SEQ ID NO: 2821354 - RNA, 9 nt, Human
ugugugugu

SEQ ID NO: 2821355 - RNA, 11 nt, Human
uguguguguau

SEQ ID NO: 2821356 - RNA, 11 nt, Human
uguguguguga

SEQ ID NO: 2821357 - RNA, 13 nt, Human
ugugugugugaau

SEQ ID NO: 2821358 - RNA, 13 nt, Human
ugugugugugaga

SEQ ID NO: 2821359 - RNA, 10 nt, Human
ugugucuuuu

SEQ ID NO: 2821360 - RNA, 22 nt, Human
ugugugaaaggaagcuccacug

SEQ ID NO: 2821361 - RNA, 18 nt, Human
ugugucuuucacagcucc

SEQ ID NO: 2821362 - RNA, 22 nt, Human
ugugucuuucacagcuccuccc

SEQ ID NO: 2821363 - RNA, 20 nt, Human
ugugugugcuuauguaugag

SEQ ID NO: 2821364 - RNA, 14 nt, Human
uguguguguaugug

SEQ ID NO: 2821365 - RNA, 23 nt, Human
uguuaaauaauauggcuaugcuu

SEQ ID NO: 2821366 - RNA, 19 nt, Human
uguguuaaguauguguaaa

SEQ ID NO: 2821367 - RNA, 15 nt, Human
uguguguuugugcug

SEQ ID NO: 2821368 - RNA, 16 nt, Human
uguguguuugugcuga

SEQ ID NO: 2821369 - RNA, 18 nt, Human
uguguucucggagugugu

SEQ ID NO: 2821370 - RNA, 13 nt, Human
uguguugaaaacc

SEQ ID NO: 2821371 - RNA, 14 nt, Human
uguguugaaaacca

SEQ ID NO: 2821372 - RNA, 16 nt, Human
uguguugaaaaccaaa

SEQ ID NO: 2821373 - RNA, 13 nt, Human
uguguugaaacug

SEQ ID NO: 2821374 - RNA, 13 nt, Human
uguguucuaucca

SEQ ID NO: 2821375 - RNA, 20 nt, Human
uguguucuauccaaacaugu

SEQ ID NO: 2821376 - RNA, 18 nt, Human
uguguucccuuugucuuu

SEQ ID NO: 2821377 - RNA, 21 nt, Human
uguguucccuuugucuuucaa

SEQ ID NO: 2821378 - RNA, 16 nt, Human
uguuaaguauguguaa

SEQ ID NO: 2821379 - RNA, 15 nt, Human
uguuaaguaugugua

SEQ ID NO: 2821380 - RNA, 15 nt, Human
uguuaauuacaccau

SEQ ID NO: 2821381 - RNA, 18 nt, Human
uguuaauuauaggagccu

SEQ ID NO: 2821382 - RNA, 13 nt, Human
uguuaauuuaugc

SEQ ID NO: 2821383 - RNA, 13 nt, Human
uguuaauuucagu

SEQ ID NO: 2821384 - RNA, 19 nt, Human
uguuaauuuuuugguacaa

SEQ ID NO: 2821385 - RNA, 21 nt, Human
uguuaauuuuuugguacaaaa

SEQ ID NO: 2821386 - RNA, 22 nt, Human
uguuaauuuuuugguacaaaaa

SEQ ID NO: 2821387 - RNA, 18 nt, Human
uguuaaaugaaauuguaa

SEQ ID NO: 2821388 - RNA, 19 nt, Human
uguuaaaugaaauuguaaa

SEQ ID NO: 2821389 - RNA, 14 nt, Human
uguuaaauuuguaa

SEQ ID NO: 2821390 - RNA, 15 nt, Human
uguuaaauuuguaag

SEQ ID NO: 2821391 - RNA, 16 nt, Human
uguuaaauuuguaagu

SEQ ID NO: 2821392 - RNA, 17 nt, Human
uguuaaauuuguaaguu

SEQ ID NO: 2821393 - RNA, 18 nt, Human
uguuaaauuuguaaguuu

SEQ ID NO: 2821394 - RNA, 19 nt, Human
uguuaaauuuguaaguuuc

SEQ ID NO: 2821395 - RNA, 21 nt, Human
uguuaaauuuguaaguuucag

SEQ ID NO: 2821396 - RNA, 23 nt, Human
uguuaaggaaacucuuaucucag

SEQ ID NO: 2821397 - RNA, 22 nt, Human
uguuaagguccugaaaguaacu

SEQ ID NO: 2821398 - RNA, 24 nt, Human
uguuaagguccugaaaguaacuca

SEQ ID NO: 2821399 - RNA, 21 nt, Human
uguuaaggaaacucuuaucuc

SEQ ID NO: 2821400 - RNA, 22 nt, Human
uguuaaggaaacucuuaucuca

SEQ ID NO: 2821401 - RNA, 20 nt, Human
uguuaagcgugucuguauuu

SEQ ID NO: 2821402 - RNA, 14 nt, Human
uguuaaggaaacuc

SEQ ID NO: 2821403 - RNA, 15 nt, Human
uguuaaggaaacucu

SEQ ID NO: 2821404 - RNA, 16 nt, Human
uguuaaggaaacucuu

SEQ ID NO: 2821405 - RNA, 17 nt, Human
uguuaaggaaacucuua

SEQ ID NO: 2821406 - RNA, 20 nt, Human
uguuaaggaaacucuuaucu

SEQ ID NO: 2821407 - RNA, 14 nt, Human
agugugucuaaauu

SEQ ID NO: 2821408 - RNA, 15 nt, Human
uguuauaucauaugu

SEQ ID NO: 2821409 - RNA, 17 nt, Human
uguuauaucauauguau

SEQ ID NO: 2821410 - RNA, 16 nt, Human
uguuauauccccugcu

SEQ ID NO: 2821411 - RNA, 19 nt, Human
uguuauauccccugcuacc

SEQ ID NO: 2821412 - RNA, 16 nt, Human
uguucugggacacagu

SEQ ID NO: 2821413 - RNA, 14 nt, Human
agugugugacauuc

SEQ ID NO: 2821414 - RNA, 15 nt, Human
uguucugggcucuuu

SEQ ID NO: 2821415 - RNA, 18 nt, Human
uguucccuuugucuuuca

SEQ ID NO: 2821416 - RNA, 19 nt, Human
uguucccuuugucuuucaa

SEQ ID NO: 2821417 - RNA, 20 nt, Human
uguucccuuugucuuucaaa

SEQ ID NO: 2821418 - RNA, 14 nt, Human
uguuccagcucuuu

SEQ ID NO: 2821419 - RNA, 18 nt, Human
uguuccaguaaucuaaua

SEQ ID NO: 2821420 - RNA, 17 nt, Human
uguucccaccugcugga

SEQ ID NO: 2821421 - RNA, 18 nt, Human
uguugcccaggcaggucu

SEQ ID NO: 2821422 - RNA, 17 nt, Human
uguugcccaggcagguc

SEQ ID NO: 2821423 - RNA, 16 nt, Human
uguugcccaggcaggu

SEQ ID NO: 2821424 - RNA, 15 nt, Human
uguugcccaggcagg

SEQ ID NO: 2821425 - RNA, 12 nt, Human
uguugcccaggc

SEQ ID NO: 2821426 - RNA, 13 nt, Human
uguugcccaggca

SEQ ID NO: 2821427 - RNA, 20 nt, Human
uguugauuuuuacuguguuu

SEQ ID NO: 2821428 - RNA, 18 nt, Human
uguugauuuuuacugugu

SEQ ID NO: 2821429 - RNA, 22 nt, Human
uguugauuuuuacuguguuuua

SEQ ID NO: 2821430 - RNA, 14 nt, Human
uguucugugucuuu

SEQ ID NO: 2821431 - RNA, 13 nt, Human
uguucugugucuu

SEQ ID NO: 2821432 - RNA, 22 nt, Human
uguucugugauacagaacucuu

SEQ ID NO: 2821433 - RNA, 19 nt, Human
uguucuguuuguuauuguu

SEQ ID NO: 2821434 - RNA, 14 nt, Human
uguucuguuucaag

SEQ ID NO: 2821435 - RNA, 14 nt, Human
uguucuguuuguua

SEQ ID NO: 2821436 - RNA, 15 nt, Human
aguggacagucugcu

SEQ ID NO: 2821437 - RNA, 22 nt, Human
aguggaauccuauauagaaugc

SEQ ID NO: 2821438 - RNA, 14 nt, Human
aguggaauuucuug

SEQ ID NO: 2821439 - RNA, 17 nt, Human
aguggaauuucuuguuu

SEQ ID NO: 2821440 - RNA, 18 nt, Human
uguuacaaaguuguaugu

SEQ ID NO: 2821441 - RNA, 17 nt, Human
aguggugcgaucugggu

SEQ ID NO: 2821442 - RNA, 16 nt, Human
aguggugcgaucuggg

SEQ ID NO: 2821443 - RNA, 15 nt, Human
uguuaagguucaaga

SEQ ID NO: 2821444 - RNA, 18 nt, Human
agugugcauggaggcccu

SEQ ID NO: 2821445 - RNA, 19 nt, Human
agugugcauggaggcccuc

SEQ ID NO: 2821446 - RNA, 15 nt, Human
agugugccacaugga

SEQ ID NO: 2821447 - RNA, 21 nt, Human
agugugcaguucuaguuugca

SEQ ID NO: 2821448 - RNA, 23 nt, Human
agugugguguuuccugcaggcca

SEQ ID NO: 2821449 - RNA, 17 nt, Human
aguguacuuaacuauuc

SEQ ID NO: 2821450 - RNA, 14 nt, Human
aguguaccuccucu

SEQ ID NO: 2821451 - RNA, 15 nt, Human
aguguaccuccucuc

SEQ ID NO: 2821452 - RNA, 17 nt, Human
aguguaccuccucucag

SEQ ID NO: 2821453 - RNA, 21 nt, Human
aguguaccuccucucaguguu

SEQ ID NO: 2821454 - RNA, 22 nt, Human
aguguaccuccucucaguguuu

SEQ ID NO: 2821455 - RNA, 13 nt, Human
aguguaccugugu

SEQ ID NO: 2821456 - RNA, 17 nt, Human
aguguaccuguguacau

SEQ ID NO: 2821457 - RNA, 20 nt, Human
aguguaccuguguacauaac

SEQ ID NO: 2821458 - RNA, 16 nt, Human
aguguacgauucuuaa

SEQ ID NO: 2821459 - RNA, 12 nt, Human
aguguagaagca

SEQ ID NO: 2821460 - RNA, 13 nt, Human
aguguagaagcau

SEQ ID NO: 2821461 - RNA, 14 nt, Human
aguguagaagcauu

SEQ ID NO: 2821462 - RNA, 15 nt, Human
aguguagaagcauuc

SEQ ID NO: 2821463 - RNA, 16 nt, Human
aguguagaagcauucc

SEQ ID NO: 2821464 - RNA, 17 nt, Human
aguguagaagcauuccu

SEQ ID NO: 2821465 - RNA, 18 nt, Human
aguguagaagcauuccuu

SEQ ID NO: 2821466 - RNA, 19 nt, Human
aguguagaagcauuccuuc

SEQ ID NO: 2821467 - RNA, 20 nt, Human
aguguagaagcauuccuucu

SEQ ID NO: 2821468 - RNA, 15 nt, Human
aguggugugaucuca

SEQ ID NO: 2821469 - RNA, 16 nt, Human
aguguaccauuugccu

SEQ ID NO: 2821470 - RNA, 15 nt, Human
aguguaaauguuagu

SEQ ID NO: 2821471 - RNA, 19 nt, Human
aucaaucaaauaaguauuu

SEQ ID NO: 2821472 - RNA, 19 nt, Human
aucaaucaucugugugaaa

SEQ ID NO: 2821473 - RNA, 19 nt, Human
aucacaaauccaaaggaaa

SEQ ID NO: 2821474 - RNA, 20 nt, Human
aucaaucaucugugugaaaa

SEQ ID NO: 2821475 - RNA, 13 nt, Human
aucacaaaaauuu

SEQ ID NO: 2821476 - RNA, 19 nt, Human
aucacaaauuucacuuaua

SEQ ID NO: 2821477 - RNA, 21 nt, Human
aucacaaccaccguuacaagu

SEQ ID NO: 2821478 - RNA, 22 nt, Human
aucacggcucacugcagccuca

SEQ ID NO: 2821479 - RNA, 13 nt, Human
aucacaauacaga

SEQ ID NO: 2821480 - RNA, 14 nt, Human
aucacaauacagau

SEQ ID NO: 2821481 - RNA, 16 nt, Human
aucacaauacagauaa

SEQ ID NO: 2821482 - RNA, 15 nt, Human
aucacaauuuuuaau

SEQ ID NO: 2821483 - RNA, 16 nt, Human
aucacaauuuuuaaug

SEQ ID NO: 2821484 - RNA, 17 nt, Human
aucacaauuuuuaaugg

SEQ ID NO: 2821485 - RNA, 13 nt, Human
aucacguguacug

SEQ ID NO: 2821486 - RNA, 16 nt, Human
aucacguguacuggcu

SEQ ID NO: 2821487 - RNA, 19 nt, Human
aucacguguacuggcuccu

SEQ ID NO: 2821488 - RNA, 20 nt, Human
aucacuaauacuaauucauu

SEQ ID NO: 2821489 - RNA, 18 nt, Human
uuccuuuguguuucuauu

SEQ ID NO: 2821490 - RNA, 20 nt, Human
uuccuuugugguuuuaugga

SEQ ID NO: 2821491 - RNA, 13 nt, Human
uuccuuugugugu

SEQ ID NO: 2821492 - RNA, 20 nt, Human
uuccuuuuaaaacacuucca

SEQ ID NO: 2821493 - RNA, 21 nt, Human
uuccuuuuaaaacacuuccau

SEQ ID NO: 2821494 - RNA, 22 nt, Human
uuccuuuuaaaacacuuccaua

SEQ ID NO: 2821495 - RNA, 21 nt, Human
uuccuuuuaaguaagguccaa

SEQ ID NO: 2821496 - RNA, 15 nt, Human
aucacuguccuccac

SEQ ID NO: 2821497 - RNA, 14 nt, Human
aucacuagccuguc

SEQ ID NO: 2821498 - RNA, 14 nt, Human
aucacuguggcugu

SEQ ID NO: 2821499 - RNA, 15 nt, Human
aucacuguggcuguc

SEQ ID NO: 2821500 - RNA, 16 nt, Human
aucacuguggcugucu

SEQ ID NO: 2821501 - RNA, 17 nt, Human
aucacuguggcugucug

SEQ ID NO: 2821502 - RNA, 16 nt, Human
aucacuguucaugcug

SEQ ID NO: 2821503 - RNA, 17 nt, Human
uuccuuugggccucugc

SEQ ID NO: 2821504 - RNA, 16 nt, Human
uuccuuugucuucaaa

SEQ ID NO: 2821505 - RNA, 17 nt, Human
uuccuuugucuucaaac

SEQ ID NO: 2821506 - RNA, 18 nt, Human
aucaagaugucagacugg

SEQ ID NO: 2821507 - RNA, 13 nt, Human
aucaaucaaauaa

SEQ ID NO: 2821508 - RNA, 15 nt, Human
aucaaucaaauaagu

SEQ ID NO: 2821509 - RNA, 22 nt, Human
aucaauaguguccuaugcaaua

SEQ ID NO: 2821510 - RNA, 23 nt, Human
aucaauaguguccuaugcaauaa

SEQ ID NO: 2821511 - RNA, 15 nt, Human
aucaauaucuaauau

SEQ ID NO: 2821512 - RNA, 18 nt, Human
aucaauaucuaauauaua

SEQ ID NO: 2821513 - RNA, 13 nt, Human
aucaagacauagc

SEQ ID NO: 2821514 - RNA, 21 nt, Human
auauuuuguauauaucugcuu

SEQ ID NO: 2821515 - RNA, 13 nt, Human
auauuuuguauau

SEQ ID NO: 2821516 - RNA, 14 nt, Human
auauuuuguauaua

SEQ ID NO: 2821517 - RNA, 12 nt, Human
uuccucuuccaa

SEQ ID NO: 2821518 - RNA, 15 nt, Human
aucaagacuggaagg

SEQ ID NO: 2821519 - RNA, 15 nt, Human
aucaagagcugcccu

SEQ ID NO: 2821520 - RNA, 16 nt, Human
aucaagagcugcccuc

SEQ ID NO: 2821521 - RNA, 17 nt, Human
aucaagagcugcccucc

SEQ ID NO: 2821522 - RNA, 19 nt, Human
aucaagagcugcccuccuu

SEQ ID NO: 2821523 - RNA, 20 nt, Human
aucaagagcugcccuccuug

SEQ ID NO: 2821524 - RNA, 16 nt, Human
aucaagaggcugagac

SEQ ID NO: 2821525 - RNA, 17 nt, Human
aucaagaggcugagaca

SEQ ID NO: 2821526 - RNA, 22 nt, Human
aucaagaugagagaacuggagg

SEQ ID NO: 2821527 - RNA, 21 nt, Human
auauuuugcacaguuagcaaa

SEQ ID NO: 2821528 - RNA, 14 nt, Human
auauuuugauaaua

SEQ ID NO: 2821529 - RNA, 23 nt, Human
auauuuugauaauaaauugaaau

SEQ ID NO: 2821530 - RNA, 17 nt, Human
auauuuugauaauaaua

SEQ ID NO: 2821531 - RNA, 18 nt, Human
auauuuugauaauaauau

SEQ ID NO: 2821532 - RNA, 21 nt, Human
auauuuucuuuaaaagacaaa

SEQ ID NO: 2821533 - RNA, 16 nt, Human
uuccuaauaucaaaug

SEQ ID NO: 2821534 - RNA, 19 nt, Human
uuccuaauaucaaaugcag

SEQ ID NO: 2821535 - RNA, 17 nt, Human
uuccuaaucagaaauuu

SEQ ID NO: 2821536 - RNA, 20 nt, Human
uuccuaaucagaaauuuuua

SEQ ID NO: 2821537 - RNA, 23 nt, Human
uuccuaaucagaaauuuuuauca

SEQ ID NO: 2821538 - RNA, 19 nt, Human
uuccucuagugcccuccac

SEQ ID NO: 2821539 - RNA, 15 nt, Human
uuccucgccucuccc

SEQ ID NO: 2821540 - RNA, 17 nt, Human
uuccucgccucucccac

SEQ ID NO: 2821541 - RNA, 14 nt, Human
uuccuccuuuauca

SEQ ID NO: 2821542 - RNA, 17 nt, Human
uuccucuauacaucucu

SEQ ID NO: 2821543 - RNA, 20 nt, Human
uuccucuauacaucucuccc

SEQ ID NO: 2821544 - RNA, 22 nt, Human
uuccucuauacaucucucccca

SEQ ID NO: 2821545 - RNA, 23 nt, Human
uuccucuagugcccuccacagcc

SEQ ID NO: 2821546 - RNA, 13 nt, Human
uuccucuucccca

SEQ ID NO: 2821547 - RNA, 20 nt, Human
uuccucuucuauuuuguaaa

SEQ ID NO: 2821548 - RNA, 21 nt, Human
uuccucuguauugugcugauu

SEQ ID NO: 2821549 - RNA, 21 nt, Human
uuccucuguuucuccuucuga

SEQ ID NO: 2821550 - RNA, 14 nt, Human
uuccuguuaaugua

SEQ ID NO: 2821551 - RNA, 22 nt, Human
uuccuucagugcaucugggaag

SEQ ID NO: 2821552 - RNA, 13 nt, Human
auauuuucacaau

SEQ ID NO: 2821553 - RNA, 17 nt, Human
auauuuucacaauguca

SEQ ID NO: 2821554 - RNA, 14 nt, Human
auauuuucaguaau

SEQ ID NO: 2821555 - RNA, 19 nt, Human
auauuuucaacgcagcccu

SEQ ID NO: 2821556 - RNA, 20 nt, Human
auauuuucaacgcagcccug

SEQ ID NO: 2821557 - RNA, 15 nt, Human
uuccuucagcuucca

SEQ ID NO: 2821558 - RNA, 19 nt, Human
uuccuguuggauuuguuua

SEQ ID NO: 2821559 - RNA, 20 nt, Human
uuccuguuggauuuguuuaa

SEQ ID NO: 2821560 - RNA, 20 nt, Human
auauuucugcuuucuuugau

SEQ ID NO: 2821561 - RNA, 13 nt, Human
auauuucucuagu

SEQ ID NO: 2821562 - RNA, 15 nt, Human
auauuucgaaagcug

SEQ ID NO: 2821563 - RNA, 12 nt, Human
auauuuaaacuc

SEQ ID NO: 2821564 - RNA, 15 nt, Human
auauuuaaacucaag

SEQ ID NO: 2821565 - RNA, 23 nt, Human
auauuuaaacucaagacaaugca

SEQ ID NO: 2821566 - RNA, 14 nt, Human
auauuuaaagacag

SEQ ID NO: 2821567 - RNA, 14 nt, Human
auauuuaaaaaugu

SEQ ID NO: 2821568 - RNA, 15 nt, Human
auauuuaaaaauguc

SEQ ID NO: 2821569 - RNA, 16 nt, Human
auauuuaaaaaugucu

SEQ ID NO: 2821570 - RNA, 17 nt, Human
auauuuaaaaaugucuu

SEQ ID NO: 2821571 - RNA, 18 nt, Human
auauuuaaaaaugucuug

SEQ ID NO: 2821572 - RNA, 12 nt, Human
auauuuaaacag

SEQ ID NO: 2821573 - RNA, 14 nt, Human
auauuuaaacagca

SEQ ID NO: 2821574 - RNA, 18 nt, Human
auauuuaaacagcagugu

SEQ ID NO: 2821575 - RNA, 15 nt, Human
auauuguugacaacu

SEQ ID NO: 2821576 - RNA, 21 nt, Human
auauuguugacaacugugacu

SEQ ID NO: 2821577 - RNA, 13 nt, Human
auauuguuuuucu

SEQ ID NO: 2821578 - RNA, 17 nt, Human
auauuguuuuucuuucu

SEQ ID NO: 2821579 - RNA, 13 nt, Human
auauuguugacaa

SEQ ID NO: 2821580 - RNA, 14 nt, Human
auauuguuaaucuc

SEQ ID NO: 2821581 - RNA, 17 nt, Human
auauuguuaaucucugu

SEQ ID NO: 2821582 - RNA, 15 nt, Human
auauuguucaaacaa

SEQ ID NO: 2821583 - RNA, 18 nt, Human
auauuguucaaacaauau

SEQ ID NO: 2821584 - RNA, 20 nt, Human
auauuguucaaacaauauca

SEQ ID NO: 2821585 - RNA, 21 nt, Human
auauuguucaaacaauaucau

SEQ ID NO: 2821586 - RNA, 22 nt, Human
auauuguucaaacaauaucaua

SEQ ID NO: 2821587 - RNA, 21 nt, Human
auauuguguuuguguauuuac

SEQ ID NO: 2821588 - RNA, 17 nt, Human
auauuguguuuguguau

SEQ ID NO: 2821589 - RNA, 18 nt, Human
auauuguguugugaaugu

SEQ ID NO: 2821590 - RNA, 13 nt, Human
auauuguguuugu

SEQ ID NO: 2821591 - RNA, 17 nt, Human
auauuguguugugaaug

SEQ ID NO: 2821592 - RNA, 13 nt, Human
auauugaugaaaa

SEQ ID NO: 2821593 - RNA, 14 nt, Human
auauugaugaaaag

SEQ ID NO: 2821594 - RNA, 16 nt, Human
auauugcccaggcugg

SEQ ID NO: 2821595 - RNA, 17 nt, Human
auauugcccaggcuggu

SEQ ID NO: 2821596 - RNA, 13 nt, Human
auauuuguaggag

SEQ ID NO: 2821597 - RNA, 12 nt, Human
auauuuguaucg

SEQ ID NO: 2821598 - RNA, 14 nt, Human
auauuuguggaaua

SEQ ID NO: 2821599 - RNA, 17 nt, Human
auauuuguguauuuaac

SEQ ID NO: 2821600 - RNA, 17 nt, Human
auauuugugcuauagua

SEQ ID NO: 2821601 - RNA, 22 nt, Human
auauuugugcuauaguauuuga

SEQ ID NO: 2821602 - RNA, 19 nt, Human
auauuucuucguucuuuuu

SEQ ID NO: 2821603 - RNA, 15 nt, Human
auauuugaaaaaaac

SEQ ID NO: 2821604 - RNA, 23 nt, Human
auauuugaaaaaaacuucauucu

SEQ ID NO: 2821605 - RNA, 12 nt, Human
auauuuguacau

SEQ ID NO: 2821606 - RNA, 13 nt, Human
auauuuguacaua

SEQ ID NO: 2821607 - RNA, 18 nt, Human
auauuuguacuguuuaau

SEQ ID NO: 2821608 - RNA, 22 nt, Human
auauuuguacuguuuaauguuc

SEQ ID NO: 2821609 - RNA, 15 nt, Human
auauuuguaaggcuu

SEQ ID NO: 2821610 - RNA, 21 nt, Human
auauuuguaaggcuuguucca

SEQ ID NO: 2821611 - RNA, 13 nt, Human
auauuaaaucugc

SEQ ID NO: 2821612 - RNA, 12 nt, Human
auauuaaaucug

SEQ ID NO: 2821613 - RNA, 14 nt, Human
auauuaacaugcuu

SEQ ID NO: 2821614 - RNA, 14 nt, Human
uucauguggcugua

SEQ ID NO: 2821615 - RNA, 22 nt, Human
uucauguugcacacccacucag

SEQ ID NO: 2821616 - RNA, 21 nt, Human
uucaugugugccaaggcugau

SEQ ID NO: 2821617 - RNA, 16 nt, Human
uucauguuuugugacu

SEQ ID NO: 2821618 - RNA, 17 nt, Human
uucauguuuugugacua

SEQ ID NO: 2821619 - RNA, 18 nt, Human
uucauguuuugugacuau

SEQ ID NO: 2821620 - RNA, 14 nt, Human
uucauguuugcuuc

SEQ ID NO: 2821621 - RNA, 14 nt, Human
uucauguuuggugc

SEQ ID NO: 2821622 - RNA, 15 nt, Human
uucauguuuggugca

SEQ ID NO: 2821623 - RNA, 19 nt, Human
uucauguuuggugcauaga

SEQ ID NO: 2821624 - RNA, 22 nt, Human
uucauguuuggugcauagaacu

SEQ ID NO: 2821625 - RNA, 18 nt, Human
auauguuuuaagaggcag

SEQ ID NO: 2821626 - RNA, 20 nt, Human
auauguuuuaagaggcaggg

SEQ ID NO: 2821627 - RNA, 17 nt, Human
auauguuuuuaaaggug

SEQ ID NO: 2821628 - RNA, 15 nt, Human
auauguuuuauuuca

SEQ ID NO: 2821629 - RNA, 13 nt, Human
auauguuuccuug

SEQ ID NO: 2821630 - RNA, 18 nt, Human
auauguuuccuuguuuau

SEQ ID NO: 2821631 - RNA, 20 nt, Human
auauguuuccuuguuuauca

SEQ ID NO: 2821632 - RNA, 16 nt, Human
auauucuguuggccag

SEQ ID NO: 2821633 - RNA, 13 nt, Human
auauucuuauaaa

SEQ ID NO: 2821634 - RNA, 21 nt, Human
auauucuggccagacucgaug

SEQ ID NO: 2821635 - RNA, 24 nt, Human
auauucugaagcaacauuuuagcu

SEQ ID NO: 2821636 - RNA, 16 nt, Human
auauugauuguccuuu

SEQ ID NO: 2821637 - RNA, 18 nt, Human
auauugaauauaauauau

SEQ ID NO: 2821638 - RNA, 14 nt, Human
auauugaagacaau

SEQ ID NO: 2821639 - RNA, 15 nt, Human
auauugaagacaauu

SEQ ID NO: 2821640 - RNA, 16 nt, Human
auauugaagacaauuu

SEQ ID NO: 2821641 - RNA, 17 nt, Human
auauugaagacaauuug

SEQ ID NO: 2821642 - RNA, 20 nt, Human
auauugaagacaauuugaua

SEQ ID NO: 2821643 - RNA, 21 nt, Human
auauugaagacaauuugauac

SEQ ID NO: 2821644 - RNA, 12 nt, Human
auauucuuguca

SEQ ID NO: 2821645 - RNA, 13 nt, Human
auauucuugucaa

SEQ ID NO: 2821646 - RNA, 15 nt, Human
auauucuugugcuuu

SEQ ID NO: 2821647 - RNA, 21 nt, Human
auauucuuuucugcaaaauag

SEQ ID NO: 2821648 - RNA, 13 nt, Human
auauugaaaaaaa

SEQ ID NO: 2821649 - RNA, 16 nt, Human
auauugaaaaaaauaa

SEQ ID NO: 2821650 - RNA, 13 nt, Human
uucugcauugcua

SEQ ID NO: 2821651 - RNA, 16 nt, Human
uucugcauugcuagau

SEQ ID NO: 2821652 - RNA, 20 nt, Human
uucugcauugcuagauaaaa

SEQ ID NO: 2821653 - RNA, 22 nt, Human
uucugcauugcuagauaaaagc

SEQ ID NO: 2821654 - RNA, 19 nt, Human
uucugaaaguuacccacug

SEQ ID NO: 2821655 - RNA, 18 nt, Human
uucucuuaaacuugugaa

SEQ ID NO: 2821656 - RNA, 22 nt, Human
uucucuuuucuaguuugcucau

SEQ ID NO: 2821657 - RNA, 13 nt, Human
uucugaaaagaaa

SEQ ID NO: 2821658 - RNA, 15 nt, Human
uucugaaaagaaaua

SEQ ID NO: 2821659 - RNA, 17 nt, Human
uucugaaaagaaauaau

SEQ ID NO: 2821660 - RNA, 19 nt, Human
uucucugugacccacuucu

SEQ ID NO: 2821661 - RNA, 16 nt, Human
uucucugugucuaaga

SEQ ID NO: 2821662 - RNA, 17 nt, Human
uucucugugucuaagau

SEQ ID NO: 2821663 - RNA, 18 nt, Human
uucucugugucuaagauu

SEQ ID NO: 2821664 - RNA, 23 nt, Human
uucucuguucuacccguuccaaa

SEQ ID NO: 2821665 - RNA, 20 nt, Human
uucucugugucuaagauucu

SEQ ID NO: 2821666 - RNA, 21 nt, Human
uucucugugucuaagauucua

SEQ ID NO: 2821667 - RNA, 22 nt, Human
uucucugugucuaagauucuag

SEQ ID NO: 2821668 - RNA, 23 nt, Human
uucucugugucuaagauucuaga

SEQ ID NO: 2821669 - RNA, 14 nt, Human
uucuguaaauacca

SEQ ID NO: 2821670 - RNA, 23 nt, Human
uucuguaaauaccauugacacau

SEQ ID NO: 2821671 - RNA, 21 nt, Human
uucuggucucuaggcugggga

SEQ ID NO: 2821672 - RNA, 18 nt, Human
uucuggguggccucggga

SEQ ID NO: 2821673 - RNA, 14 nt, Human
uucuggguggccuc

SEQ ID NO: 2821674 - RNA, 16 nt, Human
uucugggucuuuugcu

SEQ ID NO: 2821675 - RNA, 17 nt, Human
uucugggucuuuugcua

SEQ ID NO: 2821676 - RNA, 15 nt, Human
uucugggguccccag

SEQ ID NO: 2821677 - RNA, 22 nt, Human
uucugggacacaguucaauucu

SEQ ID NO: 2821678 - RNA, 11 nt, Human
uucugggacac

SEQ ID NO: 2821679 - RNA, 10 nt, Human
uucugggaca

SEQ ID NO: 2821680 - RNA, 17 nt, Human
uucugccucucuaggac

SEQ ID NO: 2821681 - RNA, 18 nt, Human
uucugccucucuaggacc

SEQ ID NO: 2821682 - RNA, 22 nt, Human
uucugccgcccccuccugaacc

SEQ ID NO: 2821683 - RNA, 21 nt, Human
uucugccgcccccuccugaac

SEQ ID NO: 2821684 - RNA, 15 nt, Human
uucugccgcccccuc

SEQ ID NO: 2821685 - RNA, 17 nt, Human
aucccucgauauuuuua

SEQ ID NO: 2821686 - RNA, 20 nt, Human
aucccucgauauuuuuaaag

SEQ ID NO: 2821687 - RNA, 24 nt, Human
aucccucgauauuuuuaaagaucu

SEQ ID NO: 2821688 - RNA, 15 nt, Human
aucccuccccaguuc

SEQ ID NO: 2821689 - RNA, 16 nt, Human
aucccuccccaguuca

SEQ ID NO: 2821690 - RNA, 17 nt, Human
aucccaggggcccaagg

SEQ ID NO: 2821691 - RNA, 19 nt, Human
aucccaggggcccaaggcg

SEQ ID NO: 2821692 - RNA, 16 nt, Human
aucccugucuuuccua

SEQ ID NO: 2821693 - RNA, 12 nt, Human
aucccugugagg

SEQ ID NO: 2821694 - RNA, 13 nt, Human
aucccuguuuaau

SEQ ID NO: 2821695 - RNA, 14 nt, Human
aucccuguuuaaua

SEQ ID NO: 2821696 - RNA, 15 nt, Human
aucccuguuuaauau

SEQ ID NO: 2821697 - RNA, 16 nt, Human
aucccuguuuaauauu

SEQ ID NO: 2821698 - RNA, 22 nt, Human
aucccuguuuaauauuuaaaca

SEQ ID NO: 2821699 - RNA, 23 nt, Human
aucccuguuuaauauuuaaacag

SEQ ID NO: 2821700 - RNA, 17 nt, Human
aucccuguuuaauauuu

SEQ ID NO: 2821701 - RNA, 18 nt, Human
aucccuguuuaauauuua

SEQ ID NO: 2821702 - RNA, 20 nt, Human
aucccuguuuaauauuuaaa

SEQ ID NO: 2821703 - RNA, 21 nt, Human
aucccuguuuaauauuuaaac

SEQ ID NO: 2821704 - RNA, 23 nt, Human
aucccucuaaugagacugaccau

SEQ ID NO: 2821705 - RNA, 14 nt, Human
aucccucucuggau

SEQ ID NO: 2821706 - RNA, 16 nt, Human
aucccucucuggauug

SEQ ID NO: 2821707 - RNA, 15 nt, Human
aucccugccugguca

SEQ ID NO: 2821708 - RNA, 13 nt, Human
uucuguacuuccu

SEQ ID NO: 2821709 - RNA, 15 nt, Human
uucuguacuuccuga

SEQ ID NO: 2821710 - RNA, 17 nt, Human
uucuguacuuccugagu

SEQ ID NO: 2821711 - RNA, 14 nt, Human
aucauuugaggaau

SEQ ID NO: 2821712 - RNA, 18 nt, Human
aucauuuguuggaaugaa

SEQ ID NO: 2821713 - RNA, 13 nt, Human
aucauuugcuuuu

SEQ ID NO: 2821714 - RNA, 16 nt, Human
auccagguucagcuug

SEQ ID NO: 2821715 - RNA, 15 nt, Human
auccagguucagcuu

SEQ ID NO: 2821716 - RNA, 17 nt, Human
auccaggguggugguga

SEQ ID NO: 2821717 - RNA, 15 nt, Human
auccagguacgcaca

SEQ ID NO: 2821718 - RNA, 16 nt, Human
auccagguacgcacag

SEQ ID NO: 2821719 - RNA, 17 nt, Human
auccagguacgcacaga

SEQ ID NO: 2821720 - RNA, 19 nt, Human
auccagguacgcacagaca

SEQ ID NO: 2821721 - RNA, 20 nt, Human
auccagguacgcacagacag

SEQ ID NO: 2821722 - RNA, 21 nt, Human
auccagguacgcacagacagg

SEQ ID NO: 2821723 - RNA, 22 nt, Human
auccagguacgcacagacaggu

SEQ ID NO: 2821724 - RNA, 14 nt, Human
auccaggucaacag

SEQ ID NO: 2821725 - RNA, 15 nt, Human
auccaggucaacaga

SEQ ID NO: 2821726 - RNA, 16 nt, Human
auccaggucaacagaa

SEQ ID NO: 2821727 - RNA, 17 nt, Human
auccaggucaacagaau

SEQ ID NO: 2821728 - RNA, 19 nt, Human
auccaggucaacagaauga

SEQ ID NO: 2821729 - RNA, 20 nt, Human
auccaggucaacagaaugaa

SEQ ID NO: 2821730 - RNA, 21 nt, Human
auccaggucaacagaaugaaa

SEQ ID NO: 2821731 - RNA, 23 nt, Human
auccaggucaacagaaugaaaaa

SEQ ID NO: 2821732 - RNA, 15 nt, Human
aucccaaccagugcc

SEQ ID NO: 2821733 - RNA, 16 nt, Human
aucccaaccagugcca

SEQ ID NO: 2821734 - RNA, 17 nt, Human
aucccaaccagugccaa

SEQ ID NO: 2821735 - RNA, 19 nt, Human
aucccaaccagugccaagg

SEQ ID NO: 2821736 - RNA, 20 nt, Human
aucccaaccagugccaagga

SEQ ID NO: 2821737 - RNA, 21 nt, Human
aucccaaccagugccaaggac

SEQ ID NO: 2821738 - RNA, 19 nt, Human
aucauuuguucugggagua

SEQ ID NO: 2821739 - RNA, 15 nt, Human
aucccaacagccaug

SEQ ID NO: 2821740 - RNA, 22 nt, Human
aucccaggacaccacacccagc

SEQ ID NO: 2821741 - RNA, 23 nt, Human
aucccaggaucgcaagagccaug

SEQ ID NO: 2821742 - RNA, 19 nt, Human
aucccaggaugcugggugg

SEQ ID NO: 2821743 - RNA, 17 nt, Human
aucccaggauguacaag

SEQ ID NO: 2821744 - RNA, 16 nt, Human
auccauguuuguaaaa

SEQ ID NO: 2821745 - RNA, 17 nt, Human
auccauucccaagaaau

SEQ ID NO: 2821746 - RNA, 19 nt, Human
auccauucccaagaaaugc

SEQ ID NO: 2821747 - RNA, 18 nt, Human
auccauguccuaugugug

SEQ ID NO: 2821748 - RNA, 19 nt, Human
auccauguccuauguguga

SEQ ID NO: 2821749 - RNA, 14 nt, Human
uucuaguuugcauu

SEQ ID NO: 2821750 - RNA, 15 nt, Human
uucuaguuugcauuc

SEQ ID NO: 2821751 - RNA, 15 nt, Human
uucuaguuugcucau

SEQ ID NO: 2821752 - RNA, 14 nt, Human
uucuauaacagaua

SEQ ID NO: 2821753 - RNA, 15 nt, Human
uucuauaacagauau

SEQ ID NO: 2821754 - RNA, 13 nt, Human
uucuauaaggcca

SEQ ID NO: 2821755 - RNA, 21 nt, Human
uucuauaaggccauaaaacag

SEQ ID NO: 2821756 - RNA, 14 nt, Human
uucuauaaggccau

SEQ ID NO: 2821757 - RNA, 18 nt, Human
uucucaaugaaaaauagu

SEQ ID NO: 2821758 - RNA, 14 nt, Human
uucucaaugaaaaa

SEQ ID NO: 2821759 - RNA, 13 nt, Human
uucucaaugaaaa

SEQ ID NO: 2821760 - RNA, 12 nt, Human
uucucaaugaaa

SEQ ID NO: 2821761 - RNA, 11 nt, Human
uucucaaugaa

SEQ ID NO: 2821762 - RNA, 23 nt, Human
uucucaaguucuaagauucuaau

SEQ ID NO: 2821763 - RNA, 13 nt, Human
uucucaaguucua

SEQ ID NO: 2821764 - RNA, 14 nt, Human
uucucaaguucuaa

SEQ ID NO: 2821765 - RNA, 16 nt, Human
uucucaaguucuaaga

SEQ ID NO: 2821766 - RNA, 17 nt, Human
uucucaaguucuaagau

SEQ ID NO: 2821767 - RNA, 18 nt, Human
uucucaaguucuaagauu

SEQ ID NO: 2821768 - RNA, 20 nt, Human
uucucaaguucuaagauucu

SEQ ID NO: 2821769 - RNA, 22 nt, Human
uucucaaguucuaagauucuaa

SEQ ID NO: 2821770 - RNA, 22 nt, Human
uucucaacaaagcacaguguua

SEQ ID NO: 2821771 - RNA, 23 nt, Human
uucuauaaggccauaaaacaggu

SEQ ID NO: 2821772 - RNA, 21 nt, Human
uucucaacaaagcacaguguu

SEQ ID NO: 2821773 - RNA, 21 nt, Human
uucuaggcacuguaguucuaa

SEQ ID NO: 2821774 - RNA, 23 nt, Human
uucuaggcacuguaguucuaaga

SEQ ID NO: 2821775 - RNA, 16 nt, Human
uucuaggcaucucugu

SEQ ID NO: 2821776 - RNA, 19 nt, Human
uucuaggcaucucuguacu

SEQ ID NO: 2821777 - RNA, 20 nt, Human
uucuaggcaucucuguacuu

SEQ ID NO: 2821778 - RNA, 14 nt, Human
uucuagggcuggga

SEQ ID NO: 2821779 - RNA, 16 nt, Human
uucuagggcugggaaa

SEQ ID NO: 2821780 - RNA, 19 nt, Human
uucuagggcugggaaacac

SEQ ID NO: 2821781 - RNA, 20 nt, Human
uucuagggcugggaaacacu

SEQ ID NO: 2821782 - RNA, 23 nt, Human
uucuagggcugggaaacacuccu

SEQ ID NO: 2821783 - RNA, 18 nt, Human
uucuagguggcaaggcug

SEQ ID NO: 2821784 - RNA, 17 nt, Human
uucuagguuucaaagau

SEQ ID NO: 2821785 - RNA, 23 nt, Human
uucuagguggcaaggcugugcuc

SEQ ID NO: 2821786 - RNA, 13 nt, Human
uucuagguuucaa

SEQ ID NO: 2821787 - RNA, 20 nt, Human
uucuagguuucaaagaugcu

SEQ ID NO: 2821788 - RNA, 16 nt, Human
uuccuuuuuucaaaau

SEQ ID NO: 2821789 - RNA, 18 nt, Human
uuccuuuuuaugaggcaa

SEQ ID NO: 2821790 - RNA, 15 nt, Human
uuccuuuuucugauu

SEQ ID NO: 2821791 - RNA, 21 nt, Human
uuccuuuuucugauuagcuuu

SEQ ID NO: 2821792 - RNA, 22 nt, Human
uuccuuuuucugauuagcuuug

SEQ ID NO: 2821793 - RNA, 20 nt, Human
uuccuuuucuauuccuucug

SEQ ID NO: 2821794 - RNA, 21 nt, Human
uuccuuuucuauuccuucugg

SEQ ID NO: 2821795 - RNA, 13 nt, Human
uuccuuuucuuua

SEQ ID NO: 2821796 - RNA, 19 nt, Human
uucucagugccaacugugg

SEQ ID NO: 2821797 - RNA, 21 nt, Human
uucucagugccaacuguggcu

SEQ ID NO: 2821798 - RNA, 22 nt, Human
uucucagugccaacuguggcug

SEQ ID NO: 2821799 - RNA, 23 nt, Human
uucucagugccaacuguggcugg

SEQ ID NO: 2821800 - RNA, 15 nt, Human
uucucaguuuguaua

SEQ ID NO: 2821801 - RNA, 12 nt, Human
uucucacagcac

SEQ ID NO: 2821802 - RNA, 21 nt, Human
uucucacagcacaugcuggcc

SEQ ID NO: 2821803 - RNA, 22 nt, Human
uucucacagcacaugcuggcca

SEQ ID NO: 2821804 - RNA, 16 nt, Human
uucucauaauuccuac

SEQ ID NO: 2821805 - RNA, 17 nt, Human
uucucauaauuccuaca

SEQ ID NO: 2821806 - RNA, 18 nt, Human
uucucauaauuccuacag

SEQ ID NO: 2821807 - RNA, 19 nt, Human
uucucauaauuccuacagc

SEQ ID NO: 2821808 - RNA, 20 nt, Human
uucucauaauuccuacagca

SEQ ID NO: 2821809 - RNA, 23 nt, Human
uucucauaauuccuacagcacua

SEQ ID NO: 2821810 - RNA, 22 nt, Human
aucagagacaaaauauuuccca

SEQ ID NO: 2821811 - RNA, 13 nt, Human
aucagagaccagg

SEQ ID NO: 2821812 - RNA, 19 nt, Human
aucagagaccaggcccugg

SEQ ID NO: 2821813 - RNA, 15 nt, Human
aucagaguagaaaua

SEQ ID NO: 2821814 - RNA, 18 nt, Human
aucagaguagaaauaaaa

SEQ ID NO: 2821815 - RNA, 20 nt, Human
aucagaguagaaauaaaagu

SEQ ID NO: 2821816 - RNA, 21 nt, Human
aucagaguagaaauaaaagug

SEQ ID NO: 2821817 - RNA, 23 nt, Human
aucagaguagaaauaaaagugaa

SEQ ID NO: 2821818 - RNA, 14 nt, Human
aucagagcaggacc

SEQ ID NO: 2821819 - RNA, 15 nt, Human
aucagagcaggaccu

SEQ ID NO: 2821820 - RNA, 16 nt, Human
aucagagcaggaccuc

SEQ ID NO: 2821821 - RNA, 13 nt, Human
aucagagcuccuc

SEQ ID NO: 2821822 - RNA, 20 nt, Human
aucagagcuccucuguccug

SEQ ID NO: 2821823 - RNA, 21 nt, Human
aucagagcuccucuguccugc

SEQ ID NO: 2821824 - RNA, 14 nt, Human
aucagaaauuuuua

SEQ ID NO: 2821825 - RNA, 15 nt, Human
aucagaaauuuuuau

SEQ ID NO: 2821826 - RNA, 23 nt, Human
aucagaagaccacaaaaauugac

SEQ ID NO: 2821827 - RNA, 12 nt, Human
aucagaagagag

SEQ ID NO: 2821828 - RNA, 22 nt, Human
aucagaagaccacaaaaauuga

SEQ ID NO: 2821829 - RNA, 15 nt, Human
uucucaucacacaca

SEQ ID NO: 2821830 - RNA, 16 nt, Human
uucucaucacacacau

SEQ ID NO: 2821831 - RNA, 20 nt, Human
aucagaugcuccaagauucu

SEQ ID NO: 2821832 - RNA, 15 nt, Human
aucaguauuaauacu

SEQ ID NO: 2821833 - RNA, 17 nt, Human
aucaguauuaauacuaa

SEQ ID NO: 2821834 - RNA, 22 nt, Human
aucaguauuaauacuaaaauau

SEQ ID NO: 2821835 - RNA, 23 nt, Human
aucaguauuaauacuaaaauaug

SEQ ID NO: 2821836 - RNA, 13 nt, Human
aucagucaauauu

SEQ ID NO: 2821837 - RNA, 15 nt, Human
aucagauaagacaua

SEQ ID NO: 2821838 - RNA, 19 nt, Human
aucagauaagacauaucuc

SEQ ID NO: 2821839 - RNA, 22 nt, Human
aucagauaagacauaucucuaa

SEQ ID NO: 2821840 - RNA, 12 nt, Human
aucagauacauc

SEQ ID NO: 2821841 - RNA, 13 nt, Human
aucagauacauca

SEQ ID NO: 2821842 - RNA, 14 nt, Human
aucagauacaucac

SEQ ID NO: 2821843 - RNA, 15 nt, Human
aucagauacaucacu

SEQ ID NO: 2821844 - RNA, 16 nt, Human
aucagauacaucacug

SEQ ID NO: 2821845 - RNA, 17 nt, Human
aucagauacaucacugc

SEQ ID NO: 2821846 - RNA, 23 nt, Human
aucagaugaacucuuagaaauga

SEQ ID NO: 2821847 - RNA, 22 nt, Human
aucagaugaacucuuagaaaug

SEQ ID NO: 2821848 - RNA, 19 nt, Human
aucagugugucuaaauuug

SEQ ID NO: 2821849 - RNA, 20 nt, Human
aucagugugucuaaauuuga

SEQ ID NO: 2821850 - RNA, 13 nt, Human
aucauaaggcuuc

SEQ ID NO: 2821851 - RNA, 15 nt, Human
aucauagaaauguaa

SEQ ID NO: 2821852 - RNA, 12 nt, Human
aucauagaaaug

SEQ ID NO: 2821853 - RNA, 15 nt, Human
aucauaagugaauuu

SEQ ID NO: 2821854 - RNA, 16 nt, Human
aucauaagugaauuua

SEQ ID NO: 2821855 - RNA, 17 nt, Human
aucauaagugaauuuau

SEQ ID NO: 2821856 - RNA, 18 nt, Human
aucauaagugaauuuaua

SEQ ID NO: 2821857 - RNA, 19 nt, Human
aucauaagugaauuuauac

SEQ ID NO: 2821858 - RNA, 19 nt, Human
aucaguguaccauuugccu

SEQ ID NO: 2821859 - RNA, 17 nt, Human
aucagugggauuuggua

SEQ ID NO: 2821860 - RNA, 18 nt, Human
aucagugggcaggauaaa

SEQ ID NO: 2821861 - RNA, 20 nt, Human
aucagugggcaggauaaacu

SEQ ID NO: 2821862 - RNA, 21 nt, Human
aucagugggcaggauaaacug

SEQ ID NO: 2821863 - RNA, 22 nt, Human
aucagugggcaggauaaacuga

SEQ ID NO: 2821864 - RNA, 13 nt, Human
aucaguggagcca

SEQ ID NO: 2821865 - RNA, 21 nt, Human
aucagucccuauguauuugca

SEQ ID NO: 2821866 - RNA, 16 nt, Human
aucagucccuauguau

SEQ ID NO: 2821867 - RNA, 13 nt, Human
aucauucccucuc

SEQ ID NO: 2821868 - RNA, 15 nt, Human
aucauucccucucau

SEQ ID NO: 2821869 - RNA, 22 nt, Human
aucauucccucucaucucaggu

SEQ ID NO: 2821870 - RNA, 12 nt, Human
aucauucaucuu

SEQ ID NO: 2821871 - RNA, 21 nt, Human
aucauucaucuucuucuuuaa

SEQ ID NO: 2821872 - RNA, 23 nt, Human
aucauucacggagauaugaagag

SEQ ID NO: 2821873 - RNA, 14 nt, Human
aucauguuuuggug

SEQ ID NO: 2821874 - RNA, 17 nt, Human
aucauguuuuggugaaa

SEQ ID NO: 2821875 - RNA, 19 nt, Human
aucauguuuuggugaaaau

SEQ ID NO: 2821876 - RNA, 21 nt, Human
aucauuaaaagaacauaaguu

SEQ ID NO: 2821877 - RNA, 18 nt, Human
aucauagguauuucaaaa

SEQ ID NO: 2821878 - RNA, 16 nt, Human
aucauagguauuucaa

SEQ ID NO: 2821879 - RNA, 17 nt, Human
aucauagguauuucaaa

SEQ ID NO: 2821880 - RNA, 13 nt, Human
aucauaugugauc

SEQ ID NO: 2821881 - RNA, 18 nt, Human
aucauaugugaucugucu

SEQ ID NO: 2821882 - RNA, 22 nt, Human
aucauaugugaucugucuugua

SEQ ID NO: 2821883 - RNA, 21 nt, Human
aucauauugguauucacuaau

SEQ ID NO: 2821884 - RNA, 20 nt, Human
aucaucaacaagauuuccuu

SEQ ID NO: 2821885 - RNA, 13 nt, Human
aucauauugauga

SEQ ID NO: 2821886 - RNA, 14 nt, Human
aucauauugaugaa

SEQ ID NO: 2821887 - RNA, 17 nt, Human
aucauauugaugaaaag

SEQ ID NO: 2821888 - RNA, 18 nt, Human
aucauauugaugaaaaga

SEQ ID NO: 2821889 - RNA, 18 nt, Human
aucaucaaggcacugccu

SEQ ID NO: 2821890 - RNA, 13 nt, Human
aucaucaaggcac

SEQ ID NO: 2821891 - RNA, 11 nt, Human
aucauguuguu

SEQ ID NO: 2821892 - RNA, 21 nt, Human
aucauguuguuaaaauuauga

SEQ ID NO: 2821893 - RNA, 13 nt, Human
aucaucagggccu

SEQ ID NO: 2821894 - RNA, 14 nt, Human
aucaucagggccug

SEQ ID NO: 2821895 - RNA, 15 nt, Human
aucaucagggccugg

SEQ ID NO: 2821896 - RNA, 19 nt, Human
aucaucaaggcacugccug

SEQ ID NO: 2821897 - RNA, 17 nt, Human
auagcugggacuacagg

SEQ ID NO: 2821898 - RNA, 18 nt, Human
auagcugcauguggcuuu

SEQ ID NO: 2821899 - RNA, 19 nt, Human
auagcugcccauuucguga

SEQ ID NO: 2821900 - RNA, 21 nt, Human
auagcugcccauuucgugagc

SEQ ID NO: 2821901 - RNA, 16 nt, Human
auagcuggcaagaaug

SEQ ID NO: 2821902 - RNA, 17 nt, Human
auagcuggcaagaaugg

SEQ ID NO: 2821903 - RNA, 10 nt, Human
uuauuuaaua

SEQ ID NO: 2821904 - RNA, 12 nt, Human
uuauuuaauaac

SEQ ID NO: 2821905 - RNA, 13 nt, Human
uuauuuaauaaca

SEQ ID NO: 2821906 - RNA, 14 nt, Human
uuauuuaauaacaa

SEQ ID NO: 2821907 - RNA, 14 nt, Human
uuauuuaauaacau

SEQ ID NO: 2821908 - RNA, 15 nt, Human
uuauuuaauaacauu

SEQ ID NO: 2821909 - RNA, 14 nt, Human
uuauuuaaagcauu

SEQ ID NO: 2821910 - RNA, 13 nt, Human
uuauuuaaaagau

SEQ ID NO: 2821911 - RNA, 17 nt, Human
uuauuuaaaagauucau

SEQ ID NO: 2821912 - RNA, 18 nt, Human
uuauuuaaaagauucauu

SEQ ID NO: 2821913 - RNA, 14 nt, Human
uuauuuaaaagauu

SEQ ID NO: 2821914 - RNA, 15 nt, Human
uuauuuaaaagauuc

SEQ ID NO: 2821915 - RNA, 16 nt, Human
uuauuuaaaagauuca

SEQ ID NO: 2821916 - RNA, 18 nt, Human
uuauuuagacucaucuua

SEQ ID NO: 2821917 - RNA, 15 nt, Human
uuauuuaaugugagu

SEQ ID NO: 2821918 - RNA, 18 nt, Human
uuauuuauauguacuguu

SEQ ID NO: 2821919 - RNA, 17 nt, Human
uuauuuauauguacugu

SEQ ID NO: 2821920 - RNA, 21 nt, Human
uuauuuauauguacuguuuua

SEQ ID NO: 2821921 - RNA, 15 nt, Human
uuauuuauauguacu

SEQ ID NO: 2821922 - RNA, 14 nt, Human
uuauuuauauguac

SEQ ID NO: 2821923 - RNA, 21 nt, Human
uuauuuauauggggaauauau

SEQ ID NO: 2821924 - RNA, 15 nt, Human
uuauuuaguauuuau

SEQ ID NO: 2821925 - RNA, 14 nt, Human
uuauuuauagucau

SEQ ID NO: 2821926 - RNA, 17 nt, Human
uuauuuagacucaucuu

SEQ ID NO: 2821927 - RNA, 23 nt, Human
uuauuuagacucaucuuacugua

SEQ ID NO: 2821928 - RNA, 12 nt, Human
uuauuuagagau

SEQ ID NO: 2821929 - RNA, 17 nt, Human
uuauuuagcaccaggga

SEQ ID NO: 2821930 - RNA, 15 nt, Human
uuauuuacagaugaa

SEQ ID NO: 2821931 - RNA, 20 nt, Human
uuauuuacagaugaauguau

SEQ ID NO: 2821932 - RNA, 19 nt, Human
uuauuuaauaacauuaccu

SEQ ID NO: 2821933 - RNA, 17 nt, Human
uuauuuacuaauuuucu

SEQ ID NO: 2821934 - RNA, 13 nt, Human
uuauuuauguacu

SEQ ID NO: 2821935 - RNA, 16 nt, Human
uuauuuauguacuuuu

SEQ ID NO: 2821936 - RNA, 15 nt, Human
uuauuuaugaaguuu

SEQ ID NO: 2821937 - RNA, 17 nt, Human
uuauuuauucagcuuca

SEQ ID NO: 2821938 - RNA, 22 nt, Human
uuauuuauucagcuucauuugu

SEQ ID NO: 2821939 - RNA, 15 nt, Human
uuauuuauuggagau

SEQ ID NO: 2821940 - RNA, 13 nt, Human
uuauuuauuuaau

SEQ ID NO: 2821941 - RNA, 18 nt, Human
uuauuuccaguguucuau

SEQ ID NO: 2821942 - RNA, 20 nt, Human
uuauuuccaguguucuauga

SEQ ID NO: 2821943 - RNA, 21 nt, Human
uuauuuccaucaugucagagc

SEQ ID NO: 2821944 - RNA, 17 nt, Human
uuauuuccaaauaaaau

SEQ ID NO: 2821945 - RNA, 19 nt, Human
uuauuuccaaauaaaauga

SEQ ID NO: 2821946 - RNA, 14 nt, Human
uuauuuauuuaaua

SEQ ID NO: 2821947 - RNA, 14 nt, Human
uuauuucacuugau

SEQ ID NO: 2821948 - RNA, 18 nt, Human
uuauuucacaaauaauag

SEQ ID NO: 2821949 - RNA, 23 nt, Human
uuauuucacacgcuguucuaaug

SEQ ID NO: 2821950 - RNA, 17 nt, Human
uuauuucagauuuugau

SEQ ID NO: 2821951 - RNA, 18 nt, Human
uuauuucagauuuugaua

SEQ ID NO: 2821952 - RNA, 19 nt, Human
uuauuucagauuuugauaa

SEQ ID NO: 2821953 - RNA, 23 nt, Human
uuauuucagauuuugauaacugu

SEQ ID NO: 2821954 - RNA, 16 nt, Human
auagcuacaggaagca

SEQ ID NO: 2821955 - RNA, 14 nt, Human
auagcuacccaaaa

SEQ ID NO: 2821956 - RNA, 16 nt, Human
auagcuacccaaaaga

SEQ ID NO: 2821957 - RNA, 19 nt, Human
auagcuacccaaaagagaa

SEQ ID NO: 2821958 - RNA, 21 nt, Human
auagcuacccaaaagagaaaa

SEQ ID NO: 2821959 - RNA, 15 nt, Human
auagcuacaggaagc

SEQ ID NO: 2821960 - RNA, 19 nt, Human
auagcucaggugucccugc

SEQ ID NO: 2821961 - RNA, 14 nt, Human
auagcuauuacugu

SEQ ID NO: 2821962 - RNA, 14 nt, Human
auagcuccuuuuga

SEQ ID NO: 2821963 - RNA, 12 nt, Human
auagcugggacu

SEQ ID NO: 2821964 - RNA, 21 nt, Human
auagcucaggugucccugcac

SEQ ID NO: 2821965 - RNA, 20 nt, Human
auagcucaggugucccugca

SEQ ID NO: 2821966 - RNA, 22 nt, Human
auagcucaggugucccugcacu

SEQ ID NO: 2821967 - RNA, 18 nt, Human
auagcuauuacugucugg

SEQ ID NO: 2821968 - RNA, 22 nt, Human
auagcuauuacugucugguuuu

SEQ ID NO: 2821969 - RNA, 22 nt, Human
auagcuaacauuuuaaauaaaa

SEQ ID NO: 2821970 - RNA, 23 nt, Human
auagcuaacauuuuaaauaaaag

SEQ ID NO: 2821971 - RNA, 15 nt, Human
auagcuaacauuuua

SEQ ID NO: 2821972 - RNA, 18 nt, Human
auagcuaaguacacaaua

SEQ ID NO: 2821973 - RNA, 17 nt, Human
auagcuaauaauguuaa

SEQ ID NO: 2821974 - RNA, 15 nt, Human
auagcuaaguacaca

SEQ ID NO: 2821975 - RNA, 14 nt, Human
auagcuaaguacac

SEQ ID NO: 2821976 - RNA, 13 nt, Human
auagcuaaguaca

SEQ ID NO: 2821977 - RNA, 11 nt, Human
auagccugugg

SEQ ID NO: 2821978 - RNA, 12 nt, Human
auagccuguggc

SEQ ID NO: 2821979 - RNA, 13 nt, Human
auagccuguggcc

SEQ ID NO: 2821980 - RNA, 20 nt, Human
auagcggguuacuuucacau

SEQ ID NO: 2821981 - RNA, 21 nt, Human
auagcgcuguuuuuguugugu

SEQ ID NO: 2821982 - RNA, 18 nt, Human
uuacuguaaccuguugcu

SEQ ID NO: 2821983 - RNA, 17 nt, Human
auaacuuugacuuucuu

SEQ ID NO: 2821984 - RNA, 14 nt, Human
auaagagcaugaaa

SEQ ID NO: 2821985 - RNA, 22 nt, Human
auaagagcaugaaauuuuuaaa

SEQ ID NO: 2821986 - RNA, 17 nt, Human
auaagagggcacacacu

SEQ ID NO: 2821987 - RNA, 19 nt, Human
auaagagggcacacacugu

SEQ ID NO: 2821988 - RNA, 16 nt, Human
auaacuucaagcaaac

SEQ ID NO: 2821989 - RNA, 12 nt, Human
auaacuucaguc

SEQ ID NO: 2821990 - RNA, 13 nt, Human
auaacuucagucc

SEQ ID NO: 2821991 - RNA, 14 nt, Human
auaacuucaguccu

SEQ ID NO: 2821992 - RNA, 20 nt, Human
auaacuucaguccugcucca

SEQ ID NO: 2821993 - RNA, 22 nt, Human
auaacuucaguccugcuccaga

SEQ ID NO: 2821994 - RNA, 12 nt, Human
auaacuuccugu

SEQ ID NO: 2821995 - RNA, 11 nt, Human
auaacuucuga

SEQ ID NO: 2821996 - RNA, 14 nt, Human
auaacuucugaccu

SEQ ID NO: 2821997 - RNA, 19 nt, Human
auaacuucuuaaaaguugu

SEQ ID NO: 2821998 - RNA, 16 nt, Human
auaacuucuuaaaagu

SEQ ID NO: 2821999 - RNA, 17 nt, Human
auaacuucuuaaaaguu

SEQ ID NO: 2822000 - RNA, 11 nt, Human
auaacuugaug

SEQ ID NO: 2822001 - RNA, 16 nt, Human
auaacuugaugcaugu

SEQ ID NO: 2822002 - RNA, 17 nt, Human
auaacuugaugcaugug

SEQ ID NO: 2822003 - RNA, 20 nt, Human
auaacuugaugcaugugguu

SEQ ID NO: 2822004 - RNA, 23 nt, Human
auagcuuuauuuuuuaaguauuu

SEQ ID NO: 2822005 - RNA, 22 nt, Human
auagcuuuauuuuuuaaguauu

SEQ ID NO: 2822006 - RNA, 21 nt, Human
auagcuuuauuuuuuaaguau

SEQ ID NO: 2822007 - RNA, 19 nt, Human
auagcuuuauuuuuuaagu

SEQ ID NO: 2822008 - RNA, 18 nt, Human
auagcuuuauuuuuuaag

SEQ ID NO: 2822009 - RNA, 10 nt, Human
auagcuuuau

SEQ ID NO: 2822010 - RNA, 21 nt, Human
uucaccaugauggccaggcug

SEQ ID NO: 2822011 - RNA, 22 nt, Human
uucaccauguuggccaggcugg

SEQ ID NO: 2822012 - RNA, 22 nt, Human
uucaccauguuggccaggcugc

SEQ ID NO: 2822013 - RNA, 22 nt, Human
auagcuucaccccaaucccagc

SEQ ID NO: 2822014 - RNA, 14 nt, Human
auagcuuguauagu

SEQ ID NO: 2822015 - RNA, 17 nt, Human
auagcuuguauagugua

SEQ ID NO: 2822016 - RNA, 20 nt, Human
auagcuuguauaguguaaaa

SEQ ID NO: 2822017 - RNA, 21 nt, Human
auagcuucaccccaaucccag

SEQ ID NO: 2822018 - RNA, 16 nt, Human
auagcuuauuauugaa

SEQ ID NO: 2822019 - RNA, 22 nt, Human
auagcuuacaagccagcuggag

SEQ ID NO: 2822020 - RNA, 22 nt, Human
auaggcaccuaccaccacgccc

SEQ ID NO: 2822021 - RNA, 23 nt, Human
auaggaucauuuguuggaaugaa

SEQ ID NO: 2822022 - RNA, 18 nt, Human
auaggaaugugaaagcac

SEQ ID NO: 2822023 - RNA, 13 nt, Human
auaggaauucauc

SEQ ID NO: 2822024 - RNA, 16 nt, Human
auaggagccugcuggu

SEQ ID NO: 2822025 - RNA, 15 nt, Human
auagggagaaaccaa

SEQ ID NO: 2822026 - RNA, 20 nt, Human
auagggcugggcaaggaaaa

SEQ ID NO: 2822027 - RNA, 21 nt, Human
auagggcugggcaaggaaaaa

SEQ ID NO: 2822028 - RNA, 17 nt, Human
auaggggauauuuaagg

SEQ ID NO: 2822029 - RNA, 18 nt, Human
auaggggauauuuaaggu

SEQ ID NO: 2822030 - RNA, 16 nt, Human
auagggguguuuauuu

SEQ ID NO: 2822031 - RNA, 14 nt, Human
auaggcccacacac

SEQ ID NO: 2822032 - RNA, 15 nt, Human
auaggcccacacaca

SEQ ID NO: 2822033 - RNA, 16 nt, Human
auaggcccacacacag

SEQ ID NO: 2822034 - RNA, 17 nt, Human
auaggcccacacacagg

SEQ ID NO: 2822035 - RNA, 18 nt, Human
auaggcccacacacaggu

SEQ ID NO: 2822036 - RNA, 20 nt, Human
uucacaguagagccagcuug

SEQ ID NO: 2822037 - RNA, 16 nt, Human
uucacagucacugaug

SEQ ID NO: 2822038 - RNA, 21 nt, Human
uucacagugaucgaugauuca

SEQ ID NO: 2822039 - RNA, 22 nt, Human
uucacagugaucgaugauucag

SEQ ID NO: 2822040 - RNA, 18 nt, Human
uucacaguagagccagcu

SEQ ID NO: 2822041 - RNA, 17 nt, Human
uucacaguagagccagc

SEQ ID NO: 2822042 - RNA, 15 nt, Human
uucacaguagagcca

SEQ ID NO: 2822043 - RNA, 23 nt, Human
uucacagggguucccuucucuca

SEQ ID NO: 2822044 - RNA, 18 nt, Human
uucacaggugugguguaa

SEQ ID NO: 2822045 - RNA, 20 nt, Human
uucacaggugugguguaauu

SEQ ID NO: 2822046 - RNA, 19 nt, Human
uucacaguagagccagcuu

SEQ ID NO: 2822047 - RNA, 14 nt, Human
uucacauaaaugca

SEQ ID NO: 2822048 - RNA, 19 nt, Human
uucacauaaaugcagccca

SEQ ID NO: 2822049 - RNA, 20 nt, Human
uucacauaaaugcagcccau

SEQ ID NO: 2822050 - RNA, 23 nt, Human
uucacagcucuguguugccaugu

SEQ ID NO: 2822051 - RNA, 13 nt, Human
uucacagcuuuua

SEQ ID NO: 2822052 - RNA, 16 nt, Human
uucacagcuuuuauca

SEQ ID NO: 2822053 - RNA, 15 nt, Human
uucacagcucugugu

SEQ ID NO: 2822054 - RNA, 17 nt, Human
uucacagcuccucccac

SEQ ID NO: 2822055 - RNA, 13 nt, Human
uucacagcuccuc

SEQ ID NO: 2822056 - RNA, 15 nt, Human
uucacagcuccuccc

SEQ ID NO: 2822057 - RNA, 15 nt, Human
uucacauagcugucu

SEQ ID NO: 2822058 - RNA, 22 nt, Human
uucaccacaugugcacaugcac

SEQ ID NO: 2822059 - RNA, 19 nt, Human
uucacauuguuugcugcua

SEQ ID NO: 2822060 - RNA, 20 nt, Human
uucacauuguuugcugcuau

SEQ ID NO: 2822061 - RNA, 18 nt, Human
uucaccagauuugcuaau

SEQ ID NO: 2822062 - RNA, 22 nt, Human
uucaccaccaaaugccaagaaa

SEQ ID NO: 2822063 - RNA, 16 nt, Human
uucaccacuucacuga

SEQ ID NO: 2822064 - RNA, 13 nt, Human
uucaccaaaauua

SEQ ID NO: 2822065 - RNA, 15 nt, Human
uucaccaaaauuauc

SEQ ID NO: 2822066 - RNA, 16 nt, Human
uucaccaaaauuaucc

SEQ ID NO: 2822067 - RNA, 18 nt, Human
uucacauagcugucuaga

SEQ ID NO: 2822068 - RNA, 12 nt, Human
uucaccagagca

SEQ ID NO: 2822069 - RNA, 22 nt, Human
uucaaacuccaagguucccuug

SEQ ID NO: 2822070 - RNA, 15 nt, Human
uucaaacuggggccu

SEQ ID NO: 2822071 - RNA, 16 nt, Human
uucaaacuggggccuc

SEQ ID NO: 2822072 - RNA, 21 nt, Human
uucaaacuggggccuccagaa

SEQ ID NO: 2822073 - RNA, 21 nt, Human
uucaaacuguaaaccaauuuu

SEQ ID NO: 2822074 - RNA, 12 nt, Human
uucaaacuguga

SEQ ID NO: 2822075 - RNA, 13 nt, Human
uucaaacugugaa

SEQ ID NO: 2822076 - RNA, 19 nt, Human
uucaaacugugaagcauuu

SEQ ID NO: 2822077 - RNA, 17 nt, Human
uucaaacuuacuauuuu

SEQ ID NO: 2822078 - RNA, 19 nt, Human
uucaaacuuacuauuuuga

SEQ ID NO: 2822079 - RNA, 15 nt, Human
uucaaaauccaaaaa

SEQ ID NO: 2822080 - RNA, 13 nt, Human
uucaaaauccuuc

SEQ ID NO: 2822081 - RNA, 16 nt, Human
uucaaaauccuuccaa

SEQ ID NO: 2822082 - RNA, 17 nt, Human
uucaaaauccuuccaaa

SEQ ID NO: 2822083 - RNA, 19 nt, Human
uucaaaauccuuccaaaga

SEQ ID NO: 2822084 - RNA, 20 nt, Human
uucaaaaugcuuuuuauuau

SEQ ID NO: 2822085 - RNA, 17 nt, Human
uucaaaaugcuuuuuau

SEQ ID NO: 2822086 - RNA, 13 nt, Human
uucaaaauauuua

SEQ ID NO: 2822087 - RNA, 15 nt, Human
uucaaaauauuuaaa

SEQ ID NO: 2822088 - RNA, 20 nt, Human
uucaaaauauuuaaaaaugu

SEQ ID NO: 2822089 - RNA, 22 nt, Human
uucaaaauauuuaaaaaugucu

SEQ ID NO: 2822090 - RNA, 15 nt, Human
uucaaaauguuaucu

SEQ ID NO: 2822091 - RNA, 23 nt, Human
uucaaaauguuaucuucucaagu

SEQ ID NO: 2822092 - RNA, 16 nt, Human
uucaaaauuaaaucug

SEQ ID NO: 2822093 - RNA, 17 nt, Human
uucaaaauuaaaucugu

SEQ ID NO: 2822094 - RNA, 14 nt, Human
uucaaaauguauau

SEQ ID NO: 2822095 - RNA, 15 nt, Human
uucaaaaauauaacu

SEQ ID NO: 2822096 - RNA, 13 nt, Human
uucaaaaaguguu

SEQ ID NO: 2822097 - RNA, 14 nt, Human
uucaaaaaguguuu

SEQ ID NO: 2822098 - RNA, 17 nt, Human
uucaaaaaguguuuauu

SEQ ID NO: 2822099 - RNA, 18 nt, Human
uuauuuuuuuuuuuugaa

SEQ ID NO: 2822100 - RNA, 20 nt, Human
uuauuuuuuuuuuuugaaaa

SEQ ID NO: 2822101 - RNA, 21 nt, Human
uucaaaaagucuacgcucucc

SEQ ID NO: 2822102 - RNA, 13 nt, Human
uucaaaaacuguu

SEQ ID NO: 2822103 - RNA, 14 nt, Human
uucaaaaacuguuu

SEQ ID NO: 2822104 - RNA, 20 nt, Human
uucaaaaacuguuuugggua

SEQ ID NO: 2822105 - RNA, 21 nt, Human
uucaaaaacuguuuuggguag

SEQ ID NO: 2822106 - RNA, 12 nt, Human
uucaaaaacugu

SEQ ID NO: 2822107 - RNA, 20 nt, Human
uuauuucugcauauguugaa

SEQ ID NO: 2822108 - RNA, 15 nt, Human
uuauuucugcauaug

SEQ ID NO: 2822109 - RNA, 13 nt, Human
uuauuucugcaua

SEQ ID NO: 2822110 - RNA, 12 nt, Human
uuauuucugcau

SEQ ID NO: 2822111 - RNA, 11 nt, Human
uuauuucugca

SEQ ID NO: 2822112 - RNA, 17 nt, Human
uuauuucugcaaacaaa

SEQ ID NO: 2822113 - RNA, 18 nt, Human
uuauuucuaguccaaaau

SEQ ID NO: 2822114 - RNA, 22 nt, Human
uuauuucuaguccaaaauuaca

SEQ ID NO: 2822115 - RNA, 14 nt, Human
uucaaggcacucua

SEQ ID NO: 2822116 - RNA, 21 nt, Human
uucaaggcacucuagauucca

SEQ ID NO: 2822117 - RNA, 22 nt, Human
uucaaggcacucuagauuccau

SEQ ID NO: 2822118 - RNA, 16 nt, Human
uucaaggcacucuaga

SEQ ID NO: 2822119 - RNA, 17 nt, Human
uucaaggcacucuagau

SEQ ID NO: 2822120 - RNA, 18 nt, Human
uucaaggcacucuagauu

SEQ ID NO: 2822121 - RNA, 19 nt, Human
uucaaggcacucuagauuc

SEQ ID NO: 2822122 - RNA, 24 nt, Human
uucaaggggagccaaaaucucaag

SEQ ID NO: 2822123 - RNA, 12 nt, Human
uucaaggcuuca

SEQ ID NO: 2822124 - RNA, 15 nt, Human
uucaaggcuuccacu

SEQ ID NO: 2822125 - RNA, 16 nt, Human
uucaaggcuuccacug

SEQ ID NO: 2822126 - RNA, 20 nt, Human
uucaaggcaucaugcagagu

SEQ ID NO: 2822127 - RNA, 18 nt, Human
uucaacuugugccuggga

SEQ ID NO: 2822128 - RNA, 22 nt, Human
uucaagugauucucaugccuca

SEQ ID NO: 2822129 - RNA, 20 nt, Human
uucaagugauucucaugccu

SEQ ID NO: 2822130 - RNA, 16 nt, Human
uucaaguuagcucagg

SEQ ID NO: 2822131 - RNA, 20 nt, Human
uucaagugauucuccugccu

SEQ ID NO: 2822132 - RNA, 13 nt, Human
uucaagugccuuu

SEQ ID NO: 2822133 - RNA, 21 nt, Human
uucaagugccuuucugcaguu

SEQ ID NO: 2822134 - RNA, 23 nt, Human
uucaagugccuuucugcaguuuu

SEQ ID NO: 2822135 - RNA, 17 nt, Human
uucaaguuagcucagga

SEQ ID NO: 2822136 - RNA, 14 nt, Human
uucaaguuauugua

SEQ ID NO: 2822137 - RNA, 17 nt, Human
uucaaguuauuguacag

SEQ ID NO: 2822138 - RNA, 20 nt, Human
uucaaguuauuguacagcug

SEQ ID NO: 2822139 - RNA, 20 nt, Human
uucaaguuuuggguauguuu

SEQ ID NO: 2822140 - RNA, 22 nt, Human
uucaaguuuuggguauguuuaa

SEQ ID NO: 2822141 - RNA, 22 nt, Human
uucaagaaaacaacuucaauau

SEQ ID NO: 2822142 - RNA, 17 nt, Human
uucaagaaaaaauaaau

SEQ ID NO: 2822143 - RNA, 21 nt, Human
uucaagaaaaaauaaauggaa

SEQ ID NO: 2822144 - RNA, 23 nt, Human
uucaagaaaaaauaaauggaaau

SEQ ID NO: 2822145 - RNA, 12 nt, Human
uucaagaaacug

SEQ ID NO: 2822146 - RNA, 20 nt, Human
uucaagaaacugaggaauuu

SEQ ID NO: 2822147 - RNA, 13 nt, Human
uucaagaaacuga

SEQ ID NO: 2822148 - RNA, 23 nt, Human
uucaagaaacugaggaauuuucu

SEQ ID NO: 2822149 - RNA, 22 nt, Human
uucaagaaagcuucaaacugca

SEQ ID NO: 2822150 - RNA, 12 nt, Human
uucaagaaauaa

SEQ ID NO: 2822151 - RNA, 14 nt, Human
auagguaaucaaug

SEQ ID NO: 2822152 - RNA, 16 nt, Human
auagguaaucaaugaa

SEQ ID NO: 2822153 - RNA, 20 nt, Human
auagguaaucaaugaauauu

SEQ ID NO: 2822154 - RNA, 23 nt, Human
auagguaaucaaugaauauugaa

SEQ ID NO: 2822155 - RNA, 16 nt, Human
auagucauuccaaaua

SEQ ID NO: 2822156 - RNA, 18 nt, Human
auagucauuuauuuuaaa

SEQ ID NO: 2822157 - RNA, 19 nt, Human
auagucaauguuucuuuua

SEQ ID NO: 2822158 - RNA, 14 nt, Human
auaguuuauugaca

SEQ ID NO: 2822159 - RNA, 14 nt, Human
auaguuucagauau

SEQ ID NO: 2822160 - RNA, 21 nt, Human
auaguuucagauauauaucau

SEQ ID NO: 2822161 - RNA, 13 nt, Human
auaguuucugagg

SEQ ID NO: 2822162 - RNA, 14 nt, Human
auaguuucugaggc

SEQ ID NO: 2822163 - RNA, 19 nt, Human
auaguuucugaggcuuuau

SEQ ID NO: 2822164 - RNA, 13 nt, Human
auaguuuguacau

SEQ ID NO: 2822165 - RNA, 20 nt, Human
auaguuugggcuucagccua

SEQ ID NO: 2822166 - RNA, 22 nt, Human
auaguuugggcuucagccuagu

SEQ ID NO: 2822167 - RNA, 15 nt, Human
auaguuuguacaugc

SEQ ID NO: 2822168 - RNA, 13 nt, Human
auaguuugucuau

SEQ ID NO: 2822169 - RNA, 15 nt, Human
auaguuugucuauuu

SEQ ID NO: 2822170 - RNA, 16 nt, Human
auaguuugucuauuuu

SEQ ID NO: 2822171 - RNA, 17 nt, Human
auaguuugucuauuuua

SEQ ID NO: 2822172 - RNA, 12 nt, Human
auaguuuguuau

SEQ ID NO: 2822173 - RNA, 17 nt, Human
auaguuuuaaacucauu

SEQ ID NO: 2822174 - RNA, 20 nt, Human
auaguuuuaaacucauuuuu

SEQ ID NO: 2822175 - RNA, 12 nt, Human
auauaaauggga

SEQ ID NO: 2822176 - RNA, 13 nt, Human
auauaaaugggaa

SEQ ID NO: 2822177 - RNA, 14 nt, Human
auauaaaugggaac

SEQ ID NO: 2822178 - RNA, 18 nt, Human
auauaaaugggaacauuu

SEQ ID NO: 2822179 - RNA, 19 nt, Human
auauaaaugggaacauuua

SEQ ID NO: 2822180 - RNA, 21 nt, Human
auauaaaugggaacauuuauu

SEQ ID NO: 2822181 - RNA, 13 nt, Human
auauaaagaauau

SEQ ID NO: 2822182 - RNA, 14 nt, Human
auauaaagaauaua

SEQ ID NO: 2822183 - RNA, 15 nt, Human
auauaaagaauauau

SEQ ID NO: 2822184 - RNA, 18 nt, Human
auauaaagaauauauaua

SEQ ID NO: 2822185 - RNA, 13 nt, Human
auauaaauauuug

SEQ ID NO: 2822186 - RNA, 13 nt, Human
auauaaaaugugc

SEQ ID NO: 2822187 - RNA, 12 nt, Human
auauaaacaucu

SEQ ID NO: 2822188 - RNA, 21 nt, Human
auauaaaaggcaaauguguac

SEQ ID NO: 2822189 - RNA, 23 nt, Human
auauaaaaggcaaauguguacau

SEQ ID NO: 2822190 - RNA, 13 nt, Human
auauaaaauaaug

SEQ ID NO: 2822191 - RNA, 14 nt, Human
auauaaaauaaugc

SEQ ID NO: 2822192 - RNA, 14 nt, Human
auauaaaauaguug

SEQ ID NO: 2822193 - RNA, 21 nt, Human
auauaaaauaguuguccauau

SEQ ID NO: 2822194 - RNA, 16 nt, Human
auauauacaguaacuu

SEQ ID NO: 2822195 - RNA, 18 nt, Human
auauauacaguaacuuua

SEQ ID NO: 2822196 - RNA, 13 nt, Human
auauauacacaca

SEQ ID NO: 2822197 - RNA, 14 nt, Human
auauauacacacac

SEQ ID NO: 2822198 - RNA, 15 nt, Human
auauauacacacaca

SEQ ID NO: 2822199 - RNA, 19 nt, Human
auauaggucucuucuccca

SEQ ID NO: 2822200 - RNA, 21 nt, Human
auauaggucucuucucccaga

SEQ ID NO: 2822201 - RNA, 22 nt, Human
auauaggucucuucucccagaa

SEQ ID NO: 2822202 - RNA, 18 nt, Human
auauaggugauguuugcu

SEQ ID NO: 2822203 - RNA, 16 nt, Human
auauaagccuuuuaua

SEQ ID NO: 2822204 - RNA, 22 nt, Human
auauagguugugcaaauuaaca

SEQ ID NO: 2822205 - RNA, 15 nt, Human
auauagguugugcaa

SEQ ID NO: 2822206 - RNA, 16 nt, Human
auauagguugugcaaa

SEQ ID NO: 2822207 - RNA, 18 nt, Human
auauagugcuauauauau

SEQ ID NO: 2822208 - RNA, 16 nt, Human
auauaguuccuaagaa

SEQ ID NO: 2822209 - RNA, 21 nt, Human
auauaguuccuaagaagcuuc

SEQ ID NO: 2822210 - RNA, 22 nt, Human
auauaguuccuaagaagcuucu

SEQ ID NO: 2822211 - RNA, 17 nt, Human
auauaguuuuuaccuuu

SEQ ID NO: 2822212 - RNA, 21 nt, Human
auauaguuuuuaccuuuuaug

SEQ ID NO: 2822213 - RNA, 15 nt, Human
auauaagaaagacau

SEQ ID NO: 2822214 - RNA, 16 nt, Human
auauaagaaagacauc

SEQ ID NO: 2822215 - RNA, 18 nt, Human
auauaagaaagacaucuu

SEQ ID NO: 2822216 - RNA, 12 nt, Human
auauaagauuuu

SEQ ID NO: 2822217 - RNA, 14 nt, Human
auauaagauuuucu

SEQ ID NO: 2822218 - RNA, 12 nt, Human
auauaaauucug

SEQ ID NO: 2822219 - RNA, 13 nt, Human
auauaaauucugu

SEQ ID NO: 2822220 - RNA, 14 nt, Human
auauaaauucugug

SEQ ID NO: 2822221 - RNA, 15 nt, Human
auauaaauucugugg

SEQ ID NO: 2822222 - RNA, 16 nt, Human
uucagauguggagcca

SEQ ID NO: 2822223 - RNA, 17 nt, Human
uucagauguggagccag

SEQ ID NO: 2822224 - RNA, 18 nt, Human
uucagauguggagccagg

SEQ ID NO: 2822225 - RNA, 19 nt, Human
uucagauguggagccaggc

SEQ ID NO: 2822226 - RNA, 14 nt, Human
uucagcaagagaga

SEQ ID NO: 2822227 - RNA, 17 nt, Human
uucagcaagagagaacc

SEQ ID NO: 2822228 - RNA, 18 nt, Human
uucagcaagagagaaccu

SEQ ID NO: 2822229 - RNA, 21 nt, Human
uucagaugggaggaaagagag

SEQ ID NO: 2822230 - RNA, 13 nt, Human
uucagauguaaug

SEQ ID NO: 2822231 - RNA, 14 nt, Human
uucagauguaaugu

SEQ ID NO: 2822232 - RNA, 15 nt, Human
uucagauguaauguu

SEQ ID NO: 2822233 - RNA, 16 nt, Human
uucagauguaauguuu

SEQ ID NO: 2822234 - RNA, 17 nt, Human
uucagauguaauguuuu

SEQ ID NO: 2822235 - RNA, 18 nt, Human
uucagauguaauguuuuc

SEQ ID NO: 2822236 - RNA, 15 nt, Human
uucagaucacugaau

SEQ ID NO: 2822237 - RNA, 16 nt, Human
uucagaucacugaauu

SEQ ID NO: 2822238 - RNA, 18 nt, Human
uucagaucacugaauuua

SEQ ID NO: 2822239 - RNA, 21 nt, Human
uucagaucacugaauuuauaa

SEQ ID NO: 2822240 - RNA, 19 nt, Human
uucagaaucacuucugaga

SEQ ID NO: 2822241 - RNA, 21 nt, Human
uucagaaucacuucugagaac

SEQ ID NO: 2822242 - RNA, 16 nt, Human
uucagaaucuuuguua

SEQ ID NO: 2822243 - RNA, 17 nt, Human
uucagaaucuuuguuaa

SEQ ID NO: 2822244 - RNA, 13 nt, Human
uucagcccccagc

SEQ ID NO: 2822245 - RNA, 15 nt, Human
uucagcccccagccc

SEQ ID NO: 2822246 - RNA, 16 nt, Human
uucagccauguacaga

SEQ ID NO: 2822247 - RNA, 16 nt, Human
uucagcaccacccuag

SEQ ID NO: 2822248 - RNA, 10 nt, Human
uucagcacca

SEQ ID NO: 2822249 - RNA, 21 nt, Human
uucagaaaauauuauguguuu

SEQ ID NO: 2822250 - RNA, 18 nt, Human
uucacuguauaaauagga

SEQ ID NO: 2822251 - RNA, 19 nt, Human
uucacuguauaaauaggag

SEQ ID NO: 2822252 - RNA, 15 nt, Human
uucagaaagaagugg

SEQ ID NO: 2822253 - RNA, 23 nt, Human
uucagaaguuuggcaauaguuug

SEQ ID NO: 2822254 - RNA, 15 nt, Human
uucagaaucacuucu

SEQ ID NO: 2822255 - RNA, 13 nt, Human
uucagaauauuca

SEQ ID NO: 2822256 - RNA, 20 nt, Human
uucagaaguuuggcaauagu

SEQ ID NO: 2822257 - RNA, 20 nt, Human
uucagaaaauauuauguguu

SEQ ID NO: 2822258 - RNA, 14 nt, Human
uucagaaaauauua

SEQ ID NO: 2822259 - RNA, 13 nt, Human
uucagaaaauauu

SEQ ID NO: 2822260 - RNA, 13 nt, Human
uucacuguauaaa

SEQ ID NO: 2822261 - RNA, 15 nt, Human
uucacuguauaaaua

SEQ ID NO: 2822262 - RNA, 16 nt, Human
uucacuguauaaauag

SEQ ID NO: 2822263 - RNA, 13 nt, Human
uucacugggccaa

SEQ ID NO: 2822264 - RNA, 13 nt, Human
uucacuggcccaa

SEQ ID NO: 2822265 - RNA, 20 nt, Human
uucacuguaagacucauucc

SEQ ID NO: 2822266 - RNA, 12 nt, Human
uucacuguacgu

SEQ ID NO: 2822267 - RNA, 22 nt, Human
uucacuguagaaugauuucaug

SEQ ID NO: 2822268 - RNA, 15 nt, Human
uucacuguagaauga

SEQ ID NO: 2822269 - RNA, 14 nt, Human
auauauagugcuau

SEQ ID NO: 2822270 - RNA, 15 nt, Human
auauauagugcuaua

SEQ ID NO: 2822271 - RNA, 16 nt, Human
auauauagugcuauau

SEQ ID NO: 2822272 - RNA, 20 nt, Human
auauauagcuggcaagaaug

SEQ ID NO: 2822273 - RNA, 11 nt, Human
auauauauaaa

SEQ ID NO: 2822274 - RNA, 13 nt, Human
auauauagaaucu

SEQ ID NO: 2822275 - RNA, 19 nt, Human
auauauagacagcuuugac

SEQ ID NO: 2822276 - RNA, 12 nt, Human
auauauauaaag

SEQ ID NO: 2822277 - RNA, 13 nt, Human
auauauauaaaga

SEQ ID NO: 2822278 - RNA, 13 nt, Human
auauauauaaagu

SEQ ID NO: 2822279 - RNA, 20 nt, Human
uucacugcauggcucccaca

SEQ ID NO: 2822280 - RNA, 13 nt, Human
auauauacauaug

SEQ ID NO: 2822281 - RNA, 14 nt, Human
auauauacauaugu

SEQ ID NO: 2822282 - RNA, 15 nt, Human
auauauaccccccca

SEQ ID NO: 2822283 - RNA, 19 nt, Human
auauauacccccccaugca

SEQ ID NO: 2822284 - RNA, 22 nt, Human
auauauacgaacaaaacacacg

SEQ ID NO: 2822285 - RNA, 20 nt, Human
auauauacaguaacuuuaug

SEQ ID NO: 2822286 - RNA, 21 nt, Human
auauauacaguaacuuuaugu

SEQ ID NO: 2822287 - RNA, 23 nt, Human
auauauacaguaacuuuaugugu

SEQ ID NO: 2822288 - RNA, 10 nt, Human
auauauacau

SEQ ID NO: 2822289 - RNA, 11 nt, Human
auauauacaua

SEQ ID NO: 2822290 - RNA, 14 nt, Human
auauauacauacac

SEQ ID NO: 2822291 - RNA, 16 nt, Human
auauauacauacacuu

SEQ ID NO: 2822292 - RNA, 18 nt, Human
auauauacauacacuugu

SEQ ID NO: 2822293 - RNA, 18 nt, Human
auauauacuuaagaauau

SEQ ID NO: 2822294 - RNA, 12 nt, Human
auauauacuugu

SEQ ID NO: 2822295 - RNA, 15 nt, Human
auauauacuuguggu

SEQ ID NO: 2822296 - RNA, 18 nt, Human
auauauagaaauauauac

SEQ ID NO: 2822297 - RNA, 13 nt, Human
uucacugcuggcu

SEQ ID NO: 2822298 - RNA, 15 nt, Human
uucacugcuggcugc

SEQ ID NO: 2822299 - RNA, 16 nt, Human
uucacugcuggcugcc

SEQ ID NO: 2822300 - RNA, 17 nt, Human
uucacugcuggcugccu

SEQ ID NO: 2822301 - RNA, 18 nt, Human
uucacugcuggcugccuu

SEQ ID NO: 2822302 - RNA, 19 nt, Human
uucacugcuggcugccuua

SEQ ID NO: 2822303 - RNA, 13 nt, Human
auaugauuuaaaa

SEQ ID NO: 2822304 - RNA, 15 nt, Human
auaugauuggcaaua

SEQ ID NO: 2822305 - RNA, 13 nt, Human
auaugauuguuuc

SEQ ID NO: 2822306 - RNA, 14 nt, Human
auaugauuguuucu

SEQ ID NO: 2822307 - RNA, 22 nt, Human
auaugauuguuucucaaaucuu

SEQ ID NO: 2822308 - RNA, 20 nt, Human
auaugauuuaaaacauguaa

SEQ ID NO: 2822309 - RNA, 15 nt, Human
auaugauuuaaaaca

SEQ ID NO: 2822310 - RNA, 16 nt, Human
auaugauuuaaaacau

SEQ ID NO: 2822311 - RNA, 21 nt, Human
auauguauauauauauaugca

SEQ ID NO: 2822312 - RNA, 18 nt, Human
auauguauauuuuuuuaa

SEQ ID NO: 2822313 - RNA, 23 nt, Human
auauguauauuuuuuuaauuuaa

SEQ ID NO: 2822314 - RNA, 16 nt, Human
auauguauuauuuaua

SEQ ID NO: 2822315 - RNA, 17 nt, Human
auauguauuauuuauaa

SEQ ID NO: 2822316 - RNA, 14 nt, Human
auauguauuaauaa

SEQ ID NO: 2822317 - RNA, 23 nt, Human
auauguauuaauaaauagagcaa

SEQ ID NO: 2822318 - RNA, 18 nt, Human
auauguauuauuuauaau

SEQ ID NO: 2822319 - RNA, 22 nt, Human
auauguauuauuuauaauuccu

SEQ ID NO: 2822320 - RNA, 20 nt, Human
auaugucucgcuagugaugu

SEQ ID NO: 2822321 - RNA, 21 nt, Human
auaugucucgcuagugauguu

SEQ ID NO: 2822322 - RNA, 16 nt, Human
auaugucugcuccuuu

SEQ ID NO: 2822323 - RNA, 16 nt, Human
uucauggaccacuguu

SEQ ID NO: 2822324 - RNA, 17 nt, Human
uucauggaccacuguuu

SEQ ID NO: 2822325 - RNA, 20 nt, Human
uucauggaccacuguuucuu

SEQ ID NO: 2822326 - RNA, 17 nt, Human
auauguauuuuuauaua

SEQ ID NO: 2822327 - RNA, 15 nt, Human
auaugucacuagaau

SEQ ID NO: 2822328 - RNA, 17 nt, Human
auaugucacuagaaugg

SEQ ID NO: 2822329 - RNA, 23 nt, Human
auauguauuauuuauaauuccua

SEQ ID NO: 2822330 - RNA, 14 nt, Human
auauguauuguaaa

SEQ ID NO: 2822331 - RNA, 21 nt, Human
auauguauuguaaacaugugu

SEQ ID NO: 2822332 - RNA, 11 nt, Human
auauguauuuu

SEQ ID NO: 2822333 - RNA, 21 nt, Human
uucauguacaagaugaaggag

SEQ ID NO: 2822334 - RNA, 13 nt, Human
uucauguacauuu

SEQ ID NO: 2822335 - RNA, 20 nt, Human
uucauguagagaaaagcaca

SEQ ID NO: 2822336 - RNA, 21 nt, Human
uucauguagagaaaagcacac

SEQ ID NO: 2822337 - RNA, 17 nt, Human
uucauguacaagaugaa

SEQ ID NO: 2822338 - RNA, 19 nt, Human
uucauggugaaaauguacu

SEQ ID NO: 2822339 - RNA, 15 nt, Human
auaucugaaauguga

SEQ ID NO: 2822340 - RNA, 18 nt, Human
auaucugaacauuuacua

SEQ ID NO: 2822341 - RNA, 17 nt, Human
auaucuugcgaauccaa

SEQ ID NO: 2822342 - RNA, 18 nt, Human
auaucuugcgaauccaag

SEQ ID NO: 2822343 - RNA, 19 nt, Human
uucaucaugaggaaagcag

SEQ ID NO: 2822344 - RNA, 20 nt, Human
auaucuucagcucuuuuugu

SEQ ID NO: 2822345 - RNA, 14 nt, Human
auaucuuaaagaaa

SEQ ID NO: 2822346 - RNA, 16 nt, Human
auaucuuaaagaaaca

SEQ ID NO: 2822347 - RNA, 19 nt, Human
auaucuuaaagaaacagcu

SEQ ID NO: 2822348 - RNA, 18 nt, Human
auaucuguggucuucaaa

SEQ ID NO: 2822349 - RNA, 12 nt, Human
auaucuguaugu

SEQ ID NO: 2822350 - RNA, 13 nt, Human
auaucuguaugua

SEQ ID NO: 2822351 - RNA, 15 nt, Human
auaucuguauguauu

SEQ ID NO: 2822352 - RNA, 21 nt, Human
auaucuguauguauuagugau

SEQ ID NO: 2822353 - RNA, 13 nt, Human
auaucugcuucag

SEQ ID NO: 2822354 - RNA, 16 nt, Human
auaucugcuucagugg

SEQ ID NO: 2822355 - RNA, 20 nt, Human
auaucuggccuaaaaucuug

SEQ ID NO: 2822356 - RNA, 21 nt, Human
auaucuggccuaaaaucuugg

SEQ ID NO: 2822357 - RNA, 15 nt, Human
auaucugaagcccuc

SEQ ID NO: 2822358 - RNA, 13 nt, Human
uucagcaaaccau

SEQ ID NO: 2822359 - RNA, 23 nt, Human
uucagccuaguggcuuguccuca

SEQ ID NO: 2822360 - RNA, 15 nt, Human
uucagccucuuucug

SEQ ID NO: 2822361 - RNA, 20 nt, Human
uucaggggacucagcccuga

SEQ ID NO: 2822362 - RNA, 19 nt, Human
uucaggggacucagcccug

SEQ ID NO: 2822363 - RNA, 17 nt, Human
uucaggggacucagccc

SEQ ID NO: 2822364 - RNA, 16 nt, Human
uucaggggacucagcc

SEQ ID NO: 2822365 - RNA, 13 nt, Human
uucagggccuggu

SEQ ID NO: 2822366 - RNA, 19 nt, Human
uucagggccugguugaaga

SEQ ID NO: 2822367 - RNA, 22 nt, Human
uucagggaauuucaggaacuag

SEQ ID NO: 2822368 - RNA, 16 nt, Human
uucaguaauguuauuu

SEQ ID NO: 2822369 - RNA, 20 nt, Human
uucaguaauaaacuguguuu

SEQ ID NO: 2822370 - RNA, 21 nt, Human
uucaguacccucucagcucca

SEQ ID NO: 2822371 - RNA, 22 nt, Human
uucaguacccucucagcuccag

SEQ ID NO: 2822372 - RNA, 13 nt, Human
uucagggucauag

SEQ ID NO: 2822373 - RNA, 23 nt, Human
uucaggggacucagcccugaggu

SEQ ID NO: 2822374 - RNA, 18 nt, Human
uucauagagauuugucua

SEQ ID NO: 2822375 - RNA, 19 nt, Human
uucauagagauuugucuaa

SEQ ID NO: 2822376 - RNA, 20 nt, Human
uucauagagauuugucuaau

SEQ ID NO: 2822377 - RNA, 15 nt, Human
uucaguacuucagca

SEQ ID NO: 2822378 - RNA, 20 nt, Human
uucaguacuucagcaagaga

SEQ ID NO: 2822379 - RNA, 22 nt, Human
uucaguacuucagcaagagaga

SEQ ID NO: 2822380 - RNA, 16 nt, Human
uucaguauguuuuaca

SEQ ID NO: 2822381 - RNA, 17 nt, Human
uucaguauguuuuacac

SEQ ID NO: 2822382 - RNA, 19 nt, Human
uucaguauguuuuacacug

SEQ ID NO: 2822383 - RNA, 20 nt, Human
uucaguauguuuuacacugu

SEQ ID NO: 2822384 - RNA, 22 nt, Human
uucaguauguuuuacacuguac

SEQ ID NO: 2822385 - RNA, 17 nt, Human
uucaguauuuuggagaa

SEQ ID NO: 2822386 - RNA, 14 nt, Human
uucauaccuaagua

SEQ ID NO: 2822387 - RNA, 16 nt, Human
uucauaccuaaguacu

SEQ ID NO: 2822388 - RNA, 18 nt, Human
uucauaccuaaguacugu

SEQ ID NO: 2822389 - RNA, 19 nt, Human
uucauaccuaaguacugua

SEQ ID NO: 2822390 - RNA, 20 nt, Human
uucauaccuaaguacuguaa

SEQ ID NO: 2822391 - RNA, 21 nt, Human
uucauaccuaaguacuguaau

SEQ ID NO: 2822392 - RNA, 22 nt, Human
uucauaccuaaguacuguaaua

SEQ ID NO: 2822393 - RNA, 20 nt, Human
uucaguauuauguaguuguu

SEQ ID NO: 2822394 - RNA, 15 nt, Human
uucauaccucagaau

SEQ ID NO: 2822395 - RNA, 23 nt, Human
uucauacuccuuuuaagcaguga

SEQ ID NO: 2822396 - RNA, 20 nt, Human
auaucuaauuauuuugcagu

SEQ ID NO: 2822397 - RNA, 14 nt, Human
auaucuacagauag

SEQ ID NO: 2822398 - RNA, 23 nt, Human
auaucuacagauagagaguuguu

SEQ ID NO: 2822399 - RNA, 19 nt, Human
auaucuaauauauaugaau

SEQ ID NO: 2822400 - RNA, 13 nt, Human
auaucuaauauau

SEQ ID NO: 2822401 - RNA, 14 nt, Human
auaucuaauauaua

SEQ ID NO: 2822402 - RNA, 17 nt, Human
auaucuaauauauauga

SEQ ID NO: 2822403 - RNA, 18 nt, Human
auaucuaauauauaugaa

SEQ ID NO: 2822404 - RNA, 15 nt, Human
auaucgcugacuuca

SEQ ID NO: 2822405 - RNA, 18 nt, Human
auaucggcucacaaagag

SEQ ID NO: 2822406 - RNA, 19 nt, Human
auaucggcucacaaagaga

SEQ ID NO: 2822407 - RNA, 14 nt, Human
auauccuuuucuuc

SEQ ID NO: 2822408 - RNA, 21 nt, Human
auauccuuuucuucuauguag

SEQ ID NO: 2822409 - RNA, 14 nt, Human
auaucuaaaguuau

SEQ ID NO: 2822410 - RNA, 15 nt, Human
auaucuaaaguuaua

SEQ ID NO: 2822411 - RNA, 16 nt, Human
auaucuaaaguuauau

SEQ ID NO: 2822412 - RNA, 19 nt, Human
auaucuaaaguuauauuuc

SEQ ID NO: 2822413 - RNA, 20 nt, Human
auaucuaaaguuauauuuca

SEQ ID NO: 2822414 - RNA, 21 nt, Human
auaucuaaaguuauauuucag

SEQ ID NO: 2822415 - RNA, 17 nt, Human
uucaucauucccucuca

SEQ ID NO: 2822416 - RNA, 19 nt, Human
uucaucauucccucucauc

SEQ ID NO: 2822417 - RNA, 20 nt, Human
uucaucauucccucucaucu

SEQ ID NO: 2822418 - RNA, 15 nt, Human
uucaucauuguuucu

SEQ ID NO: 2822419 - RNA, 22 nt, Human
uucaucauuguuucugcaugaa

SEQ ID NO: 2822420 - RNA, 23 nt, Human
uucaucauuguuucugcaugaau

SEQ ID NO: 2822421 - RNA, 17 nt, Human
auauauuacaagggaua

SEQ ID NO: 2822422 - RNA, 17 nt, Human
auauauuauaaauauau

SEQ ID NO: 2822423 - RNA, 20 nt, Human
uucauccaacuuauguuuuu

SEQ ID NO: 2822424 - RNA, 17 nt, Human
augaacuuucucuucau

SEQ ID NO: 2822425 - RNA, 13 nt, Human
augaacacuuaua

SEQ ID NO: 2822426 - RNA, 13 nt, Human
augaacccuuccu

SEQ ID NO: 2822427 - RNA, 18 nt, Human
augaacccuuccugagcu

SEQ ID NO: 2822428 - RNA, 21 nt, Human
augaacccuuccugagcuuua

SEQ ID NO: 2822429 - RNA, 22 nt, Human
augaacccuuccugagcuuuau

SEQ ID NO: 2822430 - RNA, 17 nt, Human
augaacccuuuguuucu

SEQ ID NO: 2822431 - RNA, 14 nt, Human
augaaccuucuggc

SEQ ID NO: 2822432 - RNA, 23 nt, Human
augaaucuuuguuucagguucag

SEQ ID NO: 2822433 - RNA, 20 nt, Human
augaaucucccacuccagcg

SEQ ID NO: 2822434 - RNA, 15 nt, Human
augaaucugauuuuu

SEQ ID NO: 2822435 - RNA, 17 nt, Human
augaaucugauuuuuau

SEQ ID NO: 2822436 - RNA, 22 nt, Human
augaaucugauuuuuaugauga

SEQ ID NO: 2822437 - RNA, 14 nt, Human
augaaucugcucac

SEQ ID NO: 2822438 - RNA, 16 nt, Human
augaaucugcucacuu

SEQ ID NO: 2822439 - RNA, 17 nt, Human
augaaucugcucacuuu

SEQ ID NO: 2822440 - RNA, 18 nt, Human
augaaucugcucacuuua

SEQ ID NO: 2822441 - RNA, 23 nt, Human
augaaucugucucccaguuauga

SEQ ID NO: 2822442 - RNA, 24 nt, Human
augaaucugucucccaguuaugaa

SEQ ID NO: 2822443 - RNA, 15 nt, Human
augaauguauuuauu

SEQ ID NO: 2822444 - RNA, 17 nt, Human
augaauguauuuauuug

SEQ ID NO: 2822445 - RNA, 20 nt, Human
augaauguauuuauuuggga

SEQ ID NO: 2822446 - RNA, 14 nt, Human
augaaugaaugaau

SEQ ID NO: 2822447 - RNA, 21 nt, Human
augaagauuggugggauuuuu

SEQ ID NO: 2822448 - RNA, 13 nt, Human
augaagcagcuuu

SEQ ID NO: 2822449 - RNA, 15 nt, Human
augaagcagcuuuaa

SEQ ID NO: 2822450 - RNA, 13 nt, Human
augaagcaaggaa

SEQ ID NO: 2822451 - RNA, 14 nt, Human
augaagcaaggaag

SEQ ID NO: 2822452 - RNA, 15 nt, Human
augaagcaaggaaga

SEQ ID NO: 2822453 - RNA, 16 nt, Human
augaagcaaggaagau

SEQ ID NO: 2822454 - RNA, 21 nt, Human
augaaucccacccacauguga

SEQ ID NO: 2822455 - RNA, 18 nt, Human
augaaucccacccacaug

SEQ ID NO: 2822456 - RNA, 22 nt, Human
augaagcagcuuuaaacaaauu

SEQ ID NO: 2822457 - RNA, 16 nt, Human
uuggccaucucuggau

SEQ ID NO: 2822458 - RNA, 20 nt, Human
uuggagcgagcaucccccaa

SEQ ID NO: 2822459 - RNA, 15 nt, Human
uuggagcuuacauag

SEQ ID NO: 2822460 - RNA, 20 nt, Human
uuggagcuuacauaguuuua

SEQ ID NO: 2822461 - RNA, 20 nt, Human
augaaagucuagaaauaaaa

SEQ ID NO: 2822462 - RNA, 14 nt, Human
augaaauaaagaaa

SEQ ID NO: 2822463 - RNA, 22 nt, Human
augaaauaaagacccaggggga

SEQ ID NO: 2822464 - RNA, 20 nt, Human
augaaagugaugacauauuu

SEQ ID NO: 2822465 - RNA, 22 nt, Human
augaaccacaucuugcucugcu

SEQ ID NO: 2822466 - RNA, 23 nt, Human
augaaccacaucuugcucugcug

SEQ ID NO: 2822467 - RNA, 20 nt, Human
augaacaccauaccuuugcu

SEQ ID NO: 2822468 - RNA, 17 nt, Human
augaacacccuuagaaa

SEQ ID NO: 2822469 - RNA, 13 nt, Human
augaacaaguuuu

SEQ ID NO: 2822470 - RNA, 14 nt, Human
augaacaaguuuua

SEQ ID NO: 2822471 - RNA, 15 nt, Human
augaacaaguuuuaa

SEQ ID NO: 2822472 - RNA, 21 nt, Human
augaacaaguuuuaauguaua

SEQ ID NO: 2822473 - RNA, 13 nt, Human
augaaauaugcau

SEQ ID NO: 2822474 - RNA, 15 nt, Human
augaaauaugcaucu

SEQ ID NO: 2822475 - RNA, 17 nt, Human
augaaauacuauuuaaa

SEQ ID NO: 2822476 - RNA, 22 nt, Human
augaaauuuucuagacuuucug

SEQ ID NO: 2822477 - RNA, 19 nt, Human
augaaauuuucuagacuuu

SEQ ID NO: 2822478 - RNA, 21 nt, Human
augaaauuuucuagacuuucu

SEQ ID NO: 2822479 - RNA, 23 nt, Human
augaaauuuucuagacuuucugu

SEQ ID NO: 2822480 - RNA, 14 nt, Human
augaaauuuuugua

SEQ ID NO: 2822481 - RNA, 16 nt, Human
augaaauuuuuguaaa

SEQ ID NO: 2822482 - RNA, 17 nt, Human
augaaauuuuuguaaau

SEQ ID NO: 2822483 - RNA, 19 nt, Human
uugggucaccccuccagga

SEQ ID NO: 2822484 - RNA, 20 nt, Human
uuggguagcugccacuugaa

SEQ ID NO: 2822485 - RNA, 15 nt, Human
uugggguuguguugu

SEQ ID NO: 2822486 - RNA, 16 nt, Human
uugggguuguguuguc

SEQ ID NO: 2822487 - RNA, 22 nt, Human
uuggggugccccucuccuucuu

SEQ ID NO: 2822488 - RNA, 21 nt, Human
uuggggugucuuuuuuuggug

SEQ ID NO: 2822489 - RNA, 16 nt, Human
uugggguuuuuuaaua

SEQ ID NO: 2822490 - RNA, 15 nt, Human
uugggucuauuccag

SEQ ID NO: 2822491 - RNA, 17 nt, Human
uugggucuauuccagcu

SEQ ID NO: 2822492 - RNA, 18 nt, Human
uugggucuauuccagcuc

SEQ ID NO: 2822493 - RNA, 20 nt, Human
uugguuuggccaucucugga

SEQ ID NO: 2822494 - RNA, 14 nt, Human
uuggugugcugagg

SEQ ID NO: 2822495 - RNA, 19 nt, Human
uugguguguuggacagaga

SEQ ID NO: 2822496 - RNA, 14 nt, Human
uugguguuaaaaca

SEQ ID NO: 2822497 - RNA, 15 nt, Human
uugguuaaaacugua

SEQ ID NO: 2822498 - RNA, 22 nt, Human
uugguuaaaacuguacauuuaa

SEQ ID NO: 2822499 - RNA, 14 nt, Human
uugguguacagacu

SEQ ID NO: 2822500 - RNA, 23 nt, Human
uugguguauagaaguuuguccau

SEQ ID NO: 2822501 - RNA, 21 nt, Human
uuggugucaacaugaaacacc

SEQ ID NO: 2822502 - RNA, 13 nt, Human
uugguguguccca

SEQ ID NO: 2822503 - RNA, 15 nt, Human
uugguguugucauug

SEQ ID NO: 2822504 - RNA, 18 nt, Human
uugguguugucauuguaa

SEQ ID NO: 2822505 - RNA, 20 nt, Human
uugguguaaagccaacaccc

SEQ ID NO: 2822506 - RNA, 23 nt, Human
uugguguaacaucuucaacaugu

SEQ ID NO: 2822507 - RNA, 15 nt, Human
uugguggcuuauggg

SEQ ID NO: 2822508 - RNA, 14 nt, Human
uugguggcuuuccu

SEQ ID NO: 2822509 - RNA, 13 nt, Human
uuguaaauuguca

SEQ ID NO: 2822510 - RNA, 21 nt, Human
uuguaagacaaagguuuuccu

SEQ ID NO: 2822511 - RNA, 18 nt, Human
uuguaagacaaagguuuu

SEQ ID NO: 2822512 - RNA, 15 nt, Human
uuguaagaguguaga

SEQ ID NO: 2822513 - RNA, 22 nt, Human
uuguaagacaaagguuuuccuc

SEQ ID NO: 2822514 - RNA, 19 nt, Human
uuguaaguuucaggugaca

SEQ ID NO: 2822515 - RNA, 22 nt, Human
uuguaaguuucaggugacaugu

SEQ ID NO: 2822516 - RNA, 13 nt, Human
uuguaauauuuug

SEQ ID NO: 2822517 - RNA, 14 nt, Human
uuguaauauuuugu

SEQ ID NO: 2822518 - RNA, 15 nt, Human
uuguaauauuuugua

SEQ ID NO: 2822519 - RNA, 18 nt, Human
uuguaauauuuuguauua

SEQ ID NO: 2822520 - RNA, 14 nt, Human
uuguaauauuuuua

SEQ ID NO: 2822521 - RNA, 17 nt, Human
uuguaagaguguagaag

SEQ ID NO: 2822522 - RNA, 19 nt, Human
uuguaagaguguagaagca

SEQ ID NO: 2822523 - RNA, 21 nt, Human
uuguaagaguguagaagcauu

SEQ ID NO: 2822524 - RNA, 22 nt, Human
uuguaagaguguagaagcauuc

SEQ ID NO: 2822525 - RNA, 13 nt, Human
uuguaaguuucag

SEQ ID NO: 2822526 - RNA, 16 nt, Human
uuguaaguuucaggug

SEQ ID NO: 2822527 - RNA, 17 nt, Human
uuguaaguuucagguga

SEQ ID NO: 2822528 - RNA, 18 nt, Human
uuguaaguuucaggugac

SEQ ID NO: 2822529 - RNA, 22 nt, Human
uuguaauugcuuuuuuaaauau

SEQ ID NO: 2822530 - RNA, 16 nt, Human
uuguaauucuucaguu

SEQ ID NO: 2822531 - RNA, 17 nt, Human
uuguaauucuucaguug

SEQ ID NO: 2822532 - RNA, 12 nt, Human
uuguaauugcuu

SEQ ID NO: 2822533 - RNA, 13 nt, Human
uuguaauuuugaa

SEQ ID NO: 2822534 - RNA, 12 nt, Human
aucuuaaaaagu

SEQ ID NO: 2822535 - RNA, 17 nt, Human
aucuuaaaaaguuguuc

SEQ ID NO: 2822536 - RNA, 19 nt, Human
aucuuaaaaaguuguucaa

SEQ ID NO: 2822537 - RNA, 14 nt, Human
aucuugcucugcug

SEQ ID NO: 2822538 - RNA, 21 nt, Human
aucuuaaugaaugagucuguu

SEQ ID NO: 2822539 - RNA, 16 nt, Human
aucuuaauauauuuga

SEQ ID NO: 2822540 - RNA, 17 nt, Human
aucuuggagacccugca

SEQ ID NO: 2822541 - RNA, 21 nt, Human
aucuuggacucaugaggaggg

SEQ ID NO: 2822542 - RNA, 16 nt, Human
aucuugcucugcugac

SEQ ID NO: 2822543 - RNA, 15 nt, Human
aucuugcucugcuga

SEQ ID NO: 2822544 - RNA, 23 nt, Human
aucuuggcacauuuaagagacag

SEQ ID NO: 2822545 - RNA, 21 nt, Human
aucuuggauagcuaauaauga

SEQ ID NO: 2822546 - RNA, 13 nt, Human
aucuuggcuaugu

SEQ ID NO: 2822547 - RNA, 21 nt, Human
aucuuggcuauguaauucuug

SEQ ID NO: 2822548 - RNA, 22 nt, Human
aucuuggcuauguaauucuugu

SEQ ID NO: 2822549 - RNA, 18 nt, Human
aucuugugugauuaacuu

SEQ ID NO: 2822550 - RNA, 22 nt, Human
aucuugugugauuaacuuauuu

SEQ ID NO: 2822551 - RNA, 23 nt, Human
aucuugugugauuaacuuauuua

SEQ ID NO: 2822552 - RNA, 16 nt, Human
aucuuguguuguccuu

SEQ ID NO: 2822553 - RNA, 17 nt, Human
aucuuguguuguccuuu

SEQ ID NO: 2822554 - RNA, 22 nt, Human
aucuuguguuguccuuuugucu

SEQ ID NO: 2822555 - RNA, 22 nt, Human
aucugucauuugagcagggcuc

SEQ ID NO: 2822556 - RNA, 17 nt, Human
aucugucauuugagcag

SEQ ID NO: 2822557 - RNA, 12 nt, Human
aucugucauuug

SEQ ID NO: 2822558 - RNA, 19 nt, Human
uugcccggauucugggagg

SEQ ID NO: 2822559 - RNA, 15 nt, Human
uugcccuagaugagc

SEQ ID NO: 2822560 - RNA, 16 nt, Human
uugcccuagauaguuu

SEQ ID NO: 2822561 - RNA, 21 nt, Human
aucugucaagaguaguuauau

SEQ ID NO: 2822562 - RNA, 22 nt, Human
aucugucaagaguaguuauaua

SEQ ID NO: 2822563 - RNA, 23 nt, Human
aucugucaagugggaucugucac

SEQ ID NO: 2822564 - RNA, 17 nt, Human
aucugucacaccagcca

SEQ ID NO: 2822565 - RNA, 23 nt, Human
uugccccuggggcuuccauccca

SEQ ID NO: 2822566 - RNA, 17 nt, Human
uugcccggauucuggga

SEQ ID NO: 2822567 - RNA, 17 nt, Human
uugccccgucucuguuc

SEQ ID NO: 2822568 - RNA, 21 nt, Human
uugcccccgugagccaauccc

SEQ ID NO: 2822569 - RNA, 22 nt, Human
uugcccccugcccguguacaua

SEQ ID NO: 2822570 - RNA, 16 nt, Human
aucuguggucuucaaa

SEQ ID NO: 2822571 - RNA, 20 nt, Human
aucuguguauauuauuuggc

SEQ ID NO: 2822572 - RNA, 21 nt, Human
aucuguguauauuauuuggca

SEQ ID NO: 2822573 - RNA, 18 nt, Human
aucuuaaagaaacagcuu

SEQ ID NO: 2822574 - RNA, 19 nt, Human
aucuuaaagaaacagcuuu

SEQ ID NO: 2822575 - RNA, 20 nt, Human
aucuuaaagaaacagcuuuc

SEQ ID NO: 2822576 - RNA, 21 nt, Human
aucuuaaagaaacagcuuuca

SEQ ID NO: 2822577 - RNA, 22 nt, Human
aucuuaaagaaacagcuuucaa

SEQ ID NO: 2822578 - RNA, 23 nt, Human
aucuuaaagaaacagcuuucaag

SEQ ID NO: 2822579 - RNA, 22 nt, Human
aucuguuuuuguuuauuucauu

SEQ ID NO: 2822580 - RNA, 13 nt, Human
aucuguguccugg

SEQ ID NO: 2822581 - RNA, 14 nt, Human
aucugugaugggag

SEQ ID NO: 2822582 - RNA, 22 nt, Human
aucugugcaaauccuugauacu

SEQ ID NO: 2822583 - RNA, 16 nt, Human
aucugugcauucuccu

SEQ ID NO: 2822584 - RNA, 18 nt, Human
aucugucacaccagccau

SEQ ID NO: 2822585 - RNA, 23 nt, Human
aucugugccccaugccuguccag

SEQ ID NO: 2822586 - RNA, 15 nt, Human
aucugugccccaugc

SEQ ID NO: 2822587 - RNA, 13 nt, Human
aucugugccccau

SEQ ID NO: 2822588 - RNA, 12 nt, Human
aucugugcccca

SEQ ID NO: 2822589 - RNA, 19 nt, Human
aucugugcucaggacucag

SEQ ID NO: 2822590 - RNA, 14 nt, Human
aucuuuaagaaaaa

SEQ ID NO: 2822591 - RNA, 13 nt, Human
aucuuuaagcaga

SEQ ID NO: 2822592 - RNA, 17 nt, Human
aucuuuaagcagagaag

SEQ ID NO: 2822593 - RNA, 14 nt, Human
uugcuuaguaaaau

SEQ ID NO: 2822594 - RNA, 15 nt, Human
uugcuuaguaaaauu

SEQ ID NO: 2822595 - RNA, 15 nt, Human
uugcucuuguagccc

SEQ ID NO: 2822596 - RNA, 19 nt, Human
uugcucuugucccacgugu

SEQ ID NO: 2822597 - RNA, 13 nt, Human
uugcuuuguaugc

SEQ ID NO: 2822598 - RNA, 14 nt, Human
uugcuuugcccagc

SEQ ID NO: 2822599 - RNA, 14 nt, Human
uugcuuugaagcag

SEQ ID NO: 2822600 - RNA, 15 nt, Human
uugcuuugaagcagu

SEQ ID NO: 2822601 - RNA, 19 nt, Human
uugcuuugauuuacagcaa

SEQ ID NO: 2822602 - RNA, 16 nt, Human
uugcuuugaagcaguu

SEQ ID NO: 2822603 - RNA, 22 nt, Human
uugcuuugaagcaguuguguca

SEQ ID NO: 2822604 - RNA, 20 nt, Human
uugcuuuaugccuucuuauu

SEQ ID NO: 2822605 - RNA, 15 nt, Human
uugcuuucuuuucuc

SEQ ID NO: 2822606 - RNA, 14 nt, Human
uugcuuugaaaaag

SEQ ID NO: 2822607 - RNA, 14 nt, Human
uugcuucauaaaug

SEQ ID NO: 2822608 - RNA, 16 nt, Human
uugcuuauuuaauaaa

SEQ ID NO: 2822609 - RNA, 13 nt, Human
uugcuuauuuaau

SEQ ID NO: 2822610 - RNA, 13 nt, Human
uugcuuaugacau

SEQ ID NO: 2822611 - RNA, 20 nt, Human
uugcuucauaaaugaagcag

SEQ ID NO: 2822612 - RNA, 19 nt, Human
aucuuguuccaaggccagg

SEQ ID NO: 2822613 - RNA, 15 nt, Human
uugcuucauaaauga

SEQ ID NO: 2822614 - RNA, 17 nt, Human
uugcuucauaaaugaag

SEQ ID NO: 2822615 - RNA, 16 nt, Human
uugcuuccccuuuugc

SEQ ID NO: 2822616 - RNA, 17 nt, Human
uugcuuccccuuuugcc

SEQ ID NO: 2822617 - RNA, 20 nt, Human
uugcuuccccuuuugccaau

SEQ ID NO: 2822618 - RNA, 15 nt, Human
uugcuuuauuccaga

SEQ ID NO: 2822619 - RNA, 11 nt, Human
uugcuuucacu

SEQ ID NO: 2822620 - RNA, 13 nt, Human
uugcuuucacucu

SEQ ID NO: 2822621 - RNA, 14 nt, Human
uugcuuccuccucc

SEQ ID NO: 2822622 - RNA, 15 nt, Human
uugcuuccuccuccc

SEQ ID NO: 2822623 - RNA, 17 nt, Human
uugcuuccuccucccca

SEQ ID NO: 2822624 - RNA, 14 nt, Human
uuggacuuucaaaa

SEQ ID NO: 2822625 - RNA, 23 nt, Human
uuggacuuucaaaauuaaaucug

SEQ ID NO: 2822626 - RNA, 18 nt, Human
uuggagacacaacuauuu

SEQ ID NO: 2822627 - RNA, 14 nt, Human
uuggagaaauuauu

SEQ ID NO: 2822628 - RNA, 15 nt, Human
uuggagaaauuauuu

SEQ ID NO: 2822629 - RNA, 20 nt, Human
uuggagauaaucuagaacac

SEQ ID NO: 2822630 - RNA, 14 nt, Human
uuggagaucaagga

SEQ ID NO: 2822631 - RNA, 22 nt, Human
uuggagaugcugaggguguuuc

SEQ ID NO: 2822632 - RNA, 12 nt, Human
uuggaaaauaaa

SEQ ID NO: 2822633 - RNA, 15 nt, Human
uuggaaaauaaauca

SEQ ID NO: 2822634 - RNA, 15 nt, Human
uuggacuggaugcau

SEQ ID NO: 2822635 - RNA, 13 nt, Human
uuggacuauuaua

SEQ ID NO: 2822636 - RNA, 14 nt, Human
uuggacuccaucuc

SEQ ID NO: 2822637 - RNA, 16 nt, Human
uugcuuuguaugcacu

SEQ ID NO: 2822638 - RNA, 14 nt, Human
uuggaaaaauguuu

SEQ ID NO: 2822639 - RNA, 23 nt, Human
uugcuuuguuaaaaaaaaaaaga

SEQ ID NO: 2822640 - RNA, 14 nt, Human
uugcuuuguugcac

SEQ ID NO: 2822641 - RNA, 22 nt, Human
aucuauuuuggauuguauauug

SEQ ID NO: 2822642 - RNA, 17 nt, Human
aucuagcgcaauugaag

SEQ ID NO: 2822643 - RNA, 15 nt, Human
aucuagcuaguaaua

SEQ ID NO: 2822644 - RNA, 21 nt, Human
aucuacccaagggcagaaagu

SEQ ID NO: 2822645 - RNA, 19 nt, Human
aucuacuaauuccacaccu

SEQ ID NO: 2822646 - RNA, 15 nt, Human
aucuacuaauuccac

SEQ ID NO: 2822647 - RNA, 23 nt, Human
aucuaauauguaacaagccaccc

SEQ ID NO: 2822648 - RNA, 20 nt, Human
aucuaauauguaacaagcca

SEQ ID NO: 2822649 - RNA, 14 nt, Human
aucuaauauuaaaa

SEQ ID NO: 2822650 - RNA, 16 nt, Human
aucuaauuauuuugca

SEQ ID NO: 2822651 - RNA, 12 nt, Human
uugagugugugu

SEQ ID NO: 2822652 - RNA, 15 nt, Human
uugagugugugugug

SEQ ID NO: 2822653 - RNA, 18 nt, Human
uugagugugugugugcau

SEQ ID NO: 2822654 - RNA, 15 nt, Human
uugauacucuuucua

SEQ ID NO: 2822655 - RNA, 20 nt, Human
uugauacucuuucuaaugcu

SEQ ID NO: 2822656 - RNA, 16 nt, Human
uugauacuuauauuuu

SEQ ID NO: 2822657 - RNA, 20 nt, Human
uugauacuuauauuuucgua

SEQ ID NO: 2822658 - RNA, 23 nt, Human
uugagugggguuaucucuguguu

SEQ ID NO: 2822659 - RNA, 23 nt, Human
uugacaugagauuuauaagguuu

SEQ ID NO: 2822660 - RNA, 16 nt, Human
uugacaucagccagcu

SEQ ID NO: 2822661 - RNA, 18 nt, Human
uugacaucagccagcugc

SEQ ID NO: 2822662 - RNA, 18 nt, Human
uugacaucaguuccuuug

SEQ ID NO: 2822663 - RNA, 22 nt, Human
uugacaucaguuccuuugugug

SEQ ID NO: 2822664 - RNA, 12 nt, Human
uugacagggcac

SEQ ID NO: 2822665 - RNA, 10 nt, Human
uugacagggc

SEQ ID NO: 2822666 - RNA, 14 nt, Human
uugacacucugcag

SEQ ID NO: 2822667 - RNA, 17 nt, Human
uugacacucugcagacu

SEQ ID NO: 2822668 - RNA, 22 nt, Human
aucccuuuauuacccccuccuu

SEQ ID NO: 2822669 - RNA, 22 nt, Human
aucccuugaccaggccugggcc

SEQ ID NO: 2822670 - RNA, 18 nt, Human
uugacaauaauuucaggu

SEQ ID NO: 2822671 - RNA, 14 nt, Human
uugacacaagugga

SEQ ID NO: 2822672 - RNA, 17 nt, Human
uugacacaaguggaccu

SEQ ID NO: 2822673 - RNA, 18 nt, Human
uugacacaaguggaccuu

SEQ ID NO: 2822674 - RNA, 15 nt, Human
uugacacaauuggaa

SEQ ID NO: 2822675 - RNA, 16 nt, Human
uugacacaauuggaau

SEQ ID NO: 2822676 - RNA, 16 nt, Human
uugacacagaaaaugu

SEQ ID NO: 2822677 - RNA, 18 nt, Human
uugacacauccgccuuuu

SEQ ID NO: 2822678 - RNA, 20 nt, Human
uugacacauccgccuuuugu

SEQ ID NO: 2822679 - RNA, 21 nt, Human
uugacacauccgccuuuugua

SEQ ID NO: 2822680 - RNA, 23 nt, Human
uugacacauccgccuuuuguaua

SEQ ID NO: 2822681 - RNA, 13 nt, Human
aucccuuuauuac

SEQ ID NO: 2822682 - RNA, 14 nt, Human
aucccuuuauuacc

SEQ ID NO: 2822683 - RNA, 14 nt, Human
aucccuugaccagg

SEQ ID NO: 2822684 - RNA, 18 nt, Human
aucccuugaccaggccug

SEQ ID NO: 2822685 - RNA, 13 nt, Human
aucccuucucaca

SEQ ID NO: 2822686 - RNA, 14 nt, Human
aucccuucucacag

SEQ ID NO: 2822687 - RNA, 16 nt, Human
aucccuucucacagca

SEQ ID NO: 2822688 - RNA, 17 nt, Human
aucccuucucacagcac

SEQ ID NO: 2822689 - RNA, 11 nt, Human
uugagaaaaau

SEQ ID NO: 2822690 - RNA, 17 nt, Human
uugaccaucugcuuuua

SEQ ID NO: 2822691 - RNA, 19 nt, Human
uugagaaaaauauauacua

SEQ ID NO: 2822692 - RNA, 11 nt, Human
uugaccaggcc

SEQ ID NO: 2822693 - RNA, 18 nt, Human
uugacauugcguuugacc

SEQ ID NO: 2822694 - RNA, 21 nt, Human
uugacauuguauguaucuauu

SEQ ID NO: 2822695 - RNA, 22 nt, Human
uugacauuguauguaucuauuu

SEQ ID NO: 2822696 - RNA, 11 nt, Human
uugacauuuaa

SEQ ID NO: 2822697 - RNA, 13 nt, Human
uugacauuuaauu

SEQ ID NO: 2822698 - RNA, 15 nt, Human
uugacauuuguaguu

SEQ ID NO: 2822699 - RNA, 22 nt, Human
uugacauuaagaauguugguuu

SEQ ID NO: 2822700 - RNA, 15 nt, Human
uugacauuauagaca

SEQ ID NO: 2822701 - RNA, 14 nt, Human
uugacauugcguuu

SEQ ID NO: 2822702 - RNA, 16 nt, Human
uugagcagggcucagc

SEQ ID NO: 2822703 - RNA, 12 nt, Human
uugagcagggcu

SEQ ID NO: 2822704 - RNA, 21 nt, Human
uugagcacaaaaccuguccua

SEQ ID NO: 2822705 - RNA, 11 nt, Human
uugagacagag

SEQ ID NO: 2822706 - RNA, 22 nt, Human
uugagacacggagcccagcccu

SEQ ID NO: 2822707 - RNA, 10 nt, Human
uugagacaga

SEQ ID NO: 2822708 - RNA, 23 nt, Human
uugagaaucccaaauuugauuga

SEQ ID NO: 2822709 - RNA, 16 nt, Human
uugagaauggaaacca

SEQ ID NO: 2822710 - RNA, 17 nt, Human
uugagaauggaaaccac

SEQ ID NO: 2822711 - RNA, 17 nt, Human
uugagaaggagagaaag

SEQ ID NO: 2822712 - RNA, 16 nt, Human
uugagaaguucauugu

SEQ ID NO: 2822713 - RNA, 16 nt, Human
uugagaauauugaagu

SEQ ID NO: 2822714 - RNA, 15 nt, Human
aucugaagcccuccc

SEQ ID NO: 2822715 - RNA, 18 nt, Human
aucugaagcccucccagg

SEQ ID NO: 2822716 - RNA, 20 nt, Human
aucugaagcuucacucacug

SEQ ID NO: 2822717 - RNA, 23 nt, Human
aucugaagcuucacucacuguca

SEQ ID NO: 2822718 - RNA, 18 nt, Human
aucugaaggggcaaauuc

SEQ ID NO: 2822719 - RNA, 21 nt, Human
aucugaaggggcaaauucuuu

SEQ ID NO: 2822720 - RNA, 23 nt, Human
aucugaaggggcaaauucuuuug

SEQ ID NO: 2822721 - RNA, 13 nt, Human
aucugaaauucua

SEQ ID NO: 2822722 - RNA, 20 nt, Human
aucucuuuguacaggaacug

SEQ ID NO: 2822723 - RNA, 13 nt, Human
aucugaaaacugg

SEQ ID NO: 2822724 - RNA, 14 nt, Human
aucugaaaacugga

SEQ ID NO: 2822725 - RNA, 15 nt, Human
aucugaaaacuggaa

SEQ ID NO: 2822726 - RNA, 22 nt, Human
aucucuuuguucuaaagaugga

SEQ ID NO: 2822727 - RNA, 11 nt, Human
aucucuuuuau

SEQ ID NO: 2822728 - RNA, 12 nt, Human
aucucuuuuaua

SEQ ID NO: 2822729 - RNA, 19 nt, Human
aucucuuuuauauuuguag

SEQ ID NO: 2822730 - RNA, 20 nt, Human
aucucuuuuauauuuguagg

SEQ ID NO: 2822731 - RNA, 15 nt, Human
aucucuugaggccag

SEQ ID NO: 2822732 - RNA, 13 nt, Human
aucucuuucacau

SEQ ID NO: 2822733 - RNA, 17 nt, Human
aucucuuucacauuguu

SEQ ID NO: 2822734 - RNA, 19 nt, Human
aucucuuucacauuguuug

SEQ ID NO: 2822735 - RNA, 18 nt, Human
aucucaaggaaucuuuaa

SEQ ID NO: 2822736 - RNA, 13 nt, Human
aucucaccccauc

SEQ ID NO: 2822737 - RNA, 23 nt, Human
aucucaccccaucccacacccug

SEQ ID NO: 2822738 - RNA, 22 nt, Human
aucucaccccaucccacacccu

SEQ ID NO: 2822739 - RNA, 16 nt, Human
aucucaccccauccca

SEQ ID NO: 2822740 - RNA, 14 nt, Human
aucucaccccaucc

SEQ ID NO: 2822741 - RNA, 14 nt, Human
uugauguuacagau

SEQ ID NO: 2822742 - RNA, 15 nt, Human
uugauguuacagauu

SEQ ID NO: 2822743 - RNA, 19 nt, Human
uugauguuuguggccucag

SEQ ID NO: 2822744 - RNA, 18 nt, Human
uugauguuuguggccuca

SEQ ID NO: 2822745 - RNA, 17 nt, Human
uugauguuuguggccuc

SEQ ID NO: 2822746 - RNA, 16 nt, Human
uugauguuuguggccu

SEQ ID NO: 2822747 - RNA, 15 nt, Human
uugauguuuguggcc

SEQ ID NO: 2822748 - RNA, 13 nt, Human
uugauguuugugg

SEQ ID NO: 2822749 - RNA, 16 nt, Human
uugauguuggcuggga

SEQ ID NO: 2822750 - RNA, 13 nt, Human
uugauguuggcug

SEQ ID NO: 2822751 - RNA, 20 nt, Human
uugauguguuuauuuauaga

SEQ ID NO: 2822752 - RNA, 19 nt, Human
uugcaagcaugcuugugaa

SEQ ID NO: 2822753 - RNA, 18 nt, Human
uugcccaggcuggucuca

SEQ ID NO: 2822754 - RNA, 12 nt, Human
uugccaccccac

SEQ ID NO: 2822755 - RNA, 17 nt, Human
uugccaccccacccucc

SEQ ID NO: 2822756 - RNA, 18 nt, Human
uugccaccccacccuccc

SEQ ID NO: 2822757 - RNA, 23 nt, Human
uugcccaggcuggcgugcagugg

SEQ ID NO: 2822758 - RNA, 14 nt, Human
uugcccaggcuggc

SEQ ID NO: 2822759 - RNA, 12 nt, Human
uugcccaggcug

SEQ ID NO: 2822760 - RNA, 11 nt, Human
uugcccaggcu

SEQ ID NO: 2822761 - RNA, 18 nt, Human
uugcccaggcaggucuug

SEQ ID NO: 2822762 - RNA, 16 nt, Human
uugcccaggcaggucu

SEQ ID NO: 2822763 - RNA, 14 nt, Human
uugcccaggcaggu

SEQ ID NO: 2822764 - RNA, 13 nt, Human
uugcccaggcagg

SEQ ID NO: 2822765 - RNA, 14 nt, Human
uugccaauuuuccu

SEQ ID NO: 2822766 - RNA, 22 nt, Human
uugccacagcuggagcucucaa

SEQ ID NO: 2822767 - RNA, 17 nt, Human
uugccaccaccucugug

SEQ ID NO: 2822768 - RNA, 18 nt, Human
uugccaccaccucugugg

SEQ ID NO: 2822769 - RNA, 16 nt, Human
uugccaccaggagaac

SEQ ID NO: 2822770 - RNA, 15 nt, Human
uugccaccaggagaa

SEQ ID NO: 2822771 - RNA, 14 nt, Human
uugccaccaggaga

SEQ ID NO: 2822772 - RNA, 13 nt, Human
uugccaccaggag

SEQ ID NO: 2822773 - RNA, 17 nt, Human
uugcaccuaccucacag

SEQ ID NO: 2822774 - RNA, 19 nt, Human
uugcauggcaucaccucca

SEQ ID NO: 2822775 - RNA, 19 nt, Human
uugcauggcuccagaaaug

SEQ ID NO: 2822776 - RNA, 20 nt, Human
uugcauggcuccagaaaugu

SEQ ID NO: 2822777 - RNA, 15 nt, Human
uugccaagcucagga

SEQ ID NO: 2822778 - RNA, 12 nt, Human
uugccaagacaa

SEQ ID NO: 2822779 - RNA, 13 nt, Human
uugccaagacaaa

SEQ ID NO: 2822780 - RNA, 15 nt, Human
uugccaagacaaauc

SEQ ID NO: 2822781 - RNA, 16 nt, Human
uugccaagacaaauca

SEQ ID NO: 2822782 - RNA, 17 nt, Human
uugccaagacaaaucaa

SEQ ID NO: 2822783 - RNA, 22 nt, Human
uugccaagacaaaucaacagaa

SEQ ID NO: 2822784 - RNA, 24 nt, Human
uugccaagacaaaucaacagaagc

SEQ ID NO: 2822785 - RNA, 15 nt, Human
uugccaaaucuggcu

SEQ ID NO: 2822786 - RNA, 14 nt, Human
uugcaauggcagcc

SEQ ID NO: 2822787 - RNA, 15 nt, Human
uugcaauaucugaag

SEQ ID NO: 2822788 - RNA, 15 nt, Human
uugcaauaccaagua

SEQ ID NO: 2822789 - RNA, 15 nt, Human
uugcacccagcccag

SEQ ID NO: 2822790 - RNA, 22 nt, Human
uugcaauaucugaagcccuccc

SEQ ID NO: 2822791 - RNA, 13 nt, Human
uugcaccccucac

SEQ ID NO: 2822792 - RNA, 22 nt, Human
uugcaccccucacucuggccuc

SEQ ID NO: 2822793 - RNA, 24 nt, Human
uugcaccccucacucuggccucag

SEQ ID NO: 2822794 - RNA, 23 nt, Human
uuuauauggaugauucagaaauu

SEQ ID NO: 2822795 - RNA, 14 nt, Human
uuuauauguacaug

SEQ ID NO: 2822796 - RNA, 13 nt, Human
uuuauauguacau

SEQ ID NO: 2822797 - RNA, 13 nt, Human
uuuaucacuuuuu

SEQ ID NO: 2822798 - RNA, 19 nt, Human
uuuaucacuuuuugaacua

SEQ ID NO: 2822799 - RNA, 20 nt, Human
uuuaucacuuuuugaacuaa

SEQ ID NO: 2822800 - RNA, 22 nt, Human
uuuaucacuuuuugaacuaaga

SEQ ID NO: 2822801 - RNA, 14 nt, Human
uuuauauguacugu

SEQ ID NO: 2822802 - RNA, 12 nt, Human
uuuauauguacu

SEQ ID NO: 2822803 - RNA, 18 nt, Human
uuuauauggggaauauau

SEQ ID NO: 2822804 - RNA, 17 nt, Human
uuuauauguacaugaga

SEQ ID NO: 2822805 - RNA, 21 nt, Human
uuuauauguaccguaggcuuu

SEQ ID NO: 2822806 - RNA, 13 nt, Human
uuuaguggcuuca

SEQ ID NO: 2822807 - RNA, 16 nt, Human
uuuaguguaauaagac

SEQ ID NO: 2822808 - RNA, 16 nt, Human
uuuagggccaggcagg

SEQ ID NO: 2822809 - RNA, 19 nt, Human
uuuagugaucacagcagcu

SEQ ID NO: 2822810 - RNA, 13 nt, Human
uuuagugcugcau

SEQ ID NO: 2822811 - RNA, 14 nt, Human
uuuagggccaggca

SEQ ID NO: 2822812 - RNA, 23 nt, Human
uuuaggagcuaaggcucuaugag

SEQ ID NO: 2822813 - RNA, 20 nt, Human
uuuaggcacucuuaaaugau

SEQ ID NO: 2822814 - RNA, 22 nt, Human
uuuaggcacucuuaaaugaucu

SEQ ID NO: 2822815 - RNA, 23 nt, Human
uuuacuuaaagauuuaucaaauc

SEQ ID NO: 2822816 - RNA, 20 nt, Human
uuuacuuaaagauuuaucaa

SEQ ID NO: 2822817 - RNA, 22 nt, Human
uuuacuuaaagauuuaucaaau

SEQ ID NO: 2822818 - RNA, 23 nt, Human
uuuacuucaaugggcucuuccaa

SEQ ID NO: 2822819 - RNA, 16 nt, Human
uuuacuucacuucaaa

SEQ ID NO: 2822820 - RNA, 21 nt, Human
uuuacccuugagcccucccca

SEQ ID NO: 2822821 - RNA, 19 nt, Human
uuuacucauugaaauguca

SEQ ID NO: 2822822 - RNA, 22 nt, Human
uuuacucauugaaaugucacgu

SEQ ID NO: 2822823 - RNA, 18 nt, Human
uuuacugacccuggggcu

SEQ ID NO: 2822824 - RNA, 16 nt, Human
uuuacuccucacacuu

SEQ ID NO: 2822825 - RNA, 17 nt, Human
uuuacuccucacacuua

SEQ ID NO: 2822826 - RNA, 21 nt, Human
uuuacuccucacacuuacugu

SEQ ID NO: 2822827 - RNA, 21 nt, Human
uuuacucuaugccccaaauau

SEQ ID NO: 2822828 - RNA, 22 nt, Human
uuuacucuaugccccaaauaua

SEQ ID NO: 2822829 - RNA, 14 nt, Human
uuuacuuaaagauu

SEQ ID NO: 2822830 - RNA, 20 nt, Human
uuuacuguuuugaaaucaau

SEQ ID NO: 2822831 - RNA, 22 nt, Human
uuuacuguuuugaaaucaaugc

SEQ ID NO: 2822832 - RNA, 15 nt, Human
uuuacuuaaagauuu

SEQ ID NO: 2822833 - RNA, 16 nt, Human
uuuacuuaaagauuua

SEQ ID NO: 2822834 - RNA, 22 nt, Human
uuuacugccaaagggaaauauc

SEQ ID NO: 2822835 - RNA, 12 nt, Human
uuuacuguguuu

SEQ ID NO: 2822836 - RNA, 17 nt, Human
uuuacugugaaacuggc

SEQ ID NO: 2822837 - RNA, 13 nt, Human
uuuaccuagaaga

SEQ ID NO: 2822838 - RNA, 14 nt, Human
uuuaccuagagaac

SEQ ID NO: 2822839 - RNA, 13 nt, Human
uuuacccuuggcu

SEQ ID NO: 2822840 - RNA, 14 nt, Human
augcuacugucuca

SEQ ID NO: 2822841 - RNA, 20 nt, Human
augcuacugucucacugaaa

SEQ ID NO: 2822842 - RNA, 16 nt, Human
augcuacccagccauu

SEQ ID NO: 2822843 - RNA, 14 nt, Human
augcguucacucca

SEQ ID NO: 2822844 - RNA, 15 nt, Human
augcguucacuccaa

SEQ ID NO: 2822845 - RNA, 16 nt, Human
augcgugugugugugu

SEQ ID NO: 2822846 - RNA, 17 nt, Human
augcccggcuaauuuuu

SEQ ID NO: 2822847 - RNA, 12 nt, Human
augcgugugugu

SEQ ID NO: 2822848 - RNA, 16 nt, Human
augccuuuuuuguagu

SEQ ID NO: 2822849 - RNA, 13 nt, Human
augcgcaggcugg

SEQ ID NO: 2822850 - RNA, 18 nt, Human
augcgauuuuauuacugg

SEQ ID NO: 2822851 - RNA, 19 nt, Human
augcgauuuuauuacuggc

SEQ ID NO: 2822852 - RNA, 20 nt, Human
augcgauuuuauuacuggcg

SEQ ID NO: 2822853 - RNA, 12 nt, Human
augcgcagcccc

SEQ ID NO: 2822854 - RNA, 23 nt, Human
augcgcagccccaucugugcauu

SEQ ID NO: 2822855 - RNA, 22 nt, Human
augcgcaggcuggcccugcccu

SEQ ID NO: 2822856 - RNA, 20 nt, Human
augcgcaggcuggcccugcc

SEQ ID NO: 2822857 - RNA, 18 nt, Human
augcgcaggcuggcccug

SEQ ID NO: 2822858 - RNA, 14 nt, Human
augcgcaggcuggc

SEQ ID NO: 2822859 - RNA, 14 nt, Human
augccagugugcug

SEQ ID NO: 2822860 - RNA, 20 nt, Human
augccagugugcugaugggc

SEQ ID NO: 2822861 - RNA, 11 nt, Human
augccauaaua

SEQ ID NO: 2822862 - RNA, 12 nt, Human
augccauaauac

SEQ ID NO: 2822863 - RNA, 13 nt, Human
augccauaauaca

SEQ ID NO: 2822864 - RNA, 17 nt, Human
augccauaauacaaaag

SEQ ID NO: 2822865 - RNA, 18 nt, Human
augccagggccgaccaga

SEQ ID NO: 2822866 - RNA, 21 nt, Human
augccagggccgaccagagga

SEQ ID NO: 2822867 - RNA, 12 nt, Human
augccaggacac

SEQ ID NO: 2822868 - RNA, 19 nt, Human
augccagcucagucccauc

SEQ ID NO: 2822869 - RNA, 18 nt, Human
augccagcucagucccau

SEQ ID NO: 2822870 - RNA, 16 nt, Human
augccagcuacuuccu

SEQ ID NO: 2822871 - RNA, 19 nt, Human
uuuaagguagcuucagcua

SEQ ID NO: 2822872 - RNA, 12 nt, Human
augccauccuca

SEQ ID NO: 2822873 - RNA, 21 nt, Human
augccauccucaaacacugca

SEQ ID NO: 2822874 - RNA, 19 nt, Human
augccaucuguguccuggu

SEQ ID NO: 2822875 - RNA, 23 nt, Human
augccauccucaaacacugcagg

SEQ ID NO: 2822876 - RNA, 13 nt, Human
augccauccucuu

SEQ ID NO: 2822877 - RNA, 15 nt, Human
augccauccucuuuc

SEQ ID NO: 2822878 - RNA, 21 nt, Human
augccauccucuuucucuuuu

SEQ ID NO: 2822879 - RNA, 23 nt, Human
augccauccucuuucucuuuucu

SEQ ID NO: 2822880 - RNA, 18 nt, Human
augccccgucccccucug

SEQ ID NO: 2822881 - RNA, 21 nt, Human
augccccgucccccucuggcu

SEQ ID NO: 2822882 - RNA, 18 nt, Human
augcuguucucuucuuca

SEQ ID NO: 2822883 - RNA, 19 nt, Human
augcuguucucuucuucau

SEQ ID NO: 2822884 - RNA, 11 nt, Human
augcuguuugu

SEQ ID NO: 2822885 - RNA, 22 nt, Human
augcuguuuguagugaaauaau

SEQ ID NO: 2822886 - RNA, 15 nt, Human
augcuuaaaagguug

SEQ ID NO: 2822887 - RNA, 20 nt, Human
augcuggcuguuggcugggg

SEQ ID NO: 2822888 - RNA, 19 nt, Human
augcuggcuguuggcuggg

SEQ ID NO: 2822889 - RNA, 23 nt, Human
augcuggaaccugcaaaaaauac

SEQ ID NO: 2822890 - RNA, 16 nt, Human
augcuucucaucuugu

SEQ ID NO: 2822891 - RNA, 19 nt, Human
augcuucucaucuugugaa

SEQ ID NO: 2822892 - RNA, 20 nt, Human
augcuucucaucuugugaaa

SEQ ID NO: 2822893 - RNA, 21 nt, Human
augcuucucaucuugugaaau

SEQ ID NO: 2822894 - RNA, 22 nt, Human
augcuucucaucuugugaaaug

SEQ ID NO: 2822895 - RNA, 13 nt, Human
augcuuaauuucu

SEQ ID NO: 2822896 - RNA, 14 nt, Human
augcuuaauuucua

SEQ ID NO: 2822897 - RNA, 15 nt, Human
auggaagacaggaaa

SEQ ID NO: 2822898 - RNA, 16 nt, Human
auggaagacaggaaag

SEQ ID NO: 2822899 - RNA, 12 nt, Human
auggaagagaaa

SEQ ID NO: 2822900 - RNA, 13 nt, Human
auggaagagaaau

SEQ ID NO: 2822901 - RNA, 14 nt, Human
auggaagagaaauc

SEQ ID NO: 2822902 - RNA, 15 nt, Human
auggaagagaaaucu

SEQ ID NO: 2822903 - RNA, 17 nt, Human
auggaagagaaaucuca

SEQ ID NO: 2822904 - RNA, 14 nt, Human
auggaagccaacac

SEQ ID NO: 2822905 - RNA, 14 nt, Human
auggaaggggcuga

SEQ ID NO: 2822906 - RNA, 18 nt, Human
augcuggcuguuggcugg

SEQ ID NO: 2822907 - RNA, 14 nt, Human
augcuggagaagag

SEQ ID NO: 2822908 - RNA, 15 nt, Human
augcuggagaagaga

SEQ ID NO: 2822909 - RNA, 16 nt, Human
augcuggagaagagag

SEQ ID NO: 2822910 - RNA, 17 nt, Human
augcuggagaagagagg

SEQ ID NO: 2822911 - RNA, 18 nt, Human
augcuggagaagagagga

SEQ ID NO: 2822912 - RNA, 19 nt, Human
augcuggagaagagaggag

SEQ ID NO: 2822913 - RNA, 23 nt, Human
augcuggagaagagaggagagga

SEQ ID NO: 2822914 - RNA, 12 nt, Human
augcuggagaag

SEQ ID NO: 2822915 - RNA, 22 nt, Human
augcuggacggcauuccugcuu

SEQ ID NO: 2822916 - RNA, 21 nt, Human
augcuggacggcauuccugcu

SEQ ID NO: 2822917 - RNA, 14 nt, Human
uuuaucagcaaaaa

SEQ ID NO: 2822918 - RNA, 15 nt, Human
uuuaucagcaaaaaa

SEQ ID NO: 2822919 - RNA, 13 nt, Human
uuuaucagauaca

SEQ ID NO: 2822920 - RNA, 14 nt, Human
uuuaucagauacau

SEQ ID NO: 2822921 - RNA, 16 nt, Human
uuuaucagauacauca

SEQ ID NO: 2822922 - RNA, 20 nt, Human
uuuaucagauacaucacugc

SEQ ID NO: 2822923 - RNA, 21 nt, Human
uuuaucagauacaucacugcu

SEQ ID NO: 2822924 - RNA, 22 nt, Human
uuuaucagauacaucacugcuu

SEQ ID NO: 2822925 - RNA, 22 nt, Human
uuuaucaguuuccagucucaaa

SEQ ID NO: 2822926 - RNA, 15 nt, Human
uuuaucaugaagccu

SEQ ID NO: 2822927 - RNA, 16 nt, Human
uuuaucaugaagccug

SEQ ID NO: 2822928 - RNA, 14 nt, Human
augcucagaccagc

SEQ ID NO: 2822929 - RNA, 12 nt, Human
augcucagacca

SEQ ID NO: 2822930 - RNA, 17 nt, Human
augcucccuccccugcc

SEQ ID NO: 2822931 - RNA, 16 nt, Human
augcucccuccccugc

SEQ ID NO: 2822932 - RNA, 22 nt, Human
augcucccuccccugcccuggu

SEQ ID NO: 2822933 - RNA, 13 nt, Human
augcuccuaguuu

SEQ ID NO: 2822934 - RNA, 22 nt, Human
augcuccuaguuugaccucaca

SEQ ID NO: 2822935 - RNA, 16 nt, Human
augcuccucacugccc

SEQ ID NO: 2822936 - RNA, 20 nt, Human
augcucccuccccugcccug

SEQ ID NO: 2822937 - RNA, 19 nt, Human
augcucccuccccugcccu

SEQ ID NO: 2822938 - RNA, 18 nt, Human
augcucccuccccugccc

SEQ ID NO: 2822939 - RNA, 14 nt, Human
augcucaguugcua

SEQ ID NO: 2822940 - RNA, 21 nt, Human
augcucaguugcuaaacacug

SEQ ID NO: 2822941 - RNA, 17 nt, Human
augcucagaccagcucu

SEQ ID NO: 2822942 - RNA, 15 nt, Human
uuucacauuaauauu

SEQ ID NO: 2822943 - RNA, 20 nt, Human
uuucacauuaauggucuaaa

SEQ ID NO: 2822944 - RNA, 14 nt, Human
uuucaaacuguaaa

SEQ ID NO: 2822945 - RNA, 16 nt, Human
uuucaaacuuacuauu

SEQ ID NO: 2822946 - RNA, 19 nt, Human
uuucaaacuuacuauuuug

SEQ ID NO: 2822947 - RNA, 22 nt, Human
uuucaaacuuacuauuuugaca

SEQ ID NO: 2822948 - RNA, 22 nt, Human
uuucaaacuccaagguucccuu

SEQ ID NO: 2822949 - RNA, 16 nt, Human
auggaauugauuugca

SEQ ID NO: 2822950 - RNA, 15 nt, Human
auggaauugauuugc

SEQ ID NO: 2822951 - RNA, 14 nt, Human
auggaauugauuug

SEQ ID NO: 2822952 - RNA, 13 nt, Human
auggaauugauuu

SEQ ID NO: 2822953 - RNA, 17 nt, Human
auggaaugcuguguuaa

SEQ ID NO: 2822954 - RNA, 21 nt, Human
auggaaugcuguguuaaauaa

SEQ ID NO: 2822955 - RNA, 18 nt, Human
auggaauggacauccugu

SEQ ID NO: 2822956 - RNA, 14 nt, Human
uuucaccuuuacuu

SEQ ID NO: 2822957 - RNA, 16 nt, Human
uuucaccuuuacuuua

SEQ ID NO: 2822958 - RNA, 19 nt, Human
uuucaccuuuacuuuagaa

SEQ ID NO: 2822959 - RNA, 15 nt, Human
uuucacuagaaaagc

SEQ ID NO: 2822960 - RNA, 21 nt, Human
uuucagaaagaaguggggaca

SEQ ID NO: 2822961 - RNA, 16 nt, Human
uuucaucauuguuucu

SEQ ID NO: 2822962 - RNA, 19 nt, Human
uuucauccccuuacccuua

SEQ ID NO: 2822963 - RNA, 22 nt, Human
uuucauccccuuacccuuagaa

SEQ ID NO: 2822964 - RNA, 16 nt, Human
uuucaucucuuguaua

SEQ ID NO: 2822965 - RNA, 13 nt, Human
uuucccuaaaaua

SEQ ID NO: 2822966 - RNA, 19 nt, Human
uuucccuaaaauacauuua

SEQ ID NO: 2822967 - RNA, 10 nt, Human
uuucccaagc

SEQ ID NO: 2822968 - RNA, 20 nt, Human
uuucccaaugguguuuuucu

SEQ ID NO: 2822969 - RNA, 21 nt, Human
uuucaccuccuucaauuccau

SEQ ID NO: 2822970 - RNA, 22 nt, Human
uuucauggugaaaauguacuga

SEQ ID NO: 2822971 - RNA, 20 nt, Human
uuucauggugaaaauguacu

SEQ ID NO: 2822972 - RNA, 21 nt, Human
uuucauggugaaaauguacug

SEQ ID NO: 2822973 - RNA, 18 nt, Human
uuucauguacaagaugaa

SEQ ID NO: 2822974 - RNA, 12 nt, Human
uuucauguacaa

SEQ ID NO: 2822975 - RNA, 19 nt, Human
uuuaaaucaaguauuuugu

SEQ ID NO: 2822976 - RNA, 23 nt, Human
uuuaaauaucugaacauuuacua

SEQ ID NO: 2822977 - RNA, 17 nt, Human
uuuaaaaauacacuugu

SEQ ID NO: 2822978 - RNA, 23 nt, Human
uuuaaaaaguuguagcagauugu

SEQ ID NO: 2822979 - RNA, 19 nt, Human
uuuaaaucuaaaucuauuu

SEQ ID NO: 2822980 - RNA, 22 nt, Human
uuuaaaucuaaaucuauuuauu

SEQ ID NO: 2822981 - RNA, 18 nt, Human
uuuaaaugcauaaaugca

SEQ ID NO: 2822982 - RNA, 16 nt, Human
uuuaaauguaaaacau

SEQ ID NO: 2822983 - RNA, 11 nt, Human
uuuaaauguac

SEQ ID NO: 2822984 - RNA, 20 nt, Human
uuuaaauguacagacauauu

SEQ ID NO: 2822985 - RNA, 20 nt, Human
uuuaaauguacaguuugggg

SEQ ID NO: 2822986 - RNA, 12 nt, Human
uuuaaauguaua

SEQ ID NO: 2822987 - RNA, 15 nt, Human
augcaaagaaaauca

SEQ ID NO: 2822988 - RNA, 13 nt, Human
uuuaaaaacugga

SEQ ID NO: 2822989 - RNA, 21 nt, Human
uuuaaaaagaaacaagaugcu

SEQ ID NO: 2822990 - RNA, 17 nt, Human
uuuaaaaagaaaucugg

SEQ ID NO: 2822991 - RNA, 20 nt, Human
uuuaaaaaggaacugcagca

SEQ ID NO: 2822992 - RNA, 17 nt, Human
uuuaaaaaaaucacaaa

SEQ ID NO: 2822993 - RNA, 16 nt, Human
uuuaaaaaaauuuaag

SEQ ID NO: 2822994 - RNA, 17 nt, Human
uuuaaaaaaauuuaagu

SEQ ID NO: 2822995 - RNA, 18 nt, Human
uuuaaaaaaauuuaagug

SEQ ID NO: 2822996 - RNA, 16 nt, Human
augcagaguugacaug

SEQ ID NO: 2822997 - RNA, 19 nt, Human
augcagaguugacaugaga

SEQ ID NO: 2822998 - RNA, 17 nt, Human
augcagauagaaucaau

SEQ ID NO: 2822999 - RNA, 21 nt, Human
uuuaaaaaauuaaucugggcc

SEQ ID NO: 2823000 - RNA, 18 nt, Human
uuuaaaaacauagaaaaa

SEQ ID NO: 2823001 - RNA, 19 nt, Human
uuuaaaaacauagaaaaau

SEQ ID NO: 2823002 - RNA, 13 nt, Human
uuuaagagagaaa

SEQ ID NO: 2823003 - RNA, 14 nt, Human
uuuaagagagaaau

SEQ ID NO: 2823004 - RNA, 21 nt, Human
uuuaagagagaaaucugaaaa

SEQ ID NO: 2823005 - RNA, 17 nt, Human
uuuaagacguguuugug

SEQ ID NO: 2823006 - RNA, 19 nt, Human
uuuaagacguguuuguguu

SEQ ID NO: 2823007 - RNA, 23 nt, Human
uuuaagacucucgcaucuuccca

SEQ ID NO: 2823008 - RNA, 12 nt, Human
uuuaaggaaaca

SEQ ID NO: 2823009 - RNA, 11 nt, Human
uuuaaggaaaa

SEQ ID NO: 2823010 - RNA, 22 nt, Human
uuuaaggguuuguggaaaauga

SEQ ID NO: 2823011 - RNA, 17 nt, Human
uuuaaggguuuguggaa

SEQ ID NO: 2823012 - RNA, 20 nt, Human
uuuaaggguuuguggaaaau

SEQ ID NO: 2823013 - RNA, 18 nt, Human
uuuaagggcaugccuugu

SEQ ID NO: 2823014 - RNA, 19 nt, Human
uuuaagggcaugccuugug

SEQ ID NO: 2823015 - RNA, 20 nt, Human
uuuaagggcaugccuugugc

SEQ ID NO: 2823016 - RNA, 20 nt, Human
uuuaaggaugggguuaugaa

SEQ ID NO: 2823017 - RNA, 19 nt, Human
augcaccuugugucuguac

SEQ ID NO: 2823018 - RNA, 21 nt, Human
augcaccuugugucuguacac

SEQ ID NO: 2823019 - RNA, 14 nt, Human
augcacucagcucu

SEQ ID NO: 2823020 - RNA, 17 nt, Human
augcacugacccuucca

SEQ ID NO: 2823021 - RNA, 22 nt, Human
augcacugacccuuccagacau

SEQ ID NO: 2823022 - RNA, 23 nt, Human
augcacugacccuuccagacaua

SEQ ID NO: 2823023 - RNA, 13 nt, Human
augcacggccucg

SEQ ID NO: 2823024 - RNA, 15 nt, Human
augcacggccucgcg

SEQ ID NO: 2823025 - RNA, 18 nt, Human
augcacggccucgcgucu

SEQ ID NO: 2823026 - RNA, 13 nt, Human
augcacuaugagg

SEQ ID NO: 2823027 - RNA, 16 nt, Human
augcacuaugaggaau

SEQ ID NO: 2823028 - RNA, 14 nt, Human
augcacuauguaua

SEQ ID NO: 2823029 - RNA, 18 nt, Human
augcagagguccacaaca

SEQ ID NO: 2823030 - RNA, 17 nt, Human
augcagagguccacaac

SEQ ID NO: 2823031 - RNA, 16 nt, Human
augcagagagccauuu

SEQ ID NO: 2823032 - RNA, 19 nt, Human
augcagagagccauuuugu

SEQ ID NO: 2823033 - RNA, 20 nt, Human
augcagagagccauuuugug

SEQ ID NO: 2823034 - RNA, 21 nt, Human
augcagagagccauuuuguga

SEQ ID NO: 2823035 - RNA, 22 nt, Human
augcagagagccauuuugugaa

SEQ ID NO: 2823036 - RNA, 23 nt, Human
augcagagagccauuuugugaau

SEQ ID NO: 2823037 - RNA, 20 nt, Human
augcagaauguuuuuaaaau

SEQ ID NO: 2823038 - RNA, 22 nt, Human
augcagacaugagugcgugcuc

SEQ ID NO: 2823039 - RNA, 13 nt, Human
augcagagagcca

SEQ ID NO: 2823040 - RNA, 14 nt, Human
augcagagagccau

SEQ ID NO: 2823041 - RNA, 20 nt, Human
augauuuauaguuuguacau

SEQ ID NO: 2823042 - RNA, 14 nt, Human
augauuuauaguuu

SEQ ID NO: 2823043 - RNA, 15 nt, Human
augauuuauaguuug

SEQ ID NO: 2823044 - RNA, 13 nt, Human
augauuuccuuga

SEQ ID NO: 2823045 - RNA, 16 nt, Human
augauuuccuugaaug

SEQ ID NO: 2823046 - RNA, 15 nt, Human
augauuuccuugaau

SEQ ID NO: 2823047 - RNA, 19 nt, Human
augauuuccuugaaugugg

SEQ ID NO: 2823048 - RNA, 13 nt, Human
augauuuuuagau

SEQ ID NO: 2823049 - RNA, 18 nt, Human
augauuuccuugaaugug

SEQ ID NO: 2823050 - RNA, 17 nt, Human
augauuuccuugaaugu

SEQ ID NO: 2823051 - RNA, 11 nt, Human
augcaaaaugg

SEQ ID NO: 2823052 - RNA, 12 nt, Human
augcaaaaugga

SEQ ID NO: 2823053 - RNA, 13 nt, Human
augcaaaauggaa

SEQ ID NO: 2823054 - RNA, 18 nt, Human
augcaaaauuuuuuuaau

SEQ ID NO: 2823055 - RNA, 23 nt, Human
augcaaaaagaaaugacuaauua

SEQ ID NO: 2823056 - RNA, 23 nt, Human
augcaaaagguucacuaaagcag

SEQ ID NO: 2823057 - RNA, 22 nt, Human
augauuuuuagaugagauuguu

SEQ ID NO: 2823058 - RNA, 15 nt, Human
augauuuuugucauc

SEQ ID NO: 2823059 - RNA, 17 nt, Human
augauuuuuuaaaagaa

SEQ ID NO: 2823060 - RNA, 19 nt, Human
augauuuuuuaaaagaaau

SEQ ID NO: 2823061 - RNA, 20 nt, Human
augauuuuuuaaaagaaauu

SEQ ID NO: 2823062 - RNA, 22 nt, Human
augauuuuuuaaaagaaauuua

SEQ ID NO: 2823063 - RNA, 22 nt, Human
uuguucuucagagaucauggaa

SEQ ID NO: 2823064 - RNA, 14 nt, Human
uuguucuuacacau

SEQ ID NO: 2823065 - RNA, 15 nt, Human
uuguucuuacacaua

SEQ ID NO: 2823066 - RNA, 14 nt, Human
augauuguaaaaua

SEQ ID NO: 2823067 - RNA, 15 nt, Human
augauuguaaaauag

SEQ ID NO: 2823068 - RNA, 12 nt, Human
augauuguuucu

SEQ ID NO: 2823069 - RNA, 20 nt, Human
augauuguuucucaaaucuu

SEQ ID NO: 2823070 - RNA, 18 nt, Human
augauuguaaaauagcuu

SEQ ID NO: 2823071 - RNA, 13 nt, Human
augauuuaaaaca

SEQ ID NO: 2823072 - RNA, 14 nt, Human
augauuuaaaacau

SEQ ID NO: 2823073 - RNA, 18 nt, Human
augauuuaaaacauguaa

SEQ ID NO: 2823074 - RNA, 22 nt, Human
augauuuaauaaaauaauucua

SEQ ID NO: 2823075 - RNA, 13 nt, Human
augauuuauaguu

SEQ ID NO: 2823076 - RNA, 20 nt, Human
augauuuauaaacagacaau

SEQ ID NO: 2823077 - RNA, 18 nt, Human
augauuuaauaaaauaau

SEQ ID NO: 2823078 - RNA, 19 nt, Human
augauuuaauaaaauaauu

SEQ ID NO: 2823079 - RNA, 13 nt, Human
augauuuaauaaa

SEQ ID NO: 2823080 - RNA, 14 nt, Human
augauuuaauaaaa

SEQ ID NO: 2823081 - RNA, 16 nt, Human
augauuuaauaaaaua

SEQ ID NO: 2823082 - RNA, 12 nt, Human
uuguacaaaaua

SEQ ID NO: 2823083 - RNA, 17 nt, Human
uuguagcccaggcugga

SEQ ID NO: 2823084 - RNA, 21 nt, Human
uuguagcggaugauucuucaa

SEQ ID NO: 2823085 - RNA, 13 nt, Human
uuguagcuguaaa

SEQ ID NO: 2823086 - RNA, 18 nt, Human
augaggucagagccugca

SEQ ID NO: 2823087 - RNA, 16 nt, Human
augaggucagagccug

SEQ ID NO: 2823088 - RNA, 15 nt, Human
augaggucagagccu

SEQ ID NO: 2823089 - RNA, 21 nt, Human
augagguacaaccuguucugc

SEQ ID NO: 2823090 - RNA, 15 nt, Human
augaggucagacuag

SEQ ID NO: 2823091 - RNA, 21 nt, Human
uuguaggaaggucucauucuu

SEQ ID NO: 2823092 - RNA, 20 nt, Human
augaggucagagccugcagu

SEQ ID NO: 2823093 - RNA, 19 nt, Human
augaggucagagccugcag

SEQ ID NO: 2823094 - RNA, 22 nt, Human
augaggucagagccugcaguua

SEQ ID NO: 2823095 - RNA, 18 nt, Human
augaguaacuauuauuau

SEQ ID NO: 2823096 - RNA, 14 nt, Human
augaguacaaaugc

SEQ ID NO: 2823097 - RNA, 16 nt, Human
augaguacaaaugccu

SEQ ID NO: 2823098 - RNA, 17 nt, Human
augaguacaaaugccuu

SEQ ID NO: 2823099 - RNA, 21 nt, Human
augaguaaaaaaaaaaacaau

SEQ ID NO: 2823100 - RNA, 22 nt, Human
augaguuugcccugguuucacu

SEQ ID NO: 2823101 - RNA, 15 nt, Human
augaguuugcccugg

SEQ ID NO: 2823102 - RNA, 14 nt, Human
augaguuugcuuau

SEQ ID NO: 2823103 - RNA, 16 nt, Human
augaguuaucuaagaa

SEQ ID NO: 2823104 - RNA, 17 nt, Human
augaguuaugaguuauu

SEQ ID NO: 2823105 - RNA, 15 nt, Human
augaguugugaaagu

SEQ ID NO: 2823106 - RNA, 20 nt, Human
augaguugugaaaguuuuga

SEQ ID NO: 2823107 - RNA, 12 nt, Human
augagugugcau

SEQ ID NO: 2823108 - RNA, 13 nt, Human
augagugugcaug

SEQ ID NO: 2823109 - RNA, 16 nt, Human
augaguuacugugcau

SEQ ID NO: 2823110 - RNA, 17 nt, Human
augaguuacugugcauu

SEQ ID NO: 2823111 - RNA, 14 nt, Human
augaguauacaaua

SEQ ID NO: 2823112 - RNA, 17 nt, Human
augaguauacaauauau

SEQ ID NO: 2823113 - RNA, 18 nt, Human
augaguauacaauauaua

SEQ ID NO: 2823114 - RNA, 21 nt, Human
augaguauacaauauauaaaa

SEQ ID NO: 2823115 - RNA, 23 nt, Human
augaguauacaauauauaaaaau

SEQ ID NO: 2823116 - RNA, 19 nt, Human
augaguauuaguucccugu

SEQ ID NO: 2823117 - RNA, 13 nt, Human
uugucagacauaa

SEQ ID NO: 2823118 - RNA, 14 nt, Human
uugucagacauaaa

SEQ ID NO: 2823119 - RNA, 15 nt, Human
uugucagacauaaag

SEQ ID NO: 2823120 - RNA, 16 nt, Human
uugucagacauaaagc

SEQ ID NO: 2823121 - RNA, 18 nt, Human
uugucagacauaaagcca

SEQ ID NO: 2823122 - RNA, 19 nt, Human
uugucagacauaaagccau

SEQ ID NO: 2823123 - RNA, 17 nt, Human
uugucacacacuuuggc

SEQ ID NO: 2823124 - RNA, 20 nt, Human
uugucaagucucugcuggcc

SEQ ID NO: 2823125 - RNA, 21 nt, Human
uugucauaucagcacauauuu

SEQ ID NO: 2823126 - RNA, 23 nt, Human
uugucauaucagcacauauuuuc

SEQ ID NO: 2823127 - RNA, 19 nt, Human
uuguccaauuguugacagu

SEQ ID NO: 2823128 - RNA, 22 nt, Human
uuguccaauuguugacaguucu

SEQ ID NO: 2823129 - RNA, 14 nt, Human
uuguccacccaccu

SEQ ID NO: 2823130 - RNA, 13 nt, Human
uugugaauggauu

SEQ ID NO: 2823131 - RNA, 14 nt, Human
uugugaauggauug

SEQ ID NO: 2823132 - RNA, 21 nt, Human
uugugaauggauuggauuauu

SEQ ID NO: 2823133 - RNA, 21 nt, Human
uugugaauguauuuuucuguu

SEQ ID NO: 2823134 - RNA, 15 nt, Human
uugugaauggauugg

SEQ ID NO: 2823135 - RNA, 18 nt, Human
uugugacagcucuuuuug

SEQ ID NO: 2823136 - RNA, 23 nt, Human
uugugacagcucuuuuugugaag

SEQ ID NO: 2823137 - RNA, 18 nt, Human
uugugagccaccacgucc

SEQ ID NO: 2823138 - RNA, 16 nt, Human
uuguccauauuuucac

SEQ ID NO: 2823139 - RNA, 14 nt, Human
uuguccauuuguaa

SEQ ID NO: 2823140 - RNA, 15 nt, Human
uuguccauuuguaaa

SEQ ID NO: 2823141 - RNA, 14 nt, Human
uugucccccaacuu

SEQ ID NO: 2823142 - RNA, 16 nt, Human
uugucccccaacuuga

SEQ ID NO: 2823143 - RNA, 18 nt, Human
uugucccccaacuugaga

SEQ ID NO: 2823144 - RNA, 15 nt, Human
uugugaaugcuucuc

SEQ ID NO: 2823145 - RNA, 16 nt, Human
uugugaaugcuucuca

SEQ ID NO: 2823146 - RNA, 22 nt, Human
uugugaaugauucauguuauau

SEQ ID NO: 2823147 - RNA, 15 nt, Human
uuguucaccuuugua

SEQ ID NO: 2823148 - RNA, 15 nt, Human
uuguucacugaaggu

SEQ ID NO: 2823149 - RNA, 21 nt, Human
uuguucacugaaggugauuca

SEQ ID NO: 2823150 - RNA, 22 nt, Human
uuguucaauaauaaauauuuuu

SEQ ID NO: 2823151 - RNA, 20 nt, Human
uuguucaauaauaaauauuu

SEQ ID NO: 2823152 - RNA, 14 nt, Human
uugugucuguacac

SEQ ID NO: 2823153 - RNA, 15 nt, Human
uugugucuguacacg

SEQ ID NO: 2823154 - RNA, 13 nt, Human
uugugucuguaca

SEQ ID NO: 2823155 - RNA, 21 nt, Human
uugugucaaugggcaaugaca

SEQ ID NO: 2823156 - RNA, 23 nt, Human
uuguguauuuacgcuuugauuca

SEQ ID NO: 2823157 - RNA, 22 nt, Human
uuguguauuuacgcuuugauuc

SEQ ID NO: 2823158 - RNA, 20 nt, Human
uuguguauuuacgcuuugau

SEQ ID NO: 2823159 - RNA, 21 nt, Human
uuguguaucguaaccagccag

SEQ ID NO: 2823160 - RNA, 21 nt, Human
uuguguauuuaacagggaggg

SEQ ID NO: 2823161 - RNA, 19 nt, Human
uuguguauuuacgcuuuga

SEQ ID NO: 2823162 - RNA, 13 nt, Human
uuguguauuuaac

SEQ ID NO: 2823163 - RNA, 14 nt, Human
uuguguauuuaaca

SEQ ID NO: 2823164 - RNA, 14 nt, Human
uuguguauauuugu

SEQ ID NO: 2823165 - RNA, 15 nt, Human
uuguguauauuugua

SEQ ID NO: 2823166 - RNA, 16 nt, Human
uuguguauauuuguau

SEQ ID NO: 2823167 - RNA, 20 nt, Human
uuguguaucguaaccagcca

SEQ ID NO: 2823168 - RNA, 23 nt, Human
uuguguaaugaaaaugaauaucu

SEQ ID NO: 2823169 - RNA, 24 nt, Human
uuguguaaugaaaaugaauaucua

SEQ ID NO: 2823170 - RNA, 13 nt, Human
uuguguaauuuau

SEQ ID NO: 2823171 - RNA, 23 nt, Human
uuguguacagacuuguugugacu

SEQ ID NO: 2823172 - RNA, 19 nt, Human
uuguguaauagaaaacuga

SEQ ID NO: 2823173 - RNA, 21 nt, Human
uuguguaauagaaaacugaaa

SEQ ID NO: 2823174 - RNA, 23 nt, Human
uuguguacucggaaauuaaaguu

SEQ ID NO: 2823175 - RNA, 21 nt, Human
uugugauucuuccagauguga

SEQ ID NO: 2823176 - RNA, 19 nt, Human
uugugauguauauuccuuu

SEQ ID NO: 2823177 - RNA, 20 nt, Human
uugugauguauauuccuuug

SEQ ID NO: 2823178 - RNA, 20 nt, Human
uugugauagcuaacauuuua

SEQ ID NO: 2823179 - RNA, 16 nt, Human
uugugauauauguauu

SEQ ID NO: 2823180 - RNA, 18 nt, Human
uugugaugucccaacuug

SEQ ID NO: 2823181 - RNA, 22 nt, Human
uugugaugucccaacuuguaaa

SEQ ID NO: 2823182 - RNA, 16 nt, Human
auuacuguuuauuucu

SEQ ID NO: 2823183 - RNA, 17 nt, Human
auuacuguuuauuucug

SEQ ID NO: 2823184 - RNA, 18 nt, Human
auuacuguuuauuucugu

SEQ ID NO: 2823185 - RNA, 18 nt, Human
auuacugucugguuuuaa

SEQ ID NO: 2823186 - RNA, 19 nt, Human
auuacuguugauaauucuu

SEQ ID NO: 2823187 - RNA, 20 nt, Human
auuacuguugauaauucuua

SEQ ID NO: 2823188 - RNA, 14 nt, Human
auuaaucaucuaua

SEQ ID NO: 2823189 - RNA, 19 nt, Human
auuaaucaucuauaaagaa

SEQ ID NO: 2823190 - RNA, 23 nt, Human
auuacugggccuuagugggccag

SEQ ID NO: 2823191 - RNA, 23 nt, Human
auuaaucaaucaucugugugaaa

SEQ ID NO: 2823192 - RNA, 23 nt, Human
auuaauauuuaacauuauuuaua

SEQ ID NO: 2823193 - RNA, 12 nt, Human
auuaauauuuaa

SEQ ID NO: 2823194 - RNA, 13 nt, Human
auuaaguuaucuu

SEQ ID NO: 2823195 - RNA, 19 nt, Human
auuaaguucucaaugugaa

SEQ ID NO: 2823196 - RNA, 20 nt, Human
auuaaguucucaaugugaaa

SEQ ID NO: 2823197 - RNA, 13 nt, Human
auuagacuccucc

SEQ ID NO: 2823198 - RNA, 16 nt, Human
auuagacuccuccucc

SEQ ID NO: 2823199 - RNA, 15 nt, Human
auuagacuccuccuc

SEQ ID NO: 2823200 - RNA, 13 nt, Human
auuacuucugcua

SEQ ID NO: 2823201 - RNA, 12 nt, Human
auuacuucugcu

SEQ ID NO: 2823202 - RNA, 14 nt, Human
auuacuucugcuac

SEQ ID NO: 2823203 - RNA, 20 nt, Human
auuacuuguugcaaaggucu

SEQ ID NO: 2823204 - RNA, 16 nt, Human
uuuuggaguguuaugu

SEQ ID NO: 2823205 - RNA, 17 nt, Human
uuuuggaguguuaugua

SEQ ID NO: 2823206 - RNA, 20 nt, Human
uuuuggaguguuauguauuu

SEQ ID NO: 2823207 - RNA, 17 nt, Human
uuuuggaucuugaaugu

SEQ ID NO: 2823208 - RNA, 23 nt, Human
uuuugugaauggauuggauuauu

SEQ ID NO: 2823209 - RNA, 23 nt, Human
uuuugugacuauauagagauguu

SEQ ID NO: 2823210 - RNA, 19 nt, Human
uuuugugaauggauuggau

SEQ ID NO: 2823211 - RNA, 16 nt, Human
uuuugugaagcccugu

SEQ ID NO: 2823212 - RNA, 17 nt, Human
uuuugugaagcccuguu

SEQ ID NO: 2823213 - RNA, 12 nt, Human
uuuugugcauuu

SEQ ID NO: 2823214 - RNA, 13 nt, Human
uuuugugcauuug

SEQ ID NO: 2823215 - RNA, 22 nt, Human
uuuugugcauuuguaaaugcug

SEQ ID NO: 2823216 - RNA, 16 nt, Human
uuuuguggaggcagug

SEQ ID NO: 2823217 - RNA, 15 nt, Human
uuuuguuaacugauu

SEQ ID NO: 2823218 - RNA, 16 nt, Human
uuuuguuaacugauuu

SEQ ID NO: 2823219 - RNA, 12 nt, Human
uuuuguuacugu

SEQ ID NO: 2823220 - RNA, 13 nt, Human
uuuuguuacuguu

SEQ ID NO: 2823221 - RNA, 14 nt, Human
uuuuguuacuguuc

SEQ ID NO: 2823222 - RNA, 15 nt, Human
uuuuguuacuguucu

SEQ ID NO: 2823223 - RNA, 16 nt, Human
uuuuguuacuguucuu

SEQ ID NO: 2823224 - RNA, 18 nt, Human
uuuuguuacuguucuugc

SEQ ID NO: 2823225 - RNA, 19 nt, Human
uuuuguuacuguucuugcu

SEQ ID NO: 2823226 - RNA, 20 nt, Human
uuuuguuacuguucuugcug

SEQ ID NO: 2823227 - RNA, 21 nt, Human
uuuuguuacuguucuugcugc

SEQ ID NO: 2823228 - RNA, 22 nt, Human
uuuuguuacuguucuugcugcu

SEQ ID NO: 2823229 - RNA, 23 nt, Human
uuuuguuacuguucuugcugcua

SEQ ID NO: 2823230 - RNA, 18 nt, Human
uuuugugugaccaacugu

SEQ ID NO: 2823231 - RNA, 20 nt, Human
uuuugugugaccaacugugu

SEQ ID NO: 2823232 - RNA, 17 nt, Human
uuuuguguaaugaaaau

SEQ ID NO: 2823233 - RNA, 17 nt, Human
uuuuggacuccaucucu

SEQ ID NO: 2823234 - RNA, 23 nt, Human
uuuugcuuguuauauuaagcaga

SEQ ID NO: 2823235 - RNA, 20 nt, Human
uuuuggaagauuuucagucu

SEQ ID NO: 2823236 - RNA, 19 nt, Human
uuuugcuuuuaauuaaaua

SEQ ID NO: 2823237 - RNA, 18 nt, Human
uuuugcuguuuccuuuua

SEQ ID NO: 2823238 - RNA, 18 nt, Human
auuaaaaugauuguaaaa

SEQ ID NO: 2823239 - RNA, 19 nt, Human
auuaaaaugauuguaaaau

SEQ ID NO: 2823240 - RNA, 15 nt, Human
auuaaacauaaaaca

SEQ ID NO: 2823241 - RNA, 16 nt, Human
auuaaacauaaaacaa

SEQ ID NO: 2823242 - RNA, 12 nt, Human
auuaaacagaug

SEQ ID NO: 2823243 - RNA, 14 nt, Human
auuaaacagaugau

SEQ ID NO: 2823244 - RNA, 19 nt, Human
auuaaacagaugaugagaa

SEQ ID NO: 2823245 - RNA, 21 nt, Human
auuaaacagaugaugagaauu

SEQ ID NO: 2823246 - RNA, 20 nt, Human
auuaaaaugauuguaaaaua

SEQ ID NO: 2823247 - RNA, 12 nt, Human
auuaaaauggau

SEQ ID NO: 2823248 - RNA, 13 nt, Human
auuaaaauggaug

SEQ ID NO: 2823249 - RNA, 21 nt, Human
auuaaaauggugacuuaaucc

SEQ ID NO: 2823250 - RNA, 15 nt, Human
uuuuguuguaaaaag

SEQ ID NO: 2823251 - RNA, 16 nt, Human
uuuuguuguaaaaaga

SEQ ID NO: 2823252 - RNA, 19 nt, Human
uuuuguuguaaaaagaaaa

SEQ ID NO: 2823253 - RNA, 13 nt, Human
uuuuguugugugu

SEQ ID NO: 2823254 - RNA, 16 nt, Human
uuuuguuguuucagug

SEQ ID NO: 2823255 - RNA, 13 nt, Human
uuuuguuuuacaa

SEQ ID NO: 2823256 - RNA, 16 nt, Human
uuuuguuuuacaaugu

SEQ ID NO: 2823257 - RNA, 23 nt, Human
uuuuguucgcauggucacacacu

SEQ ID NO: 2823258 - RNA, 14 nt, Human
uuuuguugauuaaa

SEQ ID NO: 2823259 - RNA, 15 nt, Human
uuuuguugauuaaaa

SEQ ID NO: 2823260 - RNA, 19 nt, Human
uuuuguugauuaaaacauu

SEQ ID NO: 2823261 - RNA, 10 nt, Human
uuuuguuacu

SEQ ID NO: 2823262 - RNA, 22 nt, Human
uuuuguucuuacacauacaguu

SEQ ID NO: 2823263 - RNA, 12 nt, Human
uuuuguucuuca

SEQ ID NO: 2823264 - RNA, 14 nt, Human
uuuuguucuucaga

SEQ ID NO: 2823265 - RNA, 19 nt, Human
uuuuguucuucagagauca

SEQ ID NO: 2823266 - RNA, 15 nt, Human
uuuuuauauuuaguu

SEQ ID NO: 2823267 - RNA, 23 nt, Human
uuuuuauaucuggaaugagccug

SEQ ID NO: 2823268 - RNA, 15 nt, Human
uuuuuauauuaaugu

SEQ ID NO: 2823269 - RNA, 17 nt, Human
uuuuuauauuaguugcu

SEQ ID NO: 2823270 - RNA, 18 nt, Human
uuuuuauauuaguugcuu

SEQ ID NO: 2823271 - RNA, 19 nt, Human
uuuuuacaaguuuuaaaua

SEQ ID NO: 2823272 - RNA, 13 nt, Human
uuuuuacagcugu

SEQ ID NO: 2823273 - RNA, 19 nt, Human
uuuuuacagcuguguuauu

SEQ ID NO: 2823274 - RNA, 16 nt, Human
uuuuuacauggagaaa

SEQ ID NO: 2823275 - RNA, 12 nt, Human
uuuuuauauaca

SEQ ID NO: 2823276 - RNA, 14 nt, Human
uuuuuauauauaca

SEQ ID NO: 2823277 - RNA, 15 nt, Human
uuuuuauaccauuca

SEQ ID NO: 2823278 - RNA, 17 nt, Human
uuuuuauaccauucaga

SEQ ID NO: 2823279 - RNA, 11 nt, Human
uuuuuacauuu

SEQ ID NO: 2823280 - RNA, 18 nt, Human
uuuuguuuuuucaaaaua

SEQ ID NO: 2823281 - RNA, 19 nt, Human
uuuuguuuuuucaaaauag

SEQ ID NO: 2823282 - RNA, 14 nt, Human
uuuuuaaaaaaaga

SEQ ID NO: 2823283 - RNA, 15 nt, Human
uuuuuaaaaaaagaa

SEQ ID NO: 2823284 - RNA, 17 nt, Human
uuuuuaaaaaaagaaaa

SEQ ID NO: 2823285 - RNA, 13 nt, Human
uuuuuaauuaaaa

SEQ ID NO: 2823286 - RNA, 16 nt, Human
uuuuuaauuaaaaacu

SEQ ID NO: 2823287 - RNA, 20 nt, Human
uuuuuaauuaaaaacuagua

SEQ ID NO: 2823288 - RNA, 11 nt, Human
uuuuuaauuua

SEQ ID NO: 2823289 - RNA, 20 nt, Human
uuuuuaauuguuguuucuuu

SEQ ID NO: 2823290 - RNA, 18 nt, Human
uuuuuaauuguuguuucu

SEQ ID NO: 2823291 - RNA, 21 nt, Human
uuuuuaauuuauuauugaaau

SEQ ID NO: 2823292 - RNA, 18 nt, Human
uuuuuacaaguuuuaaau

SEQ ID NO: 2823293 - RNA, 13 nt, Human
uuuuuacaagaag

SEQ ID NO: 2823294 - RNA, 21 nt, Human
uuuuucaaaauccaaaaagaa

SEQ ID NO: 2823295 - RNA, 9 nt, Human
uuuuucaac

SEQ ID NO: 2823296 - RNA, 18 nt, Human
uuuuucaacaaauaucuu

SEQ ID NO: 2823297 - RNA, 22 nt, Human
uuuuucaaccccacccuguuug

SEQ ID NO: 2823298 - RNA, 23 nt, Human
uuuuucaaccccacccuguuugg

SEQ ID NO: 2823299 - RNA, 15 nt, Human
uuuuugaagucuugu

SEQ ID NO: 2823300 - RNA, 19 nt, Human
uuuuugaagucuuguauaa

SEQ ID NO: 2823301 - RNA, 11 nt, Human
uuuuucaaugu

SEQ ID NO: 2823302 - RNA, 12 nt, Human
uuuuucaaugug

SEQ ID NO: 2823303 - RNA, 19 nt, Human
uuuuucaaagauguguugc

SEQ ID NO: 2823304 - RNA, 13 nt, Human
uuuuucaaggaag

SEQ ID NO: 2823305 - RNA, 18 nt, Human
uuuuuauuuauauguacu

SEQ ID NO: 2823306 - RNA, 13 nt, Human
uuuuuauuuauau

SEQ ID NO: 2823307 - RNA, 12 nt, Human
uuuuuauuucug

SEQ ID NO: 2823308 - RNA, 15 nt, Human
uuuuucaaaauagaa

SEQ ID NO: 2823309 - RNA, 20 nt, Human
uuuuucaaaauagaaaaguu

SEQ ID NO: 2823310 - RNA, 15 nt, Human
uuuuugauaaagccu

SEQ ID NO: 2823311 - RNA, 14 nt, Human
uuuuuauuuaugaa

SEQ ID NO: 2823312 - RNA, 16 nt, Human
uuuuugacucccagau

SEQ ID NO: 2823313 - RNA, 21 nt, Human
uuuuugauaaaguuucucaga

SEQ ID NO: 2823314 - RNA, 14 nt, Human
uuuuugauagcuuu

SEQ ID NO: 2823315 - RNA, 14 nt, Human
uuuuugccuucauu

SEQ ID NO: 2823316 - RNA, 14 nt, Human
uuuuuggaguguua

SEQ ID NO: 2823317 - RNA, 19 nt, Human
uuuuuggaguguuauguau

SEQ ID NO: 2823318 - RNA, 20 nt, Human
uuuuuggaguguuauguauu

SEQ ID NO: 2823319 - RNA, 22 nt, Human
uuuuugggaaaagaaaagucaa

SEQ ID NO: 2823320 - RNA, 12 nt, Human
uuuuugguacaa

SEQ ID NO: 2823321 - RNA, 13 nt, Human
uuuuugguacaaa

SEQ ID NO: 2823322 - RNA, 14 nt, Human
uuuuugguacaaaa

SEQ ID NO: 2823323 - RNA, 22 nt, Human
uuuuugguguauagaaguuugu

SEQ ID NO: 2823324 - RNA, 23 nt, Human
uuuuugggcagcaauuuaaaugu

SEQ ID NO: 2823325 - RNA, 21 nt, Human
uuuuugggcagcaauuuaaau

SEQ ID NO: 2823326 - RNA, 20 nt, Human
uuuuugggcagcaauuuaaa

SEQ ID NO: 2823327 - RNA, 11 nt, Human
uuuuuguagua

SEQ ID NO: 2823328 - RNA, 20 nt, Human
uuuuuguagugaccuguuua

SEQ ID NO: 2823329 - RNA, 19 nt, Human
uuuuuggugauucaaaugg

SEQ ID NO: 2823330 - RNA, 15 nt, Human
uuuuuguaaacugga

SEQ ID NO: 2823331 - RNA, 23 nt, Human
uuuuuguaaacuggaauuaaaag

SEQ ID NO: 2823332 - RNA, 14 nt, Human
auuaaggauguagc

SEQ ID NO: 2823333 - RNA, 18 nt, Human
auuaaggauguagcuuuu

SEQ ID NO: 2823334 - RNA, 21 nt, Human
auuaaggauguagcuuuucac

SEQ ID NO: 2823335 - RNA, 23 nt, Human
auuaaggauguagcuuuucaccu

SEQ ID NO: 2823336 - RNA, 16 nt, Human
uuuuugucaacauugu

SEQ ID NO: 2823337 - RNA, 12 nt, Human
uuuuuguauguu

SEQ ID NO: 2823338 - RNA, 11 nt, Human
uuuuuguauuu

SEQ ID NO: 2823339 - RNA, 16 nt, Human
auuaagucaagaauau

SEQ ID NO: 2823340 - RNA, 15 nt, Human
auuaaggugauguga

SEQ ID NO: 2823341 - RNA, 16 nt, Human
auuaaggugaugugau

SEQ ID NO: 2823342 - RNA, 17 nt, Human
auuaaggugaugugauu

SEQ ID NO: 2823343 - RNA, 12 nt, Human
auuccacagcug

SEQ ID NO: 2823344 - RNA, 18 nt, Human
auuccaauaugaugacuc

SEQ ID NO: 2823345 - RNA, 15 nt, Human
auuccaauauuucug

SEQ ID NO: 2823346 - RNA, 13 nt, Human
auuccaaucuaca

SEQ ID NO: 2823347 - RNA, 17 nt, Human
auuccaauaugaugacu

SEQ ID NO: 2823348 - RNA, 17 nt, Human
auucccaagcucugcuc

SEQ ID NO: 2823349 - RNA, 18 nt, Human
auuccagagaguggcucc

SEQ ID NO: 2823350 - RNA, 23 nt, Human
auuccagacugcuuccaauuuuc

SEQ ID NO: 2823351 - RNA, 23 nt, Human
auuccagaaugcuguacaucuau

SEQ ID NO: 2823352 - RNA, 20 nt, Human
auuccagaaugcuguacauc

SEQ ID NO: 2823353 - RNA, 14 nt, Human
auuccagaaugcug

SEQ ID NO: 2823354 - RNA, 19 nt, Human
auuccagaaugcuguacau

SEQ ID NO: 2823355 - RNA, 15 nt, Human
auuccagaaugcugu

SEQ ID NO: 2823356 - RNA, 19 nt, Human
auucccaagcucugcuccu

SEQ ID NO: 2823357 - RNA, 18 nt, Human
auucccaagcucugcucc

SEQ ID NO: 2823358 - RNA, 18 nt, Human
auuccagagacaucagca

SEQ ID NO: 2823359 - RNA, 14 nt, Human
auuccccauucuuc

SEQ ID NO: 2823360 - RNA, 18 nt, Human
auuccuaacuuuucaaug

SEQ ID NO: 2823361 - RNA, 14 nt, Human
auuccuaagaauca

SEQ ID NO: 2823362 - RNA, 15 nt, Human
auuccuaagccacuu

SEQ ID NO: 2823363 - RNA, 15 nt, Human
auuccccauucuucc

SEQ ID NO: 2823364 - RNA, 20 nt, Human
auucacugaaguucuccuga

SEQ ID NO: 2823365 - RNA, 14 nt, Human
auucacugggccaa

SEQ ID NO: 2823366 - RNA, 18 nt, Human
auucacuuagcagaaccu

SEQ ID NO: 2823367 - RNA, 14 nt, Human
auucacuugcauuu

SEQ ID NO: 2823368 - RNA, 16 nt, Human
auucagaucacugaau

SEQ ID NO: 2823369 - RNA, 19 nt, Human
auucagaucacugaauuua

SEQ ID NO: 2823370 - RNA, 23 nt, Human
auucagaucacugaauuuauaaa

SEQ ID NO: 2823371 - RNA, 17 nt, Human
auucagauuguuaucua

SEQ ID NO: 2823372 - RNA, 14 nt, Human
auucagcaaaccau

SEQ ID NO: 2823373 - RNA, 15 nt, Human
auucagcaaaccauu

SEQ ID NO: 2823374 - RNA, 18 nt, Human
auuauaucuguggucuuc

SEQ ID NO: 2823375 - RNA, 17 nt, Human
auucagccauguacaga

SEQ ID NO: 2823376 - RNA, 22 nt, Human
auucaggagaguagaacagaua

SEQ ID NO: 2823377 - RNA, 21 nt, Human
auucaggagaguagaacagau

SEQ ID NO: 2823378 - RNA, 11 nt, Human
auucaggcugc

SEQ ID NO: 2823379 - RNA, 16 nt, Human
auucaggcugcuuggg

SEQ ID NO: 2823380 - RNA, 13 nt, Human
auucaggcugcuu

SEQ ID NO: 2823381 - RNA, 12 nt, Human
auucaggggcug

SEQ ID NO: 2823382 - RNA, 19 nt, Human
auucaggggcugacacuuc

SEQ ID NO: 2823383 - RNA, 20 nt, Human
auucaggggcugacacuuca

SEQ ID NO: 2823384 - RNA, 17 nt, Human
auucagguauguugccu

SEQ ID NO: 2823385 - RNA, 13 nt, Human
auucagguauguu

SEQ ID NO: 2823386 - RNA, 19 nt, Human
auucaguggcgagaaauaa

SEQ ID NO: 2823387 - RNA, 18 nt, Human
auucaguguauuucaguu

SEQ ID NO: 2823388 - RNA, 22 nt, Human
auucagugcuguggccugggca

SEQ ID NO: 2823389 - RNA, 21 nt, Human
auucagugcuguggccugggc

SEQ ID NO: 2823390 - RNA, 20 nt, Human
auucagugcuguggccuggg

SEQ ID NO: 2823391 - RNA, 17 nt, Human
auucagugcuguggccu

SEQ ID NO: 2823392 - RNA, 16 nt, Human
auuccaagacucuaga

SEQ ID NO: 2823393 - RNA, 17 nt, Human
auuccaagacucuagag

SEQ ID NO: 2823394 - RNA, 18 nt, Human
auuccaagacucuagagu

SEQ ID NO: 2823395 - RNA, 16 nt, Human
auuauaucuaauuauu

SEQ ID NO: 2823396 - RNA, 23 nt, Human
auuauauggagacgcuaagaaau

SEQ ID NO: 2823397 - RNA, 23 nt, Human
auuauaucauuggaacaacugau

SEQ ID NO: 2823398 - RNA, 16 nt, Human
auuauaucaagguaaa

SEQ ID NO: 2823399 - RNA, 23 nt, Human
auuauaaaaagccacuagacucu

SEQ ID NO: 2823400 - RNA, 19 nt, Human
auuacuugauuaagauuuu

SEQ ID NO: 2823401 - RNA, 18 nt, Human
auuauaaaauuaaucaca

SEQ ID NO: 2823402 - RNA, 13 nt, Human
auuauaaacgcuu

SEQ ID NO: 2823403 - RNA, 14 nt, Human
auuauaaacgcuua

SEQ ID NO: 2823404 - RNA, 17 nt, Human
auuauaaauauauauaa

SEQ ID NO: 2823405 - RNA, 19 nt, Human
auuauaaauauauauaaag

SEQ ID NO: 2823406 - RNA, 20 nt, Human
auuauaaauauauauaaaga

SEQ ID NO: 2823407 - RNA, 17 nt, Human
auuauaacaaguguguc

SEQ ID NO: 2823408 - RNA, 17 nt, Human
auucaaacuggggccuc

SEQ ID NO: 2823409 - RNA, 19 nt, Human
auucaaacuggggccucca

SEQ ID NO: 2823410 - RNA, 22 nt, Human
auucaaacuggggccuccagaa

SEQ ID NO: 2823411 - RNA, 13 nt, Human
auucaaagguucu

SEQ ID NO: 2823412 - RNA, 14 nt, Human
auucaaagguucua

SEQ ID NO: 2823413 - RNA, 15 nt, Human
auucaaagguucuag

SEQ ID NO: 2823414 - RNA, 16 nt, Human
auucaaagguucuagg

SEQ ID NO: 2823415 - RNA, 17 nt, Human
auucaaagguucuaggu

SEQ ID NO: 2823416 - RNA, 18 nt, Human
auucaaagguucuagguu

SEQ ID NO: 2823417 - RNA, 16 nt, Human
auucacucaagcacug

SEQ ID NO: 2823418 - RNA, 17 nt, Human
auucacucaagcacuga

SEQ ID NO: 2823419 - RNA, 18 nt, Human
auucacucaagcacugau

SEQ ID NO: 2823420 - RNA, 21 nt, Human
auucacucaagcacugauauc

SEQ ID NO: 2823421 - RNA, 21 nt, Human
auucacucauacaucuggccg

SEQ ID NO: 2823422 - RNA, 20 nt, Human
auucacggagauaugaagag

SEQ ID NO: 2823423 - RNA, 21 nt, Human
auucaaagguucuagguuuca

SEQ ID NO: 2823424 - RNA, 22 nt, Human
auucacccccuuuccuggacac

SEQ ID NO: 2823425 - RNA, 16 nt, Human
auucaccuaagagauu

SEQ ID NO: 2823426 - RNA, 17 nt, Human
auucaccuaagagauuc

SEQ ID NO: 2823427 - RNA, 18 nt, Human
auucaccuaagagauucu

SEQ ID NO: 2823428 - RNA, 21 nt, Human
auucaccuaagagauucugau

SEQ ID NO: 2823429 - RNA, 22 nt, Human
auucaccuaagagauucugauu

SEQ ID NO: 2823430 - RNA, 23 nt, Human
auucaccuaagagauucugauuu

SEQ ID NO: 2823431 - RNA, 13 nt, Human
auucaccugagca

SEQ ID NO: 2823432 - RNA, 16 nt, Human
auucacccccuuuccu

SEQ ID NO: 2823433 - RNA, 16 nt, Human
auucacccccaaacag

SEQ ID NO: 2823434 - RNA, 18 nt, Human
auuauugugguaggccuu

SEQ ID NO: 2823435 - RNA, 23 nt, Human
auuauugugguaggccuuuuaac

SEQ ID NO: 2823436 - RNA, 12 nt, Human
auuauuuaaaca

SEQ ID NO: 2823437 - RNA, 11 nt, Human
auuauuuaaac

SEQ ID NO: 2823438 - RNA, 12 nt, Human
auuauugcauua

SEQ ID NO: 2823439 - RNA, 15 nt, Human
auuauugcuguugcu

SEQ ID NO: 2823440 - RNA, 16 nt, Human
auuauugcuguugcuu

SEQ ID NO: 2823441 - RNA, 18 nt, Human
auuauugcuguugcuuga

SEQ ID NO: 2823442 - RNA, 19 nt, Human
auuauugcuguugcuugaa

SEQ ID NO: 2823443 - RNA, 11 nt, Human
auuauugcuua

SEQ ID NO: 2823444 - RNA, 15 nt, Human
auuauugcuuauugc

SEQ ID NO: 2823445 - RNA, 19 nt, Human
auuauugcuuauugcuuag

SEQ ID NO: 2823446 - RNA, 12 nt, Human
auuauuuaauaa

SEQ ID NO: 2823447 - RNA, 13 nt, Human
auuauuuaauaaa

SEQ ID NO: 2823448 - RNA, 21 nt, Human
auuauuuuuuuuuuuugaaaa

SEQ ID NO: 2823449 - RNA, 17 nt, Human
auucaaaaaguguuuau

SEQ ID NO: 2823450 - RNA, 14 nt, Human
auucaaaaaguguu

SEQ ID NO: 2823451 - RNA, 16 nt, Human
auucaaaaaguguuua

SEQ ID NO: 2823452 - RNA, 23 nt, Human
auucaaaaauuaucuauagcuaa

SEQ ID NO: 2823453 - RNA, 16 nt, Human
auucaaaaauuaucua

SEQ ID NO: 2823454 - RNA, 13 nt, Human
auucaaaaguucc

SEQ ID NO: 2823455 - RNA, 14 nt, Human
auucaaaaguucca

SEQ ID NO: 2823456 - RNA, 16 nt, Human
auucaaaaguuccaag

SEQ ID NO: 2823457 - RNA, 16 nt, Human
uuuggauuugacauug

SEQ ID NO: 2823458 - RNA, 14 nt, Human
uuuggauuuuuaau

SEQ ID NO: 2823459 - RNA, 18 nt, Human
uuuggauuuuuaauuaaa

SEQ ID NO: 2823460 - RNA, 14 nt, Human
uuuggauuguauau

SEQ ID NO: 2823461 - RNA, 18 nt, Human
uuuggauucuuauguagc

SEQ ID NO: 2823462 - RNA, 20 nt, Human
uuuggauucuuauguagcag

SEQ ID NO: 2823463 - RNA, 12 nt, Human
uuugcuguaaga

SEQ ID NO: 2823464 - RNA, 19 nt, Human
uuugcuguaagaugucugu

SEQ ID NO: 2823465 - RNA, 18 nt, Human
uuugaccuucauuucaug

SEQ ID NO: 2823466 - RNA, 15 nt, Human
uuugauugauuugaa

SEQ ID NO: 2823467 - RNA, 13 nt, Human
uuugauuucuauu

SEQ ID NO: 2823468 - RNA, 18 nt, Human
uuugauuuccaaguaaua

SEQ ID NO: 2823469 - RNA, 20 nt, Human
uuugauuuccaaguaauaua

SEQ ID NO: 2823470 - RNA, 12 nt, Human
uuugauuuaugc

SEQ ID NO: 2823471 - RNA, 15 nt, Human
uuugauuuacagcaa

SEQ ID NO: 2823472 - RNA, 17 nt, Human
uuugauuuacagcaagu

SEQ ID NO: 2823473 - RNA, 18 nt, Human
uuugauuuacagcaagua

SEQ ID NO: 2823474 - RNA, 13 nt, Human
uuugauuuacaua

SEQ ID NO: 2823475 - RNA, 22 nt, Human
uuugcggccaguauuagacugg

SEQ ID NO: 2823476 - RNA, 21 nt, Human
uuugccuugggcugcuccuca

SEQ ID NO: 2823477 - RNA, 12 nt, Human
uuugccuuuaaa

SEQ ID NO: 2823478 - RNA, 17 nt, Human
uuugccuuccuuucucc

SEQ ID NO: 2823479 - RNA, 22 nt, Human
uuugccuuccuuucuccaggac

SEQ ID NO: 2823480 - RNA, 14 nt, Human
uuugccuugcagaa

SEQ ID NO: 2823481 - RNA, 16 nt, Human
uuugccuugcagaacu

SEQ ID NO: 2823482 - RNA, 17 nt, Human
uuugccuugcagaacug

SEQ ID NO: 2823483 - RNA, 19 nt, Human
uuugccuugcagaacugcc

SEQ ID NO: 2823484 - RNA, 22 nt, Human
uuugccuugcagaacugccauu

SEQ ID NO: 2823485 - RNA, 19 nt, Human
uuugcaaaguauuguaaau

SEQ ID NO: 2823486 - RNA, 19 nt, Human
uuugcaaacccgaaaauaa

SEQ ID NO: 2823487 - RNA, 14 nt, Human
uuuggauuugacau

SEQ ID NO: 2823488 - RNA, 21 nt, Human
uuugggcagcaauuuaaaugu

SEQ ID NO: 2823489 - RNA, 11 nt, Human
uuugggcaugu

SEQ ID NO: 2823490 - RNA, 14 nt, Human
uuugggcugcccug

SEQ ID NO: 2823491 - RNA, 12 nt, Human
uuugggcccugc

SEQ ID NO: 2823492 - RNA, 13 nt, Human
uuugggcccugca

SEQ ID NO: 2823493 - RNA, 14 nt, Human
uuugggcccugcau

SEQ ID NO: 2823494 - RNA, 14 nt, Human
uuugggccucugcu

SEQ ID NO: 2823495 - RNA, 16 nt, Human
uuuggcuuaaauauag

SEQ ID NO: 2823496 - RNA, 14 nt, Human
uuuggcuuccauga

SEQ ID NO: 2823497 - RNA, 16 nt, Human
uuugggagggaaaagg

SEQ ID NO: 2823498 - RNA, 17 nt, Human
uuugggaucccugucuu

SEQ ID NO: 2823499 - RNA, 18 nt, Human
uuugggauuuaauuucca

SEQ ID NO: 2823500 - RNA, 21 nt, Human
uuugggguacccacugcucug

SEQ ID NO: 2823501 - RNA, 17 nt, Human
uuugggggaaacuuccu

SEQ ID NO: 2823502 - RNA, 18 nt, Human
uuugggggacguuucuca

SEQ ID NO: 2823503 - RNA, 12 nt, Human
uuugcugggaga

SEQ ID NO: 2823504 - RNA, 15 nt, Human
uuugggcuucagccu

SEQ ID NO: 2823505 - RNA, 22 nt, Human
uuugggguacccacugcucugg

SEQ ID NO: 2823506 - RNA, 15 nt, Human
uuugggggucaggca

SEQ ID NO: 2823507 - RNA, 20 nt, Human
uuugggggucaggcagccag

SEQ ID NO: 2823508 - RNA, 20 nt, Human
uuugggggugggucuggccg

SEQ ID NO: 2823509 - RNA, 17 nt, Human
uuuggggaaaccuagag

SEQ ID NO: 2823510 - RNA, 18 nt, Human
uuuggggaaaccuagaga

SEQ ID NO: 2823511 - RNA, 22 nt, Human
uuuggguauguuuaaucuguua

SEQ ID NO: 2823512 - RNA, 10 nt, Human
uuuggggucu

SEQ ID NO: 2823513 - RNA, 18 nt, Human
uuuggggugccccucucc

SEQ ID NO: 2823514 - RNA, 19 nt, Human
auguauacuauaguaccag

SEQ ID NO: 2823515 - RNA, 15 nt, Human
auguauaguugcuuu

SEQ ID NO: 2823516 - RNA, 16 nt, Human
auguauaguuuucccu

SEQ ID NO: 2823517 - RNA, 16 nt, Human
auguauaguuuugaau

SEQ ID NO: 2823518 - RNA, 12 nt, Human
auguauauacac

SEQ ID NO: 2823519 - RNA, 13 nt, Human
auguauauacaca

SEQ ID NO: 2823520 - RNA, 15 nt, Human
auguauauacacaua

SEQ ID NO: 2823521 - RNA, 16 nt, Human
auguauauacacauau

SEQ ID NO: 2823522 - RNA, 17 nt, Human
auguauauacacauaua

SEQ ID NO: 2823523 - RNA, 18 nt, Human
auguauauacacauauac

SEQ ID NO: 2823524 - RNA, 14 nt, Human
uuugaauuguuaca

SEQ ID NO: 2823525 - RNA, 15 nt, Human
uuugaauuguuacau

SEQ ID NO: 2823526 - RNA, 16 nt, Human
uuugaauuguuuucuu

SEQ ID NO: 2823527 - RNA, 18 nt, Human
uuugaauuguuuucuuua

SEQ ID NO: 2823528 - RNA, 14 nt, Human
uuugaauuuacugg

SEQ ID NO: 2823529 - RNA, 17 nt, Human
uuugaauuuuaaaucua

SEQ ID NO: 2823530 - RNA, 20 nt, Human
uuugaauguuauuuguuauu

SEQ ID NO: 2823531 - RNA, 13 nt, Human
uuugaauuaaaac

SEQ ID NO: 2823532 - RNA, 15 nt, Human
uuugaauuaaaacuu

SEQ ID NO: 2823533 - RNA, 19 nt, Human
uuugaauuaaaacuucuua

SEQ ID NO: 2823534 - RNA, 15 nt, Human
uuucccuugaggaaa

SEQ ID NO: 2823535 - RNA, 19 nt, Human
uuucccuucaguacccucu

SEQ ID NO: 2823536 - RNA, 20 nt, Human
uuucccuucaguacccucuc

SEQ ID NO: 2823537 - RNA, 16 nt, Human
uuucccuucuugcauc

SEQ ID NO: 2823538 - RNA, 16 nt, Human
uuucccuucccuucca

SEQ ID NO: 2823539 - RNA, 12 nt, Human
uuucccuuccuc

SEQ ID NO: 2823540 - RNA, 13 nt, Human
uuucccuuccucu

SEQ ID NO: 2823541 - RNA, 15 nt, Human
uuucccuuccucuuc

SEQ ID NO: 2823542 - RNA, 19 nt, Human
uuucccuuccucuucggcc

SEQ ID NO: 2823543 - RNA, 16 nt, Human
uuucccuucaguaccc

SEQ ID NO: 2823544 - RNA, 12 nt, Human
uuucccucuuuu

SEQ ID NO: 2823545 - RNA, 22 nt, Human
uuucccucuuuucuuacuccuc

SEQ ID NO: 2823546 - RNA, 18 nt, Human
uuugacacucugcagacu

SEQ ID NO: 2823547 - RNA, 14 nt, Human
uuugacuuaaugug

SEQ ID NO: 2823548 - RNA, 16 nt, Human
uuugacuuaaugugau

SEQ ID NO: 2823549 - RNA, 23 nt, Human
uuugacuuaaugugauuacugcu

SEQ ID NO: 2823550 - RNA, 17 nt, Human
uuugacuugcaugaaga

SEQ ID NO: 2823551 - RNA, 13 nt, Human
uuugacuuuaauu

SEQ ID NO: 2823552 - RNA, 14 nt, Human
uuugacuuuaauuu

SEQ ID NO: 2823553 - RNA, 15 nt, Human
uuugacuuuaauuua

SEQ ID NO: 2823554 - RNA, 15 nt, Human
uuugacuuucuucug

SEQ ID NO: 2823555 - RNA, 17 nt, Human
uuugacuuucuucugaa

SEQ ID NO: 2823556 - RNA, 18 nt, Human
uuugacuuucuucugaau

SEQ ID NO: 2823557 - RNA, 22 nt, Human
uuugacuuucuucugaauauuu

SEQ ID NO: 2823558 - RNA, 13 nt, Human
uuugagacagagu

SEQ ID NO: 2823559 - RNA, 16 nt, Human
uuugagaccagccugg

SEQ ID NO: 2823560 - RNA, 20 nt, Human
uuugagacaguuucuuagcu

SEQ ID NO: 2823561 - RNA, 22 nt, Human
uuugagacaguuucuuagcuuu

SEQ ID NO: 2823562 - RNA, 19 nt, Human
uuugagaccagccugggca

SEQ ID NO: 2823563 - RNA, 15 nt, Human
uuugagacaguuucu

SEQ ID NO: 2823564 - RNA, 18 nt, Human
uuugagaacaaagaugac

SEQ ID NO: 2823565 - RNA, 18 nt, Human
uuugagaacguaaagaac

SEQ ID NO: 2823566 - RNA, 16 nt, Human
uuugagacaguuucuu

SEQ ID NO: 2823567 - RNA, 17 nt, Human
uuugagacaguuucuua

SEQ ID NO: 2823568 - RNA, 18 nt, Human
uuugagacaguuucuuag

SEQ ID NO: 2823569 - RNA, 19 nt, Human
uuugagacaguuucuuagc

SEQ ID NO: 2823570 - RNA, 15 nt, Human
uuugauccaagcugg

SEQ ID NO: 2823571 - RNA, 13 nt, Human
uuugagaguucua

SEQ ID NO: 2823572 - RNA, 14 nt, Human
uuugauccaagcug

SEQ ID NO: 2823573 - RNA, 19 nt, Human
uuugaugacuggcauuuua

SEQ ID NO: 2823574 - RNA, 23 nt, Human
uuugaugacuggcauuuuauaga

SEQ ID NO: 2823575 - RNA, 16 nt, Human
uuugaugcagcauuug

SEQ ID NO: 2823576 - RNA, 20 nt, Human
uuugaugcagcauuugauaa

SEQ ID NO: 2823577 - RNA, 21 nt, Human
uuugaugcagcauuugauaau

SEQ ID NO: 2823578 - RNA, 16 nt, Human
uuugaugccaagaaag

SEQ ID NO: 2823579 - RNA, 15 nt, Human
uuugauucaaaauau

SEQ ID NO: 2823580 - RNA, 22 nt, Human
uuugauucaaaauauuuaaaaa

SEQ ID NO: 2823581 - RNA, 22 nt, Human
uuugauuaguuuucuuguugcu

SEQ ID NO: 2823582 - RNA, 14 nt, Human
uuugauuaacaaau

SEQ ID NO: 2823583 - RNA, 15 nt, Human
uuugauuaacaaaua

SEQ ID NO: 2823584 - RNA, 16 nt, Human
uuugauuaacaaauau

SEQ ID NO: 2823585 - RNA, 22 nt, Human
auguccuccagaagccucuggc

SEQ ID NO: 2823586 - RNA, 20 nt, Human
auguccuccagaagccucug

SEQ ID NO: 2823587 - RNA, 23 nt, Human
auguccuccagaagccucuggcu

SEQ ID NO: 2823588 - RNA, 15 nt, Human
augucgccucugcau

SEQ ID NO: 2823589 - RNA, 15 nt, Human
augugacaauaauau

SEQ ID NO: 2823590 - RNA, 16 nt, Human
augugacaauaauauu

SEQ ID NO: 2823591 - RNA, 12 nt, Human
augucuaaaauu

SEQ ID NO: 2823592 - RNA, 13 nt, Human
augucuaaaauug

SEQ ID NO: 2823593 - RNA, 14 nt, Human
augucuaaaauugu

SEQ ID NO: 2823594 - RNA, 17 nt, Human
augucuaaaugcugaaa

SEQ ID NO: 2823595 - RNA, 11 nt, Human
augugacacau

SEQ ID NO: 2823596 - RNA, 15 nt, Human
augugacaccaaagc

SEQ ID NO: 2823597 - RNA, 16 nt, Human
augugacagguaaacu

SEQ ID NO: 2823598 - RNA, 18 nt, Human
augugacuuugcaucagc

SEQ ID NO: 2823599 - RNA, 16 nt, Human
augugagagguuugac

SEQ ID NO: 2823600 - RNA, 22 nt, Human
augugaguguguguuugugcug

SEQ ID NO: 2823601 - RNA, 17 nt, Human
augugaguuuggucugg

SEQ ID NO: 2823602 - RNA, 20 nt, Human
augugaguuuggucuggacu

SEQ ID NO: 2823603 - RNA, 21 nt, Human
augugaguuuggucuggacug

SEQ ID NO: 2823604 - RNA, 22 nt, Human
augugaguuuggucuggacuga

SEQ ID NO: 2823605 - RNA, 23 nt, Human
augugaguuuggucuggacugac

SEQ ID NO: 2823606 - RNA, 21 nt, Human
augugauaaguucuuaugcca

SEQ ID NO: 2823607 - RNA, 18 nt, Human
augugagugccuuuugca

SEQ ID NO: 2823608 - RNA, 20 nt, Human
augugagugccuuuugcaga

SEQ ID NO: 2823609 - RNA, 22 nt, Human
augugagugccuuuugcagaag

SEQ ID NO: 2823610 - RNA, 23 nt, Human
augugagugccuuuugcagaaga

SEQ ID NO: 2823611 - RNA, 21 nt, Human
augugaggaagaacuacagcu

SEQ ID NO: 2823612 - RNA, 12 nt, Human
augugaggaugu

SEQ ID NO: 2823613 - RNA, 17 nt, Human
augugagagguuugacu

SEQ ID NO: 2823614 - RNA, 21 nt, Human
augugagauuuuuuauugcua

SEQ ID NO: 2823615 - RNA, 15 nt, Human
auguauauuccuuug

SEQ ID NO: 2823616 - RNA, 16 nt, Human
auguauauguguucau

SEQ ID NO: 2823617 - RNA, 19 nt, Human
auguauauauauauaugca

SEQ ID NO: 2823618 - RNA, 12 nt, Human
auguauauauuu

SEQ ID NO: 2823619 - RNA, 14 nt, Human
auguauauauuuag

SEQ ID NO: 2823620 - RNA, 17 nt, Human
auguauauauuuagugc

SEQ ID NO: 2823621 - RNA, 18 nt, Human
auguauauuuuuuuaauu

SEQ ID NO: 2823622 - RNA, 20 nt, Human
auguauauuuuuuuaauuua

SEQ ID NO: 2823623 - RNA, 21 nt, Human
auguauauuuuuuuaauuuaa

SEQ ID NO: 2823624 - RNA, 18 nt, Human
augucauugaguaauaua

SEQ ID NO: 2823625 - RNA, 13 nt, Human
augucauuaaaug

SEQ ID NO: 2823626 - RNA, 15 nt, Human
augucauuaaugugu

SEQ ID NO: 2823627 - RNA, 16 nt, Human
augucauuaauguguu

SEQ ID NO: 2823628 - RNA, 17 nt, Human
augucauuaauguguug

SEQ ID NO: 2823629 - RNA, 13 nt, Human
augucauguguuc

SEQ ID NO: 2823630 - RNA, 21 nt, Human
augucaucagagcuccucugu

SEQ ID NO: 2823631 - RNA, 22 nt, Human
augucauauacugccauguacu

SEQ ID NO: 2823632 - RNA, 14 nt, Human
augucccuugcugu

SEQ ID NO: 2823633 - RNA, 13 nt, Human
augucauuuccuu

SEQ ID NO: 2823634 - RNA, 20 nt, Human
augucccuuuuccuaaguca

SEQ ID NO: 2823635 - RNA, 19 nt, Human
auguccuaauucuucuguc

SEQ ID NO: 2823636 - RNA, 20 nt, Human
auguccuacuaucacugaac

SEQ ID NO: 2823637 - RNA, 15 nt, Human
auguccucaccacau

SEQ ID NO: 2823638 - RNA, 13 nt, Human
auguccuaugugu

SEQ ID NO: 2823639 - RNA, 15 nt, Human
auguccuauguguga

SEQ ID NO: 2823640 - RNA, 19 nt, Human
auguccuccagaagccucu

SEQ ID NO: 2823641 - RNA, 18 nt, Human
auguccuccagaagccuc

SEQ ID NO: 2823642 - RNA, 16 nt, Human
auguccuccagaagcc

SEQ ID NO: 2823643 - RNA, 17 nt, Human
auguccucaccacaugc

SEQ ID NO: 2823644 - RNA, 21 nt, Human
auguccucagcauuucuuuuc

SEQ ID NO: 2823645 - RNA, 22 nt, Human
auguccaaagaggcugccccuc

SEQ ID NO: 2823646 - RNA, 21 nt, Human
auguccaaagaggcugccccu

SEQ ID NO: 2823647 - RNA, 20 nt, Human
auguccaaagaggcugcccc

SEQ ID NO: 2823648 - RNA, 19 nt, Human
auguccaaagaggcugccc

SEQ ID NO: 2823649 - RNA, 18 nt, Human
auguccaaagaggcugcc

SEQ ID NO: 2823650 - RNA, 16 nt, Human
auguccaaagaggcug

SEQ ID NO: 2823651 - RNA, 15 nt, Human
auguccaaagaggcu

SEQ ID NO: 2823652 - RNA, 12 nt, Human
auguccaaagag

SEQ ID NO: 2823653 - RNA, 18 nt, Human
uuugucuguuuguuucaa

SEQ ID NO: 2823654 - RNA, 21 nt, Human
uuugucuguuuguuucaagaa

SEQ ID NO: 2823655 - RNA, 23 nt, Human
uuuguacaaggggccauuuggca

SEQ ID NO: 2823656 - RNA, 23 nt, Human
uuuguaguggaaacauuuauauu

SEQ ID NO: 2823657 - RNA, 17 nt, Human
uuuguaguagcguuuuu

SEQ ID NO: 2823658 - RNA, 16 nt, Human
uuuguacauagauuua

SEQ ID NO: 2823659 - RNA, 14 nt, Human
uuuguagguaaaau

SEQ ID NO: 2823660 - RNA, 15 nt, Human
uuuguagguaaaaug

SEQ ID NO: 2823661 - RNA, 17 nt, Human
uuuguagguaaaaugua

SEQ ID NO: 2823662 - RNA, 20 nt, Human
uuuguagguaaaauguauuu

SEQ ID NO: 2823663 - RNA, 15 nt, Human
uuuguaguagcguuu

SEQ ID NO: 2823664 - RNA, 19 nt, Human
uuuguaguagcguuuuuua

SEQ ID NO: 2823665 - RNA, 16 nt, Human
uuuguagugaaauaau

SEQ ID NO: 2823666 - RNA, 18 nt, Human
uuuguagugaaauaauag

SEQ ID NO: 2823667 - RNA, 12 nt, Human
uuuguacagaau

SEQ ID NO: 2823668 - RNA, 14 nt, Human
uuuguacagagugc

SEQ ID NO: 2823669 - RNA, 21 nt, Human
uuuguaaguuucaggugacau

SEQ ID NO: 2823670 - RNA, 14 nt, Human
uuuguaaguuucag

SEQ ID NO: 2823671 - RNA, 21 nt, Human
augugaucuauguuucaucuu

SEQ ID NO: 2823672 - RNA, 16 nt, Human
augugaucugucuugu

SEQ ID NO: 2823673 - RNA, 17 nt, Human
augugaucugucuugua

SEQ ID NO: 2823674 - RNA, 18 nt, Human
augugaucugucuuguaa

SEQ ID NO: 2823675 - RNA, 19 nt, Human
augugaucugucuuguaau

SEQ ID NO: 2823676 - RNA, 20 nt, Human
augugaucugucuuguaaua

SEQ ID NO: 2823677 - RNA, 18 nt, Human
augugauccuuuuggagu

SEQ ID NO: 2823678 - RNA, 16 nt, Human
augugauauucuaaga

SEQ ID NO: 2823679 - RNA, 14 nt, Human
augugauauucuaa

SEQ ID NO: 2823680 - RNA, 15 nt, Human
augugauauucuaag

SEQ ID NO: 2823681 - RNA, 18 nt, Human
augugauauucuaagacu

SEQ ID NO: 2823682 - RNA, 18 nt, Human
augugaucacgccuggcu

SEQ ID NO: 2823683 - RNA, 23 nt, Human
augugaucagcuuucaaagcauu

SEQ ID NO: 2823684 - RNA, 17 nt, Human
uuuguaaggcuuguucc

SEQ ID NO: 2823685 - RNA, 21 nt, Human
uuuguaagucaguguugagau

SEQ ID NO: 2823686 - RNA, 22 nt, Human
uuuguaagucaguguugagaug

SEQ ID NO: 2823687 - RNA, 21 nt, Human
uuuguaagugcuacauaaauu

SEQ ID NO: 2823688 - RNA, 23 nt, Human
uuuguaagaguguagaagcauuc

SEQ ID NO: 2823689 - RNA, 22 nt, Human
uuuguaagaguguagaagcauu

SEQ ID NO: 2823690 - RNA, 12 nt, Human
uuuguaagagug

SEQ ID NO: 2823691 - RNA, 16 nt, Human
uuuguaagaguguaga

SEQ ID NO: 2823692 - RNA, 18 nt, Human
uuuguaagaacuaaagaa

SEQ ID NO: 2823693 - RNA, 19 nt, Human
uuuguaagaacuaaagaag

SEQ ID NO: 2823694 - RNA, 17 nt, Human
uuuguaagaguguagaa

SEQ ID NO: 2823695 - RNA, 18 nt, Human
uuuguaagaguguagaag

SEQ ID NO: 2823696 - RNA, 19 nt, Human
uuuguaagaguguagaagc

SEQ ID NO: 2823697 - RNA, 21 nt, Human
uuuguaagaguguagaagcau

SEQ ID NO: 2823698 - RNA, 17 nt, Human
uuuguuucugagaaaag

SEQ ID NO: 2823699 - RNA, 18 nt, Human
uuuguuuuacaaugucau

SEQ ID NO: 2823700 - RNA, 18 nt, Human
uuuguuucucccccuggg

SEQ ID NO: 2823701 - RNA, 15 nt, Human
uuuguuuccuuuguu

SEQ ID NO: 2823702 - RNA, 14 nt, Human
uuuguuuccuuugu

SEQ ID NO: 2823703 - RNA, 13 nt, Human
uuugugccagagg

SEQ ID NO: 2823704 - RNA, 14 nt, Human
uuugugauucuucc

SEQ ID NO: 2823705 - RNA, 21 nt, Human
uuugugauucuuccagaugug

SEQ ID NO: 2823706 - RNA, 17 nt, Human
uuugugauuuagaacug

SEQ ID NO: 2823707 - RNA, 21 nt, Human
uuugugcaaaagcuucaaauu

SEQ ID NO: 2823708 - RNA, 20 nt, Human
uuugugcuauaguauuugau

SEQ ID NO: 2823709 - RNA, 18 nt, Human
uuuguuuauuagaugaau

SEQ ID NO: 2823710 - RNA, 21 nt, Human
uuuguuucaagaaccuggaaa

SEQ ID NO: 2823711 - RNA, 14 nt, Human
uuugugcucauuua

SEQ ID NO: 2823712 - RNA, 21 nt, Human
uuugugcucauuuaaguuuca

SEQ ID NO: 2823713 - RNA, 20 nt, Human
uuugugccuggcuucuuucu

SEQ ID NO: 2823714 - RNA, 20 nt, Human
uuugucuuauauauauuucu

SEQ ID NO: 2823715 - RNA, 14 nt, Human
uuugucuuauauau

SEQ ID NO: 2823716 - RNA, 19 nt, Human
uuugucuuauauauauuuc

SEQ ID NO: 2823717 - RNA, 12 nt, Human
augugcugauca

SEQ ID NO: 2823718 - RNA, 21 nt, Human
augugccagguuuuuggucug

SEQ ID NO: 2823719 - RNA, 23 nt, Human
augugccaggaaacucuugcuau

SEQ ID NO: 2823720 - RNA, 21 nt, Human
augugccagggcaaugaugaa

SEQ ID NO: 2823721 - RNA, 20 nt, Human
augugccagggcaaugauga

SEQ ID NO: 2823722 - RNA, 16 nt, Human
uuuguuuuuuuccaac

SEQ ID NO: 2823723 - RNA, 22 nt, Human
uuuguuuuuuuccaacuguguu

SEQ ID NO: 2823724 - RNA, 15 nt, Human
uuuguuuuuuugcca

SEQ ID NO: 2823725 - RNA, 13 nt, Human
uuuuaaaaaaaga

SEQ ID NO: 2823726 - RNA, 15 nt, Human
uuuuaaaaaaagaaa

SEQ ID NO: 2823727 - RNA, 18 nt, Human
uuuuaaaaaaagaaaaug

SEQ ID NO: 2823728 - RNA, 22 nt, Human
augugcacccaugggcucugac

SEQ ID NO: 2823729 - RNA, 13 nt, Human
augugcagcagau

SEQ ID NO: 2823730 - RNA, 18 nt, Human
augugcagcagauuggaa

SEQ ID NO: 2823731 - RNA, 20 nt, Human
augugcagcagauuggaagg

SEQ ID NO: 2823732 - RNA, 21 nt, Human
augugcagcagauuggaagga

SEQ ID NO: 2823733 - RNA, 22 nt, Human
augugcagcagauuggaaggag

SEQ ID NO: 2823734 - RNA, 13 nt, Human
uuuguuuuugcuu

SEQ ID NO: 2823735 - RNA, 16 nt, Human
uuuguuuuugcuuguu

SEQ ID NO: 2823736 - RNA, 13 nt, Human
uuuguuuuucuca

SEQ ID NO: 2823737 - RNA, 14 nt, Human
uuuguuuuucucac

SEQ ID NO: 2823738 - RNA, 13 nt, Human
uuuguuuuuaauu

SEQ ID NO: 2823739 - RNA, 14 nt, Human
uuuguuuuucauuc

SEQ ID NO: 2823740 - RNA, 14 nt, Human
uuuguuuucauggu

SEQ ID NO: 2823741 - RNA, 13 nt, Human
uuuguuuucuuug

SEQ ID NO: 2823742 - RNA, 12 nt, Human
auguguuuccau

SEQ ID NO: 2823743 - RNA, 14 nt, Human
auguguuuuagagu

SEQ ID NO: 2823744 - RNA, 15 nt, Human
auguguuuuagaugg

SEQ ID NO: 2823745 - RNA, 16 nt, Human
auguguuuuauaaaau

SEQ ID NO: 2823746 - RNA, 13 nt, Human
auguguuuuucuc

SEQ ID NO: 2823747 - RNA, 15 nt, Human
auguguuuuucucca

SEQ ID NO: 2823748 - RNA, 16 nt, Human
auguguuuuucuccag

SEQ ID NO: 2823749 - RNA, 17 nt, Human
auguguuuuucuccagu

SEQ ID NO: 2823750 - RNA, 14 nt, Human
auguguuucaaacu

SEQ ID NO: 2823751 - RNA, 14 nt, Human
auguguggccugca

SEQ ID NO: 2823752 - RNA, 16 nt, Human
augugugguggccuca

SEQ ID NO: 2823753 - RNA, 17 nt, Human
augugugguggccucag

SEQ ID NO: 2823754 - RNA, 19 nt, Human
augugugguggccucagcu

SEQ ID NO: 2823755 - RNA, 13 nt, Human
auguguguauaag

SEQ ID NO: 2823756 - RNA, 21 nt, Human
auguguguauaagugcacaca

SEQ ID NO: 2823757 - RNA, 23 nt, Human
auguguguauaagugcacacaga

SEQ ID NO: 2823758 - RNA, 19 nt, Human
auguguguagacaaauauu

SEQ ID NO: 2823759 - RNA, 13 nt, Human
auguggaaaacag

SEQ ID NO: 2823760 - RNA, 14 nt, Human
auguguguaugugu

SEQ ID NO: 2823761 - RNA, 16 nt, Human
auguguguauguguau

SEQ ID NO: 2823762 - RNA, 12 nt, Human
auguguguauau

SEQ ID NO: 2823763 - RNA, 14 nt, Human
auguguguauauau

SEQ ID NO: 2823764 - RNA, 15 nt, Human
auguguguauauaug

SEQ ID NO: 2823765 - RNA, 18 nt, Human
auguguguauauaugugu

SEQ ID NO: 2823766 - RNA, 20 nt, Human
auguguguauauauguguau

SEQ ID NO: 2823767 - RNA, 20 nt, Human
auguguguagacaaauauuu

SEQ ID NO: 2823768 - RNA, 18 nt, Human
auguugaagaauacaguu

SEQ ID NO: 2823769 - RNA, 23 nt, Human
auguuggccaccaggugccuuuc

SEQ ID NO: 2823770 - RNA, 23 nt, Human
auguuggacaccuuuagguucuu

SEQ ID NO: 2823771 - RNA, 19 nt, Human
auguugcuggacugucaua

SEQ ID NO: 2823772 - RNA, 17 nt, Human
auguuggaagagaaagc

SEQ ID NO: 2823773 - RNA, 17 nt, Human
auguuggacaccuuuag

SEQ ID NO: 2823774 - RNA, 19 nt, Human
auguuggacaccuuuaggu

SEQ ID NO: 2823775 - RNA, 22 nt, Human
auguuggacaccuuuagguucu

SEQ ID NO: 2823776 - RNA, 15 nt, Human
auguugcuggacugu

SEQ ID NO: 2823777 - RNA, 15 nt, Human
auguugcccaggcag

SEQ ID NO: 2823778 - RNA, 14 nt, Human
auguugcccaggca

SEQ ID NO: 2823779 - RNA, 13 nt, Human
auguugcccaggc

SEQ ID NO: 2823780 - RNA, 17 nt, Human
auguucacgcaacuuga

SEQ ID NO: 2823781 - RNA, 19 nt, Human
auguucacgcaacuugaaa

SEQ ID NO: 2823782 - RNA, 22 nt, Human
auguucaacuggagacacuauu

SEQ ID NO: 2823783 - RNA, 14 nt, Human
auguucaacuggag

SEQ ID NO: 2823784 - RNA, 22 nt, Human
auguuauuuguuauuuucagua

SEQ ID NO: 2823785 - RNA, 17 nt, Human
auguucaaagccacauu

SEQ ID NO: 2823786 - RNA, 18 nt, Human
auguucaaagccacauua

SEQ ID NO: 2823787 - RNA, 13 nt, Human
auguuaagcagau

SEQ ID NO: 2823788 - RNA, 17 nt, Human
auguuaauuuuuuggua

SEQ ID NO: 2823789 - RNA, 19 nt, Human
auguuaauuuuuugguaca

SEQ ID NO: 2823790 - RNA, 20 nt, Human
auguuaauuuuuugguacaa

SEQ ID NO: 2823791 - RNA, 22 nt, Human
auguuaauuuuuugguacaaaa

SEQ ID NO: 2823792 - RNA, 23 nt, Human
auguuaauuuuuugguacaaaaa

SEQ ID NO: 2823793 - RNA, 12 nt, Human
auguuaagcaga

SEQ ID NO: 2823794 - RNA, 18 nt, Human
auguuaaccaaggaaaua

SEQ ID NO: 2823795 - RNA, 12 nt, Human
auguuaaauuug

SEQ ID NO: 2823796 - RNA, 14 nt, Human
auguuaaauuugua

SEQ ID NO: 2823797 - RNA, 15 nt, Human
auguuaaauuuguaa

SEQ ID NO: 2823798 - RNA, 16 nt, Human
auguuaaauuuguaag

SEQ ID NO: 2823799 - RNA, 17 nt, Human
auguuaaauuuguaagu

SEQ ID NO: 2823800 - RNA, 18 nt, Human
auguuaaauuuguaaguu

SEQ ID NO: 2823801 - RNA, 20 nt, Human
auguuaaauuuguaaguuuc

SEQ ID NO: 2823802 - RNA, 23 nt, Human
auguuaaauuuguaaguuucagg

SEQ ID NO: 2823803 - RNA, 22 nt, Human
auguuaaauuuguaaguuucag

SEQ ID NO: 2823804 - RNA, 24 nt, Human
auguuaugacuauguaaacuacuu

SEQ ID NO: 2823805 - RNA, 18 nt, Human
auguuaugacuauguaaa

SEQ ID NO: 2823806 - RNA, 16 nt, Human
auguuaccaucuuacu

SEQ ID NO: 2823807 - RNA, 21 nt, Human
auguuaccaucuuacuugagc

SEQ ID NO: 2823808 - RNA, 17 nt, Human
auguuaucuucucaagu

SEQ ID NO: 2823809 - RNA, 15 nt, Human
augugcuguaauuua

SEQ ID NO: 2823810 - RNA, 22 nt, Human
auguuaucuucucaaguucuaa

SEQ ID NO: 2823811 - RNA, 20 nt, Human
auguuaucuucucaaguucu

SEQ ID NO: 2823812 - RNA, 21 nt, Human
auguuaucuucucaaguucua

SEQ ID NO: 2823813 - RNA, 19 nt, Human
auguuauuuucuucuaagu

SEQ ID NO: 2823814 - RNA, 15 nt, Human
auguuauuucugcaa

SEQ ID NO: 2823815 - RNA, 17 nt, Human
auguuauuucugcaaac

SEQ ID NO: 2823816 - RNA, 18 nt, Human
auguuauuucugcaaaca

SEQ ID NO: 2823817 - RNA, 20 nt, Human
auguuauuuguuauuuucag

SEQ ID NO: 2823818 - RNA, 15 nt, Human
uuuuaguagagacag

SEQ ID NO: 2823819 - RNA, 21 nt, Human
uuuuagacagucucacuuugu

SEQ ID NO: 2823820 - RNA, 23 nt, Human
uuuuaguauuuauuuauguacuu

SEQ ID NO: 2823821 - RNA, 20 nt, Human
uuuuaguauuuauuuaugua

SEQ ID NO: 2823822 - RNA, 14 nt, Human
uuuuagugcuuuug

SEQ ID NO: 2823823 - RNA, 13 nt, Human
uuuuaguccaaau

SEQ ID NO: 2823824 - RNA, 19 nt, Human
uuuuaguauuuauuuaugu

SEQ ID NO: 2823825 - RNA, 17 nt, Human
uuuuagagacuauggag

SEQ ID NO: 2823826 - RNA, 15 nt, Human
uuuuagaguaagaaa

SEQ ID NO: 2823827 - RNA, 17 nt, Human
uuuuagaguaagaaauu

SEQ ID NO: 2823828 - RNA, 14 nt, Human
uuuuaguaaucugu

SEQ ID NO: 2823829 - RNA, 15 nt, Human
uuuuaguaaucugua

SEQ ID NO: 2823830 - RNA, 16 nt, Human
uuuuaguaaucuguac

SEQ ID NO: 2823831 - RNA, 18 nt, Human
uuuuaguaaucuguacau

SEQ ID NO: 2823832 - RNA, 19 nt, Human
uuuuaguaaucuguacauu

SEQ ID NO: 2823833 - RNA, 12 nt, Human
uuuuauuaaauu

SEQ ID NO: 2823834 - RNA, 12 nt, Human
uuuuauuaagaa

SEQ ID NO: 2823835 - RNA, 15 nt, Human
uuuuauguuuagaua

SEQ ID NO: 2823836 - RNA, 12 nt, Human
uuuuauguuuga

SEQ ID NO: 2823837 - RNA, 14 nt, Human
uuuuauguuugaau

SEQ ID NO: 2823838 - RNA, 15 nt, Human
uuuuauguuugaaua

SEQ ID NO: 2823839 - RNA, 16 nt, Human
uuuuauguuugaauau

SEQ ID NO: 2823840 - RNA, 15 nt, Human
uuuuauuccuguaug

SEQ ID NO: 2823841 - RNA, 18 nt, Human
uuuuauuccuguauguug

SEQ ID NO: 2823842 - RNA, 19 nt, Human
uuuuauugaaucuauuuaa

SEQ ID NO: 2823843 - RNA, 16 nt, Human
uuuuauugacacagaa

SEQ ID NO: 2823844 - RNA, 18 nt, Human
uuuuauugacacagaaaa

SEQ ID NO: 2823845 - RNA, 12 nt, Human
uuuuauugcuag

SEQ ID NO: 2823846 - RNA, 17 nt, Human
uuuuauugcuaguauuu

SEQ ID NO: 2823847 - RNA, 19 nt, Human
uuuuauugcuaguauuuga

SEQ ID NO: 2823848 - RNA, 20 nt, Human
uuuuauugcuaguauuugaa

SEQ ID NO: 2823849 - RNA, 21 nt, Human
uuuuauugcuaguauuugaau

SEQ ID NO: 2823850 - RNA, 23 nt, Human
uuuuauugcuaguauuugaauua

SEQ ID NO: 2823851 - RNA, 15 nt, Human
uuuuaguauucauuc

SEQ ID NO: 2823852 - RNA, 20 nt, Human
uuuuauuguauaaacuauca

SEQ ID NO: 2823853 - RNA, 17 nt, Human
uuuucagcucucuguau

SEQ ID NO: 2823854 - RNA, 17 nt, Human
uuuucaggagcgcaaga

SEQ ID NO: 2823855 - RNA, 22 nt, Human
uuuucaggagcgcaagauagau

SEQ ID NO: 2823856 - RNA, 23 nt, Human
uuuucaguauuuuggagaaauua

SEQ ID NO: 2823857 - RNA, 16 nt, Human
uuuucaguauuuugga

SEQ ID NO: 2823858 - RNA, 13 nt, Human
uuuuccaaacuga

SEQ ID NO: 2823859 - RNA, 15 nt, Human
uuuuccacccuggaa

SEQ ID NO: 2823860 - RNA, 21 nt, Human
uuuucucuuagaacauuguau

SEQ ID NO: 2823861 - RNA, 18 nt, Human
uuuucuagacuuucuguu

SEQ ID NO: 2823862 - RNA, 22 nt, Human
uuuucuagccuauuuaccugca

SEQ ID NO: 2823863 - RNA, 14 nt, Human
uuuucuaguacacu

SEQ ID NO: 2823864 - RNA, 16 nt, Human
uuuucuaguuugcuca

SEQ ID NO: 2823865 - RNA, 17 nt, Human
uuuucuaguuugcucau

SEQ ID NO: 2823866 - RNA, 23 nt, Human
uuuucuaguuugcucauacuaca

SEQ ID NO: 2823867 - RNA, 13 nt, Human
uuuucuagacuuu

SEQ ID NO: 2823868 - RNA, 14 nt, Human
uuuucuagacuuuc

SEQ ID NO: 2823869 - RNA, 13 nt, Human
uuuuccagcuccu

SEQ ID NO: 2823870 - RNA, 12 nt, Human
uuuuccagcaag

SEQ ID NO: 2823871 - RNA, 13 nt, Human
uuuuccagcaagu

SEQ ID NO: 2823872 - RNA, 9 nt, Human
uuuucugaa

SEQ ID NO: 2823873 - RNA, 11 nt, Human
uuuucugauua

SEQ ID NO: 2823874 - RNA, 17 nt, Human
uuuucugauuagcuuug

SEQ ID NO: 2823875 - RNA, 18 nt, Human
uuuucugauuagcuuugu

SEQ ID NO: 2823876 - RNA, 17 nt, Human
uuuucuggaauacauga

SEQ ID NO: 2823877 - RNA, 21 nt, Human
uuuucuggaauacaugaaaua

SEQ ID NO: 2823878 - RNA, 13 nt, Human
uuuucuguuguaa

SEQ ID NO: 2823879 - RNA, 15 nt, Human
uuuucuguuguaacu

SEQ ID NO: 2823880 - RNA, 14 nt, Human
auguuuaaucuguu

SEQ ID NO: 2823881 - RNA, 17 nt, Human
auguuuaaucuguuaug

SEQ ID NO: 2823882 - RNA, 17 nt, Human
auguuggccaggcuggu

SEQ ID NO: 2823883 - RNA, 19 nt, Human
auguuggccaggcuggucu

SEQ ID NO: 2823884 - RNA, 12 nt, Human
auguuggcuggg

SEQ ID NO: 2823885 - RNA, 21 nt, Human
auguuggccaggcuggucuaa

SEQ ID NO: 2823886 - RNA, 13 nt, Human
auguuggcuggga

SEQ ID NO: 2823887 - RNA, 14 nt, Human
auguuuaaacauuu

SEQ ID NO: 2823888 - RNA, 16 nt, Human
auguuggucaggcugg

SEQ ID NO: 2823889 - RNA, 17 nt, Human
auguuggucaggcuggu

SEQ ID NO: 2823890 - RNA, 14 nt, Human
auguugguguucca

SEQ ID NO: 2823891 - RNA, 15 nt, Human
auguugguugcacuu

SEQ ID NO: 2823892 - RNA, 16 nt, Human
auguugguugcacuuu

SEQ ID NO: 2823893 - RNA, 18 nt, Human
auguugguugcacuuugu

SEQ ID NO: 2823894 - RNA, 19 nt, Human
auguugguugcacuuugua

SEQ ID NO: 2823895 - RNA, 20 nt, Human
auguugguugcacuuuguag

SEQ ID NO: 2823896 - RNA, 14 nt, Human
auguugguuuacuu

SEQ ID NO: 2823897 - RNA, 16 nt, Human
auguugguuuacuuuc

SEQ ID NO: 2823898 - RNA, 17 nt, Human
auguugguuuacuuuca

SEQ ID NO: 2823899 - RNA, 23 nt, Human
auguuuuuaaaaguuucaaugug

SEQ ID NO: 2823900 - RNA, 22 nt, Human
auguuuuuaaaaguuucaaugu

SEQ ID NO: 2823901 - RNA, 20 nt, Human
auguuuuuaaaaguuucaau

SEQ ID NO: 2823902 - RNA, 12 nt, Human
auguuuuuauac

SEQ ID NO: 2823903 - RNA, 20 nt, Human
auguuuuuauaaaaauaaau

SEQ ID NO: 2823904 - RNA, 21 nt, Human
auguuuuuauaaaaauaaaua

SEQ ID NO: 2823905 - RNA, 18 nt, Human
auguuuuuauacaaaaua

SEQ ID NO: 2823906 - RNA, 16 nt, Human
auguuuuuaugauauc

SEQ ID NO: 2823907 - RNA, 20 nt, Human
auguuuuuaugauaucccug

SEQ ID NO: 2823908 - RNA, 20 nt, Human
auguuuuuauuaagauuauu

SEQ ID NO: 2823909 - RNA, 15 nt, Human
auguuuuuauacaaa

SEQ ID NO: 2823910 - RNA, 14 nt, Human
auguuuuuauacaa

SEQ ID NO: 2823911 - RNA, 21 nt, Human
auguuuuuguuuucuuugaau

SEQ ID NO: 2823912 - RNA, 22 nt, Human
auguuuuucugccagggagcuu

SEQ ID NO: 2823913 - RNA, 21 nt, Human
auguuuuucugccagggagcu

SEQ ID NO: 2823914 - RNA, 20 nt, Human
auuaaaaaaaaagaucuguu

SEQ ID NO: 2823915 - RNA, 14 nt, Human
auuaaaaaaaaaga

SEQ ID NO: 2823916 - RNA, 22 nt, Human
auguuuuuuaaaauauuuaucu

SEQ ID NO: 2823917 - RNA, 15 nt, Human
auguuuuuucaugug

SEQ ID NO: 2823918 - RNA, 21 nt, Human
auuggagcggugggcacuguu

SEQ ID NO: 2823919 - RNA, 22 nt, Human
auuggagaaguaauccuaggga

SEQ ID NO: 2823920 - RNA, 21 nt, Human
auuggagagggcucugugcug

SEQ ID NO: 2823921 - RNA, 17 nt, Human
auuggagauagggaaag

SEQ ID NO: 2823922 - RNA, 16 nt, Human
auuggagaugcaaaua

SEQ ID NO: 2823923 - RNA, 20 nt, Human
auuggagaugccauccucuu

SEQ ID NO: 2823924 - RNA, 18 nt, Human
auuggcauggauuucugu

SEQ ID NO: 2823925 - RNA, 21 nt, Human
auuggcauggauuucugucuu

SEQ ID NO: 2823926 - RNA, 14 nt, Human
auuggcauggcuuu

SEQ ID NO: 2823927 - RNA, 23 nt, Human
auuggcauggcuuuauuuguuuu

SEQ ID NO: 2823928 - RNA, 19 nt, Human
auuggggaauuaaaaguca

SEQ ID NO: 2823929 - RNA, 18 nt, Human
auuguacuaccuguguau

SEQ ID NO: 2823930 - RNA, 16 nt, Human
auugccuuugaauguu

SEQ ID NO: 2823931 - RNA, 17 nt, Human
auugccuuugaauguua

SEQ ID NO: 2823932 - RNA, 18 nt, Human
auugccuuugaauguuaa

SEQ ID NO: 2823933 - RNA, 22 nt, Human
auugccuuugaauguuaauuuu

SEQ ID NO: 2823934 - RNA, 23 nt, Human
auugccuuuagugaucacagcag

SEQ ID NO: 2823935 - RNA, 15 nt, Human
auugccuucuuugaa

SEQ ID NO: 2823936 - RNA, 16 nt, Human
auugccuucuuugaag

SEQ ID NO: 2823937 - RNA, 17 nt, Human
auugccuucuuugaaga

SEQ ID NO: 2823938 - RNA, 18 nt, Human
auugccuucuuugaagaa

SEQ ID NO: 2823939 - RNA, 19 nt, Human
auugccuucuuugaagaag

SEQ ID NO: 2823940 - RNA, 20 nt, Human
auugccuucuuugaagaagg

SEQ ID NO: 2823941 - RNA, 21 nt, Human
auugccuucuuugaagaaggu

SEQ ID NO: 2823942 - RNA, 16 nt, Human
auuggaacagaauguu

SEQ ID NO: 2823943 - RNA, 12 nt, Human
auuggaaaugga

SEQ ID NO: 2823944 - RNA, 23 nt, Human
auuggaaauggaugcaaaguaca

SEQ ID NO: 2823945 - RNA, 14 nt, Human
auuggaaggagaca

SEQ ID NO: 2823946 - RNA, 16 nt, Human
auuggaaggagacaca

SEQ ID NO: 2823947 - RNA, 17 nt, Human
auuggaaggagacacag

SEQ ID NO: 2823948 - RNA, 18 nt, Human
auuggaaggagacacaga

SEQ ID NO: 2823949 - RNA, 19 nt, Human
auuggaaggagacacagau

SEQ ID NO: 2823950 - RNA, 20 nt, Human
auuggaaggagacacagaug

SEQ ID NO: 2823951 - RNA, 21 nt, Human
auuggaaggagacacagaugu

SEQ ID NO: 2823952 - RNA, 22 nt, Human
auuggaaggagacacagauguu

SEQ ID NO: 2823953 - RNA, 14 nt, Human
auuggaaucugaua

SEQ ID NO: 2823954 - RNA, 18 nt, Human
auuggaaucugauauacu

SEQ ID NO: 2823955 - RNA, 18 nt, Human
auugcaucaccucuguaa

SEQ ID NO: 2823956 - RNA, 22 nt, Human
auugcaucaccucuguaauuuu

SEQ ID NO: 2823957 - RNA, 21 nt, Human
auugcaucuagguaauuuuua

SEQ ID NO: 2823958 - RNA, 19 nt, Human
auugcaucucaaaauuauu

SEQ ID NO: 2823959 - RNA, 22 nt, Human
auugccuguguauggaaaaacc

SEQ ID NO: 2823960 - RNA, 11 nt, Human
auugcauugac

SEQ ID NO: 2823961 - RNA, 13 nt, Human
auugcauucuauu

SEQ ID NO: 2823962 - RNA, 14 nt, Human
auugcauucuauug

SEQ ID NO: 2823963 - RNA, 16 nt, Human
auugcauucuauugcc

SEQ ID NO: 2823964 - RNA, 17 nt, Human
auugcauucuauugccu

SEQ ID NO: 2823965 - RNA, 18 nt, Human
auugcauucuauugccuu

SEQ ID NO: 2823966 - RNA, 22 nt, Human
auugcauucuauugccuucuuu

SEQ ID NO: 2823967 - RNA, 23 nt, Human
auugcauucuauugccuucuuug

SEQ ID NO: 2823968 - RNA, 12 nt, Human
auugaaggccug

SEQ ID NO: 2823969 - RNA, 13 nt, Human
auugaaggccugg

SEQ ID NO: 2823970 - RNA, 19 nt, Human
auugaaggaagccaaauuu

SEQ ID NO: 2823971 - RNA, 20 nt, Human
auugaaggaagccaaauuua

SEQ ID NO: 2823972 - RNA, 21 nt, Human
auugaaggaagccaaauuuau

SEQ ID NO: 2823973 - RNA, 18 nt, Human
auugaaggaucaucugaa

SEQ ID NO: 2823974 - RNA, 20 nt, Human
auugaacacaaacuguaaau

SEQ ID NO: 2823975 - RNA, 19 nt, Human
auugaacacaaacuguaaa

SEQ ID NO: 2823976 - RNA, 18 nt, Human
auugaacacaaacuguaa

SEQ ID NO: 2823977 - RNA, 17 nt, Human
auugaacacaaacugua

SEQ ID NO: 2823978 - RNA, 16 nt, Human
auugaacacaaacugu

SEQ ID NO: 2823979 - RNA, 15 nt, Human
auugaacacaaacug

SEQ ID NO: 2823980 - RNA, 14 nt, Human
auugaacacaaacu

SEQ ID NO: 2823981 - RNA, 21 nt, Human
auugaaauuguacauauuugu

SEQ ID NO: 2823982 - RNA, 19 nt, Human
auugaaauugugaacucau

SEQ ID NO: 2823983 - RNA, 17 nt, Human
auugaaauuguacauau

SEQ ID NO: 2823984 - RNA, 19 nt, Human
auuccuauauccugugacu

SEQ ID NO: 2823985 - RNA, 20 nt, Human
auuccuauauccugugacug

SEQ ID NO: 2823986 - RNA, 12 nt, Human
auugaaauuaua

SEQ ID NO: 2823987 - RNA, 19 nt, Human
auugaaauuauaguuucaa

SEQ ID NO: 2823988 - RNA, 16 nt, Human
auugaaauuguacaua

SEQ ID NO: 2823989 - RNA, 13 nt, Human
auuccuacagcac

SEQ ID NO: 2823990 - RNA, 15 nt, Human
auuccuacagcacua

SEQ ID NO: 2823991 - RNA, 16 nt, Human
auuccuacagcacuac

SEQ ID NO: 2823992 - RNA, 17 nt, Human
auuccuacagcacuacu

SEQ ID NO: 2823993 - RNA, 23 nt, Human
auuccuacagcacuacugggugu

SEQ ID NO: 2823994 - RNA, 16 nt, Human
auuccuagaauuaaac

SEQ ID NO: 2823995 - RNA, 21 nt, Human
auuccuagaauuaaaccagau

SEQ ID NO: 2823996 - RNA, 14 nt, Human
auuccuaguuggug

SEQ ID NO: 2823997 - RNA, 16 nt, Human
auuccuaguuggugag

SEQ ID NO: 2823998 - RNA, 17 nt, Human
auuccuauauaguuuau

SEQ ID NO: 2823999 - RNA, 23 nt, Human
auugaauauaauauauuugugua

SEQ ID NO: 2824000 - RNA, 13 nt, Human
auugaauauugug

SEQ ID NO: 2824001 - RNA, 14 nt, Human
auugaauauugugu

SEQ ID NO: 2824002 - RNA, 15 nt, Human
auugaauauuguguu

SEQ ID NO: 2824003 - RNA, 23 nt, Human
auugaauauuguguuccuuuuua

SEQ ID NO: 2824004 - RNA, 15 nt, Human
auugaauacuuacau

SEQ ID NO: 2824005 - RNA, 16 nt, Human
auugaauacuuacauu

SEQ ID NO: 2824006 - RNA, 10 nt, Human
auugaaucua

SEQ ID NO: 2824007 - RNA, 14 nt, Human
auugaaucuauuua

SEQ ID NO: 2824008 - RNA, 16 nt, Human
auugaaucuauuuaag

SEQ ID NO: 2824009 - RNA, 16 nt, Human
auugaauguuuccaac

SEQ ID NO: 2824010 - RNA, 16 nt, Human
auugcaacaggcuggg

SEQ ID NO: 2824011 - RNA, 13 nt, Human
auugcacauuguu

SEQ ID NO: 2824012 - RNA, 14 nt, Human
auugcacauuguuc

SEQ ID NO: 2824013 - RNA, 21 nt, Human
auugcacauuguuguuuuuuu

SEQ ID NO: 2824014 - RNA, 17 nt, Human
auugcacccagcccaga

SEQ ID NO: 2824015 - RNA, 17 nt, Human
auugcacuccagccugg

SEQ ID NO: 2824016 - RNA, 13 nt, Human
auugcauaaagca

SEQ ID NO: 2824017 - RNA, 14 nt, Human
auugcauaaagcau

SEQ ID NO: 2824018 - RNA, 15 nt, Human
auugcauaaagcaua

SEQ ID NO: 2824019 - RNA, 20 nt, Human
auugcacuccagccugggug

SEQ ID NO: 2824020 - RNA, 18 nt, Human
auugcaacaggcugggcu

SEQ ID NO: 2824021 - RNA, 17 nt, Human
auugcaacaggcugggc

SEQ ID NO: 2824022 - RNA, 19 nt, Human
auugcaacaggcugggcuu

SEQ ID NO: 2824023 - RNA, 19 nt, Human
auugauguguuuauuuaua

SEQ ID NO: 2824024 - RNA, 12 nt, Human
auugauguguuu

SEQ ID NO: 2824025 - RNA, 15 nt, Human
auugcaaaauagcau

SEQ ID NO: 2824026 - RNA, 20 nt, Human
auugauuugcauugaacaca

SEQ ID NO: 2824027 - RNA, 16 nt, Human
auugauuugcauugaa

SEQ ID NO: 2824028 - RNA, 12 nt, Human
auugauuucuuu

SEQ ID NO: 2824029 - RNA, 15 nt, Human
auugauuucuuuucu

SEQ ID NO: 2824030 - RNA, 16 nt, Human
auugauuugaagaaca

SEQ ID NO: 2824031 - RNA, 14 nt, Human
auugauuugaagaa

SEQ ID NO: 2824032 - RNA, 12 nt, Human
auugauuugcau

SEQ ID NO: 2824033 - RNA, 15 nt, Human
auugauuugcauuga

SEQ ID NO: 2824034 - RNA, 13 nt, Human
auugauuugcauu

SEQ ID NO: 2824035 - RNA, 18 nt, Human
auugaaucuauuuaagua

SEQ ID NO: 2824036 - RNA, 15 nt, Human
auuucuucagggcug

SEQ ID NO: 2824037 - RNA, 17 nt, Human
auuucuucagucagaaa

SEQ ID NO: 2824038 - RNA, 18 nt, Human
auuucuucagucagaaaa

SEQ ID NO: 2824039 - RNA, 20 nt, Human
auuucuucagucagaaaacu

SEQ ID NO: 2824040 - RNA, 21 nt, Human
auuucuucagucagaaaacuu

SEQ ID NO: 2824041 - RNA, 23 nt, Human
auuucuucagucagaaaacuuua

SEQ ID NO: 2824042 - RNA, 15 nt, Human
auuucuucaaaaugu

SEQ ID NO: 2824043 - RNA, 16 nt, Human
auuucuucaaaaugua

SEQ ID NO: 2824044 - RNA, 17 nt, Human
auuucuucaaaauguau

SEQ ID NO: 2824045 - RNA, 19 nt, Human
auuucuucaaaauguauau

SEQ ID NO: 2824046 - RNA, 20 nt, Human
auuucuucaaaauguauaua

SEQ ID NO: 2824047 - RNA, 22 nt, Human
auuucuucaaaauguauauauu

SEQ ID NO: 2824048 - RNA, 21 nt, Human
auuucuucaaauccuuccaaa

SEQ ID NO: 2824049 - RNA, 13 nt, Human
auuucuucacugu

SEQ ID NO: 2824050 - RNA, 11 nt, Human
auuucuuauag

SEQ ID NO: 2824051 - RNA, 18 nt, Human
auuugaauguuaagcaga

SEQ ID NO: 2824052 - RNA, 13 nt, Human
auuugaauguuaa

SEQ ID NO: 2824053 - RNA, 16 nt, Human
auuucuuuauauuuau

SEQ ID NO: 2824054 - RNA, 19 nt, Human
auuucuuuauauuuaucca

SEQ ID NO: 2824055 - RNA, 21 nt, Human
auuucuuuauauuuauccacu

SEQ ID NO: 2824056 - RNA, 22 nt, Human
auuucuuuauauuuauccacua

SEQ ID NO: 2824057 - RNA, 20 nt, Human
auuucuugguaagaagccgg

SEQ ID NO: 2824058 - RNA, 14 nt, Human
auuucuugcgagcc

SEQ ID NO: 2824059 - RNA, 21 nt, Human
auuucuugcucuaucucucaa

SEQ ID NO: 2824060 - RNA, 19 nt, Human
auuucuugguaagaagccg

SEQ ID NO: 2824061 - RNA, 18 nt, Human
auuugaauuuuaaaucua

SEQ ID NO: 2824062 - RNA, 20 nt, Human
auuugaauuuuaaaucuaaa

SEQ ID NO: 2824063 - RNA, 14 nt, Human
auuucgugagcccc

SEQ ID NO: 2824064 - RNA, 19 nt, Human
auuugaauguuaagcagau

SEQ ID NO: 2824065 - RNA, 15 nt, Human
auuugaauuaaaacu

SEQ ID NO: 2824066 - RNA, 17 nt, Human
auuugaauuaaaacuuc

SEQ ID NO: 2824067 - RNA, 19 nt, Human
auuugaauuaaaacuucuu

SEQ ID NO: 2824068 - RNA, 20 nt, Human
auuugaauuaaaacuucuua

SEQ ID NO: 2824069 - RNA, 21 nt, Human
auuugaauuaaaacuucuuaa

SEQ ID NO: 2824070 - RNA, 15 nt, Human
auuugagcagggcuc

SEQ ID NO: 2824071 - RNA, 14 nt, Human
auuugagacuauuu

SEQ ID NO: 2824072 - RNA, 15 nt, Human
auuugaugccaggac

SEQ ID NO: 2824073 - RNA, 16 nt, Human
auuugaugcuguuuga

SEQ ID NO: 2824074 - RNA, 23 nt, Human
auuugaugcuguuugacaaaguu

SEQ ID NO: 2824075 - RNA, 11 nt, Human
auuuggagacu

SEQ ID NO: 2824076 - RNA, 21 nt, Human
auuuggagacacaacuauuuu

SEQ ID NO: 2824077 - RNA, 17 nt, Human
auuuggagacucugugg

SEQ ID NO: 2824078 - RNA, 21 nt, Human
auuuggaggaaaaaaagcaug

SEQ ID NO: 2824079 - RNA, 21 nt, Human
auuuguaaguuucaggugaca

SEQ ID NO: 2824080 - RNA, 19 nt, Human
auuuguacagaauuuugga

SEQ ID NO: 2824081 - RNA, 21 nt, Human
auuuguacauaguuauuuauu

SEQ ID NO: 2824082 - RNA, 16 nt, Human
auuuguaauuaaauua

SEQ ID NO: 2824083 - RNA, 20 nt, Human
auuugguuuggccaucucug

SEQ ID NO: 2824084 - RNA, 22 nt, Human
auuugguuuggccaucucugga

SEQ ID NO: 2824085 - RNA, 21 nt, Human
auuugguucauuaauucuaua

SEQ ID NO: 2824086 - RNA, 16 nt, Human
auuugguucauuaauu

SEQ ID NO: 2824087 - RNA, 15 nt, Human
auuuggcaguuuggu

SEQ ID NO: 2824088 - RNA, 16 nt, Human
auuuggcaguuuggua

SEQ ID NO: 2824089 - RNA, 17 nt, Human
auuuauuuuccuaaaga

SEQ ID NO: 2824090 - RNA, 16 nt, Human
auuuauuuuccuaaag

SEQ ID NO: 2824091 - RNA, 15 nt, Human
auuuauuuuccuaaa

SEQ ID NO: 2824092 - RNA, 13 nt, Human
auuuauuuuauga

SEQ ID NO: 2824093 - RNA, 16 nt, Human
auuuauuuuaugagaa

SEQ ID NO: 2824094 - RNA, 17 nt, Human
auuuauuuuaugagaaa

SEQ ID NO: 2824095 - RNA, 18 nt, Human
auuuauuuuaugagaaau

SEQ ID NO: 2824096 - RNA, 20 nt, Human
auuuauuuuaugagaaaugu

SEQ ID NO: 2824097 - RNA, 16 nt, Human
auuuauuguuuaugua

SEQ ID NO: 2824098 - RNA, 17 nt, Human
auuuauuguuuauguaa

SEQ ID NO: 2824099 - RNA, 19 nt, Human
auuuauuguuuauguaaau

SEQ ID NO: 2824100 - RNA, 21 nt, Human
auuuauuguuuauguaaaugu

SEQ ID NO: 2824101 - RNA, 19 nt, Human
auuuauuuuccuaaagaga

SEQ ID NO: 2824102 - RNA, 16 nt, Human
auuuauuuucuuuuga

SEQ ID NO: 2824103 - RNA, 23 nt, Human
auuuauuuucuuuugaauuguuu

SEQ ID NO: 2824104 - RNA, 13 nt, Human
auuuauuuuguaa

SEQ ID NO: 2824105 - RNA, 14 nt, Human
auuuauuuuguaau

SEQ ID NO: 2824106 - RNA, 15 nt, Human
auuuauuuuguaauu

SEQ ID NO: 2824107 - RNA, 16 nt, Human
auuuauuuuguaauua

SEQ ID NO: 2824108 - RNA, 19 nt, Human
auuuauuuuguaauuauga

SEQ ID NO: 2824109 - RNA, 14 nt, Human
auuuauuuuuacaa

SEQ ID NO: 2824110 - RNA, 18 nt, Human
auuuauuuuuacaagaag

SEQ ID NO: 2824111 - RNA, 15 nt, Human
auuuauuuuucaguu

SEQ ID NO: 2824112 - RNA, 16 nt, Human
auuuauuuuucaguuc

SEQ ID NO: 2824113 - RNA, 18 nt, Human
auuuauuuuucaguucca

SEQ ID NO: 2824114 - RNA, 19 nt, Human
auuuauuuuucaguuccaa

SEQ ID NO: 2824115 - RNA, 20 nt, Human
auuuauuuuucaguuccaag

SEQ ID NO: 2824116 - RNA, 22 nt, Human
auuuauuuuucaguuccaagaa

SEQ ID NO: 2824117 - RNA, 23 nt, Human
auuuauuuuucaguuccaagaaa

SEQ ID NO: 2824118 - RNA, 19 nt, Human
auuuauuuuuuacauuauu

SEQ ID NO: 2824119 - RNA, 14 nt, Human
auuuauuuuuuaca

SEQ ID NO: 2824120 - RNA, 18 nt, Human
auuuauuuuuuacauuau

SEQ ID NO: 2824121 - RNA, 21 nt, Human
auuuauuuuucucaugaaucu

SEQ ID NO: 2824122 - RNA, 23 nt, Human
auuuccauguccccucccagagc

SEQ ID NO: 2824123 - RNA, 20 nt, Human
auuuccauguccccucccag

SEQ ID NO: 2824124 - RNA, 14 nt, Human
auuucaugugucaa

SEQ ID NO: 2824125 - RNA, 22 nt, Human
auuucaugugucaacuucaaca

SEQ ID NO: 2824126 - RNA, 11 nt, Human
auuucauucca

SEQ ID NO: 2824127 - RNA, 12 nt, Human
auuucauuccau

SEQ ID NO: 2824128 - RNA, 13 nt, Human
auuucauuccauu

SEQ ID NO: 2824129 - RNA, 16 nt, Human
auuucauuccauugcc

SEQ ID NO: 2824130 - RNA, 17 nt, Human
auuucauuccauugccu

SEQ ID NO: 2824131 - RNA, 18 nt, Human
auuucauuccauugccua

SEQ ID NO: 2824132 - RNA, 14 nt, Human
auuucauguggcug

SEQ ID NO: 2824133 - RNA, 16 nt, Human
auuucauguggcugua

SEQ ID NO: 2824134 - RNA, 14 nt, Human
auuucaaaaauaua

SEQ ID NO: 2824135 - RNA, 15 nt, Human
auuucaaaaauauaa

SEQ ID NO: 2824136 - RNA, 17 nt, Human
auuucaaaaauauaacu

SEQ ID NO: 2824137 - RNA, 18 nt, Human
auuucaaaaauauaacuu

SEQ ID NO: 2824138 - RNA, 19 nt, Human
auuucaaaaauauaacuua

SEQ ID NO: 2824139 - RNA, 18 nt, Human
auuucaugcuaucucugu

SEQ ID NO: 2824140 - RNA, 17 nt, Human
auuucaugcucugcaaa

SEQ ID NO: 2824141 - RNA, 20 nt, Human
auuucaugcucugcaaaagg

SEQ ID NO: 2824142 - RNA, 11 nt, Human
auuucuuaggg

SEQ ID NO: 2824143 - RNA, 22 nt, Human
auuucuuauacgcuuuucuuug

SEQ ID NO: 2824144 - RNA, 14 nt, Human
auuucuaaaaucuu

SEQ ID NO: 2824145 - RNA, 21 nt, Human
auuucuaaagauaauauuacu

SEQ ID NO: 2824146 - RNA, 21 nt, Human
auuucuaaaaaacagaggcca

SEQ ID NO: 2824147 - RNA, 14 nt, Human
auuucuaaaaagau

SEQ ID NO: 2824148 - RNA, 20 nt, Human
auuucuaaaaagauuagcaa

SEQ ID NO: 2824149 - RNA, 12 nt, Human
auuucuaaaaga

SEQ ID NO: 2824150 - RNA, 20 nt, Human
auuucgguugagaauggaaa

SEQ ID NO: 2824151 - RNA, 21 nt, Human
auuucgccguugaagaggaag

SEQ ID NO: 2824152 - RNA, 19 nt, Human
auuuccuuuuuuguuauua

SEQ ID NO: 2824153 - RNA, 20 nt, Human
auuucuaaaaaacagaggcc

SEQ ID NO: 2824154 - RNA, 14 nt, Human
auuucuaaaaaaca

SEQ ID NO: 2824155 - RNA, 23 nt, Human
auuuccuugaauguggcuugaga

SEQ ID NO: 2824156 - RNA, 15 nt, Human
auuuccuugugcaaa

SEQ ID NO: 2824157 - RNA, 14 nt, Human
auuuccuugaaugu

SEQ ID NO: 2824158 - RNA, 14 nt, Human
auuuccuggauguu

SEQ ID NO: 2824159 - RNA, 15 nt, Human
auuuccuggauguuu

SEQ ID NO: 2824160 - RNA, 13 nt, Human
auuuccuccuggc

SEQ ID NO: 2824161 - RNA, 19 nt, Human
auuuccucagcuuaucucu

SEQ ID NO: 2824162 - RNA, 21 nt, Human
auuuccucagcuuaucucuuu

SEQ ID NO: 2824163 - RNA, 24 nt, Human
auuuccauuuggggauauugucau

SEQ ID NO: 2824164 - RNA, 18 nt, Human
auuuccuaucaccuauuu

SEQ ID NO: 2824165 - RNA, 23 nt, Human
auuuauugauuccuuuuuucaaa

SEQ ID NO: 2824166 - RNA, 18 nt, Human
auuuauugaagaaacaga

SEQ ID NO: 2824167 - RNA, 16 nt, Human
auuuauugcacauugu

SEQ ID NO: 2824168 - RNA, 17 nt, Human
auuuauugcacauuguu

SEQ ID NO: 2824169 - RNA, 19 nt, Human
auuuauugcacauuguuca

SEQ ID NO: 2824170 - RNA, 20 nt, Human
auuuauugcacauuguucaa

SEQ ID NO: 2824171 - RNA, 22 nt, Human
auuuauugcagaggauguucau

SEQ ID NO: 2824172 - RNA, 24 nt, Human
auuuauugcagaggauguucauaa

SEQ ID NO: 2824173 - RNA, 18 nt, Human
auuguuuuaucaugacau

SEQ ID NO: 2824174 - RNA, 15 nt, Human
auuguuuugcacuuu

SEQ ID NO: 2824175 - RNA, 14 nt, Human
auuguuuugaauau

SEQ ID NO: 2824176 - RNA, 15 nt, Human
auuguuuugaauauu

SEQ ID NO: 2824177 - RNA, 17 nt, Human
auuguuuugaauauuac

SEQ ID NO: 2824178 - RNA, 22 nt, Human
auuguuuugaauauuacuccua

SEQ ID NO: 2824179 - RNA, 15 nt, Human
auuguuuucuauuua

SEQ ID NO: 2824180 - RNA, 18 nt, Human
auuguuuucuauuuaugc

SEQ ID NO: 2824181 - RNA, 21 nt, Human
auuguuuucuauuuaugccuu

SEQ ID NO: 2824182 - RNA, 22 nt, Human
auuguuuucuauuuaugccuug

SEQ ID NO: 2824183 - RNA, 19 nt, Human
auuguuuucuuuaaagaug

SEQ ID NO: 2824184 - RNA, 11 nt, Human
auuguuuuucu

SEQ ID NO: 2824185 - RNA, 16 nt, Human
auuuaaaagauucauu

SEQ ID NO: 2824186 - RNA, 14 nt, Human
auuguuuuucuuuc

SEQ ID NO: 2824187 - RNA, 15 nt, Human
auuguuuuucuuucu

SEQ ID NO: 2824188 - RNA, 19 nt, Human
auuguuuuucuuucuacaa

SEQ ID NO: 2824189 - RNA, 18 nt, Human
auuuaaaagauucauuuu

SEQ ID NO: 2824190 - RNA, 19 nt, Human
auuuaaaagauucauuuuu

SEQ ID NO: 2824191 - RNA, 18 nt, Human
auuguacucaauggauuu

SEQ ID NO: 2824192 - RNA, 22 nt, Human
auuguacucaauggauuugaug

SEQ ID NO: 2824193 - RNA, 15 nt, Human
auuguaggugcaaga

SEQ ID NO: 2824194 - RNA, 15 nt, Human
auuguaggugcaagc

SEQ ID NO: 2824195 - RNA, 15 nt, Human
auuguuuuagagacu

SEQ ID NO: 2824196 - RNA, 19 nt, Human
auuguuuuagagacuaugg

SEQ ID NO: 2824197 - RNA, 13 nt, Human
auuguuuuaucau

SEQ ID NO: 2824198 - RNA, 10 nt, Human
auuguuuuca

SEQ ID NO: 2824199 - RNA, 16 nt, Human
auuuacauguauuauu

SEQ ID NO: 2824200 - RNA, 19 nt, Human
auuuacauguauuauuuca

SEQ ID NO: 2824201 - RNA, 22 nt, Human
auuuacauguauuauuucauua

SEQ ID NO: 2824202 - RNA, 15 nt, Human
auuuacuaagccaca

SEQ ID NO: 2824203 - RNA, 13 nt, Human
auuuacuaaacau

SEQ ID NO: 2824204 - RNA, 14 nt, Human
auuuacuaaacaua

SEQ ID NO: 2824205 - RNA, 15 nt, Human
auuuacuaaacauau

SEQ ID NO: 2824206 - RNA, 16 nt, Human
auuuacuaaacauaug

SEQ ID NO: 2824207 - RNA, 19 nt, Human
auuuacuaaacauaugauu

SEQ ID NO: 2824208 - RNA, 22 nt, Human
auuuacuaaacauaugauuuca

SEQ ID NO: 2824209 - RNA, 15 nt, Human
auuuacuacaguagu

SEQ ID NO: 2824210 - RNA, 14 nt, Human
auuuacuacaguuu

SEQ ID NO: 2824211 - RNA, 18 nt, Human
auuuacuaccuuaucacu

SEQ ID NO: 2824212 - RNA, 12 nt, Human
auuuacuauaua

SEQ ID NO: 2824213 - RNA, 14 nt, Human
auuuacuauauaua

SEQ ID NO: 2824214 - RNA, 23 nt, Human
auuuacuaagccacaagaaauuu

SEQ ID NO: 2824215 - RNA, 21 nt, Human
auuuacuaagccacaagaaau

SEQ ID NO: 2824216 - RNA, 22 nt, Human
auuuacuaagccacaagaaauu

SEQ ID NO: 2824217 - RNA, 23 nt, Human
auuuaaauauaauucuguaaaug

SEQ ID NO: 2824218 - RNA, 20 nt, Human
auuuaaauaucugaacauuu

SEQ ID NO: 2824219 - RNA, 23 nt, Human
auuuaaauaucugaacauuuacu

SEQ ID NO: 2824220 - RNA, 18 nt, Human
auuuaaauauaauucugu

SEQ ID NO: 2824221 - RNA, 19 nt, Human
auuuaaauauaauucugua

SEQ ID NO: 2824222 - RNA, 20 nt, Human
auuuaaauauaauucuguaa

SEQ ID NO: 2824223 - RNA, 22 nt, Human
auuuaaauauaauucuguaaau

SEQ ID NO: 2824224 - RNA, 13 nt, Human
auuuaaauauaau

SEQ ID NO: 2824225 - RNA, 15 nt, Human
auuuaaauauaauuc

SEQ ID NO: 2824226 - RNA, 17 nt, Human
auuuaaaauugcuaugu

SEQ ID NO: 2824227 - RNA, 21 nt, Human
auuuaaaauugcuauguuacu

SEQ ID NO: 2824228 - RNA, 15 nt, Human
auuuaaauguguaca

SEQ ID NO: 2824229 - RNA, 16 nt, Human
auuuaaauguguacaa

SEQ ID NO: 2824230 - RNA, 24 nt, Human
auuuaaauguguacaauguacaca

SEQ ID NO: 2824231 - RNA, 14 nt, Human
auuuacacugccau

SEQ ID NO: 2824232 - RNA, 19 nt, Human
auuuacagaugaauguauu

SEQ ID NO: 2824233 - RNA, 23 nt, Human
auuuacagccagugggagauguu

SEQ ID NO: 2824234 - RNA, 14 nt, Human
auuuacagaacaaa

SEQ ID NO: 2824235 - RNA, 18 nt, Human
auuuacaguccuucaaaa

SEQ ID NO: 2824236 - RNA, 13 nt, Human
auuuagaaaaaag

SEQ ID NO: 2824237 - RNA, 18 nt, Human
auuuagaaaaaaguuuac

SEQ ID NO: 2824238 - RNA, 13 nt, Human
auuuaguuauagu

SEQ ID NO: 2824239 - RNA, 14 nt, Human
auuuaguuauaguu

SEQ ID NO: 2824240 - RNA, 16 nt, Human
auuuaguuauaguuuc

SEQ ID NO: 2824241 - RNA, 13 nt, Human
auuuaguuauuga

SEQ ID NO: 2824242 - RNA, 22 nt, Human
auuuaugucuauuuaagccuca

SEQ ID NO: 2824243 - RNA, 22 nt, Human
auuuaugugugaggagcugcug

SEQ ID NO: 2824244 - RNA, 14 nt, Human
auuuauguuaaaag

SEQ ID NO: 2824245 - RNA, 16 nt, Human
auuuauguuaaaagau

SEQ ID NO: 2824246 - RNA, 19 nt, Human
auuuaugugugaggagcug

SEQ ID NO: 2824247 - RNA, 18 nt, Human
auuuaugugugaggagcu

SEQ ID NO: 2824248 - RNA, 13 nt, Human
auuuaugugugag

SEQ ID NO: 2824249 - RNA, 16 nt, Human
auuuauguaacuugaa

SEQ ID NO: 2824250 - RNA, 18 nt, Human
auuuauguaaugaaguaa

SEQ ID NO: 2824251 - RNA, 19 nt, Human
auuuauguaaugaaguaaa

SEQ ID NO: 2824252 - RNA, 21 nt, Human
auuuauguaaugaaguaaagc

SEQ ID NO: 2824253 - RNA, 13 nt, Human
auuuauaacucau

SEQ ID NO: 2824254 - RNA, 17 nt, Human
auuuauaaaugagcaaa

SEQ ID NO: 2824255 - RNA, 15 nt, Human
auuuauaaaauuaga

SEQ ID NO: 2824256 - RNA, 19 nt, Human
auuuauaaaauuagaaagc

SEQ ID NO: 2824257 - RNA, 21 nt, Human
auuuauaaaauuagaaagcaa

SEQ ID NO: 2824258 - RNA, 15 nt, Human
auuuauaaacagaca

SEQ ID NO: 2824259 - RNA, 17 nt, Human
auuuauaaacagacaau

SEQ ID NO: 2824260 - RNA, 21 nt, Human
auuuauaaacagacaauaugu

SEQ ID NO: 2824261 - RNA, 23 nt, Human
auuuauaaacagacaauauguga

SEQ ID NO: 2824262 - RNA, 15 nt, Human
aaaagaaaauuuuug

SEQ ID NO: 2824263 - RNA, 11 nt, Human
aaaagaaaaug

SEQ ID NO: 2824264 - RNA, 19 nt, Human
aaaagaaaaugaaaaacaa

SEQ ID NO: 2824265 - RNA, 22 nt, Human
aaaagaaaaugaaaaacaacca

SEQ ID NO: 2824266 - RNA, 13 nt, Human
aaaagaaaaacca

SEQ ID NO: 2824267 - RNA, 14 nt, Human
aaaagaaaaaccac

SEQ ID NO: 2824268 - RNA, 21 nt, Human
aaaagaaaaaccacucccagu

SEQ ID NO: 2824269 - RNA, 15 nt, Human
aaaagaaaaauaaua

SEQ ID NO: 2824270 - RNA, 10 nt, Human
aaaagaaaau

SEQ ID NO: 2824271 - RNA, 12 nt, Human
aaaagaaaauaa

SEQ ID NO: 2824272 - RNA, 16 nt, Human
aaaagaaaagucaagg

SEQ ID NO: 2824273 - RNA, 17 nt, Human
aaaagaacacuagaguc

SEQ ID NO: 2824274 - RNA, 11 nt, Human
aaaagaagaag

SEQ ID NO: 2824275 - RNA, 13 nt, Human
aaaagaaauaaua

SEQ ID NO: 2824276 - RNA, 14 nt, Human
aaaagaaauaauaa

SEQ ID NO: 2824277 - RNA, 15 nt, Human
aaaagaaauaauaau

SEQ ID NO: 2824278 - RNA, 14 nt, Human
aaaagaaaugacua

SEQ ID NO: 2824279 - RNA, 15 nt, Human
aaaagaaaugacuaa

SEQ ID NO: 2824280 - RNA, 13 nt, Human
aaaagaaaugaug

SEQ ID NO: 2824281 - RNA, 14 nt, Human
aaaagaauauucag

SEQ ID NO: 2824282 - RNA, 21 nt, Human
aaaagaauauucagagaauau

SEQ ID NO: 2824283 - RNA, 12 nt, Human
aaaagacauguu

SEQ ID NO: 2824284 - RNA, 18 nt, Human
aaaagacauguuguaaau

SEQ ID NO: 2824285 - RNA, 13 nt, Human
aaaagacagggcu

SEQ ID NO: 2824286 - RNA, 15 nt, Human
aaaacaccuagcuuu

SEQ ID NO: 2824287 - RNA, 21 nt, Human
aaaacaccgcuucugccuuuu

SEQ ID NO: 2824288 - RNA, 22 nt, Human
aaaacaccgcuucugccuuuuc

SEQ ID NO: 2824289 - RNA, 22 nt, Human
aaaacaccuagcuuuauucuuc

SEQ ID NO: 2824290 - RNA, 21 nt, Human
aaaacacuaaaaauaaaaaug

SEQ ID NO: 2824291 - RNA, 13 nt, Human
aaaacacugugga

SEQ ID NO: 2824292 - RNA, 14 nt, Human
aaaacacuguggaa

SEQ ID NO: 2824293 - RNA, 23 nt, Human
aaaacacuguggaacuaauaaau

SEQ ID NO: 2824294 - RNA, 20 nt, Human
aaaacacugaaaaauuauac

SEQ ID NO: 2824295 - RNA, 18 nt, Human
aaaacacugccaucuuag

SEQ ID NO: 2824296 - RNA, 17 nt, Human
aaaacacuucuguccug

SEQ ID NO: 2824297 - RNA, 19 nt, Human
aaaacacuucuguccugug

SEQ ID NO: 2824298 - RNA, 18 nt, Human
aaaacagaacaucauuag

SEQ ID NO: 2824299 - RNA, 21 nt, Human
aaaacagaacaucauuagaac

SEQ ID NO: 2824300 - RNA, 22 nt, Human
aaaacagaacaucauuagaaca

SEQ ID NO: 2824301 - RNA, 15 nt, Human
aaaacuuuucucaga

SEQ ID NO: 2824302 - RNA, 15 nt, Human
aaaacuuuucugcug

SEQ ID NO: 2824303 - RNA, 12 nt, Human
aaaagaaaaaaa

SEQ ID NO: 2824304 - RNA, 13 nt, Human
aaaacuuuuaaac

SEQ ID NO: 2824305 - RNA, 14 nt, Human
aaaacuuuuaaacu

SEQ ID NO: 2824306 - RNA, 17 nt, Human
aaaagaaaaaaaaaaga

SEQ ID NO: 2824307 - RNA, 21 nt, Human
aaaagaaaaaaaaaagaagaa

SEQ ID NO: 2824308 - RNA, 11 nt, Human
aaaagaaaaaa

SEQ ID NO: 2824309 - RNA, 18 nt, Human
aaaacagcucugcaggcu

SEQ ID NO: 2824310 - RNA, 19 nt, Human
aaaacagcugcauuagaaa

SEQ ID NO: 2824311 - RNA, 23 nt, Human
aaaacagcugucucuaacuuauu

SEQ ID NO: 2824312 - RNA, 24 nt, Human
aaaacuuugacgagucaccuucca

SEQ ID NO: 2824313 - RNA, 11 nt, Human
aaaacuuugga

SEQ ID NO: 2824314 - RNA, 13 nt, Human
aaaacuuuucuca

SEQ ID NO: 2824315 - RNA, 13 nt, Human
aaaagacucuuuu

SEQ ID NO: 2824316 - RNA, 12 nt, Human
aaaagagaagaa

SEQ ID NO: 2824317 - RNA, 13 nt, Human
aaaagagaagaag

SEQ ID NO: 2824318 - RNA, 15 nt, Human
aaaagagaagaagaa

SEQ ID NO: 2824319 - RNA, 17 nt, Human
aaaagagaagaagaaaa

SEQ ID NO: 2824320 - RNA, 18 nt, Human
aaaagagaagaagaaaaa

SEQ ID NO: 2824321 - RNA, 14 nt, Human
aaaagacuucccua

SEQ ID NO: 2824322 - RNA, 20 nt, Human
aaaagacuucccuaacacuu

SEQ ID NO: 2824323 - RNA, 14 nt, Human
aaaagagaauuaga

SEQ ID NO: 2824324 - RNA, 18 nt, Human
aaaagagaauuagauuau

SEQ ID NO: 2824325 - RNA, 23 nt, Human
aaaagagaauuagauuauauugg

SEQ ID NO: 2824326 - RNA, 21 nt, Human
aaaagagagcagagaauauaa

SEQ ID NO: 2824327 - RNA, 22 nt, Human
aaaagagagcagagaauauaac

SEQ ID NO: 2824328 - RNA, 12 nt, Human
aaaagaggaaaa

SEQ ID NO: 2824329 - RNA, 15 nt, Human
aaaagagauugagau

SEQ ID NO: 2824330 - RNA, 15 nt, Human
aaaagaggagcacuu

SEQ ID NO: 2824331 - RNA, 15 nt, Human
aaaagagucuuccaa

SEQ ID NO: 2824332 - RNA, 17 nt, Human
aaaagagucuuccaauu

SEQ ID NO: 2824333 - RNA, 23 nt, Human
aaaagaucuguuuugaaggcaaa

SEQ ID NO: 2824334 - RNA, 15 nt, Human
aaaagucacuuacua

SEQ ID NO: 2824335 - RNA, 15 nt, Human
aaaaucagccagaca

SEQ ID NO: 2824336 - RNA, 12 nt, Human
aaaaguuguuca

SEQ ID NO: 2824337 - RNA, 13 nt, Human
aaaaguuguucaa

SEQ ID NO: 2824338 - RNA, 15 nt, Human
aaaaguuguucaacu

SEQ ID NO: 2824339 - RNA, 18 nt, Human
aaaaguuguucaacuauu

SEQ ID NO: 2824340 - RNA, 13 nt, Human
aaaagugacacag

SEQ ID NO: 2824341 - RNA, 14 nt, Human
aaaagugacacagc

SEQ ID NO: 2824342 - RNA, 15 nt, Human
aaaagugacacagca

SEQ ID NO: 2824343 - RNA, 17 nt, Human
aaaagugacacagcagc

SEQ ID NO: 2824344 - RNA, 16 nt, Human
aaaaguuggacuaaau

SEQ ID NO: 2824345 - RNA, 20 nt, Human
aaaaguuggacuaaaugccu

SEQ ID NO: 2824346 - RNA, 23 nt, Human
aaaaguuggacuaaaugccuagu

SEQ ID NO: 2824347 - RNA, 13 nt, Human
aaaauaaaaaugg

SEQ ID NO: 2824348 - RNA, 13 nt, Human
aaaauaaaacaaa

SEQ ID NO: 2824349 - RNA, 14 nt, Human
aaaauaaaacaaag

SEQ ID NO: 2824350 - RNA, 15 nt, Human
aaaagucguuuucca

SEQ ID NO: 2824351 - RNA, 16 nt, Human
aaaagucguuuuccaa

SEQ ID NO: 2824352 - RNA, 19 nt, Human
aaaagucguuuuccaaacu

SEQ ID NO: 2824353 - RNA, 22 nt, Human
aaaagucguuuuccaaacugac

SEQ ID NO: 2824354 - RNA, 23 nt, Human
aaaagucguuuuccaaacugacu

SEQ ID NO: 2824355 - RNA, 17 nt, Human
aaaagugaaugaaagau

SEQ ID NO: 2824356 - RNA, 20 nt, Human
aaaagugaaugaaagauuaa

SEQ ID NO: 2824357 - RNA, 14 nt, Human
aaaagucacaaugu

SEQ ID NO: 2824358 - RNA, 15 nt, Human
aaaagucacaauguu

SEQ ID NO: 2824359 - RNA, 16 nt, Human
aaaagucacaauguuc

SEQ ID NO: 2824360 - RNA, 19 nt, Human
aaaagucacaauguucuuu

SEQ ID NO: 2824361 - RNA, 19 nt, Human
aaaagucagacugcuggga

SEQ ID NO: 2824362 - RNA, 13 nt, Human
aaaaguccaauuu

SEQ ID NO: 2824363 - RNA, 18 nt, Human
aaaaguccaauuuuaauu

SEQ ID NO: 2824364 - RNA, 22 nt, Human
aaaaguccaauuuuaauuuagu

SEQ ID NO: 2824365 - RNA, 19 nt, Human
aaaaguauuuugaaguuua

SEQ ID NO: 2824366 - RNA, 20 nt, Human
aaaaguauuuugaaguuuac

SEQ ID NO: 2824367 - RNA, 22 nt, Human
aaaaguauuuugaaguuuacau

SEQ ID NO: 2824368 - RNA, 23 nt, Human
aaaaguauuuugaaguuuacauu

SEQ ID NO: 2824369 - RNA, 14 nt, Human
aaagcauugcuguu

SEQ ID NO: 2824370 - RNA, 18 nt, Human
aaagcauugcuguuaugu

SEQ ID NO: 2824371 - RNA, 17 nt, Human
aaagcauugcuuuuauu

SEQ ID NO: 2824372 - RNA, 21 nt, Human
aaagcauugcuuuuauuuuga

SEQ ID NO: 2824373 - RNA, 22 nt, Human
aaagcauugcuuuuauuuugaa

SEQ ID NO: 2824374 - RNA, 13 nt, Human
aaagccugcaauu

SEQ ID NO: 2824375 - RNA, 18 nt, Human
aaagccugcaauuucaua

SEQ ID NO: 2824376 - RNA, 16 nt, Human
aaagccucugcugcca

SEQ ID NO: 2824377 - RNA, 13 nt, Human
aaagaaaaaaaau

SEQ ID NO: 2824378 - RNA, 19 nt, Human
aaagaaaaaaaaaagaaga

SEQ ID NO: 2824379 - RNA, 20 nt, Human
aaagaaaaaaaaaagaagaa

SEQ ID NO: 2824380 - RNA, 21 nt, Human
aaagaaaaaaaaaagaagaag

SEQ ID NO: 2824381 - RNA, 22 nt, Human
aaagaaaaaaaaaagaagaaga

SEQ ID NO: 2824382 - RNA, 10 nt, Human
aaagaaaaaa

SEQ ID NO: 2824383 - RNA, 13 nt, Human
aaagaucuguuuu

SEQ ID NO: 2824384 - RNA, 16 nt, Human
aaagaucuguuuugaa

SEQ ID NO: 2824385 - RNA, 15 nt, Human
aaagaucuacaugaa

SEQ ID NO: 2824386 - RNA, 16 nt, Human
aaagaucuacaugaau

SEQ ID NO: 2824387 - RNA, 20 nt, Human
aaagaucaaaauaaaaagug

SEQ ID NO: 2824388 - RNA, 14 nt, Human
aaagaucaaaauaa

SEQ ID NO: 2824389 - RNA, 15 nt, Human
aaagaucaaaauaaa

SEQ ID NO: 2824390 - RNA, 16 nt, Human
aaagaucaaaauaaaa

SEQ ID NO: 2824391 - RNA, 17 nt, Human
aaagaucaaaauaaaaa

SEQ ID NO: 2824392 - RNA, 13 nt, Human
aaaaucuauucug

SEQ ID NO: 2824393 - RNA, 14 nt, Human
aaaaucuauucugu

SEQ ID NO: 2824394 - RNA, 16 nt, Human
aaacucuuaucucagu

SEQ ID NO: 2824395 - RNA, 13 nt, Human
aaacucuuaucuc

SEQ ID NO: 2824396 - RNA, 15 nt, Human
aaacucuuaucucag

SEQ ID NO: 2824397 - RNA, 13 nt, Human
aaacugcaguccu

SEQ ID NO: 2824398 - RNA, 23 nt, Human
aaacugcauaagugaaaaucuua

SEQ ID NO: 2824399 - RNA, 9 nt, Human
aaagaaaaa

SEQ ID NO: 2824400 - RNA, 11 nt, Human
aaagaaaaaaa

SEQ ID NO: 2824401 - RNA, 19 nt, Human
aaaccaguguagccuugcc

SEQ ID NO: 2824402 - RNA, 20 nt, Human
aaaccaguuuagauuucaag

SEQ ID NO: 2824403 - RNA, 23 nt, Human
aaaccaguuuagauuucaagaaa

SEQ ID NO: 2824404 - RNA, 15 nt, Human
aaacccaauccaaau

SEQ ID NO: 2824405 - RNA, 13 nt, Human
aaacccacaaaaa

SEQ ID NO: 2824406 - RNA, 17 nt, Human
aaaccauuuuuaaagua

SEQ ID NO: 2824407 - RNA, 16 nt, Human
aaauauuuauuaaaua

SEQ ID NO: 2824408 - RNA, 18 nt, Human
aaauauuuauuaaauaaa

SEQ ID NO: 2824409 - RNA, 22 nt, Human
aaauauuuauuaaauaaaauca

SEQ ID NO: 2824410 - RNA, 23 nt, Human
aaauauuuauuaaauaaaaucaa

SEQ ID NO: 2824411 - RNA, 15 nt, Human
aaauauuuauuuauu

SEQ ID NO: 2824412 - RNA, 12 nt, Human
aaauauuuaucu

SEQ ID NO: 2824413 - RNA, 10 nt, Human
aaauauuuau

SEQ ID NO: 2824414 - RNA, 19 nt, Human
aaauauuuugauaauaaau

SEQ ID NO: 2824415 - RNA, 20 nt, Human
aaauauuuugauaauaaauu

SEQ ID NO: 2824416 - RNA, 21 nt, Human
aaauauuuugauaauaaauug

SEQ ID NO: 2824417 - RNA, 22 nt, Human
aaauauuuguacauaguuauuu

SEQ ID NO: 2824418 - RNA, 17 nt, Human
aaauauuugacuauucu

SEQ ID NO: 2824419 - RNA, 18 nt, Human
aaauauuugacuugcaug

SEQ ID NO: 2824420 - RNA, 20 nt, Human
aaauauuugacuugcaugaa

SEQ ID NO: 2824421 - RNA, 12 nt, Human
aaauauuuggag

SEQ ID NO: 2824422 - RNA, 17 nt, Human
aaauauuuggucucuau

SEQ ID NO: 2824423 - RNA, 21 nt, Human
aaauauuuggucucuauuuca

SEQ ID NO: 2824424 - RNA, 15 nt, Human
aaauauuuguacaua

SEQ ID NO: 2824425 - RNA, 14 nt, Human
aaauauuuguacau

SEQ ID NO: 2824426 - RNA, 17 nt, Human
aaauauuuuuaaaagau

SEQ ID NO: 2824427 - RNA, 14 nt, Human
aaauauuuuuagua

SEQ ID NO: 2824428 - RNA, 18 nt, Human
aaauagaguguaguuuac

SEQ ID NO: 2824429 - RNA, 14 nt, Human
aaauagaguguagu

SEQ ID NO: 2824430 - RNA, 19 nt, Human
aaauagaguauaugcacuu

SEQ ID NO: 2824431 - RNA, 17 nt, Human
aaauagaguauaugcac

SEQ ID NO: 2824432 - RNA, 20 nt, Human
aaauagagcuuuuaaaaaug

SEQ ID NO: 2824433 - RNA, 15 nt, Human
aaauagauaauuaaa

SEQ ID NO: 2824434 - RNA, 14 nt, Human
aaauagauacaaau

SEQ ID NO: 2824435 - RNA, 19 nt, Human
aaauagaguuugcuauuag

SEQ ID NO: 2824436 - RNA, 16 nt, Human
aaauagaugucuuuua

SEQ ID NO: 2824437 - RNA, 18 nt, Human
aaauagaugucuuuuaua

SEQ ID NO: 2824438 - RNA, 21 nt, Human
aaauagaugucuuuuauagug

SEQ ID NO: 2824439 - RNA, 13 nt, Human
aaauagcaaaacu

SEQ ID NO: 2824440 - RNA, 14 nt, Human
aaauauuuaaaaau

SEQ ID NO: 2824441 - RNA, 17 nt, Human
aaauauuguugacaacu

SEQ ID NO: 2824442 - RNA, 21 nt, Human
aaauauuguugacaacuguga

SEQ ID NO: 2824443 - RNA, 23 nt, Human
aaaucucaaauuuggauugcuaa

SEQ ID NO: 2824444 - RNA, 16 nt, Human
aaaucaaaacaaguga

SEQ ID NO: 2824445 - RNA, 21 nt, Human
aaaucaaaacucacaagugcu

SEQ ID NO: 2824446 - RNA, 15 nt, Human
aaauauuuuuuacag

SEQ ID NO: 2824447 - RNA, 22 nt, Human
aaauauuuuuuauauauacagu

SEQ ID NO: 2824448 - RNA, 17 nt, Human
aaaucucaccccauccc

SEQ ID NO: 2824449 - RNA, 11 nt, Human
aaaucucauac

SEQ ID NO: 2824450 - RNA, 23 nt, Human
aaaucucauacucccccacaguu

SEQ ID NO: 2824451 - RNA, 22 nt, Human
aaaucuuuuaaaaauucaaaug

SEQ ID NO: 2824452 - RNA, 13 nt, Human
aaaugcuuugcuu

SEQ ID NO: 2824453 - RNA, 18 nt, Human
aaaugcuucacuguacgu

SEQ ID NO: 2824454 - RNA, 19 nt, Human
aaaugcuucacuguacgua

SEQ ID NO: 2824455 - RNA, 19 nt, Human
aaauggauauuauuagaaa

SEQ ID NO: 2824456 - RNA, 17 nt, Human
aaauggaugcaaaguac

SEQ ID NO: 2824457 - RNA, 17 nt, Human
aaauggaugccuugaau

SEQ ID NO: 2824458 - RNA, 21 nt, Human
aaauggaugccuugaauaaua

SEQ ID NO: 2824459 - RNA, 22 nt, Human
aaauggaugccuugaauaauaa

SEQ ID NO: 2824460 - RNA, 23 nt, Human
aaauggaugccuugaauaauaag

SEQ ID NO: 2824461 - RNA, 11 nt, Human
aaaucuuuuac

SEQ ID NO: 2824462 - RNA, 16 nt, Human
aaaugcuguguugggu

SEQ ID NO: 2824463 - RNA, 17 nt, Human
aaagccuguaagccugc

SEQ ID NO: 2824464 - RNA, 22 nt, Human
aaagccuguaagccugcaagcc

SEQ ID NO: 2824465 - RNA, 16 nt, Human
aaaggauguugguguu

SEQ ID NO: 2824466 - RNA, 22 nt, Human
aaagcauuaauuuuuuuucauu

SEQ ID NO: 2824467 - RNA, 18 nt, Human
aaaggauucauguggaau

SEQ ID NO: 2824468 - RNA, 13 nt, Human
aaaggaugugauu

SEQ ID NO: 2824469 - RNA, 21 nt, Human
aaauguucagaagguugcucu

SEQ ID NO: 2824470 - RNA, 15 nt, Human
aaauguucagaaggu

SEQ ID NO: 2824471 - RNA, 23 nt, Human
aaauguugaauaaaaauauguac

SEQ ID NO: 2824472 - RNA, 20 nt, Human
aaauguugacauaccuuuua

SEQ ID NO: 2824473 - RNA, 22 nt, Human
aaauguugacauaccuuuuauu

SEQ ID NO: 2824474 - RNA, 19 nt, Human
aaauguugagaaucccaaa

SEQ ID NO: 2824475 - RNA, 14 nt, Human
aaauguuugacaca

SEQ ID NO: 2824476 - RNA, 21 nt, Human
aaauguuugucucaguuggaa

SEQ ID NO: 2824477 - RNA, 20 nt, Human
aaauguuuguuaaaaauaaa

SEQ ID NO: 2824478 - RNA, 18 nt, Human
aaauguuuuagcaauuua

SEQ ID NO: 2824479 - RNA, 14 nt, Human
aaauguuuuauaag

SEQ ID NO: 2824480 - RNA, 22 nt, Human
aaauguuuuauaaguucacaaa

SEQ ID NO: 2824481 - RNA, 16 nt, Human
aaauguuuuucugcca

SEQ ID NO: 2824482 - RNA, 23 nt, Human
aaauguuuuucugccagggagcu

SEQ ID NO: 2824483 - RNA, 21 nt, Human
aaauguuuuucugccagggag

SEQ ID NO: 2824484 - RNA, 13 nt, Human
aaauggccauuug

SEQ ID NO: 2824485 - RNA, 15 nt, Human
aaauggauacuacau

SEQ ID NO: 2824486 - RNA, 21 nt, Human
aaauggauacuacaucuuuaa

SEQ ID NO: 2824487 - RNA, 17 nt, Human
aaauggcaaguuuugau

SEQ ID NO: 2824488 - RNA, 16 nt, Human
aaauggcagugaugaa

SEQ ID NO: 2824489 - RNA, 11 nt, Human
aacagccaugc

SEQ ID NO: 2824490 - RNA, 16 nt, Human
aacagccaugcccgca

SEQ ID NO: 2824491 - RNA, 18 nt, Human
aacagccacuccccucca

SEQ ID NO: 2824492 - RNA, 15 nt, Human
aacagccacuccccu

SEQ ID NO: 2824493 - RNA, 12 nt, Human
aacagccaacag

SEQ ID NO: 2824494 - RNA, 15 nt, Human
aacagccaacagcua

SEQ ID NO: 2824495 - RNA, 17 nt, Human
aacagccuauuccugaa

SEQ ID NO: 2824496 - RNA, 13 nt, Human
aacagccucacuu

SEQ ID NO: 2824497 - RNA, 11 nt, Human
aacaggcagau

SEQ ID NO: 2824498 - RNA, 15 nt, Human
aacaucuucaacaug

SEQ ID NO: 2824499 - RNA, 16 nt, Human
aacaucuucaacaugu

SEQ ID NO: 2824500 - RNA, 20 nt, Human
aacaucuuugacacucugca

SEQ ID NO: 2824501 - RNA, 22 nt, Human
aacaucuuugacacucugcaga

SEQ ID NO: 2824502 - RNA, 21 nt, Human
aacaucuuuuuaaccugcaaa

SEQ ID NO: 2824503 - RNA, 13 nt, Human
aacaugaaacacc

SEQ ID NO: 2824504 - RNA, 20 nt, Human
aacaugaaagucuagaaaua

SEQ ID NO: 2824505 - RNA, 12 nt, Human
aacaugaaauga

SEQ ID NO: 2824506 - RNA, 14 nt, Human
aacaugaaaugaua

SEQ ID NO: 2824507 - RNA, 18 nt, Human
aacaugaaaugauagauu

SEQ ID NO: 2824508 - RNA, 13 nt, Human
aacaugacacuga

SEQ ID NO: 2824509 - RNA, 14 nt, Human
aacaugacacugac

SEQ ID NO: 2824510 - RNA, 19 nt, Human
aacaugacauuuaccagca

SEQ ID NO: 2824511 - RNA, 22 nt, Human
aacaugacauuuaccagcaacu

SEQ ID NO: 2824512 - RNA, 20 nt, Human
aacaugaacacccuuagaaa

SEQ ID NO: 2824513 - RNA, 22 nt, Human
aacaugaacacccuuagaaaau

SEQ ID NO: 2824514 - RNA, 12 nt, Human
aaccuuuuuaaa

SEQ ID NO: 2824515 - RNA, 16 nt, Human
aaccuuuuuccuagua

SEQ ID NO: 2824516 - RNA, 22 nt, Human
aacaugguaaacgcugucccua

SEQ ID NO: 2824517 - RNA, 18 nt, Human
aacauggugucuggauuc

SEQ ID NO: 2824518 - RNA, 21 nt, Human
aacaugggcucuucacuagug

SEQ ID NO: 2824519 - RNA, 17 nt, Human
aacccucaggggaaaac

SEQ ID NO: 2824520 - RNA, 22 nt, Human
aacccucaggggaaaacuguua

SEQ ID NO: 2824521 - RNA, 23 nt, Human
aacccucaggggaaaacuguuac

SEQ ID NO: 2824522 - RNA, 19 nt, Human
aacccucagagccaccccu

SEQ ID NO: 2824523 - RNA, 12 nt, Human
aacccucagagc

SEQ ID NO: 2824524 - RNA, 23 nt, Human
aaccgugagcaggaaggccuggg

SEQ ID NO: 2824525 - RNA, 18 nt, Human
aaccguuuugaagcuacu

SEQ ID NO: 2824526 - RNA, 17 nt, Human
aaccguuuugaagcuac

SEQ ID NO: 2824527 - RNA, 17 nt, Human
aaugaugcccugcucca

SEQ ID NO: 2824528 - RNA, 18 nt, Human
aaugaugcccugcuccag

SEQ ID NO: 2824529 - RNA, 17 nt, Human
aaugauggcaauuuugu

SEQ ID NO: 2824530 - RNA, 14 nt, Human
aaugauggcaauuu

SEQ ID NO: 2824531 - RNA, 19 nt, Human
aaugauggcaauuuuguaa

SEQ ID NO: 2824532 - RNA, 21 nt, Human
aaugauggcagugguuugaaa

SEQ ID NO: 2824533 - RNA, 18 nt, Human
aaugauggcaauuuugua

SEQ ID NO: 2824534 - RNA, 22 nt, Human
aaugaugguaggaagaagcucu

SEQ ID NO: 2824535 - RNA, 13 nt, Human
aaugaaagaugau

SEQ ID NO: 2824536 - RNA, 12 nt, Human
aaugaaagauua

SEQ ID NO: 2824537 - RNA, 13 nt, Human
aaugaaagauuaa

SEQ ID NO: 2824538 - RNA, 15 nt, Human
aaugaaagauuaaac

SEQ ID NO: 2824539 - RNA, 16 nt, Human
aaugaaagauuaaaca

SEQ ID NO: 2824540 - RNA, 20 nt, Human
aaugaaagauuaaacagaug

SEQ ID NO: 2824541 - RNA, 15 nt, Human
aaugaagcagcuuua

SEQ ID NO: 2824542 - RNA, 17 nt, Human
aaugaagcagcuuuaaa

SEQ ID NO: 2824543 - RNA, 13 nt, Human
aaugaagccagcu

SEQ ID NO: 2824544 - RNA, 19 nt, Human
aaugaagcagcuuuaaaca

SEQ ID NO: 2824545 - RNA, 22 nt, Human
aaugaagcagcuuuaaacaaau

SEQ ID NO: 2824546 - RNA, 13 nt, Human
aaucucaccccau

SEQ ID NO: 2824547 - RNA, 16 nt, Human
aaucucaauccugcag

SEQ ID NO: 2824548 - RNA, 19 nt, Human
aaucucaaugaagccagcu

SEQ ID NO: 2824549 - RNA, 16 nt, Human
aaucucaaggaaucuu

SEQ ID NO: 2824550 - RNA, 21 nt, Human
aaucucaaggaaucuuuaagc

SEQ ID NO: 2824551 - RNA, 23 nt, Human
aaucucagagguagggcugccac

SEQ ID NO: 2824552 - RNA, 22 nt, Human
aaucucagagguagggcugcca

SEQ ID NO: 2824553 - RNA, 22 nt, Human
aaucucaccccaucccacaccc

SEQ ID NO: 2824554 - RNA, 15 nt, Human
aaucugaucugagug

SEQ ID NO: 2824555 - RNA, 17 nt, Human
aaucugauggcuucucc

SEQ ID NO: 2824556 - RNA, 18 nt, Human
aaucugaagcuucacuca

SEQ ID NO: 2824557 - RNA, 14 nt, Human
aauauguguuuacu

SEQ ID NO: 2824558 - RNA, 21 nt, Human
aauauuaaaucugcuggaguu

SEQ ID NO: 2824559 - RNA, 13 nt, Human
aauauuaaaucug

SEQ ID NO: 2824560 - RNA, 22 nt, Human
aauaugucucgcuagugauguu

SEQ ID NO: 2824561 - RNA, 11 nt, Human
aauaugucugc

SEQ ID NO: 2824562 - RNA, 14 nt, Human
aauaugugagauuu

SEQ ID NO: 2824563 - RNA, 16 nt, Human
aauaugugagauuuuu

SEQ ID NO: 2824564 - RNA, 18 nt, Human
aauaugugagauuuuuua

SEQ ID NO: 2824565 - RNA, 19 nt, Human
aauaugugagauuuuuuau

SEQ ID NO: 2824566 - RNA, 21 nt, Human
aauaugugagauuuuuuauug

SEQ ID NO: 2824567 - RNA, 22 nt, Human
aauaugugagauuuuuuauugc

SEQ ID NO: 2824568 - RNA, 21 nt, Human
aauaugugagugccuuuugca

SEQ ID NO: 2824569 - RNA, 19 nt, Human
aauauauauauauaucagu

SEQ ID NO: 2824570 - RNA, 21 nt, Human
aauauauauauauaucaguuu

SEQ ID NO: 2824571 - RNA, 23 nt, Human
aauauauauauauaucaguuuga

SEQ ID NO: 2824572 - RNA, 20 nt, Human
aauauguauuguaaacaugu

SEQ ID NO: 2824573 - RNA, 19 nt, Human
aauauauacgaacaaaaca

SEQ ID NO: 2824574 - RNA, 12 nt, Human
aauauauauaaa

SEQ ID NO: 2824575 - RNA, 20 nt, Human
aauauauagcuggcaagaau

SEQ ID NO: 2824576 - RNA, 10 nt, Human
aauauauaua

SEQ ID NO: 2824577 - RNA, 13 nt, Human
aauauauauaaag

SEQ ID NO: 2824578 - RNA, 16 nt, Human
aauauauauaaagaau

SEQ ID NO: 2824579 - RNA, 19 nt, Human
aauauauauaaagaauaua

SEQ ID NO: 2824580 - RNA, 22 nt, Human
aauauauauaaagaauauauau

SEQ ID NO: 2824581 - RNA, 12 nt, Human
aauauauauaca

SEQ ID NO: 2824582 - RNA, 13 nt, Human
aauauauauacau

SEQ ID NO: 2824583 - RNA, 14 nt, Human
aauauauauacaua

SEQ ID NO: 2824584 - RNA, 15 nt, Human
aauauauauacauau

SEQ ID NO: 2824585 - RNA, 16 nt, Human
aauauauauacauaug

SEQ ID NO: 2824586 - RNA, 17 nt, Human
aauauauauacauaugu

SEQ ID NO: 2824587 - RNA, 19 nt, Human
aauauauauacauauguag

SEQ ID NO: 2824588 - RNA, 22 nt, Human
aauauauauagugcuauauaua

SEQ ID NO: 2824589 - RNA, 11 nt, Human
aauauauauau

SEQ ID NO: 2824590 - RNA, 13 nt, Human
aauauauauauau

SEQ ID NO: 2824591 - RNA, 16 nt, Human
aauauauaaaaauaua

SEQ ID NO: 2824592 - RNA, 17 nt, Human
aauauauaaaaauauau

SEQ ID NO: 2824593 - RNA, 19 nt, Human
aauauauaaaaauauauau

SEQ ID NO: 2824594 - RNA, 20 nt, Human
aauauauaaaaauauauaua

SEQ ID NO: 2824595 - RNA, 14 nt, Human
aauauauaauuuau

SEQ ID NO: 2824596 - RNA, 18 nt, Human
aauauauacgaacaaaac

SEQ ID NO: 2824597 - RNA, 23 nt, Human
aaucaauguucacgcaacuugaa

SEQ ID NO: 2824598 - RNA, 22 nt, Human
aaucaaugcuauaacuauguug

SEQ ID NO: 2824599 - RNA, 22 nt, Human
aauauuuuuugaggcuaaagaa

SEQ ID NO: 2824600 - RNA, 14 nt, Human
aaucaaaaauugaa

SEQ ID NO: 2824601 - RNA, 17 nt, Human
aaucaaaaauugaagag

SEQ ID NO: 2824602 - RNA, 14 nt, Human
aaucaaaacaagug

SEQ ID NO: 2824603 - RNA, 14 nt, Human
aauauuaccuaaug

SEQ ID NO: 2824604 - RNA, 18 nt, Human
aauauuaccuaaugaaag

SEQ ID NO: 2824605 - RNA, 19 nt, Human
aauauuaccuaaugaaagu

SEQ ID NO: 2824606 - RNA, 22 nt, Human
aauauuacucaguuuauguugu

SEQ ID NO: 2824607 - RNA, 17 nt, Human
aauauuacuccuauuuu

SEQ ID NO: 2824608 - RNA, 20 nt, Human
aauauuacuccuauuuuugu

SEQ ID NO: 2824609 - RNA, 20 nt, Human
aauauuacuguuuauuucug

SEQ ID NO: 2824610 - RNA, 13 nt, Human
aaucaaugaauau

SEQ ID NO: 2824611 - RNA, 14 nt, Human
aaucaaugaauauu

SEQ ID NO: 2824612 - RNA, 16 nt, Human
aaucaaugaauauuga

SEQ ID NO: 2824613 - RNA, 19 nt, Human
aaucaaugaauauugaagu

SEQ ID NO: 2824614 - RNA, 22 nt, Human
aaucaaugaauauugaaguuuc

SEQ ID NO: 2824615 - RNA, 22 nt, Human
aaucaaugcaagagugauugca

SEQ ID NO: 2824616 - RNA, 15 nt, Human
aaucaauaaagaaaa

SEQ ID NO: 2824617 - RNA, 15 nt, Human
aaucaaguuguaacu

SEQ ID NO: 2824618 - RNA, 22 nt, Human
aaucaaguuguaacuuauauug

SEQ ID NO: 2824619 - RNA, 23 nt, Human
aaucaaguuuuaagugaaaguga

SEQ ID NO: 2824620 - RNA, 23 nt, Human
aaucaaguuggcuucuaaucaaa

SEQ ID NO: 2824621 - RNA, 17 nt, Human
aaucaaagccagggucu

SEQ ID NO: 2824622 - RNA, 14 nt, Human
aaucaaauaaguau

SEQ ID NO: 2824623 - RNA, 15 nt, Human
aaucaaauaaguauu

SEQ ID NO: 2824624 - RNA, 16 nt, Human
aaucaaauaaguauuu

SEQ ID NO: 2824625 - RNA, 18 nt, Human
aaucaaauaaguauuuau

SEQ ID NO: 2824626 - RNA, 21 nt, Human
aaguugaauggccugccuuga

SEQ ID NO: 2824627 - RNA, 20 nt, Human
aaguugaaagaguccuauuu

SEQ ID NO: 2824628 - RNA, 16 nt, Human
aaguggcuauuucuuu

SEQ ID NO: 2824629 - RNA, 12 nt, Human
aagugcugggau

SEQ ID NO: 2824630 - RNA, 22 nt, Human
aaguggaccuuaggccuuccuc

SEQ ID NO: 2824631 - RNA, 18 nt, Human
aaguggacuggccccugg

SEQ ID NO: 2824632 - RNA, 20 nt, Human
aaguggacuggccccugggu

SEQ ID NO: 2824633 - RNA, 14 nt, Human
aaguggcauguuuu

SEQ ID NO: 2824634 - RNA, 16 nt, Human
aaguggcauguuuugu

SEQ ID NO: 2824635 - RNA, 22 nt, Human
aaguggcauguuuugugcauuu

SEQ ID NO: 2824636 - RNA, 23 nt, Human
aagugcuggcaaccacuaagaau

SEQ ID NO: 2824637 - RNA, 22 nt, Human
aagugcuggcaaccacuaagaa

SEQ ID NO: 2824638 - RNA, 22 nt, Human
aaguggcaaucucagaugcagu

SEQ ID NO: 2824639 - RNA, 14 nt, Human
aaguuggacuaaau

SEQ ID NO: 2824640 - RNA, 18 nt, Human
aaguuggacuaaaugccu

SEQ ID NO: 2824641 - RNA, 22 nt, Human
aaguuggacuaaaugccuaguu

SEQ ID NO: 2824642 - RNA, 18 nt, Human
aaguuguaacuuauauug

SEQ ID NO: 2824643 - RNA, 19 nt, Human
aaguuguaacuuauauuga

SEQ ID NO: 2824644 - RNA, 12 nt, Human
aaguuguacaug

SEQ ID NO: 2824645 - RNA, 15 nt, Human
aaguuguacaugaaa

SEQ ID NO: 2824646 - RNA, 16 nt, Human
aaguuguacaugaaau

SEQ ID NO: 2824647 - RNA, 13 nt, Human
aaguuguuugcau

SEQ ID NO: 2824648 - RNA, 16 nt, Human
aaguuguagcagauug

SEQ ID NO: 2824649 - RNA, 17 nt, Human
aaguuguuugucaucuu

SEQ ID NO: 2824650 - RNA, 12 nt, Human
aaguuuaaaaca

SEQ ID NO: 2824651 - RNA, 18 nt, Human
aaguuuaaaacaguauuu

SEQ ID NO: 2824652 - RNA, 19 nt, Human
aaguuuaaaacaguauuua

SEQ ID NO: 2824653 - RNA, 16 nt, Human
aauaaaccaaaggaca

SEQ ID NO: 2824654 - RNA, 17 nt, Human
aauaaaccaaaggacau

SEQ ID NO: 2824655 - RNA, 21 nt, Human
aauaaaccaaaggacauuaug

SEQ ID NO: 2824656 - RNA, 14 nt, Human
aauaaacuucagca

SEQ ID NO: 2824657 - RNA, 13 nt, Human
aauaaacuuuuuu

SEQ ID NO: 2824658 - RNA, 15 nt, Human
aauaaacuuuuuuuc

SEQ ID NO: 2824659 - RNA, 16 nt, Human
aauaaacuuuuuuuca

SEQ ID NO: 2824660 - RNA, 17 nt, Human
aauaaacuuuuuuucaa

SEQ ID NO: 2824661 - RNA, 18 nt, Human
aauaaacuuuuuuucaau

SEQ ID NO: 2824662 - RNA, 19 nt, Human
aauaaacuuuuuuucaaug

SEQ ID NO: 2824663 - RNA, 20 nt, Human
aauaaacuuuuuuucaaugu

SEQ ID NO: 2824664 - RNA, 21 nt, Human
aauaaacuuuuuuucaaugug

SEQ ID NO: 2824665 - RNA, 23 nt, Human
aauaaacauccuucaagaacucu

SEQ ID NO: 2824666 - RNA, 13 nt, Human
aauaaacauccuu

SEQ ID NO: 2824667 - RNA, 11 nt, Human
aauaaagacag

SEQ ID NO: 2824668 - RNA, 12 nt, Human
aauaaagacagg

SEQ ID NO: 2824669 - RNA, 13 nt, Human
aauaaagaaauug

SEQ ID NO: 2824670 - RNA, 15 nt, Human
aauaaagaguuagaa

SEQ ID NO: 2824671 - RNA, 18 nt, Human
aauaaagaguuagaauga

SEQ ID NO: 2824672 - RNA, 17 nt, Human
aauaaagacaaccauau

SEQ ID NO: 2824673 - RNA, 20 nt, Human
aauaaagacaaccauauuua

SEQ ID NO: 2824674 - RNA, 13 nt, Human
aagaagaaugugu

SEQ ID NO: 2824675 - RNA, 13 nt, Human
aagaagaaaagag

SEQ ID NO: 2824676 - RNA, 14 nt, Human
aagaagaaaagaga

SEQ ID NO: 2824677 - RNA, 15 nt, Human
aagaagaaaagagaa

SEQ ID NO: 2824678 - RNA, 21 nt, Human
aagaagaaaagagaagaagaa

SEQ ID NO: 2824679 - RNA, 18 nt, Human
aagaacuuuuucuuuucc

SEQ ID NO: 2824680 - RNA, 19 nt, Human
aagaacuuuuucuuuuccc

SEQ ID NO: 2824681 - RNA, 9 nt, Human
aagaagaaa

SEQ ID NO: 2824682 - RNA, 12 nt, Human
aagaagaaaaaa

SEQ ID NO: 2824683 - RNA, 13 nt, Human
aagaagaaaaaaa

SEQ ID NO: 2824684 - RNA, 14 nt, Human
aagaagaaaaaaac

SEQ ID NO: 2824685 - RNA, 12 nt, Human
aagaagaaaaag

SEQ ID NO: 2824686 - RNA, 14 nt, Human
aagaagaaaaaggu

SEQ ID NO: 2824687 - RNA, 15 nt, Human
aagaagaaagacucu

SEQ ID NO: 2824688 - RNA, 13 nt, Human
aagaagaagggca

SEQ ID NO: 2824689 - RNA, 15 nt, Human
aagaagaacuugcau

SEQ ID NO: 2824690 - RNA, 9 nt, Human
aagaagaag

SEQ ID NO: 2824691 - RNA, 15 nt, Human
aagaagaagaaaaga

SEQ ID NO: 2824692 - RNA, 16 nt, Human
aagacaauuugauaca

SEQ ID NO: 2824693 - RNA, 17 nt, Human
aagacaauuugauacau

SEQ ID NO: 2824694 - RNA, 19 nt, Human
aagacaauuugauacauaa

SEQ ID NO: 2824695 - RNA, 20 nt, Human
aagacaauuugauacauaau

SEQ ID NO: 2824696 - RNA, 17 nt, Human
aagacacucaaauauga

SEQ ID NO: 2824697 - RNA, 13 nt, Human
aagacaccagagc

SEQ ID NO: 2824698 - RNA, 14 nt, Human
aagacaccagagca

SEQ ID NO: 2824699 - RNA, 15 nt, Human
aagacaccagagcag

SEQ ID NO: 2824700 - RNA, 16 nt, Human
aagacaccagagcaga

SEQ ID NO: 2824701 - RNA, 20 nt, Human
aagacaccagagcagaugca

SEQ ID NO: 2824702 - RNA, 21 nt, Human
aagacaccagagcagaugcag

SEQ ID NO: 2824703 - RNA, 22 nt, Human
aagacaccagagcagaugcaga

SEQ ID NO: 2824704 - RNA, 17 nt, Human
aagacaaccauauuuag

SEQ ID NO: 2824705 - RNA, 13 nt, Human
aagacaagaaaau

SEQ ID NO: 2824706 - RNA, 14 nt, Human
aagacaagaaaauc

SEQ ID NO: 2824707 - RNA, 12 nt, Human
aacgcagcccug

SEQ ID NO: 2824708 - RNA, 16 nt, Human
aacgcagcccugcuuu

SEQ ID NO: 2824709 - RNA, 17 nt, Human
aacgccuccccugcccc

SEQ ID NO: 2824710 - RNA, 14 nt, Human
aagaacuagcauaa

SEQ ID NO: 2824711 - RNA, 11 nt, Human
aagaacaugug

SEQ ID NO: 2824712 - RNA, 22 nt, Human
aagaaccaaaaguuuuccugag

SEQ ID NO: 2824713 - RNA, 20 nt, Human
aagaacucaaacuucuggcu

SEQ ID NO: 2824714 - RNA, 16 nt, Human
aagaacucaucacugu

SEQ ID NO: 2824715 - RNA, 19 nt, Human
aagaacucaucacuguggc

SEQ ID NO: 2824716 - RNA, 20 nt, Human
aagaacucaucacuguggcu

SEQ ID NO: 2824717 - RNA, 23 nt, Human
aagaacuauaugugaauccucuu

SEQ ID NO: 2824718 - RNA, 13 nt, Human
aagaaccuggaaa

SEQ ID NO: 2824719 - RNA, 17 nt, Human
aagaacugcacaugaag

SEQ ID NO: 2824720 - RNA, 19 nt, Human
aagaacugcacaugaagaa

SEQ ID NO: 2824721 - RNA, 19 nt, Human
aagaacugucauguaaaca

SEQ ID NO: 2824722 - RNA, 20 nt, Human
aagaacugucauguaaacau

SEQ ID NO: 2824723 - RNA, 22 nt, Human
aagaacugucauguaaacauac

SEQ ID NO: 2824724 - RNA, 15 nt, Human
aagaacuugcaugga

SEQ ID NO: 2824725 - RNA, 21 nt, Human
aagaacuguuuacugcuugau

SEQ ID NO: 2824726 - RNA, 15 nt, Human
aagaacuuacugauu

SEQ ID NO: 2824727 - RNA, 20 nt, Human
aagaacuuacugauuauuuu

SEQ ID NO: 2824728 - RNA, 17 nt, Human
aagacacugccugggcu

SEQ ID NO: 2824729 - RNA, 16 nt, Human
aagacacugccugggc

SEQ ID NO: 2824730 - RNA, 15 nt, Human
aagacacugccuggg

SEQ ID NO: 2824731 - RNA, 14 nt, Human
aagacacugccugg

SEQ ID NO: 2824732 - RNA, 13 nt, Human
aagacacugccug

SEQ ID NO: 2824733 - RNA, 12 nt, Human
aagacacugccu

SEQ ID NO: 2824734 - RNA, 11 nt, Human
aagacacugcc

SEQ ID NO: 2824735 - RNA, 23 nt, Human
aagacaccagagcagaugcagag

SEQ ID NO: 2824736 - RNA, 12 nt, Human
aagacagagucu

SEQ ID NO: 2824737 - RNA, 18 nt, Human
aagacauagcauccaagu

SEQ ID NO: 2824738 - RNA, 15 nt, Human
aagacauaucucuaa

SEQ ID NO: 2824739 - RNA, 16 nt, Human
aagacauaucucuaau

SEQ ID NO: 2824740 - RNA, 20 nt, Human
aagacaugauuuccuugaau

SEQ ID NO: 2824741 - RNA, 16 nt, Human
aagacaugauuuccuu

SEQ ID NO: 2824742 - RNA, 15 nt, Human
aagacaugauuuccu

SEQ ID NO: 2824743 - RNA, 14 nt, Human
aagacaugauuucc

SEQ ID NO: 2824744 - RNA, 14 nt, Human
aagacauaacguuu

SEQ ID NO: 2824745 - RNA, 18 nt, Human
aagacauaacguuuuucc

SEQ ID NO: 2824746 - RNA, 19 nt, Human
aagacauaacguuuuuccu

SEQ ID NO: 2824747 - RNA, 20 nt, Human
aagacauaacguuuuuccuu

SEQ ID NO: 2824748 - RNA, 21 nt, Human
aagacauaacguuuuuccuuu

SEQ ID NO: 2824749 - RNA, 22 nt, Human
aagacauaacguuuuuccuuua

SEQ ID NO: 2824750 - RNA, 22 nt, Human
aagacagaugccccagagcugu

SEQ ID NO: 2824751 - RNA, 20 nt, Human
aagacagaugccccagagcu

SEQ ID NO: 2824752 - RNA, 17 nt, Human
aagacagaugccccaga

SEQ ID NO: 2824753 - RNA, 16 nt, Human
aagacagaugccccag

SEQ ID NO: 2824754 - RNA, 18 nt, Human
aagaccaccacuucgaaa

SEQ ID NO: 2824755 - RNA, 19 nt, Human
aagaccaccaccucagagu

SEQ ID NO: 2824756 - RNA, 13 nt, Human
aagaccaaacuuc

SEQ ID NO: 2824757 - RNA, 17 nt, Human
aagaccacaaaaauuga

SEQ ID NO: 2824758 - RNA, 16 nt, Human
aagaccaccaccucag

SEQ ID NO: 2824759 - RNA, 21 nt, Human
aagacaugauuuccuugaaug

SEQ ID NO: 2824760 - RNA, 19 nt, Human
aagacaugcacuaugagga

SEQ ID NO: 2824761 - RNA, 12 nt, Human
aagacauuucuu

SEQ ID NO: 2824762 - RNA, 14 nt, Human
aagacauuucuuuu

SEQ ID NO: 2824763 - RNA, 15 nt, Human
aagacauuucuuuuc

SEQ ID NO: 2824764 - RNA, 21 nt, Human
aagacauuucuuuucuuuuua

SEQ ID NO: 2824765 - RNA, 22 nt, Human
aagacauuucuuuucuuuuuac

SEQ ID NO: 2824766 - RNA, 23 nt, Human
aagacauuucuuuucuuuuuaca

SEQ ID NO: 2824767 - RNA, 17 nt, Human
aagagaaaggccugcac

SEQ ID NO: 2824768 - RNA, 19 nt, Human
aagagaaaggccugcacac

SEQ ID NO: 2824769 - RNA, 12 nt, Human
aagagaaacuuu

SEQ ID NO: 2824770 - RNA, 18 nt, Human
aagagaaacuuuauacau

SEQ ID NO: 2824771 - RNA, 19 nt, Human
aagagaaacuuuauacauu

SEQ ID NO: 2824772 - RNA, 20 nt, Human
aagagaaacuuuauacauua

SEQ ID NO: 2824773 - RNA, 22 nt, Human
aagagaaacuuuauacauuagu

SEQ ID NO: 2824774 - RNA, 14 nt, Human
aagagagaaaauaa

SEQ ID NO: 2824775 - RNA, 16 nt, Human
aagagagaaaaacaaa

SEQ ID NO: 2824776 - RNA, 22 nt, Human
aagagacagucaccccaggacu

SEQ ID NO: 2824777 - RNA, 17 nt, Human
aagagacaguuauuuau

SEQ ID NO: 2824778 - RNA, 11 nt, Human
aagagaaaucu

SEQ ID NO: 2824779 - RNA, 14 nt, Human
aagagaaaucucau

SEQ ID NO: 2824780 - RNA, 19 nt, Human
aagagaccuguuuuaaaaa

SEQ ID NO: 2824781 - RNA, 12 nt, Human
aagagacucagc

SEQ ID NO: 2824782 - RNA, 14 nt, Human
aagagacucagccu

SEQ ID NO: 2824783 - RNA, 15 nt, Human
aagagacucagccug

SEQ ID NO: 2824784 - RNA, 16 nt, Human
aagagacucagccugc

SEQ ID NO: 2824785 - RNA, 17 nt, Human
aagagacucagccugca

SEQ ID NO: 2824786 - RNA, 19 nt, Human
aagagacucagccugcagu

SEQ ID NO: 2824787 - RNA, 18 nt, Human
aagagacugcguucugca

SEQ ID NO: 2824788 - RNA, 12 nt, Human
aagagagaaaaa

SEQ ID NO: 2824789 - RNA, 21 nt, Human
aagagauauguagaaggcaca

SEQ ID NO: 2824790 - RNA, 14 nt, Human
aagagauaugggaa

SEQ ID NO: 2824791 - RNA, 13 nt, Human
aagagauauuuug

SEQ ID NO: 2824792 - RNA, 22 nt, Human
aagagauauuuugggcaugugg

SEQ ID NO: 2824793 - RNA, 22 nt, Human
aagagaguauuuuuauacaaac

SEQ ID NO: 2824794 - RNA, 19 nt, Human
aagagaggaugugcaagcg

SEQ ID NO: 2824795 - RNA, 20 nt, Human
aagagaggaugugcaagcga

SEQ ID NO: 2824796 - RNA, 21 nt, Human
aagagagggccaugcaauuca

SEQ ID NO: 2824797 - RNA, 22 nt, Human
aagagagggccaugcaauucau

SEQ ID NO: 2824798 - RNA, 11 nt, Human
aagagaguuuu

SEQ ID NO: 2824799 - RNA, 19 nt, Human
aagagaguuuuuaauagaa

SEQ ID NO: 2824800 - RNA, 19 nt, Human
aagagaggagaggagagag

SEQ ID NO: 2824801 - RNA, 16 nt, Human
aagaguaguaauagag

SEQ ID NO: 2824802 - RNA, 19 nt, Human
aagaguaguugauguugca

SEQ ID NO: 2824803 - RNA, 22 nt, Human
aagaguaguugauguugcauuu

SEQ ID NO: 2824804 - RNA, 23 nt, Human
aagaguaguugauguugcauuuu

SEQ ID NO: 2824805 - RNA, 15 nt, Human
aagaguccucugaau

SEQ ID NO: 2824806 - RNA, 12 nt, Human
aagagugugugu

SEQ ID NO: 2824807 - RNA, 13 nt, Human
aagagugugugug

SEQ ID NO: 2824808 - RNA, 21 nt, Human
aagaguugccccgucucuguu

SEQ ID NO: 2824809 - RNA, 22 nt, Human
aagaguugccccgucucuguuc

SEQ ID NO: 2824810 - RNA, 22 nt, Human
aagaguguagaagcauuccuuc

SEQ ID NO: 2824811 - RNA, 14 nt, Human
aagaguguagaagc

SEQ ID NO: 2824812 - RNA, 15 nt, Human
aagaguguagaagca

SEQ ID NO: 2824813 - RNA, 16 nt, Human
aagaguguagaagcau

SEQ ID NO: 2824814 - RNA, 18 nt, Human
aagaguguagaagcauuc

SEQ ID NO: 2824815 - RNA, 24 nt, Human
aagagucuaaagauggaguuucua

SEQ ID NO: 2824816 - RNA, 13 nt, Human
aagagucuaaaga

SEQ ID NO: 2824817 - RNA, 14 nt, Human
aagagucuaaagau

SEQ ID NO: 2824818 - RNA, 12 nt, Human
aagaguguagaa

SEQ ID NO: 2824819 - RNA, 13 nt, Human
aagaguguagaag

SEQ ID NO: 2824820 - RNA, 22 nt, Human
aagcugaucauaagugaauuua

SEQ ID NO: 2824821 - RNA, 13 nt, Human
aagcugauccugc

SEQ ID NO: 2824822 - RNA, 15 nt, Human
aagcuagacagaucc

SEQ ID NO: 2824823 - RNA, 21 nt, Human
aagcuagacagauccccguuc

SEQ ID NO: 2824824 - RNA, 18 nt, Human
aaggcaaauguguacaug

SEQ ID NO: 2824825 - RNA, 12 nt, Human
aaggagaacaaa

SEQ ID NO: 2824826 - RNA, 13 nt, Human
aaggagaacaaau

SEQ ID NO: 2824827 - RNA, 14 nt, Human
aaggagaacaaaua

SEQ ID NO: 2824828 - RNA, 15 nt, Human
aaggagaacaaauau

SEQ ID NO: 2824829 - RNA, 22 nt, Human
aaggcagggagggccugggccc

SEQ ID NO: 2824830 - RNA, 19 nt, Human
aaggcagggagggccuggg

SEQ ID NO: 2824831 - RNA, 19 nt, Human
aagcuacugugugugugaa

SEQ ID NO: 2824832 - RNA, 22 nt, Human
aagcuacugugugugugaauga

SEQ ID NO: 2824833 - RNA, 23 nt, Human
aagcuacugugugugugaaugaa

SEQ ID NO: 2824834 - RNA, 15 nt, Human
aagcgugagccacug

SEQ ID NO: 2824835 - RNA, 23 nt, Human
aagcgaggcaugccugagagaca

SEQ ID NO: 2824836 - RNA, 21 nt, Human
aagcggcccuaagggaguguc

SEQ ID NO: 2824837 - RNA, 20 nt, Human
aagcggcccuaagggagugu

SEQ ID NO: 2824838 - RNA, 21 nt, Human
aagcgaugaauuuggagacuc

SEQ ID NO: 2824839 - RNA, 20 nt, Human
aagcgaugaauuuggagacu

SEQ ID NO: 2824840 - RNA, 14 nt, Human
aagcgauucuccug

SEQ ID NO: 2824841 - RNA, 15 nt, Human
aagcgauucuccugc

SEQ ID NO: 2824842 - RNA, 20 nt, Human
aagcgauucuccugccucag

SEQ ID NO: 2824843 - RNA, 16 nt, Human
aagcgauauacagaug

SEQ ID NO: 2824844 - RNA, 21 nt, Human
aagcgauauacagaugaaaau

SEQ ID NO: 2824845 - RNA, 22 nt, Human
aagcgauauacagaugaaaauu

SEQ ID NO: 2824846 - RNA, 10 nt, Human
aagccuuugu

SEQ ID NO: 2824847 - RNA, 11 nt, Human
aagccuugugu

SEQ ID NO: 2824848 - RNA, 13 nt, Human
aagccuuguguau

SEQ ID NO: 2824849 - RNA, 19 nt, Human
aagccuuguguauauuugu

SEQ ID NO: 2824850 - RNA, 21 nt, Human
aagccuuguguauauuuguau

SEQ ID NO: 2824851 - RNA, 22 nt, Human
aagccuuguguauauuuguaua

SEQ ID NO: 2824852 - RNA, 17 nt, Human
aagccuuuacugacccu

SEQ ID NO: 2824853 - RNA, 23 nt, Human
aagccuuuacugacccuggggcu

SEQ ID NO: 2824854 - RNA, 19 nt, Human
aagccuuuaguaucagugu

SEQ ID NO: 2824855 - RNA, 20 nt, Human
aagccuuuaguaucaguguu

SEQ ID NO: 2824856 - RNA, 21 nt, Human
aagccuuuaguaucaguguuu

SEQ ID NO: 2824857 - RNA, 13 nt, Human
aagauaauugcua

SEQ ID NO: 2824858 - RNA, 17 nt, Human
aagauaauugcuauuua

SEQ ID NO: 2824859 - RNA, 21 nt, Human
aagauaauugcuauuuauuuu

SEQ ID NO: 2824860 - RNA, 19 nt, Human
aagauaauuguugaaauuu

SEQ ID NO: 2824861 - RNA, 18 nt, Human
aagauacaaauuaauuuu

SEQ ID NO: 2824862 - RNA, 20 nt, Human
aagauacaaauuaauuuuac

SEQ ID NO: 2824863 - RNA, 17 nt, Human
aagaguugugcacgcag

SEQ ID NO: 2824864 - RNA, 21 nt, Human
aagccaggcagguagccaggg

SEQ ID NO: 2824865 - RNA, 12 nt, Human
aagccagggucu

SEQ ID NO: 2824866 - RNA, 19 nt, Human
aagccagggucucucccuc

SEQ ID NO: 2824867 - RNA, 20 nt, Human
aagccagggucucucccuca

SEQ ID NO: 2824868 - RNA, 21 nt, Human
aagccagggucucucccucag

SEQ ID NO: 2824869 - RNA, 23 nt, Human
aagccagggucucucccucaggu

SEQ ID NO: 2824870 - RNA, 18 nt, Human
aagccaguguugccuaag

SEQ ID NO: 2824871 - RNA, 23 nt, Human
aagccaguguugccuaaguauua

SEQ ID NO: 2824872 - RNA, 16 nt, Human
aauuggaggaaagcaa

SEQ ID NO: 2824873 - RNA, 21 nt, Human
aauugggagcuugggaaugga

SEQ ID NO: 2824874 - RNA, 14 nt, Human
aauugggaguccag

SEQ ID NO: 2824875 - RNA, 15 nt, Human
aauugggaguccagg

SEQ ID NO: 2824876 - RNA, 18 nt, Human
aauugggaguccaggcac

SEQ ID NO: 2824877 - RNA, 19 nt, Human
aauugggaguccaggcaca

SEQ ID NO: 2824878 - RNA, 21 nt, Human
aauugggaguccaggcacagg

SEQ ID NO: 2824879 - RNA, 12 nt, Human
aauucuguaaau

SEQ ID NO: 2824880 - RNA, 19 nt, Human
aauucugagacauguguca

SEQ ID NO: 2824881 - RNA, 12 nt, Human
aauucuguuuua

SEQ ID NO: 2824882 - RNA, 21 nt, Human
aauucuguuuuagguuaaaaa

SEQ ID NO: 2824883 - RNA, 23 nt, Human
aauucuguggguccgauaauauc

SEQ ID NO: 2824884 - RNA, 15 nt, Human
aauucuguuaaaauc

SEQ ID NO: 2824885 - RNA, 16 nt, Human
aauucuauaaggccau

SEQ ID NO: 2824886 - RNA, 22 nt, Human
aauucuauaaggccauaaaaca

SEQ ID NO: 2824887 - RNA, 15 nt, Human
aauucuauuaaagug

SEQ ID NO: 2824888 - RNA, 23 nt, Human
aauucuauuaaagugcuaagguu

SEQ ID NO: 2824889 - RNA, 15 nt, Human
aauucuacauuguca

SEQ ID NO: 2824890 - RNA, 22 nt, Human
aauucuagcuuugagcuuaaga

SEQ ID NO: 2824891 - RNA, 20 nt, Human
aauucucuguggaaugaaua

SEQ ID NO: 2824892 - RNA, 14 nt, Human
aauucucuuucaaa

SEQ ID NO: 2824893 - RNA, 21 nt, Human
aauucucauuugucacacacu

SEQ ID NO: 2824894 - RNA, 16 nt, Human
aauucuccugauaaaa

SEQ ID NO: 2824895 - RNA, 14 nt, Human
aauucuccugccuc

SEQ ID NO: 2824896 - RNA, 15 nt, Human
aauucuccugccuuu

SEQ ID NO: 2824897 - RNA, 16 nt, Human
aauucuccugccuuug

SEQ ID NO: 2824898 - RNA, 18 nt, Human
aauucuccugccuuugcc

SEQ ID NO: 2824899 - RNA, 16 nt, Human
aauucuccugccucag

SEQ ID NO: 2824900 - RNA, 15 nt, Human
aauucuccugccuca

SEQ ID NO: 2824901 - RNA, 13 nt, Human
aauuauauuugug

SEQ ID NO: 2824902 - RNA, 20 nt, Human
aauuauauuugugcuauagu

SEQ ID NO: 2824903 - RNA, 22 nt, Human
aauuauauuugugcuauaguau

SEQ ID NO: 2824904 - RNA, 23 nt, Human
aauuauauuugugcuauaguauu

SEQ ID NO: 2824905 - RNA, 12 nt, Human
aauuauaucugu

SEQ ID NO: 2824906 - RNA, 21 nt, Human
aauuauaucuguggucuucaa

SEQ ID NO: 2824907 - RNA, 20 nt, Human
aauuauauagguugugcaaa

SEQ ID NO: 2824908 - RNA, 21 nt, Human
aauuauauagguugugcaaau

SEQ ID NO: 2824909 - RNA, 15 nt, Human
aauuauaguuucuga

SEQ ID NO: 2824910 - RNA, 16 nt, Human
aauuauaguuucugag

SEQ ID NO: 2824911 - RNA, 17 nt, Human
aauuauaguuucugagg

SEQ ID NO: 2824912 - RNA, 21 nt, Human
aauuauaguuucugaggcuuu

SEQ ID NO: 2824913 - RNA, 21 nt, Human
aauuauaggagccuuaauuuu

SEQ ID NO: 2824914 - RNA, 13 nt, Human
aauuauaguuuca

SEQ ID NO: 2824915 - RNA, 13 nt, Human
aauuauaguuucu

SEQ ID NO: 2824916 - RNA, 14 nt, Human
aauuauaguuucug

SEQ ID NO: 2824917 - RNA, 12 nt, Human
aauuauacuaac

SEQ ID NO: 2824918 - RNA, 13 nt, Human
aauuauacaaauu

SEQ ID NO: 2824919 - RNA, 20 nt, Human
aauuauacaaauuaaaaaga

SEQ ID NO: 2824920 - RNA, 19 nt, Human
aauuauacccccugcaaag

SEQ ID NO: 2824921 - RNA, 15 nt, Human
aauucgcccgagcug

SEQ ID NO: 2824922 - RNA, 21 nt, Human
aauucgcccgagcuguuuaug

SEQ ID NO: 2824923 - RNA, 23 nt, Human
aauucgcccgagcuguuuauguu

SEQ ID NO: 2824924 - RNA, 11 nt, Human
aauuccugggc

SEQ ID NO: 2824925 - RNA, 17 nt, Human
aauuaugauggaagaca

SEQ ID NO: 2824926 - RNA, 22 nt, Human
aauuaugauggaagacaggaaa

SEQ ID NO: 2824927 - RNA, 13 nt, Human
aauuaugauuugg

SEQ ID NO: 2824928 - RNA, 15 nt, Human
aauuaugauuugggu

SEQ ID NO: 2824929 - RNA, 18 nt, Human
aauuaugcacuaaauaug

SEQ ID NO: 2824930 - RNA, 19 nt, Human
aauuaugcacuaaauauga

SEQ ID NO: 2824931 - RNA, 21 nt, Human
aauuaugggaauaauugcuuu

SEQ ID NO: 2824932 - RNA, 22 nt, Human
aauuaugggaauaauugcuuuu

SEQ ID NO: 2824933 - RNA, 15 nt, Human
aauuauguaaugcaa

SEQ ID NO: 2824934 - RNA, 18 nt, Human
aauuauguaaugcaaaau

SEQ ID NO: 2824935 - RNA, 23 nt, Human
aauuaucuauagcuaaguacaca

SEQ ID NO: 2824936 - RNA, 17 nt, Human
aauuaugaaucugauuu

SEQ ID NO: 2824937 - RNA, 21 nt, Human
aauuaugaaucugauuuuuau

SEQ ID NO: 2824938 - RNA, 12 nt, Human
aauuaugacaau

SEQ ID NO: 2824939 - RNA, 20 nt, Human
aauuaucaauaucuaauaua

SEQ ID NO: 2824940 - RNA, 14 nt, Human
aauuauccuauuuc

SEQ ID NO: 2824941 - RNA, 16 nt, Human
aauuauccuauuucag

SEQ ID NO: 2824942 - RNA, 17 nt, Human
aauuauccuauuucagu

SEQ ID NO: 2824943 - RNA, 21 nt, Human
aauuauccugaacucuucugc

SEQ ID NO: 2824944 - RNA, 22 nt, Human
aauuaucuauagcuaaguacac

SEQ ID NO: 2824945 - RNA, 15 nt, Human
aauuaucuauagcua

SEQ ID NO: 2824946 - RNA, 14 nt, Human
aauuguacauauuu

SEQ ID NO: 2824947 - RNA, 15 nt, Human
aauuguacauauuug

SEQ ID NO: 2824948 - RNA, 21 nt, Human
aauuguacauauuuguggaau

SEQ ID NO: 2824949 - RNA, 22 nt, Human
aauuguaccuuuuuuguuuuuu

SEQ ID NO: 2824950 - RNA, 18 nt, Human
aauuucauaugcuguaua

SEQ ID NO: 2824951 - RNA, 16 nt, Human
aauuucauaugcugua

SEQ ID NO: 2824952 - RNA, 15 nt, Human
aauuucauaucuaca

SEQ ID NO: 2824953 - RNA, 21 nt, Human
aauuuccacaaaaucugucca

SEQ ID NO: 2824954 - RNA, 13 nt, Human
aauuucccacccc

SEQ ID NO: 2824955 - RNA, 18 nt, Human
aauuucccacccccaccc

SEQ ID NO: 2824956 - RNA, 17 nt, Human
aauuucccuucuugcau

SEQ ID NO: 2824957 - RNA, 13 nt, Human
acaccagagccca

SEQ ID NO: 2824958 - RNA, 23 nt, Human
acaccagagcccaccuuggcuca

SEQ ID NO: 2824959 - RNA, 18 nt, Human
acaccagagcccaccuug

SEQ ID NO: 2824960 - RNA, 18 nt, Human
acacagcucuucuccagg

SEQ ID NO: 2824961 - RNA, 12 nt, Human
acacguguccug

SEQ ID NO: 2824962 - RNA, 23 nt, Human
acacguucacccaucuuaucaag

SEQ ID NO: 2824963 - RNA, 15 nt, Human
acacgugaugugaua

SEQ ID NO: 2824964 - RNA, 20 nt, Human
acacgcacgcacacacacaa

SEQ ID NO: 2824965 - RNA, 22 nt, Human
acacgccugcaaacgcugccug

SEQ ID NO: 2824966 - RNA, 16 nt, Human
acacgccuuccccuca

SEQ ID NO: 2824967 - RNA, 13 nt, Human
acacgcacgcaca

SEQ ID NO: 2824968 - RNA, 14 nt, Human
acacgcacgcacac

SEQ ID NO: 2824969 - RNA, 15 nt, Human
acacgcacgcacaca

SEQ ID NO: 2824970 - RNA, 16 nt, Human
acacgcacgcacacac

SEQ ID NO: 2824971 - RNA, 17 nt, Human
acacgcacgcacacaca

SEQ ID NO: 2824972 - RNA, 18 nt, Human
acacgcacgcacacacac

SEQ ID NO: 2824973 - RNA, 20 nt, Human
acacgcgccccccucccaga

SEQ ID NO: 2824974 - RNA, 22 nt, Human
acacgcgccccccucccagagg

SEQ ID NO: 2824975 - RNA, 23 nt, Human
acacgcgccccccucccagaggc

SEQ ID NO: 2824976 - RNA, 13 nt, Human
acacgcgcgcaca

SEQ ID NO: 2824977 - RNA, 20 nt, Human
acacgcauggucaacccuca

SEQ ID NO: 2824978 - RNA, 20 nt, Human
acacgccccaauuuucaggu

SEQ ID NO: 2824979 - RNA, 21 nt, Human
acacgccccaauuuucaggua

SEQ ID NO: 2824980 - RNA, 16 nt, Human
acacagcucuucucca

SEQ ID NO: 2824981 - RNA, 14 nt, Human
acacagcucuucuc

SEQ ID NO: 2824982 - RNA, 13 nt, Human
acacagccugggc

SEQ ID NO: 2824983 - RNA, 23 nt, Human
acacagccgauucaccugagcag

SEQ ID NO: 2824984 - RNA, 19 nt, Human
acacagccgauucaccuga

SEQ ID NO: 2824985 - RNA, 14 nt, Human
acacagcagcaguu

SEQ ID NO: 2824986 - RNA, 19 nt, Human
acacagaaaauguugagaa

SEQ ID NO: 2824987 - RNA, 22 nt, Human
acacagcagcuucaccagagca

SEQ ID NO: 2824988 - RNA, 18 nt, Human
acacagaaaauguugaga

SEQ ID NO: 2824989 - RNA, 14 nt, Human
acacacuuuuuaag

SEQ ID NO: 2824990 - RNA, 19 nt, Human
acacacuuuuuaagaaaua

SEQ ID NO: 2824991 - RNA, 17 nt, Human
acacacuuuuuauuaga

SEQ ID NO: 2824992 - RNA, 20 nt, Human
acaacuccuagggccacuga

SEQ ID NO: 2824993 - RNA, 12 nt, Human
acaacugacaca

SEQ ID NO: 2824994 - RNA, 14 nt, Human
acaacugacacagg

SEQ ID NO: 2824995 - RNA, 15 nt, Human
acaacugacacagga

SEQ ID NO: 2824996 - RNA, 16 nt, Human
acaacugacacaggaa

SEQ ID NO: 2824997 - RNA, 21 nt, Human
acaacugccucgaaacacaga

SEQ ID NO: 2824998 - RNA, 15 nt, Human
acaacugcaaagaaa

SEQ ID NO: 2824999 - RNA, 18 nt, Human
acaacugcaauaacuucu

SEQ ID NO: 2825000 - RNA, 20 nt, Human
acaacugcaauaacuucuga

SEQ ID NO: 2825001 - RNA, 21 nt, Human
acaacugcaauaacuucugac

SEQ ID NO: 2825002 - RNA, 14 nt, Human
acaacugugacugu

SEQ ID NO: 2825003 - RNA, 11 nt, Human
acaacugugac

SEQ ID NO: 2825004 - RNA, 13 nt, Human
acaacugugacug

SEQ ID NO: 2825005 - RNA, 22 nt, Human
acaacugccucgaaacacagaa

SEQ ID NO: 2825006 - RNA, 17 nt, Human
acaacugucuaacuuua

SEQ ID NO: 2825007 - RNA, 19 nt, Human
acaacugucuaacuuuaga

SEQ ID NO: 2825008 - RNA, 18 nt, Human
acaaguguauaucagaaa

SEQ ID NO: 2825009 - RNA, 19 nt, Human
acaaguguauaucagaaaa

SEQ ID NO: 2825010 - RNA, 20 nt, Human
acaaguguauaucagaaaag

SEQ ID NO: 2825011 - RNA, 17 nt, Human
acaagugccgcaaauug

SEQ ID NO: 2825012 - RNA, 18 nt, Human
acaagugccgcaaauugu

SEQ ID NO: 2825013 - RNA, 20 nt, Human
acaagugccgcaaauuguac

SEQ ID NO: 2825014 - RNA, 23 nt, Human
acaagugccgcaaauuguaccuu

SEQ ID NO: 2825015 - RNA, 15 nt, Human
acaaggucauggcca

SEQ ID NO: 2825016 - RNA, 17 nt, Human
acaaggucauggccaca

SEQ ID NO: 2825017 - RNA, 19 nt, Human
acaaggucauggccacacu

SEQ ID NO: 2825018 - RNA, 20 nt, Human
acaaggucauggccacacug

SEQ ID NO: 2825019 - RNA, 21 nt, Human
acaaggucauggccacacugu

SEQ ID NO: 2825020 - RNA, 23 nt, Human
acaaggucauggccacacuguga

SEQ ID NO: 2825021 - RNA, 24 nt, Human
acaaggucauggccacacugugac

SEQ ID NO: 2825022 - RNA, 21 nt, Human
acaagguaccccuuucuggcu

SEQ ID NO: 2825023 - RNA, 18 nt, Human
acaaggggcuguuacaua

SEQ ID NO: 2825024 - RNA, 21 nt, Human
acaaggggcuguuacauaaca

SEQ ID NO: 2825025 - RNA, 13 nt, Human
acaacuuagugua

SEQ ID NO: 2825026 - RNA, 14 nt, Human
acaacuuaguguaa

SEQ ID NO: 2825027 - RNA, 21 nt, Human
acaagggcugaccugccucuc

SEQ ID NO: 2825028 - RNA, 16 nt, Human
acaaacuguguacaua

SEQ ID NO: 2825029 - RNA, 21 nt, Human
acaaacuuuaggguaaaaauu

SEQ ID NO: 2825030 - RNA, 15 nt, Human
acaacauuuugagaa

SEQ ID NO: 2825031 - RNA, 18 nt, Human
acaacauuuugagaacaa

SEQ ID NO: 2825032 - RNA, 21 nt, Human
acaaccaagcgcauccaaucu

SEQ ID NO: 2825033 - RNA, 14 nt, Human
acaaccauuccaga

SEQ ID NO: 2825034 - RNA, 16 nt, Human
acaaccauauuuagca

SEQ ID NO: 2825035 - RNA, 21 nt, Human
acaaccaauuuacacugccau

SEQ ID NO: 2825036 - RNA, 14 nt, Human
acaaacuggagucu

SEQ ID NO: 2825037 - RNA, 18 nt, Human
acaaacuguaaaaaaugu

SEQ ID NO: 2825038 - RNA, 13 nt, Human
acaaacuguaaau

SEQ ID NO: 2825039 - RNA, 15 nt, Human
acaaacucucugaac

SEQ ID NO: 2825040 - RNA, 23 nt, Human
acaaacuacuugauuuuauugua

SEQ ID NO: 2825041 - RNA, 22 nt, Human
acaaacucucugaaccccuccc

SEQ ID NO: 2825042 - RNA, 13 nt, Human
acaaacucuugaa

SEQ ID NO: 2825043 - RNA, 20 nt, Human
acaaacucaccaucugugca

SEQ ID NO: 2825044 - RNA, 14 nt, Human
acaaacaucacucu

SEQ ID NO: 2825045 - RNA, 12 nt, Human
acaaacauugug

SEQ ID NO: 2825046 - RNA, 13 nt, Human
acaaacauugugu

SEQ ID NO: 2825047 - RNA, 16 nt, Human
acaaacauuguguuga

SEQ ID NO: 2825048 - RNA, 19 nt, Human
acaaacauuguguugacau

SEQ ID NO: 2825049 - RNA, 20 nt, Human
acaaacauuguguugacauu

SEQ ID NO: 2825050 - RNA, 11 nt, Human
acaaacauuuu

SEQ ID NO: 2825051 - RNA, 12 nt, Human
acaaacauuuuu

SEQ ID NO: 2825052 - RNA, 14 nt, Human
acaaacauuuuuca

SEQ ID NO: 2825053 - RNA, 15 nt, Human
acaaacauuuuucaa

SEQ ID NO: 2825054 - RNA, 16 nt, Human
acaaacauuuuucaac

SEQ ID NO: 2825055 - RNA, 17 nt, Human
acaaacauuuuucaaca

SEQ ID NO: 2825056 - RNA, 12 nt, Human
acaaaccaaguc

SEQ ID NO: 2825057 - RNA, 15 nt, Human
acaaaccacaacuga

SEQ ID NO: 2825058 - RNA, 16 nt, Human
acaaaccacaacugac

SEQ ID NO: 2825059 - RNA, 15 nt, Human
acaaacacauuguua

SEQ ID NO: 2825060 - RNA, 17 nt, Human
acaaacacauuguuauu

SEQ ID NO: 2825061 - RNA, 19 nt, Human
acaaacacauuguuauuuu

SEQ ID NO: 2825062 - RNA, 15 nt, Human
acaaacaccucccag

SEQ ID NO: 2825063 - RNA, 21 nt, Human
acaaacaccuucuuauuauau

SEQ ID NO: 2825064 - RNA, 23 nt, Human
acaaacacuacagacaauaaaua

SEQ ID NO: 2825065 - RNA, 14 nt, Human
acaaacaaucucuu

SEQ ID NO: 2825066 - RNA, 16 nt, Human
acaaacaaucucuuaa

SEQ ID NO: 2825067 - RNA, 22 nt, Human
acagcugagagacuuuuaauca

SEQ ID NO: 2825068 - RNA, 19 nt, Human
acagcucuuuuugugaagu

SEQ ID NO: 2825069 - RNA, 17 nt, Human
acaggcaaugcuggcug

SEQ ID NO: 2825070 - RNA, 14 nt, Human
acaggcacccacca

SEQ ID NO: 2825071 - RNA, 16 nt, Human
acaggcaaugcuggcu

SEQ ID NO: 2825072 - RNA, 15 nt, Human
acaggcaaugcuggc

SEQ ID NO: 2825073 - RNA, 18 nt, Human
acagcucuucuccaggcu

SEQ ID NO: 2825074 - RNA, 15 nt, Human
acagcugagagacuu

SEQ ID NO: 2825075 - RNA, 16 nt, Human
acagcugagagacuuu

SEQ ID NO: 2825076 - RNA, 19 nt, Human
acagcugagagacuuuuaa

SEQ ID NO: 2825077 - RNA, 20 nt, Human
acagcucuucuccaggcugu

SEQ ID NO: 2825078 - RNA, 19 nt, Human
acagcucuucuccaggcug

SEQ ID NO: 2825079 - RNA, 13 nt, Human
acagugcaucuca

SEQ ID NO: 2825080 - RNA, 15 nt, Human
acagugcaucucagc

SEQ ID NO: 2825081 - RNA, 17 nt, Human
acagugcaucucagccc

SEQ ID NO: 2825082 - RNA, 18 nt, Human
acagugcaucucagccca

SEQ ID NO: 2825083 - RNA, 23 nt, Human
acaggcacccaccaucaugucug

SEQ ID NO: 2825084 - RNA, 13 nt, Human
acagugcugugug

SEQ ID NO: 2825085 - RNA, 18 nt, Human
acagugccaacuccucac

SEQ ID NO: 2825086 - RNA, 19 nt, Human
acaguggauuguuuauacu

SEQ ID NO: 2825087 - RNA, 17 nt, Human
acaguggauugcauuuc

SEQ ID NO: 2825088 - RNA, 22 nt, Human
acagugcuucagccugaggcug

SEQ ID NO: 2825089 - RNA, 20 nt, Human
acagugcuugccacagagcg

SEQ ID NO: 2825090 - RNA, 21 nt, Human
acagugcuugccacagagcgg

SEQ ID NO: 2825091 - RNA, 21 nt, Human
acagugcuucagccugaggcu

SEQ ID NO: 2825092 - RNA, 20 nt, Human
acagugcuucagccugaggc

SEQ ID NO: 2825093 - RNA, 18 nt, Human
acagugcuucagccugag

SEQ ID NO: 2825094 - RNA, 17 nt, Human
acagugcuucagccuga

SEQ ID NO: 2825095 - RNA, 15 nt, Human
acagugcuucagccu

SEQ ID NO: 2825096 - RNA, 14 nt, Human
acagugcuucagcc

SEQ ID NO: 2825097 - RNA, 16 nt, Human
acagugggaacucuga

SEQ ID NO: 2825098 - RNA, 18 nt, Human
acagugggaacucugaca

SEQ ID NO: 2825099 - RNA, 19 nt, Human
acagugggaacucugacaa

SEQ ID NO: 2825100 - RNA, 21 nt, Human
acagugggaacucugacaagg

SEQ ID NO: 2825101 - RNA, 14 nt, Human
acauuugccuugcu

SEQ ID NO: 2825102 - RNA, 15 nt, Human
acauuugccuugcug

SEQ ID NO: 2825103 - RNA, 23 nt, Human
acauuucuuagacuacauuuaga

SEQ ID NO: 2825104 - RNA, 13 nt, Human
acauuugccuugc

SEQ ID NO: 2825105 - RNA, 14 nt, Human
acauuugccuugca

SEQ ID NO: 2825106 - RNA, 16 nt, Human
acauuugccuugcaga

SEQ ID NO: 2825107 - RNA, 17 nt, Human
acauuugccuugcagaa

SEQ ID NO: 2825108 - RNA, 20 nt, Human
acauuugccuugcagaacug

SEQ ID NO: 2825109 - RNA, 21 nt, Human
acauuugccuugcagaacugc

SEQ ID NO: 2825110 - RNA, 23 nt, Human
acauuugccuugcagaacugcca

SEQ ID NO: 2825111 - RNA, 14 nt, Human
acauuucuuuucuu

SEQ ID NO: 2825112 - RNA, 15 nt, Human
acauuucuuuucuuu

SEQ ID NO: 2825113 - RNA, 18 nt, Human
acauuucuuuucuuuuua

SEQ ID NO: 2825114 - RNA, 20 nt, Human
acauuucuuuucuuuuuaca

SEQ ID NO: 2825115 - RNA, 21 nt, Human
acauuucuuuucuuuuuacau

SEQ ID NO: 2825116 - RNA, 22 nt, Human
acauuucuuuucuuuuuacaua

SEQ ID NO: 2825117 - RNA, 19 nt, Human
acauuucuguaaauaccau

SEQ ID NO: 2825118 - RNA, 21 nt, Human
accaacgcgaaaccaauuccu

SEQ ID NO: 2825119 - RNA, 23 nt, Human
accaacgcgaaaccaauuccuca

SEQ ID NO: 2825120 - RNA, 14 nt, Human
accaagccguggcu

SEQ ID NO: 2825121 - RNA, 15 nt, Human
accaagccguggcuu

SEQ ID NO: 2825122 - RNA, 16 nt, Human
accaagccguggcuuc

SEQ ID NO: 2825123 - RNA, 17 nt, Human
accaagccguggcuucc

SEQ ID NO: 2825124 - RNA, 18 nt, Human
accaagccguggcuuccc

SEQ ID NO: 2825125 - RNA, 18 nt, Human
accaccccaacaaaccau

SEQ ID NO: 2825126 - RNA, 17 nt, Human
accaccauccaccgcug

SEQ ID NO: 2825127 - RNA, 19 nt, Human
accaccauccaccgcugcu

SEQ ID NO: 2825128 - RNA, 20 nt, Human
accaccauccaccgcugcuc

SEQ ID NO: 2825129 - RNA, 21 nt, Human
accaccauccaccgcugcucc

SEQ ID NO: 2825130 - RNA, 16 nt, Human
accacgcuggaccuug

SEQ ID NO: 2825131 - RNA, 14 nt, Human
accacgcuggaccu

SEQ ID NO: 2825132 - RNA, 18 nt, Human
accacgcuggaccuugaa

SEQ ID NO: 2825133 - RNA, 16 nt, Human
accacgcuggggucug

SEQ ID NO: 2825134 - RNA, 18 nt, Human
accaccccgccugcccuc

SEQ ID NO: 2825135 - RNA, 17 nt, Human
accacgucugucuucac

SEQ ID NO: 2825136 - RNA, 14 nt, Human
accacguccagcug

SEQ ID NO: 2825137 - RNA, 18 nt, Human
accacggaaaagagcgca

SEQ ID NO: 2825138 - RNA, 14 nt, Human
accacggaaaagag

SEQ ID NO: 2825139 - RNA, 18 nt, Human
accacgucugucuucaca

SEQ ID NO: 2825140 - RNA, 17 nt, Human
acauguguuggcagccu

SEQ ID NO: 2825141 - RNA, 20 nt, Human
acauguguagccugugcaug

SEQ ID NO: 2825142 - RNA, 23 nt, Human
acaugugucaacaccccugugug

SEQ ID NO: 2825143 - RNA, 17 nt, Human
acauguguagccugugc

SEQ ID NO: 2825144 - RNA, 18 nt, Human
acauguguagccugugca

SEQ ID NO: 2825145 - RNA, 12 nt, Human
acauguguuuua

SEQ ID NO: 2825146 - RNA, 21 nt, Human
acauguguuuuaauuccaaua

SEQ ID NO: 2825147 - RNA, 19 nt, Human
acauguuuuuauacaaaau

SEQ ID NO: 2825148 - RNA, 17 nt, Human
acauguuuuuauacaaa

SEQ ID NO: 2825149 - RNA, 13 nt, Human
acaugugguuuau

SEQ ID NO: 2825150 - RNA, 16 nt, Human
acaugugguuuauaga

SEQ ID NO: 2825151 - RNA, 20 nt, Human
acauguguagccuauguugu

SEQ ID NO: 2825152 - RNA, 21 nt, Human
acauguguagccuauguugug

SEQ ID NO: 2825153 - RNA, 12 nt, Human
acauguguguau

SEQ ID NO: 2825154 - RNA, 13 nt, Human
acauguguguaua

SEQ ID NO: 2825155 - RNA, 14 nt, Human
acauguguguauau

SEQ ID NO: 2825156 - RNA, 15 nt, Human
acauguguguauaua

SEQ ID NO: 2825157 - RNA, 17 nt, Human
acauguguguauauaug

SEQ ID NO: 2825158 - RNA, 18 nt, Human
acauguguguauauaugu

SEQ ID NO: 2825159 - RNA, 22 nt, Human
acauguguguauauauguguau

SEQ ID NO: 2825160 - RNA, 23 nt, Human
acauguguguauauauguguaua

SEQ ID NO: 2825161 - RNA, 22 nt, Human
acaugugccagggcaaugauga

SEQ ID NO: 2825162 - RNA, 23 nt, Human
acaugcggagaacaaaugugaag

SEQ ID NO: 2825163 - RNA, 15 nt, Human
acaugccugccccaa

SEQ ID NO: 2825164 - RNA, 21 nt, Human
acaugccugccccaaacaaau

SEQ ID NO: 2825165 - RNA, 17 nt, Human
acaugcagcccaugccc

SEQ ID NO: 2825166 - RNA, 15 nt, Human
acaugcagcccaugc

SEQ ID NO: 2825167 - RNA, 18 nt, Human
acaugcagcccaugccca

SEQ ID NO: 2825168 - RNA, 17 nt, Human
acaucccugagcaggaa

SEQ ID NO: 2825169 - RNA, 22 nt, Human
acaugccugccccaaacaaaua

SEQ ID NO: 2825170 - RNA, 17 nt, Human
acaugcggagaacaaau

SEQ ID NO: 2825171 - RNA, 13 nt, Human
acaugcacgugug

SEQ ID NO: 2825172 - RNA, 17 nt, Human
acaugcacucagcucuu

SEQ ID NO: 2825173 - RNA, 16 nt, Human
acaugcacuaugagga

SEQ ID NO: 2825174 - RNA, 17 nt, Human
acaugcacuaugaggaa

SEQ ID NO: 2825175 - RNA, 18 nt, Human
acaugcacucagcucuug

SEQ ID NO: 2825176 - RNA, 12 nt, Human
acaugcacugac

SEQ ID NO: 2825177 - RNA, 13 nt, Human
acaugcacugacc

SEQ ID NO: 2825178 - RNA, 14 nt, Human
acaugcacugaccc

SEQ ID NO: 2825179 - RNA, 18 nt, Human
acaugcacugacccuucc

SEQ ID NO: 2825180 - RNA, 19 nt, Human
acaugcacugacccuucca

SEQ ID NO: 2825181 - RNA, 18 nt, Human
acauccaacuccagcaac

SEQ ID NO: 2825182 - RNA, 16 nt, Human
acauccaacuccagca

SEQ ID NO: 2825183 - RNA, 19 nt, Human
acauccaacuccagcaacu

SEQ ID NO: 2825184 - RNA, 18 nt, Human
acauccccccgccaaaag

SEQ ID NO: 2825185 - RNA, 23 nt, Human
acaucccuacaaaaaauuagaaa

SEQ ID NO: 2825186 - RNA, 18 nt, Human
acaucccgggacgcagca

SEQ ID NO: 2825187 - RNA, 21 nt, Human
acauaaguaauucaagaaaac

SEQ ID NO: 2825188 - RNA, 17 nt, Human
acauaauaaaaaauuau

SEQ ID NO: 2825189 - RNA, 23 nt, Human
acauaauaaaaaauuaugacaau

SEQ ID NO: 2825190 - RNA, 14 nt, Human
acauaauaaauuaa

SEQ ID NO: 2825191 - RNA, 21 nt, Human
acauaauacacuugcccugcu

SEQ ID NO: 2825192 - RNA, 22 nt, Human
acauaauacacuugcccugcuc

SEQ ID NO: 2825193 - RNA, 20 nt, Human
acauaaguaauucaagaaaa

SEQ ID NO: 2825194 - RNA, 23 nt, Human
acauaacguuuuuccuuuaaaaa

SEQ ID NO: 2825195 - RNA, 12 nt, Human
acauaacuaaau

SEQ ID NO: 2825196 - RNA, 13 nt, Human
acauaacuaaauu

SEQ ID NO: 2825197 - RNA, 15 nt, Human
acauaacuaaauuug

SEQ ID NO: 2825198 - RNA, 18 nt, Human
acauaacuaaauuugaua

SEQ ID NO: 2825199 - RNA, 22 nt, Human
acauaacuaaauuugauacuua

SEQ ID NO: 2825200 - RNA, 23 nt, Human
acauaacuaaauuugauacuuau

SEQ ID NO: 2825201 - RNA, 12 nt, Human
acauaacaagaa

SEQ ID NO: 2825202 - RNA, 13 nt, Human
acauaacaagaaa

SEQ ID NO: 2825203 - RNA, 14 nt, Human
acauaacaagaaaa

SEQ ID NO: 2825204 - RNA, 15 nt, Human
acauaacaagaaaau

SEQ ID NO: 2825205 - RNA, 14 nt, Human
acauaacguuuuuc

SEQ ID NO: 2825206 - RNA, 15 nt, Human
acauaacguuuuucc

SEQ ID NO: 2825207 - RNA, 16 nt, Human
acauaacguuuuuccu

SEQ ID NO: 2825208 - RNA, 18 nt, Human
acauaacguuuuuccuuu

SEQ ID NO: 2825209 - RNA, 20 nt, Human
acauaacguuuuuccuuuaa

SEQ ID NO: 2825210 - RNA, 21 nt, Human
acauaacguuuuuccuuuaaa

SEQ ID NO: 2825211 - RNA, 19 nt, Human
acauaaucuaguuuacaga

SEQ ID NO: 2825212 - RNA, 22 nt, Human
acauaaucuaguuuacagaaaa

SEQ ID NO: 2825213 - RNA, 13 nt, Human
acauaaugaaaau

SEQ ID NO: 2825214 - RNA, 19 nt, Human
acauaaugaaaauauuuuu

SEQ ID NO: 2825215 - RNA, 22 nt, Human
acauaacguuuuuccuuuaaaa

SEQ ID NO: 2825216 - RNA, 21 nt, Human
acauccaaaauaguuaagaca

SEQ ID NO: 2825217 - RNA, 12 nt, Human
acaucauuuugu

SEQ ID NO: 2825218 - RNA, 17 nt, Human
acaucauuuuguuuucc

SEQ ID NO: 2825219 - RNA, 18 nt, Human
acauacacgaaagagaga

SEQ ID NO: 2825220 - RNA, 16 nt, Human
acauacacuuguauaa

SEQ ID NO: 2825221 - RNA, 19 nt, Human
acauacacuuguauaaaug

SEQ ID NO: 2825222 - RNA, 20 nt, Human
acauacacuuguauaaaugu

SEQ ID NO: 2825223 - RNA, 21 nt, Human
acauacacuuguauaaaugua

SEQ ID NO: 2825224 - RNA, 15 nt, Human
acauaacugccuuga

SEQ ID NO: 2825225 - RNA, 15 nt, Human
acauacaguuuuaug

SEQ ID NO: 2825226 - RNA, 12 nt, Human
accucugccuga

SEQ ID NO: 2825227 - RNA, 23 nt, Human
accucugccugaagucacacagu

SEQ ID NO: 2825228 - RNA, 20 nt, Human
accucugccugaagucacac

SEQ ID NO: 2825229 - RNA, 15 nt, Human
accucugugugcucc

SEQ ID NO: 2825230 - RNA, 11 nt, Human
accucugugug

SEQ ID NO: 2825231 - RNA, 12 nt, Human
accucugugugc

SEQ ID NO: 2825232 - RNA, 15 nt, Human
accucugucauuugu

SEQ ID NO: 2825233 - RNA, 12 nt, Human
accucugucuca

SEQ ID NO: 2825234 - RNA, 13 nt, Human
accucugucucau

SEQ ID NO: 2825235 - RNA, 15 nt, Human
accucugucucaucc

SEQ ID NO: 2825236 - RNA, 16 nt, Human
accucugucucauccu

SEQ ID NO: 2825237 - RNA, 20 nt, Human
accucugucucauccuccug

SEQ ID NO: 2825238 - RNA, 21 nt, Human
accucugucucauccuccugg

SEQ ID NO: 2825239 - RNA, 23 nt, Human
accucugucucauccuccuggaa

SEQ ID NO: 2825240 - RNA, 14 nt, Human
accucugugaccuc

SEQ ID NO: 2825241 - RNA, 15 nt, Human
accucugugaccuca

SEQ ID NO: 2825242 - RNA, 16 nt, Human
accucugugaccucag

SEQ ID NO: 2825243 - RNA, 17 nt, Human
accucugugaccucagg

SEQ ID NO: 2825244 - RNA, 18 nt, Human
accucugugaccucaggc

SEQ ID NO: 2825245 - RNA, 19 nt, Human
accucugugaccucaggca

SEQ ID NO: 2825246 - RNA, 21 nt, Human
accucugugaggaaagcacac

SEQ ID NO: 2825247 - RNA, 16 nt, Human
accucugugccucugu

SEQ ID NO: 2825248 - RNA, 11 nt, Human
accuugcuguc

SEQ ID NO: 2825249 - RNA, 12 nt, Human
accuugcugucc

SEQ ID NO: 2825250 - RNA, 14 nt, Human
accuugcuguccug

SEQ ID NO: 2825251 - RNA, 17 nt, Human
accuugcuguccugauc

SEQ ID NO: 2825252 - RNA, 19 nt, Human
accuugcuguccugaucug

SEQ ID NO: 2825253 - RNA, 23 nt, Human
accuugcuguccugaucugugau

SEQ ID NO: 2825254 - RNA, 12 nt, Human
accuugcuucuu

SEQ ID NO: 2825255 - RNA, 22 nt, Human
accuugcuucuuacugauaauu

SEQ ID NO: 2825256 - RNA, 13 nt, Human
accuugcuaauuu

SEQ ID NO: 2825257 - RNA, 20 nt, Human
accuugcuaauuuucucaaa

SEQ ID NO: 2825258 - RNA, 23 nt, Human
accuguggaacauaaaaaggaca

SEQ ID NO: 2825259 - RNA, 20 nt, Human
accuguggaacauaaaaagg

SEQ ID NO: 2825260 - RNA, 16 nt, Human
accugugccucggcuu

SEQ ID NO: 2825261 - RNA, 15 nt, Human
accugugccucggcu

SEQ ID NO: 2825262 - RNA, 14 nt, Human
accuguaaucccag

SEQ ID NO: 2825263 - RNA, 15 nt, Human
accuguaaucccagc

SEQ ID NO: 2825264 - RNA, 19 nt, Human
accuguaaucccagcacuu

SEQ ID NO: 2825265 - RNA, 16 nt, Human
accuguaaucccagca

SEQ ID NO: 2825266 - RNA, 17 nt, Human
accuguaaucccagcac

SEQ ID NO: 2825267 - RNA, 19 nt, Human
accugugaguuuaaagcaa

SEQ ID NO: 2825268 - RNA, 14 nt, Human
accugugccucggc

SEQ ID NO: 2825269 - RNA, 18 nt, Human
accugugaguuuaaagca

SEQ ID NO: 2825270 - RNA, 16 nt, Human
accugugaguaaauau

SEQ ID NO: 2825271 - RNA, 17 nt, Human
accugugaguaaauauu

SEQ ID NO: 2825272 - RNA, 23 nt, Human
accugccccgcccagcugcaccu

SEQ ID NO: 2825273 - RNA, 17 nt, Human
accugccccgcccagcu

SEQ ID NO: 2825274 - RNA, 16 nt, Human
accugccccgcccagc

SEQ ID NO: 2825275 - RNA, 17 nt, Human
accuuggagagacacag

SEQ ID NO: 2825276 - RNA, 14 nt, Human
acgcacacacacaa

SEQ ID NO: 2825277 - RNA, 13 nt, Human
acgcacagacagg

SEQ ID NO: 2825278 - RNA, 14 nt, Human
acgcacagacaggu

SEQ ID NO: 2825279 - RNA, 21 nt, Human
acgcacagacagguuuucaca

SEQ ID NO: 2825280 - RNA, 19 nt, Human
acgcacauauacacacaca

SEQ ID NO: 2825281 - RNA, 18 nt, Human
acgcaaaaccacuuuccu

SEQ ID NO: 2825282 - RNA, 13 nt, Human
acgcacacacaca

SEQ ID NO: 2825283 - RNA, 23 nt, Human
acgcaaugaaaagucguuuucca

SEQ ID NO: 2825284 - RNA, 18 nt, Human
acgauuuucuccagcuca

SEQ ID NO: 2825285 - RNA, 22 nt, Human
acgcuguucuaauggcacuuau

SEQ ID NO: 2825286 - RNA, 16 nt, Human
acgcaggcaucugauu

SEQ ID NO: 2825287 - RNA, 13 nt, Human
acgcuucacagug

SEQ ID NO: 2825288 - RNA, 16 nt, Human
acgcuucacagugauc

SEQ ID NO: 2825289 - RNA, 18 nt, Human
acgcagcccuagagccug

SEQ ID NO: 2825290 - RNA, 19 nt, Human
acgcagcccuagagccugc

SEQ ID NO: 2825291 - RNA, 20 nt, Human
acgcagcccuagagccugcc

SEQ ID NO: 2825292 - RNA, 14 nt, Human
acgcagcccuagag

SEQ ID NO: 2825293 - RNA, 12 nt, Human
acgcagcccugc

SEQ ID NO: 2825294 - RNA, 21 nt, Human
acgcagcccuagagccugccu

SEQ ID NO: 2825295 - RNA, 22 nt, Human
acgcagcccuagagccugccug

SEQ ID NO: 2825296 - RNA, 23 nt, Human
acgcagcccuagagccugccugg

SEQ ID NO: 2825297 - RNA, 24 nt, Human
acgcagcccuagagccugccugga

SEQ ID NO: 2825298 - RNA, 22 nt, Human
acgcagcccugcuuugggcugc

SEQ ID NO: 2825299 - RNA, 23 nt, Human
acgcagcccugcuuugggcugcc

SEQ ID NO: 2825300 - RNA, 12 nt, Human
acgucuucuaaa

SEQ ID NO: 2825301 - RNA, 15 nt, Human
acgucuuucuuuuuu

SEQ ID NO: 2825302 - RNA, 15 nt, Human
acgcuugcucauuuu

SEQ ID NO: 2825303 - RNA, 19 nt, Human
acggaauaguuggcuagga

SEQ ID NO: 2825304 - RNA, 14 nt, Human
acggacaauaaacc

SEQ ID NO: 2825305 - RNA, 15 nt, Human
acggacaauaaaccu

SEQ ID NO: 2825306 - RNA, 18 nt, Human
acggacaauaaaccuccg

SEQ ID NO: 2825307 - RNA, 19 nt, Human
acggacaauaaaccuccgc

SEQ ID NO: 2825308 - RNA, 15 nt, Human
acggacacccccucg

SEQ ID NO: 2825309 - RNA, 16 nt, Human
acggacacccccucgc

SEQ ID NO: 2825310 - RNA, 18 nt, Human
acuaauggggcggugaga

SEQ ID NO: 2825311 - RNA, 20 nt, Human
acuaauuaggguacauuuau

SEQ ID NO: 2825312 - RNA, 23 nt, Human
acuaauuaggguacauuuauaau

SEQ ID NO: 2825313 - RNA, 12 nt, Human
acuaauguaaaa

SEQ ID NO: 2825314 - RNA, 15 nt, Human
acuaauguaaaauga

SEQ ID NO: 2825315 - RNA, 16 nt, Human
acuaauguaaaaugau

SEQ ID NO: 2825316 - RNA, 14 nt, Human
acguggaaccucug

SEQ ID NO: 2825317 - RNA, 16 nt, Human
acguggaaccucuguc

SEQ ID NO: 2825318 - RNA, 17 nt, Human
acguggaaccucugucu

SEQ ID NO: 2825319 - RNA, 18 nt, Human
acguggaaccucugucuc

SEQ ID NO: 2825320 - RNA, 20 nt, Human
acguggaaccucugucucau

SEQ ID NO: 2825321 - RNA, 20 nt, Human
acgugcgcugggcacuuccc

SEQ ID NO: 2825322 - RNA, 22 nt, Human
acgugcgcugggcacuucccug

SEQ ID NO: 2825323 - RNA, 23 nt, Human
acgugcgcugggcacuucccugc

SEQ ID NO: 2825324 - RNA, 19 nt, Human
acguggagagcuggugccc

SEQ ID NO: 2825325 - RNA, 18 nt, Human
acguggagagcuggugcc

SEQ ID NO: 2825326 - RNA, 16 nt, Human
acguggagagcuggug

SEQ ID NO: 2825327 - RNA, 15 nt, Human
acguggagagcuggu

SEQ ID NO: 2825328 - RNA, 17 nt, Human
acguggacguuuuuaau

SEQ ID NO: 2825329 - RNA, 14 nt, Human
acguggagagcugg

SEQ ID NO: 2825330 - RNA, 21 nt, Human
acccugucucuuaaagaaaaa

SEQ ID NO: 2825331 - RNA, 22 nt, Human
acccuggggccuggaccugccu

SEQ ID NO: 2825332 - RNA, 21 nt, Human
acccuggggcuggcuuuucug

SEQ ID NO: 2825333 - RNA, 22 nt, Human
acccuggggcuggcuuuucugu

SEQ ID NO: 2825334 - RNA, 16 nt, Human
acccuggugccuggcu

SEQ ID NO: 2825335 - RNA, 23 nt, Human
acccuguaaaauggagguggaaa

SEQ ID NO: 2825336 - RNA, 19 nt, Human
acccuguacauauguaaac

SEQ ID NO: 2825337 - RNA, 15 nt, Human
acccuguaccucauc

SEQ ID NO: 2825338 - RNA, 16 nt, Human
acccuguaccucaucc

SEQ ID NO: 2825339 - RNA, 17 nt, Human
acccuguaccucauccc

SEQ ID NO: 2825340 - RNA, 20 nt, Human
acccuguacuguucuguguc

SEQ ID NO: 2825341 - RNA, 22 nt, Human
acccuguacuguucugugucuu

SEQ ID NO: 2825342 - RNA, 16 nt, Human
acccuggggagaaagu

SEQ ID NO: 2825343 - RNA, 17 nt, Human
acccuggggccuggacc

SEQ ID NO: 2825344 - RNA, 18 nt, Human
acccuggggccuggaccu

SEQ ID NO: 2825345 - RNA, 19 nt, Human
acccuggggccuggaccug

SEQ ID NO: 2825346 - RNA, 13 nt, Human
acccuggggccug

SEQ ID NO: 2825347 - RNA, 12 nt, Human
acccugggaagg

SEQ ID NO: 2825348 - RNA, 12 nt, Human
acccugggaccu

SEQ ID NO: 2825349 - RNA, 22 nt, Human
acccuggccgcccccugccccc

SEQ ID NO: 2825350 - RNA, 23 nt, Human
acccugggaccuaggggcgccgc

SEQ ID NO: 2825351 - RNA, 14 nt, Human
acccugggagacag

SEQ ID NO: 2825352 - RNA, 16 nt, Human
acccugggagacagac

SEQ ID NO: 2825353 - RNA, 17 nt, Human
acccugggagacagacc

SEQ ID NO: 2825354 - RNA, 16 nt, Human
acccuggccgcccccu

SEQ ID NO: 2825355 - RNA, 17 nt, Human
acccuggccgcccccug

SEQ ID NO: 2825356 - RNA, 19 nt, Human
acccuggccgcccccugcc

SEQ ID NO: 2825357 - RNA, 18 nt, Human
acccucagagccaccccu

SEQ ID NO: 2825358 - RNA, 21 nt, Human
acccucaggggaaaacuguua

SEQ ID NO: 2825359 - RNA, 15 nt, Human
acccuggcauuaugu

SEQ ID NO: 2825360 - RNA, 18 nt, Human
acccuggcacccagggug

SEQ ID NO: 2825361 - RNA, 21 nt, Human
acccucaaccucuucuggcuc

SEQ ID NO: 2825362 - RNA, 14 nt, Human
acccucacucugcc

SEQ ID NO: 2825363 - RNA, 15 nt, Human
acccucacucugcca

SEQ ID NO: 2825364 - RNA, 16 nt, Human
acccucacucugccag

SEQ ID NO: 2825365 - RNA, 17 nt, Human
acccucacucugccagg

SEQ ID NO: 2825366 - RNA, 18 nt, Human
acccucacucugccaggg

SEQ ID NO: 2825367 - RNA, 21 nt, Human
acccucacucugccagggcag

SEQ ID NO: 2825368 - RNA, 11 nt, Human
acccucagagc

SEQ ID NO: 2825369 - RNA, 18 nt, Human
acccuaucuccugacaga

SEQ ID NO: 2825370 - RNA, 15 nt, Human
acccuaucuccugac

SEQ ID NO: 2825371 - RNA, 17 nt, Human
acccuauauguaguaua

SEQ ID NO: 2825372 - RNA, 14 nt, Human
acccuaucuccuga

SEQ ID NO: 2825373 - RNA, 16 nt, Human
acccuaguuucccuga

SEQ ID NO: 2825374 - RNA, 21 nt, Human
acccuaguucuaccucaggca

SEQ ID NO: 2825375 - RNA, 22 nt, Human
acccuagucccuuccccucccu

SEQ ID NO: 2825376 - RNA, 15 nt, Human
acccuaguucuaccu

SEQ ID NO: 2825377 - RNA, 21 nt, Human
acccuaggccucucaccucug

SEQ ID NO: 2825378 - RNA, 19 nt, Human
acccuagguucccgguccc

SEQ ID NO: 2825379 - RNA, 22 nt, Human
acccuagguucccggucccgag

SEQ ID NO: 2825380 - RNA, 16 nt, Human
acccuagguucccugu

SEQ ID NO: 2825381 - RNA, 18 nt, Human
acccuagguucccuguuc

SEQ ID NO: 2825382 - RNA, 19 nt, Human
acccuagguucccuguucu

SEQ ID NO: 2825383 - RNA, 22 nt, Human
acccuagguucccuguucuucc

SEQ ID NO: 2825384 - RNA, 23 nt, Human
acccuagguucccuguucuuccu

SEQ ID NO: 2825385 - RNA, 19 nt, Human
acccuagccaaugucuccu

SEQ ID NO: 2825386 - RNA, 17 nt, Human
acccuagcccucucccu

SEQ ID NO: 2825387 - RNA, 18 nt, Human
acccuagcccucucccuc

SEQ ID NO: 2825388 - RNA, 16 nt, Human
acccuagccaaugucu

SEQ ID NO: 2825389 - RNA, 18 nt, Human
acccuacuucuuuugcuc

SEQ ID NO: 2825390 - RNA, 14 nt, Human
acccuacuucuuuu

SEQ ID NO: 2825391 - RNA, 13 nt, Human
acccuaaugucuu

SEQ ID NO: 2825392 - RNA, 19 nt, Human
acccuaaugucuucauaaa

SEQ ID NO: 2825393 - RNA, 23 nt, Human
acccuaaugucuucauaaaguac

SEQ ID NO: 2825394 - RNA, 13 nt, Human
acccuaccugugc

SEQ ID NO: 2825395 - RNA, 17 nt, Human
acccuaccugugccuga

SEQ ID NO: 2825396 - RNA, 16 nt, Human
acccuaccugugccug

SEQ ID NO: 2825397 - RNA, 12 nt, Human
acccguuccaaa

SEQ ID NO: 2825398 - RNA, 13 nt, Human
acccguuccaaaa

SEQ ID NO: 2825399 - RNA, 16 nt, Human
acccgugagcgccugu

SEQ ID NO: 2825400 - RNA, 17 nt, Human
acccgugagcgccugug

SEQ ID NO: 2825401 - RNA, 19 nt, Human
acccgugagcgccugugca

SEQ ID NO: 2825402 - RNA, 12 nt, Human
accucaggcagc

SEQ ID NO: 2825403 - RNA, 15 nt, Human
accucaggcagcuca

SEQ ID NO: 2825404 - RNA, 17 nt, Human
accucaggcacuagccu

SEQ ID NO: 2825405 - RNA, 18 nt, Human
accucaggcacuagccuu

SEQ ID NO: 2825406 - RNA, 19 nt, Human
accucaggcacuagccuuu

SEQ ID NO: 2825407 - RNA, 12 nt, Human
accucaggaaag

SEQ ID NO: 2825408 - RNA, 16 nt, Human
accucaggaaagaaua

SEQ ID NO: 2825409 - RNA, 17 nt, Human
accucaggaaagaauag

SEQ ID NO: 2825410 - RNA, 23 nt, Human
accucaggaaagaauagaaagaa

SEQ ID NO: 2825411 - RNA, 15 nt, Human
accguggcccugccc

SEQ ID NO: 2825412 - RNA, 19 nt, Human
accguggcccugcccucuc

SEQ ID NO: 2825413 - RNA, 20 nt, Human
accguggcccugcccucucc

SEQ ID NO: 2825414 - RNA, 21 nt, Human
accguggcccugcccucuccu

SEQ ID NO: 2825415 - RNA, 23 nt, Human
accucagccugcacagugucccc

SEQ ID NO: 2825416 - RNA, 20 nt, Human
accucagccugcacaguguc

SEQ ID NO: 2825417 - RNA, 12 nt, Human
accucagccugc

SEQ ID NO: 2825418 - RNA, 21 nt, Human
accucaggugauccacccacc

SEQ ID NO: 2825419 - RNA, 20 nt, Human
accucaggugauccacccac

SEQ ID NO: 2825420 - RNA, 15 nt, Human
accucaggcaggaag

SEQ ID NO: 2825421 - RNA, 12 nt, Human
accucaggcagg

SEQ ID NO: 2825422 - RNA, 16 nt, Human
accucaggcagcucaa

SEQ ID NO: 2825423 - RNA, 17 nt, Human
accucaggcagcucaag

SEQ ID NO: 2825424 - RNA, 11 nt, Human
accucauguuu

SEQ ID NO: 2825425 - RNA, 15 nt, Human
accucauguuuauga

SEQ ID NO: 2825426 - RNA, 18 nt, Human
accucauguuuaugaaaa

SEQ ID NO: 2825427 - RNA, 19 nt, Human
accucauguuuaugaaaau

SEQ ID NO: 2825428 - RNA, 20 nt, Human
accucauguuuaugaaaaua

SEQ ID NO: 2825429 - RNA, 21 nt, Human
accucauuaaccgaugcuuua

SEQ ID NO: 2825430 - RNA, 21 nt, Human
accucaggccaggugcagugg

SEQ ID NO: 2825431 - RNA, 23 nt, Human
accucaggcacuagccuuuggcu

SEQ ID NO: 2825432 - RNA, 20 nt, Human
accucaggccaggugcagug

SEQ ID NO: 2825433 - RNA, 13 nt, Human
accucaggccagg

SEQ ID NO: 2825434 - RNA, 16 nt, Human
accgggcacucagaag

SEQ ID NO: 2825435 - RNA, 20 nt, Human
accgggccacagagaaagua

SEQ ID NO: 2825436 - RNA, 14 nt, Human
accgggcacucaga

SEQ ID NO: 2825437 - RNA, 12 nt, Human
accgggcacuca

SEQ ID NO: 2825438 - RNA, 11 nt, Human
accucagccuc

SEQ ID NO: 2825439 - RNA, 12 nt, Human
accucagccucc

SEQ ID NO: 2825440 - RNA, 19 nt, Human
accgugccuggccacgccc

SEQ ID NO: 2825441 - RNA, 23 nt, Human
accgggcugggagcucugcagag

SEQ ID NO: 2825442 - RNA, 18 nt, Human
accgggaauaaccuucca

SEQ ID NO: 2825443 - RNA, 22 nt, Human
accgggccaguaucuauauaug

SEQ ID NO: 2825444 - RNA, 21 nt, Human
accgggcugggagcucugcag

SEQ ID NO: 2825445 - RNA, 17 nt, Human
accucauugacaagaac

SEQ ID NO: 2825446 - RNA, 19 nt, Human
accuccaacagaacuaaau

SEQ ID NO: 2825447 - RNA, 23 nt, Human
accuccaacagaacuaaauguuc

SEQ ID NO: 2825448 - RNA, 12 nt, Human
acugguggcccg

SEQ ID NO: 2825449 - RNA, 13 nt, Human
acuggugcacuuu

SEQ ID NO: 2825450 - RNA, 16 nt, Human
acuggugcacuuugua

SEQ ID NO: 2825451 - RNA, 18 nt, Human
acuggugcacuuuguaaa

SEQ ID NO: 2825452 - RNA, 20 nt, Human
acuggugcacuuuguaaauu

SEQ ID NO: 2825453 - RNA, 21 nt, Human
acuggugcacuuuguaaauuc

SEQ ID NO: 2825454 - RNA, 22 nt, Human
acuggugcacuuuguaaauucc

SEQ ID NO: 2825455 - RNA, 21 nt, Human
acuggaguggcucgccaggcc

SEQ ID NO: 2825456 - RNA, 13 nt, Human
acuggagucugga

SEQ ID NO: 2825457 - RNA, 15 nt, Human
acuggagucuggagu

SEQ ID NO: 2825458 - RNA, 18 nt, Human
acugcuuuuuuuuuucca

SEQ ID NO: 2825459 - RNA, 19 nt, Human
acugcuuuuuuuuuuccag

SEQ ID NO: 2825460 - RNA, 21 nt, Human
acugcuuuuuuuuuuccagca

SEQ ID NO: 2825461 - RNA, 18 nt, Human
acuggaacggugaaggug

SEQ ID NO: 2825462 - RNA, 21 nt, Human
acuggaacggugaaggugaca

SEQ ID NO: 2825463 - RNA, 16 nt, Human
acuggagcccaggagu

SEQ ID NO: 2825464 - RNA, 21 nt, Human
acugccauguacuaguuuuag

SEQ ID NO: 2825465 - RNA, 17 nt, Human
acugccauuauuuucug

SEQ ID NO: 2825466 - RNA, 18 nt, Human
acugccauuauuuucugu

SEQ ID NO: 2825467 - RNA, 20 nt, Human
acugccauuauuuucuguca

SEQ ID NO: 2825468 - RNA, 21 nt, Human
acugccauuauuuucugucag

SEQ ID NO: 2825469 - RNA, 22 nt, Human
acugccauuauuuucugucaga

SEQ ID NO: 2825470 - RNA, 23 nt, Human
acugccauuauuuucugucagau

SEQ ID NO: 2825471 - RNA, 20 nt, Human
acugccgugcauuagcacag

SEQ ID NO: 2825472 - RNA, 19 nt, Human
acugcccaggccugccugu

SEQ ID NO: 2825473 - RNA, 16 nt, Human
acugugccaugugcca

SEQ ID NO: 2825474 - RNA, 22 nt, Human
acuguaacugugucaugauuca

SEQ ID NO: 2825475 - RNA, 21 nt, Human
acugucuuuggaaaaauguuu

SEQ ID NO: 2825476 - RNA, 22 nt, Human
acugucuuuggaaaaauguuug

SEQ ID NO: 2825477 - RNA, 23 nt, Human
acugucuuuggaaaaauguuugu

SEQ ID NO: 2825478 - RNA, 18 nt, Human
acugugccaugugccagg

SEQ ID NO: 2825479 - RNA, 17 nt, Human
acugugccaugugccag

SEQ ID NO: 2825480 - RNA, 17 nt, Human
acuguaaaccaauuuuu

SEQ ID NO: 2825481 - RNA, 18 nt, Human
acuguaaaaaaugugugu

SEQ ID NO: 2825482 - RNA, 17 nt, Human
acuguaacauauucugu

SEQ ID NO: 2825483 - RNA, 18 nt, Human
acuguaaauaaaaagaaa

SEQ ID NO: 2825484 - RNA, 16 nt, Human
acuguaaauaugaauc

SEQ ID NO: 2825485 - RNA, 17 nt, Human
acuguaaauaugaaucu

SEQ ID NO: 2825486 - RNA, 19 nt, Human
acuuaaaaaaaaaaaaaag

SEQ ID NO: 2825487 - RNA, 20 nt, Human
acuuaaaaaaaaaaaaaagc

SEQ ID NO: 2825488 - RNA, 21 nt, Human
acuuaaaaaaaaaaaaaagcu

SEQ ID NO: 2825489 - RNA, 22 nt, Human
acuuaaaaaaaaaaaaaagcuu

SEQ ID NO: 2825490 - RNA, 19 nt, Human
acuuaaaaauguaaauauu

SEQ ID NO: 2825491 - RNA, 23 nt, Human
acuuaaaaauguaaauauucuau

SEQ ID NO: 2825492 - RNA, 14 nt, Human
acuuaaaaauguaa

SEQ ID NO: 2825493 - RNA, 16 nt, Human
acuuaaaaauguaaau

SEQ ID NO: 2825494 - RNA, 17 nt, Human
acuuaaaaauguaaaua

SEQ ID NO: 2825495 - RNA, 18 nt, Human
acuuaaaaauguaaauau

SEQ ID NO: 2825496 - RNA, 22 nt, Human
acuuaaaauaggggauauuuaa

SEQ ID NO: 2825497 - RNA, 23 nt, Human
acuuaaaauaggggauauuuaag

SEQ ID NO: 2825498 - RNA, 12 nt, Human
acuguuuuucca

SEQ ID NO: 2825499 - RNA, 19 nt, Human
acuguuuuuccauaguuuu

SEQ ID NO: 2825500 - RNA, 21 nt, Human
acuguuuuuccauaguuuuga

SEQ ID NO: 2825501 - RNA, 22 nt, Human
acuguuuuuccauaguuuugau

SEQ ID NO: 2825502 - RNA, 19 nt, Human
acuguuuuuagacaccuuc

SEQ ID NO: 2825503 - RNA, 18 nt, Human
acuucagaugggaggaaa

SEQ ID NO: 2825504 - RNA, 12 nt, Human
acuucagcaaga

SEQ ID NO: 2825505 - RNA, 14 nt, Human
acuucagcaagaga

SEQ ID NO: 2825506 - RNA, 15 nt, Human
acuucagcaagagag

SEQ ID NO: 2825507 - RNA, 16 nt, Human
acuucagcaagagaga

SEQ ID NO: 2825508 - RNA, 17 nt, Human
acuucagcaagagagaa

SEQ ID NO: 2825509 - RNA, 18 nt, Human
acuucagcaagagagaac

SEQ ID NO: 2825510 - RNA, 19 nt, Human
acuucagcaagagagaacc

SEQ ID NO: 2825511 - RNA, 21 nt, Human
acuucagcaagagagaaccua

SEQ ID NO: 2825512 - RNA, 10 nt, Human
acuucagcac

SEQ ID NO: 2825513 - RNA, 11 nt, Human
acuucagcacc

SEQ ID NO: 2825514 - RNA, 16 nt, Human
acuucuugcccugggg

SEQ ID NO: 2825515 - RNA, 18 nt, Human
acuucuugcccuggggau

SEQ ID NO: 2825516 - RNA, 22 nt, Human
acuucuuggcuuggugaggaaa

SEQ ID NO: 2825517 - RNA, 12 nt, Human
acuucuugucag

SEQ ID NO: 2825518 - RNA, 13 nt, Human
acuucuugucaga

SEQ ID NO: 2825519 - RNA, 15 nt, Human
acuucuugucagaca

SEQ ID NO: 2825520 - RNA, 16 nt, Human
acuucuugucagacau

SEQ ID NO: 2825521 - RNA, 17 nt, Human
acuucuugucagacaua

SEQ ID NO: 2825522 - RNA, 19 nt, Human
acuucuugucagacauaaa

SEQ ID NO: 2825523 - RNA, 20 nt, Human
acuucuugucagacauaaag

SEQ ID NO: 2825524 - RNA, 21 nt, Human
acuucuugucagacauaaagc

SEQ ID NO: 2825525 - RNA, 22 nt, Human
acuucuugucagacauaaagcc

SEQ ID NO: 2825526 - RNA, 23 nt, Human
acuucuugucagacauaaagcca

SEQ ID NO: 2825527 - RNA, 24 nt, Human
acuucuugucagacauaaagccau

SEQ ID NO: 2825528 - RNA, 16 nt, Human
acuugggugacggcag

SEQ ID NO: 2825529 - RNA, 20 nt, Human
acuucuuuugcucuuagcug

SEQ ID NO: 2825530 - RNA, 20 nt, Human
acuuguacaaaauaaacaaa

SEQ ID NO: 2825531 - RNA, 18 nt, Human
acuuguacaaaauaaaca

SEQ ID NO: 2825532 - RNA, 14 nt, Human
acuuguacaaaaua

SEQ ID NO: 2825533 - RNA, 19 nt, Human
acuugguccaacugcaacu

SEQ ID NO: 2825534 - RNA, 20 nt, Human
acuugguccaacugcaacuc

SEQ ID NO: 2825535 - RNA, 19 nt, Human
acuuggucugccaggcccc

SEQ ID NO: 2825536 - RNA, 11 nt, Human
acuuguagcug

SEQ ID NO: 2825537 - RNA, 14 nt, Human
acuuguagcuguaa

SEQ ID NO: 2825538 - RNA, 16 nt, Human
acuuguagcuguaaaa

SEQ ID NO: 2825539 - RNA, 17 nt, Human
acuuguagcuguaaaac

SEQ ID NO: 2825540 - RNA, 21 nt, Human
acuuguagcuguaaaacgcug

SEQ ID NO: 2825541 - RNA, 14 nt, Human
acuuguaggauaag

SEQ ID NO: 2825542 - RNA, 23 nt, Human
acuuguaggauaagugaaaugga

SEQ ID NO: 2825543 - RNA, 14 nt, Human
acuuguauaaaugu

SEQ ID NO: 2825544 - RNA, 15 nt, Human
acuuguauaaaugua

SEQ ID NO: 2825545 - RNA, 19 nt, Human
acuuguauaaauguauaua

SEQ ID NO: 2825546 - RNA, 20 nt, Human
acuuguauaaauguauauac

SEQ ID NO: 2825547 - RNA, 21 nt, Human
acuuguauaaauguauauaca

SEQ ID NO: 2825548 - RNA, 22 nt, Human
acuugggggaacgaugugucug

SEQ ID NO: 2825549 - RNA, 13 nt, Human
acuccggcccucc

SEQ ID NO: 2825550 - RNA, 20 nt, Human
acuccggauugcguuccucc

SEQ ID NO: 2825551 - RNA, 23 nt, Human
acuccggauugcguuccuccccg

SEQ ID NO: 2825552 - RNA, 12 nt, Human
acuccgccccca

SEQ ID NO: 2825553 - RNA, 13 nt, Human
acuccgcccccag

SEQ ID NO: 2825554 - RNA, 15 nt, Human
acuccgcccccagcc

SEQ ID NO: 2825555 - RNA, 16 nt, Human
acuccgcccccagccu

SEQ ID NO: 2825556 - RNA, 17 nt, Human
acuccgcccccagccua

SEQ ID NO: 2825557 - RNA, 18 nt, Human
acuccgcccccagccuau

SEQ ID NO: 2825558 - RNA, 21 nt, Human
acuccgcccccagccuaugag

SEQ ID NO: 2825559 - RNA, 14 nt, Human
acucccugcagaug

SEQ ID NO: 2825560 - RNA, 21 nt, Human
acucccucucaggauccaagc

SEQ ID NO: 2825561 - RNA, 13 nt, Human
acucccucucagg

SEQ ID NO: 2825562 - RNA, 18 nt, Human
acucccugccccccagcc

SEQ ID NO: 2825563 - RNA, 17 nt, Human
acucccugcagaugcca

SEQ ID NO: 2825564 - RNA, 13 nt, Human
acucccuucccau

SEQ ID NO: 2825565 - RNA, 21 nt, Human
acucccuucccaugacccagg

SEQ ID NO: 2825566 - RNA, 23 nt, Human
acucccuucccaugacccaggcu

SEQ ID NO: 2825567 - RNA, 22 nt, Human
acucccuccucaccucuggacu

SEQ ID NO: 2825568 - RNA, 20 nt, Human
acucccuccucaccucugga

SEQ ID NO: 2825569 - RNA, 19 nt, Human
acucccuccucaccucugg

SEQ ID NO: 2825570 - RNA, 16 nt, Human
acucccuccucaccuc

SEQ ID NO: 2825571 - RNA, 13 nt, Human
acucccuccucac

SEQ ID NO: 2825572 - RNA, 15 nt, Human
acucccuccucaccu

SEQ ID NO: 2825573 - RNA, 14 nt, Human
acuccccaaggaag

SEQ ID NO: 2825574 - RNA, 19 nt, Human
acuccccaaggaagagcca

SEQ ID NO: 2825575 - RNA, 19 nt, Human
acucccacccagucucugc

SEQ ID NO: 2825576 - RNA, 20 nt, Human
acucccacccagucucugcu

SEQ ID NO: 2825577 - RNA, 22 nt, Human
acucccacccagucucugcucc

SEQ ID NO: 2825578 - RNA, 15 nt, Human
acucccaagcuggac

SEQ ID NO: 2825579 - RNA, 12 nt, Human
acuccauuccca

SEQ ID NO: 2825580 - RNA, 14 nt, Human
acuccauucccaac

SEQ ID NO: 2825581 - RNA, 18 nt, Human
acuccauucccaacuaga

SEQ ID NO: 2825582 - RNA, 22 nt, Human
acuccauucccaacuagacauu

SEQ ID NO: 2825583 - RNA, 22 nt, Human
acucccaguccaaauguccucc

SEQ ID NO: 2825584 - RNA, 15 nt, Human
acucccaguccccag

SEQ ID NO: 2825585 - RNA, 16 nt, Human
acucccaucaccucua

SEQ ID NO: 2825586 - RNA, 13 nt, Human
acucccaggcagc

SEQ ID NO: 2825587 - RNA, 13 nt, Human
acucccaugaagc

SEQ ID NO: 2825588 - RNA, 14 nt, Human
acucccaugaagcc

SEQ ID NO: 2825589 - RNA, 15 nt, Human
acucccaugaagccu

SEQ ID NO: 2825590 - RNA, 16 nt, Human
acucccaugaagccuu

SEQ ID NO: 2825591 - RNA, 17 nt, Human
acucccaugaagccuuu

SEQ ID NO: 2825592 - RNA, 18 nt, Human
acucccaugaagccuuuu

SEQ ID NO: 2825593 - RNA, 20 nt, Human
acucccaugaagccuuuuga

SEQ ID NO: 2825594 - RNA, 22 nt, Human
acucccaugaagccuuuugaaa

SEQ ID NO: 2825595 - RNA, 21 nt, Human
acuccggugugccugcagccc

SEQ ID NO: 2825596 - RNA, 20 nt, Human
acuccggugugccugcagcc

SEQ ID NO: 2825597 - RNA, 19 nt, Human
acuccggugugccugcagc

SEQ ID NO: 2825598 - RNA, 14 nt, Human
acuccggcccuccu

SEQ ID NO: 2825599 - RNA, 15 nt, Human
acuccggcccuccua

SEQ ID NO: 2825600 - RNA, 16 nt, Human
acuccggugugccugc

SEQ ID NO: 2825601 - RNA, 15 nt, Human
acuccggugugccug

SEQ ID NO: 2825602 - RNA, 17 nt, Human
acuccuaaaccuuugcc

SEQ ID NO: 2825603 - RNA, 15 nt, Human
acucuacagaggcca

SEQ ID NO: 2825604 - RNA, 14 nt, Human
acugauauauuuuc

SEQ ID NO: 2825605 - RNA, 13 nt, Human
acugauauucaga

SEQ ID NO: 2825606 - RNA, 15 nt, Human
acugauauucagaau

SEQ ID NO: 2825607 - RNA, 16 nt, Human
acugauauucagaauu

SEQ ID NO: 2825608 - RNA, 23 nt, Human
acugaugggcaacccccagccug

SEQ ID NO: 2825609 - RNA, 22 nt, Human
acugauuugcaauaaaaaugau

SEQ ID NO: 2825610 - RNA, 13 nt, Human
acugacacaggaa

SEQ ID NO: 2825611 - RNA, 20 nt, Human
acugacacaggaaaccaaca

SEQ ID NO: 2825612 - RNA, 21 nt, Human
acugacacaggaaaccaacac

SEQ ID NO: 2825613 - RNA, 13 nt, Human
acugacacaaagg

SEQ ID NO: 2825614 - RNA, 14 nt, Human
acugacacaaagga

SEQ ID NO: 2825615 - RNA, 16 nt, Human
acugacacaaaggaag

SEQ ID NO: 2825616 - RNA, 17 nt, Human
acugacacaaaggaagu

SEQ ID NO: 2825617 - RNA, 15 nt, Human
acugaauuuguacuu

SEQ ID NO: 2825618 - RNA, 18 nt, Human
acugacauuguuggccaa

SEQ ID NO: 2825619 - RNA, 17 nt, Human
acugacauuguuggcca

SEQ ID NO: 2825620 - RNA, 20 nt, Human
acugacacucccacccaguc

SEQ ID NO: 2825621 - RNA, 12 nt, Human
acugacagcaug

SEQ ID NO: 2825622 - RNA, 13 nt, Human
acugacagcaugu

SEQ ID NO: 2825623 - RNA, 20 nt, Human
acugacagcaugugcccucc

SEQ ID NO: 2825624 - RNA, 18 nt, Human
acugacagccucccaccc

SEQ ID NO: 2825625 - RNA, 23 nt, Human
acugacaugauuagcagaagaaa

SEQ ID NO: 2825626 - RNA, 21 nt, Human
acugaauuaaucaucuauaaa

SEQ ID NO: 2825627 - RNA, 13 nt, Human
acugaauuaauca

SEQ ID NO: 2825628 - RNA, 20 nt, Human
acugaaugggaucaugaaag

SEQ ID NO: 2825629 - RNA, 21 nt, Human
acugaaugggaucaugaaagu

SEQ ID NO: 2825630 - RNA, 19 nt, Human
acugaauguuuauuccuug

SEQ ID NO: 2825631 - RNA, 19 nt, Human
acucuacccucccaccccc

SEQ ID NO: 2825632 - RNA, 18 nt, Human
acucuacccucccacccc

SEQ ID NO: 2825633 - RNA, 16 nt, Human
acucuacccucccacc

SEQ ID NO: 2825634 - RNA, 15 nt, Human
acucuacccucccac

SEQ ID NO: 2825635 - RNA, 13 nt, Human
acucuacccuccc

SEQ ID NO: 2825636 - RNA, 17 nt, Human
acucuaccagugcaggc

SEQ ID NO: 2825637 - RNA, 18 nt, Human
acucuaccagugcaggcu

SEQ ID NO: 2825638 - RNA, 22 nt, Human
acucuaccagugcaggcuggcc

SEQ ID NO: 2825639 - RNA, 15 nt, Human
acugauuuuugugau

SEQ ID NO: 2825640 - RNA, 14 nt, Human
acugauuuuuguga

SEQ ID NO: 2825641 - RNA, 18 nt, Human
acugauguacaauuaaaa

SEQ ID NO: 2825642 - RNA, 23 nt, Human
auaaaaauauuguguugugaaug

SEQ ID NO: 2825643 - RNA, 22 nt, Human
auaaaaauauuguguugugaau

SEQ ID NO: 2825644 - RNA, 23 nt, Human
auaaaaacauugccuuugaaugu

SEQ ID NO: 2825645 - RNA, 19 nt, Human
auaaaaaucauggcaacau

SEQ ID NO: 2825646 - RNA, 12 nt, Human
auaaaaaugaca

SEQ ID NO: 2825647 - RNA, 13 nt, Human
auaaaaaugacag

SEQ ID NO: 2825648 - RNA, 13 nt, Human
auaaaacaaaggg

SEQ ID NO: 2825649 - RNA, 12 nt, Human
auaaaacaggua

SEQ ID NO: 2825650 - RNA, 14 nt, Human
auaaaacagcuuug

SEQ ID NO: 2825651 - RNA, 12 nt, Human
auaaaaaaugga

SEQ ID NO: 2825652 - RNA, 15 nt, Human
auaaaaaauuaugac

SEQ ID NO: 2825653 - RNA, 20 nt, Human
auaaaaagacauucuuccaa

SEQ ID NO: 2825654 - RNA, 13 nt, Human
auaaaaacuugaa

SEQ ID NO: 2825655 - RNA, 20 nt, Human
auaaaaacuugaaaauauau

SEQ ID NO: 2825656 - RNA, 16 nt, Human
auaaaaacccacaaaa

SEQ ID NO: 2825657 - RNA, 18 nt, Human
auaaaaacccacaaaaau

SEQ ID NO: 2825658 - RNA, 14 nt, Human
auaaaaaaauaaaa

SEQ ID NO: 2825659 - RNA, 14 nt, Human
auaaaaaagaaauc

SEQ ID NO: 2825660 - RNA, 11 nt, Human
auaaaaaauaa

SEQ ID NO: 2825661 - RNA, 19 nt, Human
auaaaaaauauucuuguca

SEQ ID NO: 2825662 - RNA, 17 nt, Human
auaaaaaaacaaucauu

SEQ ID NO: 2825663 - RNA, 19 nt, Human
auaaaaaaacaaucauuug

SEQ ID NO: 2825664 - RNA, 20 nt, Human
aguuugaugucauuaaugug

SEQ ID NO: 2825665 - RNA, 15 nt, Human
aguuugcauuccuga

SEQ ID NO: 2825666 - RNA, 20 nt, Human
aguuugcauuccugauauga

SEQ ID NO: 2825667 - RNA, 21 nt, Human
aguuugcccugguuucacugg

SEQ ID NO: 2825668 - RNA, 12 nt, Human
aguuugcccugg

SEQ ID NO: 2825669 - RNA, 20 nt, Human
aguuugaucacacuauuuua

SEQ ID NO: 2825670 - RNA, 17 nt, Human
aguuugaggcugcagcg

SEQ ID NO: 2825671 - RNA, 14 nt, Human
aguuugaggcugca

SEQ ID NO: 2825672 - RNA, 14 nt, Human
aguuucuuagcuuu

SEQ ID NO: 2825673 - RNA, 14 nt, Human
aguuucuguuugau

SEQ ID NO: 2825674 - RNA, 17 nt, Human
aguuucuguuugauucu

SEQ ID NO: 2825675 - RNA, 18 nt, Human
aguuucuguuugauucuu

SEQ ID NO: 2825676 - RNA, 19 nt, Human
aguuucuguuugauucuuu

SEQ ID NO: 2825677 - RNA, 17 nt, Human
aguuucuguccugcugg

SEQ ID NO: 2825678 - RNA, 13 nt, Human
aguuaauuuaucu

SEQ ID NO: 2825679 - RNA, 15 nt, Human
aguuaauuuaucuaa

SEQ ID NO: 2825680 - RNA, 18 nt, Human
aguuaauuuaucuaaauu

SEQ ID NO: 2825681 - RNA, 14 nt, Human
aguuaauuagcauu

SEQ ID NO: 2825682 - RNA, 19 nt, Human
aguuaauuagcauucuggc

SEQ ID NO: 2825683 - RNA, 20 nt, Human
aguuaacuauugcauuuaua

SEQ ID NO: 2825684 - RNA, 24 nt, Human
aguuaacuauugcauuuauaugua

SEQ ID NO: 2825685 - RNA, 15 nt, Human
aguuaacaucaugaa

SEQ ID NO: 2825686 - RNA, 21 nt, Human
aguuaacaucaugaauuuauu

SEQ ID NO: 2825687 - RNA, 15 nt, Human
aguuaacuauugcau

SEQ ID NO: 2825688 - RNA, 19 nt, Human
aguuaacuauugcauuuau

SEQ ID NO: 2825689 - RNA, 17 nt, Human
aguuaacuauugcauuu

SEQ ID NO: 2825690 - RNA, 21 nt, Human
aguuaaauagaguauaugcac

SEQ ID NO: 2825691 - RNA, 23 nt, Human
aguuaaauagaguauaugcacuu

SEQ ID NO: 2825692 - RNA, 14 nt, Human
aguguuuuggacuc

SEQ ID NO: 2825693 - RNA, 15 nt, Human
aguguuuuggacucc

SEQ ID NO: 2825694 - RNA, 18 nt, Human
aguguuuuggacuccauc

SEQ ID NO: 2825695 - RNA, 19 nt, Human
aguguuuuggacuccaucu

SEQ ID NO: 2825696 - RNA, 20 nt, Human
aguguuuuggacuccaucuc

SEQ ID NO: 2825697 - RNA, 21 nt, Human
aguguuuuggacuccaucucu

SEQ ID NO: 2825698 - RNA, 22 nt, Human
aguguuuuggacuccaucucuc

SEQ ID NO: 2825699 - RNA, 23 nt, Human
aguguuuuggacuccaucucuca

SEQ ID NO: 2825700 - RNA, 12 nt, Human
aguguuuggggg

SEQ ID NO: 2825701 - RNA, 22 nt, Human
aguguuugggggacguuucuca

SEQ ID NO: 2825702 - RNA, 23 nt, Human
aguguuugggggacguuucucau

SEQ ID NO: 2825703 - RNA, 21 nt, Human
aguguuucuguuauuaacaaa

SEQ ID NO: 2825704 - RNA, 20 nt, Human
aguguuuggugcucauuuaa

SEQ ID NO: 2825705 - RNA, 14 nt, Human
aguguuuuaaauuc

SEQ ID NO: 2825706 - RNA, 15 nt, Human
aguguuuuaaauucu

SEQ ID NO: 2825707 - RNA, 17 nt, Human
aguguuuuaaauucuga

SEQ ID NO: 2825708 - RNA, 18 nt, Human
aguguuuuaaauucugag

SEQ ID NO: 2825709 - RNA, 19 nt, Human
aguguuuuaaauucugaga

SEQ ID NO: 2825710 - RNA, 17 nt, Human
aguguuuuaagaaaugu

SEQ ID NO: 2825711 - RNA, 19 nt, Human
aguguuuuaagaaauguag

SEQ ID NO: 2825712 - RNA, 21 nt, Human
aguguuuuaagaaauguaguu

SEQ ID NO: 2825713 - RNA, 19 nt, Human
aguggccccuuaggccagu

SEQ ID NO: 2825714 - RNA, 15 nt, Human
aguguuucuguuauu

SEQ ID NO: 2825715 - RNA, 14 nt, Human
agugcucaucuguu

SEQ ID NO: 2825716 - RNA, 14 nt, Human
aguguuucuguuau

SEQ ID NO: 2825717 - RNA, 14 nt, Human
aguggccacucagc

SEQ ID NO: 2825718 - RNA, 14 nt, Human
agugcuccccucug

SEQ ID NO: 2825719 - RNA, 18 nt, Human
agugcuccccucugaaag

SEQ ID NO: 2825720 - RNA, 22 nt, Human
aguggcauguuuugugcauuug

SEQ ID NO: 2825721 - RNA, 14 nt, Human
aguucauacccugu

SEQ ID NO: 2825722 - RNA, 18 nt, Human
aguucauaccuaaguacu

SEQ ID NO: 2825723 - RNA, 20 nt, Human
aguucauaccuaaguacugu

SEQ ID NO: 2825724 - RNA, 21 nt, Human
aguucauaccuaaguacugua

SEQ ID NO: 2825725 - RNA, 22 nt, Human
aguucauaccuaaguacuguaa

SEQ ID NO: 2825726 - RNA, 20 nt, Human
aguucauauuccauauuuau

SEQ ID NO: 2825727 - RNA, 19 nt, Human
aguucauauuccauauuua

SEQ ID NO: 2825728 - RNA, 18 nt, Human
aguucaucccagccccaa

SEQ ID NO: 2825729 - RNA, 19 nt, Human
aguucaucccagccccaau

SEQ ID NO: 2825730 - RNA, 20 nt, Human
aguucaucccagccccaauu

SEQ ID NO: 2825731 - RNA, 20 nt, Human
aguuccaagagucuaaagau

SEQ ID NO: 2825732 - RNA, 20 nt, Human
aguuccaaguccaauaagac

SEQ ID NO: 2825733 - RNA, 14 nt, Human
aguuccacagauug

SEQ ID NO: 2825734 - RNA, 18 nt, Human
aguuccacagauuguuuc

SEQ ID NO: 2825735 - RNA, 21 nt, Human
aguuccacagauuguuucuau

SEQ ID NO: 2825736 - RNA, 20 nt, Human
aguuguucaauaauaaauau

SEQ ID NO: 2825737 - RNA, 15 nt, Human
aguuguucaacuauu

SEQ ID NO: 2825738 - RNA, 17 nt, Human
aguuguucaacuauuuu

SEQ ID NO: 2825739 - RNA, 20 nt, Human
aguuguucaacuauuuuauu

SEQ ID NO: 2825740 - RNA, 19 nt, Human
aguugaaugacaacagaag

SEQ ID NO: 2825741 - RNA, 17 nt, Human
aguugaagacuuuguuu

SEQ ID NO: 2825742 - RNA, 15 nt, Human
aguugaaguuuagga

SEQ ID NO: 2825743 - RNA, 15 nt, Human
auacaauucuacauu

SEQ ID NO: 2825744 - RNA, 20 nt, Human
auacaauguauuuauuuaaa

SEQ ID NO: 2825745 - RNA, 21 nt, Human
auacaauguauuuauuuaaaa

SEQ ID NO: 2825746 - RNA, 18 nt, Human
auacaauguauuuauuua

SEQ ID NO: 2825747 - RNA, 23 nt, Human
auaauguuaaauuuguaaguuuc

SEQ ID NO: 2825748 - RNA, 18 nt, Human
auaauguuaaccaaggaa

SEQ ID NO: 2825749 - RNA, 19 nt, Human
auaauguuaaccaaggaaa

SEQ ID NO: 2825750 - RNA, 20 nt, Human
auaauguuaaccaaggaaau

SEQ ID NO: 2825751 - RNA, 16 nt, Human
auaauguuaaauuugu

SEQ ID NO: 2825752 - RNA, 18 nt, Human
auaauguuaaauuuguaa

SEQ ID NO: 2825753 - RNA, 19 nt, Human
auaauguuaaauuuguaag

SEQ ID NO: 2825754 - RNA, 22 nt, Human
auaauguuaaauuuguaaguuu

SEQ ID NO: 2825755 - RNA, 14 nt, Human
auaagugaaaaucu

SEQ ID NO: 2825756 - RNA, 16 nt, Human
auaagugaaaaucuua

SEQ ID NO: 2825757 - RNA, 21 nt, Human
auaagugaaauggauacuaca

SEQ ID NO: 2825758 - RNA, 22 nt, Human
auaagugaaauggauacuacau

SEQ ID NO: 2825759 - RNA, 17 nt, Human
auaaguaauucaagaaa

SEQ ID NO: 2825760 - RNA, 15 nt, Human
auaagugaagugaua

SEQ ID NO: 2825761 - RNA, 15 nt, Human
auaagugaauaauaa

SEQ ID NO: 2825762 - RNA, 14 nt, Human
auaagugaauuuau

SEQ ID NO: 2825763 - RNA, 15 nt, Human
auaagugaauuuaua

SEQ ID NO: 2825764 - RNA, 19 nt, Human
auaagugcacacagaaaua

SEQ ID NO: 2825765 - RNA, 20 nt, Human
auaagugcacacagaaauau

SEQ ID NO: 2825766 - RNA, 21 nt, Human
auaagugcacacagaaauaua

SEQ ID NO: 2825767 - RNA, 23 nt, Human
auaagugcacacagaaauauaua

SEQ ID NO: 2825768 - RNA, 10 nt, Human
auaauguuaa

SEQ ID NO: 2825769 - RNA, 11 nt, Human
auaauguuaaa

SEQ ID NO: 2825770 - RNA, 12 nt, Human
auaauguuaaau

SEQ ID NO: 2825771 - RNA, 12 nt, Human
auaaugugugua

SEQ ID NO: 2825772 - RNA, 13 nt, Human
auaauguguguau

SEQ ID NO: 2825773 - RNA, 14 nt, Human
auaauguguguaug

SEQ ID NO: 2825774 - RNA, 15 nt, Human
auaauguguguaugu

SEQ ID NO: 2825775 - RNA, 16 nt, Human
auaauguguguaugug

SEQ ID NO: 2825776 - RNA, 18 nt, Human
auaauguguguaugugua

SEQ ID NO: 2825777 - RNA, 19 nt, Human
auaauguguguauguguau

SEQ ID NO: 2825778 - RNA, 15 nt, Human
auaaguaaaugcuag

SEQ ID NO: 2825779 - RNA, 23 nt, Human
auaagguuucguuucuguauaca

SEQ ID NO: 2825780 - RNA, 14 nt, Human
auaagcucuaguuc

SEQ ID NO: 2825781 - RNA, 19 nt, Human
auaagguuucguuucugua

SEQ ID NO: 2825782 - RNA, 20 nt, Human
auaagguuucguuucuguau

SEQ ID NO: 2825783 - RNA, 20 nt, Human
auaagguguuuucuguguaa

SEQ ID NO: 2825784 - RNA, 21 nt, Human
auaagguguuuucuguguaac

SEQ ID NO: 2825785 - RNA, 22 nt, Human
auaagguguuuucuguguaacc

SEQ ID NO: 2825786 - RNA, 21 nt, Human
auaagcuaacaccagacagac

SEQ ID NO: 2825787 - RNA, 18 nt, Human
auaagcggcguaaguuua

SEQ ID NO: 2825788 - RNA, 15 nt, Human
auaaagagagaaaaa

SEQ ID NO: 2825789 - RNA, 11 nt, Human
auaaagacagg

SEQ ID NO: 2825790 - RNA, 16 nt, Human
auaaagacccaggggg

SEQ ID NO: 2825791 - RNA, 19 nt, Human
auaaagaggcguugcuuuc

SEQ ID NO: 2825792 - RNA, 21 nt, Human
auaaagagagaaaaacaaauu

SEQ ID NO: 2825793 - RNA, 13 nt, Human
auaaagaguuaga

SEQ ID NO: 2825794 - RNA, 14 nt, Human
auacacauauaccu

SEQ ID NO: 2825795 - RNA, 21 nt, Human
auacacauauaccuauaaugu

SEQ ID NO: 2825796 - RNA, 23 nt, Human
auacacauauaccuauaaugugu

SEQ ID NO: 2825797 - RNA, 14 nt, Human
auacaccgggccug

SEQ ID NO: 2825798 - RNA, 18 nt, Human
auacaccgggccuggaga

SEQ ID NO: 2825799 - RNA, 23 nt, Human
auacacccccucuucugagcaca

SEQ ID NO: 2825800 - RNA, 22 nt, Human
auacacccccucuucugagcac

SEQ ID NO: 2825801 - RNA, 15 nt, Human
auacacgaaagagag

SEQ ID NO: 2825802 - RNA, 19 nt, Human
auacacuaaccaaaucucu

SEQ ID NO: 2825803 - RNA, 22 nt, Human
auacacuauuugugagcaaagg

SEQ ID NO: 2825804 - RNA, 19 nt, Human
auacacuaauuccuuucua

SEQ ID NO: 2825805 - RNA, 22 nt, Human
auaaguaacuuuauucuugaaa

SEQ ID NO: 2825806 - RNA, 12 nt, Human
auacuugaacaa

SEQ ID NO: 2825807 - RNA, 13 nt, Human
auacuugaacaaa

SEQ ID NO: 2825808 - RNA, 14 nt, Human
auacuugaacaaaa

SEQ ID NO: 2825809 - RNA, 15 nt, Human
auacuugaacaaaag

SEQ ID NO: 2825810 - RNA, 17 nt, Human
auacuugaacaaaaggg

SEQ ID NO: 2825811 - RNA, 18 nt, Human
auacuugaacaaaagggu

SEQ ID NO: 2825812 - RNA, 22 nt, Human
auacuugaacaaaagggucaga

SEQ ID NO: 2825813 - RNA, 16 nt, Human
auagcaacacucuaua

SEQ ID NO: 2825814 - RNA, 15 nt, Human
auagcaacaggaaaa

SEQ ID NO: 2825815 - RNA, 17 nt, Human
auagaaaacugaaaauc

SEQ ID NO: 2825816 - RNA, 21 nt, Human
auagaaaaguagacaaucauu

SEQ ID NO: 2825817 - RNA, 10 nt, Human
auagaaaaau

SEQ ID NO: 2825818 - RNA, 23 nt, Human
auagaaaaauucagcaaaccauu

SEQ ID NO: 2825819 - RNA, 21 nt, Human
auacuuuuuuuucuuuaaaaa

SEQ ID NO: 2825820 - RNA, 14 nt, Human
auacuuuuuuucac

SEQ ID NO: 2825821 - RNA, 15 nt, Human
auacuuuuuuucaca

SEQ ID NO: 2825822 - RNA, 20 nt, Human
auacuuuuuacaauuaaaaa

SEQ ID NO: 2825823 - RNA, 13 nt, Human
auacuuuuucuaa

SEQ ID NO: 2825824 - RNA, 17 nt, Human
auacuuuuucuaaugag

SEQ ID NO: 2825825 - RNA, 15 nt, Human
auacuuuuucuuuug

SEQ ID NO: 2825826 - RNA, 17 nt, Human
auacuuuuucuuuugua

SEQ ID NO: 2825827 - RNA, 18 nt, Human
auacuuuuucuuuuguaa

SEQ ID NO: 2825828 - RNA, 21 nt, Human
auacuuuuucuuuuguaagug

SEQ ID NO: 2825829 - RNA, 13 nt, Human
auacuuuuuacaa

SEQ ID NO: 2825830 - RNA, 12 nt, Human
auacuuuuccuu

SEQ ID NO: 2825831 - RNA, 13 nt, Human
auacuuuuccuua

SEQ ID NO: 2825832 - RNA, 19 nt, Human
auacuuuuccuuaccuuua

SEQ ID NO: 2825833 - RNA, 21 nt, Human
auacuuaaauggaaaaaauga

SEQ ID NO: 2825834 - RNA, 22 nt, Human
auacugugugcuuguuuuauaa

SEQ ID NO: 2825835 - RNA, 14 nt, Human
auacuguguggaac

SEQ ID NO: 2825836 - RNA, 12 nt, Human
aguaccuugcuu

SEQ ID NO: 2825837 - RNA, 13 nt, Human
aguaccuugcuuc

SEQ ID NO: 2825838 - RNA, 14 nt, Human
aguaccuugcuucu

SEQ ID NO: 2825839 - RNA, 15 nt, Human
aguacuggcauggua

SEQ ID NO: 2825840 - RNA, 21 nt, Human
aguacuucuccacccugcucu

SEQ ID NO: 2825841 - RNA, 17 nt, Human
aguacugcucuuguuuc

SEQ ID NO: 2825842 - RNA, 17 nt, Human
aguauaucauguaaaga

SEQ ID NO: 2825843 - RNA, 21 nt, Human
aguauaucauguaaagaaaug

SEQ ID NO: 2825844 - RNA, 20 nt, Human
aguauaucccaagugcacuu

SEQ ID NO: 2825845 - RNA, 17 nt, Human
aguauagccuauggcag

SEQ ID NO: 2825846 - RNA, 19 nt, Human
aguacuucuccacccugcu

SEQ ID NO: 2825847 - RNA, 20 nt, Human
aguacuucuccacccugcuc

SEQ ID NO: 2825848 - RNA, 14 nt, Human
aguaacugacauga

SEQ ID NO: 2825849 - RNA, 15 nt, Human
aguauauuuaaacuc

SEQ ID NO: 2825850 - RNA, 22 nt, Human
aguauauuucuucguucuuuuu

SEQ ID NO: 2825851 - RNA, 12 nt, Human
aguauaugugag

SEQ ID NO: 2825852 - RNA, 15 nt, Human
aguauauguucccuc

SEQ ID NO: 2825853 - RNA, 19 nt, Human
aguaacuucuuauggaauu

SEQ ID NO: 2825854 - RNA, 17 nt, Human
aguaacuucuuauggaa

SEQ ID NO: 2825855 - RNA, 14 nt, Human
aguaacuuggcuuu

SEQ ID NO: 2825856 - RNA, 15 nt, Human
aguaacuuggcuuuc

SEQ ID NO: 2825857 - RNA, 18 nt, Human
aguaacuuggcuuucauu

SEQ ID NO: 2825858 - RNA, 14 nt, Human
aguaacuuuaugug

SEQ ID NO: 2825859 - RNA, 16 nt, Human
aguaacuuuaugugua

SEQ ID NO: 2825860 - RNA, 17 nt, Human
aguaacuuuauguguaa

SEQ ID NO: 2825861 - RNA, 15 nt, Human
aguaccugaaaagua

SEQ ID NO: 2825862 - RNA, 14 nt, Human
aguaccugaaaagu

SEQ ID NO: 2825863 - RNA, 20 nt, Human
aguaacuuuauguguaaaua

SEQ ID NO: 2825864 - RNA, 15 nt, Human
aguaacuuuauucuu

SEQ ID NO: 2825865 - RNA, 19 nt, Human
aguaacuuuauguguaaau

SEQ ID NO: 2825866 - RNA, 13 nt, Human
aguaagaaaagug

SEQ ID NO: 2825867 - RNA, 19 nt, Human
aguaacugccaucaagaug

SEQ ID NO: 2825868 - RNA, 22 nt, Human
aguaacucauuuguuaaaauua

SEQ ID NO: 2825869 - RNA, 11 nt, Human
aguaacuccca

SEQ ID NO: 2825870 - RNA, 12 nt, Human
aguaacucauuu

SEQ ID NO: 2825871 - RNA, 21 nt, Human
aguaacgggucguaaugacuu

SEQ ID NO: 2825872 - RNA, 22 nt, Human
aguaacgggucguaaugacuua

SEQ ID NO: 2825873 - RNA, 15 nt, Human
aguaacuauuauuau

SEQ ID NO: 2825874 - RNA, 22 nt, Human
aguaacucauaaucuauaaaca

SEQ ID NO: 2825875 - RNA, 12 nt, Human
aguaaccugggu

SEQ ID NO: 2825876 - RNA, 18 nt, Human
aguaaaguguucugccag

SEQ ID NO: 2825877 - RNA, 19 nt, Human
aguaaagugauaauuucug

SEQ ID NO: 2825878 - RNA, 18 nt, Human
aguaaagugauaauuucu

SEQ ID NO: 2825879 - RNA, 12 nt, Human
aguaaagaacug

SEQ ID NO: 2825880 - RNA, 23 nt, Human
aguaaagaacugcacaugaagaa

SEQ ID NO: 2825881 - RNA, 13 nt, Human
aguaaagccauua

SEQ ID NO: 2825882 - RNA, 20 nt, Human
aguaaagccauuaaaugaau

SEQ ID NO: 2825883 - RNA, 21 nt, Human
aguaaagccauuaaaugaaua

SEQ ID NO: 2825884 - RNA, 23 nt, Human
aguaaagccauuaaaugaauauu

SEQ ID NO: 2825885 - RNA, 17 nt, Human
aguaaagccguuguuua

SEQ ID NO: 2825886 - RNA, 18 nt, Human
aguaaagccguuguuuac

SEQ ID NO: 2825887 - RNA, 22 nt, Human
aguaaauaucccaaacugugau

SEQ ID NO: 2825888 - RNA, 13 nt, Human
aguaaauauugag

SEQ ID NO: 2825889 - RNA, 18 nt, Human
aguaaauauugaggcuuu

SEQ ID NO: 2825890 - RNA, 21 nt, Human
aguaaauauugaggcuuugug

SEQ ID NO: 2825891 - RNA, 24 nt, Human
aguaaacuccccuuucccucgcua

SEQ ID NO: 2825892 - RNA, 15 nt, Human
aguaaacugcagucc

SEQ ID NO: 2825893 - RNA, 13 nt, Human
aguaaaauuuauu

SEQ ID NO: 2825894 - RNA, 15 nt, Human
aguaaaauuuauuuc

SEQ ID NO: 2825895 - RNA, 16 nt, Human
aguaaaauuuauuuca

SEQ ID NO: 2825896 - RNA, 17 nt, Human
aguaaaauuuauuucau

SEQ ID NO: 2825897 - RNA, 16 nt, Human
aggggccauuuggcau

SEQ ID NO: 2825898 - RNA, 22 nt, Human
aggggccagaggaacuguccag

SEQ ID NO: 2825899 - RNA, 16 nt, Human
agugauguaccaugaa

SEQ ID NO: 2825900 - RNA, 14 nt, Human
agugauguuuuuau

SEQ ID NO: 2825901 - RNA, 17 nt, Human
agugauguuuuuaugau

SEQ ID NO: 2825902 - RNA, 23 nt, Human
agugauguuuuuaugauaucccu

SEQ ID NO: 2825903 - RNA, 20 nt, Human
agugauggguuaguggaugg

SEQ ID NO: 2825904 - RNA, 22 nt, Human
agugauccucccaccucagccu

SEQ ID NO: 2825905 - RNA, 20 nt, Human
agugauccucccaccucagc

SEQ ID NO: 2825906 - RNA, 19 nt, Human
agugauccucccaccucag

SEQ ID NO: 2825907 - RNA, 20 nt, Human
agugauucuccugccucagc

SEQ ID NO: 2825908 - RNA, 18 nt, Human
agugauucuccugccuca

SEQ ID NO: 2825909 - RNA, 19 nt, Human
agugauucuccugccucag

SEQ ID NO: 2825910 - RNA, 22 nt, Human
agugccuuucugcaguuuuuca

SEQ ID NO: 2825911 - RNA, 19 nt, Human
agugccuuuugcagaagag

SEQ ID NO: 2825912 - RNA, 20 nt, Human
agugccuuuugcagaagagg

SEQ ID NO: 2825913 - RNA, 22 nt, Human
agugccuuuugcagaagagggu

SEQ ID NO: 2825914 - RNA, 14 nt, Human
agugcgugcucagu

SEQ ID NO: 2825915 - RNA, 13 nt, Human
agugcgugaaugu

SEQ ID NO: 2825916 - RNA, 14 nt, Human
agugcgugaaugua

SEQ ID NO: 2825917 - RNA, 17 nt, Human
agugcgugaauguaugu

SEQ ID NO: 2825918 - RNA, 16 nt, Human
agugcgugccguguga

SEQ ID NO: 2825919 - RNA, 13 nt, Human
agugcguguguag

SEQ ID NO: 2825920 - RNA, 16 nt, Human
agugcguguguagagu

SEQ ID NO: 2825921 - RNA, 18 nt, Human
agugcguguguagaguua

SEQ ID NO: 2825922 - RNA, 22 nt, Human
agugcguguguagaguuaagaa

SEQ ID NO: 2825923 - RNA, 13 nt, Human
agugcuaagguuc

SEQ ID NO: 2825924 - RNA, 14 nt, Human
agugcuaagguucu

SEQ ID NO: 2825925 - RNA, 15 nt, Human
agugcuaagguucua

SEQ ID NO: 2825926 - RNA, 16 nt, Human
agugcuaagguucuaa

SEQ ID NO: 2825927 - RNA, 17 nt, Human
agugcuaagguucuaag

SEQ ID NO: 2825928 - RNA, 18 nt, Human
agugcuaagguucuaagg

SEQ ID NO: 2825929 - RNA, 21 nt, Human
agugcuaagguucuaaggccu

SEQ ID NO: 2825930 - RNA, 14 nt, Human
agugcuacauaaau

SEQ ID NO: 2825931 - RNA, 17 nt, Human
agugcuacauaaauugg

SEQ ID NO: 2825932 - RNA, 21 nt, Human
agugcuagugagcugggcaug

SEQ ID NO: 2825933 - RNA, 23 nt, Human
agugcuagugagcugggcauggu

SEQ ID NO: 2825934 - RNA, 13 nt, Human
agugcuauauaua

SEQ ID NO: 2825935 - RNA, 14 nt, Human
agugcuauauauau

SEQ ID NO: 2825936 - RNA, 15 nt, Human
agugcuauauauaua

SEQ ID NO: 2825937 - RNA, 16 nt, Human
agugcuauauauauaa

SEQ ID NO: 2825938 - RNA, 17 nt, Human
agugcuauauauauaaa

SEQ ID NO: 2825939 - RNA, 19 nt, Human
agugcuauauauauaaaua

SEQ ID NO: 2825940 - RNA, 22 nt, Human
agugcuauauauauaaauauuu

SEQ ID NO: 2825941 - RNA, 23 nt, Human
agugcuauauauauaaauauuug

SEQ ID NO: 2825942 - RNA, 15 nt, Human
agugcuaugaagaca

SEQ ID NO: 2825943 - RNA, 14 nt, Human
agugacagaggcag

SEQ ID NO: 2825944 - RNA, 17 nt, Human
agugaaugccagugugc

SEQ ID NO: 2825945 - RNA, 13 nt, Human
agugaaugaaaga

SEQ ID NO: 2825946 - RNA, 14 nt, Human
agugaaugaaagau

SEQ ID NO: 2825947 - RNA, 15 nt, Human
agugaaugaaagauu

SEQ ID NO: 2825948 - RNA, 13 nt, Human
agugaaugaaaca

SEQ ID NO: 2825949 - RNA, 15 nt, Human
agugaauaugccugu

SEQ ID NO: 2825950 - RNA, 19 nt, Human
agugacagaggcagcccca

SEQ ID NO: 2825951 - RNA, 16 nt, Human
agugacagaggcagcc

SEQ ID NO: 2825952 - RNA, 13 nt, Human
agucauuuacuaa

SEQ ID NO: 2825953 - RNA, 14 nt, Human
agucauuuacuaaa

SEQ ID NO: 2825954 - RNA, 15 nt, Human
agucauuuacuaaac

SEQ ID NO: 2825955 - RNA, 17 nt, Human
agucauuuacuaaacau

SEQ ID NO: 2825956 - RNA, 18 nt, Human
agucauuuacuaaacaua

SEQ ID NO: 2825957 - RNA, 19 nt, Human
agucauuuacuaaacauau

SEQ ID NO: 2825958 - RNA, 23 nt, Human
agucauuuacuaaacauaugauu

SEQ ID NO: 2825959 - RNA, 15 nt, Human
agucauuuauuuuaa

SEQ ID NO: 2825960 - RNA, 16 nt, Human
agucauuuauuuuaaa

SEQ ID NO: 2825961 - RNA, 20 nt, Human
agucauuuauuuuaaaaaau

SEQ ID NO: 2825962 - RNA, 22 nt, Human
agucauuuauuuuaaaaaauga

SEQ ID NO: 2825963 - RNA, 13 nt, Human
agucauuguaugu

SEQ ID NO: 2825964 - RNA, 18 nt, Human
agucauuguauguuauua

SEQ ID NO: 2825965 - RNA, 17 nt, Human
agucauuuaacugaaga

SEQ ID NO: 2825966 - RNA, 22 nt, Human
agucauuuaacugaagauguug

SEQ ID NO: 2825967 - RNA, 14 nt, Human
aguccucuuuucug

SEQ ID NO: 2825968 - RNA, 20 nt, Human
aguccucuggguaggaauca

SEQ ID NO: 2825969 - RNA, 13 nt, Human
aguccugugaauu

SEQ ID NO: 2825970 - RNA, 14 nt, Human
aguccugugaauuu

SEQ ID NO: 2825971 - RNA, 23 nt, Human
aguccugugaauuucuucacugu

SEQ ID NO: 2825972 - RNA, 15 nt, Human
aguccugugcugaau

SEQ ID NO: 2825973 - RNA, 14 nt, Human
aguccuuaaaaauc

SEQ ID NO: 2825974 - RNA, 21 nt, Human
aguccuuaaaaaucacacugu

SEQ ID NO: 2825975 - RNA, 14 nt, Human
aguccucugaauga

SEQ ID NO: 2825976 - RNA, 20 nt, Human
aguccucucccaaguccaca

SEQ ID NO: 2825977 - RNA, 12 nt, Human
aguccucugaau

SEQ ID NO: 2825978 - RNA, 21 nt, Human
aguccucguagccaucucucu

SEQ ID NO: 2825979 - RNA, 23 nt, Human
aguccuccccucacagccucuga

SEQ ID NO: 2825980 - RNA, 17 nt, Human
aguccucguagccaucu

SEQ ID NO: 2825981 - RNA, 15 nt, Human
aguccucguagccau

SEQ ID NO: 2825982 - RNA, 20 nt, Human
aguccuccccucacagccuc

SEQ ID NO: 2825983 - RNA, 21 nt, Human
aguccuccccucacagccucu

SEQ ID NO: 2825984 - RNA, 22 nt, Human
aguccuccccucacagccucug

SEQ ID NO: 2825985 - RNA, 19 nt, Human
aguccuccgguugcauacu

SEQ ID NO: 2825986 - RNA, 23 nt, Human
aguccuccgguugcauacuggac

SEQ ID NO: 2825987 - RNA, 13 nt, Human
agucuggaguggg

SEQ ID NO: 2825988 - RNA, 16 nt, Human
agucuggagugggcag

SEQ ID NO: 2825989 - RNA, 18 nt, Human
agucuggagugggcagag

SEQ ID NO: 2825990 - RNA, 19 nt, Human
agucuggagugggcagagc

SEQ ID NO: 2825991 - RNA, 21 nt, Human
agucugcagauagaaagcauu

SEQ ID NO: 2825992 - RNA, 21 nt, Human
agucuguaucaaacccacgau

SEQ ID NO: 2825993 - RNA, 21 nt, Human
agucuguauuuuuaaagcaug

SEQ ID NO: 2825994 - RNA, 13 nt, Human
agucuguccugug

SEQ ID NO: 2825995 - RNA, 15 nt, Human
agucuguccugugac

SEQ ID NO: 2825996 - RNA, 16 nt, Human
agucuguccugugacg

SEQ ID NO: 2825997 - RNA, 17 nt, Human
agucuggugggaggacg

SEQ ID NO: 2825998 - RNA, 14 nt, Human
agucugggacacaa

SEQ ID NO: 2825999 - RNA, 21 nt, Human
agucugggacacaaaacuccg

SEQ ID NO: 2826000 - RNA, 22 nt, Human
agucugggacacaaaacuccgc

SEQ ID NO: 2826001 - RNA, 17 nt, Human
agucugucucaaaagaa

SEQ ID NO: 2826002 - RNA, 14 nt, Human
agucugucuucugu

SEQ ID NO: 2826003 - RNA, 15 nt, Human
agucugucuucugua

SEQ ID NO: 2826004 - RNA, 16 nt, Human
agucugucuucuguau

SEQ ID NO: 2826005 - RNA, 17 nt, Human
agucugucuucuguaua

SEQ ID NO: 2826006 - RNA, 18 nt, Human
agucugucuucuguauau

SEQ ID NO: 2826007 - RNA, 20 nt, Human
agucugucuucuguauauaa

SEQ ID NO: 2826008 - RNA, 22 nt, Human
agucugucuucuguauauaaau

SEQ ID NO: 2826009 - RNA, 14 nt, Human
agugaauaaacuuc

SEQ ID NO: 2826010 - RNA, 15 nt, Human
agugaauaaacuuca

SEQ ID NO: 2826011 - RNA, 16 nt, Human
agugaauaaacuucag

SEQ ID NO: 2826012 - RNA, 17 nt, Human
agugaauaaacuucagc

SEQ ID NO: 2826013 - RNA, 18 nt, Human
agugaauaaacuucagca

SEQ ID NO: 2826014 - RNA, 19 nt, Human
agugaauaaacuucagcac

SEQ ID NO: 2826015 - RNA, 20 nt, Human
agugaauaaacuucagcacc

SEQ ID NO: 2826016 - RNA, 21 nt, Human
agugaauaaacuucagcacca

SEQ ID NO: 2826017 - RNA, 16 nt, Human
agucgaggacagggag

SEQ ID NO: 2826018 - RNA, 17 nt, Human
aguccuuuauguggaaa

SEQ ID NO: 2826019 - RNA, 16 nt, Human
aguccuuuuuuuccau

SEQ ID NO: 2826020 - RNA, 21 nt, Human
aguccuuuuuuuccaucuuua

SEQ ID NO: 2826021 - RNA, 18 nt, Human
agucgaauuaauagcuuu

SEQ ID NO: 2826022 - RNA, 21 nt, Human
agucgaauuaauagcuuuuau

SEQ ID NO: 2826023 - RNA, 16 nt, Human
aguccugugaauuucu

SEQ ID NO: 2826024 - RNA, 24 nt, Human
aguccuuaaaauguaagauuauag

SEQ ID NO: 2826025 - RNA, 14 nt, Human
aguccuuuaugugg

SEQ ID NO: 2826026 - RNA, 18 nt, Human
aguccuuuaauuaagacu

SEQ ID NO: 2826027 - RNA, 20 nt, Human
aguccuuuuacuacagcuau

SEQ ID NO: 2826028 - RNA, 23 nt, Human
aguccuuuuacuacagcuaugaa

SEQ ID NO: 2826029 - RNA, 12 nt, Human
aguccuuuucuu

SEQ ID NO: 2826030 - RNA, 12 nt, Human
aguccuuuugua

SEQ ID NO: 2826031 - RNA, 14 nt, Human
aguccuuuuguaaa

SEQ ID NO: 2826032 - RNA, 15 nt, Human
aguccuuuuguaaag

SEQ ID NO: 2826033 - RNA, 16 nt, Human
aguccuuuuguaaagu

SEQ ID NO: 2826034 - RNA, 22 nt, Human
aguccuuuuguaaagugaagaa

SEQ ID NO: 2826035 - RNA, 23 nt, Human
aguccuuuuguaaagugaagaau

SEQ ID NO: 2826036 - RNA, 18 nt, Human
agucuggaaugcaguggu

SEQ ID NO: 2826037 - RNA, 20 nt, Human
agucugauucccaagcucug

SEQ ID NO: 2826038 - RNA, 22 nt, Human
agucugauucccaagcucugcu

SEQ ID NO: 2826039 - RNA, 21 nt, Human
agucugauucccaagcucugc

SEQ ID NO: 2826040 - RNA, 13 nt, Human
aguaucagaauug

SEQ ID NO: 2826041 - RNA, 14 nt, Human
aguaucagaauuga

SEQ ID NO: 2826042 - RNA, 18 nt, Human
aguaucagaauugaaaca

SEQ ID NO: 2826043 - RNA, 15 nt, Human
aguaucaggucuccc

SEQ ID NO: 2826044 - RNA, 18 nt, Human
aguaucaggucucccacg

SEQ ID NO: 2826045 - RNA, 13 nt, Human
aguaucaguguuu

SEQ ID NO: 2826046 - RNA, 16 nt, Human
aguaucaguguuuuaa

SEQ ID NO: 2826047 - RNA, 17 nt, Human
aguaucaguguuuuaaa

SEQ ID NO: 2826048 - RNA, 18 nt, Human
aguaucaguguuuuaaau

SEQ ID NO: 2826049 - RNA, 20 nt, Human
aguaucaguguuuuaaauuc

SEQ ID NO: 2826050 - RNA, 21 nt, Human
aguaucaguguuuuaaauucu

SEQ ID NO: 2826051 - RNA, 22 nt, Human
aguaucaguguuuuaaauucug

SEQ ID NO: 2826052 - RNA, 21 nt, Human
aucaucccaucuaagcugcag

SEQ ID NO: 2826053 - RNA, 23 nt, Human
aucaucccaucuaagcugcagcu

SEQ ID NO: 2826054 - RNA, 17 nt, Human
aucauccugcagacaga

SEQ ID NO: 2826055 - RNA, 15 nt, Human
aucaucgaaaauuca

SEQ ID NO: 2826056 - RNA, 20 nt, Human
aucaucgaaaauucauuuca

SEQ ID NO: 2826057 - RNA, 13 nt, Human
aucaucgccagag

SEQ ID NO: 2826058 - RNA, 15 nt, Human
aucaucgccagaggu

SEQ ID NO: 2826059 - RNA, 16 nt, Human
aucaucgccagaggug

SEQ ID NO: 2826060 - RNA, 20 nt, Human
aucaucgccagaggugcuuc

SEQ ID NO: 2826061 - RNA, 22 nt, Human
aucaucgccagaggugcuucac

SEQ ID NO: 2826062 - RNA, 24 nt, Human
aucaucggagucagccaggagcug

SEQ ID NO: 2826063 - RNA, 14 nt, Human
aucauccagaaguu

SEQ ID NO: 2826064 - RNA, 15 nt, Human
aucaaaguucugcuu

SEQ ID NO: 2826065 - RNA, 16 nt, Human
aucaaaguucugcuuu

SEQ ID NO: 2826066 - RNA, 20 nt, Human
aucaaaguucugcuuucucc

SEQ ID NO: 2826067 - RNA, 23 nt, Human
aucaaaguucugcuuucucccca

SEQ ID NO: 2826068 - RNA, 13 nt, Human
aucaaaguauuug

SEQ ID NO: 2826069 - RNA, 20 nt, Human
aucaaagucaaaaauagcaa

SEQ ID NO: 2826070 - RNA, 19 nt, Human
aucaaauaaguauuuauaa

SEQ ID NO: 2826071 - RNA, 20 nt, Human
aucaaauaaguauuuauaau

SEQ ID NO: 2826072 - RNA, 17 nt, Human
aucaaauaaguauuuau

SEQ ID NO: 2826073 - RNA, 18 nt, Human
aucaaauaaguauuuaua

SEQ ID NO: 2826074 - RNA, 19 nt, Human
aucaugcuggaaccugcaa

SEQ ID NO: 2826075 - RNA, 22 nt, Human
aucaugcuggaaccugcaaaaa

SEQ ID NO: 2826076 - RNA, 14 nt, Human
aucaugcuuuaaag

SEQ ID NO: 2826077 - RNA, 17 nt, Human
aucaugcuuuaaagugu

SEQ ID NO: 2826078 - RNA, 20 nt, Human
aucaugcuuuaaaguguaau

SEQ ID NO: 2826079 - RNA, 22 nt, Human
aucaugcuuuaaaguguaauaa

SEQ ID NO: 2826080 - RNA, 18 nt, Human
aucaugcuuugaaaaauc

SEQ ID NO: 2826081 - RNA, 19 nt, Human
aucaugcccggucccaccc

SEQ ID NO: 2826082 - RNA, 21 nt, Human
aucaugcccggucccaccccu

SEQ ID NO: 2826083 - RNA, 23 nt, Human
aucaugcccggucccaccccucc

SEQ ID NO: 2826084 - RNA, 19 nt, Human
aucaucuaauucucugugg

SEQ ID NO: 2826085 - RNA, 13 nt, Human
aucaugacauguu

SEQ ID NO: 2826086 - RNA, 19 nt, Human
aucaugaauuuauugcaca

SEQ ID NO: 2826087 - RNA, 13 nt, Human
aucaugaauuuua

SEQ ID NO: 2826088 - RNA, 16 nt, Human
aucaugacauguuaua

SEQ ID NO: 2826089 - RNA, 18 nt, Human
aucaugacauguuauaua

SEQ ID NO: 2826090 - RNA, 22 nt, Human
aucaugcagcucaacuuucugu

SEQ ID NO: 2826091 - RNA, 14 nt, Human
auccagaugguggg

SEQ ID NO: 2826092 - RNA, 15 nt, Human
auccagaugguggga

SEQ ID NO: 2826093 - RNA, 20 nt, Human
auccagauggugggaugugg

SEQ ID NO: 2826094 - RNA, 18 nt, Human
auccagcaguacaauaaa

SEQ ID NO: 2826095 - RNA, 16 nt, Human
auccagcagucucugc

SEQ ID NO: 2826096 - RNA, 18 nt, Human
auccagcagucucugccu

SEQ ID NO: 2826097 - RNA, 19 nt, Human
auccagcagucucugccuu

SEQ ID NO: 2826098 - RNA, 12 nt, Human
auccacuuugca

SEQ ID NO: 2826099 - RNA, 21 nt, Human
auccacugugccaugugccag

SEQ ID NO: 2826100 - RNA, 23 nt, Human
auccacucuacccucccaccccc

SEQ ID NO: 2826101 - RNA, 22 nt, Human
auccacucuacccucccacccc

SEQ ID NO: 2826102 - RNA, 21 nt, Human
auccuucuggcagauucaaau

SEQ ID NO: 2826103 - RNA, 17 nt, Human
auccuuccucacaccag

SEQ ID NO: 2826104 - RNA, 14 nt, Human
aucccccuugccac

SEQ ID NO: 2826105 - RNA, 18 nt, Human
aucccccuugccacccca

SEQ ID NO: 2826106 - RNA, 15 nt, Human
auccuuccucuccuu

SEQ ID NO: 2826107 - RNA, 12 nt, Human
auccuuccuaua

SEQ ID NO: 2826108 - RNA, 14 nt, Human
auccuuccuauaac

SEQ ID NO: 2826109 - RNA, 15 nt, Human
auccuuccuauaacu

SEQ ID NO: 2826110 - RNA, 17 nt, Human
auccuuccuauaacuug

SEQ ID NO: 2826111 - RNA, 20 nt, Human
auccuuccuauaacuugaug

SEQ ID NO: 2826112 - RNA, 22 nt, Human
auccuuccuauaacuugaugca

SEQ ID NO: 2826113 - RNA, 19 nt, Human
auccuucgugaacaucccc

SEQ ID NO: 2826114 - RNA, 20 nt, Human
auccuucgugaacauccccu

SEQ ID NO: 2826115 - RNA, 23 nt, Human
auccuucgugaacauccccuccc

SEQ ID NO: 2826116 - RNA, 18 nt, Human
auccccaugccuguggcu

SEQ ID NO: 2826117 - RNA, 20 nt, Human
auccccaugccuguggcugc

SEQ ID NO: 2826118 - RNA, 13 nt, Human
aucccccaaaguu

SEQ ID NO: 2826119 - RNA, 19 nt, Human
auccagggcucugaccagu

SEQ ID NO: 2826120 - RNA, 14 nt, Human
auccccagucccaa

SEQ ID NO: 2826121 - RNA, 22 nt, Human
auccccaguucgccuggagccc

SEQ ID NO: 2826122 - RNA, 14 nt, Human
aucccccaggagaa

SEQ ID NO: 2826123 - RNA, 12 nt, Human
aucgaaaauuca

SEQ ID NO: 2826124 - RNA, 16 nt, Human
aucgaaaauucauuuc

SEQ ID NO: 2826125 - RNA, 17 nt, Human
aucgaaaauucauuuca

SEQ ID NO: 2826126 - RNA, 15 nt, Human
aucgaaccguuuuga

SEQ ID NO: 2826127 - RNA, 20 nt, Human
aucgaaauaacaauguuaag

SEQ ID NO: 2826128 - RNA, 22 nt, Human
aucgaaauaacaauguuaagga

SEQ ID NO: 2826129 - RNA, 13 nt, Human
aucgaaauaacaa

SEQ ID NO: 2826130 - RNA, 17 nt, Human
aucgaaauaacaauguu

SEQ ID NO: 2826131 - RNA, 18 nt, Human
aucgaaauaacaauguua

SEQ ID NO: 2826132 - RNA, 19 nt, Human
aucgaaauaacaauguuaa

SEQ ID NO: 2826133 - RNA, 23 nt, Human
aucgaaauaacaauguuaaggaa

SEQ ID NO: 2826134 - RNA, 14 nt, Human
aucgaccugccucg

SEQ ID NO: 2826135 - RNA, 20 nt, Human
aucgaaucuacuaauuccac

SEQ ID NO: 2826136 - RNA, 18 nt, Human
aucgaaucuacuaauucc

SEQ ID NO: 2826137 - RNA, 12 nt, Human
aucaaaaauaau

SEQ ID NO: 2826138 - RNA, 13 nt, Human
aucaaaaauaaug

SEQ ID NO: 2826139 - RNA, 19 nt, Human
aucaaaaauugaagagaga

SEQ ID NO: 2826140 - RNA, 16 nt, Human
aucaaaacaagugaaa

SEQ ID NO: 2826141 - RNA, 16 nt, Human
auauuuuuuuaauuua

SEQ ID NO: 2826142 - RNA, 17 nt, Human
auauuuuuuuaauuuaa

SEQ ID NO: 2826143 - RNA, 17 nt, Human
aucaaagaauaagaaaa

SEQ ID NO: 2826144 - RNA, 18 nt, Human
aucaaagagagaaaauaa

SEQ ID NO: 2826145 - RNA, 12 nt, Human
aucaaaggacac

SEQ ID NO: 2826146 - RNA, 19 nt, Human
aucaaaacucacaagugcu

SEQ ID NO: 2826147 - RNA, 17 nt, Human
auagcaauagcauggau

SEQ ID NO: 2826148 - RNA, 22 nt, Human
auagcaacuuuuguguaaugaa

SEQ ID NO: 2826149 - RNA, 17 nt, Human
auagcaagauugcuuaa

SEQ ID NO: 2826150 - RNA, 19 nt, Human
auagcaagacacaucccua

SEQ ID NO: 2826151 - RNA, 14 nt, Human
auagcaaauucaaa

SEQ ID NO: 2826152 - RNA, 20 nt, Human
auggcuuuauuuguuuuuuu

SEQ ID NO: 2826153 - RNA, 23 nt, Human
auggcuuuauuuguuuuuuuugu

SEQ ID NO: 2826154 - RNA, 15 nt, Human
auggcuuucagaaaa

SEQ ID NO: 2826155 - RNA, 16 nt, Human
auggcuuucagaaaac

SEQ ID NO: 2826156 - RNA, 21 nt, Human
auggcuuucagaaaacgggaa

SEQ ID NO: 2826157 - RNA, 23 nt, Human
auggcuuucagaaaacgggaagc

SEQ ID NO: 2826158 - RNA, 19 nt, Human
auggaguuaacaucaugaa

SEQ ID NO: 2826159 - RNA, 15 nt, Human
auggaguucuugugc

SEQ ID NO: 2826160 - RNA, 15 nt, Human
auggaguuucuaagg

SEQ ID NO: 2826161 - RNA, 16 nt, Human
auggaguuucuaaggu

SEQ ID NO: 2826162 - RNA, 20 nt, Human
auggauaaaauaaugcugca

SEQ ID NO: 2826163 - RNA, 21 nt, Human
auggauaaaauaaugcugcaa

SEQ ID NO: 2826164 - RNA, 13 nt, Human
auggaguuucuaa

SEQ ID NO: 2826165 - RNA, 14 nt, Human
auggaguuucuaag

SEQ ID NO: 2826166 - RNA, 23 nt, Human
augggaaaggaggcaugccucug

SEQ ID NO: 2826167 - RNA, 21 nt, Human
augggaacacuggcagacugu

SEQ ID NO: 2826168 - RNA, 11 nt, Human
augggaacauu

SEQ ID NO: 2826169 - RNA, 13 nt, Human
augggaacauuua

SEQ ID NO: 2826170 - RNA, 14 nt, Human
augggaacauuuau

SEQ ID NO: 2826171 - RNA, 15 nt, Human
augggaacauuuauu

SEQ ID NO: 2826172 - RNA, 21 nt, Human
augggaacauuuauuuuauga

SEQ ID NO: 2826173 - RNA, 23 nt, Human
augggaacauuuauuuuaugaga

SEQ ID NO: 2826174 - RNA, 19 nt, Human
augggacaaauugcacaga

SEQ ID NO: 2826175 - RNA, 21 nt, Human
augcuuuaggauguacaguua

SEQ ID NO: 2826176 - RNA, 13 nt, Human
augcucuucugug

SEQ ID NO: 2826177 - RNA, 14 nt, Human
augcuuugcuuugu

SEQ ID NO: 2826178 - RNA, 15 nt, Human
augcuuugcuuuguc

SEQ ID NO: 2826179 - RNA, 16 nt, Human
augcuuugcuuugucu

SEQ ID NO: 2826180 - RNA, 18 nt, Human
augcuuugcuuugucugg

SEQ ID NO: 2826181 - RNA, 22 nt, Human
augcuuugucuucagccucucc

SEQ ID NO: 2826182 - RNA, 22 nt, Human
augcuuugaaaaaucacuugau

SEQ ID NO: 2826183 - RNA, 11 nt, Human
auggagccagc

SEQ ID NO: 2826184 - RNA, 13 nt, Human
auggagcaagaga

SEQ ID NO: 2826185 - RNA, 19 nt, Human
auggagcaguacaugggaa

SEQ ID NO: 2826186 - RNA, 20 nt, Human
auggagauucaguuuucauu

SEQ ID NO: 2826187 - RNA, 23 nt, Human
auggagagcuggagccuggugcc

SEQ ID NO: 2826188 - RNA, 15 nt, Human
auggagccagcuccc

SEQ ID NO: 2826189 - RNA, 18 nt, Human
auggagccagcucccucu

SEQ ID NO: 2826190 - RNA, 19 nt, Human
auggagauucaguuuucau

SEQ ID NO: 2826191 - RNA, 13 nt, Human
auggagagcugga

SEQ ID NO: 2826192 - RNA, 18 nt, Human
augccugguggcagcugc

SEQ ID NO: 2826193 - RNA, 19 nt, Human
augccugguggcagcugcg

SEQ ID NO: 2826194 - RNA, 14 nt, Human
augccugguggcag

SEQ ID NO: 2826195 - RNA, 13 nt, Human
augccugguggca

SEQ ID NO: 2826196 - RNA, 12 nt, Human
augccugguggc

SEQ ID NO: 2826197 - RNA, 11 nt, Human
augccuggugg

SEQ ID NO: 2826198 - RNA, 16 nt, Human
augcaugucaaacaug

SEQ ID NO: 2826199 - RNA, 21 nt, Human
augccugguggcagcugcggu

SEQ ID NO: 2826200 - RNA, 22 nt, Human
augcaugucaaacaugagaugu

SEQ ID NO: 2826201 - RNA, 16 nt, Human
augccuguaauucagu

SEQ ID NO: 2826202 - RNA, 18 nt, Human
augccuguaauucagugu

SEQ ID NO: 2826203 - RNA, 16 nt, Human
augccuguccagccug

SEQ ID NO: 2826204 - RNA, 15 nt, Human
augcauaauucacau

SEQ ID NO: 2826205 - RNA, 23 nt, Human
augcauggagggcugcccuguac

SEQ ID NO: 2826206 - RNA, 14 nt, Human
augcauaaaugcau

SEQ ID NO: 2826207 - RNA, 23 nt, Human
augaagcauuuacuuuguguuca

SEQ ID NO: 2826208 - RNA, 16 nt, Human
augaaacucacaaaug

SEQ ID NO: 2826209 - RNA, 12 nt, Human
augaagccagcu

SEQ ID NO: 2826210 - RNA, 14 nt, Human
augaaagaauauau

SEQ ID NO: 2826211 - RNA, 15 nt, Human
augaaagaauauauu

SEQ ID NO: 2826212 - RNA, 18 nt, Human
augaaagaauauauuuau

SEQ ID NO: 2826213 - RNA, 22 nt, Human
augaagccuguggaugaucaau

SEQ ID NO: 2826214 - RNA, 11 nt, Human
augaagccuuu

SEQ ID NO: 2826215 - RNA, 14 nt, Human
augaagccuuuuga

SEQ ID NO: 2826216 - RNA, 16 nt, Human
augaagccuuuugaaa

SEQ ID NO: 2826217 - RNA, 17 nt, Human
augaagccuuuugaaag

SEQ ID NO: 2826218 - RNA, 20 nt, Human
augaagccuuuugaaaggga

SEQ ID NO: 2826219 - RNA, 19 nt, Human
augaagcgaaacacagaga

SEQ ID NO: 2826220 - RNA, 18 nt, Human
augaagccgaccuuagau

SEQ ID NO: 2826221 - RNA, 19 nt, Human
augaagccgaccuuagauu

SEQ ID NO: 2826222 - RNA, 23 nt, Human
augaagccgaccuuagauuuagu

SEQ ID NO: 2826223 - RNA, 17 nt, Human
augaagcccaagugaaa

SEQ ID NO: 2826224 - RNA, 15 nt, Human
augaagcccaaguga

SEQ ID NO: 2826225 - RNA, 12 nt, Human
augaagcccaag

SEQ ID NO: 2826226 - RNA, 13 nt, Human
augaauacaaauu

SEQ ID NO: 2826227 - RNA, 14 nt, Human
augaauacaaauuu

SEQ ID NO: 2826228 - RNA, 15 nt, Human
augaauacaaauuuu

SEQ ID NO: 2826229 - RNA, 13 nt, Human
augaauacagcag

SEQ ID NO: 2826230 - RNA, 15 nt, Human
augaauacagcagca

SEQ ID NO: 2826231 - RNA, 16 nt, Human
augaauacagcagcaa

SEQ ID NO: 2826232 - RNA, 17 nt, Human
augaauacagcagcaag

SEQ ID NO: 2826233 - RNA, 17 nt, Human
augaauaaagacaccua

SEQ ID NO: 2826234 - RNA, 17 nt, Human
augaccuuauccuuccu

SEQ ID NO: 2826235 - RNA, 21 nt, Human
augaccuuauccuuccucucc

SEQ ID NO: 2826236 - RNA, 13 nt, Human
augaauauauggc

SEQ ID NO: 2826237 - RNA, 20 nt, Human
augaauauauggcauuugca

SEQ ID NO: 2826238 - RNA, 22 nt, Human
augaauauauggcauuugcaga

SEQ ID NO: 2826239 - RNA, 23 nt, Human
augaauauauuuaagcaacaucu

SEQ ID NO: 2826240 - RNA, 19 nt, Human
augagccucagcauccugg

SEQ ID NO: 2826241 - RNA, 21 nt, Human
augagccucagcauccuggca

SEQ ID NO: 2826242 - RNA, 21 nt, Human
augaggaaaauaauguaauug

SEQ ID NO: 2826243 - RNA, 17 nt, Human
augagcugaucugcgga

SEQ ID NO: 2826244 - RNA, 15 nt, Human
agggaugggccuggc

SEQ ID NO: 2826245 - RNA, 16 nt, Human
agggaugggccuggca

SEQ ID NO: 2826246 - RNA, 17 nt, Human
agggaugggccuggcau

SEQ ID NO: 2826247 - RNA, 22 nt, Human
agggaugggccuggcauucuug

SEQ ID NO: 2826248 - RNA, 15 nt, Human
agggauucaggcugc

SEQ ID NO: 2826249 - RNA, 14 nt, Human
agggauucaggcug

SEQ ID NO: 2826250 - RNA, 13 nt, Human
agggauggugccc

SEQ ID NO: 2826251 - RNA, 18 nt, Human
agggauucacaucugcau

SEQ ID NO: 2826252 - RNA, 18 nt, Human
agggauucaggcugcuug

SEQ ID NO: 2826253 - RNA, 16 nt, Human
agggauucaggcugcu

SEQ ID NO: 2826254 - RNA, 19 nt, Human
agggauucaggcugcuugg

SEQ ID NO: 2826255 - RNA, 19 nt, Human
agggaugcugccugaguca

SEQ ID NO: 2826256 - RNA, 18 nt, Human
agggaugcugccugaguc

SEQ ID NO: 2826257 - RNA, 17 nt, Human
agggaugcugccugagu

SEQ ID NO: 2826258 - RNA, 16 nt, Human
agggaugcugccugag

SEQ ID NO: 2826259 - RNA, 15 nt, Human
agggaugacuaaaau

SEQ ID NO: 2826260 - RNA, 17 nt, Human
agggaugaaagagaagg

SEQ ID NO: 2826261 - RNA, 20 nt, Human
agggaugagcauggagcugg

SEQ ID NO: 2826262 - RNA, 21 nt, Human
agggaugagcauggagcuggc

SEQ ID NO: 2826263 - RNA, 22 nt, Human
agggaugacuaaaauauuuauu

SEQ ID NO: 2826264 - RNA, 19 nt, Human
agggaugagcauggagcug

SEQ ID NO: 2826265 - RNA, 16 nt, Human
agggauugcugccacu

SEQ ID NO: 2826266 - RNA, 20 nt, Human
agggcguucuuaggcugcug

SEQ ID NO: 2826267 - RNA, 21 nt, Human
agggcguucuuaggcugcugg

SEQ ID NO: 2826268 - RNA, 19 nt, Human
agggcuacccucccccagg

SEQ ID NO: 2826269 - RNA, 14 nt, Human
agggauuucuuagg

SEQ ID NO: 2826270 - RNA, 15 nt, Human
agggauuucuuaggg

SEQ ID NO: 2826271 - RNA, 13 nt, Human
agggauuucuuug

SEQ ID NO: 2826272 - RNA, 22 nt, Human
aggggcaucugccccuccccca

SEQ ID NO: 2826273 - RNA, 21 nt, Human
aggggcaucugccccuccccc

SEQ ID NO: 2826274 - RNA, 20 nt, Human
aggggcaucugccccucccc

SEQ ID NO: 2826275 - RNA, 19 nt, Human
aggggcaucugccccuccc

SEQ ID NO: 2826276 - RNA, 17 nt, Human
aggggcaucugccccuc

SEQ ID NO: 2826277 - RNA, 16 nt, Human
aggggcaucugccccu

SEQ ID NO: 2826278 - RNA, 16 nt, Human
agggcuagcaucccug

SEQ ID NO: 2826279 - RNA, 15 nt, Human
agggcuauggugugg

SEQ ID NO: 2826280 - RNA, 19 nt, Human
agggcuaugguguggacug

SEQ ID NO: 2826281 - RNA, 21 nt, Human
agggcuacugcagcuuuacau

SEQ ID NO: 2826282 - RNA, 22 nt, Human
agggacucugaagccucuggga

SEQ ID NO: 2826283 - RNA, 21 nt, Human
agggacucugaagccucuggg

SEQ ID NO: 2826284 - RNA, 20 nt, Human
agggacucugaagccucugg

SEQ ID NO: 2826285 - RNA, 19 nt, Human
agggaccaacugggcccaa

SEQ ID NO: 2826286 - RNA, 17 nt, Human
agggaccaacugggccc

SEQ ID NO: 2826287 - RNA, 16 nt, Human
agggaccaacugggcc

SEQ ID NO: 2826288 - RNA, 14 nt, Human
aggcuuacacccac

SEQ ID NO: 2826289 - RNA, 17 nt, Human
aggcuuaccaaaguauu

SEQ ID NO: 2826290 - RNA, 12 nt, Human
aggcuguuugcu

SEQ ID NO: 2826291 - RNA, 14 nt, Human
aggcuguuugcuuc

SEQ ID NO: 2826292 - RNA, 19 nt, Human
aggcuguuugcuucaccgu

SEQ ID NO: 2826293 - RNA, 17 nt, Human
aggcuuaauaaaaauga

SEQ ID NO: 2826294 - RNA, 19 nt, Human
aggcuuaauaaaaaugaca

SEQ ID NO: 2826295 - RNA, 20 nt, Human
aggcuuaauaaaaaugacag

SEQ ID NO: 2826296 - RNA, 21 nt, Human
aggcuuaauaaaaaugacaga

SEQ ID NO: 2826297 - RNA, 24 nt, Human
aggcuguaucccaugagccucagc

SEQ ID NO: 2826298 - RNA, 17 nt, Human
aggcugccaaggccaga

SEQ ID NO: 2826299 - RNA, 20 nt, Human
aggcuguucccauguagccc

SEQ ID NO: 2826300 - RNA, 16 nt, Human
aggcuguucugcacug

SEQ ID NO: 2826301 - RNA, 18 nt, Human
aggcuguucugcacugaa

SEQ ID NO: 2826302 - RNA, 19 nt, Human
aggcuguucugcacugaaa

SEQ ID NO: 2826303 - RNA, 20 nt, Human
aggcuguucugcacugaaaa

SEQ ID NO: 2826304 - RNA, 21 nt, Human
aggcuguucugcacugaaaag

SEQ ID NO: 2826305 - RNA, 23 nt, Human
aggcuguaucccaugagccucag

SEQ ID NO: 2826306 - RNA, 21 nt, Human
aggcugcagucagucaugaug

SEQ ID NO: 2826307 - RNA, 15 nt, Human
aggcugcagcgagcu

SEQ ID NO: 2826308 - RNA, 14 nt, Human
aggcugcagcugga

SEQ ID NO: 2826309 - RNA, 15 nt, Human
aggcugcagcuggac

SEQ ID NO: 2826310 - RNA, 16 nt, Human
aggcugcagcuggaca

SEQ ID NO: 2826311 - RNA, 17 nt, Human
aggcugcagcuggacag

SEQ ID NO: 2826312 - RNA, 18 nt, Human
aggcugcagcuggacaga

SEQ ID NO: 2826313 - RNA, 19 nt, Human
aggcugcagcuggacagag

SEQ ID NO: 2826314 - RNA, 20 nt, Human
aggcugcagcuggacagagg

SEQ ID NO: 2826315 - RNA, 21 nt, Human
aggcugcagcuggacagaggg

SEQ ID NO: 2826316 - RNA, 22 nt, Human
aggcugcagcuggacagagggg

SEQ ID NO: 2826317 - RNA, 18 nt, Human
aggcuaguccggacccac

SEQ ID NO: 2826318 - RNA, 22 nt, Human
aggcuaguccggacccaccuca

SEQ ID NO: 2826319 - RNA, 16 nt, Human
aggcucuucuccccag

SEQ ID NO: 2826320 - RNA, 17 nt, Human
aggcucuucuccccaga

SEQ ID NO: 2826321 - RNA, 18 nt, Human
aggcucuucuccccagag

SEQ ID NO: 2826322 - RNA, 13 nt, Human
aggcugaggcaca

SEQ ID NO: 2826323 - RNA, 14 nt, Human
aggcugaggcacaa

SEQ ID NO: 2826324 - RNA, 13 nt, Human
aggcugaggacuu

SEQ ID NO: 2826325 - RNA, 11 nt, Human
aggcugaggac

SEQ ID NO: 2826326 - RNA, 13 nt, Human
aggcucuucuccu

SEQ ID NO: 2826327 - RNA, 11 nt, Human
aggcugagccu

SEQ ID NO: 2826328 - RNA, 19 nt, Human
aggcucuucuccccagagu

SEQ ID NO: 2826329 - RNA, 13 nt, Human
aggcugagccuca

SEQ ID NO: 2826330 - RNA, 16 nt, Human
aggcuagcuggagccu

SEQ ID NO: 2826331 - RNA, 17 nt, Human
aggcuagcuggagccug

SEQ ID NO: 2826332 - RNA, 18 nt, Human
aggcuagcuggagccugg

SEQ ID NO: 2826333 - RNA, 19 nt, Human
aggccagggacaguaauaa

SEQ ID NO: 2826334 - RNA, 12 nt, Human
aggccaggccgg

SEQ ID NO: 2826335 - RNA, 17 nt, Human
aggccaugggccuccug

SEQ ID NO: 2826336 - RNA, 16 nt, Human
aggccaugggccuccu

SEQ ID NO: 2826337 - RNA, 14 nt, Human
aggccaugggccuc

SEQ ID NO: 2826338 - RNA, 22 nt, Human
aggcauguucucugaggacacu

SEQ ID NO: 2826339 - RNA, 20 nt, Human
aggcauguucucugaggaca

SEQ ID NO: 2826340 - RNA, 13 nt, Human
aggcauuaacaca

SEQ ID NO: 2826341 - RNA, 19 nt, Human
aggcauuaacacaaaggag

SEQ ID NO: 2826342 - RNA, 13 nt, Human
aggcauuaauguu

SEQ ID NO: 2826343 - RNA, 16 nt, Human
aggcauuaauguuucu

SEQ ID NO: 2826344 - RNA, 19 nt, Human
aggcauuaauguuucuauc

SEQ ID NO: 2826345 - RNA, 20 nt, Human
aggcauuaauguuucuaucu

SEQ ID NO: 2826346 - RNA, 21 nt, Human
aggcauuaauguuucuaucug

SEQ ID NO: 2826347 - RNA, 14 nt, Human
aggcauugaggaag

SEQ ID NO: 2826348 - RNA, 19 nt, Human
aggcauugaggaagagucu

SEQ ID NO: 2826349 - RNA, 17 nt, Human
aggcaugugugaaacau

SEQ ID NO: 2826350 - RNA, 18 nt, Human
aggcaugugugaaacaua

SEQ ID NO: 2826351 - RNA, 22 nt, Human
aggcaugugccacccacccaac

SEQ ID NO: 2826352 - RNA, 21 nt, Human
aggcaucucuguacuuugcuu

SEQ ID NO: 2826353 - RNA, 22 nt, Human
aggcaucucuguacuuugcuug

SEQ ID NO: 2826354 - RNA, 16 nt, Human
aggcaucugauuugca

SEQ ID NO: 2826355 - RNA, 21 nt, Human
aggcaugaagagcaaaaauau

SEQ ID NO: 2826356 - RNA, 20 nt, Human
aggcaugaguuacugugcau

SEQ ID NO: 2826357 - RNA, 13 nt, Human
aggcaugccucug

SEQ ID NO: 2826358 - RNA, 14 nt, Human
aggcaugccucuga

SEQ ID NO: 2826359 - RNA, 15 nt, Human
aggcaugccucugau

SEQ ID NO: 2826360 - RNA, 17 nt, Human
aggcaugccucugauau

SEQ ID NO: 2826361 - RNA, 18 nt, Human
aggcaugccucugauaug

SEQ ID NO: 2826362 - RNA, 21 nt, Human
aggcaugccucugauauggga

SEQ ID NO: 2826363 - RNA, 23 nt, Human
aggcaugccucugauaugggacu

SEQ ID NO: 2826364 - RNA, 19 nt, Human
aggcagccaaccuaagcaa

SEQ ID NO: 2826365 - RNA, 17 nt, Human
aggcaucgcaauguaag

SEQ ID NO: 2826366 - RNA, 13 nt, Human
aggcagauacagg

SEQ ID NO: 2826367 - RNA, 18 nt, Human
aggcagagggccuuugcu

SEQ ID NO: 2826368 - RNA, 19 nt, Human
aggcagaguuugccuuccu

SEQ ID NO: 2826369 - RNA, 14 nt, Human
aggcacuuuggggg

SEQ ID NO: 2826370 - RNA, 22 nt, Human
aggcacuuuggggguuugaggg

SEQ ID NO: 2826371 - RNA, 23 nt, Human
aggcacuuuggggguuugagggu

SEQ ID NO: 2826372 - RNA, 16 nt, Human
aggcagaaaauugcac

SEQ ID NO: 2826373 - RNA, 21 nt, Human
aggcacuguaguucuaagacu

SEQ ID NO: 2826374 - RNA, 16 nt, Human
aggcacuuaagcacaa

SEQ ID NO: 2826375 - RNA, 14 nt, Human
aggcacuuauugua

SEQ ID NO: 2826376 - RNA, 16 nt, Human
aggcacuuauuguaaa

SEQ ID NO: 2826377 - RNA, 17 nt, Human
aggcacuuauuguaaau

SEQ ID NO: 2826378 - RNA, 18 nt, Human
aggcacuuauuguaaauu

SEQ ID NO: 2826379 - RNA, 21 nt, Human
aggcacuuauuguaaauuuua

SEQ ID NO: 2826380 - RNA, 16 nt, Human
aggagggcguucuuag

SEQ ID NO: 2826381 - RNA, 17 nt, Human
aggagggcguucuuagg

SEQ ID NO: 2826382 - RNA, 21 nt, Human
aggagggcguucuuaggcugc

SEQ ID NO: 2826383 - RNA, 17 nt, Human
aggaggggaaaaaaaug

SEQ ID NO: 2826384 - RNA, 19 nt, Human
aggaggggaaaaaaauguu

SEQ ID NO: 2826385 - RNA, 14 nt, Human
aggagggcauccau

SEQ ID NO: 2826386 - RNA, 22 nt, Human
aggagggcauccauaccagcuc

SEQ ID NO: 2826387 - RNA, 20 nt, Human
aggagggcccuaccugauug

SEQ ID NO: 2826388 - RNA, 18 nt, Human
aggagagccugcugcaug

SEQ ID NO: 2826389 - RNA, 14 nt, Human
aggagggaggggga

SEQ ID NO: 2826390 - RNA, 16 nt, Human
aggagagccugcugca

SEQ ID NO: 2826391 - RNA, 15 nt, Human
aggagagccugcugc

SEQ ID NO: 2826392 - RNA, 14 nt, Human
aggagagccugcug

SEQ ID NO: 2826393 - RNA, 13 nt, Human
aggagagccugcu

SEQ ID NO: 2826394 - RNA, 12 nt, Human
aggagagccugc

SEQ ID NO: 2826395 - RNA, 15 nt, Human
aggagggagggggcu

SEQ ID NO: 2826396 - RNA, 19 nt, Human
aggagggaugcugccugag

SEQ ID NO: 2826397 - RNA, 22 nt, Human
aggagacacugugcuauaaauc

SEQ ID NO: 2826398 - RNA, 14 nt, Human
aggagaccaaggcg

SEQ ID NO: 2826399 - RNA, 18 nt, Human
aggagacaguucaagaaa

SEQ ID NO: 2826400 - RNA, 17 nt, Human
aggagagauagccugug

SEQ ID NO: 2826401 - RNA, 18 nt, Human
aggagagauagccugugg

SEQ ID NO: 2826402 - RNA, 19 nt, Human
aggagagauagccuguggc

SEQ ID NO: 2826403 - RNA, 20 nt, Human
aggagagauagccuguggcc

SEQ ID NO: 2826404 - RNA, 16 nt, Human
aggagagcccuucauu

SEQ ID NO: 2826405 - RNA, 17 nt, Human
aggagaccaaggcggga

SEQ ID NO: 2826406 - RNA, 14 nt, Human
aggagugagcacua

SEQ ID NO: 2826407 - RNA, 23 nt, Human
aggaguucagggucauagcaugc

SEQ ID NO: 2826408 - RNA, 19 nt, Human
aggaguuccacagauuguu

SEQ ID NO: 2826409 - RNA, 21 nt, Human
aggaguucgagaccagccugg

SEQ ID NO: 2826410 - RNA, 16 nt, Human
aggaguucgagaccag

SEQ ID NO: 2826411 - RNA, 20 nt, Human
aggaguuccuugaucuguau

SEQ ID NO: 2826412 - RNA, 17 nt, Human
aggaguucgaggcugca

SEQ ID NO: 2826413 - RNA, 16 nt, Human
aggaguucgaggcugc

SEQ ID NO: 2826414 - RNA, 22 nt, Human
aggaguucgagaccagccuggc

SEQ ID NO: 2826415 - RNA, 12 nt, Human
aggagugagcac

SEQ ID NO: 2826416 - RNA, 18 nt, Human
aggaguacaggugaagca

SEQ ID NO: 2826417 - RNA, 13 nt, Human
aggaggugugagg

SEQ ID NO: 2826418 - RNA, 20 nt, Human
aggaggugugaggaggaggc

SEQ ID NO: 2826419 - RNA, 14 nt, Human
aggaggugccugga

SEQ ID NO: 2826420 - RNA, 20 nt, Human
aggagguggaggcugcagug

SEQ ID NO: 2826421 - RNA, 17 nt, Human
aggagguggcagcccug

SEQ ID NO: 2826422 - RNA, 14 nt, Human
aggagguggcagcc

SEQ ID NO: 2826423 - RNA, 23 nt, Human
aggagguggcagcccuguaggga

SEQ ID NO: 2826424 - RNA, 21 nt, Human
aggagguggcagcccuguagg

SEQ ID NO: 2826425 - RNA, 20 nt, Human
aggagguggcagcccuguag

SEQ ID NO: 2826426 - RNA, 18 nt, Human
aggagguggcagcccugu

SEQ ID NO: 2826427 - RNA, 19 nt, Human
aggaugggggcuggccucu

SEQ ID NO: 2826428 - RNA, 22 nt, Human
aggauggccuggccagggccug

SEQ ID NO: 2826429 - RNA, 23 nt, Human
aggauggccuggccagggccugg

SEQ ID NO: 2826430 - RNA, 13 nt, Human
aggauggccuggc

SEQ ID NO: 2826431 - RNA, 16 nt, Human
aggauggccuggccag

SEQ ID NO: 2826432 - RNA, 17 nt, Human
aggauggccuggccagg

SEQ ID NO: 2826433 - RNA, 17 nt, Human
aggaugucccugggcca

SEQ ID NO: 2826434 - RNA, 20 nt, Human
aggaugucccugggccaggg

SEQ ID NO: 2826435 - RNA, 21 nt, Human
aggaugucccugggccagggu

SEQ ID NO: 2826436 - RNA, 22 nt, Human
aggaugucccugggccaggguc

SEQ ID NO: 2826437 - RNA, 23 nt, Human
aggaugucccugggccagggucu

SEQ ID NO: 2826438 - RNA, 17 nt, Human
aggaugucucaaacuuc

SEQ ID NO: 2826439 - RNA, 15 nt, Human
aggaugguguuacug

SEQ ID NO: 2826440 - RNA, 18 nt, Human
aggaugucacagggccaa

SEQ ID NO: 2826441 - RNA, 21 nt, Human
aggaugugggggaagaccugg

SEQ ID NO: 2826442 - RNA, 20 nt, Human
aggaugugauuguggaaugg

SEQ ID NO: 2826443 - RNA, 15 nt, Human
agcuacaacagccuc

SEQ ID NO: 2826444 - RNA, 16 nt, Human
agcuacaacagccuca

SEQ ID NO: 2826445 - RNA, 19 nt, Human
agcuacaacagccucacuu

SEQ ID NO: 2826446 - RNA, 20 nt, Human
agcuacaacagccucacuug

SEQ ID NO: 2826447 - RNA, 18 nt, Human
agcucacagugcugugug

SEQ ID NO: 2826448 - RNA, 21 nt, Human
agcucaccagccccagugccc

SEQ ID NO: 2826449 - RNA, 14 nt, Human
agcucaccagcccc

SEQ ID NO: 2826450 - RNA, 13 nt, Human
agcucaccagccc

SEQ ID NO: 2826451 - RNA, 15 nt, Human
agcuaaugggacacu

SEQ ID NO: 2826452 - RNA, 14 nt, Human
agcuaaugggacac

SEQ ID NO: 2826453 - RNA, 13 nt, Human
agcuaaugggaca

SEQ ID NO: 2826454 - RNA, 23 nt, Human
agcuaaggaggggaaaaaaaugu

SEQ ID NO: 2826455 - RNA, 10 nt, Human
agcuaaggcu

SEQ ID NO: 2826456 - RNA, 13 nt, Human
agcuaaggcucua

SEQ ID NO: 2826457 - RNA, 18 nt, Human
agcuaagcuaggaaugaa

SEQ ID NO: 2826458 - RNA, 17 nt, Human
agcuaagcuaggaauga

SEQ ID NO: 2826459 - RNA, 16 nt, Human
agcuaagggugggugc

SEQ ID NO: 2826460 - RNA, 20 nt, Human
agcuaagggugggugcucag

SEQ ID NO: 2826461 - RNA, 21 nt, Human
agcuaagggugggugcucaga

SEQ ID NO: 2826462 - RNA, 22 nt, Human
agcuaagggugggugcucagaa

SEQ ID NO: 2826463 - RNA, 23 nt, Human
agcuaagggugggugcucagaau

SEQ ID NO: 2826464 - RNA, 15 nt, Human
agcuaaggcucuaug

SEQ ID NO: 2826465 - RNA, 18 nt, Human
agcuaaggcucuaugagu

SEQ ID NO: 2826466 - RNA, 20 nt, Human
agcuaaggcucuaugagucu

SEQ ID NO: 2826467 - RNA, 17 nt, Human
agcuaagggaagacauu

SEQ ID NO: 2826468 - RNA, 18 nt, Human
agcuaagggaagacauuu

SEQ ID NO: 2826469 - RNA, 19 nt, Human
agcuaagggaagacauuuc

SEQ ID NO: 2826470 - RNA, 20 nt, Human
agcuaagggaagacauuucu

SEQ ID NO: 2826471 - RNA, 13 nt, Human
agcgaaguagcuu

SEQ ID NO: 2826472 - RNA, 17 nt, Human
agcgaaguagcuugcuc

SEQ ID NO: 2826473 - RNA, 20 nt, Human
agcgaaugcuaggucucgga

SEQ ID NO: 2826474 - RNA, 15 nt, Human
agcgauucuucugcu

SEQ ID NO: 2826475 - RNA, 19 nt, Human
agcgauucuucugcuucag

SEQ ID NO: 2826476 - RNA, 17 nt, Human
agcgauucuucugcuuc

SEQ ID NO: 2826477 - RNA, 16 nt, Human
agcuaacacacagcuc

SEQ ID NO: 2826478 - RNA, 17 nt, Human
agcuaacacacagcucc

SEQ ID NO: 2826479 - RNA, 18 nt, Human
agcuaacacacagcuccc

SEQ ID NO: 2826480 - RNA, 19 nt, Human
agcuaacacacagcuccca

SEQ ID NO: 2826481 - RNA, 17 nt, Human
agcuaaacggauuccaa

SEQ ID NO: 2826482 - RNA, 14 nt, Human
agcgauucuccugc

SEQ ID NO: 2826483 - RNA, 18 nt, Human
agcuaaacggauuccaaa

SEQ ID NO: 2826484 - RNA, 17 nt, Human
agcuaacauuuuaaaua

SEQ ID NO: 2826485 - RNA, 22 nt, Human
agcuaacauuuuaaauaaaaga

SEQ ID NO: 2826486 - RNA, 23 nt, Human
agcuaacccccuucuacugagcc

SEQ ID NO: 2826487 - RNA, 15 nt, Human
agcuaaccuuauccu

SEQ ID NO: 2826488 - RNA, 22 nt, Human
agcuaaccuuauccugcauugu

SEQ ID NO: 2826489 - RNA, 18 nt, Human
agcuaacauuuuaaauaa

SEQ ID NO: 2826490 - RNA, 20 nt, Human
agcuaacauuuuaaauaaaa

SEQ ID NO: 2826491 - RNA, 23 nt, Human
agcuaacauuuuaaauaaaagaa

SEQ ID NO: 2826492 - RNA, 23 nt, Human
agcuaaccaguuaccacacaucu

SEQ ID NO: 2826493 - RNA, 19 nt, Human
agcuaacccagguccccuc

SEQ ID NO: 2826494 - RNA, 15 nt, Human
agccugggcagccag

SEQ ID NO: 2826495 - RNA, 20 nt, Human
agccugggcagcauagcaag

SEQ ID NO: 2826496 - RNA, 17 nt, Human
agccugggcagcauagc

SEQ ID NO: 2826497 - RNA, 20 nt, Human
agccugggcaacagagcaag

SEQ ID NO: 2826498 - RNA, 18 nt, Human
agccugggcaacagagca

SEQ ID NO: 2826499 - RNA, 17 nt, Human
agccugggcaacagagc

SEQ ID NO: 2826500 - RNA, 15 nt, Human
agccugggcaacaga

SEQ ID NO: 2826501 - RNA, 17 nt, Human
agccuggccagccuaca

SEQ ID NO: 2826502 - RNA, 16 nt, Human
agccuggcccauagaa

SEQ ID NO: 2826503 - RNA, 17 nt, Human
agccuggcccauagaaa

SEQ ID NO: 2826504 - RNA, 19 nt, Human
agccuggcccauagaaaca

SEQ ID NO: 2826505 - RNA, 20 nt, Human
agccuuuuuaaaacacaugu

SEQ ID NO: 2826506 - RNA, 19 nt, Human
agccuuuuuaaaacacaug

SEQ ID NO: 2826507 - RNA, 18 nt, Human
agccuuuuuaaaacacau

SEQ ID NO: 2826508 - RNA, 17 nt, Human
agccuuuuuaaaacaca

SEQ ID NO: 2826509 - RNA, 22 nt, Human
agccuuuuuaaaacacauguuu

SEQ ID NO: 2826510 - RNA, 21 nt, Human
agccuuuuuaaaacacauguu

SEQ ID NO: 2826511 - RNA, 16 nt, Human
agccuuuuuaaaacac

SEQ ID NO: 2826512 - RNA, 16 nt, Human
agccuuugccuccccg

SEQ ID NO: 2826513 - RNA, 15 nt, Human
agccuuugccucccc

SEQ ID NO: 2826514 - RNA, 15 nt, Human
agcgaacaaccacag

SEQ ID NO: 2826515 - RNA, 14 nt, Human
agcgaaacacagag

SEQ ID NO: 2826516 - RNA, 22 nt, Human
agccuuuacugacccuggggcu

SEQ ID NO: 2826517 - RNA, 23 nt, Human
agccuuuaauggacuuauuucuu

SEQ ID NO: 2826518 - RNA, 18 nt, Human
agccuuuaguaucagugu

SEQ ID NO: 2826519 - RNA, 19 nt, Human
agccuuuaguaucaguguu

SEQ ID NO: 2826520 - RNA, 20 nt, Human
agccuuuaguaucaguguuu

SEQ ID NO: 2826521 - RNA, 17 nt, Human
agccugggcagccaggc

SEQ ID NO: 2826522 - RNA, 14 nt, Human
agccugcuuuuuaa

SEQ ID NO: 2826523 - RNA, 19 nt, Human
agccuggaacaucaucaag

SEQ ID NO: 2826524 - RNA, 20 nt, Human
agccuggaacaucaucaagg

SEQ ID NO: 2826525 - RNA, 21 nt, Human
agccuggaacaucaucaaggc

SEQ ID NO: 2826526 - RNA, 19 nt, Human
agccuggagacccacccca

SEQ ID NO: 2826527 - RNA, 24 nt, Human
agccuggagacccaccccaccugc

SEQ ID NO: 2826528 - RNA, 14 nt, Human
agccuggccaacau

SEQ ID NO: 2826529 - RNA, 20 nt, Human
agccuggccaacauggcgaa

SEQ ID NO: 2826530 - RNA, 13 nt, Human
agccuggcacagg

SEQ ID NO: 2826531 - RNA, 16 nt, Human
agccuggcacaggacu

SEQ ID NO: 2826532 - RNA, 19 nt, Human
agccuggcacaggacugau

SEQ ID NO: 2826533 - RNA, 20 nt, Human
agccuggcacagggcagugg

SEQ ID NO: 2826534 - RNA, 17 nt, Human
agccuggcacagggcag

SEQ ID NO: 2826535 - RNA, 18 nt, Human
agccuggcacagggcagu

SEQ ID NO: 2826536 - RNA, 20 nt, Human
agccugcuggucacagccuc

SEQ ID NO: 2826537 - RNA, 21 nt, Human
agccugcuggucacagccucc

SEQ ID NO: 2826538 - RNA, 22 nt, Human
agccugcuggucacagccuccu

SEQ ID NO: 2826539 - RNA, 23 nt, Human
agccugcuggucacagccuccuc

SEQ ID NO: 2826540 - RNA, 14 nt, Human
agccugcuucccac

SEQ ID NO: 2826541 - RNA, 15 nt, Human
agccugcuucccacc

SEQ ID NO: 2826542 - RNA, 19 nt, Human
agccugcuucccaccuccc

SEQ ID NO: 2826543 - RNA, 22 nt, Human
agccugcuucccaccucccugc

SEQ ID NO: 2826544 - RNA, 23 nt, Human
agccugcuucccaccucccugcc

SEQ ID NO: 2826545 - RNA, 12 nt, Human
agccugcugcau

SEQ ID NO: 2826546 - RNA, 13 nt, Human
agccugcugccca

SEQ ID NO: 2826547 - RNA, 17 nt, Human
agccugcugcccaggcu

SEQ ID NO: 2826548 - RNA, 20 nt, Human
agccugcugcccaggcugug

SEQ ID NO: 2826549 - RNA, 11 nt, Human
agccugcugca

SEQ ID NO: 2826550 - RNA, 14 nt, Human
agcugccuuggcuc

SEQ ID NO: 2826551 - RNA, 16 nt, Human
agcugccuuggcucag

SEQ ID NO: 2826552 - RNA, 17 nt, Human
agcugccuuggcucaga

SEQ ID NO: 2826553 - RNA, 19 nt, Human
agcugccuuggcucagaca

SEQ ID NO: 2826554 - RNA, 20 nt, Human
agcugccuuggcucagacau

SEQ ID NO: 2826555 - RNA, 15 nt, Human
agcugguuagaaaug

SEQ ID NO: 2826556 - RNA, 15 nt, Human
agcugguggacccag

SEQ ID NO: 2826557 - RNA, 15 nt, Human
agcuggucccacuca

SEQ ID NO: 2826558 - RNA, 20 nt, Human
agcuggguuggaaaacagua

SEQ ID NO: 2826559 - RNA, 16 nt, Human
agcuggguuggaaaac

SEQ ID NO: 2826560 - RNA, 14 nt, Human
agcuggguuggaaa

SEQ ID NO: 2826561 - RNA, 16 nt, Human
agcucuuggcuccacu

SEQ ID NO: 2826562 - RNA, 23 nt, Human
agcucuuguccucaguccauuua

SEQ ID NO: 2826563 - RNA, 13 nt, Human
agcuccucuccug

SEQ ID NO: 2826564 - RNA, 14 nt, Human
agcuccucuccugg

SEQ ID NO: 2826565 - RNA, 15 nt, Human
agcuccucuccugga

SEQ ID NO: 2826566 - RNA, 16 nt, Human
agcuccucuccuggag

SEQ ID NO: 2826567 - RNA, 17 nt, Human
agcuccucuccuggagg

SEQ ID NO: 2826568 - RNA, 18 nt, Human
agcuccucuccuggagga

SEQ ID NO: 2826569 - RNA, 23 nt, Human
agcucaccagccccagugcccac

SEQ ID NO: 2826570 - RNA, 22 nt, Human
agcucaccagccccagugccca

SEQ ID NO: 2826571 - RNA, 19 nt, Human
agccugggauuucuaugca

SEQ ID NO: 2826572 - RNA, 17 nt, Human
agcugguuagaaaugca

SEQ ID NO: 2826573 - RNA, 19 nt, Human
aggaaaaccaagccguggc

SEQ ID NO: 2826574 - RNA, 13 nt, Human
aggaaaaacaggu

SEQ ID NO: 2826575 - RNA, 17 nt, Human
agcuuuuugucuuuucu

SEQ ID NO: 2826576 - RNA, 10 nt, Human
aggaaaaaaa

SEQ ID NO: 2826577 - RNA, 24 nt, Human
aggaaaaaaacuauuaaggaugua

SEQ ID NO: 2826578 - RNA, 13 nt, Human
aggaaaaaaagac

SEQ ID NO: 2826579 - RNA, 14 nt, Human
aggaaaaaaagacu

SEQ ID NO: 2826580 - RNA, 15 nt, Human
aggaaaaaaagcaug

SEQ ID NO: 2826581 - RNA, 13 nt, Human
aggaaaaaaauag

SEQ ID NO: 2826582 - RNA, 13 nt, Human
agcuuuuugucuu

SEQ ID NO: 2826583 - RNA, 19 nt, Human
agcuuuguuucaaccaagu

SEQ ID NO: 2826584 - RNA, 16 nt, Human
agcuuuguccccugcu

SEQ ID NO: 2826585 - RNA, 17 nt, Human
agcuuuguccccugcuu

SEQ ID NO: 2826586 - RNA, 18 nt, Human
agcuuuguccccugcuuc

SEQ ID NO: 2826587 - RNA, 20 nt, Human
agcuuuguccccugcuucag

SEQ ID NO: 2826588 - RNA, 21 nt, Human
agcuuuguccccugcuucaga

SEQ ID NO: 2826589 - RNA, 12 nt, Human
agcuuuguguuu

SEQ ID NO: 2826590 - RNA, 17 nt, Human
agcuuuguguuugguuu

SEQ ID NO: 2826591 - RNA, 21 nt, Human
agcuuuguguuugguuuacau

SEQ ID NO: 2826592 - RNA, 22 nt, Human
agcuuuguguuugguuuacauu

SEQ ID NO: 2826593 - RNA, 23 nt, Human
agcuuuguguuugguuuacauuu

SEQ ID NO: 2826594 - RNA, 21 nt, Human
aggaacagcuaugggagcccc

SEQ ID NO: 2826595 - RNA, 21 nt, Human
aggaacagaaggaugaaugag

SEQ ID NO: 2826596 - RNA, 14 nt, Human
aggaacagaaggau

SEQ ID NO: 2826597 - RNA, 13 nt, Human
aggaacagaagga

SEQ ID NO: 2826598 - RNA, 14 nt, Human
aggaacuuccaggu

SEQ ID NO: 2826599 - RNA, 18 nt, Human
aggaacuugaaaaauacu

SEQ ID NO: 2826600 - RNA, 17 nt, Human
aggaagaaacagaagag

SEQ ID NO: 2826601 - RNA, 19 nt, Human
aggaagaaacagaagagag

SEQ ID NO: 2826602 - RNA, 23 nt, Human
aggaacacaggcgcugaguaugg

SEQ ID NO: 2826603 - RNA, 14 nt, Human
aggaaaacugcaug

SEQ ID NO: 2826604 - RNA, 16 nt, Human
aggaaaaccugaagac

SEQ ID NO: 2826605 - RNA, 20 nt, Human
aggaaaaccaagccguggcu

SEQ ID NO: 2826606 - RNA, 21 nt, Human
aggaaaaccaagccguggcuu

SEQ ID NO: 2826607 - RNA, 22 nt, Human
aggaaaaccaagccguggcuuc

SEQ ID NO: 2826608 - RNA, 23 nt, Human
aggaaaaccaagccguggcuucc

SEQ ID NO: 2826609 - RNA, 13 nt, Human
aggaacuucagag

SEQ ID NO: 2826610 - RNA, 14 nt, Human
aggaaggugguggg

SEQ ID NO: 2826611 - RNA, 16 nt, Human
aggaaggucucauucu

SEQ ID NO: 2826612 - RNA, 17 nt, Human
aggaaggucucauucuu

SEQ ID NO: 2826613 - RNA, 24 nt, Human
agacaaaaucucuauacugcccug

SEQ ID NO: 2826614 - RNA, 20 nt, Human
agacaagauauuguacauaa

SEQ ID NO: 2826615 - RNA, 21 nt, Human
agacaagauauuguacauaaa

SEQ ID NO: 2826616 - RNA, 22 nt, Human
agacaagauauuguacauaaaa

SEQ ID NO: 2826617 - RNA, 14 nt, Human
agacaaaaagacaa

SEQ ID NO: 2826618 - RNA, 15 nt, Human
agacaaaaagacaaa

SEQ ID NO: 2826619 - RNA, 18 nt, Human
agacaaaaagacaaacau

SEQ ID NO: 2826620 - RNA, 22 nt, Human
agacaagugacuguaucugugu

SEQ ID NO: 2826621 - RNA, 20 nt, Human
agacaagugacuguaucugu

SEQ ID NO: 2826622 - RNA, 23 nt, Human
agacaagugacuguaucugugua

SEQ ID NO: 2826623 - RNA, 15 nt, Human
agacaaguuccaugg

SEQ ID NO: 2826624 - RNA, 22 nt, Human
agacaaguuccaugggauacaa

SEQ ID NO: 2826625 - RNA, 13 nt, Human
agacaaugucugc

SEQ ID NO: 2826626 - RNA, 20 nt, Human
agacaaugucugcagcccug

SEQ ID NO: 2826627 - RNA, 21 nt, Human
agacaaugucugcagcccuga

SEQ ID NO: 2826628 - RNA, 13 nt, Human
agacaaggaaaua

SEQ ID NO: 2826629 - RNA, 20 nt, Human
agacaaugcaccuagcugug

SEQ ID NO: 2826630 - RNA, 22 nt, Human
agaauuuuccugagacaaauuu

SEQ ID NO: 2826631 - RNA, 23 nt, Human
agaauuuuccugagacaaauuuu

SEQ ID NO: 2826632 - RNA, 15 nt, Human
agaauuuugagcagg

SEQ ID NO: 2826633 - RNA, 15 nt, Human
agaauuuuuuugucu

SEQ ID NO: 2826634 - RNA, 16 nt, Human
agaauuuuuuugucuu

SEQ ID NO: 2826635 - RNA, 14 nt, Human
agaauuuuuuuugu

SEQ ID NO: 2826636 - RNA, 15 nt, Human
agaauuuuuuuuguu

SEQ ID NO: 2826637 - RNA, 20 nt, Human
agaauuuuuuuuguuguuuc

SEQ ID NO: 2826638 - RNA, 12 nt, Human
agaauuuuggaa

SEQ ID NO: 2826639 - RNA, 13 nt, Human
agaauuuuaggaa

SEQ ID NO: 2826640 - RNA, 14 nt, Human
agaauuuuaggaac

SEQ ID NO: 2826641 - RNA, 20 nt, Human
agaauuuuaggaacuucaga

SEQ ID NO: 2826642 - RNA, 22 nt, Human
agaauuuuaggaacuucagaga

SEQ ID NO: 2826643 - RNA, 16 nt, Human
agacuagauugccuuu

SEQ ID NO: 2826644 - RNA, 22 nt, Human
agacuaggauaauguccaacua

SEQ ID NO: 2826645 - RNA, 19 nt, Human
agacuagauugccuuuguu

SEQ ID NO: 2826646 - RNA, 22 nt, Human
agacuaguuuuuauuccuugug

SEQ ID NO: 2826647 - RNA, 12 nt, Human
agacuauauaca

SEQ ID NO: 2826648 - RNA, 13 nt, Human
agacuauauacau

SEQ ID NO: 2826649 - RNA, 14 nt, Human
agacuauauacaug

SEQ ID NO: 2826650 - RNA, 15 nt, Human
agacuauauacaugu

SEQ ID NO: 2826651 - RNA, 17 nt, Human
agacuauauacaugugu

SEQ ID NO: 2826652 - RNA, 18 nt, Human
agacuauauacaugugug

SEQ ID NO: 2826653 - RNA, 19 nt, Human
agacuauauacaugugugu

SEQ ID NO: 2826654 - RNA, 20 nt, Human
agacuauauacaugugugua

SEQ ID NO: 2826655 - RNA, 21 nt, Human
agacuauauacauguguguau

SEQ ID NO: 2826656 - RNA, 21 nt, Human
agacgacaaggaaaggcaaau

SEQ ID NO: 2826657 - RNA, 20 nt, Human
agacgauaguuaucuguucu

SEQ ID NO: 2826658 - RNA, 15 nt, Human
agacuaucagcccaa

SEQ ID NO: 2826659 - RNA, 13 nt, Human
agacgacaggcga

SEQ ID NO: 2826660 - RNA, 22 nt, Human
agaccuuuuggcccaaucucug

SEQ ID NO: 2826661 - RNA, 15 nt, Human
agaccauuuaacaug

SEQ ID NO: 2826662 - RNA, 16 nt, Human
agaccauuuaacaugc

SEQ ID NO: 2826663 - RNA, 18 nt, Human
agaccauuuaacaugcaa

SEQ ID NO: 2826664 - RNA, 16 nt, Human
agaccaccccgccugc

SEQ ID NO: 2826665 - RNA, 13 nt, Human
agacagcccucca

SEQ ID NO: 2826666 - RNA, 23 nt, Human
agacaauugagguaaguuuuuug

SEQ ID NO: 2826667 - RNA, 14 nt, Human
agaccaccccgccu

SEQ ID NO: 2826668 - RNA, 17 nt, Human
agaccaccauccaccgc

SEQ ID NO: 2826669 - RNA, 18 nt, Human
agagaaacaauaaagaga

SEQ ID NO: 2826670 - RNA, 14 nt, Human
agagaaacaaacuu

SEQ ID NO: 2826671 - RNA, 15 nt, Human
agagaaacaaacuuu

SEQ ID NO: 2826672 - RNA, 15 nt, Human
agagaaagaaaauga

SEQ ID NO: 2826673 - RNA, 16 nt, Human
agagaaagaaaaugaa

SEQ ID NO: 2826674 - RNA, 12 nt, Human
agagaaacuuua

SEQ ID NO: 2826675 - RNA, 13 nt, Human
agagaaacuuuau

SEQ ID NO: 2826676 - RNA, 21 nt, Human
agagaaacuuuauacauuagu

SEQ ID NO: 2826677 - RNA, 24 nt, Human
agagaaagugggugagaugcugga

SEQ ID NO: 2826678 - RNA, 18 nt, Human
agagaaaguacuucucca

SEQ ID NO: 2826679 - RNA, 23 nt, Human
agacugaaaauauauaagcucag

SEQ ID NO: 2826680 - RNA, 15 nt, Human
agacucuuugcauau

SEQ ID NO: 2826681 - RNA, 19 nt, Human
agacugacaaccucaucca

SEQ ID NO: 2826682 - RNA, 12 nt, Human
agagaaaauaua

SEQ ID NO: 2826683 - RNA, 14 nt, Human
agagaaaauauaug

SEQ ID NO: 2826684 - RNA, 15 nt, Human
agagaaaauauaugu

SEQ ID NO: 2826685 - RNA, 16 nt, Human
agagaaaauauaugua

SEQ ID NO: 2826686 - RNA, 19 nt, Human
agagaaaauauauguauuu

SEQ ID NO: 2826687 - RNA, 23 nt, Human
agagaaaauauauguauuuuuau

SEQ ID NO: 2826688 - RNA, 13 nt, Human
agagaaacaaacu

SEQ ID NO: 2826689 - RNA, 13 nt, Human
agagaauauaaca

SEQ ID NO: 2826690 - RNA, 16 nt, Human
agagaauauaacauga

SEQ ID NO: 2826691 - RNA, 17 nt, Human
agagaauauaacaugaa

SEQ ID NO: 2826692 - RNA, 18 nt, Human
agagaauauaacaugaaa

SEQ ID NO: 2826693 - RNA, 22 nt, Human
agagaauauaacaugaaaugau

SEQ ID NO: 2826694 - RNA, 23 nt, Human
agagaauauaacaugaaaugaua

SEQ ID NO: 2826695 - RNA, 15 nt, Human
agagaauaugucugc

SEQ ID NO: 2826696 - RNA, 22 nt, Human
agagaauaugucugcuccuuuc

SEQ ID NO: 2826697 - RNA, 22 nt, Human
agagagauauaucugaaaacug

SEQ ID NO: 2826698 - RNA, 17 nt, Human
agagagaugggagcucc

SEQ ID NO: 2826699 - RNA, 18 nt, Human
agagagaugggagcuccu

SEQ ID NO: 2826700 - RNA, 19 nt, Human
agagagaugggagcuccuc

SEQ ID NO: 2826701 - RNA, 11 nt, Human
agagaaaucuc

SEQ ID NO: 2826702 - RNA, 14 nt, Human
agagaaaucugaaa

SEQ ID NO: 2826703 - RNA, 13 nt, Human
agagaaauggcaa

SEQ ID NO: 2826704 - RNA, 14 nt, Human
agagaaaugucuuu

SEQ ID NO: 2826705 - RNA, 12 nt, Human
agagaaauucug

SEQ ID NO: 2826706 - RNA, 13 nt, Human
agagaaauucugu

SEQ ID NO: 2826707 - RNA, 17 nt, Human
agagaaauucuguuaaa

SEQ ID NO: 2826708 - RNA, 18 nt, Human
agagaaauucuguuaaaa

SEQ ID NO: 2826709 - RNA, 20 nt, Human
agagaaccgagcaaagauca

SEQ ID NO: 2826710 - RNA, 21 nt, Human
agagaaccgagcaaagaucaa

SEQ ID NO: 2826711 - RNA, 19 nt, Human
agagaaccuaacuguaucu

SEQ ID NO: 2826712 - RNA, 21 nt, Human
agagaaccuaacuguaucuug

SEQ ID NO: 2826713 - RNA, 23 nt, Human
agagaaccuaacuguaucuugag

SEQ ID NO: 2826714 - RNA, 15 nt, Human
agagaaccgagcaaa

SEQ ID NO: 2826715 - RNA, 17 nt, Human
agagaaccgagcaaaga

SEQ ID NO: 2826716 - RNA, 17 nt, Human
agagaggagaggagaga

SEQ ID NO: 2826717 - RNA, 14 nt, Human
agagaggagccaga

SEQ ID NO: 2826718 - RNA, 14 nt, Human
agagaggcagagag

SEQ ID NO: 2826719 - RNA, 15 nt, Human
agagaggcagagagc

SEQ ID NO: 2826720 - RNA, 16 nt, Human
agagaggcagagagcg

SEQ ID NO: 2826721 - RNA, 13 nt, Human
agagaggcagaga

SEQ ID NO: 2826722 - RNA, 19 nt, Human
agagaggaugugcaagcga

SEQ ID NO: 2826723 - RNA, 14 nt, Human
agagcccagaggua

SEQ ID NO: 2826724 - RNA, 16 nt, Human
agagcccagagguaac

SEQ ID NO: 2826725 - RNA, 20 nt, Human
agagcccagagguaacagaa

SEQ ID NO: 2826726 - RNA, 14 nt, Human
agagcccagccauu

SEQ ID NO: 2826727 - RNA, 22 nt, Human
agagcccagagguaacagaaca

SEQ ID NO: 2826728 - RNA, 24 nt, Human
agagcccagagguaacagaacagc

SEQ ID NO: 2826729 - RNA, 13 nt, Human
agagccugaucuc

SEQ ID NO: 2826730 - RNA, 14 nt, Human
agagccugaucucu

SEQ ID NO: 2826731 - RNA, 16 nt, Human
agagccugaucucuuc

SEQ ID NO: 2826732 - RNA, 18 nt, Human
agagccugaucucuuccu

SEQ ID NO: 2826733 - RNA, 19 nt, Human
agagccugaucucuuccug

SEQ ID NO: 2826734 - RNA, 20 nt, Human
agagccugaucucuuccugu

SEQ ID NO: 2826735 - RNA, 12 nt, Human
agagccugcugc

SEQ ID NO: 2826736 - RNA, 15 nt, Human
agagccugccuggag

SEQ ID NO: 2826737 - RNA, 16 nt, Human
agagccugccuggagc

SEQ ID NO: 2826738 - RNA, 17 nt, Human
agagccugccuggagcg

SEQ ID NO: 2826739 - RNA, 11 nt, Human
agaacaggguc

SEQ ID NO: 2826740 - RNA, 21 nt, Human
agaacagggucauguuugcag

SEQ ID NO: 2826741 - RNA, 23 nt, Human
agaacagguguuggugacaauug

SEQ ID NO: 2826742 - RNA, 14 nt, Human
agaacaucauuaga

SEQ ID NO: 2826743 - RNA, 17 nt, Human
agaacauaaagguaaaa

SEQ ID NO: 2826744 - RNA, 20 nt, Human
agaacauaaagguaaaacaa

SEQ ID NO: 2826745 - RNA, 21 nt, Human
agaacagugcuugccacagag

SEQ ID NO: 2826746 - RNA, 17 nt, Human
agaacaguaucuuugca

SEQ ID NO: 2826747 - RNA, 22 nt, Human
agaacaguaucuuugcacucca

SEQ ID NO: 2826748 - RNA, 12 nt, Human
agaacagcuuca

SEQ ID NO: 2826749 - RNA, 22 nt, Human
agaacagcuucagguuaucgaa

SEQ ID NO: 2826750 - RNA, 13 nt, Human
agaacagcuucag

SEQ ID NO: 2826751 - RNA, 14 nt, Human
agaacagcuucagg

SEQ ID NO: 2826752 - RNA, 16 nt, Human
agaacagcuucagguu

SEQ ID NO: 2826753 - RNA, 18 nt, Human
agaacagcuucagguuau

SEQ ID NO: 2826754 - RNA, 17 nt, Human
agaacacugugaaaaca

SEQ ID NO: 2826755 - RNA, 16 nt, Human
agaacagaucuuuuac

SEQ ID NO: 2826756 - RNA, 22 nt, Human
agaacaucuuugacacucugca

SEQ ID NO: 2826757 - RNA, 23 nt, Human
agaacaucuuugacacucugcag

SEQ ID NO: 2826758 - RNA, 13 nt, Human
agaacaugugaga

SEQ ID NO: 2826759 - RNA, 22 nt, Human
agaacaugugagagguuugacu

SEQ ID NO: 2826760 - RNA, 15 nt, Human
agaacaucauuagaa

SEQ ID NO: 2826761 - RNA, 16 nt, Human
agaacaucauuagaac

SEQ ID NO: 2826762 - RNA, 18 nt, Human
agaacaucauuagaacaa

SEQ ID NO: 2826763 - RNA, 20 nt, Human
agaacaucauuagaacaaag

SEQ ID NO: 2826764 - RNA, 19 nt, Human
agaacagauaaucagugug

SEQ ID NO: 2826765 - RNA, 14 nt, Human
agaacacugugaaa

SEQ ID NO: 2826766 - RNA, 20 nt, Human
agaacacuaacucaccagcc

SEQ ID NO: 2826767 - RNA, 18 nt, Human
agaacacuaacucaccag

SEQ ID NO: 2826768 - RNA, 18 nt, Human
agaacacggcucacgcuu

SEQ ID NO: 2826769 - RNA, 14 nt, Human
agaacacgcguauu

SEQ ID NO: 2826770 - RNA, 21 nt, Human
agaacacagccgauucaccug

SEQ ID NO: 2826771 - RNA, 13 nt, Human
agaacaauugucc

SEQ ID NO: 2826772 - RNA, 15 nt, Human
agaacaauuuucuug

SEQ ID NO: 2826773 - RNA, 19 nt, Human
agaacaauagguaaagcua

SEQ ID NO: 2826774 - RNA, 20 nt, Human
agaacaaagugagacagucc

SEQ ID NO: 2826775 - RNA, 12 nt, Human
agaacaaauauu

SEQ ID NO: 2826776 - RNA, 14 nt, Human
agaacaaauauuca

SEQ ID NO: 2826777 - RNA, 18 nt, Human
agaacaaauauucagaau

SEQ ID NO: 2826778 - RNA, 24 nt, Human
agaacaaauauucagaauauucau

SEQ ID NO: 2826779 - RNA, 11 nt, Human
agaagagccac

SEQ ID NO: 2826780 - RNA, 13 nt, Human
agaagagccacag

SEQ ID NO: 2826781 - RNA, 14 nt, Human
agaagagccacagu

SEQ ID NO: 2826782 - RNA, 22 nt, Human
agaagagccacagugagggaga

SEQ ID NO: 2826783 - RNA, 13 nt, Human
agaagauccccuc

SEQ ID NO: 2826784 - RNA, 14 nt, Human
agaagauccccuca

SEQ ID NO: 2826785 - RNA, 17 nt, Human
agaagauccuaaaacaa

SEQ ID NO: 2826786 - RNA, 18 nt, Human
agaagauccuaaaacaaa

SEQ ID NO: 2826787 - RNA, 13 nt, Human
agaagagaagcug

SEQ ID NO: 2826788 - RNA, 15 nt, Human
agaagagaagcugcu

SEQ ID NO: 2826789 - RNA, 16 nt, Human
agaagagaagcugcug

SEQ ID NO: 2826790 - RNA, 17 nt, Human
agaagagaagcugcuga

SEQ ID NO: 2826791 - RNA, 22 nt, Human
agaaccaucccuauuuuguauu

SEQ ID NO: 2826792 - RNA, 14 nt, Human
agaaccagccauau

SEQ ID NO: 2826793 - RNA, 20 nt, Human
agaaccagccauauacacuu

SEQ ID NO: 2826794 - RNA, 20 nt, Human
agaaccaggcaacuugggaa

SEQ ID NO: 2826795 - RNA, 11 nt, Human
agaacauugua

SEQ ID NO: 2826796 - RNA, 18 nt, Human
agaaccaaaaguuuuccu

SEQ ID NO: 2826797 - RNA, 20 nt, Human
agaaccaaaaguuuuccuga

SEQ ID NO: 2826798 - RNA, 17 nt, Human
agaaccaaagcucaaau

SEQ ID NO: 2826799 - RNA, 22 nt, Human
agaaccaccccggcccccugcc

SEQ ID NO: 2826800 - RNA, 23 nt, Human
agaaccaccccggcccccugccc

SEQ ID NO: 2826801 - RNA, 17 nt, Human
agaaccaggcaacuugg

SEQ ID NO: 2826802 - RNA, 17 nt, Human
agaagucaaaguaaaac

SEQ ID NO: 2826803 - RNA, 13 nt, Human
agaagaugaaugg

SEQ ID NO: 2826804 - RNA, 16 nt, Human
agaaggggaagcacuc

SEQ ID NO: 2826805 - RNA, 20 nt, Human
agaagggccaguccugccug

SEQ ID NO: 2826806 - RNA, 19 nt, Human
agaagggccaguccugccu

SEQ ID NO: 2826807 - RNA, 19 nt, Human
agaagggcauaaaacagcu

SEQ ID NO: 2826808 - RNA, 21 nt, Human
agaagggauaacccuacaccc

SEQ ID NO: 2826809 - RNA, 17 nt, Human
agaagggcuccugcagg

SEQ ID NO: 2826810 - RNA, 15 nt, Human
agaaggggaagcacu

SEQ ID NO: 2826811 - RNA, 16 nt, Human
agaagaugaucagacc

SEQ ID NO: 2826812 - RNA, 23 nt, Human
agaagaugcuccagcaacacagc

SEQ ID NO: 2826813 - RNA, 14 nt, Human
agaagaugcuccag

SEQ ID NO: 2826814 - RNA, 17 nt, Human
agaagaugaucagaccu

SEQ ID NO: 2826815 - RNA, 14 nt, Human
agaagucacacagu

SEQ ID NO: 2826816 - RNA, 20 nt, Human
agaagucaugaagcccaagu

SEQ ID NO: 2826817 - RNA, 17 nt, Human
agaagucaugaagccca

SEQ ID NO: 2826818 - RNA, 19 nt, Human
agaaguccuguaugucugu

SEQ ID NO: 2826819 - RNA, 21 nt, Human
agaaguccuguaugucuguca

SEQ ID NO: 2826820 - RNA, 22 nt, Human
agaaguccuguaugucugucau

SEQ ID NO: 2826821 - RNA, 16 nt, Human
agaauccuuuuguaga

SEQ ID NO: 2826822 - RNA, 17 nt, Human
agaauccuuuuguagaa

SEQ ID NO: 2826823 - RNA, 22 nt, Human
agaauccuuuuguagaaugaac

SEQ ID NO: 2826824 - RNA, 21 nt, Human
agaauccuaggcuccacccca

SEQ ID NO: 2826825 - RNA, 15 nt, Human
agaaucuaaagccag

SEQ ID NO: 2826826 - RNA, 16 nt, Human
agaaucuaaagccagu

SEQ ID NO: 2826827 - RNA, 18 nt, Human
agaaucuauauuuaacaa

SEQ ID NO: 2826828 - RNA, 12 nt, Human
agaaucuauuuu

SEQ ID NO: 2826829 - RNA, 13 nt, Human
agaaucuauuuuc

SEQ ID NO: 2826830 - RNA, 14 nt, Human
agaaucuauuuucu

SEQ ID NO: 2826831 - RNA, 15 nt, Human
agaaucuauuuucua

SEQ ID NO: 2826832 - RNA, 16 nt, Human
agaaucuauuuucuau

SEQ ID NO: 2826833 - RNA, 21 nt, Human
agaaucuauuuucuauguacu

SEQ ID NO: 2826834 - RNA, 22 nt, Human
agaaucuauuuucuauguacua

SEQ ID NO: 2826835 - RNA, 17 nt, Human
agaaucugcaauucaaa

SEQ ID NO: 2826836 - RNA, 19 nt, Human
agaaucuguuucccagcag

SEQ ID NO: 2826837 - RNA, 16 nt, Human
agaaugaaagggccca

SEQ ID NO: 2826838 - RNA, 12 nt, Human
agaaugagccuc

SEQ ID NO: 2826839 - RNA, 14 nt, Human
agaaugaaaaauga

SEQ ID NO: 2826840 - RNA, 15 nt, Human
agaaugaaaaaugaa

SEQ ID NO: 2826841 - RNA, 18 nt, Human
agaaugaaaaaugaaaga

SEQ ID NO: 2826842 - RNA, 22 nt, Human
agaaugaaaaaugaaagaugau

SEQ ID NO: 2826843 - RNA, 16 nt, Human
agaaugaaaacucauu

SEQ ID NO: 2826844 - RNA, 12 nt, Human
agaaugcauuga

SEQ ID NO: 2826845 - RNA, 13 nt, Human
agaaugcauugau

SEQ ID NO: 2826846 - RNA, 20 nt, Human
agaaugcauugauauuguga

SEQ ID NO: 2826847 - RNA, 21 nt, Human
agaaugcauugauauugugaa

SEQ ID NO: 2826848 - RNA, 22 nt, Human
agaaugcauugauauugugaac

SEQ ID NO: 2826849 - RNA, 16 nt, Human
agaaugcacagauaua

SEQ ID NO: 2826850 - RNA, 17 nt, Human
agaaugcacagauauac

SEQ ID NO: 2826851 - RNA, 18 nt, Human
agaaugcacagauauacu

SEQ ID NO: 2826852 - RNA, 22 nt, Human
agaaugcacagauauacuuugu

SEQ ID NO: 2826853 - RNA, 20 nt, Human
agaaugaugauaacagaacu

SEQ ID NO: 2826854 - RNA, 21 nt, Human
agaucugcagggggugugucu

SEQ ID NO: 2826855 - RNA, 18 nt, Human
agaucucugcuuuggaaa

SEQ ID NO: 2826856 - RNA, 23 nt, Human
agaucucugcuuuggaaaucaca

SEQ ID NO: 2826857 - RNA, 19 nt, Human
agauucuauaguucuagac

SEQ ID NO: 2826858 - RNA, 20 nt, Human
agauucuauaguucuagaca

SEQ ID NO: 2826859 - RNA, 21 nt, Human
agauucuauaguucuagacau

SEQ ID NO: 2826860 - RNA, 19 nt, Human
agauucuacauauucuuua

SEQ ID NO: 2826861 - RNA, 13 nt, Human
agauucuaaugau

SEQ ID NO: 2826862 - RNA, 14 nt, Human
agauucuaaugaug

SEQ ID NO: 2826863 - RNA, 13 nt, Human
agauucuaaaggu

SEQ ID NO: 2826864 - RNA, 23 nt, Human
agauucuaaagguccacaggucu

SEQ ID NO: 2826865 - RNA, 10 nt, Human
agauucuaac

SEQ ID NO: 2826866 - RNA, 12 nt, Human
agauucuaacgg

SEQ ID NO: 2826867 - RNA, 15 nt, Human
agauucuauaguucu

SEQ ID NO: 2826868 - RNA, 16 nt, Human
agauucuauaguucua

SEQ ID NO: 2826869 - RNA, 18 nt, Human
agauucuauaguucuaga

SEQ ID NO: 2826870 - RNA, 11 nt, Human
agauucuagau

SEQ ID NO: 2826871 - RNA, 12 nt, Human
agauucuagauc

SEQ ID NO: 2826872 - RNA, 14 nt, Human
agauucuagaucag

SEQ ID NO: 2826873 - RNA, 14 nt, Human
agauucuagaugau

SEQ ID NO: 2826874 - RNA, 14 nt, Human
agauucuaaagauu

SEQ ID NO: 2826875 - RNA, 15 nt, Human
agauucuaaagauuc

SEQ ID NO: 2826876 - RNA, 16 nt, Human
agauucuaaagauucu

SEQ ID NO: 2826877 - RNA, 17 nt, Human
agauucuaaagauucua

SEQ ID NO: 2826878 - RNA, 18 nt, Human
agauucuaaagauucuau

SEQ ID NO: 2826879 - RNA, 21 nt, Human
agauucuaaagauucuauagu

SEQ ID NO: 2826880 - RNA, 12 nt, Human
agauucuaaagg

SEQ ID NO: 2826881 - RNA, 21 nt, Human
agaugaauuauccuauuucag

SEQ ID NO: 2826882 - RNA, 12 nt, Human
agaugacaaccu

SEQ ID NO: 2826883 - RNA, 17 nt, Human
agaugacaaccuccauu

SEQ ID NO: 2826884 - RNA, 16 nt, Human
agaugaccauaaccac

SEQ ID NO: 2826885 - RNA, 20 nt, Human
agaugaccauaaccacugaa

SEQ ID NO: 2826886 - RNA, 21 nt, Human
agauggcugugccucugccug

SEQ ID NO: 2826887 - RNA, 22 nt, Human
agauggcugugccucugccugu

SEQ ID NO: 2826888 - RNA, 17 nt, Human
agauggcugugccucug

SEQ ID NO: 2826889 - RNA, 18 nt, Human
agauggcugugccucugc

SEQ ID NO: 2826890 - RNA, 19 nt, Human
agauggcugugccucugcc

SEQ ID NO: 2826891 - RNA, 20 nt, Human
agauggcugugccucugccu

SEQ ID NO: 2826892 - RNA, 23 nt, Human
agcaaaauugauguguuuauuua

SEQ ID NO: 2826893 - RNA, 18 nt, Human
agcaaagaggacucgcuu

SEQ ID NO: 2826894 - RNA, 22 nt, Human
agcaaagaggacucgcuuguaa

SEQ ID NO: 2826895 - RNA, 23 nt, Human
agcaaagaggacucgcuuguaaa

SEQ ID NO: 2826896 - RNA, 19 nt, Human
agcaaauaaacuaggaaau

SEQ ID NO: 2826897 - RNA, 22 nt, Human
agcaaagugguagguacuuuuu

SEQ ID NO: 2826898 - RNA, 12 nt, Human
agcaaauacuua

SEQ ID NO: 2826899 - RNA, 14 nt, Human
agcaaauacuuagc

SEQ ID NO: 2826900 - RNA, 15 nt, Human
agcaaauacuuagca

SEQ ID NO: 2826901 - RNA, 21 nt, Human
agcaaauacuuagcaaaaagu

SEQ ID NO: 2826902 - RNA, 22 nt, Human
agcaaauacuuagcaaaaagug

SEQ ID NO: 2826903 - RNA, 21 nt, Human
agcaaauaucauacuguucaa

SEQ ID NO: 2826904 - RNA, 19 nt, Human
agcaaaggcugagaacacu

SEQ ID NO: 2826905 - RNA, 12 nt, Human
agcaaagaucaa

SEQ ID NO: 2826906 - RNA, 13 nt, Human
agcaaagaucaaa

SEQ ID NO: 2826907 - RNA, 14 nt, Human
agcaaagaucaaaa

SEQ ID NO: 2826908 - RNA, 15 nt, Human
agcaaagaucaaaau

SEQ ID NO: 2826909 - RNA, 17 nt, Human
agcaaagaucaaaauaa

SEQ ID NO: 2826910 - RNA, 14 nt, Human
agcaaauuucaaaa

SEQ ID NO: 2826911 - RNA, 18 nt, Human
agcaaauuucaaaagaca

SEQ ID NO: 2826912 - RNA, 19 nt, Human
agcaaauuucaaaagacau

SEQ ID NO: 2826913 - RNA, 24 nt, Human
agcaaauuucaaaagacauguugu

SEQ ID NO: 2826914 - RNA, 16 nt, Human
agauugcaacaggcug

SEQ ID NO: 2826915 - RNA, 22 nt, Human
agauugaguauaaaaacuugaa

SEQ ID NO: 2826916 - RNA, 23 nt, Human
agauugaguauaaaaacuugaaa

SEQ ID NO: 2826917 - RNA, 19 nt, Human
agauugagagaagagacaa

SEQ ID NO: 2826918 - RNA, 18 nt, Human
agauugagagaagagaca

SEQ ID NO: 2826919 - RNA, 15 nt, Human
agauugagaaggaga

SEQ ID NO: 2826920 - RNA, 16 nt, Human
agauugagaaggagag

SEQ ID NO: 2826921 - RNA, 17 nt, Human
agauugagaaggagaga

SEQ ID NO: 2826922 - RNA, 18 nt, Human
agauugagaaggagagaa

SEQ ID NO: 2826923 - RNA, 19 nt, Human
agauugagaaggagagaaa

SEQ ID NO: 2826924 - RNA, 19 nt, Human
agauugcaacaggcugggc

SEQ ID NO: 2826925 - RNA, 17 nt, Human
agauugcaacaggcugg

SEQ ID NO: 2826926 - RNA, 19 nt, Human
agcaaaauugauguguuua

SEQ ID NO: 2826927 - RNA, 13 nt, Human
agcaaaauugaug

SEQ ID NO: 2826928 - RNA, 19 nt, Human
agauugcugaaaaaguaga

SEQ ID NO: 2826929 - RNA, 13 nt, Human
agauugcuaauug

SEQ ID NO: 2826930 - RNA, 16 nt, Human
agauugcuaauugcug

SEQ ID NO: 2826931 - RNA, 18 nt, Human
agauugcuaauugcuguu

SEQ ID NO: 2826932 - RNA, 19 nt, Human
agauugcuaauugcuguug

SEQ ID NO: 2826933 - RNA, 16 nt, Human
agauugccccaggucu

SEQ ID NO: 2826934 - RNA, 18 nt, Human
agauagagaguuguugug

SEQ ID NO: 2826935 - RNA, 22 nt, Human
agauagagaguuguuguguaca

SEQ ID NO: 2826936 - RNA, 20 nt, Human
agauauaacuauugcccagg

SEQ ID NO: 2826937 - RNA, 15 nt, Human
agauagggcugggca

SEQ ID NO: 2826938 - RNA, 18 nt, Human
agauagggcugggcaagg

SEQ ID NO: 2826939 - RNA, 12 nt, Human
agauaggaccuu

SEQ ID NO: 2826940 - RNA, 14 nt, Human
agauaggaccuugg

SEQ ID NO: 2826941 - RNA, 16 nt, Human
agauaggaccuugggc

SEQ ID NO: 2826942 - RNA, 17 nt, Human
agauaggaccuugggcc

SEQ ID NO: 2826943 - RNA, 18 nt, Human
agauaggaccuugggcca

SEQ ID NO: 2826944 - RNA, 14 nt, Human
agauagccuguggc

SEQ ID NO: 2826945 - RNA, 15 nt, Human
agauagccuguggcc

SEQ ID NO: 2826946 - RNA, 17 nt, Human
agauagccuguggcccu

SEQ ID NO: 2826947 - RNA, 18 nt, Human
agauagccuguggcccug

SEQ ID NO: 2826948 - RNA, 13 nt, Human
agauagcugcaug

SEQ ID NO: 2826949 - RNA, 14 nt, Human
agauagcugcaugu

SEQ ID NO: 2826950 - RNA, 21 nt, Human
agauagcugcauguggcuuuu

SEQ ID NO: 2826951 - RNA, 22 nt, Human
agaguguagaagcauuccuucu

SEQ ID NO: 2826952 - RNA, 20 nt, Human
agaguguaguuuacagaaaa

SEQ ID NO: 2826953 - RNA, 15 nt, Human
agagugucaaccaga

SEQ ID NO: 2826954 - RNA, 17 nt, Human
agagugucaaccagaca

SEQ ID NO: 2826955 - RNA, 18 nt, Human
agagugucaaccagacag

SEQ ID NO: 2826956 - RNA, 19 nt, Human
agagugucaaccagacaga

SEQ ID NO: 2826957 - RNA, 20 nt, Human
agagugucaaccagacagag

SEQ ID NO: 2826958 - RNA, 21 nt, Human
agagugucaaccagacagagg

SEQ ID NO: 2826959 - RNA, 22 nt, Human
agagugucaaccagacagaggg

SEQ ID NO: 2826960 - RNA, 21 nt, Human
agagugucucagggugcagag

SEQ ID NO: 2826961 - RNA, 15 nt, Human
agaguguagaagcau

SEQ ID NO: 2826962 - RNA, 16 nt, Human
agaguguagaagcauu

SEQ ID NO: 2826963 - RNA, 17 nt, Human
agaguguagaagcauuc

SEQ ID NO: 2826964 - RNA, 18 nt, Human
agaguguagaagcauucc

SEQ ID NO: 2826965 - RNA, 12 nt, Human
agaguguagaag

SEQ ID NO: 2826966 - RNA, 13 nt, Human
agaguguagaagc

SEQ ID NO: 2826967 - RNA, 14 nt, Human
agaguguagaagca

SEQ ID NO: 2826968 - RNA, 16 nt, Human
agauagaauuuccaau

SEQ ID NO: 2826969 - RNA, 13 nt, Human
agauagaauuucc

SEQ ID NO: 2826970 - RNA, 19 nt, Human
agaguugaggaacuguaca

SEQ ID NO: 2826971 - RNA, 20 nt, Human
agagggucugaggaauccag

SEQ ID NO: 2826972 - RNA, 15 nt, Human
agagggucacagugu

SEQ ID NO: 2826973 - RNA, 16 nt, Human
agaguggccuggccag

SEQ ID NO: 2826974 - RNA, 15 nt, Human
agaguggccuggcca

SEQ ID NO: 2826975 - RNA, 14 nt, Human
agaguggccuggcc

SEQ ID NO: 2826976 - RNA, 13 nt, Human
agaguggccuggc

SEQ ID NO: 2826977 - RNA, 12 nt, Human
agaguggccugg

SEQ ID NO: 2826978 - RNA, 22 nt, Human
agaguggccuggccaggagcuc

SEQ ID NO: 2826979 - RNA, 19 nt, Human
agaguggccuggccaggag

SEQ ID NO: 2826980 - RNA, 17 nt, Human
agaguggccuggccagg

SEQ ID NO: 2826981 - RNA, 12 nt, Human
agaguggcuccu

SEQ ID NO: 2826982 - RNA, 13 nt, Human
agaguggcuccuc

SEQ ID NO: 2826983 - RNA, 14 nt, Human
agaguggcuccucc

SEQ ID NO: 2826984 - RNA, 14 nt, Human
agauagauuuggaa

SEQ ID NO: 2826985 - RNA, 14 nt, Human
agauaugaauauau

SEQ ID NO: 2826986 - RNA, 13 nt, Human
agauaucuuuucu

SEQ ID NO: 2826987 - RNA, 14 nt, Human
agauaucuuuucuu

SEQ ID NO: 2826988 - RNA, 17 nt, Human
agauaucuuuucuuuag

SEQ ID NO: 2826989 - RNA, 18 nt, Human
agauaucuuuucuuuaga

SEQ ID NO: 2826990 - RNA, 23 nt, Human
agauaucuuuucuuuagagaacu

SEQ ID NO: 2826991 - RNA, 13 nt, Human
agauauauaucau

SEQ ID NO: 2826992 - RNA, 15 nt, Human
agauauacuuugugg

SEQ ID NO: 2826993 - RNA, 17 nt, Human
agauauacuuuguggac

SEQ ID NO: 2826994 - RNA, 23 nt, Human
agauauacuuuguggaccaauua

SEQ ID NO: 2826995 - RNA, 15 nt, Human
agcacuaggcaccca

SEQ ID NO: 2826996 - RNA, 23 nt, Human
agcacuagguucaauucccugaa

SEQ ID NO: 2826997 - RNA, 18 nt, Human
agcacucacgcccuaagc

SEQ ID NO: 2826998 - RNA, 15 nt, Human
agcacucaggcucuc

SEQ ID NO: 2826999 - RNA, 17 nt, Human
agcacucaggcucucca

SEQ ID NO: 2827000 - RNA, 18 nt, Human
agcacucaggcucuccau

SEQ ID NO: 2827001 - RNA, 19 nt, Human
agcacucaggcucuccauu

SEQ ID NO: 2827002 - RNA, 18 nt, Human
agcacucauuuucuauaa

SEQ ID NO: 2827003 - RNA, 17 nt, Human
agcagcuaaauuuucug

SEQ ID NO: 2827004 - RNA, 18 nt, Human
agcagcuaaauuuucuga

SEQ ID NO: 2827005 - RNA, 20 nt, Human
agcagcuagaaaacauuuuu

SEQ ID NO: 2827006 - RNA, 14 nt, Human
agcagccuguggca

SEQ ID NO: 2827007 - RNA, 13 nt, Human
agcagccuguggc

SEQ ID NO: 2827008 - RNA, 23 nt, Human
agcagccugagcaacucuugauu

SEQ ID NO: 2827009 - RNA, 16 nt, Human
agcagccugcuuccca

SEQ ID NO: 2827010 - RNA, 22 nt, Human
agcagccugcuucccaccuccc

SEQ ID NO: 2827011 - RNA, 13 nt, Human
agcagugcaggca

SEQ ID NO: 2827012 - RNA, 15 nt, Human
agcagugcaggcaca

SEQ ID NO: 2827013 - RNA, 14 nt, Human
agcaauuuucgaac

SEQ ID NO: 2827014 - RNA, 12 nt, Human
agcacaaacaca

SEQ ID NO: 2827015 - RNA, 13 nt, Human
agcacaaacacaa

SEQ ID NO: 2827016 - RNA, 14 nt, Human
agcacaaacacaag

SEQ ID NO: 2827017 - RNA, 22 nt, Human
agcaauuucgccguugaagagg

SEQ ID NO: 2827018 - RNA, 21 nt, Human
agcaauuucgccguugaagag

SEQ ID NO: 2827019 - RNA, 24 nt, Human
agcaauuuaauauuuugcacaguu

SEQ ID NO: 2827020 - RNA, 21 nt, Human
agcaauuucuugcucuaucuc

SEQ ID NO: 2827021 - RNA, 20 nt, Human
agcacuaaggugugcucuga

SEQ ID NO: 2827022 - RNA, 15 nt, Human
agcacagauuuuaau

SEQ ID NO: 2827023 - RNA, 16 nt, Human
agcacagauuuuaauu

SEQ ID NO: 2827024 - RNA, 17 nt, Human
agcacagauuuuaauug

SEQ ID NO: 2827025 - RNA, 21 nt, Human
agcacagauuuuaauugucau

SEQ ID NO: 2827026 - RNA, 14 nt, Human
agcacuacugggug

SEQ ID NO: 2827027 - RNA, 15 nt, Human
agcacuacugggugu

SEQ ID NO: 2827028 - RNA, 16 nt, Human
agcacuacuggguguc

SEQ ID NO: 2827029 - RNA, 17 nt, Human
agcacuacuggguguca

SEQ ID NO: 2827030 - RNA, 18 nt, Human
agcacuacugggugucau

SEQ ID NO: 2827031 - RNA, 19 nt, Human
agcacuacugggugucauu

SEQ ID NO: 2827032 - RNA, 20 nt, Human
agcacuacugggugucauuu

SEQ ID NO: 2827033 - RNA, 22 nt, Human
agcacuacugggugucauuuca

SEQ ID NO: 2827034 - RNA, 23 nt, Human
agcacuacugggugucauuucau

SEQ ID NO: 2827035 - RNA, 13 nt, Human
agcacuagagaau

SEQ ID NO: 2827036 - RNA, 15 nt, Human
agcacuagagaaugc

SEQ ID NO: 2827037 - RNA, 16 nt, Human
agcacuagagaaugca

SEQ ID NO: 2827038 - RNA, 17 nt, Human
agcacuagagaaugcac

SEQ ID NO: 2827039 - RNA, 20 nt, Human
agcacuagagaaugcacaga

SEQ ID NO: 2827040 - RNA, 17 nt, Human
agcacagauaaaaagug

SEQ ID NO: 2827041 - RNA, 19 nt, Human
agcacagauaaaaagugga

SEQ ID NO: 2827042 - RNA, 20 nt, Human
agcacagauaaaaaguggaa

SEQ ID NO: 2827043 - RNA, 21 nt, Human
agcacagauaaaaaguggaau

SEQ ID NO: 2827044 - RNA, 23 nt, Human
agcaauuuaauauuuugcacagu

SEQ ID NO: 2827045 - RNA, 20 nt, Human
agcaauuuauacaauaucau

SEQ ID NO: 2827046 - RNA, 19 nt, Human
agcaauuuaaauguuauga

SEQ ID NO: 2827047 - RNA, 17 nt, Human
agcaauuuaacuagaca

SEQ ID NO: 2827048 - RNA, 19 nt, Human
agcaauuuaacuagacaca

SEQ ID NO: 2827049 - RNA, 22 nt, Human
agcaauuuaacuagacacagau

SEQ ID NO: 2827050 - RNA, 13 nt, Human
agcaauuuaaaug

SEQ ID NO: 2827051 - RNA, 17 nt, Human
agcaauuuaaauguuau

SEQ ID NO: 2827052 - RNA, 16 nt, Human
agcaauuuaaauguua

SEQ ID NO: 2827053 - RNA, 20 nt, Human
agcaauucuccugccucagc

SEQ ID NO: 2827054 - RNA, 19 nt, Human
agcaauucuccugccucag

SEQ ID NO: 2827055 - RNA, 18 nt, Human
agcaauucuccugccuca

SEQ ID NO: 2827056 - RNA, 17 nt, Human
agcaauucuccugccuc

SEQ ID NO: 2827057 - RNA, 15 nt, Human
agcaauucuccugcc

SEQ ID NO: 2827058 - RNA, 23 nt, Human
agccaaggugggcugagcccugg

SEQ ID NO: 2827059 - RNA, 18 nt, Human
agccaaggugucauuuau

SEQ ID NO: 2827060 - RNA, 22 nt, Human
agccaaggugggcugagcccug

SEQ ID NO: 2827061 - RNA, 17 nt, Human
agccauuuugugaaugg

SEQ ID NO: 2827062 - RNA, 19 nt, Human
agccauuuugugaauggau

SEQ ID NO: 2827063 - RNA, 14 nt, Human
agccauuuugugaa

SEQ ID NO: 2827064 - RNA, 15 nt, Human
agccauuuugugaau

SEQ ID NO: 2827065 - RNA, 16 nt, Human
agccauuuugugaaug

SEQ ID NO: 2827066 - RNA, 13 nt, Human
agcccaccuuggc

SEQ ID NO: 2827067 - RNA, 14 nt, Human
agcccacccugcug

SEQ ID NO: 2827068 - RNA, 16 nt, Human
agcccacccugcugcc

SEQ ID NO: 2827069 - RNA, 13 nt, Human
agcccacccugcu

SEQ ID NO: 2827070 - RNA, 22 nt, Human
agcaucucuugaggccaggagu

SEQ ID NO: 2827071 - RNA, 17 nt, Human
agcaucugcauugccca

SEQ ID NO: 2827072 - RNA, 19 nt, Human
agcaucugcauugcccagu

SEQ ID NO: 2827073 - RNA, 24 nt, Human
agcaucugcauugcccagucuuuc

SEQ ID NO: 2827074 - RNA, 19 nt, Human
agcaucucuugaggccagg

SEQ ID NO: 2827075 - RNA, 17 nt, Human
agcaucucuugaggcca

SEQ ID NO: 2827076 - RNA, 21 nt, Human
agccaacgacaaagccaaacu

SEQ ID NO: 2827077 - RNA, 12 nt, Human
agcaucuguaca

SEQ ID NO: 2827078 - RNA, 13 nt, Human
agcaucuguacaa

SEQ ID NO: 2827079 - RNA, 17 nt, Human
agcaucuguacaaaggg

SEQ ID NO: 2827080 - RNA, 15 nt, Human
agccaacuuuugcau

SEQ ID NO: 2827081 - RNA, 16 nt, Human
agccaagaaagaugua

SEQ ID NO: 2827082 - RNA, 17 nt, Human
agccaagaaagauguau

SEQ ID NO: 2827083 - RNA, 20 nt, Human
agccaaggugggcugagccc

SEQ ID NO: 2827084 - RNA, 19 nt, Human
agccaaggugggcugagcc

SEQ ID NO: 2827085 - RNA, 14 nt, Human
agcaucucaugagu

SEQ ID NO: 2827086 - RNA, 20 nt, Human
agcaucucagccuaccauga

SEQ ID NO: 2827087 - RNA, 12 nt, Human
agcaucuaaguu

SEQ ID NO: 2827088 - RNA, 20 nt, Human
agcaucuaaguuauaagacu

SEQ ID NO: 2827089 - RNA, 22 nt, Human
agcaucuaaguuauaagacucu

SEQ ID NO: 2827090 - RNA, 23 nt, Human
agcaucuaaguuauaagacucuc

SEQ ID NO: 2827091 - RNA, 21 nt, Human
auuuuaagacguguuuguguu

SEQ ID NO: 2827092 - RNA, 20 nt, Human
auuuuaagacguguuugugu

SEQ ID NO: 2827093 - RNA, 14 nt, Human
auuuuaagcauugu

SEQ ID NO: 2827094 - RNA, 15 nt, Human
auuuuaagcauugug

SEQ ID NO: 2827095 - RNA, 17 nt, Human
auuuuaagcauugugag

SEQ ID NO: 2827096 - RNA, 19 nt, Human
auuuuaagcauugugagua

SEQ ID NO: 2827097 - RNA, 14 nt, Human
auuuuaagcacucu

SEQ ID NO: 2827098 - RNA, 21 nt, Human
auuuuaagcacucuuaaagca

SEQ ID NO: 2827099 - RNA, 22 nt, Human
auuuuaagcacucuuaaagcaa

SEQ ID NO: 2827100 - RNA, 21 nt, Human
auuuguacauauguaaaauaa

SEQ ID NO: 2827101 - RNA, 19 nt, Human
auuuguacauauguaaaau

SEQ ID NO: 2827102 - RNA, 18 nt, Human
auuuguacauauguaaaa

SEQ ID NO: 2827103 - RNA, 16 nt, Human
auuuguacauauguaa

SEQ ID NO: 2827104 - RNA, 19 nt, Human
auuuuaaaucuaaaucuau

SEQ ID NO: 2827105 - RNA, 21 nt, Human
auuuuaaaucuaaaucuauuu

SEQ ID NO: 2827106 - RNA, 16 nt, Human
auuuuaaauaaaagaa

SEQ ID NO: 2827107 - RNA, 15 nt, Human
auuuuaaauaaaaga

SEQ ID NO: 2827108 - RNA, 14 nt, Human
auuuuaaauaaaag

SEQ ID NO: 2827109 - RNA, 13 nt, Human
caaagaaaugaac

SEQ ID NO: 2827110 - RNA, 14 nt, Human
caaagaaaugaaca

SEQ ID NO: 2827111 - RNA, 15 nt, Human
caaagaaaugaacau

SEQ ID NO: 2827112 - RNA, 16 nt, Human
caaagaaaugaacauu

SEQ ID NO: 2827113 - RNA, 17 nt, Human
caaagaaaugaacauuc

SEQ ID NO: 2827114 - RNA, 18 nt, Human
caaagaaaugaacauucc

SEQ ID NO: 2827115 - RNA, 19 nt, Human
caaagaaaugaacauucca

SEQ ID NO: 2827116 - RNA, 20 nt, Human
caaagaaaugaacauuccaa

SEQ ID NO: 2827117 - RNA, 22 nt, Human
caaacugcuggacgucuuucuu

SEQ ID NO: 2827118 - RNA, 12 nt, Human
caaacuggaguc

SEQ ID NO: 2827119 - RNA, 16 nt, Human
caaacuggagucugga

SEQ ID NO: 2827120 - RNA, 17 nt, Human
caaacuggagucuggag

SEQ ID NO: 2827121 - RNA, 20 nt, Human
caaacuggagucuggagugg

SEQ ID NO: 2827122 - RNA, 23 nt, Human
caaacuggagucuggagugggca

SEQ ID NO: 2827123 - RNA, 15 nt, Human
caaagaauaagaaaa

SEQ ID NO: 2827124 - RNA, 20 nt, Human
caaagaauguuagagcacag

SEQ ID NO: 2827125 - RNA, 22 nt, Human
caaagaauguuagagcacagua

SEQ ID NO: 2827126 - RNA, 19 nt, Human
caaagaaucccuagacuuu

SEQ ID NO: 2827127 - RNA, 20 nt, Human
caaagaaucccuagacuuua

SEQ ID NO: 2827128 - RNA, 23 nt, Human
caaagaaucccuagacuuuaggc

SEQ ID NO: 2827129 - RNA, 16 nt, Human
caaagagguauuuauc

SEQ ID NO: 2827130 - RNA, 14 nt, Human
caaagaguagaauu

SEQ ID NO: 2827131 - RNA, 13 nt, Human
caaagcccagcuu

SEQ ID NO: 2827132 - RNA, 21 nt, Human
caaaguucuaauaauuucuaa

SEQ ID NO: 2827133 - RNA, 22 nt, Human
caaaguucuaauaauuucuaau

SEQ ID NO: 2827134 - RNA, 15 nt, Human
caaaguucuguguuu

SEQ ID NO: 2827135 - RNA, 17 nt, Human
caaaguucuguguuuaa

SEQ ID NO: 2827136 - RNA, 20 nt, Human
caaaguucuguguuuaauuu

SEQ ID NO: 2827137 - RNA, 22 nt, Human
caaaguucuguguuuaauuucu

SEQ ID NO: 2827138 - RNA, 21 nt, Human
caaaguucccuacuuccugug

SEQ ID NO: 2827139 - RNA, 22 nt, Human
caaaguucccuacuuccuguga

SEQ ID NO: 2827140 - RNA, 22 nt, Human
caaagugguagguacuuuuugu

SEQ ID NO: 2827141 - RNA, 20 nt, Human
caaaguucuaauaauuucua

SEQ ID NO: 2827142 - RNA, 18 nt, Human
caaauauuguugacaacu

SEQ ID NO: 2827143 - RNA, 23 nt, Human
caaaguucuaauaauuucuaaug

SEQ ID NO: 2827144 - RNA, 13 nt, Human
caaauauucagaa

SEQ ID NO: 2827145 - RNA, 15 nt, Human
caaauauucagaaua

SEQ ID NO: 2827146 - RNA, 22 nt, Human
caaauauuguugacaacuguga

SEQ ID NO: 2827147 - RNA, 23 nt, Human
caaauauuguugacaacugugac

SEQ ID NO: 2827148 - RNA, 14 nt, Human
caaauauuuauuuu

SEQ ID NO: 2827149 - RNA, 12 nt, Human
caaauauuuauu

SEQ ID NO: 2827150 - RNA, 16 nt, Human
caaauauuuauuuucu

SEQ ID NO: 2827151 - RNA, 15 nt, Human
caaauauuuauuuuc

SEQ ID NO: 2827152 - RNA, 14 nt, Human
caaauuaaaaagau

SEQ ID NO: 2827153 - RNA, 15 nt, Human
caaauuaaaaagauu

SEQ ID NO: 2827154 - RNA, 18 nt, Human
caaauuaaaaagauucuu

SEQ ID NO: 2827155 - RNA, 19 nt, Human
caaauuaaaaagauucuuu

SEQ ID NO: 2827156 - RNA, 21 nt, Human
caaauuaaaaagauucuuuuu

SEQ ID NO: 2827157 - RNA, 22 nt, Human
caaauuaaaaagauucuuuuuc

SEQ ID NO: 2827158 - RNA, 23 nt, Human
caaauuaaaaagauucuuuuucu

SEQ ID NO: 2827159 - RNA, 22 nt, Human
caaauugcacagaaguccugua

SEQ ID NO: 2827160 - RNA, 14 nt, Human
caaauugagacagu

SEQ ID NO: 2827161 - RNA, 23 nt, Human
caaauugagacagugcacaugaa

SEQ ID NO: 2827162 - RNA, 14 nt, Human
caaauucuuuugaa

SEQ ID NO: 2827163 - RNA, 16 nt, Human
caaauucuuuugaauu

SEQ ID NO: 2827164 - RNA, 17 nt, Human
caaauucuuuugaauug

SEQ ID NO: 2827165 - RNA, 18 nt, Human
caaauucuuuugaauugu

SEQ ID NO: 2827166 - RNA, 21 nt, Human
caaauucuuuugaauuguuac

SEQ ID NO: 2827167 - RNA, 23 nt, Human
caaauucuuuugaauuguuacau

SEQ ID NO: 2827168 - RNA, 19 nt, Human
caaauuggacuuucaaaau

SEQ ID NO: 2827169 - RNA, 21 nt, Human
caaauuggacuuucaaaauua

SEQ ID NO: 2827170 - RNA, 22 nt, Human
caaauugcuccuaagcuucaaa

SEQ ID NO: 2827171 - RNA, 23 nt, Human
caaagccccuugcucuccccugc

SEQ ID NO: 2827172 - RNA, 17 nt, Human
caaaggacauuaugugu

SEQ ID NO: 2827173 - RNA, 18 nt, Human
caaaggacauuaugugug

SEQ ID NO: 2827174 - RNA, 19 nt, Human
caaaggacauuaugugugc

SEQ ID NO: 2827175 - RNA, 20 nt, Human
caaaggacauuaugugugca

SEQ ID NO: 2827176 - RNA, 22 nt, Human
caaagggagcacuggguugacu

SEQ ID NO: 2827177 - RNA, 18 nt, Human
caaagggaaauaucauuu

SEQ ID NO: 2827178 - RNA, 15 nt, Human
caaagggaaauauca

SEQ ID NO: 2827179 - RNA, 17 nt, Human
caaagggaaauaucauu

SEQ ID NO: 2827180 - RNA, 13 nt, Human
caaaggcugggac

SEQ ID NO: 2827181 - RNA, 15 nt, Human
caaaggcugguggca

SEQ ID NO: 2827182 - RNA, 23 nt, Human
caaaggguaucaggugcugccau

SEQ ID NO: 2827183 - RNA, 21 nt, Human
caaaggguaucaggugcugcc

SEQ ID NO: 2827184 - RNA, 20 nt, Human
caaaggguaucaggugcugc

SEQ ID NO: 2827185 - RNA, 12 nt, Human
caaagggcccag

SEQ ID NO: 2827186 - RNA, 14 nt, Human
caaagggcccagau

SEQ ID NO: 2827187 - RNA, 20 nt, Human
caaagggcacagcaucugua

SEQ ID NO: 2827188 - RNA, 21 nt, Human
caaagggcacagcaucuguag

SEQ ID NO: 2827189 - RNA, 23 nt, Human
caaagggcacagcaucuguaguc

SEQ ID NO: 2827190 - RNA, 17 nt, Human
caaaggggaaagaacau

SEQ ID NO: 2827191 - RNA, 21 nt, Human
caaaggggaaagaacauaaag

SEQ ID NO: 2827192 - RNA, 15 nt, Human
caaaggggacaggcc

SEQ ID NO: 2827193 - RNA, 18 nt, Human
caaaggggacaggccuca

SEQ ID NO: 2827194 - RNA, 19 nt, Human
caaaggggacaggccucac

SEQ ID NO: 2827195 - RNA, 21 nt, Human
caaaggggacaggccucaccu

SEQ ID NO: 2827196 - RNA, 19 nt, Human
caaaggggaucauaaaguu

SEQ ID NO: 2827197 - RNA, 20 nt, Human
caaaggggaucauaaaguua

SEQ ID NO: 2827198 - RNA, 20 nt, Human
caacaggcugggcuucagug

SEQ ID NO: 2827199 - RNA, 15 nt, Human
caagaccuaggcuca

SEQ ID NO: 2827200 - RNA, 15 nt, Human
caagaaaucccuguu

SEQ ID NO: 2827201 - RNA, 14 nt, Human
caagaaaucccugu

SEQ ID NO: 2827202 - RNA, 14 nt, Human
caacuucuucagag

SEQ ID NO: 2827203 - RNA, 12 nt, Human
caacugugacug

SEQ ID NO: 2827204 - RNA, 13 nt, Human
caacuguggcugg

SEQ ID NO: 2827205 - RNA, 14 nt, Human
caacuguguagcau

SEQ ID NO: 2827206 - RNA, 15 nt, Human
caacuucucuugcuu

SEQ ID NO: 2827207 - RNA, 19 nt, Human
caacuucucuugcuuucua

SEQ ID NO: 2827208 - RNA, 20 nt, Human
caacuucuuuuuauuuucuu

SEQ ID NO: 2827209 - RNA, 23 nt, Human
caacuugaaauuauaucuguggu

SEQ ID NO: 2827210 - RNA, 24 nt, Human
caacuugaaauuauaucugugguc

SEQ ID NO: 2827211 - RNA, 19 nt, Human
caacuugaacuucaccugc

SEQ ID NO: 2827212 - RNA, 20 nt, Human
caacuugaacuucaccugca

SEQ ID NO: 2827213 - RNA, 9 nt, Human
caacuugag

SEQ ID NO: 2827214 - RNA, 16 nt, Human
caacuugagauguaug

SEQ ID NO: 2827215 - RNA, 21 nt, Human
caacuugagauguaugaaggc

SEQ ID NO: 2827216 - RNA, 22 nt, Human
caacuugagauguaugaaggcu

SEQ ID NO: 2827217 - RNA, 13 nt, Human
caacuugagggcc

SEQ ID NO: 2827218 - RNA, 18 nt, Human
caacuucuucagagcuga

SEQ ID NO: 2827219 - RNA, 16 nt, Human
caacuugagggcccag

SEQ ID NO: 2827220 - RNA, 19 nt, Human
caacuugagggcccagagc

SEQ ID NO: 2827221 - RNA, 20 nt, Human
caacuugagggcccagagca

SEQ ID NO: 2827222 - RNA, 21 nt, Human
caacuugagggcccagagcag

SEQ ID NO: 2827223 - RNA, 22 nt, Human
caacuugagggcccagagcagg

SEQ ID NO: 2827224 - RNA, 22 nt, Human
caacuugcauccaacuccagga

SEQ ID NO: 2827225 - RNA, 17 nt, Human
caagagggucugaggaa

SEQ ID NO: 2827226 - RNA, 16 nt, Human
caagagggucugagga

SEQ ID NO: 2827227 - RNA, 12 nt, Human
caagagggucug

SEQ ID NO: 2827228 - RNA, 20 nt, Human
caagcagagguggccagagc

SEQ ID NO: 2827229 - RNA, 18 nt, Human
caagcagagugcacagcu

SEQ ID NO: 2827230 - RNA, 19 nt, Human
caagcagagugcacagcug

SEQ ID NO: 2827231 - RNA, 20 nt, Human
caagcagagugcacagcugu

SEQ ID NO: 2827232 - RNA, 21 nt, Human
caagcagagugcacagcuguc

SEQ ID NO: 2827233 - RNA, 16 nt, Human
caagcagauacugcug

SEQ ID NO: 2827234 - RNA, 17 nt, Human
caagcagauacugcugu

SEQ ID NO: 2827235 - RNA, 19 nt, Human
caagcagauacugcugugu

SEQ ID NO: 2827236 - RNA, 23 nt, Human
caagcagauacugcuguguaaug

SEQ ID NO: 2827237 - RNA, 15 nt, Human
caagagguacagggu

SEQ ID NO: 2827238 - RNA, 21 nt, Human
caagagguacaggguuuuuac

SEQ ID NO: 2827239 - RNA, 15 nt, Human
caagaggugggaggg

SEQ ID NO: 2827240 - RNA, 16 nt, Human
caagaggugggagggc

SEQ ID NO: 2827241 - RNA, 22 nt, Human
caagaggguccuuuaguaccug

SEQ ID NO: 2827242 - RNA, 21 nt, Human
caagcagccugagcaacucuu

SEQ ID NO: 2827243 - RNA, 22 nt, Human
caagcagcgaccgcccccuccu

SEQ ID NO: 2827244 - RNA, 17 nt, Human
caagcagcaucuucugg

SEQ ID NO: 2827245 - RNA, 17 nt, Human
caagcagagguggccag

SEQ ID NO: 2827246 - RNA, 18 nt, Human
caagcagagguggccaga

SEQ ID NO: 2827247 - RNA, 12 nt, Human
caagcagccaag

SEQ ID NO: 2827248 - RNA, 18 nt, Human
caagagaaaggccugcac

SEQ ID NO: 2827249 - RNA, 20 nt, Human
caagagaaaggccugcacac

SEQ ID NO: 2827250 - RNA, 21 nt, Human
caagagaaaggccugcacaca

SEQ ID NO: 2827251 - RNA, 22 nt, Human
caagagaaaggccugcacacaa

SEQ ID NO: 2827252 - RNA, 22 nt, Human
caagacuggaagguggggacag

SEQ ID NO: 2827253 - RNA, 20 nt, Human
caagacuuggcaacagaagc

SEQ ID NO: 2827254 - RNA, 15 nt, Human
caagacuuggcaaca

SEQ ID NO: 2827255 - RNA, 17 nt, Human
caagagcccccuugaca

SEQ ID NO: 2827256 - RNA, 22 nt, Human
caagagcccccuugacaccggg

SEQ ID NO: 2827257 - RNA, 12 nt, Human
caagagccugau

SEQ ID NO: 2827258 - RNA, 14 nt, Human
caagagccugaucu

SEQ ID NO: 2827259 - RNA, 16 nt, Human
caagagccugaucucu

SEQ ID NO: 2827260 - RNA, 19 nt, Human
caagagccugaucucuucc

SEQ ID NO: 2827261 - RNA, 20 nt, Human
caagagccugaucucuuccu

SEQ ID NO: 2827262 - RNA, 21 nt, Human
caagagccugaucucuuccug

SEQ ID NO: 2827263 - RNA, 22 nt, Human
caagagccugaucucuuccugu

SEQ ID NO: 2827264 - RNA, 23 nt, Human
caagagccugaucucuuccuguu

SEQ ID NO: 2827265 - RNA, 17 nt, Human
caagagggcacuggugg

SEQ ID NO: 2827266 - RNA, 18 nt, Human
caagagggcacugguggc

SEQ ID NO: 2827267 - RNA, 19 nt, Human
caagagggcacugguggcc

SEQ ID NO: 2827268 - RNA, 20 nt, Human
caagagggcacugguggccc

SEQ ID NO: 2827269 - RNA, 20 nt, Human
caagcaugcuugugaaaaug

SEQ ID NO: 2827270 - RNA, 15 nt, Human
caagcaucaggggga

SEQ ID NO: 2827271 - RNA, 22 nt, Human
caagcaucagggggaagaagca

SEQ ID NO: 2827272 - RNA, 17 nt, Human
caagccaagaaagaugu

SEQ ID NO: 2827273 - RNA, 19 nt, Human
caagccaacgacaaagcca

SEQ ID NO: 2827274 - RNA, 18 nt, Human
caagccaacgacaaagcc

SEQ ID NO: 2827275 - RNA, 23 nt, Human
caagcauugcuucagaaugaauu

SEQ ID NO: 2827276 - RNA, 14 nt, Human
caagccagcuggag

SEQ ID NO: 2827277 - RNA, 23 nt, Human
caagccaaaguggcauguuuugu

SEQ ID NO: 2827278 - RNA, 17 nt, Human
caagccauguauaaaug

SEQ ID NO: 2827279 - RNA, 19 nt, Human
caagccauguauaaaugug

SEQ ID NO: 2827280 - RNA, 21 nt, Human
caagccauguauaaaugugau

SEQ ID NO: 2827281 - RNA, 22 nt, Human
caagcccacagcacagcucccu

SEQ ID NO: 2827282 - RNA, 14 nt, Human
caagcccccccuuc

SEQ ID NO: 2827283 - RNA, 16 nt, Human
caagcccccccuucca

SEQ ID NO: 2827284 - RNA, 15 nt, Human
caagcccaggccacc

SEQ ID NO: 2827285 - RNA, 14 nt, Human
caagcccaggugcc

SEQ ID NO: 2827286 - RNA, 21 nt, Human
caagcccaggugccagccuga

SEQ ID NO: 2827287 - RNA, 22 nt, Human
caagcccaggugccagccugag

SEQ ID NO: 2827288 - RNA, 21 nt, Human
caaggacuaggguccugggga

SEQ ID NO: 2827289 - RNA, 20 nt, Human
caaggacuaggguccugggg

SEQ ID NO: 2827290 - RNA, 19 nt, Human
caaggacuaggguccuggg

SEQ ID NO: 2827291 - RNA, 18 nt, Human
caaggacuaggguccugg

SEQ ID NO: 2827292 - RNA, 14 nt, Human
caaggacuaggguc

SEQ ID NO: 2827293 - RNA, 16 nt, Human
caaggacuaggguccu

SEQ ID NO: 2827294 - RNA, 14 nt, Human
caagcuguuuucuu

SEQ ID NO: 2827295 - RNA, 20 nt, Human
caagcuuguuaucagcuuuc

SEQ ID NO: 2827296 - RNA, 16 nt, Human
caagcuguuuucuucu

SEQ ID NO: 2827297 - RNA, 14 nt, Human
caaggacugaggga

SEQ ID NO: 2827298 - RNA, 15 nt, Human
caaggacugagggac

SEQ ID NO: 2827299 - RNA, 23 nt, Human
caagggaauuucuucaacucccu

SEQ ID NO: 2827300 - RNA, 17 nt, Human
caaggucauggccacac

SEQ ID NO: 2827301 - RNA, 19 nt, Human
caaggucauggccacacug

SEQ ID NO: 2827302 - RNA, 20 nt, Human
caaggucauggccacacugu

SEQ ID NO: 2827303 - RNA, 22 nt, Human
caaggucauggccacacuguga

SEQ ID NO: 2827304 - RNA, 23 nt, Human
caaggucauggccacacugugac

SEQ ID NO: 2827305 - RNA, 15 nt, Human
caaggucauuucuuc

SEQ ID NO: 2827306 - RNA, 17 nt, Human
caaggggccauuuggca

SEQ ID NO: 2827307 - RNA, 23 nt, Human
caaggggaauguuugccucugcc

SEQ ID NO: 2827308 - RNA, 19 nt, Human
caaggggagucaccuuccc

SEQ ID NO: 2827309 - RNA, 20 nt, Human
caaggggagucaccuucccu

SEQ ID NO: 2827310 - RNA, 23 nt, Human
caaggggagucaccuucccuugc

SEQ ID NO: 2827311 - RNA, 21 nt, Human
caaggggaauguuugccucug

SEQ ID NO: 2827312 - RNA, 13 nt, Human
caagggauggugc

SEQ ID NO: 2827313 - RNA, 19 nt, Human
caagggcaaaaagucuaca

SEQ ID NO: 2827314 - RNA, 14 nt, Human
caagggcagaaagu

SEQ ID NO: 2827315 - RNA, 17 nt, Human
caagggcaugagcauug

SEQ ID NO: 2827316 - RNA, 19 nt, Human
caagggacaaggacacgcg

SEQ ID NO: 2827317 - RNA, 18 nt, Human
caagggagguaagggagg

SEQ ID NO: 2827318 - RNA, 20 nt, Human
caagugauucuccugccuca

SEQ ID NO: 2827319 - RNA, 19 nt, Human
caagugacuguaucugugu

SEQ ID NO: 2827320 - RNA, 18 nt, Human
caagugacuguaucugug

SEQ ID NO: 2827321 - RNA, 20 nt, Human
caagugccagucuugugucu

SEQ ID NO: 2827322 - RNA, 16 nt, Human
caagugccgcaaauug

SEQ ID NO: 2827323 - RNA, 17 nt, Human
caagugccgcaaauugu

SEQ ID NO: 2827324 - RNA, 18 nt, Human
caagugccgcaaauugua

SEQ ID NO: 2827325 - RNA, 21 nt, Human
caagugacuguaucuguguag

SEQ ID NO: 2827326 - RNA, 15 nt, Human
caagugccaaaugcu

SEQ ID NO: 2827327 - RNA, 16 nt, Human
caagugccaaaugcuc

SEQ ID NO: 2827328 - RNA, 18 nt, Human
caagugauucuccugccu

SEQ ID NO: 2827329 - RNA, 19 nt, Human
caagugauucuccugccuc

SEQ ID NO: 2827330 - RNA, 16 nt, Human
caagugacaucucuuu

SEQ ID NO: 2827331 - RNA, 15 nt, Human
caagugacaucucuu

SEQ ID NO: 2827332 - RNA, 20 nt, Human
caagugaaauaacaaaaugg

SEQ ID NO: 2827333 - RNA, 21 nt, Human
caagugaaauaacaaaaugga

SEQ ID NO: 2827334 - RNA, 22 nt, Human
caagugaaauaacaaaauggac

SEQ ID NO: 2827335 - RNA, 21 nt, Human
caagguuuaaagagucuagau

SEQ ID NO: 2827336 - RNA, 18 nt, Human
caagguuuaaagagucua

SEQ ID NO: 2827337 - RNA, 20 nt, Human
caagguuuaaagagucuaga

SEQ ID NO: 2827338 - RNA, 22 nt, Human
caagguuuaaagagucuagauu

SEQ ID NO: 2827339 - RNA, 16 nt, Human
caagguucccuugugg

SEQ ID NO: 2827340 - RNA, 13 nt, Human
caagguucuaacc

SEQ ID NO: 2827341 - RNA, 17 nt, Human
caagguuuaaagagucu

SEQ ID NO: 2827342 - RNA, 14 nt, Human
caagguuccacaga

SEQ ID NO: 2827343 - RNA, 15 nt, Human
caagguuccacagag

SEQ ID NO: 2827344 - RNA, 16 nt, Human
caagguuccacagagu

SEQ ID NO: 2827345 - RNA, 17 nt, Human
caagguuccacagagua

SEQ ID NO: 2827346 - RNA, 18 nt, Human
caagguuccacagaguaa

SEQ ID NO: 2827347 - RNA, 14 nt, Human
caacaggcugggcu

SEQ ID NO: 2827348 - RNA, 17 nt, Human
caacaggcugggcuuca

SEQ ID NO: 2827349 - RNA, 11 nt, Human
caacagugagu

SEQ ID NO: 2827350 - RNA, 12 nt, Human
caacagugaguc

SEQ ID NO: 2827351 - RNA, 21 nt, Human
caaauuuagaaacuaauugac

SEQ ID NO: 2827352 - RNA, 22 nt, Human
caaauuuagaaacuaauugacu

SEQ ID NO: 2827353 - RNA, 13 nt, Human
caacaggcugggc

SEQ ID NO: 2827354 - RNA, 14 nt, Human
caacaguuccuuca

SEQ ID NO: 2827355 - RNA, 16 nt, Human
caacauaacccacuug

SEQ ID NO: 2827356 - RNA, 17 nt, Human
caacauaacccacuugu

SEQ ID NO: 2827357 - RNA, 18 nt, Human
caacauaacccacuuguc

SEQ ID NO: 2827358 - RNA, 14 nt, Human
caaccuaaccugug

SEQ ID NO: 2827359 - RNA, 16 nt, Human
caaccuaaccuguguc

SEQ ID NO: 2827360 - RNA, 17 nt, Human
caaccuaaccugugucu

SEQ ID NO: 2827361 - RNA, 19 nt, Human
caaccuaaccugugucugc

SEQ ID NO: 2827362 - RNA, 16 nt, Human
caacauaaucuaguuu

SEQ ID NO: 2827363 - RNA, 14 nt, Human
caaccucauugaca

SEQ ID NO: 2827364 - RNA, 13 nt, Human
caacugggcccaa

SEQ ID NO: 2827365 - RNA, 19 nt, Human
caacuggacauugucugcg

SEQ ID NO: 2827366 - RNA, 19 nt, Human
caacugcaauaacuucuga

SEQ ID NO: 2827367 - RNA, 23 nt, Human
caacugcaauaacuucugaccuu

SEQ ID NO: 2827368 - RNA, 18 nt, Human
caacugucuuauuuaaug

SEQ ID NO: 2827369 - RNA, 16 nt, Human
caacuguguucauuag

SEQ ID NO: 2827370 - RNA, 12 nt, Human
caacuguguugu

SEQ ID NO: 2827371 - RNA, 14 nt, Human
caacuguguuguau

SEQ ID NO: 2827372 - RNA, 15 nt, Human
caacuguguuguauu

SEQ ID NO: 2827373 - RNA, 16 nt, Human
caacuguguuguauua

SEQ ID NO: 2827374 - RNA, 17 nt, Human
caacuguguuguauuaa

SEQ ID NO: 2827375 - RNA, 19 nt, Human
caacuguguuguauuaaca

SEQ ID NO: 2827376 - RNA, 21 nt, Human
caacuguguuguauuaacaaa

SEQ ID NO: 2827377 - RNA, 12 nt, Human
caacuguauaua

SEQ ID NO: 2827378 - RNA, 13 nt, Human
caacuguauauau

SEQ ID NO: 2827379 - RNA, 15 nt, Human
caacuguauauauuc

SEQ ID NO: 2827380 - RNA, 19 nt, Human
caacugcaaagaaaguggg

SEQ ID NO: 2827381 - RNA, 23 nt, Human
caacugcaaagaaagugggaggu

SEQ ID NO: 2827382 - RNA, 12 nt, Human
caacugcaacuc

SEQ ID NO: 2827383 - RNA, 11 nt, Human
caacugacaca

SEQ ID NO: 2827384 - RNA, 13 nt, Human
caacugacacagg

SEQ ID NO: 2827385 - RNA, 14 nt, Human
caacugacacagga

SEQ ID NO: 2827386 - RNA, 15 nt, Human
caacugacacaggaa

SEQ ID NO: 2827387 - RNA, 16 nt, Human
caacugacacaggaaa

SEQ ID NO: 2827388 - RNA, 13 nt, Human
caacugacacucc

SEQ ID NO: 2827389 - RNA, 14 nt, Human
caacugacacuccc

SEQ ID NO: 2827390 - RNA, 17 nt, Human
caacugacacucccacc

SEQ ID NO: 2827391 - RNA, 16 nt, Human
caaccucccaacccag

SEQ ID NO: 2827392 - RNA, 17 nt, Human
caaccucccaacccaga

SEQ ID NO: 2827393 - RNA, 13 nt, Human
caaccucccucuu

SEQ ID NO: 2827394 - RNA, 15 nt, Human
caaccucccucuugu

SEQ ID NO: 2827395 - RNA, 16 nt, Human
caaccucccucuuguu

SEQ ID NO: 2827396 - RNA, 17 nt, Human
caaccucccucuuguuu

SEQ ID NO: 2827397 - RNA, 18 nt, Human
caaccucccucuuguuuu

SEQ ID NO: 2827398 - RNA, 19 nt, Human
caaccucccucuuguuuug

SEQ ID NO: 2827399 - RNA, 20 nt, Human
caaccucccucuuguuuugu

SEQ ID NO: 2827400 - RNA, 12 nt, Human
caacucuugauu

SEQ ID NO: 2827401 - RNA, 18 nt, Human
caacucuugauuauccau

SEQ ID NO: 2827402 - RNA, 16 nt, Human
caacucuugauuaucc

SEQ ID NO: 2827403 - RNA, 20 nt, Human
cacaagaaauuugauuucua

SEQ ID NO: 2827404 - RNA, 12 nt, Human
cacaagaaauuu

SEQ ID NO: 2827405 - RNA, 14 nt, Human
cacaagaaauuuga

SEQ ID NO: 2827406 - RNA, 17 nt, Human
cacaagaaucacuugaa

SEQ ID NO: 2827407 - RNA, 18 nt, Human
cacaaggcuccaagaccu

SEQ ID NO: 2827408 - RNA, 16 nt, Human
cacaaggucauggcca

SEQ ID NO: 2827409 - RNA, 17 nt, Human
cacaaggucauggccac

SEQ ID NO: 2827410 - RNA, 18 nt, Human
cacaaggucauggccaca

SEQ ID NO: 2827411 - RNA, 19 nt, Human
cacaaggucauggccacac

SEQ ID NO: 2827412 - RNA, 20 nt, Human
cacaaggucauggccacacu

SEQ ID NO: 2827413 - RNA, 21 nt, Human
cacaaggucauggccacacug

SEQ ID NO: 2827414 - RNA, 22 nt, Human
cacaaggucauggccacacugu

SEQ ID NO: 2827415 - RNA, 23 nt, Human
cacaaggucauggccacacugug

SEQ ID NO: 2827416 - RNA, 16 nt, Human
cacaaguccugugaau

SEQ ID NO: 2827417 - RNA, 20 nt, Human
cacaaguccugugaauuucu

SEQ ID NO: 2827418 - RNA, 13 nt, Human
cacaagucuucca

SEQ ID NO: 2827419 - RNA, 14 nt, Human
cacaagucuuccag

SEQ ID NO: 2827420 - RNA, 14 nt, Human
cacaaguaagagac

SEQ ID NO: 2827421 - RNA, 22 nt, Human
cacaaguaagagacucagccug

SEQ ID NO: 2827422 - RNA, 23 nt, Human
cacaaguaagagacucagccugc

SEQ ID NO: 2827423 - RNA, 21 nt, Human
cacaaguccuggauguugugu

SEQ ID NO: 2827424 - RNA, 17 nt, Human
cacaaggugcaaaucaa

SEQ ID NO: 2827425 - RNA, 17 nt, Human
cacaagggaaggacaga

SEQ ID NO: 2827426 - RNA, 22 nt, Human
cacaagggaaggacagaaagga

SEQ ID NO: 2827427 - RNA, 12 nt, Human
cacaagggcucu

SEQ ID NO: 2827428 - RNA, 19 nt, Human
cacaagugccgcaaauugu

SEQ ID NO: 2827429 - RNA, 21 nt, Human
cacaagugccgcaaauuguac

SEQ ID NO: 2827430 - RNA, 19 nt, Human
cacaagugcucaucuguug

SEQ ID NO: 2827431 - RNA, 19 nt, Human
cacaaucucggcucacugc

SEQ ID NO: 2827432 - RNA, 17 nt, Human
cacaacuuaguguaaua

SEQ ID NO: 2827433 - RNA, 18 nt, Human
cacaacugacacaggaaa

SEQ ID NO: 2827434 - RNA, 19 nt, Human
cacaacugcaauaacuucu

SEQ ID NO: 2827435 - RNA, 20 nt, Human
cacaacugcaauaacuucug

SEQ ID NO: 2827436 - RNA, 21 nt, Human
cacaacugcaauaacuucuga

SEQ ID NO: 2827437 - RNA, 23 nt, Human
cacaacugcaauaacuucugacc

SEQ ID NO: 2827438 - RNA, 15 nt, Human
cacaacuuuuaacca

SEQ ID NO: 2827439 - RNA, 12 nt, Human
cacaaauaaaau

SEQ ID NO: 2827440 - RNA, 13 nt, Human
cacaaacuguaaa

SEQ ID NO: 2827441 - RNA, 23 nt, Human
cacaaauauuuauuuucuuucug

SEQ ID NO: 2827442 - RNA, 21 nt, Human
cacaaauauuuauuuucuuuc

SEQ ID NO: 2827443 - RNA, 13 nt, Human
cacaaauauuuau

SEQ ID NO: 2827444 - RNA, 11 nt, Human
caauuuuguaa

SEQ ID NO: 2827445 - RNA, 20 nt, Human
caauuuucuggaauacauga

SEQ ID NO: 2827446 - RNA, 12 nt, Human
caauuuucuugu

SEQ ID NO: 2827447 - RNA, 13 nt, Human
caauucaaaaguu

SEQ ID NO: 2827448 - RNA, 12 nt, Human
caauuuuguaac

SEQ ID NO: 2827449 - RNA, 14 nt, Human
caauuuuuaggaag

SEQ ID NO: 2827450 - RNA, 12 nt, Human
caauuuuuaaug

SEQ ID NO: 2827451 - RNA, 13 nt, Human
caauuuuuaaugg

SEQ ID NO: 2827452 - RNA, 22 nt, Human
caauuuuuaauggcagcagaaa

SEQ ID NO: 2827453 - RNA, 11 nt, Human
caauuuuucca

SEQ ID NO: 2827454 - RNA, 15 nt, Human
cacaaaccaugcaaa

SEQ ID NO: 2827455 - RNA, 12 nt, Human
cacaaacauuuu

SEQ ID NO: 2827456 - RNA, 13 nt, Human
cacaaacauuuuu

SEQ ID NO: 2827457 - RNA, 15 nt, Human
cacaaacauuuuuca

SEQ ID NO: 2827458 - RNA, 18 nt, Human
cacaaaccacaacugaca

SEQ ID NO: 2827459 - RNA, 19 nt, Human
cacaaaccacaacugacac

SEQ ID NO: 2827460 - RNA, 20 nt, Human
cacaaaccacaacugacaca

SEQ ID NO: 2827461 - RNA, 13 nt, Human
cacaaaccugccu

SEQ ID NO: 2827462 - RNA, 17 nt, Human
cacaaaccugccugggu

SEQ ID NO: 2827463 - RNA, 17 nt, Human
cacaaaccuucugccuu

SEQ ID NO: 2827464 - RNA, 12 nt, Human
cacaaacuguaa

SEQ ID NO: 2827465 - RNA, 15 nt, Human
cacaaaccugccugg

SEQ ID NO: 2827466 - RNA, 13 nt, Human
cacaaacucacca

SEQ ID NO: 2827467 - RNA, 13 nt, Human
caaugcacaucca

SEQ ID NO: 2827468 - RNA, 14 nt, Human
caaugcacauccau

SEQ ID NO: 2827469 - RNA, 18 nt, Human
caaugcacauccauuccc

SEQ ID NO: 2827470 - RNA, 16 nt, Human
caaugcacauggugca

SEQ ID NO: 2827471 - RNA, 15 nt, Human
caaugguguuuuucu

SEQ ID NO: 2827472 - RNA, 19 nt, Human
caaugguguuuuucuugua

SEQ ID NO: 2827473 - RNA, 22 nt, Human
caaugguguuuuucuuguaaau

SEQ ID NO: 2827474 - RNA, 23 nt, Human
caaugguguuuuucuuguaaaug

SEQ ID NO: 2827475 - RNA, 16 nt, Human
caauuagggccuagcc

SEQ ID NO: 2827476 - RNA, 17 nt, Human
caauuagguuuuuccuu

SEQ ID NO: 2827477 - RNA, 16 nt, Human
caaugguuuuuaaauu

SEQ ID NO: 2827478 - RNA, 17 nt, Human
caaugguuuuuaaauuu

SEQ ID NO: 2827479 - RNA, 18 nt, Human
caaugguuuuuaaauuuu

SEQ ID NO: 2827480 - RNA, 21 nt, Human
caaugguuuuuaaauuuugua

SEQ ID NO: 2827481 - RNA, 23 nt, Human
caaugguuuuuaaauuuuguaau

SEQ ID NO: 2827482 - RNA, 15 nt, Human
caauuauaguuucug

SEQ ID NO: 2827483 - RNA, 18 nt, Human
caauuauaguuucugagg

SEQ ID NO: 2827484 - RNA, 14 nt, Human
caauuauaguuucu

SEQ ID NO: 2827485 - RNA, 22 nt, Human
caauuauaguuucugaggcuuu

SEQ ID NO: 2827486 - RNA, 14 nt, Human
caauuauugauaua

SEQ ID NO: 2827487 - RNA, 15 nt, Human
caauuauugauauau

SEQ ID NO: 2827488 - RNA, 17 nt, Human
caauuauugauauauau

SEQ ID NO: 2827489 - RNA, 18 nt, Human
caauuauugauauauauu

SEQ ID NO: 2827490 - RNA, 20 nt, Human
caauuauugauauauauuau

SEQ ID NO: 2827491 - RNA, 22 nt, Human
caauuauugauauauauuauaa

SEQ ID NO: 2827492 - RNA, 17 nt, Human
caauuauuguuacacau

SEQ ID NO: 2827493 - RNA, 22 nt, Human
caauuauuguuacacauuaagu

SEQ ID NO: 2827494 - RNA, 23 nt, Human
caauuauuguuacacauuaagua

SEQ ID NO: 2827495 - RNA, 13 nt, Human
cacacccagccca

SEQ ID NO: 2827496 - RNA, 12 nt, Human
cacaccagccau

SEQ ID NO: 2827497 - RNA, 22 nt, Human
cacaccagagcccaccuuggcu

SEQ ID NO: 2827498 - RNA, 21 nt, Human
cacaccagagcccaccuuggc

SEQ ID NO: 2827499 - RNA, 15 nt, Human
cacacagcucugucc

SEQ ID NO: 2827500 - RNA, 14 nt, Human
cacacagcucuguc

SEQ ID NO: 2827501 - RNA, 13 nt, Human
cacacagcucugu

SEQ ID NO: 2827502 - RNA, 15 nt, Human
cacacagcagcaguu

SEQ ID NO: 2827503 - RNA, 22 nt, Human
cacacagauuugagcucagccc

SEQ ID NO: 2827504 - RNA, 20 nt, Human
cacacccagcccacuucugc

SEQ ID NO: 2827505 - RNA, 14 nt, Human
cacacccagcccac

SEQ ID NO: 2827506 - RNA, 12 nt, Human
cacacccagccu

SEQ ID NO: 2827507 - RNA, 13 nt, Human
cacacccagccuc

SEQ ID NO: 2827508 - RNA, 14 nt, Human
cacacccagccuca

SEQ ID NO: 2827509 - RNA, 15 nt, Human
cacacccagccucag

SEQ ID NO: 2827510 - RNA, 16 nt, Human
cacacccagccucagu

SEQ ID NO: 2827511 - RNA, 18 nt, Human
cacacccagccucagucc

SEQ ID NO: 2827512 - RNA, 19 nt, Human
cacacccagccucaguccu

SEQ ID NO: 2827513 - RNA, 17 nt, Human
cacaccgggcacucaga

SEQ ID NO: 2827514 - RNA, 14 nt, Human
cacaccucacucuu

SEQ ID NO: 2827515 - RNA, 18 nt, Human
cacaccucacucuuuaua

SEQ ID NO: 2827516 - RNA, 13 nt, Human
cacaccucaguuc

SEQ ID NO: 2827517 - RNA, 21 nt, Human
cacaccucaguucccuuggcc

SEQ ID NO: 2827518 - RNA, 20 nt, Human
cacaccucaguucccuuggc

SEQ ID NO: 2827519 - RNA, 18 nt, Human
cacaccucaguucccuug

SEQ ID NO: 2827520 - RNA, 17 nt, Human
cacaccucaguucccuu

SEQ ID NO: 2827521 - RNA, 22 nt, Human
cacaccucaguucccuuggccu

SEQ ID NO: 2827522 - RNA, 21 nt, Human
cacacgcacauauacacacac

SEQ ID NO: 2827523 - RNA, 16 nt, Human
cacacagauacacaca

SEQ ID NO: 2827524 - RNA, 17 nt, Human
cacacagauacacacac

SEQ ID NO: 2827525 - RNA, 18 nt, Human
cacacagauacacacaca

SEQ ID NO: 2827526 - RNA, 20 nt, Human
cacacagauuugagcucagc

SEQ ID NO: 2827527 - RNA, 18 nt, Human
cacacagauuugagcuca

SEQ ID NO: 2827528 - RNA, 14 nt, Human
cacacacuuuggcu

SEQ ID NO: 2827529 - RNA, 12 nt, Human
cacacacacaca

SEQ ID NO: 2827530 - RNA, 11 nt, Human
cacacacacac

SEQ ID NO: 2827531 - RNA, 11 nt, Human
cacacacacaa

SEQ ID NO: 2827532 - RNA, 14 nt, Human
cacacaccucacca

SEQ ID NO: 2827533 - RNA, 12 nt, Human
cacacacacaag

SEQ ID NO: 2827534 - RNA, 15 nt, Human
cacacacccugaggu

SEQ ID NO: 2827535 - RNA, 18 nt, Human
cacacacccugaggucag

SEQ ID NO: 2827536 - RNA, 14 nt, Human
cacacacugaugcu

SEQ ID NO: 2827537 - RNA, 20 nt, Human
cacacaccagagcccaccuu

SEQ ID NO: 2827538 - RNA, 16 nt, Human
cacacaccagagccca

SEQ ID NO: 2827539 - RNA, 15 nt, Human
cacacaccagagccc

SEQ ID NO: 2827540 - RNA, 13 nt, Human
cacacacaacagc

SEQ ID NO: 2827541 - RNA, 15 nt, Human
cacacacaacagcca

SEQ ID NO: 2827542 - RNA, 16 nt, Human
cacacacaacagccaa

SEQ ID NO: 2827543 - RNA, 20 nt, Human
cacacacaacagccaacagc

SEQ ID NO: 2827544 - RNA, 9 nt, Human
cacacacac

SEQ ID NO: 2827545 - RNA, 10 nt, Human
cacacacaca

SEQ ID NO: 2827546 - RNA, 15 nt, Human
cacacacaaaauaaa

SEQ ID NO: 2827547 - RNA, 13 nt, Human
cacacacaaaccu

SEQ ID NO: 2827548 - RNA, 14 nt, Human
cacacacaaaccuu

SEQ ID NO: 2827549 - RNA, 18 nt, Human
cacacaagaagaagggca

SEQ ID NO: 2827550 - RNA, 16 nt, Human
cacacaagcccacagc

SEQ ID NO: 2827551 - RNA, 16 nt, Human
cacacaaguaagagac

SEQ ID NO: 2827552 - RNA, 20 nt, Human
cacacaaguaagagacucag

SEQ ID NO: 2827553 - RNA, 21 nt, Human
cacacaaguaagagacucagc

SEQ ID NO: 2827554 - RNA, 23 nt, Human
cacacaaguaagagacucagccu

SEQ ID NO: 2827555 - RNA, 16 nt, Human
cacacaagaagaaggg

SEQ ID NO: 2827556 - RNA, 15 nt, Human
cacacaacagccaac

SEQ ID NO: 2827557 - RNA, 16 nt, Human
cacacaagggaaggac

SEQ ID NO: 2827558 - RNA, 19 nt, Human
cacacaagggaaggacaga

SEQ ID NO: 2827559 - RNA, 24 nt, Human
cacaaucucggcucacugcauccu

SEQ ID NO: 2827560 - RNA, 23 nt, Human
cacaaucucggcucacugcaucc

SEQ ID NO: 2827561 - RNA, 22 nt, Human
cacaaucucggcucacugcauc

SEQ ID NO: 2827562 - RNA, 20 nt, Human
cacaaucucggcucacugca

SEQ ID NO: 2827563 - RNA, 13 nt, Human
cacacacacacaa

SEQ ID NO: 2827564 - RNA, 14 nt, Human
cacacacacacaaa

SEQ ID NO: 2827565 - RNA, 14 nt, Human
cacacacacacaag

SEQ ID NO: 2827566 - RNA, 16 nt, Human
caagugccugcuuuua

SEQ ID NO: 2827567 - RNA, 23 nt, Human
caauaucauaucaucacauugag

SEQ ID NO: 2827568 - RNA, 14 nt, Human
caauauuaaaucug

SEQ ID NO: 2827569 - RNA, 15 nt, Human
caauauuaaaucugc

SEQ ID NO: 2827570 - RNA, 17 nt, Human
caaucucccgcugcugc

SEQ ID NO: 2827571 - RNA, 18 nt, Human
caaucucggcucacugca

SEQ ID NO: 2827572 - RNA, 13 nt, Human
caaucuauuauuu

SEQ ID NO: 2827573 - RNA, 14 nt, Human
caaucuauuauuuc

SEQ ID NO: 2827574 - RNA, 23 nt, Human
caaucuauuauuucucuaauuau

SEQ ID NO: 2827575 - RNA, 14 nt, Human
caaucucaaggaau

SEQ ID NO: 2827576 - RNA, 18 nt, Human
caaucucaaggaaucuuu

SEQ ID NO: 2827577 - RNA, 20 nt, Human
caaucucaaggaaucuuuaa

SEQ ID NO: 2827578 - RNA, 12 nt, Human
caaucuaauuuu

SEQ ID NO: 2827579 - RNA, 14 nt, Human
caauccuuuauuau

SEQ ID NO: 2827580 - RNA, 13 nt, Human
caaucgcaaauca

SEQ ID NO: 2827581 - RNA, 15 nt, Human
caaucgcaaaucaaa

SEQ ID NO: 2827582 - RNA, 17 nt, Human
caauccugucuuucuga

SEQ ID NO: 2827583 - RNA, 19 nt, Human
caauccuggcucuguggcu

SEQ ID NO: 2827584 - RNA, 21 nt, Human
caaugauggcaauuuuguaac

SEQ ID NO: 2827585 - RNA, 24 nt, Human
caaugauggcaauuuuguaacgaa

SEQ ID NO: 2827586 - RNA, 19 nt, Human
caaugaaauauugcuguau

SEQ ID NO: 2827587 - RNA, 21 nt, Human
caaugaaaaauagugucuuug

SEQ ID NO: 2827588 - RNA, 17 nt, Human
caaugaaaguuugcacu

SEQ ID NO: 2827589 - RNA, 12 nt, Human
caaugaaaaguc

SEQ ID NO: 2827590 - RNA, 20 nt, Human
caaugaaaagucguuuucca

SEQ ID NO: 2827591 - RNA, 18 nt, Human
caaugaaagguacuauau

SEQ ID NO: 2827592 - RNA, 14 nt, Human
caaucuuugaaaga

SEQ ID NO: 2827593 - RNA, 16 nt, Human
caaucuuugaaagacu

SEQ ID NO: 2827594 - RNA, 19 nt, Human
caaucuuugaaagacuucc

SEQ ID NO: 2827595 - RNA, 20 nt, Human
caaucuuugaaagacuucca

SEQ ID NO: 2827596 - RNA, 23 nt, Human
caaucuuugaaagacuuccaaag

SEQ ID NO: 2827597 - RNA, 16 nt, Human
caaucuuuuuuacucu

SEQ ID NO: 2827598 - RNA, 13 nt, Human
caaugauuauuuu

SEQ ID NO: 2827599 - RNA, 15 nt, Human
caaugauuauuuuca

SEQ ID NO: 2827600 - RNA, 20 nt, Human
caaugauuauuuucauuaca

SEQ ID NO: 2827601 - RNA, 14 nt, Human
caaugcacugacau

SEQ ID NO: 2827602 - RNA, 16 nt, Human
caaugcaagagugauu

SEQ ID NO: 2827603 - RNA, 21 nt, Human
caaugcaagagugauugcagc

SEQ ID NO: 2827604 - RNA, 22 nt, Human
caaugcaagagugauugcagcu

SEQ ID NO: 2827605 - RNA, 23 nt, Human
caaugcaagagugauugcagcuu

SEQ ID NO: 2827606 - RNA, 21 nt, Human
cacacuaaccuggguucccuu

SEQ ID NO: 2827607 - RNA, 14 nt, Human
cacacuacaccaca

SEQ ID NO: 2827608 - RNA, 16 nt, Human
cacacuacaccacaca

SEQ ID NO: 2827609 - RNA, 17 nt, Human
cacacuacaccacacac

SEQ ID NO: 2827610 - RNA, 18 nt, Human
cacacuacaccacacaca

SEQ ID NO: 2827611 - RNA, 19 nt, Human
cacacuacaccacacacaa

SEQ ID NO: 2827612 - RNA, 15 nt, Human
cacagugaagugcug

SEQ ID NO: 2827613 - RNA, 11 nt, Human
cacagugaccc

SEQ ID NO: 2827614 - RNA, 16 nt, Human
cacagugacccuuccc

SEQ ID NO: 2827615 - RNA, 17 nt, Human
cacagugacccuuccca

SEQ ID NO: 2827616 - RNA, 19 nt, Human
cacagugagggagauccca

SEQ ID NO: 2827617 - RNA, 23 nt, Human
cacaugaccugaucacuagccug

SEQ ID NO: 2827618 - RNA, 24 nt, Human
cacaugaaucccacccacauguga

SEQ ID NO: 2827619 - RNA, 18 nt, Human
cacaugcacgugugugca

SEQ ID NO: 2827620 - RNA, 12 nt, Human
cacaugcacaca

SEQ ID NO: 2827621 - RNA, 13 nt, Human
cacaugcacacac

SEQ ID NO: 2827622 - RNA, 12 nt, Human
cacaugcuggcc

SEQ ID NO: 2827623 - RNA, 13 nt, Human
cacaugcuggcca

SEQ ID NO: 2827624 - RNA, 14 nt, Human
cacaugcuggccag

SEQ ID NO: 2827625 - RNA, 15 nt, Human
cacaugcuggccagc

SEQ ID NO: 2827626 - RNA, 16 nt, Human
cacaugcuggccagcc

SEQ ID NO: 2827627 - RNA, 17 nt, Human
cacaugcuggccagccu

SEQ ID NO: 2827628 - RNA, 18 nt, Human
cacaugcuggccagccug

SEQ ID NO: 2827629 - RNA, 19 nt, Human
cacaugcuggccagccugg

SEQ ID NO: 2827630 - RNA, 12 nt, Human
cacaugcuucaa

SEQ ID NO: 2827631 - RNA, 18 nt, Human
cacaugcggagaacaaau

SEQ ID NO: 2827632 - RNA, 9 nt, Human
cacaugcua

SEQ ID NO: 2827633 - RNA, 21 nt, Human
cacaugcuaggaugcggaaau

SEQ ID NO: 2827634 - RNA, 20 nt, Human
cacaggcaaaauccuugcuu

SEQ ID NO: 2827635 - RNA, 16 nt, Human
cacaggcaaaauccuu

SEQ ID NO: 2827636 - RNA, 19 nt, Human
cacaggcagguccaggguu

SEQ ID NO: 2827637 - RNA, 14 nt, Human
cacaggcccggcuc

SEQ ID NO: 2827638 - RNA, 12 nt, Human
cacaggcccccu

SEQ ID NO: 2827639 - RNA, 13 nt, Human
cacaggcccccuu

SEQ ID NO: 2827640 - RNA, 21 nt, Human
cacaggcccccuugagugggg

SEQ ID NO: 2827641 - RNA, 22 nt, Human
cacaggcccccuugaguggggu

SEQ ID NO: 2827642 - RNA, 20 nt, Human
cacagcucuucuccaggcug

SEQ ID NO: 2827643 - RNA, 19 nt, Human
cacagcucuucuccaggcu

SEQ ID NO: 2827644 - RNA, 17 nt, Human
cacaggaucagucugau

SEQ ID NO: 2827645 - RNA, 16 nt, Human
cacaggaugaaggcaa

SEQ ID NO: 2827646 - RNA, 23 nt, Human
cacaggaugaggugguggagugg

SEQ ID NO: 2827647 - RNA, 16 nt, Human
cacaggaugcuggccu

SEQ ID NO: 2827648 - RNA, 16 nt, Human
cacaggaugcuguguu

SEQ ID NO: 2827649 - RNA, 17 nt, Human
cacaggaugcuguguug

SEQ ID NO: 2827650 - RNA, 15 nt, Human
cacaggacucugccu

SEQ ID NO: 2827651 - RNA, 16 nt, Human
cacaggacucugccuc

SEQ ID NO: 2827652 - RNA, 18 nt, Human
cacagcucuucuccaggc

SEQ ID NO: 2827653 - RNA, 22 nt, Human
cacagccagggggaugccacuc

SEQ ID NO: 2827654 - RNA, 13 nt, Human
cacagcacagcuc

SEQ ID NO: 2827655 - RNA, 17 nt, Human
cacagcacagcucccug

SEQ ID NO: 2827656 - RNA, 13 nt, Human
cacagcacaugcu

SEQ ID NO: 2827657 - RNA, 19 nt, Human
cacacgcgcgcgcacacac

SEQ ID NO: 2827658 - RNA, 21 nt, Human
cacacgcgcgcgcacacacac

SEQ ID NO: 2827659 - RNA, 17 nt, Human
cacacgccucccacugg

SEQ ID NO: 2827660 - RNA, 20 nt, Human
cacacgccucccacuggggu

SEQ ID NO: 2827661 - RNA, 14 nt, Human
cacacgcgcgcaca

SEQ ID NO: 2827662 - RNA, 21 nt, Human
cacacgccccaauuuucaggu

SEQ ID NO: 2827663 - RNA, 18 nt, Human
cacacgcgcgcacacaca

SEQ ID NO: 2827664 - RNA, 13 nt, Human
cacacgcacgcac

SEQ ID NO: 2827665 - RNA, 14 nt, Human
cacacgcacgcaca

SEQ ID NO: 2827666 - RNA, 15 nt, Human
cacacgcacgcacac

SEQ ID NO: 2827667 - RNA, 17 nt, Human
cacacgcacgcacacac

SEQ ID NO: 2827668 - RNA, 19 nt, Human
cacacgcacgcacacacac

SEQ ID NO: 2827669 - RNA, 21 nt, Human
cacacgcacgcacacacacaa

SEQ ID NO: 2827670 - RNA, 13 nt, Human
cacagauuuuaau

SEQ ID NO: 2827671 - RNA, 14 nt, Human
cacagauuuuaauu

SEQ ID NO: 2827672 - RNA, 15 nt, Human
cacagauuuuaauug

SEQ ID NO: 2827673 - RNA, 16 nt, Human
cacagauuuuaauugu

SEQ ID NO: 2827674 - RNA, 18 nt, Human
cacagauuuuaauuguca

SEQ ID NO: 2827675 - RNA, 19 nt, Human
cacagauuuuaauugucau

SEQ ID NO: 2827676 - RNA, 21 nt, Human
cacagauuuuaauugucaugg

SEQ ID NO: 2827677 - RNA, 17 nt, Human
cacagcaaacugucccc

SEQ ID NO: 2827678 - RNA, 15 nt, Human
cacacacacaaaccu

SEQ ID NO: 2827679 - RNA, 20 nt, Human
cacacgguuugaagccugga

SEQ ID NO: 2827680 - RNA, 19 nt, Human
cacacgguuugaagccugg

SEQ ID NO: 2827681 - RNA, 11 nt, Human
caccagcacca

SEQ ID NO: 2827682 - RNA, 16 nt, Human
caccagauagcagagg

SEQ ID NO: 2827683 - RNA, 21 nt, Human
caccagagcauuuccaacacc

SEQ ID NO: 2827684 - RNA, 16 nt, Human
caccagucacaugacc

SEQ ID NO: 2827685 - RNA, 23 nt, Human
caccagucacaugaccugaucac

SEQ ID NO: 2827686 - RNA, 19 nt, Human
caccaggugccuuucaaau

SEQ ID NO: 2827687 - RNA, 22 nt, Human
caccaggugccuuucaaauuua

SEQ ID NO: 2827688 - RNA, 20 nt, Human
caccagucccuguccggaau

SEQ ID NO: 2827689 - RNA, 14 nt, Human
caccagucccuguc

SEQ ID NO: 2827690 - RNA, 13 nt, Human
caccagugucccc

SEQ ID NO: 2827691 - RNA, 14 nt, Human
caccaguguccccu

SEQ ID NO: 2827692 - RNA, 16 nt, Human
caccaguguccccucc

SEQ ID NO: 2827693 - RNA, 18 nt, Human
caccaguguccccuccac

SEQ ID NO: 2827694 - RNA, 18 nt, Human
caccagugugggguucug

SEQ ID NO: 2827695 - RNA, 23 nt, Human
caccagugugggguucugcuggg

SEQ ID NO: 2827696 - RNA, 18 nt, Human
caccauaggucaccuuua

SEQ ID NO: 2827697 - RNA, 16 nt, Human
caccauaccuuugcua

SEQ ID NO: 2827698 - RNA, 21 nt, Human
caccauauucagugcuguggc

SEQ ID NO: 2827699 - RNA, 16 nt, Human
caccauauucagugcu

SEQ ID NO: 2827700 - RNA, 17 nt, Human
caccaucaugucuggcu

SEQ ID NO: 2827701 - RNA, 15 nt, Human
caccaucaugucugg

SEQ ID NO: 2827702 - RNA, 18 nt, Human
caccaucaugucuggcua

SEQ ID NO: 2827703 - RNA, 23 nt, Human
caccaucuuaagagaugccucau

SEQ ID NO: 2827704 - RNA, 15 nt, Human
caccaugauggccag

SEQ ID NO: 2827705 - RNA, 18 nt, Human
caccaugauggggcccua

SEQ ID NO: 2827706 - RNA, 14 nt, Human
caccaugcuuccag

SEQ ID NO: 2827707 - RNA, 14 nt, Human
caccaucgcuggcc

SEQ ID NO: 2827708 - RNA, 17 nt, Human
caccaucgcuggccccu

SEQ ID NO: 2827709 - RNA, 19 nt, Human
caccauguuggccaggcug

SEQ ID NO: 2827710 - RNA, 20 nt, Human
caccauguuggccaggcugg

SEQ ID NO: 2827711 - RNA, 20 nt, Human
caccauguuggccaggcugc

SEQ ID NO: 2827712 - RNA, 16 nt, Human
caccauggccagccaa

SEQ ID NO: 2827713 - RNA, 12 nt, Human
caccauggccag

SEQ ID NO: 2827714 - RNA, 15 nt, Human
caccauguauuuugu

SEQ ID NO: 2827715 - RNA, 20 nt, Human
caccauguugcccaggcugg

SEQ ID NO: 2827716 - RNA, 15 nt, Human
caccaagaaagcagg

SEQ ID NO: 2827717 - RNA, 22 nt, Human
caccaagacuuguuuuaugcuc

SEQ ID NO: 2827718 - RNA, 15 nt, Human
caccaagaugucugu

SEQ ID NO: 2827719 - RNA, 17 nt, Human
caccaagaugucugucu

SEQ ID NO: 2827720 - RNA, 13 nt, Human
caccaagcccagu

SEQ ID NO: 2827721 - RNA, 12 nt, Human
caccaagcccag

SEQ ID NO: 2827722 - RNA, 21 nt, Human
caccaauuggauaaagcagcu

SEQ ID NO: 2827723 - RNA, 11 nt, Human
caccaaggaaa

SEQ ID NO: 2827724 - RNA, 12 nt, Human
caccaaggaaac

SEQ ID NO: 2827725 - RNA, 20 nt, Human
caccaaggaaacgcuaccuc

SEQ ID NO: 2827726 - RNA, 21 nt, Human
caccaaggaaacgcuaccucu

SEQ ID NO: 2827727 - RNA, 15 nt, Human
caccagagcccaccu

SEQ ID NO: 2827728 - RNA, 18 nt, Human
caccagagcaaccucuca

SEQ ID NO: 2827729 - RNA, 20 nt, Human
caccagagcaaccucucacu

SEQ ID NO: 2827730 - RNA, 22 nt, Human
caccagagcaaccucucacucc

SEQ ID NO: 2827731 - RNA, 12 nt, Human
caccagagcaga

SEQ ID NO: 2827732 - RNA, 16 nt, Human
caccagagcagaugca

SEQ ID NO: 2827733 - RNA, 17 nt, Human
caccagagcagaugcag

SEQ ID NO: 2827734 - RNA, 18 nt, Human
caccagagcagaugcaga

SEQ ID NO: 2827735 - RNA, 19 nt, Human
caccagagcagaugcagag

SEQ ID NO: 2827736 - RNA, 20 nt, Human
caccagagcagaugcagaga

SEQ ID NO: 2827737 - RNA, 16 nt, Human
caccagagaccguccu

SEQ ID NO: 2827738 - RNA, 19 nt, Human
caccagagaccguccucac

SEQ ID NO: 2827739 - RNA, 20 nt, Human
caccagagaccguccucacc

SEQ ID NO: 2827740 - RNA, 21 nt, Human
caccagagaccguccucaccc

SEQ ID NO: 2827741 - RNA, 11 nt, Human
caccagagacc

SEQ ID NO: 2827742 - RNA, 22 nt, Human
caccagagcccaccuuggcuca

SEQ ID NO: 2827743 - RNA, 20 nt, Human
caccagagcccaccuuggcu

SEQ ID NO: 2827744 - RNA, 18 nt, Human
caccagagcccaccuugg

SEQ ID NO: 2827745 - RNA, 17 nt, Human
caccagagcccaccuug

SEQ ID NO: 2827746 - RNA, 19 nt, Human
caccacacccagcccacuu

SEQ ID NO: 2827747 - RNA, 15 nt, Human
caccacacccagccu

SEQ ID NO: 2827748 - RNA, 16 nt, Human
caccacacccagccuc

SEQ ID NO: 2827749 - RNA, 14 nt, Human
caccacagacacac

SEQ ID NO: 2827750 - RNA, 17 nt, Human
caccacacccagccuca

SEQ ID NO: 2827751 - RNA, 18 nt, Human
caccacacccagccucag

SEQ ID NO: 2827752 - RNA, 12 nt, Human
caccacagacac

SEQ ID NO: 2827753 - RNA, 13 nt, Human
caccacagacaca

SEQ ID NO: 2827754 - RNA, 14 nt, Human
caccacgcccggcu

SEQ ID NO: 2827755 - RNA, 15 nt, Human
caccacgcccggcua

SEQ ID NO: 2827756 - RNA, 19 nt, Human
caccacgcuggggucuggg

SEQ ID NO: 2827757 - RNA, 23 nt, Human
cacccaacccuaucuccugacag

SEQ ID NO: 2827758 - RNA, 22 nt, Human
cacccaacccuaucuccugaca

SEQ ID NO: 2827759 - RNA, 24 nt, Human
cacccaacccuaucuccugacaga

SEQ ID NO: 2827760 - RNA, 15 nt, Human
cacccaaccccaagc

SEQ ID NO: 2827761 - RNA, 19 nt, Human
cacccaagagauuguuguu

SEQ ID NO: 2827762 - RNA, 22 nt, Human
cacccaaagagguauuuaucuu

SEQ ID NO: 2827763 - RNA, 17 nt, Human
cacccaaagcauggacu

SEQ ID NO: 2827764 - RNA, 18 nt, Human
cacccaaagcauggacua

SEQ ID NO: 2827765 - RNA, 22 nt, Human
cccaggguggacuuagaaagca

SEQ ID NO: 2827766 - RNA, 18 nt, Human
cccaggguggagugcagu

SEQ ID NO: 2827767 - RNA, 19 nt, Human
cccaggguggagugcagug

SEQ ID NO: 2827768 - RNA, 13 nt, Human
cccagguccucac

SEQ ID NO: 2827769 - RNA, 21 nt, Human
cccagguggaaggcagacagc

SEQ ID NO: 2827770 - RNA, 23 nt, Human
cccagguggaaggcagacagcag

SEQ ID NO: 2827771 - RNA, 16 nt, Human
cccaggugccagccug

SEQ ID NO: 2827772 - RNA, 19 nt, Human
cccagguguuaacauucca

SEQ ID NO: 2827773 - RNA, 21 nt, Human
cccagguguuaacauuccaag

SEQ ID NO: 2827774 - RNA, 22 nt, Human
cccagguguuaacauuccaaga

SEQ ID NO: 2827775 - RNA, 13 nt, Human
cccagugcccaca

SEQ ID NO: 2827776 - RNA, 19 nt, Human
cccagugagauuacagagg

SEQ ID NO: 2827777 - RNA, 23 nt, Human
cccagugagucucuggggcaggc

SEQ ID NO: 2827778 - RNA, 20 nt, Human
cccagucuggaaugcagugg

SEQ ID NO: 2827779 - RNA, 19 nt, Human
cccaguccaaauguccucc

SEQ ID NO: 2827780 - RNA, 23 nt, Human
cccaguccaaauguccuccagaa

SEQ ID NO: 2827781 - RNA, 21 nt, Human
cccaggccgggguggagcaug

SEQ ID NO: 2827782 - RNA, 12 nt, Human
cccaggccggcc

SEQ ID NO: 2827783 - RNA, 13 nt, Human
cccaggccggcca

SEQ ID NO: 2827784 - RNA, 17 nt, Human
cccaggccggccagccu

SEQ ID NO: 2827785 - RNA, 21 nt, Human
cccaggccggccagccucacc

SEQ ID NO: 2827786 - RNA, 23 nt, Human
cccaggccggccagccucacccu

SEQ ID NO: 2827787 - RNA, 13 nt, Human
cccaggcgggagc

SEQ ID NO: 2827788 - RNA, 22 nt, Human
cccaggcgggagcgguggcccu

SEQ ID NO: 2827789 - RNA, 23 nt, Human
cccaggcgggagcgguggcccug

SEQ ID NO: 2827790 - RNA, 14 nt, Human
cccaggcuccgccc

SEQ ID NO: 2827791 - RNA, 18 nt, Human
cccaggcuccgcccuuag

SEQ ID NO: 2827792 - RNA, 21 nt, Human
cccaggcuccgcccuuagucc

SEQ ID NO: 2827793 - RNA, 23 nt, Human
cccaggcuccgcccuuagucccc

SEQ ID NO: 2827794 - RNA, 14 nt, Human
cccaggcugagccu

SEQ ID NO: 2827795 - RNA, 13 nt, Human
cccaggccucugu

SEQ ID NO: 2827796 - RNA, 14 nt, Human
cccaggccuauguu

SEQ ID NO: 2827797 - RNA, 21 nt, Human
cccaggccuauguugauccau

SEQ ID NO: 2827798 - RNA, 15 nt, Human
cccaggccugccugu

SEQ ID NO: 2827799 - RNA, 16 nt, Human
cccaggccugccuguu

SEQ ID NO: 2827800 - RNA, 18 nt, Human
cccaggcgccccuucccc

SEQ ID NO: 2827801 - RNA, 20 nt, Human
cccaggggucccagccaccc

SEQ ID NO: 2827802 - RNA, 15 nt, Human
cccagggucuucccu

SEQ ID NO: 2827803 - RNA, 18 nt, Human
cccagggucuucccuacc

SEQ ID NO: 2827804 - RNA, 16 nt, Human
cccagggucuucccua

SEQ ID NO: 2827805 - RNA, 23 nt, Human
cccagggucuucccuaccucagg

SEQ ID NO: 2827806 - RNA, 19 nt, Human
cccagggggcaugaccaga

SEQ ID NO: 2827807 - RNA, 19 nt, Human
cccaggggucccagccacc

SEQ ID NO: 2827808 - RNA, 18 nt, Human
cccaggggucccagccac

SEQ ID NO: 2827809 - RNA, 16 nt, Human
cccaggggucccagcc

SEQ ID NO: 2827810 - RNA, 15 nt, Human
cccaggggucccagc

SEQ ID NO: 2827811 - RNA, 16 nt, Human
cccaggggaggcggca

SEQ ID NO: 2827812 - RNA, 23 nt, Human
cccaggggaggcggcacuccaac

SEQ ID NO: 2827813 - RNA, 23 nt, Human
cccaggaguuugaggcugcagcg

SEQ ID NO: 2827814 - RNA, 22 nt, Human
cccaggaguuugaggcugcagc

SEQ ID NO: 2827815 - RNA, 13 nt, Human
cccaggcaggucu

SEQ ID NO: 2827816 - RNA, 11 nt, Human
cccaggcaggu

SEQ ID NO: 2827817 - RNA, 14 nt, Human
cccaggcaggccac

SEQ ID NO: 2827818 - RNA, 14 nt, Human
cccaggagggaggg

SEQ ID NO: 2827819 - RNA, 24 nt, Human
cccaggaguucgaggcugcaguca

SEQ ID NO: 2827820 - RNA, 18 nt, Human
cccaggagggagggggcu

SEQ ID NO: 2827821 - RNA, 18 nt, Human
cccaggagggcauccaua

SEQ ID NO: 2827822 - RNA, 20 nt, Human
cccaggaggggaacacugcc

SEQ ID NO: 2827823 - RNA, 22 nt, Human
cccaggaggggaacacugcccu

SEQ ID NO: 2827824 - RNA, 18 nt, Human
cccaggagccccgaggcc

SEQ ID NO: 2827825 - RNA, 21 nt, Human
cccaggagccccgaggccuuc

SEQ ID NO: 2827826 - RNA, 22 nt, Human
cccaggccccugccacccuggg

SEQ ID NO: 2827827 - RNA, 21 nt, Human
cccaggccccugccacccugg

SEQ ID NO: 2827828 - RNA, 18 nt, Human
cccaggccccugccaccc

SEQ ID NO: 2827829 - RNA, 16 nt, Human
cccaggccccugccac

SEQ ID NO: 2827830 - RNA, 11 nt, Human
cccaggccccu

SEQ ID NO: 2827831 - RNA, 13 nt, Human
cccaggcccacuc

SEQ ID NO: 2827832 - RNA, 15 nt, Human
cccaggcccacucag

SEQ ID NO: 2827833 - RNA, 16 nt, Human
cccaggcccacucagg

SEQ ID NO: 2827834 - RNA, 17 nt, Human
cccaggcaggucuugaa

SEQ ID NO: 2827835 - RNA, 16 nt, Human
cccaagugugaacaaa

SEQ ID NO: 2827836 - RNA, 21 nt, Human
cccaaguuuccauagcaacag

SEQ ID NO: 2827837 - RNA, 23 nt, Human
cccaaguuuccauagcaacagga

SEQ ID NO: 2827838 - RNA, 12 nt, Human
cccaauagcugc

SEQ ID NO: 2827839 - RNA, 19 nt, Human
cccaaucccagcuaccuca

SEQ ID NO: 2827840 - RNA, 15 nt, Human
cccaaucagcacuga

SEQ ID NO: 2827841 - RNA, 16 nt, Human
cccaaucagcacugaa

SEQ ID NO: 2827842 - RNA, 17 nt, Human
cccaaucagcacugaaa

SEQ ID NO: 2827843 - RNA, 22 nt, Human
cccaauccagguacgcacagac

SEQ ID NO: 2827844 - RNA, 23 nt, Human
cccaauccagguacgcacagaca

SEQ ID NO: 2827845 - RNA, 24 nt, Human
cccaauccagguacgcacagacag

SEQ ID NO: 2827846 - RNA, 12 nt, Human
cccacacccugg

SEQ ID NO: 2827847 - RNA, 13 nt, Human
cccacaaaaaugu

SEQ ID NO: 2827848 - RNA, 16 nt, Human
cccaauguaggagcug

SEQ ID NO: 2827849 - RNA, 20 nt, Human
cccaaucccagcuaccucaa

SEQ ID NO: 2827850 - RNA, 15 nt, Human
cccaaugcugauguc

SEQ ID NO: 2827851 - RNA, 17 nt, Human
cccaaugguguuuuucu

SEQ ID NO: 2827852 - RNA, 15 nt, Human
cccaauugagaaaaa

SEQ ID NO: 2827853 - RNA, 11 nt, Human
cccaauuuccc

SEQ ID NO: 2827854 - RNA, 14 nt, Human
cccaauuggaggaa

SEQ ID NO: 2827855 - RNA, 19 nt, Human
cccaaauuugauugauuug

SEQ ID NO: 2827856 - RNA, 17 nt, Human
cccaacaaaccauccag

SEQ ID NO: 2827857 - RNA, 15 nt, Human
cccaacaacauccau

SEQ ID NO: 2827858 - RNA, 16 nt, Human
cccaaauuugauugau

SEQ ID NO: 2827859 - RNA, 18 nt, Human
cccaaguggugaaugaca

SEQ ID NO: 2827860 - RNA, 15 nt, Human
cccaagugugaacaa

SEQ ID NO: 2827861 - RNA, 23 nt, Human
cccaaauuagggcaauuggaaca

SEQ ID NO: 2827862 - RNA, 20 nt, Human
cccaagugguuuccacaugc

SEQ ID NO: 2827863 - RNA, 21 nt, Human
cccaagugguuuccacaugcu

SEQ ID NO: 2827864 - RNA, 24 nt, Human
cccaagugguuuccacaugcucug

SEQ ID NO: 2827865 - RNA, 18 nt, Human
cccagcaagugagagcug

SEQ ID NO: 2827866 - RNA, 16 nt, Human
cccagcaagugagagc

SEQ ID NO: 2827867 - RNA, 22 nt, Human
cccagauugcaacaggcugggc

SEQ ID NO: 2827868 - RNA, 21 nt, Human
cccagauugcaacaggcuggg

SEQ ID NO: 2827869 - RNA, 20 nt, Human
cccagauugcaacaggcugg

SEQ ID NO: 2827870 - RNA, 20 nt, Human
cccagaucuggucccuugca

SEQ ID NO: 2827871 - RNA, 21 nt, Human
cccagaugggggaaagcacag

SEQ ID NO: 2827872 - RNA, 23 nt, Human
cccagauggcuggaaggggucca

SEQ ID NO: 2827873 - RNA, 19 nt, Human
cccagaucuggucccuugc

SEQ ID NO: 2827874 - RNA, 18 nt, Human
cccagaucuggucccuug

SEQ ID NO: 2827875 - RNA, 19 nt, Human
cccagaucagucagagccc

SEQ ID NO: 2827876 - RNA, 20 nt, Human
cccagaucauguuuugguga

SEQ ID NO: 2827877 - RNA, 16 nt, Human
cccacaccucugccag

SEQ ID NO: 2827878 - RNA, 15 nt, Human
cccacaccucugcca

SEQ ID NO: 2827879 - RNA, 22 nt, Human
cccacaccucaguucccuuggc

SEQ ID NO: 2827880 - RNA, 13 nt, Human
cccacaccucagu

SEQ ID NO: 2827881 - RNA, 14 nt, Human
cccacacuaaccug

SEQ ID NO: 2827882 - RNA, 22 nt, Human
cccagagguaacagaacagcuu

SEQ ID NO: 2827883 - RNA, 13 nt, Human
cccagagguaaca

SEQ ID NO: 2827884 - RNA, 18 nt, Human
cccagagguaacagaaca

SEQ ID NO: 2827885 - RNA, 20 nt, Human
cccagagguaacagaacagc

SEQ ID NO: 2827886 - RNA, 23 nt, Human
cccagagguaacagaacagcuuc

SEQ ID NO: 2827887 - RNA, 13 nt, Human
cccagagguccag

SEQ ID NO: 2827888 - RNA, 15 nt, Human
cccagagguccagcc

SEQ ID NO: 2827889 - RNA, 16 nt, Human
cccagagguccagccc

SEQ ID NO: 2827890 - RNA, 17 nt, Human
cccagagguccagccca

SEQ ID NO: 2827891 - RNA, 18 nt, Human
cccagagguccagcccau

SEQ ID NO: 2827892 - RNA, 19 nt, Human
cccagagguccagcccauc

SEQ ID NO: 2827893 - RNA, 15 nt, Human
cccagagucaucuga

SEQ ID NO: 2827894 - RNA, 15 nt, Human
cccagcgagcccugg

SEQ ID NO: 2827895 - RNA, 18 nt, Human
cccagcgagcccuggugg

SEQ ID NO: 2827896 - RNA, 17 nt, Human
cccagcgagcccuggug

SEQ ID NO: 2827897 - RNA, 23 nt, Human
cccagcgagcccugguggcagug

SEQ ID NO: 2827898 - RNA, 19 nt, Human
cccagcgagcccugguggc

SEQ ID NO: 2827899 - RNA, 15 nt, Human
cccagcgcucugccu

SEQ ID NO: 2827900 - RNA, 16 nt, Human
cccagcgcucugccuc

SEQ ID NO: 2827901 - RNA, 16 nt, Human
cccagcucgcgggacc

SEQ ID NO: 2827902 - RNA, 15 nt, Human
cccagcucccuagga

SEQ ID NO: 2827903 - RNA, 12 nt, Human
cccagcccuggc

SEQ ID NO: 2827904 - RNA, 23 nt, Human
cccagcuacucagaagccugagg

SEQ ID NO: 2827905 - RNA, 20 nt, Human
cccagcucaggggcagcuca

SEQ ID NO: 2827906 - RNA, 22 nt, Human
cccagcuacucagaagccugag

SEQ ID NO: 2827907 - RNA, 21 nt, Human
cccagcuacucagaagccuga

SEQ ID NO: 2827908 - RNA, 15 nt, Human
cccagcuaaauaauc

SEQ ID NO: 2827909 - RNA, 14 nt, Human
cccagcuaccucaa

SEQ ID NO: 2827910 - RNA, 22 nt, Human
cccagcuacccuuuuucuccag

SEQ ID NO: 2827911 - RNA, 22 nt, Human
cccagcuaccucaaccaaugcc

SEQ ID NO: 2827912 - RNA, 17 nt, Human
cccagcuacucagaagc

SEQ ID NO: 2827913 - RNA, 22 nt, Human
cccagcgggcagguucugccug

SEQ ID NO: 2827914 - RNA, 22 nt, Human
cccagccccuagcccaggagag

SEQ ID NO: 2827915 - RNA, 16 nt, Human
cccagccccuccccca

SEQ ID NO: 2827916 - RNA, 18 nt, Human
cccagccccucccccauc

SEQ ID NO: 2827917 - RNA, 20 nt, Human
cccagccccuagcccaggag

SEQ ID NO: 2827918 - RNA, 14 nt, Human
cccagcccuggcuc

SEQ ID NO: 2827919 - RNA, 15 nt, Human
cccagcccuggcucu

SEQ ID NO: 2827920 - RNA, 16 nt, Human
cccagcccuggcucug

SEQ ID NO: 2827921 - RNA, 18 nt, Human
cccagcccuggcucugca

SEQ ID NO: 2827922 - RNA, 18 nt, Human
cccagccggccaauggaa

SEQ ID NO: 2827923 - RNA, 12 nt, Human
cccagccugcua

SEQ ID NO: 2827924 - RNA, 12 nt, Human
cccagccuauga

SEQ ID NO: 2827925 - RNA, 15 nt, Human
cccagccuaugagca

SEQ ID NO: 2827926 - RNA, 23 nt, Human
cccagccuaugagcauccugagc

SEQ ID NO: 2827927 - RNA, 22 nt, Human
cccagcaagugagagcugggug

SEQ ID NO: 2827928 - RNA, 21 nt, Human
cccagcaagugagagcugggu

SEQ ID NO: 2827929 - RNA, 20 nt, Human
cccagcaagugagagcuggg

SEQ ID NO: 2827930 - RNA, 19 nt, Human
cccagcaagugagagcugg

SEQ ID NO: 2827931 - RNA, 23 nt, Human
cccagcaagugagagcugggugu

SEQ ID NO: 2827932 - RNA, 13 nt, Human
cccagccccuaga

SEQ ID NO: 2827933 - RNA, 14 nt, Human
cccagccccuagaa

SEQ ID NO: 2827934 - RNA, 16 nt, Human
cccagccccuagaaac

SEQ ID NO: 2827935 - RNA, 19 nt, Human
cccagccccuagaaaccca

SEQ ID NO: 2827936 - RNA, 21 nt, Human
cccagccccuagaaacccaag

SEQ ID NO: 2827937 - RNA, 22 nt, Human
cccagccccuagaaacccaagc

SEQ ID NO: 2827938 - RNA, 13 nt, Human
cccagccccuagc

SEQ ID NO: 2827939 - RNA, 11 nt, Human
cccagccccua

SEQ ID NO: 2827940 - RNA, 14 nt, Human
cccagccccuagcc

SEQ ID NO: 2827941 - RNA, 17 nt, Human
cccagccccuagcccag

SEQ ID NO: 2827942 - RNA, 18 nt, Human
cccagccccuagcccagg

SEQ ID NO: 2827943 - RNA, 19 nt, Human
cccagccccuagcccagga

SEQ ID NO: 2827944 - RNA, 13 nt, Human
ccccaccccuacc

SEQ ID NO: 2827945 - RNA, 14 nt, Human
ccccaccccuccag

SEQ ID NO: 2827946 - RNA, 16 nt, Human
ccccaagcuguuuucu

SEQ ID NO: 2827947 - RNA, 14 nt, Human
ccccaagcuguuuu

SEQ ID NO: 2827948 - RNA, 14 nt, Human
ccccaagccuggca

SEQ ID NO: 2827949 - RNA, 13 nt, Human
ccccaagccuggc

SEQ ID NO: 2827950 - RNA, 17 nt, Human
ccccaagcuguuuucuu

SEQ ID NO: 2827951 - RNA, 13 nt, Human
cccauucugccug

SEQ ID NO: 2827952 - RNA, 18 nt, Human
cccauucugcccuguggg

SEQ ID NO: 2827953 - RNA, 15 nt, Human
cccauucucaucugc

SEQ ID NO: 2827954 - RNA, 16 nt, Human
cccauucucaucugca

SEQ ID NO: 2827955 - RNA, 22 nt, Human
ccccaacaaaccauccagugac

SEQ ID NO: 2827956 - RNA, 18 nt, Human
ccccaacauauaaaauaa

SEQ ID NO: 2827957 - RNA, 14 nt, Human
ccccaacucugagc

SEQ ID NO: 2827958 - RNA, 16 nt, Human
ccccaacucugagccc

SEQ ID NO: 2827959 - RNA, 17 nt, Human
ccccaacucugagccca

SEQ ID NO: 2827960 - RNA, 18 nt, Human
ccccaacucugagcccau

SEQ ID NO: 2827961 - RNA, 19 nt, Human
ccccaacucugagcccaug

SEQ ID NO: 2827962 - RNA, 22 nt, Human
ccccaacagcgacauagcccau

SEQ ID NO: 2827963 - RNA, 20 nt, Human
ccccaacagcgacauagccc

SEQ ID NO: 2827964 - RNA, 13 nt, Human
cccauggagccag

SEQ ID NO: 2827965 - RNA, 19 nt, Human
cccauggagccagcucccu

SEQ ID NO: 2827966 - RNA, 17 nt, Human
cccaguggccacucagc

SEQ ID NO: 2827967 - RNA, 22 nt, Human
cccaguggccacucagcuuccu

SEQ ID NO: 2827968 - RNA, 17 nt, Human
cccauggcccucccagu

SEQ ID NO: 2827969 - RNA, 14 nt, Human
cccauggcccugug

SEQ ID NO: 2827970 - RNA, 15 nt, Human
cccauggcccugugc

SEQ ID NO: 2827971 - RNA, 21 nt, Human
cccauggcccugugcuaaucc

SEQ ID NO: 2827972 - RNA, 22 nt, Human
cccauggcccugugcuaauccc

SEQ ID NO: 2827973 - RNA, 24 nt, Human
cccaugggacaaauugcacagaag

SEQ ID NO: 2827974 - RNA, 14 nt, Human
cccaugggcucuga

SEQ ID NO: 2827975 - RNA, 17 nt, Human
cccauucgcgcucugcu

SEQ ID NO: 2827976 - RNA, 20 nt, Human
cccauucgcgcucugcucag

SEQ ID NO: 2827977 - RNA, 16 nt, Human
cccaguggccacucag

SEQ ID NO: 2827978 - RNA, 20 nt, Human
cccagugcccacaggaucag

SEQ ID NO: 2827979 - RNA, 15 nt, Human
cccagugcccacagg

SEQ ID NO: 2827980 - RNA, 14 nt, Human
cccaguggcugcug

SEQ ID NO: 2827981 - RNA, 16 nt, Human
ccauaucuuaaagaaa

SEQ ID NO: 2827982 - RNA, 21 nt, Human
ccauaucuuaaagaaacagcu

SEQ ID NO: 2827983 - RNA, 14 nt, Human
ccauaucuugcgaa

SEQ ID NO: 2827984 - RNA, 21 nt, Human
ccauaucuugcgaauccaagc

SEQ ID NO: 2827985 - RNA, 22 nt, Human
ccauaucuugcgaauccaagcu

SEQ ID NO: 2827986 - RNA, 23 nt, Human
ccauaucuugcgaauccaagcuc

SEQ ID NO: 2827987 - RNA, 15 nt, Human
ccauauaaguuugaa

SEQ ID NO: 2827988 - RNA, 16 nt, Human
ccauauaaguuugaag

SEQ ID NO: 2827989 - RNA, 23 nt, Human
ccauauaaguuugaaggaaacag

SEQ ID NO: 2827990 - RNA, 19 nt, Human
ccauauaaguuugaaggaa

SEQ ID NO: 2827991 - RNA, 22 nt, Human
ccauauaaguuugaaggaaaca

SEQ ID NO: 2827992 - RNA, 16 nt, Human
ccauauauaacagaua

SEQ ID NO: 2827993 - RNA, 21 nt, Human
ccauauauaacagauacauuu

SEQ ID NO: 2827994 - RNA, 14 nt, Human
ccauauauauauau

SEQ ID NO: 2827995 - RNA, 15 nt, Human
ccauauauccuuuuc

SEQ ID NO: 2827996 - RNA, 15 nt, Human
ccauaugaucuguuu

SEQ ID NO: 2827997 - RNA, 13 nt, Human
ccaucacaggguu

SEQ ID NO: 2827998 - RNA, 16 nt, Human
ccaucacaauacagau

SEQ ID NO: 2827999 - RNA, 17 nt, Human
ccaucacaauacagaua

SEQ ID NO: 2828000 - RNA, 20 nt, Human
ccaucacaggguugggccca

SEQ ID NO: 2828001 - RNA, 18 nt, Human
ccagugagggacgucaga

SEQ ID NO: 2828002 - RNA, 22 nt, Human
ccauaccacccaaugcugaugu

SEQ ID NO: 2828003 - RNA, 14 nt, Human
ccauaccagcucgc

SEQ ID NO: 2828004 - RNA, 12 nt, Human
ccauacuaauua

SEQ ID NO: 2828005 - RNA, 23 nt, Human
ccauacuaauuauacccccugca

SEQ ID NO: 2828006 - RNA, 13 nt, Human
ccauacuaauuau

SEQ ID NO: 2828007 - RNA, 13 nt, Human
ccauacucagccu

SEQ ID NO: 2828008 - RNA, 14 nt, Human
ccauacucagccug

SEQ ID NO: 2828009 - RNA, 15 nt, Human
ccauacucagccugc

SEQ ID NO: 2828010 - RNA, 21 nt, Human
ccauacucagccugcugccca

SEQ ID NO: 2828011 - RNA, 14 nt, Human
ccauacucauuucu

SEQ ID NO: 2828012 - RNA, 15 nt, Human
ccauacucauuucua

SEQ ID NO: 2828013 - RNA, 17 nt, Human
ccauacuuaucucucug

SEQ ID NO: 2828014 - RNA, 15 nt, Human
ccaucucccacccug

SEQ ID NO: 2828015 - RNA, 16 nt, Human
ccaucucccacccugu

SEQ ID NO: 2828016 - RNA, 17 nt, Human
ccaucucccacccugua

SEQ ID NO: 2828017 - RNA, 18 nt, Human
ccaucucgcucccuccca

SEQ ID NO: 2828018 - RNA, 22 nt, Human
ccaucucgcucccucccaggac

SEQ ID NO: 2828019 - RNA, 13 nt, Human
ccaucucggagca

SEQ ID NO: 2828020 - RNA, 20 nt, Human
ccaucucggagcaucccgga

SEQ ID NO: 2828021 - RNA, 21 nt, Human
ccaucucggagcaucccggag

SEQ ID NO: 2828022 - RNA, 22 nt, Human
ccaucucggagcaucccggagg

SEQ ID NO: 2828023 - RNA, 23 nt, Human
ccaucucggagcaucccggagga

SEQ ID NO: 2828024 - RNA, 20 nt, Human
ccaucucgggcacaggccca

SEQ ID NO: 2828025 - RNA, 23 nt, Human
ccaucucuauauaaaaacaaaaa

SEQ ID NO: 2828026 - RNA, 18 nt, Human
ccaucucucauccuccag

SEQ ID NO: 2828027 - RNA, 17 nt, Human
ccaucuccuuucaggga

SEQ ID NO: 2828028 - RNA, 16 nt, Human
ccaucuccuuucaggg

SEQ ID NO: 2828029 - RNA, 20 nt, Human
ccaucuccuauaaucuguca

SEQ ID NO: 2828030 - RNA, 21 nt, Human
ccaucuccuauaaucugucaa

SEQ ID NO: 2828031 - RNA, 22 nt, Human
ccaucuccuauaaucugucaaa

SEQ ID NO: 2828032 - RNA, 23 nt, Human
ccaucuccuauaaucugucaaaa

SEQ ID NO: 2828033 - RNA, 18 nt, Human
ccaucuccuuucagggaa

SEQ ID NO: 2828034 - RNA, 16 nt, Human
ccauccacucuacccu

SEQ ID NO: 2828035 - RNA, 19 nt, Human
ccauccaccgcugcuccac

SEQ ID NO: 2828036 - RNA, 16 nt, Human
ccaucaguuagagcug

SEQ ID NO: 2828037 - RNA, 18 nt, Human
ccaucauugcugucugca

SEQ ID NO: 2828038 - RNA, 22 nt, Human
ccaucauugcugucugcagccu

SEQ ID NO: 2828039 - RNA, 22 nt, Human
ccauccacucuacccucccacc

SEQ ID NO: 2828040 - RNA, 19 nt, Human
ccauccacucuacccuccc

SEQ ID NO: 2828041 - RNA, 13 nt, Human
ccauccagcuugc

SEQ ID NO: 2828042 - RNA, 15 nt, Human
ccauccagcuugcca

SEQ ID NO: 2828043 - RNA, 16 nt, Human
ccauccagcuugccag

SEQ ID NO: 2828044 - RNA, 21 nt, Human
ccaucagcccaacgggaagca

SEQ ID NO: 2828045 - RNA, 18 nt, Human
ccauccacuuacauauau

SEQ ID NO: 2828046 - RNA, 14 nt, Human
ccaugaagacagga

SEQ ID NO: 2828047 - RNA, 15 nt, Human
ccaugaagacaggau

SEQ ID NO: 2828048 - RNA, 23 nt, Human
ccaucugcuuuuauuaaauuugu

SEQ ID NO: 2828049 - RNA, 12 nt, Human
ccaugaugcugg

SEQ ID NO: 2828050 - RNA, 11 nt, Human
ccaugaagccu

SEQ ID NO: 2828051 - RNA, 12 nt, Human
ccaugaagccuu

SEQ ID NO: 2828052 - RNA, 13 nt, Human
ccaugaagccuuu

SEQ ID NO: 2828053 - RNA, 14 nt, Human
ccaugaagccuuuu

SEQ ID NO: 2828054 - RNA, 16 nt, Human
ccaugaagccuuuuga

SEQ ID NO: 2828055 - RNA, 13 nt, Human
ccaugauggccag

SEQ ID NO: 2828056 - RNA, 18 nt, Human
ccaugauggccaggcuga

SEQ ID NO: 2828057 - RNA, 22 nt, Human
ccaucuggguccuugcaccccu

SEQ ID NO: 2828058 - RNA, 23 nt, Human
ccaucuggguccuugcaccccuc

SEQ ID NO: 2828059 - RNA, 12 nt, Human
ccaugaagacag

SEQ ID NO: 2828060 - RNA, 14 nt, Human
ccaugaagaauucc

SEQ ID NO: 2828061 - RNA, 19 nt, Human
ccaugaagacaggacagug

SEQ ID NO: 2828062 - RNA, 17 nt, Human
ccaugaagacaggacag

SEQ ID NO: 2828063 - RNA, 16 nt, Human
ccaugaagacaggaca

SEQ ID NO: 2828064 - RNA, 13 nt, Human
ccaugaagacagg

SEQ ID NO: 2828065 - RNA, 12 nt, Human
ccaucuggccug

SEQ ID NO: 2828066 - RNA, 13 nt, Human
ccaucuggccugg

SEQ ID NO: 2828067 - RNA, 14 nt, Human
ccaucuggccuggc

SEQ ID NO: 2828068 - RNA, 15 nt, Human
ccaucuggccuggcc

SEQ ID NO: 2828069 - RNA, 16 nt, Human
ccaucuggccuggccu

SEQ ID NO: 2828070 - RNA, 17 nt, Human
ccaucuggccuggccug

SEQ ID NO: 2828071 - RNA, 18 nt, Human
ccaucuggccuggccugg

SEQ ID NO: 2828072 - RNA, 22 nt, Human
ccaucuggccuggccuggcccu

SEQ ID NO: 2828073 - RNA, 17 nt, Human
ccaucuggguccuugca

SEQ ID NO: 2828074 - RNA, 18 nt, Human
ccaucuggguccuugcac

SEQ ID NO: 2828075 - RNA, 22 nt, Human
ccaucugggcuccuaaccuucc

SEQ ID NO: 2828076 - RNA, 22 nt, Human
ccaugcaagaacucaucacugu

SEQ ID NO: 2828077 - RNA, 23 nt, Human
ccaugauucuauuuauauguaca

SEQ ID NO: 2828078 - RNA, 17 nt, Human
ccaugcaauucauccca

SEQ ID NO: 2828079 - RNA, 12 nt, Human
ccaugcaccaaa

SEQ ID NO: 2828080 - RNA, 13 nt, Human
ccaugcaccaaac

SEQ ID NO: 2828081 - RNA, 16 nt, Human
ccaugcugggaagacg

SEQ ID NO: 2828082 - RNA, 15 nt, Human
ccaugcuccucacug

SEQ ID NO: 2828083 - RNA, 16 nt, Human
ccaugcuccucacugc

SEQ ID NO: 2828084 - RNA, 17 nt, Human
ccaugcuccucacugcc

SEQ ID NO: 2828085 - RNA, 21 nt, Human
ccaugcuccucacugcccgca

SEQ ID NO: 2828086 - RNA, 22 nt, Human
ccaugcuccucacugcccgcac

SEQ ID NO: 2828087 - RNA, 14 nt, Human
ccaugccaggaacc

SEQ ID NO: 2828088 - RNA, 18 nt, Human
ccaugcaugacagccucu

SEQ ID NO: 2828089 - RNA, 11 nt, Human
ccaugcauuuc

SEQ ID NO: 2828090 - RNA, 20 nt, Human
ccaugcauuucauaaacuaa

SEQ ID NO: 2828091 - RNA, 15 nt, Human
ccaugcccaccugcc

SEQ ID NO: 2828092 - RNA, 13 nt, Human
ccaugcccaccug

SEQ ID NO: 2828093 - RNA, 21 nt, Human
ccaugcccaccugcccaucac

SEQ ID NO: 2828094 - RNA, 18 nt, Human
ccaugcccaccugcccau

SEQ ID NO: 2828095 - RNA, 17 nt, Human
ccaugcccaccugccca

SEQ ID NO: 2828096 - RNA, 16 nt, Human
ccaugcccaccugccc

SEQ ID NO: 2828097 - RNA, 20 nt, Human
ccaugccaaagcuagggugg

SEQ ID NO: 2828098 - RNA, 13 nt, Human
ccaugccacguuc

SEQ ID NO: 2828099 - RNA, 18 nt, Human
ccaugccacguuccacag

SEQ ID NO: 2828100 - RNA, 21 nt, Human
ccaugccacguuccacaguug

SEQ ID NO: 2828101 - RNA, 13 nt, Human
ccaugcaggcccu

SEQ ID NO: 2828102 - RNA, 14 nt, Human
ccaugcaggcccuu

SEQ ID NO: 2828103 - RNA, 17 nt, Human
ccaugcaggcccuuuga

SEQ ID NO: 2828104 - RNA, 12 nt, Human
ccaugcaggggg

SEQ ID NO: 2828105 - RNA, 19 nt, Human
ccaugcagggggcuccugg

SEQ ID NO: 2828106 - RNA, 15 nt, Human
ccaugccaggaaccu

SEQ ID NO: 2828107 - RNA, 17 nt, Human
cccaaacaaauaugcaa

SEQ ID NO: 2828108 - RNA, 20 nt, Human
cccaaacaaauaugcaaaag

SEQ ID NO: 2828109 - RNA, 20 nt, Human
ccauuuugggguacccacug

SEQ ID NO: 2828110 - RNA, 22 nt, Human
ccauuuugggguacccacugcu

SEQ ID NO: 2828111 - RNA, 19 nt, Human
cccaaagcagcccuucccc

SEQ ID NO: 2828112 - RNA, 21 nt, Human
cccaaagagcacaaacauuuu

SEQ ID NO: 2828113 - RNA, 13 nt, Human
cccaaacccuagg

SEQ ID NO: 2828114 - RNA, 14 nt, Human
cccaaaagauugcu

SEQ ID NO: 2828115 - RNA, 12 nt, Human
cccaaacuguga

SEQ ID NO: 2828116 - RNA, 22 nt, Human
cccaaacuguucaagaaauaau

SEQ ID NO: 2828117 - RNA, 16 nt, Human
cccaaacaccuuccag

SEQ ID NO: 2828118 - RNA, 19 nt, Human
cccaaacaccuuccagcuc

SEQ ID NO: 2828119 - RNA, 21 nt, Human
cccaaacaccuuccagcuccu

SEQ ID NO: 2828120 - RNA, 22 nt, Human
cccaaacaccuuccagcuccug

SEQ ID NO: 2828121 - RNA, 18 nt, Human
ccauucugccugcccagg

SEQ ID NO: 2828122 - RNA, 17 nt, Human
ccauucugccugcccag

SEQ ID NO: 2828123 - RNA, 16 nt, Human
ccauucugccugccca

SEQ ID NO: 2828124 - RNA, 20 nt, Human
ccauucugccugcccaggcc

SEQ ID NO: 2828125 - RNA, 19 nt, Human
ccauucugccugcccaggc

SEQ ID NO: 2828126 - RNA, 21 nt, Human
ccauucugccugcccaggccc

SEQ ID NO: 2828127 - RNA, 14 nt, Human
ccauggacuuuaua

SEQ ID NO: 2828128 - RNA, 21 nt, Human
ccaugcugggaagacgccuga

SEQ ID NO: 2828129 - RNA, 16 nt, Human
ccaggugccuuucaaa

SEQ ID NO: 2828130 - RNA, 18 nt, Human
ccaggugccuuucaaauu

SEQ ID NO: 2828131 - RNA, 20 nt, Human
ccaggugccuuucaaauuua

SEQ ID NO: 2828132 - RNA, 21 nt, Human
ccaggugccuuucaaauuuag

SEQ ID NO: 2828133 - RNA, 15 nt, Human
ccaggugcccagcua

SEQ ID NO: 2828134 - RNA, 13 nt, Human
ccaggugcccagc

SEQ ID NO: 2828135 - RNA, 15 nt, Human
ccaggucucacgggc

SEQ ID NO: 2828136 - RNA, 16 nt, Human
ccaggucucacgggca

SEQ ID NO: 2828137 - RNA, 23 nt, Human
ccaggucucacgggcaugggcac

SEQ ID NO: 2828138 - RNA, 23 nt, Human
ccaggucugggaagcugagggca

SEQ ID NO: 2828139 - RNA, 13 nt, Human
ccaggucaacaga

SEQ ID NO: 2828140 - RNA, 14 nt, Human
ccaggucaacagaa

SEQ ID NO: 2828141 - RNA, 19 nt, Human
ccaggucaacagaaugaaa

SEQ ID NO: 2828142 - RNA, 20 nt, Human
ccaggucaacagaaugaaaa

SEQ ID NO: 2828143 - RNA, 21 nt, Human
ccaggucaacagaaugaaaaa

SEQ ID NO: 2828144 - RNA, 22 nt, Human
ccaggucaacagaaugaaaaau

SEQ ID NO: 2828145 - RNA, 14 nt, Human
ccaggucacacgac

SEQ ID NO: 2828146 - RNA, 21 nt, Human
ccagggccuggaagacagaga

SEQ ID NO: 2828147 - RNA, 16 nt, Human
ccagggccuggaagac

SEQ ID NO: 2828148 - RNA, 17 nt, Human
ccagggccuggaagaca

SEQ ID NO: 2828149 - RNA, 19 nt, Human
ccagggccuggaagacaga

SEQ ID NO: 2828150 - RNA, 20 nt, Human
ccagggccuggaagacagag

SEQ ID NO: 2828151 - RNA, 15 nt, Human
ccaggucccccugca

SEQ ID NO: 2828152 - RNA, 16 nt, Human
ccaggucccccugcag

SEQ ID NO: 2828153 - RNA, 17 nt, Human
ccaggucccccugcagc

SEQ ID NO: 2828154 - RNA, 18 nt, Human
ccaggucccccugcagcu

SEQ ID NO: 2828155 - RNA, 12 nt, Human
ccagguccccuc

SEQ ID NO: 2828156 - RNA, 20 nt, Human
ccagugaauucuugaaggaa

SEQ ID NO: 2828157 - RNA, 16 nt, Human
ccagugaauucuugaa

SEQ ID NO: 2828158 - RNA, 20 nt, Human
ccagugaaaucaguuacucu

SEQ ID NO: 2828159 - RNA, 12 nt, Human
ccagucuugugu

SEQ ID NO: 2828160 - RNA, 18 nt, Human
ccagucuuuaaaggccca

SEQ ID NO: 2828161 - RNA, 19 nt, Human
ccagucuuuaaaggcccag

SEQ ID NO: 2828162 - RNA, 20 nt, Human
ccagucuuuaaaggcccagc

SEQ ID NO: 2828163 - RNA, 21 nt, Human
ccagucuuuaaaggcccagcc

SEQ ID NO: 2828164 - RNA, 22 nt, Human
ccagucuuuaaaggcccagccc

SEQ ID NO: 2828165 - RNA, 23 nt, Human
ccagucuuuaaaggcccagcccc

SEQ ID NO: 2828166 - RNA, 18 nt, Human
ccaguaucuauauaugug

SEQ ID NO: 2828167 - RNA, 14 nt, Human
ccaguaccuugcuu

SEQ ID NO: 2828168 - RNA, 18 nt, Human
ccaguaccuccugucucu

SEQ ID NO: 2828169 - RNA, 20 nt, Human
ccaguaccuccugucucugg

SEQ ID NO: 2828170 - RNA, 22 nt, Human
ccaguaccuccugucucuggcc

SEQ ID NO: 2828171 - RNA, 20 nt, Human
ccaguaggggcuuauaauaa

SEQ ID NO: 2828172 - RNA, 14 nt, Human
ccaguaucuauaua

SEQ ID NO: 2828173 - RNA, 14 nt, Human
ccagguucagcuug

SEQ ID NO: 2828174 - RNA, 16 nt, Human
ccagguuaucugggca

SEQ ID NO: 2828175 - RNA, 15 nt, Human
ccagguucaacccac

SEQ ID NO: 2828176 - RNA, 20 nt, Human
ccagguucaacccacagcua

SEQ ID NO: 2828177 - RNA, 20 nt, Human
ccagguucaagcgauucucc

SEQ ID NO: 2828178 - RNA, 22 nt, Human
ccagguucaagcgauucuccug

SEQ ID NO: 2828179 - RNA, 23 nt, Human
ccagguucaagcgauucuccugc

SEQ ID NO: 2828180 - RNA, 21 nt, Human
ccagguguuacuguaauuccu

SEQ ID NO: 2828181 - RNA, 17 nt, Human
ccagguguuacuguaau

SEQ ID NO: 2828182 - RNA, 22 nt, Human
ccagguguguccaccugggcau

SEQ ID NO: 2828183 - RNA, 19 nt, Human
ccagguguuaacauuccaa

SEQ ID NO: 2828184 - RNA, 20 nt, Human
ccagguguuaacauuccaag

SEQ ID NO: 2828185 - RNA, 23 nt, Human
ccagguguuaacauuccaagacu

SEQ ID NO: 2828186 - RNA, 22 nt, Human
ccaguaacgggucguaaugacu

SEQ ID NO: 2828187 - RNA, 13 nt, Human
ccaggccccugcc

SEQ ID NO: 2828188 - RNA, 15 nt, Human
ccaggcccccaccac

SEQ ID NO: 2828189 - RNA, 19 nt, Human
ccaggcccccaccacacau

SEQ ID NO: 2828190 - RNA, 20 nt, Human
ccaggcccccaccacacauc

SEQ ID NO: 2828191 - RNA, 21 nt, Human
ccaggcccccaccacacaucc

SEQ ID NO: 2828192 - RNA, 22 nt, Human
ccaggcccccaccacacauccc

SEQ ID NO: 2828193 - RNA, 23 nt, Human
ccaggcccccaccacacauccca

SEQ ID NO: 2828194 - RNA, 19 nt, Human
ccaggcuggucucaaacuc

SEQ ID NO: 2828195 - RNA, 21 nt, Human
ccaggcuggucucgaacuccu

SEQ ID NO: 2828196 - RNA, 20 nt, Human
ccaggcuguaucccaugagc

SEQ ID NO: 2828197 - RNA, 17 nt, Human
ccaggcuugccugcagg

SEQ ID NO: 2828198 - RNA, 13 nt, Human
ccaggcuggucuu

SEQ ID NO: 2828199 - RNA, 22 nt, Human
ccaggcuggucuugaaguccug

SEQ ID NO: 2828200 - RNA, 21 nt, Human
ccaggcugguuucgaacuccu

SEQ ID NO: 2828201 - RNA, 18 nt, Human
ccaggcuugccugcaggc

SEQ ID NO: 2828202 - RNA, 17 nt, Human
ccagggaagcugucccu

SEQ ID NO: 2828203 - RNA, 22 nt, Human
ccagggcacccuguggcccugg

SEQ ID NO: 2828204 - RNA, 23 nt, Human
ccagggcacccuguggcccuggc

SEQ ID NO: 2828205 - RNA, 18 nt, Human
ccagggaagcuggccgag

SEQ ID NO: 2828206 - RNA, 17 nt, Human
ccagggaagcuggccga

SEQ ID NO: 2828207 - RNA, 18 nt, Human
ccaggcuuuguacagagu

SEQ ID NO: 2828208 - RNA, 12 nt, Human
ccagggcagugc

SEQ ID NO: 2828209 - RNA, 14 nt, Human
ccagggcagugcua

SEQ ID NO: 2828210 - RNA, 17 nt, Human
ccagggcagugcuagug

SEQ ID NO: 2828211 - RNA, 22 nt, Human
ccagggcagugcuagugagcug

SEQ ID NO: 2828212 - RNA, 23 nt, Human
ccagggcagugcuagugagcugg

SEQ ID NO: 2828213 - RNA, 15 nt, Human
ccaggagccccgagg

SEQ ID NO: 2828214 - RNA, 15 nt, Human
ccaggagcugucacc

SEQ ID NO: 2828215 - RNA, 23 nt, Human
ccaggagcugucaccaaggaaac

SEQ ID NO: 2828216 - RNA, 19 nt, Human
ccaggcaggugccuggaca

SEQ ID NO: 2828217 - RNA, 20 nt, Human
ccaggaauauugucauccuu

SEQ ID NO: 2828218 - RNA, 19 nt, Human
ccaggaauuugggacccug

SEQ ID NO: 2828219 - RNA, 20 nt, Human
ccaggaauuugggacccugc

SEQ ID NO: 2828220 - RNA, 22 nt, Human
ccaggaauuugggacccugcuu

SEQ ID NO: 2828221 - RNA, 23 nt, Human
ccaggaauuugggacccugcuuu

SEQ ID NO: 2828222 - RNA, 19 nt, Human
ccagcugggcucugcaauu

SEQ ID NO: 2828223 - RNA, 14 nt, Human
ccaggaccaagcca

SEQ ID NO: 2828224 - RNA, 13 nt, Human
ccaggacagucag

SEQ ID NO: 2828225 - RNA, 22 nt, Human
ccaggacaccacacccagccuc

SEQ ID NO: 2828226 - RNA, 23 nt, Human
ccaggacaccacacccagccuca

SEQ ID NO: 2828227 - RNA, 17 nt, Human
ccaggacaccacaccca

SEQ ID NO: 2828228 - RNA, 18 nt, Human
ccaggacaccacacccag

SEQ ID NO: 2828229 - RNA, 19 nt, Human
ccaggacaccacacccagc

SEQ ID NO: 2828230 - RNA, 20 nt, Human
ccaggacaccacacccagcc

SEQ ID NO: 2828231 - RNA, 21 nt, Human
ccaggacaccacacccagccu

SEQ ID NO: 2828232 - RNA, 22 nt, Human
ccaggacucccuccucaccucu

SEQ ID NO: 2828233 - RNA, 18 nt, Human
ccaggacucccuccucac

SEQ ID NO: 2828234 - RNA, 17 nt, Human
ccaggacucccuccuca

SEQ ID NO: 2828235 - RNA, 16 nt, Human
ccaggacucccuccuc

SEQ ID NO: 2828236 - RNA, 23 nt, Human
ccaggacucccuccucaccucug

SEQ ID NO: 2828237 - RNA, 14 nt, Human
ccaggacuccuccc

SEQ ID NO: 2828238 - RNA, 17 nt, Human
ccaggacuccuccccac

SEQ ID NO: 2828239 - RNA, 11 nt, Human
ccaggacucug

SEQ ID NO: 2828240 - RNA, 22 nt, Human
ccaggacucugaccccagcauu

SEQ ID NO: 2828241 - RNA, 18 nt, Human
ccaggacucugaccccag

SEQ ID NO: 2828242 - RNA, 14 nt, Human
ccaggacucugacc

SEQ ID NO: 2828243 - RNA, 13 nt, Human
ccaggacucugac

SEQ ID NO: 2828244 - RNA, 14 nt, Human
ccaggacucccucc

SEQ ID NO: 2828245 - RNA, 22 nt, Human
ccagacaaggaaauacccuucu

SEQ ID NO: 2828246 - RNA, 12 nt, Human
ccagcugccucc

SEQ ID NO: 2828247 - RNA, 16 nt, Human
ccagcugcaggaauca

SEQ ID NO: 2828248 - RNA, 19 nt, Human
ccagcugcaggaaucaaaa

SEQ ID NO: 2828249 - RNA, 20 nt, Human
ccagcugcaggaaucaaaaa

SEQ ID NO: 2828250 - RNA, 23 nt, Human
ccagcugcaggaaucaaaaauug

SEQ ID NO: 2828251 - RNA, 24 nt, Human
ccagcuggagaaauaugguacuca

SEQ ID NO: 2828252 - RNA, 15 nt, Human
ccagcugcugcucug

SEQ ID NO: 2828253 - RNA, 16 nt, Human
ccagcugcugcucuga

SEQ ID NO: 2828254 - RNA, 11 nt, Human
ccagcugcugu

SEQ ID NO: 2828255 - RNA, 13 nt, Human
ccagcugcugucu

SEQ ID NO: 2828256 - RNA, 14 nt, Human
ccagcugcugucuu

SEQ ID NO: 2828257 - RNA, 19 nt, Human
ccagcugcugucuucugga

SEQ ID NO: 2828258 - RNA, 16 nt, Human
ccagcugggcucugca

SEQ ID NO: 2828259 - RNA, 18 nt, Human
ccagcugggcucugcaau

SEQ ID NO: 2828260 - RNA, 18 nt, Human
ccagccuucuuccauccc

SEQ ID NO: 2828261 - RNA, 19 nt, Human
ccagccuucuuccauccca

SEQ ID NO: 2828262 - RNA, 22 nt, Human
ccagccuucuuccaucccagga

SEQ ID NO: 2828263 - RNA, 16 nt, Human
ccagagcccaccuugg

SEQ ID NO: 2828264 - RNA, 12 nt, Human
ccagagcagggu

SEQ ID NO: 2828265 - RNA, 14 nt, Human
ccagagcagggugu

SEQ ID NO: 2828266 - RNA, 22 nt, Human
ccagagcccaccuuggcucaag

SEQ ID NO: 2828267 - RNA, 18 nt, Human
ccagagcauuuccaacac

SEQ ID NO: 2828268 - RNA, 16 nt, Human
ccagcgagcccuggug

SEQ ID NO: 2828269 - RNA, 15 nt, Human
ccagcgagcccuggu

SEQ ID NO: 2828270 - RNA, 14 nt, Human
ccagcgagcccugg

SEQ ID NO: 2828271 - RNA, 14 nt, Human
ccagcucuggcuuc

SEQ ID NO: 2828272 - RNA, 12 nt, Human
ccagcucuggcu

SEQ ID NO: 2828273 - RNA, 13 nt, Human
ccacucccaggca

SEQ ID NO: 2828274 - RNA, 15 nt, Human
ccacucccaggcagc

SEQ ID NO: 2828275 - RNA, 14 nt, Human
ccacucccaguccc

SEQ ID NO: 2828276 - RNA, 13 nt, Human
ccacuccauuccc

SEQ ID NO: 2828277 - RNA, 14 nt, Human
ccacuccauuccca

SEQ ID NO: 2828278 - RNA, 12 nt, Human
ccacuuaccuag

SEQ ID NO: 2828279 - RNA, 18 nt, Human
ccacuuacauauauuuuu

SEQ ID NO: 2828280 - RNA, 20 nt, Human
ccacuuacauauauuuuuaa

SEQ ID NO: 2828281 - RNA, 19 nt, Human
ccacuuagaaauugcauuu

SEQ ID NO: 2828282 - RNA, 14 nt, Human
ccacucccaggcag

SEQ ID NO: 2828283 - RNA, 16 nt, Human
ccagaaaucauuuuac

SEQ ID NO: 2828284 - RNA, 17 nt, Human
ccagaacaacaacuauc

SEQ ID NO: 2828285 - RNA, 13 nt, Human
ccagaaauuagaa

SEQ ID NO: 2828286 - RNA, 22 nt, Human
ccagaaaugucuaaaugcugaa

SEQ ID NO: 2828287 - RNA, 17 nt, Human
ccagaaauuagaaaccu

SEQ ID NO: 2828288 - RNA, 24 nt, Human
ccagaaacuguucccaccugcugg

SEQ ID NO: 2828289 - RNA, 20 nt, Human
ccacuucaaugcacauggug

SEQ ID NO: 2828290 - RNA, 16 nt, Human
ccagaaaggagacuag

SEQ ID NO: 2828291 - RNA, 14 nt, Human
ccagaaaggagacu

SEQ ID NO: 2828292 - RNA, 21 nt, Human
ccacuuagaaauugcauuucc

SEQ ID NO: 2828293 - RNA, 18 nt, Human
ccacuccagcgcugagug

SEQ ID NO: 2828294 - RNA, 16 nt, Human
ccacuuaggcuuugua

SEQ ID NO: 2828295 - RNA, 22 nt, Human
ccacuuauuccccauucuuccu

SEQ ID NO: 2828296 - RNA, 13 nt, Human
ccagaaguugugg

SEQ ID NO: 2828297 - RNA, 22 nt, Human
ccagaaguuguggauuucaguu

SEQ ID NO: 2828298 - RNA, 23 nt, Human
ccagaaguuguggauuucaguuu

SEQ ID NO: 2828299 - RNA, 22 nt, Human
ccagaagauagcuucaccccaa

SEQ ID NO: 2828300 - RNA, 24 nt, Human
ccagaagauccccucaggacugca

SEQ ID NO: 2828301 - RNA, 18 nt, Human
ccagaagauccccucagg

SEQ ID NO: 2828302 - RNA, 22 nt, Human
ccagaagauccccucaggacug

SEQ ID NO: 2828303 - RNA, 20 nt, Human
ccagaacacggcucacgcuu

SEQ ID NO: 2828304 - RNA, 21 nt, Human
ccagaagaagagaagcugcug

SEQ ID NO: 2828305 - RNA, 22 nt, Human
ccagaagaagagaagcugcuga

SEQ ID NO: 2828306 - RNA, 23 nt, Human
ccagaagaagagaagcugcugac

SEQ ID NO: 2828307 - RNA, 17 nt, Human
ccagaagaagauggcug

SEQ ID NO: 2828308 - RNA, 21 nt, Human
ccagacaccuugacagggcac

SEQ ID NO: 2828309 - RNA, 13 nt, Human
ccagaauuuggaa

SEQ ID NO: 2828310 - RNA, 15 nt, Human
ccagaauuuggaaau

SEQ ID NO: 2828311 - RNA, 16 nt, Human
ccagaauuuggaaauc

SEQ ID NO: 2828312 - RNA, 17 nt, Human
ccagaauuuggaaaucc

SEQ ID NO: 2828313 - RNA, 18 nt, Human
ccagaauuuggaaauccu

SEQ ID NO: 2828314 - RNA, 21 nt, Human
ccagaauuuggaaauccuagu

SEQ ID NO: 2828315 - RNA, 23 nt, Human
ccagaauuuggaaauccuaguuu

SEQ ID NO: 2828316 - RNA, 23 nt, Human
ccagaauggucuuucuaaugugu

SEQ ID NO: 2828317 - RNA, 16 nt, Human
ccagaaugcuuuagga

SEQ ID NO: 2828318 - RNA, 21 nt, Human
ccagaaugcuguacaucuauu

SEQ ID NO: 2828319 - RNA, 20 nt, Human
ccagaauugugcaaauggaa

SEQ ID NO: 2828320 - RNA, 13 nt, Human
ccagaauuucaaa

SEQ ID NO: 2828321 - RNA, 17 nt, Human
ccagacagacaacacug

SEQ ID NO: 2828322 - RNA, 22 nt, Human
ccagacagacaucucugcaccc

SEQ ID NO: 2828323 - RNA, 11 nt, Human
ccagacagacc

SEQ ID NO: 2828324 - RNA, 12 nt, Human
ccagacagaggg

SEQ ID NO: 2828325 - RNA, 15 nt, Human
ccagacagaggguca

SEQ ID NO: 2828326 - RNA, 17 nt, Human
ccagacagagggucaca

SEQ ID NO: 2828327 - RNA, 23 nt, Human
ccagacagagggucacaguguuu

SEQ ID NO: 2828328 - RNA, 23 nt, Human
ccagacacugaccauccacucua

SEQ ID NO: 2828329 - RNA, 19 nt, Human
ccagacagacaucucugca

SEQ ID NO: 2828330 - RNA, 18 nt, Human
ccagacagacaucucugc

SEQ ID NO: 2828331 - RNA, 14 nt, Human
ccagaccccuggcu

SEQ ID NO: 2828332 - RNA, 15 nt, Human
ccagagcagaugcag

SEQ ID NO: 2828333 - RNA, 16 nt, Human
ccagagcagaugcaga

SEQ ID NO: 2828334 - RNA, 17 nt, Human
ccagagcagaugcagag

SEQ ID NO: 2828335 - RNA, 18 nt, Human
ccagagcagaugcagaga

SEQ ID NO: 2828336 - RNA, 20 nt, Human
ccagagcagaugcagagagc

SEQ ID NO: 2828337 - RNA, 22 nt, Human
ccagagcagaugcagagagcca

SEQ ID NO: 2828338 - RNA, 23 nt, Human
ccagagcagaugcagagagccau

SEQ ID NO: 2828339 - RNA, 14 nt, Human
ccagagcaggaagc

SEQ ID NO: 2828340 - RNA, 15 nt, Human
ccagagcaggaagca

SEQ ID NO: 2828341 - RNA, 15 nt, Human
ccagaccccuggcuu

SEQ ID NO: 2828342 - RNA, 16 nt, Human
ccagaccccuggcuuu

SEQ ID NO: 2828343 - RNA, 14 nt, Human
ccagagcagaugca

SEQ ID NO: 2828344 - RNA, 17 nt, Human
ccagaccccuggcuuuu

SEQ ID NO: 2828345 - RNA, 22 nt, Human
ccacuacaugcagcccaugccc

SEQ ID NO: 2828346 - RNA, 22 nt, Human
ccacuacacuccagccugagca

SEQ ID NO: 2828347 - RNA, 21 nt, Human
ccacuacacuccagccugagc

SEQ ID NO: 2828348 - RNA, 20 nt, Human
ccacuacacuccagccugag

SEQ ID NO: 2828349 - RNA, 21 nt, Human
ccacuagaacucuccaucuua

SEQ ID NO: 2828350 - RNA, 18 nt, Human
ccacuaggacucugaggc

SEQ ID NO: 2828351 - RNA, 16 nt, Human
ccacuaggacucugag

SEQ ID NO: 2828352 - RNA, 17 nt, Human
ccacuagacccacugga

SEQ ID NO: 2828353 - RNA, 15 nt, Human
ccacuagacccacug

SEQ ID NO: 2828354 - RNA, 20 nt, Human
ccacuauaaaaugucuucaa

SEQ ID NO: 2828355 - RNA, 16 nt, Human
ccacuauccuucguga

SEQ ID NO: 2828356 - RNA, 20 nt, Human
ccacuaggacucugaggcuc

SEQ ID NO: 2828357 - RNA, 19 nt, Human
ccacuaggacucugaggcu

SEQ ID NO: 2828358 - RNA, 22 nt, Human
ccacuaguaaguaauuaugcac

SEQ ID NO: 2828359 - RNA, 23 nt, Human
ccacuaguaaguaauuaugcacu

SEQ ID NO: 2828360 - RNA, 12 nt, Human
ccacucagcccc

SEQ ID NO: 2828361 - RNA, 13 nt, Human
ccacucagccccu

SEQ ID NO: 2828362 - RNA, 14 nt, Human
ccacucagccccua

SEQ ID NO: 2828363 - RNA, 15 nt, Human
ccacucagccccuag

SEQ ID NO: 2828364 - RNA, 16 nt, Human
ccacucagccccuagg

SEQ ID NO: 2828365 - RNA, 17 nt, Human
ccacucagccccuagga

SEQ ID NO: 2828366 - RNA, 18 nt, Human
ccacucagccccuaggag

SEQ ID NO: 2828367 - RNA, 16 nt, Human
ccacuagacucuucac

SEQ ID NO: 2828368 - RNA, 13 nt, Human
ccacucagcuucc

SEQ ID NO: 2828369 - RNA, 13 nt, Human
ccacucaggaggc

SEQ ID NO: 2828370 - RNA, 15 nt, Human
ccacucagcuccgug

SEQ ID NO: 2828371 - RNA, 11 nt, Human
ccacucagcuc

SEQ ID NO: 2828372 - RNA, 20 nt, Human
ccacucaggccaacaagcca

SEQ ID NO: 2828373 - RNA, 14 nt, Human
ccacucagggguca

SEQ ID NO: 2828374 - RNA, 13 nt, Human
ccacucaggccaa

SEQ ID NO: 2828375 - RNA, 20 nt, Human
ccacucaggaggcugaggca

SEQ ID NO: 2828376 - RNA, 14 nt, Human
ccacucagcuuccu

SEQ ID NO: 2828377 - RNA, 18 nt, Human
ccacucaggcauuugacu

SEQ ID NO: 2828378 - RNA, 20 nt, Human
ccacuccagaccccuggcuu

SEQ ID NO: 2828379 - RNA, 21 nt, Human
ccacuccagaccccuggcuuu

SEQ ID NO: 2828380 - RNA, 22 nt, Human
ccacuccagaccccuggcuuuu

SEQ ID NO: 2828381 - RNA, 13 nt, Human
ccacgcuggagug

SEQ ID NO: 2828382 - RNA, 16 nt, Human
ccacgcuggagugcag

SEQ ID NO: 2828383 - RNA, 18 nt, Human
ccaccugucucagccucc

SEQ ID NO: 2828384 - RNA, 16 nt, Human
ccaccugucucagccu

SEQ ID NO: 2828385 - RNA, 15 nt, Human
ccaccugucucagcc

SEQ ID NO: 2828386 - RNA, 12 nt, Human
ccaccugucuca

SEQ ID NO: 2828387 - RNA, 23 nt, Human
ccaccugucucagccucccagag

SEQ ID NO: 2828388 - RNA, 20 nt, Human
ccaccugucucagccuccca

SEQ ID NO: 2828389 - RNA, 18 nt, Human
ccaccccauccaguucau

SEQ ID NO: 2828390 - RNA, 11 nt, Human
ccaccugucuc

SEQ ID NO: 2828391 - RNA, 18 nt, Human
ccacggccaggccagagg

SEQ ID NO: 2828392 - RNA, 16 nt, Human
ccacggccaggccaga

SEQ ID NO: 2828393 - RNA, 19 nt, Human
ccacgcuggagugcaguga

SEQ ID NO: 2828394 - RNA, 18 nt, Human
ccacgcuggagugcagug

SEQ ID NO: 2828395 - RNA, 23 nt, Human
ccacggccaggccagagggagug

SEQ ID NO: 2828396 - RNA, 20 nt, Human
ccacggcguuguaccuguag

SEQ ID NO: 2828397 - RNA, 13 nt, Human
ccacggcuaagag

SEQ ID NO: 2828398 - RNA, 17 nt, Human
ccacggcuaagaggcug

SEQ ID NO: 2828399 - RNA, 18 nt, Human
ccacggcuaagaggcugc

SEQ ID NO: 2828400 - RNA, 21 nt, Human
ccacggcuaagaggcugcuga

SEQ ID NO: 2828401 - RNA, 12 nt, Human
ccaccccacacu

SEQ ID NO: 2828402 - RNA, 13 nt, Human
ccaccccacacuu

SEQ ID NO: 2828403 - RNA, 19 nt, Human
ccaccccagaaauggugaa

SEQ ID NO: 2828404 - RNA, 14 nt, Human
ccaccccagccccc

SEQ ID NO: 2828405 - RNA, 16 nt, Human
ccaccccaccugcagg

SEQ ID NO: 2828406 - RNA, 14 nt, Human
ccacuacacuccag

SEQ ID NO: 2828407 - RNA, 19 nt, Human
ccacuacacuccagccuga

SEQ ID NO: 2828408 - RNA, 18 nt, Human
ccacuacacuccagccug

SEQ ID NO: 2828409 - RNA, 15 nt, Human
ccacguauuccccuu

SEQ ID NO: 2828410 - RNA, 20 nt, Human
ccacguauuccccuucccac

SEQ ID NO: 2828411 - RNA, 14 nt, Human
ccacaggaaagugu

SEQ ID NO: 2828412 - RNA, 19 nt, Human
ccacaggaagccugcaguc

SEQ ID NO: 2828413 - RNA, 22 nt, Human
ccacaggaagccugcaguccug

SEQ ID NO: 2828414 - RNA, 12 nt, Human
ccacagcuuccu

SEQ ID NO: 2828415 - RNA, 14 nt, Human
ccacagcuuccugu

SEQ ID NO: 2828416 - RNA, 16 nt, Human
ccacagcugcuggaga

SEQ ID NO: 2828417 - RNA, 11 nt, Human
ccacagcuucc

SEQ ID NO: 2828418 - RNA, 12 nt, Human
ccacagcugcug

SEQ ID NO: 2828419 - RNA, 13 nt, Human
ccacagcugcugg

SEQ ID NO: 2828420 - RNA, 14 nt, Human
ccacagcugcugga

SEQ ID NO: 2828421 - RNA, 12 nt, Human
ccacacuccagc

SEQ ID NO: 2828422 - RNA, 14 nt, Human
ccacagcugcucaa

SEQ ID NO: 2828423 - RNA, 23 nt, Human
ccacacuaaccuggguucccuuu

SEQ ID NO: 2828424 - RNA, 22 nt, Human
ccacacuaaccuggguucccuu

SEQ ID NO: 2828425 - RNA, 16 nt, Human
ccacacuaaccugggu

SEQ ID NO: 2828426 - RNA, 21 nt, Human
ccacacccucccccgccacuc

SEQ ID NO: 2828427 - RNA, 16 nt, Human
ccacacccuguacugu

SEQ ID NO: 2828428 - RNA, 16 nt, Human
ccacaggaucagucug

SEQ ID NO: 2828429 - RNA, 17 nt, Human
ccacaggaagugaagaa

SEQ ID NO: 2828430 - RNA, 23 nt, Human
ccacaggaagccugcaguccugg

SEQ ID NO: 2828431 - RNA, 19 nt, Human
ccacaggaggcaagcaagc

SEQ ID NO: 2828432 - RNA, 21 nt, Human
ccacaggaggcaagcaagcuc

SEQ ID NO: 2828433 - RNA, 22 nt, Human
ccacaggaggcaagcaagcucu

SEQ ID NO: 2828434 - RNA, 20 nt, Human
ccacaggagugggaaaacac

SEQ ID NO: 2828435 - RNA, 15 nt, Human
ccacaggcccuuccu

SEQ ID NO: 2828436 - RNA, 16 nt, Human
ccacaggcccuuccuc

SEQ ID NO: 2828437 - RNA, 23 nt, Human
ccacaggcccuuccucuccacug

SEQ ID NO: 2828438 - RNA, 17 nt, Human
ccacaggcccuuccucu

SEQ ID NO: 2828439 - RNA, 18 nt, Human
ccacaggcccuuccucuc

SEQ ID NO: 2828440 - RNA, 19 nt, Human
ccacaggcccuuccucucc

SEQ ID NO: 2828441 - RNA, 22 nt, Human
ccacaggcccuuccucuccacu

SEQ ID NO: 2828442 - RNA, 15 nt, Human
ccacacccagcccac

SEQ ID NO: 2828443 - RNA, 20 nt, Human
ccacacccagcccacuucug

SEQ ID NO: 2828444 - RNA, 22 nt, Human
ccacacccagcccacuucugcc

SEQ ID NO: 2828445 - RNA, 21 nt, Human
ccacacccagcccacuucugc

SEQ ID NO: 2828446 - RNA, 17 nt, Human
ccacacccagccucagu

SEQ ID NO: 2828447 - RNA, 19 nt, Human
ccacacccagccucagucc

SEQ ID NO: 2828448 - RNA, 13 nt, Human
ccacacccagccu

SEQ ID NO: 2828449 - RNA, 14 nt, Human
ccacacccagccuc

SEQ ID NO: 2828450 - RNA, 15 nt, Human
ccacacccagccuca

SEQ ID NO: 2828451 - RNA, 16 nt, Human
ccacacccagccucag

SEQ ID NO: 2828452 - RNA, 11 nt, Human
ccacacccucc

SEQ ID NO: 2828453 - RNA, 15 nt, Human
ccacacagcuacagc

SEQ ID NO: 2828454 - RNA, 19 nt, Human
ccacacagcuacagcuuuc

SEQ ID NO: 2828455 - RNA, 14 nt, Human
ccacacaggcuggc

SEQ ID NO: 2828456 - RNA, 12 nt, Human
ccacacauccca

SEQ ID NO: 2828457 - RNA, 15 nt, Human
ccacacaucccagcc

SEQ ID NO: 2828458 - RNA, 17 nt, Human
ccacacaucccagccca

SEQ ID NO: 2828459 - RNA, 18 nt, Human
ccacacaucccagcccaa

SEQ ID NO: 2828460 - RNA, 15 nt, Human
ccaauauguauugua

SEQ ID NO: 2828461 - RNA, 15 nt, Human
ccaauauuaaaucug

SEQ ID NO: 2828462 - RNA, 16 nt, Human
ccaauauguauuguaa

SEQ ID NO: 2828463 - RNA, 22 nt, Human
ccaauauguauuguaaacaugu

SEQ ID NO: 2828464 - RNA, 18 nt, Human
ccaauauuaaaucugcug

SEQ ID NO: 2828465 - RNA, 16 nt, Human
ccacauuuucagccaa

SEQ ID NO: 2828466 - RNA, 19 nt, Human
ccacauuuggaauacuuuu

SEQ ID NO: 2828467 - RNA, 22 nt, Human
ccacauuuggaauacuuuuugu

SEQ ID NO: 2828468 - RNA, 23 nt, Human
ccacauuugguucuaagaaaccc

SEQ ID NO: 2828469 - RNA, 17 nt, Human
ccacauuugugccgaca

SEQ ID NO: 2828470 - RNA, 14 nt, Human
ccacauuagaacuu

SEQ ID NO: 2828471 - RNA, 13 nt, Human
ccacauuuggaau

SEQ ID NO: 2828472 - RNA, 14 nt, Human
ccacauuucuaaaa

SEQ ID NO: 2828473 - RNA, 15 nt, Human
ccacauuucuaaaau

SEQ ID NO: 2828474 - RNA, 14 nt, Human
ccacauuguuuuaa

SEQ ID NO: 2828475 - RNA, 16 nt, Human
ccacauuguuuuaaaa

SEQ ID NO: 2828476 - RNA, 17 nt, Human
ccacauuuagucucuuu

SEQ ID NO: 2828477 - RNA, 19 nt, Human
ccacauuuagucucuuuau

SEQ ID NO: 2828478 - RNA, 20 nt, Human
ccacauuuagucucuuuauu

SEQ ID NO: 2828479 - RNA, 23 nt, Human
ccacauuuagucucuuuauuccu

SEQ ID NO: 2828480 - RNA, 21 nt, Human
ccaccauggccagccaacuuu

SEQ ID NO: 2828481 - RNA, 17 nt, Human
ccaccauggccagccaa

SEQ ID NO: 2828482 - RNA, 16 nt, Human
ccaccauggccagcca

SEQ ID NO: 2828483 - RNA, 17 nt, Human
ccaccaagacuuguuuu

SEQ ID NO: 2828484 - RNA, 15 nt, Human
ccaccaacccucaga

SEQ ID NO: 2828485 - RNA, 17 nt, Human
ccacaucuugcucugcu

SEQ ID NO: 2828486 - RNA, 18 nt, Human
ccacaucuugcucugcug

SEQ ID NO: 2828487 - RNA, 19 nt, Human
ccacaucuugcucugcuga

SEQ ID NO: 2828488 - RNA, 17 nt, Human
ccacaugcggagaacaa

SEQ ID NO: 2828489 - RNA, 16 nt, Human
ccacaugugcacaugc

SEQ ID NO: 2828490 - RNA, 17 nt, Human
ccacaugggagcagucc

SEQ ID NO: 2828491 - RNA, 18 nt, Human
ccacaugggagcagucca

SEQ ID NO: 2828492 - RNA, 24 nt, Human
ccacaugggagcaguccaugcaug

SEQ ID NO: 2828493 - RNA, 20 nt, Human
ccacauguacagacauacau

SEQ ID NO: 2828494 - RNA, 15 nt, Human
ccacaugugacacau

SEQ ID NO: 2828495 - RNA, 19 nt, Human
ccacaugugacacauaugc

SEQ ID NO: 2828496 - RNA, 22 nt, Human
ccacauaagggguuugccauuu

SEQ ID NO: 2828497 - RNA, 16 nt, Human
ccacaguugccaccac

SEQ ID NO: 2828498 - RNA, 20 nt, Human
ccacaguugccaccaccucu

SEQ ID NO: 2828499 - RNA, 22 nt, Human
ccacaguugccaccaccucugu

SEQ ID NO: 2828500 - RNA, 23 nt, Human
ccacaguugccaccaccucugug

SEQ ID NO: 2828501 - RNA, 16 nt, Human
ccacagucaaagaagg

SEQ ID NO: 2828502 - RNA, 20 nt, Human
ccacauccuccguccagccg

SEQ ID NO: 2828503 - RNA, 19 nt, Human
ccacauccuccguccagcc

SEQ ID NO: 2828504 - RNA, 20 nt, Human
ccacaucccgggacgcagca

SEQ ID NO: 2828505 - RNA, 15 nt, Human
ccacaguagucuuga

SEQ ID NO: 2828506 - RNA, 17 nt, Human
ccacaguagucuugaug

SEQ ID NO: 2828507 - RNA, 14 nt, Human
ccacagucaaagaa

SEQ ID NO: 2828508 - RNA, 22 nt, Human
ccacagguucaugccaccaugg

SEQ ID NO: 2828509 - RNA, 23 nt, Human
ccacagguguuuauacagcucag

SEQ ID NO: 2828510 - RNA, 14 nt, Human
ccacaggugugagc

SEQ ID NO: 2828511 - RNA, 17 nt, Human
ccacaggugugagccac

SEQ ID NO: 2828512 - RNA, 15 nt, Human
ccacaggucuagacu

SEQ ID NO: 2828513 - RNA, 14 nt, Human
ccacaggucuagac

SEQ ID NO: 2828514 - RNA, 23 nt, Human
ccacccaggagccccgaggccuu

SEQ ID NO: 2828515 - RNA, 14 nt, Human
ccacccaggaggga

SEQ ID NO: 2828516 - RNA, 12 nt, Human
ccacccaggagg

SEQ ID NO: 2828517 - RNA, 15 nt, Human
ccacccagucucugc

SEQ ID NO: 2828518 - RNA, 23 nt, Human
ccacccauaauccuuucugccga

SEQ ID NO: 2828519 - RNA, 18 nt, Human
ccacccaggagggagggg

SEQ ID NO: 2828520 - RNA, 17 nt, Human
ccacccaggagggaggg

SEQ ID NO: 2828521 - RNA, 23 nt, Human
ccacccaggagggagggggcuau

SEQ ID NO: 2828522 - RNA, 21 nt, Human
ccacccaggagccccgaggcc

SEQ ID NO: 2828523 - RNA, 13 nt, Human
ccacccaacccua

SEQ ID NO: 2828524 - RNA, 21 nt, Human
ccacccaaccccaagccagcc

SEQ ID NO: 2828525 - RNA, 19 nt, Human
ccacccaacccuaucuccu

SEQ ID NO: 2828526 - RNA, 16 nt, Human
ccacccaacccuaucu

SEQ ID NO: 2828527 - RNA, 21 nt, Human
ccacccaacccuaucuccuga

SEQ ID NO: 2828528 - RNA, 19 nt, Human
ccaaagccaaagcuaggcc

SEQ ID NO: 2828529 - RNA, 21 nt, Human
ccaaacugacucaacagucau

SEQ ID NO: 2828530 - RNA, 20 nt, Human
ccaaagccaauaacacacag

SEQ ID NO: 2828531 - RNA, 21 nt, Human
ccaaagccaauaacacacagc

SEQ ID NO: 2828532 - RNA, 13 nt, Human
ccaaagcauggac

SEQ ID NO: 2828533 - RNA, 14 nt, Human
ccaaagcauggacu

SEQ ID NO: 2828534 - RNA, 22 nt, Human
ccaaagccaccagacugacaaa

SEQ ID NO: 2828535 - RNA, 13 nt, Human
ccaaagccaccag

SEQ ID NO: 2828536 - RNA, 13 nt, Human
ccaaacucugcca

SEQ ID NO: 2828537 - RNA, 13 nt, Human
ccaaacagugaca

SEQ ID NO: 2828538 - RNA, 12 nt, Human
ccaaacauguau

SEQ ID NO: 2828539 - RNA, 14 nt, Human
ccaaacauguauuu

SEQ ID NO: 2828540 - RNA, 15 nt, Human
ccaaacauguauuua

SEQ ID NO: 2828541 - RNA, 17 nt, Human
ccaaacauguauuuaug

SEQ ID NO: 2828542 - RNA, 18 nt, Human
ccaaacauguauuuaugu

SEQ ID NO: 2828543 - RNA, 16 nt, Human
ccaaaggcucucuccu

SEQ ID NO: 2828544 - RNA, 19 nt, Human
ccaaaggccauggagagcu

SEQ ID NO: 2828545 - RNA, 20 nt, Human
ccaaaggccauggagagcug

SEQ ID NO: 2828546 - RNA, 18 nt, Human
ccaaaggaggcuggcagg

SEQ ID NO: 2828547 - RNA, 17 nt, Human
ccaaaggaggcuggcag

SEQ ID NO: 2828548 - RNA, 16 nt, Human
ccaaaggaggcuggca

SEQ ID NO: 2828549 - RNA, 15 nt, Human
ccaaaggaggcuggc

SEQ ID NO: 2828550 - RNA, 12 nt, Human
ccaaaggaggcu

SEQ ID NO: 2828551 - RNA, 20 nt, Human
ccaaaggacauuaugugugc

SEQ ID NO: 2828552 - RNA, 15 nt, Human
ccaaagcuaggccug

SEQ ID NO: 2828553 - RNA, 23 nt, Human
ccaaagccccuugcucuccccug

SEQ ID NO: 2828554 - RNA, 17 nt, Human
ccaaacauaugcacauu

SEQ ID NO: 2828555 - RNA, 20 nt, Human
ccaaagccaccucugucauu

SEQ ID NO: 2828556 - RNA, 17 nt, Human
ccaaagcuaggccuggc

SEQ ID NO: 2828557 - RNA, 16 nt, Human
ccaaagcuaggccugg

SEQ ID NO: 2828558 - RNA, 21 nt, Human
ccaaagcuaggccuggccaga

SEQ ID NO: 2828559 - RNA, 13 nt, Human
ccaaagcugccca

SEQ ID NO: 2828560 - RNA, 19 nt, Human
ccaaagcuaggguggcccu

SEQ ID NO: 2828561 - RNA, 18 nt, Human
ccaaagcuaggguggccc

SEQ ID NO: 2828562 - RNA, 21 nt, Human
ccaaagcugcccacuguuucu

SEQ ID NO: 2828563 - RNA, 20 nt, Human
ccaaagcugcccacuguuuc

SEQ ID NO: 2828564 - RNA, 12 nt, Human
ccaaagcuuuau

SEQ ID NO: 2828565 - RNA, 18 nt, Human
ccaaagcugcccacuguu

SEQ ID NO: 2828566 - RNA, 23 nt, Human
ccaaagcuaggguggcccuugca

SEQ ID NO: 2828567 - RNA, 17 nt, Human
ccaaauuuucuuuuuau

SEQ ID NO: 2828568 - RNA, 15 nt, Human
ccaaauuugauugau

SEQ ID NO: 2828569 - RNA, 14 nt, Human
ccaaaguaaaagaa

SEQ ID NO: 2828570 - RNA, 17 nt, Human
ccaaaguaaaagaaacc

SEQ ID NO: 2828571 - RNA, 11 nt, Human
ccaacaaacca

SEQ ID NO: 2828572 - RNA, 12 nt, Human
ccaacaaaccau

SEQ ID NO: 2828573 - RNA, 13 nt, Human
ccaacaaaccauc

SEQ ID NO: 2828574 - RNA, 16 nt, Human
ccaacaaaccauccag

SEQ ID NO: 2828575 - RNA, 20 nt, Human
ccaaauuugauugauuugaa

SEQ ID NO: 2828576 - RNA, 17 nt, Human
ccaaaggggacaggccu

SEQ ID NO: 2828577 - RNA, 18 nt, Human
ccaaaggggacaggccuc

SEQ ID NO: 2828578 - RNA, 19 nt, Human
ccaaaggggacaggccuca

SEQ ID NO: 2828579 - RNA, 23 nt, Human
ccaaaggggacaggccucaccuc

SEQ ID NO: 2828580 - RNA, 20 nt, Human
ccaaaggggaccccuaugaa

SEQ ID NO: 2828581 - RNA, 14 nt, Human
ccaaaggcccccua

SEQ ID NO: 2828582 - RNA, 21 nt, Human
ccaaaggccauggagagcugg

SEQ ID NO: 2828583 - RNA, 12 nt, Human
ccaaaggccccc

SEQ ID NO: 2828584 - RNA, 12 nt, Human
ccaaaggcuggu

SEQ ID NO: 2828585 - RNA, 13 nt, Human
ccaaaggcuggug

SEQ ID NO: 2828586 - RNA, 15 nt, Human
ccaaaggcugguggc

SEQ ID NO: 2828587 - RNA, 21 nt, Human
ccaaaggcugguggcaagugc

SEQ ID NO: 2828588 - RNA, 20 nt, Human
ccaaagggagaguuccagag

SEQ ID NO: 2828589 - RNA, 21 nt, Human
ccaaagggagaguuccagagg

SEQ ID NO: 2828590 - RNA, 14 nt, Human
ccaacaagcagcug

SEQ ID NO: 2828591 - RNA, 18 nt, Human
ccaacaagccagaaucag

SEQ ID NO: 2828592 - RNA, 17 nt, Human
ccaacaacauccauguc

SEQ ID NO: 2828593 - RNA, 13 nt, Human
ccaacaagaaugc

SEQ ID NO: 2828594 - RNA, 15 nt, Human
ccaacaagaaugcau

SEQ ID NO: 2828595 - RNA, 16 nt, Human
ccaacaagaaugcauu

SEQ ID NO: 2828596 - RNA, 18 nt, Human
ccaacaagaaugcauuga

SEQ ID NO: 2828597 - RNA, 19 nt, Human
ccaacaagaaugcauugau

SEQ ID NO: 2828598 - RNA, 15 nt, Human
ccaacaccacagaaa

SEQ ID NO: 2828599 - RNA, 14 nt, Human
ccaacaccacagac

SEQ ID NO: 2828600 - RNA, 15 nt, Human
ccaacaccacagaca

SEQ ID NO: 2828601 - RNA, 16 nt, Human
ccaacaccacagacac

SEQ ID NO: 2828602 - RNA, 17 nt, Human
ccaacaccacagacaca

SEQ ID NO: 2828603 - RNA, 14 nt, Human
ccaacacucaagaa

SEQ ID NO: 2828604 - RNA, 21 nt, Human
ccaacacucaagaagcaggcu

SEQ ID NO: 2828605 - RNA, 18 nt, Human
ccaacaccacagacacac

SEQ ID NO: 2828606 - RNA, 21 nt, Human
ccaacaccacagacacacaca

SEQ ID NO: 2828607 - RNA, 23 nt, Human
ccaacaccacagacacacacacg

SEQ ID NO: 2828608 - RNA, 18 nt, Human
ccaacagaacuaaauguu

SEQ ID NO: 2828609 - RNA, 20 nt, Human
ccaacacuguggguguguga

SEQ ID NO: 2828610 - RNA, 12 nt, Human
ccaacagccaug

SEQ ID NO: 2828611 - RNA, 13 nt, Human
ccaacagccaugc

SEQ ID NO: 2828612 - RNA, 15 nt, Human
ccaacagccaugccc

SEQ ID NO: 2828613 - RNA, 22 nt, Human
ccaacagcgacauagcccaucc

SEQ ID NO: 2828614 - RNA, 23 nt, Human
ccaacagcgacauagcccauccc

SEQ ID NO: 2828615 - RNA, 11 nt, Human
ccaacagcuac

SEQ ID NO: 2828616 - RNA, 13 nt, Human
ccaacagcuacaa

SEQ ID NO: 2828617 - RNA, 16 nt, Human
ccaacagcuacaacag

SEQ ID NO: 2828618 - RNA, 17 nt, Human
ccaacagcuacaacagc

SEQ ID NO: 2828619 - RNA, 18 nt, Human
ccaacagcuacaacagcc

SEQ ID NO: 2828620 - RNA, 21 nt, Human
ccaacagcuacaacagccuca

SEQ ID NO: 2828621 - RNA, 23 nt, Human
ccaacagcuacaacagccucacu

SEQ ID NO: 2828622 - RNA, 22 nt, Human
ccaacaggcuguucugcacuga

SEQ ID NO: 2828623 - RNA, 20 nt, Human
ccaaccaaguggcucccaca

SEQ ID NO: 2828624 - RNA, 23 nt, Human
ccaaccaacuugguucugcuuca

SEQ ID NO: 2828625 - RNA, 17 nt, Human
ccaaccagugccaagga

SEQ ID NO: 2828626 - RNA, 18 nt, Human
ccaaccagugccaaggac

SEQ ID NO: 2828627 - RNA, 20 nt, Human
ccaacccccaccccacacuu

SEQ ID NO: 2828628 - RNA, 19 nt, Human
ccaacccccaccccacacu

SEQ ID NO: 2828629 - RNA, 19 nt, Human
ccaacccccauucucaucu

SEQ ID NO: 2828630 - RNA, 18 nt, Human
ccaacccccaccccacac

SEQ ID NO: 2828631 - RNA, 17 nt, Human
ccaacccccaccccaca

SEQ ID NO: 2828632 - RNA, 16 nt, Human
ccaacccccaccccac

SEQ ID NO: 2828633 - RNA, 13 nt, Human
ccaacccccaccc

SEQ ID NO: 2828634 - RNA, 19 nt, Human
ccaaccccuuaagcccugg

SEQ ID NO: 2828635 - RNA, 18 nt, Human
ccaaccccccaccugcca

SEQ ID NO: 2828636 - RNA, 14 nt, Human
ccaacccucagagc

SEQ ID NO: 2828637 - RNA, 15 nt, Human
ccaacccucagagcc

SEQ ID NO: 2828638 - RNA, 19 nt, Human
ccaacccuagguucccugu

SEQ ID NO: 2828639 - RNA, 22 nt, Human
ccaacccuagguucccuguucu

SEQ ID NO: 2828640 - RNA, 20 nt, Human
ccaacccuaucuccugacag

SEQ ID NO: 2828641 - RNA, 19 nt, Human
ccaacccuaucuccugaca

SEQ ID NO: 2828642 - RNA, 23 nt, Human
ccaacccuaucuccugacagaag

SEQ ID NO: 2828643 - RNA, 19 nt, Human
ccaagaauagaugcugacu

SEQ ID NO: 2828644 - RNA, 18 nt, Human
ccaagaauccacauuucu

SEQ ID NO: 2828645 - RNA, 20 nt, Human
ccaagaauagcaucuguaca

SEQ ID NO: 2828646 - RNA, 22 nt, Human
ccaagaauagcaucuguacaaa

SEQ ID NO: 2828647 - RNA, 19 nt, Human
ccaagaauccacauuucua

SEQ ID NO: 2828648 - RNA, 21 nt, Human
ccaagaauccacauuucuaaa

SEQ ID NO: 2828649 - RNA, 20 nt, Human
ccaagaauagaugcugacug

SEQ ID NO: 2828650 - RNA, 13 nt, Human
ccaagacaaauca

SEQ ID NO: 2828651 - RNA, 14 nt, Human
ccaagacaaaucaa

SEQ ID NO: 2828652 - RNA, 16 nt, Human
ccaagacaaaucaaca

SEQ ID NO: 2828653 - RNA, 18 nt, Human
ccaagacaaaucaacaga

SEQ ID NO: 2828654 - RNA, 22 nt, Human
ccaagacaaaucaacagaagca

SEQ ID NO: 2828655 - RNA, 18 nt, Human
ccaagacagaugccccag

SEQ ID NO: 2828656 - RNA, 21 nt, Human
ccaagacagaugccccagagc

SEQ ID NO: 2828657 - RNA, 19 nt, Human
ccaagacagaugccccaga

SEQ ID NO: 2828658 - RNA, 14 nt, Human
ccaagacucuagag

SEQ ID NO: 2828659 - RNA, 15 nt, Human
ccaagacucuagagu

SEQ ID NO: 2828660 - RNA, 21 nt, Human
ccaagacucuagaguccaagg

SEQ ID NO: 2828661 - RNA, 20 nt, Human
ccaagagaaggggaagcacu

SEQ ID NO: 2828662 - RNA, 24 nt, Human
ccaagagacuccuugagagaccag

SEQ ID NO: 2828663 - RNA, 22 nt, Human
ccaagacuuggcaacagaagca

SEQ ID NO: 2828664 - RNA, 18 nt, Human
ccaagacuuggcaacaga

SEQ ID NO: 2828665 - RNA, 20 nt, Human
ccaagacuuggcaacagaag

SEQ ID NO: 2828666 - RNA, 21 nt, Human
ccaagagaaaggccugcacac

SEQ ID NO: 2828667 - RNA, 22 nt, Human
ccaagagaaaggccugcacaca

SEQ ID NO: 2828668 - RNA, 23 nt, Human
ccaagagaaaggccugcacacaa

SEQ ID NO: 2828669 - RNA, 13 nt, Human
ccaacauauaaaa

SEQ ID NO: 2828670 - RNA, 19 nt, Human
ccaagacuucauugucccu

SEQ ID NO: 2828671 - RNA, 22 nt, Human
ccaagacucuagaguccaaggu

SEQ ID NO: 2828672 - RNA, 20 nt, Human
ccaagagagggccaugcaau

SEQ ID NO: 2828673 - RNA, 19 nt, Human
ccaagaggguccuuuagua

SEQ ID NO: 2828674 - RNA, 11 nt, Human
ccaagagucua

SEQ ID NO: 2828675 - RNA, 15 nt, Human
ccaagagucuaaaga

SEQ ID NO: 2828676 - RNA, 16 nt, Human
ccaagagucugaugau

SEQ ID NO: 2828677 - RNA, 16 nt, Human
ccaagagucuaaagau

SEQ ID NO: 2828678 - RNA, 13 nt, Human
ccaagaucuauaa

SEQ ID NO: 2828679 - RNA, 17 nt, Human
ccaagaugacuggggug

SEQ ID NO: 2828680 - RNA, 15 nt, Human
ccaagauaggaccuu

SEQ ID NO: 2828681 - RNA, 21 nt, Human
ccaagauaggaccuugggcca

SEQ ID NO: 2828682 - RNA, 17 nt, Human
ccaagauucuagaugau

SEQ ID NO: 2828683 - RNA, 13 nt, Human
ccaagauuccgga

SEQ ID NO: 2828684 - RNA, 20 nt, Human
ccaagauuccggauccuaag

SEQ ID NO: 2828685 - RNA, 13 nt, Human
ccaagauucuaga

SEQ ID NO: 2828686 - RNA, 14 nt, Human
ccaagauucuagau

SEQ ID NO: 2828687 - RNA, 15 nt, Human
ccaagauucuagaug

SEQ ID NO: 2828688 - RNA, 16 nt, Human
ccaagauucuagauga

SEQ ID NO: 2828689 - RNA, 14 nt, Human
ccaagcacugugcu

SEQ ID NO: 2828690 - RNA, 21 nt, Human
ccaagcacugugcucagggcu

SEQ ID NO: 2828691 - RNA, 22 nt, Human
ccaagcacugugcucagggcua

SEQ ID NO: 2828692 - RNA, 19 nt, Human
ccaagcacuuucaguccaa

SEQ ID NO: 2828693 - RNA, 21 nt, Human
ccaagcagagcaaucaguuag

SEQ ID NO: 2828694 - RNA, 15 nt, Human
ccaagccaaaaaccu

SEQ ID NO: 2828695 - RNA, 21 nt, Human
ccaagccaaaaaccuuagcuc

SEQ ID NO: 2828696 - RNA, 16 nt, Human
ccaagcaucaggggga

SEQ ID NO: 2828697 - RNA, 19 nt, Human
ccaagcaucagggggaaga

SEQ ID NO: 2828698 - RNA, 18 nt, Human
ccaagcucaaagcgugga

SEQ ID NO: 2828699 - RNA, 16 nt, Human
ccaagcuauccuggcu

SEQ ID NO: 2828700 - RNA, 15 nt, Human
ccaagcuaucuaaag

SEQ ID NO: 2828701 - RNA, 18 nt, Human
ccaagcuaucuaaaguuu

SEQ ID NO: 2828702 - RNA, 17 nt, Human
ccaagcucaaagcgugg

SEQ ID NO: 2828703 - RNA, 13 nt, Human
ccaagcuauuccu

SEQ ID NO: 2828704 - RNA, 16 nt, Human
ccaagcuauuccuuuc

SEQ ID NO: 2828705 - RNA, 17 nt, Human
ccaagcuauuccuuucc

SEQ ID NO: 2828706 - RNA, 18 nt, Human
ccaagcuauuccuuuccc

SEQ ID NO: 2828707 - RNA, 19 nt, Human
ccaagcuauuccuuucccu

SEQ ID NO: 2828708 - RNA, 20 nt, Human
ccaagcuauuccuuucccuu

SEQ ID NO: 2828709 - RNA, 23 nt, Human
ccaagcuauuccuuucccuuccu

SEQ ID NO: 2828710 - RNA, 17 nt, Human
ccaagcuaagcacugcc

SEQ ID NO: 2828711 - RNA, 20 nt, Human
ccaagcuaagcacugccacu

SEQ ID NO: 2828712 - RNA, 19 nt, Human
ccaagccuccacagcgagg

SEQ ID NO: 2828713 - RNA, 18 nt, Human
ccaagccuccacagcgag

SEQ ID NO: 2828714 - RNA, 16 nt, Human
ccaagccuccacagcg

SEQ ID NO: 2828715 - RNA, 15 nt, Human
ccaagccuccacagc

SEQ ID NO: 2828716 - RNA, 14 nt, Human
ccaagccuccacag

SEQ ID NO: 2828717 - RNA, 13 nt, Human
ccaagccuccaca

SEQ ID NO: 2828718 - RNA, 20 nt, Human
ccaagccuccacagcgaggg

SEQ ID NO: 2828719 - RNA, 15 nt, Human
ccaagccuggcaagg

SEQ ID NO: 2828720 - RNA, 13 nt, Human
ccaagccguggcu

SEQ ID NO: 2828721 - RNA, 22 nt, Human
ccaagccuacuuuugccauuga

SEQ ID NO: 2828722 - RNA, 16 nt, Human
ccaaggucugagcacu

SEQ ID NO: 2828723 - RNA, 15 nt, Human
ccaaggucugagcca

SEQ ID NO: 2828724 - RNA, 21 nt, Human
ccaaggucugagccacagcag

SEQ ID NO: 2828725 - RNA, 22 nt, Human
ccaaggggaauguuugccucug

SEQ ID NO: 2828726 - RNA, 21 nt, Human
ccaaggggcaaauuuuuauuu

SEQ ID NO: 2828727 - RNA, 20 nt, Human
ccaaggggagucaccuuccc

SEQ ID NO: 2828728 - RNA, 21 nt, Human
ccaaggggagucaccuucccu

SEQ ID NO: 2828729 - RNA, 22 nt, Human
ccaaggggagucaccuucccuu

SEQ ID NO: 2828730 - RNA, 19 nt, Human
ccaaggccagaguggccug

SEQ ID NO: 2828731 - RNA, 21 nt, Human
ccaagggaaagaaaaggaagg

SEQ ID NO: 2828732 - RNA, 18 nt, Human
ccaaggccagaguggccu

SEQ ID NO: 2828733 - RNA, 15 nt, Human
ccaaggccagagugg

SEQ ID NO: 2828734 - RNA, 15 nt, Human
ccaagggcagaaagu

SEQ ID NO: 2828735 - RNA, 20 nt, Human
ccaagggaugaaagagaagg

SEQ ID NO: 2828736 - RNA, 19 nt, Human
ccaagggaugaaagagaag

SEQ ID NO: 2828737 - RNA, 18 nt, Human
ccaaggggugggccacag

SEQ ID NO: 2828738 - RNA, 19 nt, Human
ccaagucagcccaacaggc

SEQ ID NO: 2828739 - RNA, 14 nt, Human
ccaaguauuuauua

SEQ ID NO: 2828740 - RNA, 21 nt, Human
ccaaguauagccuauggcaga

SEQ ID NO: 2828741 - RNA, 20 nt, Human
ccaaguagcugggauuacag

SEQ ID NO: 2828742 - RNA, 15 nt, Human
ccaaguagucugcuc

SEQ ID NO: 2828743 - RNA, 18 nt, Human
ccaaguagucugcucaca

SEQ ID NO: 2828744 - RNA, 20 nt, Human
ccaaguagucugcucacagu

SEQ ID NO: 2828745 - RNA, 15 nt, Human
ccaaguaagaggcug

SEQ ID NO: 2828746 - RNA, 16 nt, Human
ccaaguaagaggcugg

SEQ ID NO: 2828747 - RNA, 17 nt, Human
ccaaguaagaggcugga

SEQ ID NO: 2828748 - RNA, 21 nt, Human
ccaaguaagaggcuggaguug

SEQ ID NO: 2828749 - RNA, 16 nt, Human
ccaaguaauauaaugg

SEQ ID NO: 2828750 - RNA, 14 nt, Human
ccaauaacacacag

SEQ ID NO: 2828751 - RNA, 18 nt, Human
ccaauagcaaauucaaag

SEQ ID NO: 2828752 - RNA, 14 nt, Human
ccaauagcugccca

SEQ ID NO: 2828753 - RNA, 15 nt, Human
ccaauagcugcccau

SEQ ID NO: 2828754 - RNA, 22 nt, Human
ccaauaguuguugauuggcagg

SEQ ID NO: 2828755 - RNA, 16 nt, Human
ccaauaacacacagcu

SEQ ID NO: 2828756 - RNA, 14 nt, Human
ccaauaacauucuu

SEQ ID NO: 2828757 - RNA, 16 nt, Human
ccaaguuuccauagca

SEQ ID NO: 2828758 - RNA, 17 nt, Human
ccaaguuuccauagcaa

SEQ ID NO: 2828759 - RNA, 20 nt, Human
ccaaguuuccauagcaacag

SEQ ID NO: 2828760 - RNA, 21 nt, Human
ccaaguccgcagaagcccuga

SEQ ID NO: 2828761 - RNA, 18 nt, Human
ccaagucggaacagcaga

SEQ ID NO: 2828762 - RNA, 19 nt, Human
ccaagucggaacagcagau

SEQ ID NO: 2828763 - RNA, 22 nt, Human
cauuuagcuaaacggauuccaa

SEQ ID NO: 2828764 - RNA, 22 nt, Human
cauuuagauccugguuucauaa

SEQ ID NO: 2828765 - RNA, 19 nt, Human
cauuuagauugaaaacuuu

SEQ ID NO: 2828766 - RNA, 20 nt, Human
cauuuagauugaaaacuuuu

SEQ ID NO: 2828767 - RNA, 16 nt, Human
cauuuaggggcaagca

SEQ ID NO: 2828768 - RNA, 20 nt, Human
cauuuccucagcuuaucucu

SEQ ID NO: 2828769 - RNA, 17 nt, Human
cauuuaggggccacuuu

SEQ ID NO: 2828770 - RNA, 23 nt, Human
cauuuccuaucaccuauuuccau

SEQ ID NO: 2828771 - RNA, 13 nt, Human
cauuuccugacag

SEQ ID NO: 2828772 - RNA, 20 nt, Human
cauuuccugacagaaggacu

SEQ ID NO: 2828773 - RNA, 19 nt, Human
cauuuccugagaccacaga

SEQ ID NO: 2828774 - RNA, 16 nt, Human
cauuguuuuaaaaaga

SEQ ID NO: 2828775 - RNA, 13 nt, Human
cauuguuuuaaaa

SEQ ID NO: 2828776 - RNA, 19 nt, Human
cauuguuguuuuuuuaaua

SEQ ID NO: 2828777 - RNA, 13 nt, Human
cauuuccuguguc

SEQ ID NO: 2828778 - RNA, 12 nt, Human
cauuuccugugu

SEQ ID NO: 2828779 - RNA, 21 nt, Human
cauuucgccccucauuuaucc

SEQ ID NO: 2828780 - RNA, 17 nt, Human
cauuucgccccucauuu

SEQ ID NO: 2828781 - RNA, 19 nt, Human
cauuucgugagccccaucu

SEQ ID NO: 2828782 - RNA, 20 nt, Human
cauuucgugagccccaucuu

SEQ ID NO: 2828783 - RNA, 21 nt, Human
cauuucgugagccccaucuuc

SEQ ID NO: 2828784 - RNA, 22 nt, Human
cauuucgugagccccaucuuca

SEQ ID NO: 2828785 - RNA, 14 nt, Human
cauuucuaaaagaa

SEQ ID NO: 2828786 - RNA, 22 nt, Human
cauuucuaaaagaauauucaga

SEQ ID NO: 2828787 - RNA, 16 nt, Human
cauuuccuucaaggca

SEQ ID NO: 2828788 - RNA, 22 nt, Human
cauuucuaccaaggcauaucau

SEQ ID NO: 2828789 - RNA, 12 nt, Human
cauuucuaaaau

SEQ ID NO: 2828790 - RNA, 16 nt, Human
cauugccaccaggaga

SEQ ID NO: 2828791 - RNA, 15 nt, Human
cauugccaccaggag

SEQ ID NO: 2828792 - RNA, 14 nt, Human
cauugccaccagga

SEQ ID NO: 2828793 - RNA, 13 nt, Human
cauugccaccagg

SEQ ID NO: 2828794 - RNA, 18 nt, Human
cauugcauucuauugccu

SEQ ID NO: 2828795 - RNA, 19 nt, Human
cauugcauucuauugccuu

SEQ ID NO: 2828796 - RNA, 20 nt, Human
cauugcauucuauugccuuc

SEQ ID NO: 2828797 - RNA, 15 nt, Human
cauuguagagcuucu

SEQ ID NO: 2828798 - RNA, 22 nt, Human
cauugccuaacuacuaguuuuu

SEQ ID NO: 2828799 - RNA, 16 nt, Human
cauugccuagcucuuu

SEQ ID NO: 2828800 - RNA, 20 nt, Human
cauugccaccaggagaacca

SEQ ID NO: 2828801 - RNA, 17 nt, Human
cauugccaccaggagaa

SEQ ID NO: 2828802 - RNA, 15 nt, Human
cauugccaaaaagga

SEQ ID NO: 2828803 - RNA, 14 nt, Human
cauugcccagucuu

SEQ ID NO: 2828804 - RNA, 17 nt, Human
cauugcccagucuuuca

SEQ ID NO: 2828805 - RNA, 18 nt, Human
cauugcccagucuuucau

SEQ ID NO: 2828806 - RNA, 20 nt, Human
cauugcccagucuuucaugu

SEQ ID NO: 2828807 - RNA, 15 nt, Human
cauuguacuaccugu

SEQ ID NO: 2828808 - RNA, 16 nt, Human
cauuguacuaccugug

SEQ ID NO: 2828809 - RNA, 16 nt, Human
cauuguagagcuucug

SEQ ID NO: 2828810 - RNA, 17 nt, Human
cauuguagagcuucugg

SEQ ID NO: 2828811 - RNA, 19 nt, Human
cauuguagagcuucuggca

SEQ ID NO: 2828812 - RNA, 21 nt, Human
cauuguagagcuucuggcacu

SEQ ID NO: 2828813 - RNA, 18 nt, Human
cauuguuggccaaagcca

SEQ ID NO: 2828814 - RNA, 12 nt, Human
cauuguuucugu

SEQ ID NO: 2828815 - RNA, 21 nt, Human
cauuguuucugugggcgggcc

SEQ ID NO: 2828816 - RNA, 14 nt, Human
cauuguuugcugcu

SEQ ID NO: 2828817 - RNA, 16 nt, Human
cauuguuugcugcuau

SEQ ID NO: 2828818 - RNA, 17 nt, Human
cauuguuggccaaagcc

SEQ ID NO: 2828819 - RNA, 16 nt, Human
cauuguugcucccugu

SEQ ID NO: 2828820 - RNA, 17 nt, Human
cauuguugcucccugug

SEQ ID NO: 2828821 - RNA, 20 nt, Human
cauuguugagcuauugcugu

SEQ ID NO: 2828822 - RNA, 13 nt, Human
cauuguugagcua

SEQ ID NO: 2828823 - RNA, 17 nt, Human
cauuguucaccuuugua

SEQ ID NO: 2828824 - RNA, 18 nt, Human
cauuguucaccuuuguag

SEQ ID NO: 2828825 - RNA, 19 nt, Human
cauuguucaccuuuguagc

SEQ ID NO: 2828826 - RNA, 17 nt, Human
cauugucccucuucacu

SEQ ID NO: 2828827 - RNA, 18 nt, Human
cauugucccucuucacuc

SEQ ID NO: 2828828 - RNA, 20 nt, Human
cauugucccucuucacuccc

SEQ ID NO: 2828829 - RNA, 17 nt, Human
cauugucucguuuguga

SEQ ID NO: 2828830 - RNA, 19 nt, Human
cauugugaguaaaucagau

SEQ ID NO: 2828831 - RNA, 22 nt, Human
cauugugauguauauuccuuug

SEQ ID NO: 2828832 - RNA, 15 nt, Human
cauuguaugaugugu

SEQ ID NO: 2828833 - RNA, 16 nt, Human
cauuguaugauguguu

SEQ ID NO: 2828834 - RNA, 17 nt, Human
cauuguaugauguguug

SEQ ID NO: 2828835 - RNA, 18 nt, Human
cauuguaugauguguugu

SEQ ID NO: 2828836 - RNA, 20 nt, Human
cauuguaugauguguuguga

SEQ ID NO: 2828837 - RNA, 22 nt, Human
cauuguaugauguguugugaua

SEQ ID NO: 2828838 - RNA, 15 nt, Human
cauuguauguaucua

SEQ ID NO: 2828839 - RNA, 16 nt, Human
cauuguauguaucuau

SEQ ID NO: 2828840 - RNA, 17 nt, Human
cauuguauguaucuauu

SEQ ID NO: 2828841 - RNA, 22 nt, Human
cauuugcguuccaugaugcugg

SEQ ID NO: 2828842 - RNA, 19 nt, Human
cauuugcucuuucaucucu

SEQ ID NO: 2828843 - RNA, 18 nt, Human
cauuugagcagggcucag

SEQ ID NO: 2828844 - RNA, 17 nt, Human
cauuugagcagggcuca

SEQ ID NO: 2828845 - RNA, 20 nt, Human
cauuugagcagggcucagcg

SEQ ID NO: 2828846 - RNA, 17 nt, Human
cauuugccaauuuuccu

SEQ ID NO: 2828847 - RNA, 21 nt, Human
cauuugcguuccaugaugcug

SEQ ID NO: 2828848 - RNA, 12 nt, Human
cauuugccuugc

SEQ ID NO: 2828849 - RNA, 15 nt, Human
cauuugccuugcaga

SEQ ID NO: 2828850 - RNA, 16 nt, Human
cauuugccuugcagaa

SEQ ID NO: 2828851 - RNA, 19 nt, Human
cauuugccuugcagaacug

SEQ ID NO: 2828852 - RNA, 20 nt, Human
cauuugccuugcagaacugc

SEQ ID NO: 2828853 - RNA, 21 nt, Human
cauuugccuugcagaacugcc

SEQ ID NO: 2828854 - RNA, 22 nt, Human
cauuugccuugcagaacugcca

SEQ ID NO: 2828855 - RNA, 14 nt, Human
cauuugccuugcug

SEQ ID NO: 2828856 - RNA, 21 nt, Human
cauuugaauaaagccugcuuu

SEQ ID NO: 2828857 - RNA, 18 nt, Human
cauuugaaguguaccugu

SEQ ID NO: 2828858 - RNA, 19 nt, Human
cauuugaaguguaccugug

SEQ ID NO: 2828859 - RNA, 14 nt, Human
cauuuuaggaaagg

SEQ ID NO: 2828860 - RNA, 13 nt, Human
cauuuuaaaaaca

SEQ ID NO: 2828861 - RNA, 21 nt, Human
cauuuuaaaaacauagaaaaa

SEQ ID NO: 2828862 - RNA, 16 nt, Human
cauuuguuuuucucac

SEQ ID NO: 2828863 - RNA, 15 nt, Human
cauuuuauaaagugc

SEQ ID NO: 2828864 - RNA, 22 nt, Human
cauuuuauaaagugcuugugua

SEQ ID NO: 2828865 - RNA, 23 nt, Human
cauuuuauaaagugcuuguguaa

SEQ ID NO: 2828866 - RNA, 17 nt, Human
cauuuuauagacacccu

SEQ ID NO: 2828867 - RNA, 18 nt, Human
cauuuugugaauggauug

SEQ ID NO: 2828868 - RNA, 21 nt, Human
cauuuugugaauggauuggau

SEQ ID NO: 2828869 - RNA, 13 nt, Human
cauuuugugaaug

SEQ ID NO: 2828870 - RNA, 14 nt, Human
cauuuugugaaugg

SEQ ID NO: 2828871 - RNA, 15 nt, Human
cauuuugugaaugga

SEQ ID NO: 2828872 - RNA, 16 nt, Human
cauuuugugaauggau

SEQ ID NO: 2828873 - RNA, 12 nt, Human
cauuuugugaag

SEQ ID NO: 2828874 - RNA, 13 nt, Human
cauuuugugaagc

SEQ ID NO: 2828875 - RNA, 15 nt, Human
cauuuugugaagccc

SEQ ID NO: 2828876 - RNA, 17 nt, Human
cauuuugugaagcccug

SEQ ID NO: 2828877 - RNA, 18 nt, Human
cauuuugugaagcccugu

SEQ ID NO: 2828878 - RNA, 20 nt, Human
cauuuugugaagcccuguug

SEQ ID NO: 2828879 - RNA, 12 nt, Human
cauuuugugaau

SEQ ID NO: 2828880 - RNA, 20 nt, Human
ccaaacauccuacaagacac

SEQ ID NO: 2828881 - RNA, 19 nt, Human
ccaaacauccuacaagaca

SEQ ID NO: 2828882 - RNA, 16 nt, Human
ccaaacagccacacug

SEQ ID NO: 2828883 - RNA, 22 nt, Human
ccaaacaccuuccagcuccugu

SEQ ID NO: 2828884 - RNA, 12 nt, Human
ccaaacagcaaa

SEQ ID NO: 2828885 - RNA, 13 nt, Human
ccaaacagcaaac

SEQ ID NO: 2828886 - RNA, 19 nt, Human
ccaaacagcaaaccaagag

SEQ ID NO: 2828887 - RNA, 22 nt, Human
ccaaacagcaaaccaagagauu

SEQ ID NO: 2828888 - RNA, 23 nt, Human
ccaaacagcaaaccaagagauug

SEQ ID NO: 2828889 - RNA, 12 nt, Human
cauuuuucugca

SEQ ID NO: 2828890 - RNA, 13 nt, Human
cauuuuguucuua

SEQ ID NO: 2828891 - RNA, 15 nt, Human
cauuuuguucuuaca

SEQ ID NO: 2828892 - RNA, 18 nt, Human
cauuuuguucuuacacau

SEQ ID NO: 2828893 - RNA, 19 nt, Human
cauuuuguucuuacacaua

SEQ ID NO: 2828894 - RNA, 21 nt, Human
cauuuuguucuuacacauaca

SEQ ID NO: 2828895 - RNA, 12 nt, Human
cauuuuguugua

SEQ ID NO: 2828896 - RNA, 13 nt, Human
cauuuuguuguaa

SEQ ID NO: 2828897 - RNA, 19 nt, Human
cauuuuuccguuugcuuuu

SEQ ID NO: 2828898 - RNA, 13 nt, Human
cauuuuucauuca

SEQ ID NO: 2828899 - RNA, 21 nt, Human
cauuuuucauucacuucucuu

SEQ ID NO: 2828900 - RNA, 20 nt, Human
ccaaacaccuuccagcuccu

SEQ ID NO: 2828901 - RNA, 15 nt, Human
cggccccucccgccc

SEQ ID NO: 2828902 - RNA, 12 nt, Human
cggcccccugcc

SEQ ID NO: 2828903 - RNA, 15 nt, Human
cggcccccuggucuc

SEQ ID NO: 2828904 - RNA, 18 nt, Human
cggcccccuggucucugg

SEQ ID NO: 2828905 - RNA, 22 nt, Human
cggccccagcaccucagccugc

SEQ ID NO: 2828906 - RNA, 14 nt, Human
cggccucccaaagu

SEQ ID NO: 2828907 - RNA, 23 nt, Human
cggccugaugcucccuccccugc

SEQ ID NO: 2828908 - RNA, 19 nt, Human
cggccugaugcucccuccc

SEQ ID NO: 2828909 - RNA, 17 nt, Human
cggccugaugcucccuc

SEQ ID NO: 2828910 - RNA, 22 nt, Human
cggggagggugacaguggccgc

SEQ ID NO: 2828911 - RNA, 15 nt, Human
cggggagggugacag

SEQ ID NO: 2828912 - RNA, 15 nt, Human
cgggcaugggcacuc

SEQ ID NO: 2828913 - RNA, 16 nt, Human
cgggagggcggcacag

SEQ ID NO: 2828914 - RNA, 20 nt, Human
cgggaggauguucugggaca

SEQ ID NO: 2828915 - RNA, 21 nt, Human
cgggagccugaucaccugccc

SEQ ID NO: 2828916 - RNA, 22 nt, Human
cgggagccugaucaccugcccu

SEQ ID NO: 2828917 - RNA, 22 nt, Human
cgggaggcggagcuugcaguga

SEQ ID NO: 2828918 - RNA, 13 nt, Human
cgggaggaggugu

SEQ ID NO: 2828919 - RNA, 17 nt, Human
cgggagcgguggcccug

SEQ ID NO: 2828920 - RNA, 20 nt, Human
cgggagcgguggcccugucc

SEQ ID NO: 2828921 - RNA, 12 nt, Human
cggcugggcaca

SEQ ID NO: 2828922 - RNA, 20 nt, Human
cggcugggcacacgccuccc

SEQ ID NO: 2828923 - RNA, 16 nt, Human
cggcugggcacacgcc

SEQ ID NO: 2828924 - RNA, 17 nt, Human
cggcugggcacacgccu

SEQ ID NO: 2828925 - RNA, 14 nt, Human
cggcugggucugug

SEQ ID NO: 2828926 - RNA, 14 nt, Human
cggcugugcucaga

SEQ ID NO: 2828927 - RNA, 16 nt, Human
cggcugugcucagaga

SEQ ID NO: 2828928 - RNA, 13 nt, Human
cggaugcugcuuc

SEQ ID NO: 2828929 - RNA, 14 nt, Human
cggaugcugcuucc

SEQ ID NO: 2828930 - RNA, 20 nt, Human
cggauccuaagcaucuaagu

SEQ ID NO: 2828931 - RNA, 20 nt, Human
cggacuaagccuaccugcuc

SEQ ID NO: 2828932 - RNA, 21 nt, Human
cggacuaagccuaccugcucu

SEQ ID NO: 2828933 - RNA, 15 nt, Human
cggacuccuccuuuc

SEQ ID NO: 2828934 - RNA, 19 nt, Human
cggacuccuccuuucuccu

SEQ ID NO: 2828935 - RNA, 19 nt, Human
cggauccuaagcaucuaag

SEQ ID NO: 2828936 - RNA, 17 nt, Human
cggauccuaagcaucua

SEQ ID NO: 2828937 - RNA, 12 nt, Human
cggaccccagcu

SEQ ID NO: 2828938 - RNA, 13 nt, Human
cggaccccagcug

SEQ ID NO: 2828939 - RNA, 16 nt, Human
cggacacuccuagaga

SEQ ID NO: 2828940 - RNA, 14 nt, Human
cggacacuccuaga

SEQ ID NO: 2828941 - RNA, 15 nt, Human
cggacacuccuagag

SEQ ID NO: 2828942 - RNA, 22 nt, Human
cggaccgcuuguggggacccag

SEQ ID NO: 2828943 - RNA, 23 nt, Human
cggaccgcuuguggggacccagg

SEQ ID NO: 2828944 - RNA, 14 nt, Human
cggaccccagcugu

SEQ ID NO: 2828945 - RNA, 20 nt, Human
cggaccccagcugugagccu

SEQ ID NO: 2828946 - RNA, 21 nt, Human
cggaccuuggcagcccaggcc

SEQ ID NO: 2828947 - RNA, 22 nt, Human
cggaccccagcugugagccuug

SEQ ID NO: 2828948 - RNA, 15 nt, Human
cggauugcguuccuc

SEQ ID NO: 2828949 - RNA, 24 nt, Human
cggauuccaaagaguagaauugca

SEQ ID NO: 2828950 - RNA, 12 nt, Human
cggauuccagcc

SEQ ID NO: 2828951 - RNA, 16 nt, Human
cggauuccagcccaca

SEQ ID NO: 2828952 - RNA, 19 nt, Human
cggcaacuaagcagucccu

SEQ ID NO: 2828953 - RNA, 22 nt, Human
cggcaacuaagcagucccugag

SEQ ID NO: 2828954 - RNA, 11 nt, Human
cggcaggcccu

SEQ ID NO: 2828955 - RNA, 12 nt, Human
cggcaggcccug

SEQ ID NO: 2828956 - RNA, 13 nt, Human
cggcaggcccugc

SEQ ID NO: 2828957 - RNA, 14 nt, Human
cggcaggcccugca

SEQ ID NO: 2828958 - RNA, 15 nt, Human
cggcaggcccugcag

SEQ ID NO: 2828959 - RNA, 16 nt, Human
cggcaggcccugcagu

SEQ ID NO: 2828960 - RNA, 17 nt, Human
cggcaggcccugcagug

SEQ ID NO: 2828961 - RNA, 14 nt, Human
cgcuaucuucacau

SEQ ID NO: 2828962 - RNA, 13 nt, Human
cgcuauuacaaau

SEQ ID NO: 2828963 - RNA, 14 nt, Human
cgcuauuacaaaua

SEQ ID NO: 2828964 - RNA, 17 nt, Human
cgcucaccuagagccag

SEQ ID NO: 2828965 - RNA, 18 nt, Human
cgcucaccuagagccaga

SEQ ID NO: 2828966 - RNA, 17 nt, Human
cgcuauugucaccaggg

SEQ ID NO: 2828967 - RNA, 15 nt, Human
cgcucgccccaccgg

SEQ ID NO: 2828968 - RNA, 21 nt, Human
cgcucgccccaccggcgcgcu

SEQ ID NO: 2828969 - RNA, 13 nt, Human
cgcuccugugucu

SEQ ID NO: 2828970 - RNA, 17 nt, Human
cgcucuccuuucuuucu

SEQ ID NO: 2828971 - RNA, 13 nt, Human
cgcucuccugcca

SEQ ID NO: 2828972 - RNA, 14 nt, Human
cgcucuccugccac

SEQ ID NO: 2828973 - RNA, 15 nt, Human
cgcucguguguucua

SEQ ID NO: 2828974 - RNA, 23 nt, Human
cgcucguguguucuauccaaaca

SEQ ID NO: 2828975 - RNA, 19 nt, Human
cggaacccaagcuuagaac

SEQ ID NO: 2828976 - RNA, 21 nt, Human
cggaaccgcucaccuagagcc

SEQ ID NO: 2828977 - RNA, 17 nt, Human
cggaacccaagcuuaga

SEQ ID NO: 2828978 - RNA, 12 nt, Human
cggaacagcaga

SEQ ID NO: 2828979 - RNA, 13 nt, Human
cggaacagcagau

SEQ ID NO: 2828980 - RNA, 12 nt, Human
cggaaagguauu

SEQ ID NO: 2828981 - RNA, 20 nt, Human
cggaaagguauuugggaaac

SEQ ID NO: 2828982 - RNA, 21 nt, Human
cggaaagguauuugggaaacu

SEQ ID NO: 2828983 - RNA, 13 nt, Human
cggaaauuaaagu

SEQ ID NO: 2828984 - RNA, 14 nt, Human
cggaaauuaaaguu

SEQ ID NO: 2828985 - RNA, 18 nt, Human
cggacagccacggccagg

SEQ ID NO: 2828986 - RNA, 16 nt, Human
cggacagccacggcca

SEQ ID NO: 2828987 - RNA, 15 nt, Human
cggacagccacggcc

SEQ ID NO: 2828988 - RNA, 12 nt, Human
cggacacccccu

SEQ ID NO: 2828989 - RNA, 14 nt, Human
cggacacccccucg

SEQ ID NO: 2828990 - RNA, 12 nt, Human
cggacaauaaac

SEQ ID NO: 2828991 - RNA, 13 nt, Human
cggacaauaaacc

SEQ ID NO: 2828992 - RNA, 20 nt, Human
cggacaauaaaccuccgcca

SEQ ID NO: 2828993 - RNA, 22 nt, Human
cggacaauaaaccuccgccaau

SEQ ID NO: 2828994 - RNA, 20 nt, Human
cggaaugaaccacaucuugc

SEQ ID NO: 2828995 - RNA, 19 nt, Human
cggaauuuaccugauuucu

SEQ ID NO: 2828996 - RNA, 13 nt, Human
cggaauuuaccug

SEQ ID NO: 2828997 - RNA, 22 nt, Human
cgcacaauaguaaccuggguaa

SEQ ID NO: 2828998 - RNA, 14 nt, Human
cgcacacacacaca

SEQ ID NO: 2828999 - RNA, 14 nt, Human
cgcacuuuccacuu

SEQ ID NO: 2829000 - RNA, 15 nt, Human
cgcacuuuccacuuc

SEQ ID NO: 2829001 - RNA, 19 nt, Human
cgcacuuuccacuucuucc

SEQ ID NO: 2829002 - RNA, 20 nt, Human
cgcacuuuccacuucuuccu

SEQ ID NO: 2829003 - RNA, 13 nt, Human
cgcacacacacaa

SEQ ID NO: 2829004 - RNA, 11 nt, Human
cgcaagcugag

SEQ ID NO: 2829005 - RNA, 22 nt, Human
cgcaaugaaaagucguuuucca

SEQ ID NO: 2829006 - RNA, 19 nt, Human
cgauucuucugcuucagcc

SEQ ID NO: 2829007 - RNA, 13 nt, Human
cgauucuucugcu

SEQ ID NO: 2829008 - RNA, 21 nt, Human
cgauucuucugcuucagccuc

SEQ ID NO: 2829009 - RNA, 12 nt, Human
cgauuccuucuc

SEQ ID NO: 2829010 - RNA, 13 nt, Human
cgauuccuucucu

SEQ ID NO: 2829011 - RNA, 12 nt, Human
cgauucuccugc

SEQ ID NO: 2829012 - RNA, 18 nt, Human
cgauucuccugccucagc

SEQ ID NO: 2829013 - RNA, 19 nt, Human
cgaucuggguucacugcaa

SEQ ID NO: 2829014 - RNA, 14 nt, Human
cgaugaaggcugcc

SEQ ID NO: 2829015 - RNA, 17 nt, Human
cgaucucuuauuuuaca

SEQ ID NO: 2829016 - RNA, 21 nt, Human
cgaugaauuuggagacucugu

SEQ ID NO: 2829017 - RNA, 14 nt, Human
cgaucucccaccuu

SEQ ID NO: 2829018 - RNA, 15 nt, Human
cgaucucggcucagu

SEQ ID NO: 2829019 - RNA, 16 nt, Human
cgagggcagcugcuau

SEQ ID NO: 2829020 - RNA, 22 nt, Human
cgauccaccugucucagccucc

SEQ ID NO: 2829021 - RNA, 14 nt, Human
cgaucccacacagg

SEQ ID NO: 2829022 - RNA, 19 nt, Human
cgaucgcggcggagcuggc

SEQ ID NO: 2829023 - RNA, 13 nt, Human
cgauccugccacc

SEQ ID NO: 2829024 - RNA, 17 nt, Human
cgauccugccacccugu

SEQ ID NO: 2829025 - RNA, 18 nt, Human
cgauccugccacccugua

SEQ ID NO: 2829026 - RNA, 12 nt, Human
cgaggacaggga

SEQ ID NO: 2829027 - RNA, 13 nt, Human
cgaggacagggag

SEQ ID NO: 2829028 - RNA, 19 nt, Human
cgaggccuucucugaagga

SEQ ID NO: 2829029 - RNA, 18 nt, Human
cgaggccuucucugaagg

SEQ ID NO: 2829030 - RNA, 13 nt, Human
cgagggcagcugc

SEQ ID NO: 2829031 - RNA, 20 nt, Human
cgauccaccugucucagccu

SEQ ID NO: 2829032 - RNA, 23 nt, Human
ccuuuguaaauugucagaugcug

SEQ ID NO: 2829033 - RNA, 16 nt, Human
ccuuuguacagcccag

SEQ ID NO: 2829034 - RNA, 17 nt, Human
ccuuuguacagcccaga

SEQ ID NO: 2829035 - RNA, 16 nt, Human
ccuuuguagcacucag

SEQ ID NO: 2829036 - RNA, 14 nt, Human
ccuuuggcucugga

SEQ ID NO: 2829037 - RNA, 15 nt, Human
ccuuuggcucuggag

SEQ ID NO: 2829038 - RNA, 16 nt, Human
ccuuuggcucuggaga

SEQ ID NO: 2829039 - RNA, 19 nt, Human
ccuuuggcucuggagacag

SEQ ID NO: 2829040 - RNA, 19 nt, Human
cgagcgcuaucuucacaua

SEQ ID NO: 2829041 - RNA, 15 nt, Human
cgagcuccagagcaa

SEQ ID NO: 2829042 - RNA, 12 nt, Human
cgagcugucccc

SEQ ID NO: 2829043 - RNA, 21 nt, Human
cgagcuguuuauguuuuuaua

SEQ ID NO: 2829044 - RNA, 12 nt, Human
ccuuuaagaaaa

SEQ ID NO: 2829045 - RNA, 11 nt, Human
ccuuucugugu

SEQ ID NO: 2829046 - RNA, 13 nt, Human
ccuuucugugugc

SEQ ID NO: 2829047 - RNA, 16 nt, Human
ccuuucuguaccauuu

SEQ ID NO: 2829048 - RNA, 12 nt, Human
ccuuucugugcc

SEQ ID NO: 2829049 - RNA, 13 nt, Human
ccuuucugugccc

SEQ ID NO: 2829050 - RNA, 14 nt, Human
ccuuucugugcccu

SEQ ID NO: 2829051 - RNA, 19 nt, Human
ccuuucugugcccuacuca

SEQ ID NO: 2829052 - RNA, 20 nt, Human
ccuuucugugcccuacucau

SEQ ID NO: 2829053 - RNA, 14 nt, Human
ccuuucuggcucuc

SEQ ID NO: 2829054 - RNA, 12 nt, Human
ccuuucucuuuc

SEQ ID NO: 2829055 - RNA, 14 nt, Human
ccuuucucuuucuc

SEQ ID NO: 2829056 - RNA, 16 nt, Human
ccuuucucuuucucuc

SEQ ID NO: 2829057 - RNA, 17 nt, Human
ccuuucucuuucucucu

SEQ ID NO: 2829058 - RNA, 18 nt, Human
ccuuucucuuucucucuu

SEQ ID NO: 2829059 - RNA, 21 nt, Human
ccuuucucuuucucucuuccc

SEQ ID NO: 2829060 - RNA, 22 nt, Human
ccuuucucuuucucucuucccu

SEQ ID NO: 2829061 - RNA, 15 nt, Human
ccuuucugccgaccc

SEQ ID NO: 2829062 - RNA, 17 nt, Human
ccuuucugccgaccccu

SEQ ID NO: 2829063 - RNA, 16 nt, Human
ccuuguuacccaugaa

SEQ ID NO: 2829064 - RNA, 18 nt, Human
ccuuguuacccaugaaaa

SEQ ID NO: 2829065 - RNA, 20 nt, Human
ccuuguuuugaaaaccuaaa

SEQ ID NO: 2829066 - RNA, 20 nt, Human
ccuuuaaaaaaauuuaagug

SEQ ID NO: 2829067 - RNA, 15 nt, Human
ccuuuaaaaaagaaa

SEQ ID NO: 2829068 - RNA, 15 nt, Human
ccuuguguauauuug

SEQ ID NO: 2829069 - RNA, 16 nt, Human
ccuuguguauauuugu

SEQ ID NO: 2829070 - RNA, 18 nt, Human
ccuuguguauauuuguau

SEQ ID NO: 2829071 - RNA, 13 nt, Human
ccuuggcugcagg

SEQ ID NO: 2829072 - RNA, 12 nt, Human
ccuuggcugcag

SEQ ID NO: 2829073 - RNA, 12 nt, Human
ccuuggcucaga

SEQ ID NO: 2829074 - RNA, 15 nt, Human
ccuuggcucagacau

SEQ ID NO: 2829075 - RNA, 22 nt, Human
ccuuggcucaauccucuaagcu

SEQ ID NO: 2829076 - RNA, 18 nt, Human
ccuuggcucaauccucua

SEQ ID NO: 2829077 - RNA, 18 nt, Human
ccuuugcaaaucaguguu

SEQ ID NO: 2829078 - RNA, 14 nt, Human
ccuuugcacaggau

SEQ ID NO: 2829079 - RNA, 18 nt, Human
ccuuugaauguuaauuuu

SEQ ID NO: 2829080 - RNA, 13 nt, Human
ccuuugagacagu

SEQ ID NO: 2829081 - RNA, 14 nt, Human
ccuuugacauuuaa

SEQ ID NO: 2829082 - RNA, 16 nt, Human
ccuuugacauuuaauu

SEQ ID NO: 2829083 - RNA, 15 nt, Human
ccuuugagacaguuu

SEQ ID NO: 2829084 - RNA, 17 nt, Human
ccuuugagacaguuucu

SEQ ID NO: 2829085 - RNA, 19 nt, Human
ccuuugagacaguuucuua

SEQ ID NO: 2829086 - RNA, 14 nt, Human
ccuuucuugacaaa

SEQ ID NO: 2829087 - RNA, 23 nt, Human
ccuuucuugacaaaaccuaacuu

SEQ ID NO: 2829088 - RNA, 17 nt, Human
ccuuugaaaccugcucu

SEQ ID NO: 2829089 - RNA, 14 nt, Human
ccuuugaagccuca

SEQ ID NO: 2829090 - RNA, 20 nt, Human
ccuuugaagccucagcuacc

SEQ ID NO: 2829091 - RNA, 19 nt, Human
ccuuugcugaggccuccag

SEQ ID NO: 2829092 - RNA, 11 nt, Human
ccuuugccccu

SEQ ID NO: 2829093 - RNA, 13 nt, Human
ccuuugccuccag

SEQ ID NO: 2829094 - RNA, 14 nt, Human
ccuuugccuccaga

SEQ ID NO: 2829095 - RNA, 23 nt, Human
ccuuugccuccagaagcacuggg

SEQ ID NO: 2829096 - RNA, 16 nt, Human
ccuuugcgccugugac

SEQ ID NO: 2829097 - RNA, 13 nt, Human
ccuuugcucuuuc

SEQ ID NO: 2829098 - RNA, 21 nt, Human
ccuuuaaagaugaacucugaa

SEQ ID NO: 2829099 - RNA, 13 nt, Human
ccuuugcagggca

SEQ ID NO: 2829100 - RNA, 14 nt, Human
ccuuugcagggcag

SEQ ID NO: 2829101 - RNA, 15 nt, Human
ccuuugcagggcagc

SEQ ID NO: 2829102 - RNA, 16 nt, Human
ccuuugcagggcagcc

SEQ ID NO: 2829103 - RNA, 17 nt, Human
ccuuugcagggcagccc

SEQ ID NO: 2829104 - RNA, 18 nt, Human
ccuuugcagggcagcccc

SEQ ID NO: 2829105 - RNA, 20 nt, Human
ccuuugcaucguccccuccc

SEQ ID NO: 2829106 - RNA, 15 nt, Human
ccuuuggagaugcug

SEQ ID NO: 2829107 - RNA, 20 nt, Human
ccuuuggagaugcugagggu

SEQ ID NO: 2829108 - RNA, 15 nt, Human
ccuuuggccuuggcu

SEQ ID NO: 2829109 - RNA, 12 nt, Human
ccuuuggcucug

SEQ ID NO: 2829110 - RNA, 19 nt, Human
cgcgugcacguggagagcu

SEQ ID NO: 2829111 - RNA, 21 nt, Human
cgcgucuccuguuuuucuggg

SEQ ID NO: 2829112 - RNA, 19 nt, Human
cgcgugcccucgcugcuuc

SEQ ID NO: 2829113 - RNA, 20 nt, Human
cgcgugcacacaccagagcc

SEQ ID NO: 2829114 - RNA, 19 nt, Human
cgcgugcacacaccagagc

SEQ ID NO: 2829115 - RNA, 16 nt, Human
cgcgugcacacaccag

SEQ ID NO: 2829116 - RNA, 22 nt, Human
cgcgacuaauuucaaaaugcuu

SEQ ID NO: 2829117 - RNA, 14 nt, Human
cgcgaucccacaca

SEQ ID NO: 2829118 - RNA, 16 nt, Human
cgcgaucccacacagg

SEQ ID NO: 2829119 - RNA, 15 nt, Human
cgcgacuaauuucaa

SEQ ID NO: 2829120 - RNA, 21 nt, Human
cgcgucgcccucccaggcucu

SEQ ID NO: 2829121 - RNA, 12 nt, Human
cgcgucuccugu

SEQ ID NO: 2829122 - RNA, 13 nt, Human
cgcgucuccuguu

SEQ ID NO: 2829123 - RNA, 23 nt, Human
cgcguguccccggggcccagggg

SEQ ID NO: 2829124 - RNA, 14 nt, Human
cgcuaccucccucc

SEQ ID NO: 2829125 - RNA, 15 nt, Human
cgcuaccucccuccc

SEQ ID NO: 2829126 - RNA, 15 nt, Human
cgcuaccucucuguc

SEQ ID NO: 2829127 - RNA, 17 nt, Human
cgcuaccucucuguccc

SEQ ID NO: 2829128 - RNA, 16 nt, Human
cgcuacuauaaagaga

SEQ ID NO: 2829129 - RNA, 17 nt, Human
cgcuacuauaaagagaa

SEQ ID NO: 2829130 - RNA, 15 nt, Human
cgcuagagcagccca

SEQ ID NO: 2829131 - RNA, 17 nt, Human
cgcuagagcagcccaaa

SEQ ID NO: 2829132 - RNA, 13 nt, Human
cgcccucuuccug

SEQ ID NO: 2829133 - RNA, 14 nt, Human
cgcccucuuccuga

SEQ ID NO: 2829134 - RNA, 15 nt, Human
cgcccucuuccugac

SEQ ID NO: 2829135 - RNA, 14 nt, Human
cgccccccucccag

SEQ ID NO: 2829136 - RNA, 15 nt, Human
cgccccccucccaga

SEQ ID NO: 2829137 - RNA, 17 nt, Human
cgccccccucccagagg

SEQ ID NO: 2829138 - RNA, 12 nt, Human
cgcccccugccc

SEQ ID NO: 2829139 - RNA, 14 nt, Human
cgcccccuccucua

SEQ ID NO: 2829140 - RNA, 22 nt, Human
cgcccuccccuccccugcugca

SEQ ID NO: 2829141 - RNA, 16 nt, Human
cgcccuccuuucugug

SEQ ID NO: 2829142 - RNA, 14 nt, Human
cgcccuccccuccc

SEQ ID NO: 2829143 - RNA, 16 nt, Human
cgcccuccccuccccu

SEQ ID NO: 2829144 - RNA, 18 nt, Human
cgcccuccccuccccugc

SEQ ID NO: 2829145 - RNA, 20 nt, Human
cgcccuccccuccccugcug

SEQ ID NO: 2829146 - RNA, 23 nt, Human
cgcccgucugugugugaccccuc

SEQ ID NO: 2829147 - RNA, 13 nt, Human
cgcccucccaggc

SEQ ID NO: 2829148 - RNA, 12 nt, Human
cgcccucccagg

SEQ ID NO: 2829149 - RNA, 19 nt, Human
cgcccccacccugagcgcc

SEQ ID NO: 2829150 - RNA, 11 nt, Human
cgcccccagcc

SEQ ID NO: 2829151 - RNA, 13 nt, Human
cgcccccagccua

SEQ ID NO: 2829152 - RNA, 15 nt, Human
cgcccaggagacauc

SEQ ID NO: 2829153 - RNA, 12 nt, Human
cgcccaggcugg

SEQ ID NO: 2829154 - RNA, 20 nt, Human
cgcccaggcuggagugcaau

SEQ ID NO: 2829155 - RNA, 19 nt, Human
cgcccaggcuggagugcaa

SEQ ID NO: 2829156 - RNA, 15 nt, Human
cgcccagcugcaccu

SEQ ID NO: 2829157 - RNA, 13 nt, Human
cgcagaagcccug

SEQ ID NO: 2829158 - RNA, 20 nt, Human
cgcccagcugcaccugccag

SEQ ID NO: 2829159 - RNA, 18 nt, Human
cgcccagcugcaccugcc

SEQ ID NO: 2829160 - RNA, 23 nt, Human
cgcccagcugcaccugccagccu

SEQ ID NO: 2829161 - RNA, 11 nt, Human
cgcccaggaga

SEQ ID NO: 2829162 - RNA, 20 nt, Human
cguuuacuaugccugugucu

SEQ ID NO: 2829163 - RNA, 13 nt, Human
cguuuagaccaag

SEQ ID NO: 2829164 - RNA, 15 nt, Human
cguuuagaccaagga

SEQ ID NO: 2829165 - RNA, 16 nt, Human
cguuuagaccaaggaa

SEQ ID NO: 2829166 - RNA, 18 nt, Human
cguuuagaccaaggaaca

SEQ ID NO: 2829167 - RNA, 21 nt, Human
cguuuagaccaaggaacaaaa

SEQ ID NO: 2829168 - RNA, 19 nt, Human
cguucuuaggcugcuggga

SEQ ID NO: 2829169 - RNA, 20 nt, Human
cguucuuaggcugcugggau

SEQ ID NO: 2829170 - RNA, 12 nt, Human
cguucucugccu

SEQ ID NO: 2829171 - RNA, 19 nt, Human
cguuccugacaucacagca

SEQ ID NO: 2829172 - RNA, 21 nt, Human
cguuccugacaucacagcagc

SEQ ID NO: 2829173 - RNA, 22 nt, Human
cguuccugacaucacagcagcc

SEQ ID NO: 2829174 - RNA, 22 nt, Human
cguuccuucaaagcaaaugucu

SEQ ID NO: 2829175 - RNA, 20 nt, Human
cguuccaugaugcugggauu

SEQ ID NO: 2829176 - RNA, 15 nt, Human
cguuuuggaagcucu

SEQ ID NO: 2829177 - RNA, 23 nt, Human
cguuuugugugguggcaccuccu

SEQ ID NO: 2829178 - RNA, 20 nt, Human
cguuuugaagcuacugugug

SEQ ID NO: 2829179 - RNA, 13 nt, Human
cguuuugaagcua

SEQ ID NO: 2829180 - RNA, 15 nt, Human
cguuuucuguuugga

SEQ ID NO: 2829181 - RNA, 17 nt, Human
cguuugaccuuuuaugu

SEQ ID NO: 2829182 - RNA, 19 nt, Human
cguuuuccaaacugacuca

SEQ ID NO: 2829183 - RNA, 20 nt, Human
cguuuccugagaagugucua

SEQ ID NO: 2829184 - RNA, 18 nt, Human
cguuucuccaccuagacu

SEQ ID NO: 2829185 - RNA, 22 nt, Human
cguuucuccaccuagacuguaa

SEQ ID NO: 2829186 - RNA, 15 nt, Human
cguuucuucacuuuu

SEQ ID NO: 2829187 - RNA, 11 nt, Human
cguucauuugu

SEQ ID NO: 2829188 - RNA, 12 nt, Human
cguucauuugug

SEQ ID NO: 2829189 - RNA, 12 nt, Human
cguuccacaguu

SEQ ID NO: 2829190 - RNA, 14 nt, Human
cguuccacaguugc

SEQ ID NO: 2829191 - RNA, 16 nt, Human
cguuccacaguugcca

SEQ ID NO: 2829192 - RNA, 17 nt, Human
cguuccacaguugccac

SEQ ID NO: 2829193 - RNA, 19 nt, Human
cguuccacaguugccacca

SEQ ID NO: 2829194 - RNA, 20 nt, Human
cguuccacaguugccaccac

SEQ ID NO: 2829195 - RNA, 22 nt, Human
cguuccacaguugccaccaccu

SEQ ID NO: 2829196 - RNA, 22 nt, Human
cguggcugcgugccccugcugc

SEQ ID NO: 2829197 - RNA, 16 nt, Human
cgugccuggccacgcc

SEQ ID NO: 2829198 - RNA, 12 nt, Human
cgugccuggcca

SEQ ID NO: 2829199 - RNA, 13 nt, Human
cgugccuucagcu

SEQ ID NO: 2829200 - RNA, 15 nt, Human
cgugccuucagcucu

SEQ ID NO: 2829201 - RNA, 16 nt, Human
cgugccuucagcucua

SEQ ID NO: 2829202 - RNA, 18 nt, Human
cgugccuucagcucuaca

SEQ ID NO: 2829203 - RNA, 15 nt, Human
cguggcccugcccuc

SEQ ID NO: 2829204 - RNA, 18 nt, Human
cguggcccugcccucucc

SEQ ID NO: 2829205 - RNA, 15 nt, Human
cgucuggaaguccaa

SEQ ID NO: 2829206 - RNA, 23 nt, Human
cgucucuggagcggaauuuaccu

SEQ ID NO: 2829207 - RNA, 15 nt, Human
cgucugaagcuugac

SEQ ID NO: 2829208 - RNA, 18 nt, Human
cgucugaagcuugacucc

SEQ ID NO: 2829209 - RNA, 21 nt, Human
cgucugaagcuugacucccaa

SEQ ID NO: 2829210 - RNA, 14 nt, Human
cgucugacaggcaa

SEQ ID NO: 2829211 - RNA, 13 nt, Human
cgucugacaggca

SEQ ID NO: 2829212 - RNA, 22 nt, Human
cgucccccucuggcuccagcug

SEQ ID NO: 2829213 - RNA, 15 nt, Human
cgucccuagcaguga

SEQ ID NO: 2829214 - RNA, 16 nt, Human
cgucccuagcagugaa

SEQ ID NO: 2829215 - RNA, 13 nt, Human
cguccccuccccc

SEQ ID NO: 2829216 - RNA, 21 nt, Human
cguccccucccccaccccugc

SEQ ID NO: 2829217 - RNA, 22 nt, Human
cguccccucccccaccccugcu

SEQ ID NO: 2829218 - RNA, 17 nt, Human
cgucgaggggcucucag

SEQ ID NO: 2829219 - RNA, 16 nt, Human
cgucgaggggcucuca

SEQ ID NO: 2829220 - RNA, 15 nt, Human
cgucgcccucccagg

SEQ ID NO: 2829221 - RNA, 16 nt, Human
cgucgcccucccaggc

SEQ ID NO: 2829222 - RNA, 22 nt, Human
cguccucaccccuguccucacu

SEQ ID NO: 2829223 - RNA, 20 nt, Human
cguccguggguugcuaacug

SEQ ID NO: 2829224 - RNA, 21 nt, Human
cguccguggguugcuaacuga

SEQ ID NO: 2829225 - RNA, 23 nt, Human
cguccguggguugcuaacugaac

SEQ ID NO: 2829226 - RNA, 14 nt, Human
cguccucaccccug

SEQ ID NO: 2829227 - RNA, 17 nt, Human
cguccucaccccugucc

SEQ ID NO: 2829228 - RNA, 20 nt, Human
cguccucaccccuguccuca

SEQ ID NO: 2829229 - RNA, 22 nt, Human
cgugcacacaccagagcccacc

SEQ ID NO: 2829230 - RNA, 22 nt, Human
cgugcaguggugcgaucugggu

SEQ ID NO: 2829231 - RNA, 15 nt, Human
cgugcaccuguacuc

SEQ ID NO: 2829232 - RNA, 22 nt, Human
cgugccgugugagugugacagg

SEQ ID NO: 2829233 - RNA, 16 nt, Human
cgugccgccugcacuc

SEQ ID NO: 2829234 - RNA, 15 nt, Human
cgugccgccugcacu

SEQ ID NO: 2829235 - RNA, 13 nt, Human
cgugccccugcug

SEQ ID NO: 2829236 - RNA, 15 nt, Human
cgugccccugcugcu

SEQ ID NO: 2829237 - RNA, 18 nt, Human
cgugccccugcugcuguc

SEQ ID NO: 2829238 - RNA, 21 nt, Human
cgugcacacaccagagcccac

SEQ ID NO: 2829239 - RNA, 20 nt, Human
cgugcacacaccagagccca

SEQ ID NO: 2829240 - RNA, 12 nt, Human
cgugaacugugc

SEQ ID NO: 2829241 - RNA, 13 nt, Human
cgugaagggauuu

SEQ ID NO: 2829242 - RNA, 18 nt, Human
cgugaaaacggagcugaa

SEQ ID NO: 2829243 - RNA, 18 nt, Human
cgucugucuucacagcuc

SEQ ID NO: 2829244 - RNA, 11 nt, Human
cgucugugugc

SEQ ID NO: 2829245 - RNA, 20 nt, Human
cgucugugugugaccccucc

SEQ ID NO: 2829246 - RNA, 21 nt, Human
cgucugugugugaccccuccu

SEQ ID NO: 2829247 - RNA, 22 nt, Human
cgucugugugugaccccuccug

SEQ ID NO: 2829248 - RNA, 23 nt, Human
cgucugugugugaccccuccugg

SEQ ID NO: 2829249 - RNA, 14 nt, Human
cgucuguccaucug

SEQ ID NO: 2829250 - RNA, 15 nt, Human
cgucuguccaucugc

SEQ ID NO: 2829251 - RNA, 20 nt, Human
cgucuguccaucugcccgcc

SEQ ID NO: 2829252 - RNA, 15 nt, Human
cgucaacguuguacu

SEQ ID NO: 2829253 - RNA, 16 nt, Human
cgucaacguuguacug

SEQ ID NO: 2829254 - RNA, 17 nt, Human
cgucaacguuguacugu

SEQ ID NO: 2829255 - RNA, 21 nt, Human
cgucaacguuguacuguaugu

SEQ ID NO: 2829256 - RNA, 19 nt, Human
cgucacgugcgcugggcac

SEQ ID NO: 2829257 - RNA, 20 nt, Human
cgucacgugcgcugggcacu

SEQ ID NO: 2829258 - RNA, 17 nt, Human
cgucagaagcacccagg

SEQ ID NO: 2829259 - RNA, 11 nt, Human
cguaugaaaau

SEQ ID NO: 2829260 - RNA, 12 nt, Human
cguaugaaaaug

SEQ ID NO: 2829261 - RNA, 21 nt, Human
cguaugaaaaugaguugugaa

SEQ ID NO: 2829262 - RNA, 17 nt, Human
cguauauauaagaaaga

SEQ ID NO: 2829263 - RNA, 18 nt, Human
cguauauauaagaaagac

SEQ ID NO: 2829264 - RNA, 23 nt, Human
cguauauauaagaaagacaucuu

SEQ ID NO: 2829265 - RNA, 22 nt, Human
cguauaugucucaggucccugc

SEQ ID NO: 2829266 - RNA, 14 nt, Human
cguauuccccuucc

SEQ ID NO: 2829267 - RNA, 18 nt, Human
cguauuccccuucccacu

SEQ ID NO: 2829268 - RNA, 12 nt, Human
cguauuuuaaaa

SEQ ID NO: 2829269 - RNA, 20 nt, Human
cguauuuuaaaagccacaua

SEQ ID NO: 2829270 - RNA, 22 nt, Human
cguauuuuaaaagccacauaga

SEQ ID NO: 2829271 - RNA, 21 nt, Human
cguccaggccgcgcccuuucc

SEQ ID NO: 2829272 - RNA, 21 nt, Human
cguccagguucaacccacagc

SEQ ID NO: 2829273 - RNA, 22 nt, Human
cguccaggccgcgcccuuuccc

SEQ ID NO: 2829274 - RNA, 16 nt, Human
cguaucccgagucugg

SEQ ID NO: 2829275 - RNA, 15 nt, Human
cgucccaagauguug

SEQ ID NO: 2829276 - RNA, 21 nt, Human
cgucccccucuggcuccagcu

SEQ ID NO: 2829277 - RNA, 14 nt, Human
cgucccccucuggc

SEQ ID NO: 2829278 - RNA, 14 nt, Human
cguccacagcuucc

SEQ ID NO: 2829279 - RNA, 15 nt, Human
cguccacagcuuccu

SEQ ID NO: 2829280 - RNA, 16 nt, Human
cguccacagcuuccug

SEQ ID NO: 2829281 - RNA, 21 nt, Human
cguccagccgccauugccacc

SEQ ID NO: 2829282 - RNA, 19 nt, Human
cguccaggagccugugccu

SEQ ID NO: 2829283 - RNA, 19 nt, Human
cgucaucacuuuucaguga

SEQ ID NO: 2829284 - RNA, 17 nt, Human
cgucagucuuuuucugu

SEQ ID NO: 2829285 - RNA, 22 nt, Human
cgucagucuuuuucuguuguaa

SEQ ID NO: 2829286 - RNA, 16 nt, Human
cgucaggguuggugug

SEQ ID NO: 2829287 - RNA, 18 nt, Human
cgucaggguuggugugcu

SEQ ID NO: 2829288 - RNA, 19 nt, Human
cgucaggguuggugugcug

SEQ ID NO: 2829289 - RNA, 20 nt, Human
cgucaggguuggugugcuga

SEQ ID NO: 2829290 - RNA, 14 nt, Human
cggggccccagggc

SEQ ID NO: 2829291 - RNA, 19 nt, Human
cggggcaugcuggggcaag

SEQ ID NO: 2829292 - RNA, 17 nt, Human
cggggcaugcuggggca

SEQ ID NO: 2829293 - RNA, 16 nt, Human
cggggcaugcuggggc

SEQ ID NO: 2829294 - RNA, 15 nt, Human
cgguggaagagcuca

SEQ ID NO: 2829295 - RNA, 22 nt, Human
cgguggacuugaacuuuccugg

SEQ ID NO: 2829296 - RNA, 14 nt, Human
cgguggcccugucc

SEQ ID NO: 2829297 - RNA, 16 nt, Human
cgguggcccugucccu

SEQ ID NO: 2829298 - RNA, 14 nt, Human
cgggcaucuuuggg

SEQ ID NO: 2829299 - RNA, 16 nt, Human
cggugcuccaggcagg

SEQ ID NO: 2829300 - RNA, 15 nt, Human
cggggccccagggcu

SEQ ID NO: 2829301 - RNA, 13 nt, Human
cggugcuccaggc

SEQ ID NO: 2829302 - RNA, 14 nt, Human
cggugcuccaggca

SEQ ID NO: 2829303 - RNA, 15 nt, Human
cggugcuccaggcag

SEQ ID NO: 2829304 - RNA, 21 nt, Human
cguaggaugaaaagauucuuc

SEQ ID NO: 2829305 - RNA, 22 nt, Human
cguagcuucuaccaugaacaga

SEQ ID NO: 2829306 - RNA, 20 nt, Human
cguagccaaggugggcugag

SEQ ID NO: 2829307 - RNA, 20 nt, Human
cguagcgugcccgugugcau

SEQ ID NO: 2829308 - RNA, 15 nt, Human
ccuggugcugccaca

SEQ ID NO: 2829309 - RNA, 18 nt, Human
ccuggugcugccacacuu

SEQ ID NO: 2829310 - RNA, 21 nt, Human
ccuggugcugccacacuucag

SEQ ID NO: 2829311 - RNA, 15 nt, Human
ccuggugcuuccaaa

SEQ ID NO: 2829312 - RNA, 13 nt, Human
ccugguggcagcu

SEQ ID NO: 2829313 - RNA, 12 nt, Human
ccugguggcagc

SEQ ID NO: 2829314 - RNA, 20 nt, Human
ccugguggacaguccuggga

SEQ ID NO: 2829315 - RNA, 19 nt, Human
ccugguggacaguccuggg

SEQ ID NO: 2829316 - RNA, 18 nt, Human
ccugguggacaguccugg

SEQ ID NO: 2829317 - RNA, 17 nt, Human
ccugguggacaguccug

SEQ ID NO: 2829318 - RNA, 14 nt, Human
ccugguggacaguc

SEQ ID NO: 2829319 - RNA, 12 nt, Human
ccugguggacag

SEQ ID NO: 2829320 - RNA, 14 nt, Human
ccuguaauucagug

SEQ ID NO: 2829321 - RNA, 15 nt, Human
ccuguaauucagugu

SEQ ID NO: 2829322 - RNA, 17 nt, Human
ccuguaauucaguguau

SEQ ID NO: 2829323 - RNA, 18 nt, Human
ccuguaaucccagcacuu

SEQ ID NO: 2829324 - RNA, 18 nt, Human
ccuguacuguucuguguc

SEQ ID NO: 2829325 - RNA, 23 nt, Human
ccuguacucaggaggcugagggg

SEQ ID NO: 2829326 - RNA, 17 nt, Human
ccuguacuguucugugu

SEQ ID NO: 2829327 - RNA, 22 nt, Human
ccuguacucaggaggcugaggg

SEQ ID NO: 2829328 - RNA, 21 nt, Human
ccuguacucaggaggcugagg

SEQ ID NO: 2829329 - RNA, 15 nt, Human
ccuguacucaggagg

SEQ ID NO: 2829330 - RNA, 14 nt, Human
ccuguacucaggag

SEQ ID NO: 2829331 - RNA, 13 nt, Human
ccuguacucagga

SEQ ID NO: 2829332 - RNA, 23 nt, Human
ccuguaccuuuugaggagcccca

SEQ ID NO: 2829333 - RNA, 22 nt, Human
ccuguaccuuuugaggagcccc

SEQ ID NO: 2829334 - RNA, 14 nt, Human
ccuguauuuaagca

SEQ ID NO: 2829335 - RNA, 16 nt, Human
ccuguauuuaagcaaa

SEQ ID NO: 2829336 - RNA, 17 nt, Human
ccuguauuuaagcaaau

SEQ ID NO: 2829337 - RNA, 18 nt, Human
ccuguauuuaagcaaaua

SEQ ID NO: 2829338 - RNA, 19 nt, Human
ccuguauuuaagcaaauac

SEQ ID NO: 2829339 - RNA, 20 nt, Human
ccuguauuuaagcaaauacu

SEQ ID NO: 2829340 - RNA, 13 nt, Human
ccuguauguuguc

SEQ ID NO: 2829341 - RNA, 14 nt, Human
ccuguauguugucc

SEQ ID NO: 2829342 - RNA, 19 nt, Human
ccuguaguugcguggacuc

SEQ ID NO: 2829343 - RNA, 16 nt, Human
ccuguaugucuccagu

SEQ ID NO: 2829344 - RNA, 17 nt, Human
ccuguaugucuccagua

SEQ ID NO: 2829345 - RNA, 14 nt, Human
ccuguaugucuguc

SEQ ID NO: 2829346 - RNA, 15 nt, Human
ccuguaugucuguca

SEQ ID NO: 2829347 - RNA, 16 nt, Human
ccuguaugucugucau

SEQ ID NO: 2829348 - RNA, 18 nt, Human
ccuguaugucugucauug

SEQ ID NO: 2829349 - RNA, 19 nt, Human
ccuguaugucugucauugu

SEQ ID NO: 2829350 - RNA, 14 nt, Human
ccugucacauugca

SEQ ID NO: 2829351 - RNA, 15 nt, Human
ccugucacauugcau

SEQ ID NO: 2829352 - RNA, 20 nt, Human
ccugucacauugcauucuau

SEQ ID NO: 2829353 - RNA, 21 nt, Human
ccugucacauugcauucuauu

SEQ ID NO: 2829354 - RNA, 15 nt, Human
ccuguaguuaggaaa

SEQ ID NO: 2829355 - RNA, 14 nt, Human
ccuguaguuaggaa

SEQ ID NO: 2829356 - RNA, 13 nt, Human
ccuguaguccuag

SEQ ID NO: 2829357 - RNA, 19 nt, Human
ccuguaguuaggaaauaaa

SEQ ID NO: 2829358 - RNA, 18 nt, Human
ccuguaguuaggaaauaa

SEQ ID NO: 2829359 - RNA, 17 nt, Human
ccuguaguuaggaaaua

SEQ ID NO: 2829360 - RNA, 16 nt, Human
ccuguaguuaggaaau

SEQ ID NO: 2829361 - RNA, 22 nt, Human
ccuguaguuaggaaauaaaacc

SEQ ID NO: 2829362 - RNA, 21 nt, Human
ccuguaguuaggaaauaaaac

SEQ ID NO: 2829363 - RNA, 23 nt, Human
ccuguaguuaggaaauaaaaccu

SEQ ID NO: 2829364 - RNA, 18 nt, Human
ccuguaguugcguggacu

SEQ ID NO: 2829365 - RNA, 21 nt, Human
ccugugccuccucacccccag

SEQ ID NO: 2829366 - RNA, 20 nt, Human
ccugugccuccucaccccca

SEQ ID NO: 2829367 - RNA, 15 nt, Human
ccugugccuccucac

SEQ ID NO: 2829368 - RNA, 20 nt, Human
ccugugcauguaugucuugg

SEQ ID NO: 2829369 - RNA, 14 nt, Human
ccugugcauguaug

SEQ ID NO: 2829370 - RNA, 17 nt, Human
ccugugcauguaugucu

SEQ ID NO: 2829371 - RNA, 17 nt, Human
ccugugcaaugcauuag

SEQ ID NO: 2829372 - RNA, 12 nt, Human
ccugugcacaca

SEQ ID NO: 2829373 - RNA, 13 nt, Human
ccugugcacacac

SEQ ID NO: 2829374 - RNA, 14 nt, Human
ccugugcacacaca

SEQ ID NO: 2829375 - RNA, 17 nt, Human
ccugugcacacacacac

SEQ ID NO: 2829376 - RNA, 22 nt, Human
ccugugcacacacacacacaug

SEQ ID NO: 2829377 - RNA, 21 nt, Human
ccugugaggagccccaucugu

SEQ ID NO: 2829378 - RNA, 17 nt, Human
ccugugcaaaaaaauua

SEQ ID NO: 2829379 - RNA, 20 nt, Human
ccugugauccacccaacccu

SEQ ID NO: 2829380 - RNA, 17 nt, Human
ccugugaucuuauuuuu

SEQ ID NO: 2829381 - RNA, 19 nt, Human
ccugugaucuuauuuuucu

SEQ ID NO: 2829382 - RNA, 21 nt, Human
ccugugaucuuauuuuucuaa

SEQ ID NO: 2829383 - RNA, 22 nt, Human
ccugugaucuuauuuuucuaaa

SEQ ID NO: 2829384 - RNA, 16 nt, Human
ccugugaugcugggca

SEQ ID NO: 2829385 - RNA, 17 nt, Human
ccugugagguuucccaa

SEQ ID NO: 2829386 - RNA, 19 nt, Human
ccugugagguuucccaaug

SEQ ID NO: 2829387 - RNA, 15 nt, Human
ccugugaguaaauau

SEQ ID NO: 2829388 - RNA, 16 nt, Human
ccugugaguaaauauu

SEQ ID NO: 2829389 - RNA, 17 nt, Human
ccugugaguaaauauug

SEQ ID NO: 2829390 - RNA, 16 nt, Human
ccuguccucccauccc

SEQ ID NO: 2829391 - RNA, 22 nt, Human
ccuguccucacugcucccugaa

SEQ ID NO: 2829392 - RNA, 21 nt, Human
ccuguccucacugcucccuga

SEQ ID NO: 2829393 - RNA, 17 nt, Human
ccuguccucccaucccc

SEQ ID NO: 2829394 - RNA, 21 nt, Human
ccuguccucccauccccugga

SEQ ID NO: 2829395 - RNA, 22 nt, Human
ccuguccucccauccccuggac

SEQ ID NO: 2829396 - RNA, 23 nt, Human
ccuguccucccauccccuggacu

SEQ ID NO: 2829397 - RNA, 18 nt, Human
ccugugacuucagcucug

SEQ ID NO: 2829398 - RNA, 12 nt, Human
ccuguccccgca

SEQ ID NO: 2829399 - RNA, 14 nt, Human
ccuguccccgcagc

SEQ ID NO: 2829400 - RNA, 16 nt, Human
ccuguccagccugggc

SEQ ID NO: 2829401 - RNA, 14 nt, Human
ccuguccagccugg

SEQ ID NO: 2829402 - RNA, 12 nt, Human
ccuguccagccu

SEQ ID NO: 2829403 - RNA, 22 nt, Human
ccuguccagccugggcagccag

SEQ ID NO: 2829404 - RNA, 21 nt, Human
ccuguggaaugagugugcaug

SEQ ID NO: 2829405 - RNA, 23 nt, Human
ccuguggaaugagugugcaugga

SEQ ID NO: 2829406 - RNA, 12 nt, Human
ccugggaggccc

SEQ ID NO: 2829407 - RNA, 17 nt, Human
ccuggcugagggcagcu

SEQ ID NO: 2829408 - RNA, 13 nt, Human
ccugggaggcagu

SEQ ID NO: 2829409 - RNA, 16 nt, Human
ccuggccuuuccuggu

SEQ ID NO: 2829410 - RNA, 20 nt, Human
ccuggcgacugccccugccu

SEQ ID NO: 2829411 - RNA, 22 nt, Human
ccuggcuaauaaggcuuuagug

SEQ ID NO: 2829412 - RNA, 13 nt, Human
ccuggcucuugug

SEQ ID NO: 2829413 - RNA, 20 nt, Human
ccuggcucuguggcuugcua

SEQ ID NO: 2829414 - RNA, 17 nt, Human
ccuggcucuguggcuug

SEQ ID NO: 2829415 - RNA, 20 nt, Human
ccuggcucuugugcuggaug

SEQ ID NO: 2829416 - RNA, 22 nt, Human
ccuggcucuuucgucacccuug

SEQ ID NO: 2829417 - RNA, 23 nt, Human
ccuggcucuuucgucacccuugg

SEQ ID NO: 2829418 - RNA, 22 nt, Human
ccuggcucugcaaugggcacug

SEQ ID NO: 2829419 - RNA, 15 nt, Human
ccuggcucugcuguc

SEQ ID NO: 2829420 - RNA, 17 nt, Human
ccuggcucugcuguccc

SEQ ID NO: 2829421 - RNA, 13 nt, Human
ccuggccaggagc

SEQ ID NO: 2829422 - RNA, 14 nt, Human
ccuggccaggagcu

SEQ ID NO: 2829423 - RNA, 22 nt, Human
ccuggccaggagcucuucaggc

SEQ ID NO: 2829424 - RNA, 21 nt, Human
ccuggccaggagcucuucagg

SEQ ID NO: 2829425 - RNA, 20 nt, Human
ccuggccaggagcucuucag

SEQ ID NO: 2829426 - RNA, 19 nt, Human
ccuggccaggagcucuuca

SEQ ID NO: 2829427 - RNA, 18 nt, Human
ccuggccaggagcucuuc

SEQ ID NO: 2829428 - RNA, 16 nt, Human
ccuggccaggagcucu

SEQ ID NO: 2829429 - RNA, 15 nt, Human
ccuggccaggagcuc

SEQ ID NO: 2829430 - RNA, 15 nt, Human
ccuggcccccugagu

SEQ ID NO: 2829431 - RNA, 18 nt, Human
ccuggccccucaaccucc

SEQ ID NO: 2829432 - RNA, 22 nt, Human
ccuggccaggcagaucugugcc

SEQ ID NO: 2829433 - RNA, 14 nt, Human
ccuggccaggcaga

SEQ ID NO: 2829434 - RNA, 14 nt, Human
ccuggccagggccu

SEQ ID NO: 2829435 - RNA, 15 nt, Human
ccuggccagggccug

SEQ ID NO: 2829436 - RNA, 19 nt, Human
ccuggccagggccuggaag

SEQ ID NO: 2829437 - RNA, 20 nt, Human
ccuggccagggccuggaaga

SEQ ID NO: 2829438 - RNA, 23 nt, Human
ccuggccagggccuggaagacag

SEQ ID NO: 2829439 - RNA, 13 nt, Human
ccuggacugggag

SEQ ID NO: 2829440 - RNA, 14 nt, Human
ccuggacugggagg

SEQ ID NO: 2829441 - RNA, 14 nt, Human
ccuggacuguuuuc

SEQ ID NO: 2829442 - RNA, 17 nt, Human
ccuggacugggagguag

SEQ ID NO: 2829443 - RNA, 18 nt, Human
ccuggacugggagguaga

SEQ ID NO: 2829444 - RNA, 20 nt, Human
ccuggagcaaucacagauga

SEQ ID NO: 2829445 - RNA, 21 nt, Human
ccuggagcaaucacagaugag

SEQ ID NO: 2829446 - RNA, 18 nt, Human
ccuggagcagaccacccc

SEQ ID NO: 2829447 - RNA, 12 nt, Human
ccuggcagccgu

SEQ ID NO: 2829448 - RNA, 18 nt, Human
ccuggcagccgugccuuc

SEQ ID NO: 2829449 - RNA, 19 nt, Human
ccuggcagccgugccuuca

SEQ ID NO: 2829450 - RNA, 21 nt, Human
ccuggaccugcccugggccac

SEQ ID NO: 2829451 - RNA, 23 nt, Human
ccuggaccugcccugggccacac

SEQ ID NO: 2829452 - RNA, 13 nt, Human
ccuggaccugccu

SEQ ID NO: 2829453 - RNA, 14 nt, Human
ccuggaccugccuc

SEQ ID NO: 2829454 - RNA, 16 nt, Human
ccuggaccugccuccu

SEQ ID NO: 2829455 - RNA, 20 nt, Human
ccuggaccugccuccugccu

SEQ ID NO: 2829456 - RNA, 22 nt, Human
ccuggaccugccuccugccugc

SEQ ID NO: 2829457 - RNA, 23 nt, Human
ccuggaccugccuccugccugcc

SEQ ID NO: 2829458 - RNA, 22 nt, Human
ccuggacuagagggaccucucc

SEQ ID NO: 2829459 - RNA, 15 nt, Human
ccuggacuagaggga

SEQ ID NO: 2829460 - RNA, 14 nt, Human
ccuggacuccugca

SEQ ID NO: 2829461 - RNA, 23 nt, Human
ccuggacaguaucccacauccaa

SEQ ID NO: 2829462 - RNA, 19 nt, Human
ccuggacaguaucccacau

SEQ ID NO: 2829463 - RNA, 20 nt, Human
ccuggacauuugccuugcug

SEQ ID NO: 2829464 - RNA, 21 nt, Human
ccuggacauuugccuugcugg

SEQ ID NO: 2829465 - RNA, 22 nt, Human
ccuggaaaggcucagucucagg

SEQ ID NO: 2829466 - RNA, 21 nt, Human
ccuggaaaggcucagucucag

SEQ ID NO: 2829467 - RNA, 20 nt, Human
ccuggaaaggcucagucuca

SEQ ID NO: 2829468 - RNA, 17 nt, Human
ccuggaaaggcucaguc

SEQ ID NO: 2829469 - RNA, 15 nt, Human
ccuggaaaggcucag

SEQ ID NO: 2829470 - RNA, 17 nt, Human
ccugcuuugggcugccc

SEQ ID NO: 2829471 - RNA, 18 nt, Human
ccugcuuugggcugcccu

SEQ ID NO: 2829472 - RNA, 16 nt, Human
ccugcuuuuugaaaug

SEQ ID NO: 2829473 - RNA, 17 nt, Human
ccugcuuuuugaaauga

SEQ ID NO: 2829474 - RNA, 22 nt, Human
ccugcuuuuugaaaugaaauuu

SEQ ID NO: 2829475 - RNA, 23 nt, Human
ccugcuuuuugaaaugaaauuua

SEQ ID NO: 2829476 - RNA, 15 nt, Human
ccugcuuuggcgggc

SEQ ID NO: 2829477 - RNA, 17 nt, Human
ccuggaaaaauuccaga

SEQ ID NO: 2829478 - RNA, 17 nt, Human
ccugcuuuagagcuagg

SEQ ID NO: 2829479 - RNA, 17 nt, Human
ccugcuggucacagccu

SEQ ID NO: 2829480 - RNA, 13 nt, Human
ccugcugguucag

SEQ ID NO: 2829481 - RNA, 18 nt, Human
ccugcucccucucccccu

SEQ ID NO: 2829482 - RNA, 20 nt, Human
ccugcucccucucccccuua

SEQ ID NO: 2829483 - RNA, 14 nt, Human
ccugcuccgcugcu

SEQ ID NO: 2829484 - RNA, 15 nt, Human
ccugcuccgcugcuc

SEQ ID NO: 2829485 - RNA, 17 nt, Human
ccugcuccgcugcuccu

SEQ ID NO: 2829486 - RNA, 20 nt, Human
ccugcuccgcugcuccuugg

SEQ ID NO: 2829487 - RNA, 21 nt, Human
ccugcuccgcugcuccuuggc

SEQ ID NO: 2829488 - RNA, 22 nt, Human
ccugcuccgcugcuccuuggcu

SEQ ID NO: 2829489 - RNA, 19 nt, Human
ccugcugguucaggguugg

SEQ ID NO: 2829490 - RNA, 18 nt, Human
ccugcuggucacagccuc

SEQ ID NO: 2829491 - RNA, 20 nt, Human
ccugcuggucacagccuccu

SEQ ID NO: 2829492 - RNA, 12 nt, Human
ccugcuucccac

SEQ ID NO: 2829493 - RNA, 14 nt, Human
ccugcuucccaccu

SEQ ID NO: 2829494 - RNA, 18 nt, Human
ccugcuucccaccucccu

SEQ ID NO: 2829495 - RNA, 20 nt, Human
ccugcuucccaccucccugc

SEQ ID NO: 2829496 - RNA, 21 nt, Human
ccugcuucccaccucccugcc

SEQ ID NO: 2829497 - RNA, 23 nt, Human
ccugcuucccaccucccugccca

SEQ ID NO: 2829498 - RNA, 24 nt, Human
ccugcuucccaccucccugcccag

SEQ ID NO: 2829499 - RNA, 15 nt, Human
ccugauuucuucagg

SEQ ID NO: 2829500 - RNA, 18 nt, Human
ccugauuugguacuuuug

SEQ ID NO: 2829501 - RNA, 19 nt, Human
ccugcaaagcccagcuuga

SEQ ID NO: 2829502 - RNA, 14 nt, Human
ccugcgucuuccgc

SEQ ID NO: 2829503 - RNA, 17 nt, Human
ccugcgucuuccgcccc

SEQ ID NO: 2829504 - RNA, 18 nt, Human
ccugcgucuuccgccccu

SEQ ID NO: 2829505 - RNA, 23 nt, Human
ccugcgucuuccgccccugccug

SEQ ID NO: 2829506 - RNA, 22 nt, Human
ccugcguuuuggaagcucugaa

SEQ ID NO: 2829507 - RNA, 17 nt, Human
ccugcguugguccagag

SEQ ID NO: 2829508 - RNA, 18 nt, Human
ccugcguugguccagagc

SEQ ID NO: 2829509 - RNA, 19 nt, Human
ccugcguugguccagagcg

SEQ ID NO: 2829510 - RNA, 12 nt, Human
ccuucagcucca

SEQ ID NO: 2829511 - RNA, 18 nt, Human
ccuucagcucacgcuuca

SEQ ID NO: 2829512 - RNA, 20 nt, Human
ccuucaauuccugggcccca

SEQ ID NO: 2829513 - RNA, 16 nt, Human
ccuucaauuccugggc

SEQ ID NO: 2829514 - RNA, 15 nt, Human
ccuucaauuccuggg

SEQ ID NO: 2829515 - RNA, 14 nt, Human
ccuucaauuccugg

SEQ ID NO: 2829516 - RNA, 19 nt, Human
ccuucaaguuagcucagga

SEQ ID NO: 2829517 - RNA, 17 nt, Human
ccuucaaguuagcucag

SEQ ID NO: 2829518 - RNA, 17 nt, Human
ccuucaguacccucuca

SEQ ID NO: 2829519 - RNA, 19 nt, Human
ccuucaguacccucucagc

SEQ ID NO: 2829520 - RNA, 20 nt, Human
ccuucaguacccucucagcu

SEQ ID NO: 2829521 - RNA, 23 nt, Human
ccuucaguacccucucagcucca

SEQ ID NO: 2829522 - RNA, 21 nt, Human
ccuucagucuugaauuucuaa

SEQ ID NO: 2829523 - RNA, 20 nt, Human
ccuucagucuugaauuucua

SEQ ID NO: 2829524 - RNA, 24 nt, Human
ccuucaguacccucucagcuccag

SEQ ID NO: 2829525 - RNA, 13 nt, Human
ccuuccacugccu

SEQ ID NO: 2829526 - RNA, 15 nt, Human
ccuuccacugccucu

SEQ ID NO: 2829527 - RNA, 16 nt, Human
ccuuccacugccucug

SEQ ID NO: 2829528 - RNA, 17 nt, Human
ccuuccacugccucugc

SEQ ID NO: 2829529 - RNA, 18 nt, Human
ccuuccacugccucugcc

SEQ ID NO: 2829530 - RNA, 20 nt, Human
ccuuccacugccucugccuu

SEQ ID NO: 2829531 - RNA, 21 nt, Human
ccuuccacugccucugccuua

SEQ ID NO: 2829532 - RNA, 13 nt, Human
ccuuccagacaua

SEQ ID NO: 2829533 - RNA, 14 nt, Human
ccuuccagacauac

SEQ ID NO: 2829534 - RNA, 22 nt, Human
ccuuccagacauacgaaacaca

SEQ ID NO: 2829535 - RNA, 19 nt, Human
ccuuccaugucgccucugc

SEQ ID NO: 2829536 - RNA, 20 nt, Human
ccuuccaugucgccucugca

SEQ ID NO: 2829537 - RNA, 21 nt, Human
ccuuccaugucgccucugcau

SEQ ID NO: 2829538 - RNA, 23 nt, Human
ccuuccaugucgccucugcauuc

SEQ ID NO: 2829539 - RNA, 14 nt, Human
ccuuccucuggggc

SEQ ID NO: 2829540 - RNA, 15 nt, Human
ccuuccucuggggcu

SEQ ID NO: 2829541 - RNA, 22 nt, Human
ccuuccucuggggcucuagggu

SEQ ID NO: 2829542 - RNA, 12 nt, Human
ccuuccucuucg

SEQ ID NO: 2829543 - RNA, 14 nt, Human
ccuuccucuucggc

SEQ ID NO: 2829544 - RNA, 20 nt, Human
ccuuccucuucggcccucag

SEQ ID NO: 2829545 - RNA, 14 nt, Human
ccugugcuggggga

SEQ ID NO: 2829546 - RNA, 20 nt, Human
ccuucccaaguaagaggcug

SEQ ID NO: 2829547 - RNA, 21 nt, Human
ccuucccaaguaagaggcugg

SEQ ID NO: 2829548 - RNA, 14 nt, Human
ccuuccucugaggc

SEQ ID NO: 2829549 - RNA, 13 nt, Human
ccuuccugcuuga

SEQ ID NO: 2829550 - RNA, 15 nt, Human
ccuucgauacaccgg

SEQ ID NO: 2829551 - RNA, 20 nt, Human
ccuucgauacaccgggccug

SEQ ID NO: 2829552 - RNA, 22 nt, Human
ccuucgauacaccgggccugga

SEQ ID NO: 2829553 - RNA, 23 nt, Human
ccuucgauacaccgggccuggag

SEQ ID NO: 2829554 - RNA, 13 nt, Human
ccuucgccaccug

SEQ ID NO: 2829555 - RNA, 23 nt, Human
ccuguggaacauaaaaaggacau

SEQ ID NO: 2829556 - RNA, 19 nt, Human
ccuguggaacauaaaaagg

SEQ ID NO: 2829557 - RNA, 24 nt, Human
ccuguggaacauaaaaaggacauc

SEQ ID NO: 2829558 - RNA, 15 nt, Human
ccuguggaacccagc

SEQ ID NO: 2829559 - RNA, 17 nt, Human
ccuguggaacccagcag

SEQ ID NO: 2829560 - RNA, 22 nt, Human
ccuguggaacccagcaguucug

SEQ ID NO: 2829561 - RNA, 19 nt, Human
ccuguggaagagugugugu

SEQ ID NO: 2829562 - RNA, 14 nt, Human
ccuguggcccuggc

SEQ ID NO: 2829563 - RNA, 13 nt, Human
ccuguggcccugu

SEQ ID NO: 2829564 - RNA, 18 nt, Human
ccuguggcccuguccugc

SEQ ID NO: 2829565 - RNA, 21 nt, Human
ccuguggcccuguccugccau

SEQ ID NO: 2829566 - RNA, 22 nt, Human
ccuguggcccuguccugccaug

SEQ ID NO: 2829567 - RNA, 23 nt, Human
ccuguggcaucuuugccuugggc

SEQ ID NO: 2829568 - RNA, 18 nt, Human
ccuguggcaucuuugccu

SEQ ID NO: 2829569 - RNA, 13 nt, Human
ccuuacccuggga

SEQ ID NO: 2829570 - RNA, 14 nt, Human
ccuuacccuuagaa

SEQ ID NO: 2829571 - RNA, 15 nt, Human
ccuuacccuuagaau

SEQ ID NO: 2829572 - RNA, 15 nt, Human
ccuuagaaaaugugu

SEQ ID NO: 2829573 - RNA, 16 nt, Human
ccuuagaaaauguguc

SEQ ID NO: 2829574 - RNA, 18 nt, Human
ccuuagaaauguaaacug

SEQ ID NO: 2829575 - RNA, 19 nt, Human
ccuuagaaauguaaacugc

SEQ ID NO: 2829576 - RNA, 21 nt, Human
ccuuagaaauguaaacugcca

SEQ ID NO: 2829577 - RNA, 22 nt, Human
ccuuagaaauguaaacugccau

SEQ ID NO: 2829578 - RNA, 23 nt, Human
ccuuagaaauguaaacugccaua

SEQ ID NO: 2829579 - RNA, 14 nt, Human
ccuuagaaccuuuc

SEQ ID NO: 2829580 - RNA, 15 nt, Human
ccuuagaaccuuucu

SEQ ID NO: 2829581 - RNA, 16 nt, Human
ccuuagaaccuuucuu

SEQ ID NO: 2829582 - RNA, 18 nt, Human
ccuuagaaccuuucuuac

SEQ ID NO: 2829583 - RNA, 22 nt, Human
ccuuauuugcuaaucaaagcca

SEQ ID NO: 2829584 - RNA, 19 nt, Human
ccuucaaagcaaaugucuu

SEQ ID NO: 2829585 - RNA, 14 nt, Human
ccuucaaccauucc

SEQ ID NO: 2829586 - RNA, 19 nt, Human
ccuucaagaacucugggcu

SEQ ID NO: 2829587 - RNA, 17 nt, Human
ccuucaacguuucuuca

SEQ ID NO: 2829588 - RNA, 19 nt, Human
ccuucaacguuucuucacu

SEQ ID NO: 2829589 - RNA, 21 nt, Human
ccuucaacguuucuucacuuu

SEQ ID NO: 2829590 - RNA, 23 nt, Human
ccuucaagccagcaacacagagc

SEQ ID NO: 2829591 - RNA, 20 nt, Human
ccuuagagguccucuggagc

SEQ ID NO: 2829592 - RNA, 23 nt, Human
ccuuagauugaaguaaacugcag

SEQ ID NO: 2829593 - RNA, 19 nt, Human
ccuuagauuuaguagugua

SEQ ID NO: 2829594 - RNA, 15 nt, Human
ccuucaaagcaaaug

SEQ ID NO: 2829595 - RNA, 18 nt, Human
ccuuauuuucaagaaacu

SEQ ID NO: 2829596 - RNA, 14 nt, Human
ccuuauuuucaaga

SEQ ID NO: 2829597 - RNA, 17 nt, Human
ccuuagagguccucugg

SEQ ID NO: 2829598 - RNA, 19 nt, Human
ccuuagagguccucuggag

SEQ ID NO: 2829599 - RNA, 18 nt, Human
ccuuagagguccucugga

SEQ ID NO: 2829600 - RNA, 16 nt, Human
ccuuagaccuuccaua

SEQ ID NO: 2829601 - RNA, 16 nt, Human
ccuugaacuggguacu

SEQ ID NO: 2829602 - RNA, 14 nt, Human
ccuugaacugggua

SEQ ID NO: 2829603 - RNA, 18 nt, Human
ccuucgcuccugugucuu

SEQ ID NO: 2829604 - RNA, 15 nt, Human
ccuucgcuccugugu

SEQ ID NO: 2829605 - RNA, 14 nt, Human
ccuucgcuccugug

SEQ ID NO: 2829606 - RNA, 13 nt, Human
ccuucgcuccugu

SEQ ID NO: 2829607 - RNA, 14 nt, Human
ccuucuuuuucuuc

SEQ ID NO: 2829608 - RNA, 16 nt, Human
ccuucuuuuucuucuu

SEQ ID NO: 2829609 - RNA, 13 nt, Human
ccuucuuugauaa

SEQ ID NO: 2829610 - RNA, 13 nt, Human
ccuucuuugaaga

SEQ ID NO: 2829611 - RNA, 14 nt, Human
ccuucuuugaagaa

SEQ ID NO: 2829612 - RNA, 15 nt, Human
ccuucuuugaagaag

SEQ ID NO: 2829613 - RNA, 14 nt, Human
ccuucuuuuaugag

SEQ ID NO: 2829614 - RNA, 22 nt, Human
ccuucuuuuaugagcagaagga

SEQ ID NO: 2829615 - RNA, 24 nt, Human
ccuucuuuuaugagcagaaggaaa

SEQ ID NO: 2829616 - RNA, 19 nt, Human
ccuucuuuucucauguguu

SEQ ID NO: 2829617 - RNA, 12 nt, Human
ccuucuuuugua

SEQ ID NO: 2829618 - RNA, 18 nt, Human
ccuucuuugauaauguua

SEQ ID NO: 2829619 - RNA, 19 nt, Human
ccuucuuugauaauguuaa

SEQ ID NO: 2829620 - RNA, 20 nt, Human
ccuucuuugauaauguuaaa

SEQ ID NO: 2829621 - RNA, 21 nt, Human
ccuucuuugauaauguuaaau

SEQ ID NO: 2829622 - RNA, 17 nt, Human
ccuugacagggcacacc

SEQ ID NO: 2829623 - RNA, 15 nt, Human
ccuugacagggcaca

SEQ ID NO: 2829624 - RNA, 13 nt, Human
ccuugacagggca

SEQ ID NO: 2829625 - RNA, 14 nt, Human
ccuugacagggcac

SEQ ID NO: 2829626 - RNA, 12 nt, Human
ccuugaaugugg

SEQ ID NO: 2829627 - RNA, 12 nt, Human
ccuugaaugcug

SEQ ID NO: 2829628 - RNA, 14 nt, Human
ccuugaaugcugcc

SEQ ID NO: 2829629 - RNA, 15 nt, Human
ccuugaaugcugcca

SEQ ID NO: 2829630 - RNA, 16 nt, Human
ccuugaaugcugccag

SEQ ID NO: 2829631 - RNA, 17 nt, Human
ccuugaaugcugccagu

SEQ ID NO: 2829632 - RNA, 18 nt, Human
ccuugaaugcugccagug

SEQ ID NO: 2829633 - RNA, 19 nt, Human
ccuugaaugcugccagugu

SEQ ID NO: 2829634 - RNA, 20 nt, Human
ccuugaaugcugccagugug

SEQ ID NO: 2829635 - RNA, 22 nt, Human
ccuugaaugcugccagugugga

SEQ ID NO: 2829636 - RNA, 14 nt, Human
ccuugaucuguaua

SEQ ID NO: 2829637 - RNA, 11 nt, Human
ccuugaucauu

SEQ ID NO: 2829638 - RNA, 13 nt, Human
ccuugaucauuuu

SEQ ID NO: 2829639 - RNA, 19 nt, Human
ccuuggcaucacagggcag

SEQ ID NO: 2829640 - RNA, 19 nt, Human
ccuuggcagguccuggcca

SEQ ID NO: 2829641 - RNA, 16 nt, Human
ccuuggcauagacaug

SEQ ID NO: 2829642 - RNA, 14 nt, Human
ccuuggcaccaaag

SEQ ID NO: 2829643 - RNA, 16 nt, Human
ccuuggcaccaaagau

SEQ ID NO: 2829644 - RNA, 20 nt, Human
ccuuggcaccaaagaugcag

SEQ ID NO: 2829645 - RNA, 23 nt, Human
ccuuggcaccaaagaugcagccg

SEQ ID NO: 2829646 - RNA, 15 nt, Human
ccuugaccaggccug

SEQ ID NO: 2829647 - RNA, 16 nt, Human
ccuugaccaggccugg

SEQ ID NO: 2829648 - RNA, 12 nt, Human
ccuugaccaggc

SEQ ID NO: 2829649 - RNA, 24 nt, Human
ccucaguccuccccucacagccuc

SEQ ID NO: 2829650 - RNA, 22 nt, Human
ccucaguccuccccucacagcc

SEQ ID NO: 2829651 - RNA, 23 nt, Human
ccucaguccuccccucacagccu

SEQ ID NO: 2829652 - RNA, 16 nt, Human
ccuccccucucugcac

SEQ ID NO: 2829653 - RNA, 13 nt, Human
ccucccggugccc

SEQ ID NO: 2829654 - RNA, 15 nt, Human
ccucccuagccagca

SEQ ID NO: 2829655 - RNA, 16 nt, Human
ccucccggugcccaag

SEQ ID NO: 2829656 - RNA, 21 nt, Human
ccucccuagccagcacuugua

SEQ ID NO: 2829657 - RNA, 20 nt, Human
ccucccugaaaauguuuuuc

SEQ ID NO: 2829658 - RNA, 13 nt, Human
ccucccugcccag

SEQ ID NO: 2829659 - RNA, 14 nt, Human
ccucccugcccagg

SEQ ID NO: 2829660 - RNA, 15 nt, Human
ccucccugcccaggc

SEQ ID NO: 2829661 - RNA, 14 nt, Human
ccuccuccccacuu

SEQ ID NO: 2829662 - RNA, 13 nt, Human
ccuccuccccacu

SEQ ID NO: 2829663 - RNA, 21 nt, Human
ccuccuccccaacuguggggg

SEQ ID NO: 2829664 - RNA, 15 nt, Human
ccuccucccuguuau

SEQ ID NO: 2829665 - RNA, 19 nt, Human
ccuccucccuguuauuuuc

SEQ ID NO: 2829666 - RNA, 16 nt, Human
ccuccugagggaggac

SEQ ID NO: 2829667 - RNA, 19 nt, Human
ccuccugagggaggaccug

SEQ ID NO: 2829668 - RNA, 13 nt, Human
ccuccugccucga

SEQ ID NO: 2829669 - RNA, 14 nt, Human
ccuccuccuggacu

SEQ ID NO: 2829670 - RNA, 22 nt, Human
ccuccugugugugcgccuacag

SEQ ID NO: 2829671 - RNA, 15 nt, Human
ccuccugugugugcg

SEQ ID NO: 2829672 - RNA, 13 nt, Human
ccuccugugugug

SEQ ID NO: 2829673 - RNA, 12 nt, Human
ccuccugugggg

SEQ ID NO: 2829674 - RNA, 18 nt, Human
ccuccuguggggaaaggg

SEQ ID NO: 2829675 - RNA, 17 nt, Human
ccuccuguguacugugu

SEQ ID NO: 2829676 - RNA, 18 nt, Human
ccuccuguguacuguguc

SEQ ID NO: 2829677 - RNA, 13 nt, Human
ccuccugggcuaa

SEQ ID NO: 2829678 - RNA, 20 nt, Human
ccuccuggaaccuugcuguc

SEQ ID NO: 2829679 - RNA, 21 nt, Human
ccuccuggaaccuugcugucc

SEQ ID NO: 2829680 - RNA, 22 nt, Human
ccuccuggaaccuugcuguccu

SEQ ID NO: 2829681 - RNA, 15 nt, Human
ccuccuggccucaga

SEQ ID NO: 2829682 - RNA, 18 nt, Human
ccuccuggccucagacug

SEQ ID NO: 2829683 - RNA, 19 nt, Human
ccuccuggccucagacugc

SEQ ID NO: 2829684 - RNA, 21 nt, Human
ccuccuggccucagacugcac

SEQ ID NO: 2829685 - RNA, 13 nt, Human
ccuccuggacucc

SEQ ID NO: 2829686 - RNA, 12 nt, Human
ccuccugccucc

SEQ ID NO: 2829687 - RNA, 14 nt, Human
ccucagucucccuc

SEQ ID NO: 2829688 - RNA, 11 nt, Human
ccucaguccuc

SEQ ID NO: 2829689 - RNA, 12 nt, Human
ccucaguccucc

SEQ ID NO: 2829690 - RNA, 16 nt, Human
ccucaguccuccccuc

SEQ ID NO: 2829691 - RNA, 17 nt, Human
ccucaguccuccccuca

SEQ ID NO: 2829692 - RNA, 18 nt, Human
ccucaguccuccccucac

SEQ ID NO: 2829693 - RNA, 19 nt, Human
ccucaguccuccccucaca

SEQ ID NO: 2829694 - RNA, 20 nt, Human
ccucaguccuccccucacag

SEQ ID NO: 2829695 - RNA, 21 nt, Human
ccucaguccuccccucacagc

SEQ ID NO: 2829696 - RNA, 24 nt, Human
ccucagguguuuuuuaugaagugc

SEQ ID NO: 2829697 - RNA, 15 nt, Human
ccucaguaagacgac

SEQ ID NO: 2829698 - RNA, 19 nt, Human
ccucaguauauuuaaacuc

SEQ ID NO: 2829699 - RNA, 16 nt, Human
ccucaguccauuuaua

SEQ ID NO: 2829700 - RNA, 18 nt, Human
ccucaguccauuuauaua

SEQ ID NO: 2829701 - RNA, 20 nt, Human
ccucaguccauuuauauaug

SEQ ID NO: 2829702 - RNA, 22 nt, Human
ccucagucccaaauccuuccca

SEQ ID NO: 2829703 - RNA, 19 nt, Human
ccucaggugauccacccac

SEQ ID NO: 2829704 - RNA, 17 nt, Human
ccucaggugauccaccc

SEQ ID NO: 2829705 - RNA, 22 nt, Human
ccucaggugauccacccaccuc

SEQ ID NO: 2829706 - RNA, 21 nt, Human
ccucagguaaucgaccugccu

SEQ ID NO: 2829707 - RNA, 23 nt, Human
ccucagguaaucgaccugccucg

SEQ ID NO: 2829708 - RNA, 22 nt, Human
ccucagguaaucgaccugccuc

SEQ ID NO: 2829709 - RNA, 21 nt, Human
ccucacuaucccggcugcccu

SEQ ID NO: 2829710 - RNA, 21 nt, Human
ccucacuaggcuucugguuga

SEQ ID NO: 2829711 - RNA, 22 nt, Human
ccucacuaucccggcugcccuu

SEQ ID NO: 2829712 - RNA, 21 nt, Human
ccucagaacccuuggcuugcc

SEQ ID NO: 2829713 - RNA, 16 nt, Human
ccucagaacccuuggc

SEQ ID NO: 2829714 - RNA, 21 nt, Human
ccucagaacaaagugagacag

SEQ ID NO: 2829715 - RNA, 14 nt, Human
ccucagcauccugg

SEQ ID NO: 2829716 - RNA, 22 nt, Human
ccucagaacccuuggcuugccc

SEQ ID NO: 2829717 - RNA, 23 nt, Human
ccucagacgagacccaagggcag

SEQ ID NO: 2829718 - RNA, 23 nt, Human
ccucagaacaaagugagacaguc

SEQ ID NO: 2829719 - RNA, 12 nt, Human
ccucagacugca

SEQ ID NO: 2829720 - RNA, 16 nt, Human
ccucagacugcaccca

SEQ ID NO: 2829721 - RNA, 17 nt, Human
ccucagcauccuggcac

SEQ ID NO: 2829722 - RNA, 16 nt, Human
ccucagcauccuggca

SEQ ID NO: 2829723 - RNA, 16 nt, Human
ccucagccacacccag

SEQ ID NO: 2829724 - RNA, 19 nt, Human
ccucagccacacccaggca

SEQ ID NO: 2829725 - RNA, 18 nt, Human
ccucaggggaaaacuguu

SEQ ID NO: 2829726 - RNA, 21 nt, Human
ccucaggggaaaacuguuacc

SEQ ID NO: 2829727 - RNA, 11 nt, Human
ccucugccacc

SEQ ID NO: 2829728 - RNA, 13 nt, Human
ccucugccaccag

SEQ ID NO: 2829729 - RNA, 13 nt, Human
ccucugccacacu

SEQ ID NO: 2829730 - RNA, 18 nt, Human
ccucugccacacucugac

SEQ ID NO: 2829731 - RNA, 24 nt, Human
ccucugccaccagagaccguccuc

SEQ ID NO: 2829732 - RNA, 17 nt, Human
ccucugccaccagagac

SEQ ID NO: 2829733 - RNA, 19 nt, Human
ccucugccaccagagaccg

SEQ ID NO: 2829734 - RNA, 16 nt, Human
ccucuggaauugcuca

SEQ ID NO: 2829735 - RNA, 17 nt, Human
ccucuggagcccuaacc

SEQ ID NO: 2829736 - RNA, 18 nt, Human
ccucuggacuggcuagag

SEQ ID NO: 2829737 - RNA, 17 nt, Human
ccucuggaggggugugg

SEQ ID NO: 2829738 - RNA, 17 nt, Human
ccucuggacuggcuaga

SEQ ID NO: 2829739 - RNA, 16 nt, Human
ccucuggacuggcuag

SEQ ID NO: 2829740 - RNA, 15 nt, Human
ccucuggacuggcua

SEQ ID NO: 2829741 - RNA, 14 nt, Human
ccucuggacuggcu

SEQ ID NO: 2829742 - RNA, 21 nt, Human
ccucuggauuaggucucuguu

SEQ ID NO: 2829743 - RNA, 21 nt, Human
ccucuggcauuagaauuauuu

SEQ ID NO: 2829744 - RNA, 23 nt, Human
ccucuggcauuagaauuauuuaa

SEQ ID NO: 2829745 - RNA, 20 nt, Human
ccucuggagggguguggcuc

SEQ ID NO: 2829746 - RNA, 22 nt, Human
ccucuggagggguguggcuccu

SEQ ID NO: 2829747 - RNA, 22 nt, Human
ccucuggcuugggcagggucug

SEQ ID NO: 2829748 - RNA, 23 nt, Human
ccucugggaaaugagaaggcagc

SEQ ID NO: 2829749 - RNA, 12 nt, Human
ccucugggaacc

SEQ ID NO: 2829750 - RNA, 13 nt, Human
ccucugggaaccu

SEQ ID NO: 2829751 - RNA, 14 nt, Human
ccucugggaaccuc

SEQ ID NO: 2829752 - RNA, 15 nt, Human
ccucugggaaccucc

SEQ ID NO: 2829753 - RNA, 17 nt, Human
ccucugggaaccuccca

SEQ ID NO: 2829754 - RNA, 18 nt, Human
ccucugggaaccucccag

SEQ ID NO: 2829755 - RNA, 19 nt, Human
ccucugggaaccucccaga

SEQ ID NO: 2829756 - RNA, 20 nt, Human
ccucugggaaccucccagag

SEQ ID NO: 2829757 - RNA, 21 nt, Human
ccucugggaaccucccagagg

SEQ ID NO: 2829758 - RNA, 22 nt, Human
ccucugggaaccucccagaggu

SEQ ID NO: 2829759 - RNA, 23 nt, Human
ccucugggaaccucccagagguc

SEQ ID NO: 2829760 - RNA, 20 nt, Human
ccucugggucagugguccac

SEQ ID NO: 2829761 - RNA, 17 nt, Human
ccucugggucagugguc

SEQ ID NO: 2829762 - RNA, 17 nt, Human
ccucuggggcucuaggg

SEQ ID NO: 2829763 - RNA, 18 nt, Human
ccucuggggcucuagggu

SEQ ID NO: 2829764 - RNA, 23 nt, Human
ccucuggcuagaggccagcccca

SEQ ID NO: 2829765 - RNA, 22 nt, Human
ccucuggcuagaggccagcccc

SEQ ID NO: 2829766 - RNA, 13 nt, Human
ccucuggcuagag

SEQ ID NO: 2829767 - RNA, 12 nt, Human
ccucuggcuaga

SEQ ID NO: 2829768 - RNA, 17 nt, Human
ccucuggccgccuaggc

SEQ ID NO: 2829769 - RNA, 20 nt, Human
ccucuggccgccuaggcuca

SEQ ID NO: 2829770 - RNA, 24 nt, Human
ccucuggcuagaggccagccccac

SEQ ID NO: 2829771 - RNA, 17 nt, Human
ccucuggcuccagcugg

SEQ ID NO: 2829772 - RNA, 16 nt, Human
ccucuggcuccagcug

SEQ ID NO: 2829773 - RNA, 18 nt, Human
ccucugacacacagcucu

SEQ ID NO: 2829774 - RNA, 17 nt, Human
ccucugacacacagcuc

SEQ ID NO: 2829775 - RNA, 11 nt, Human
ccucuccugga

SEQ ID NO: 2829776 - RNA, 12 nt, Human
ccucuccuggag

SEQ ID NO: 2829777 - RNA, 13 nt, Human
ccucuccuggagg

SEQ ID NO: 2829778 - RNA, 14 nt, Human
ccucuccuggagga

SEQ ID NO: 2829779 - RNA, 15 nt, Human
ccucuccuggaggau

SEQ ID NO: 2829780 - RNA, 13 nt, Human
ccucucugcccua

SEQ ID NO: 2829781 - RNA, 12 nt, Human
ccucucccccuu

SEQ ID NO: 2829782 - RNA, 12 nt, Human
ccucuccccucc

SEQ ID NO: 2829783 - RNA, 13 nt, Human
ccucuccccucca

SEQ ID NO: 2829784 - RNA, 14 nt, Human
ccucuccccuccag

SEQ ID NO: 2829785 - RNA, 15 nt, Human
ccucuccccuccagc

SEQ ID NO: 2829786 - RNA, 16 nt, Human
ccucuccccuccagcc

SEQ ID NO: 2829787 - RNA, 17 nt, Human
ccucuccccuccagccu

SEQ ID NO: 2829788 - RNA, 15 nt, Human
ccucugacacacagc

SEQ ID NO: 2829789 - RNA, 16 nt, Human
ccucugacacacagcu

SEQ ID NO: 2829790 - RNA, 13 nt, Human
ccucucugggccu

SEQ ID NO: 2829791 - RNA, 16 nt, Human
ccucucugggccucag

SEQ ID NO: 2829792 - RNA, 10 nt, Human
ccucucuggu

SEQ ID NO: 2829793 - RNA, 12 nt, Human
ccucucuguccc

SEQ ID NO: 2829794 - RNA, 13 nt, Human
ccucucugucccu

SEQ ID NO: 2829795 - RNA, 17 nt, Human
ccucucugucccuugcu

SEQ ID NO: 2829796 - RNA, 19 nt, Human
ccucuccacugccuucgau

SEQ ID NO: 2829797 - RNA, 12 nt, Human
ccucucccaggg

SEQ ID NO: 2829798 - RNA, 12 nt, Human
ccucuccacugc

SEQ ID NO: 2829799 - RNA, 13 nt, Human
ccucuccacugcc

SEQ ID NO: 2829800 - RNA, 14 nt, Human
ccucuccacugccu

SEQ ID NO: 2829801 - RNA, 16 nt, Human
ccucuccacugccuuc

SEQ ID NO: 2829802 - RNA, 23 nt, Human
ccuccugugugugcgccuacagg

SEQ ID NO: 2829803 - RNA, 12 nt, Human
ccuccuucagac

SEQ ID NO: 2829804 - RNA, 16 nt, Human
ccucucacuaaacuuu

SEQ ID NO: 2829805 - RNA, 14 nt, Human
ccucucacucccca

SEQ ID NO: 2829806 - RNA, 17 nt, Human
ccuccuucaauuccaua

SEQ ID NO: 2829807 - RNA, 15 nt, Human
ccucucaccucugug

SEQ ID NO: 2829808 - RNA, 20 nt, Human
ccuccuuaucaaaggacacc

SEQ ID NO: 2829809 - RNA, 18 nt, Human
ccuccuuaucaaaggaca

SEQ ID NO: 2829810 - RNA, 23 nt, Human
ccucucaggauccaagcuaagca

SEQ ID NO: 2829811 - RNA, 13 nt, Human
ccucucagcucca

SEQ ID NO: 2829812 - RNA, 16 nt, Human
ccucucagcuccaggu

SEQ ID NO: 2829813 - RNA, 18 nt, Human
ccucucagcuccaggugg

SEQ ID NO: 2829814 - RNA, 15 nt, Human
ccucucaggagccau

SEQ ID NO: 2829815 - RNA, 15 nt, Human
ccucucaggauccaa

SEQ ID NO: 2829816 - RNA, 18 nt, Human
ccucucaggauccaagcu

SEQ ID NO: 2829817 - RNA, 21 nt, Human
ccugaauuuuguugcuguuuu

SEQ ID NO: 2829818 - RNA, 14 nt, Human
ccugaucugugaua

SEQ ID NO: 2829819 - RNA, 14 nt, Human
ccugaucucuuccu

SEQ ID NO: 2829820 - RNA, 15 nt, Human
ccugaucucuuccug

SEQ ID NO: 2829821 - RNA, 16 nt, Human
ccugaucucuuccugu

SEQ ID NO: 2829822 - RNA, 17 nt, Human
ccugaucucuuccuguu

SEQ ID NO: 2829823 - RNA, 20 nt, Human
ccugaucucuuccuguuuug

SEQ ID NO: 2829824 - RNA, 15 nt, Human
ccugauccugugaag

SEQ ID NO: 2829825 - RNA, 23 nt, Human
ccugaugcucccuccccugcccu

SEQ ID NO: 2829826 - RNA, 20 nt, Human
ccugaugcucccuccccugc

SEQ ID NO: 2829827 - RNA, 19 nt, Human
ccugaugcucccuccccug

SEQ ID NO: 2829828 - RNA, 16 nt, Human
ccugaugcucccuccc

SEQ ID NO: 2829829 - RNA, 14 nt, Human
ccugaugcucccuc

SEQ ID NO: 2829830 - RNA, 13 nt, Human
ccugaugcucccu

SEQ ID NO: 2829831 - RNA, 15 nt, Human
ccugaugcagucacg

SEQ ID NO: 2829832 - RNA, 16 nt, Human
ccugaugcagucacgu

SEQ ID NO: 2829833 - RNA, 21 nt, Human
ccugauguguccucagggagc

SEQ ID NO: 2829834 - RNA, 19 nt, Human
ccugauguguccucaggga

SEQ ID NO: 2829835 - RNA, 21 nt, Human
ccugaugguacaggaaagcuc

SEQ ID NO: 2829836 - RNA, 18 nt, Human
ccugaugguacaggaaag

SEQ ID NO: 2829837 - RNA, 20 nt, Human
ccugauggcaggauggccug

SEQ ID NO: 2829838 - RNA, 23 nt, Human
ccugauggcaggauggccuggcc

SEQ ID NO: 2829839 - RNA, 18 nt, Human
ccugaugcuuuugucuaa

SEQ ID NO: 2829840 - RNA, 19 nt, Human
ccugaugcuuuugucuaau

SEQ ID NO: 2829841 - RNA, 21 nt, Human
ccugauggaaguaaagccuca

SEQ ID NO: 2829842 - RNA, 17 nt, Human
ccugauggaccugucac

SEQ ID NO: 2829843 - RNA, 21 nt, Human
ccugauggcacuuagcuauca

SEQ ID NO: 2829844 - RNA, 13 nt, Human
ccugaaauuccaa

SEQ ID NO: 2829845 - RNA, 14 nt, Human
ccugaaauuccaaa

SEQ ID NO: 2829846 - RNA, 17 nt, Human
ccugaacaagaauugga

SEQ ID NO: 2829847 - RNA, 16 nt, Human
ccugaacaagaauugg

SEQ ID NO: 2829848 - RNA, 15 nt, Human
ccugaacaagaauug

SEQ ID NO: 2829849 - RNA, 13 nt, Human
ccugaacaagaau

SEQ ID NO: 2829850 - RNA, 15 nt, Human
ccugaaauuucagau

SEQ ID NO: 2829851 - RNA, 14 nt, Human
ccugaaauuucaga

SEQ ID NO: 2829852 - RNA, 14 nt, Human
ccugaaauuucacc

SEQ ID NO: 2829853 - RNA, 18 nt, Human
ccugaaauuccaaagucu

SEQ ID NO: 2829854 - RNA, 15 nt, Human
ccugaaauuccaaag

SEQ ID NO: 2829855 - RNA, 16 nt, Human
ccugaaauuccaaagu

SEQ ID NO: 2829856 - RNA, 22 nt, Human
ccucuuugucugcgugggucag

SEQ ID NO: 2829857 - RNA, 19 nt, Human
ccucuuuuguuaaauaaua

SEQ ID NO: 2829858 - RNA, 11 nt, Human
ccucuuuucuu

SEQ ID NO: 2829859 - RNA, 15 nt, Human
ccucuuuucuuacuc

SEQ ID NO: 2829860 - RNA, 20 nt, Human
ccucuuuucuuacuccuccu

SEQ ID NO: 2829861 - RNA, 21 nt, Human
ccucuuuucuuacuccuccuc

SEQ ID NO: 2829862 - RNA, 22 nt, Human
ccucuuuucuuacuccuccucu

SEQ ID NO: 2829863 - RNA, 15 nt, Human
ccucuuccucccuca

SEQ ID NO: 2829864 - RNA, 16 nt, Human
ccucuuccucccucau

SEQ ID NO: 2829865 - RNA, 19 nt, Human
ccucuuccucccucauucc

SEQ ID NO: 2829866 - RNA, 18 nt, Human
ccucuuccgugacgucac

SEQ ID NO: 2829867 - RNA, 13 nt, Human
ccucuucaccccc

SEQ ID NO: 2829868 - RNA, 17 nt, Human
ccucuucaccccccacu

SEQ ID NO: 2829869 - RNA, 17 nt, Human
ccucuucaccccggcag

SEQ ID NO: 2829870 - RNA, 20 nt, Human
ccucuucaccccggcaggcc

SEQ ID NO: 2829871 - RNA, 21 nt, Human
ccucuucaccccggcaggccc

SEQ ID NO: 2829872 - RNA, 22 nt, Human
ccucuucaccccggcaggcccu

SEQ ID NO: 2829873 - RNA, 23 nt, Human
ccucuucaccccggcaggcccug

SEQ ID NO: 2829874 - RNA, 13 nt, Human
ccucuucacuccc

SEQ ID NO: 2829875 - RNA, 14 nt, Human
ccucuucacucccc

SEQ ID NO: 2829876 - RNA, 17 nt, Human
ccugaagucacacagug

SEQ ID NO: 2829877 - RNA, 16 nt, Human
ccugaagucacacagu

SEQ ID NO: 2829878 - RNA, 15 nt, Human
ccugaagucacacag

SEQ ID NO: 2829879 - RNA, 23 nt, Human
ccugaauguauugaacuuggaaa

SEQ ID NO: 2829880 - RNA, 21 nt, Human
ccugaauguuuaaagaucaug

SEQ ID NO: 2829881 - RNA, 15 nt, Human
ccugaauucuuuuuc

SEQ ID NO: 2829882 - RNA, 22 nt, Human
ccugaaucccccuugccacccc

SEQ ID NO: 2829883 - RNA, 21 nt, Human
ccugaaggaacauuccuuagu

SEQ ID NO: 2829884 - RNA, 19 nt, Human
ccugaaucccccuugccac

SEQ ID NO: 2829885 - RNA, 20 nt, Human
ccugaaucccccuugccacc

SEQ ID NO: 2829886 - RNA, 21 nt, Human
ccugaagacucauucuucugu

SEQ ID NO: 2829887 - RNA, 18 nt, Human
ccugaagaauuaagauac

SEQ ID NO: 2829888 - RNA, 21 nt, Human
ccugaacaagaauuggaagcu

SEQ ID NO: 2829889 - RNA, 15 nt, Human
ccugaaccgcacagc

SEQ ID NO: 2829890 - RNA, 22 nt, Human
ccugaacagcauggcacucccu

SEQ ID NO: 2829891 - RNA, 23 nt, Human
ccugaacagcauggcacucccuc

SEQ ID NO: 2829892 - RNA, 20 nt, Human
ccugaaccgcacagcucagg

SEQ ID NO: 2829893 - RNA, 18 nt, Human
ccugaaccgcacagcuca

SEQ ID NO: 2829894 - RNA, 16 nt, Human
ccugaaccgcacagcu

SEQ ID NO: 2829895 - RNA, 22 nt, Human
ccugaaccgcacagcucaggag

SEQ ID NO: 2829896 - RNA, 21 nt, Human
ccugaaccgcacagcucagga

SEQ ID NO: 2829897 - RNA, 14 nt, Human
ccugaagaacagua

SEQ ID NO: 2829898 - RNA, 23 nt, Human
ccucuuaaagcugccuguaguua

SEQ ID NO: 2829899 - RNA, 19 nt, Human
ccucuuacgguaguuagga

SEQ ID NO: 2829900 - RNA, 16 nt, Human
ccucuuacuaauguaa

SEQ ID NO: 2829901 - RNA, 22 nt, Human
ccucuuaaagcugccuguaguu

SEQ ID NO: 2829902 - RNA, 21 nt, Human
ccucuuaaagcugccuguagu

SEQ ID NO: 2829903 - RNA, 20 nt, Human
ccucuuaaagcugccuguag

SEQ ID NO: 2829904 - RNA, 19 nt, Human
ccucuuaaagcugccugua

SEQ ID NO: 2829905 - RNA, 17 nt, Human
ccucuuaaagcugccug

SEQ ID NO: 2829906 - RNA, 20 nt, Human
ccucugucuucagcacccuc

SEQ ID NO: 2829907 - RNA, 14 nt, Human
ccucugucugcccu

SEQ ID NO: 2829908 - RNA, 16 nt, Human
ccucugucugcccuuc

SEQ ID NO: 2829909 - RNA, 22 nt, Human
ccucugucugcccuucacccca

SEQ ID NO: 2829910 - RNA, 22 nt, Human
ccucugucuugugaaggcaggg

SEQ ID NO: 2829911 - RNA, 14 nt, Human
ccucugugccuucu

SEQ ID NO: 2829912 - RNA, 17 nt, Human
ccucugugaccucaggc

SEQ ID NO: 2829913 - RNA, 23 nt, Human
ccucugugaggaaagcacacagu

SEQ ID NO: 2829914 - RNA, 15 nt, Human
ccucugugaccucag

SEQ ID NO: 2829915 - RNA, 23 nt, Human
ccucuguggcauugaaaugagca

SEQ ID NO: 2829916 - RNA, 16 nt, Human
ccucuguggugucugc

SEQ ID NO: 2829917 - RNA, 17 nt, Human
ccucuguggugucugcc

SEQ ID NO: 2829918 - RNA, 21 nt, Human
ccucugugccuucuuuugauu

SEQ ID NO: 2829919 - RNA, 16 nt, Human
ccucugugaccucagg

SEQ ID NO: 2829920 - RNA, 13 nt, Human
ccucuguguccuu

SEQ ID NO: 2829921 - RNA, 19 nt, Human
ccucuguguccuucccugc

SEQ ID NO: 2829922 - RNA, 20 nt, Human
ccucuguguccuucccugca

SEQ ID NO: 2829923 - RNA, 21 nt, Human
ccucuguucugcacacagcac

SEQ ID NO: 2829924 - RNA, 19 nt, Human
ccucugugugcuccuccuu

SEQ ID NO: 2829925 - RNA, 13 nt, Human
ccucugucugccc

SEQ ID NO: 2829926 - RNA, 22 nt, Human
ccucugucucauccuccuggaa

SEQ ID NO: 2829927 - RNA, 23 nt, Human
ccucugucucauccuccuggaac

SEQ ID NO: 2829928 - RNA, 24 nt, Human
ccucugucucauccuccuggaacc

SEQ ID NO: 2829929 - RNA, 17 nt, Human
ccucuguccaggcacug

SEQ ID NO: 2829930 - RNA, 14 nt, Human
ccucugucauuugu

SEQ ID NO: 2829931 - RNA, 15 nt, Human
ccucugucauuuguu

SEQ ID NO: 2829932 - RNA, 16 nt, Human
ccucugucauuuguug

SEQ ID NO: 2829933 - RNA, 19 nt, Human
ccucugguucuucauuuau

SEQ ID NO: 2829934 - RNA, 17 nt, Human
ccucuguaccccaugac

SEQ ID NO: 2829935 - RNA, 19 nt, Human
ccucuguaccccaugaccu

SEQ ID NO: 2829936 - RNA, 17 nt, Human
ccucuguccugcuucug

SEQ ID NO: 2829937 - RNA, 18 nt, Human
ccucuguccugcuucuga

SEQ ID NO: 2829938 - RNA, 15 nt, Human
ccucugucuagcaug

SEQ ID NO: 2829939 - RNA, 16 nt, Human
ccucugucuagcaugc

SEQ ID NO: 2829940 - RNA, 17 nt, Human
ccucugucuagcaugcc

SEQ ID NO: 2829941 - RNA, 20 nt, Human
ccucugucuagcaugccaac

SEQ ID NO: 2829942 - RNA, 21 nt, Human
ccucugucuagcaugccaaca

SEQ ID NO: 2829943 - RNA, 11 nt, Human
ccucugucuca

SEQ ID NO: 2829944 - RNA, 12 nt, Human
ccucugucucau

SEQ ID NO: 2829945 - RNA, 14 nt, Human
ccucugucucaucc

SEQ ID NO: 2829946 - RNA, 15 nt, Human
ccucugucucauccu

SEQ ID NO: 2829947 - RNA, 18 nt, Human
ccucugucucauccuccu

SEQ ID NO: 2829948 - RNA, 20 nt, Human
ccucugucucauccuccugg

SEQ ID NO: 2829949 - RNA, 16 nt, Human
cccuuccucuccacug

SEQ ID NO: 2829950 - RNA, 17 nt, Human
cccuuccucuccacugc

SEQ ID NO: 2829951 - RNA, 20 nt, Human
cccuuccucuccacugccuu

SEQ ID NO: 2829952 - RNA, 15 nt, Human
cccuugaugcacaga

SEQ ID NO: 2829953 - RNA, 16 nt, Human
cccuugaugcacagag

SEQ ID NO: 2829954 - RNA, 19 nt, Human
cccuugaugcacagagaag

SEQ ID NO: 2829955 - RNA, 19 nt, Human
cccuugauuuaaacacaca

SEQ ID NO: 2829956 - RNA, 20 nt, Human
cccuugauuuaaacacacag

SEQ ID NO: 2829957 - RNA, 21 nt, Human
cccuugauuuaaacacacaga

SEQ ID NO: 2829958 - RNA, 21 nt, Human
cccuuaccacugcucugauga

SEQ ID NO: 2829959 - RNA, 17 nt, Human
cccuuaccacugcucug

SEQ ID NO: 2829960 - RNA, 22 nt, Human
cccuuaccccuuagccucccug

SEQ ID NO: 2829961 - RNA, 21 nt, Human
cccuuacccuuuccuccuuua

SEQ ID NO: 2829962 - RNA, 21 nt, Human
cccuuccuaauuccacagcug

SEQ ID NO: 2829963 - RNA, 17 nt, Human
cccuuaccccuuagccu

SEQ ID NO: 2829964 - RNA, 13 nt, Human
cccuuccucucca

SEQ ID NO: 2829965 - RNA, 13 nt, Human
cccuuccuccucc

SEQ ID NO: 2829966 - RNA, 14 nt, Human
cccuuccuccucca

SEQ ID NO: 2829967 - RNA, 19 nt, Human
cccuuccuccuccaccacc

SEQ ID NO: 2829968 - RNA, 23 nt, Human
cccuuccuccuccaccaccgccc

SEQ ID NO: 2829969 - RNA, 10 nt, Human
cccuuccucu

SEQ ID NO: 2829970 - RNA, 22 nt, Human
cccuugcacuaaaguauguaaa

SEQ ID NO: 2829971 - RNA, 16 nt, Human
cccuugcagcuaguuu

SEQ ID NO: 2829972 - RNA, 19 nt, Human
cccuugcaguucagcacca

SEQ ID NO: 2829973 - RNA, 19 nt, Human
cccuugcagcuaguuuucu

SEQ ID NO: 2829974 - RNA, 23 nt, Human
cccuugcaguucagcaccacccu

SEQ ID NO: 2829975 - RNA, 21 nt, Human
cccuugcaguucagcaccacc

SEQ ID NO: 2829976 - RNA, 13 nt, Human
cccuugccacccc

SEQ ID NO: 2829977 - RNA, 16 nt, Human
cccuuggccugucuca

SEQ ID NO: 2829978 - RNA, 19 nt, Human
cccuugggccaccccuccu

SEQ ID NO: 2829979 - RNA, 12 nt, Human
cccuugggccac

SEQ ID NO: 2829980 - RNA, 18 nt, Human
cccuuggcuucugugaug

SEQ ID NO: 2829981 - RNA, 16 nt, Human
cccuuggcuucuguga

SEQ ID NO: 2829982 - RNA, 23 nt, Human
cccuuggcugugaggccccugga

SEQ ID NO: 2829983 - RNA, 15 nt, Human
cccuuggcucaaucc

SEQ ID NO: 2829984 - RNA, 19 nt, Human
cccuuggccugucucaucc

SEQ ID NO: 2829985 - RNA, 22 nt, Human
cccuuggcugugaggccccugg

SEQ ID NO: 2829986 - RNA, 14 nt, Human
cccuuggcugugag

SEQ ID NO: 2829987 - RNA, 14 nt, Human
cccuuucccucgcu

SEQ ID NO: 2829988 - RNA, 15 nt, Human
cccuuucccucgcua

SEQ ID NO: 2829989 - RNA, 18 nt, Human
cccuuuccuuccaucccu

SEQ ID NO: 2829990 - RNA, 14 nt, Human
cccuuuccuuccua

SEQ ID NO: 2829991 - RNA, 15 nt, Human
cccuuuccuuccauc

SEQ ID NO: 2829992 - RNA, 13 nt, Human
cccuuuccuucca

SEQ ID NO: 2829993 - RNA, 15 nt, Human
cccuuugaagccuca

SEQ ID NO: 2829994 - RNA, 17 nt, Human
cccuuugaagccucagc

SEQ ID NO: 2829995 - RNA, 18 nt, Human
cccuuugaagccucagcu

SEQ ID NO: 2829996 - RNA, 21 nt, Human
cccuuugaagccucagcuacc

SEQ ID NO: 2829997 - RNA, 22 nt, Human
cccuuucugggcaccggggccu

SEQ ID NO: 2829998 - RNA, 12 nt, Human
cccuuucugugu

SEQ ID NO: 2829999 - RNA, 14 nt, Human
cccuuucuggcucu

SEQ ID NO: 2830000 - RNA, 17 nt, Human
cccuuucuugacaaaac

SEQ ID NO: 2830001 - RNA, 13 nt, Human
cccuuugggcccu

SEQ ID NO: 2830002 - RNA, 15 nt, Human
cccuuugggcccugc

SEQ ID NO: 2830003 - RNA, 16 nt, Human
cccuuugggcccugca

SEQ ID NO: 2830004 - RNA, 17 nt, Human
cccuuugggcccugcau

SEQ ID NO: 2830005 - RNA, 18 nt, Human
cccuuugggcccugcaug

SEQ ID NO: 2830006 - RNA, 19 nt, Human
cccuuugggcccugcaugu

SEQ ID NO: 2830007 - RNA, 20 nt, Human
cccuuugggcccugcaugua

SEQ ID NO: 2830008 - RNA, 22 nt, Human
cccuuugggcccugcauguagu

SEQ ID NO: 2830009 - RNA, 13 nt, Human
cccuuuuauacua

SEQ ID NO: 2830010 - RNA, 19 nt, Human
cccuuuguuucuuguuuau

SEQ ID NO: 2830011 - RNA, 23 nt, Human
cccuuuggagaugcugagggugu

SEQ ID NO: 2830012 - RNA, 21 nt, Human
cccuuugcaucguccccuccc

SEQ ID NO: 2830013 - RNA, 15 nt, Human
cccuuuuucuccagc

SEQ ID NO: 2830014 - RNA, 20 nt, Human
cccuuuuguugagccaggcc

SEQ ID NO: 2830015 - RNA, 16 nt, Human
cccuuuuucuccagcu

SEQ ID NO: 2830016 - RNA, 17 nt, Human
cccuuugucuuucaaac

SEQ ID NO: 2830017 - RNA, 17 nt, Human
ccgaggccuucucugaa

SEQ ID NO: 2830018 - RNA, 17 nt, Human
ccgagcuccagagcaac

SEQ ID NO: 2830019 - RNA, 18 nt, Human
ccgagaucacgccacugc

SEQ ID NO: 2830020 - RNA, 21 nt, Human
ccgagcaaagaucaaaauaaa

SEQ ID NO: 2830021 - RNA, 23 nt, Human
ccgagcaaagaucaaaauaaaaa

SEQ ID NO: 2830022 - RNA, 22 nt, Human
ccgagcaauauuuauggaugca

SEQ ID NO: 2830023 - RNA, 13 nt, Human
ccgagucugggac

SEQ ID NO: 2830024 - RNA, 14 nt, Human
ccgagucugggaca

SEQ ID NO: 2830025 - RNA, 17 nt, Human
ccgagucugggacacaa

SEQ ID NO: 2830026 - RNA, 22 nt, Human
ccgagucugggacacaaaacuc

SEQ ID NO: 2830027 - RNA, 21 nt, Human
ccgagucucuucuccacugga

SEQ ID NO: 2830028 - RNA, 16 nt, Human
ccgaggguccuggcuc

SEQ ID NO: 2830029 - RNA, 22 nt, Human
ccgagucucuucuccacuggau

SEQ ID NO: 2830030 - RNA, 13 nt, Human
ccgcccucuuccu

SEQ ID NO: 2830031 - RNA, 14 nt, Human
ccgcccucuuccug

SEQ ID NO: 2830032 - RNA, 15 nt, Human
ccgcccucuuccuga

SEQ ID NO: 2830033 - RNA, 18 nt, Human
ccgccccuucccuucccu

SEQ ID NO: 2830034 - RNA, 13 nt, Human
ccgccccugcagc

SEQ ID NO: 2830035 - RNA, 14 nt, Human
ccgccccugcagca

SEQ ID NO: 2830036 - RNA, 16 nt, Human
ccgccccugcagcacg

SEQ ID NO: 2830037 - RNA, 17 nt, Human
ccgccccugcagcacgg

SEQ ID NO: 2830038 - RNA, 17 nt, Human
ccgccccugccugccau

SEQ ID NO: 2830039 - RNA, 19 nt, Human
cccugguggcagugggagc

SEQ ID NO: 2830040 - RNA, 16 nt, Human
cccugguggcaguggg

SEQ ID NO: 2830041 - RNA, 15 nt, Human
cccugguggcagugg

SEQ ID NO: 2830042 - RNA, 21 nt, Human
cccugguuuccugcccuggga

SEQ ID NO: 2830043 - RNA, 21 nt, Human
cccugguggcagugggagcug

SEQ ID NO: 2830044 - RNA, 13 nt, Human
ccccuccccugcu

SEQ ID NO: 2830045 - RNA, 15 nt, Human
ccccuccccugcugc

SEQ ID NO: 2830046 - RNA, 18 nt, Human
ccccucccccaaccccca

SEQ ID NO: 2830047 - RNA, 16 nt, Human
ccccucccccaacccc

SEQ ID NO: 2830048 - RNA, 21 nt, Human
ccccucccccaacccccaccc

SEQ ID NO: 2830049 - RNA, 14 nt, Human
ccccucccagggcc

SEQ ID NO: 2830050 - RNA, 13 nt, Human
ccccuagcccagg

SEQ ID NO: 2830051 - RNA, 17 nt, Human
ccccuagcccaggagag

SEQ ID NO: 2830052 - RNA, 15 nt, Human
ccccucccccaaccc

SEQ ID NO: 2830053 - RNA, 12 nt, Human
ccccuagcccag

SEQ ID NO: 2830054 - RNA, 13 nt, Human
ccccuagaaaccc

SEQ ID NO: 2830055 - RNA, 16 nt, Human
ccccuagaaacccaag

SEQ ID NO: 2830056 - RNA, 17 nt, Human
ccccuagaaacccaagc

SEQ ID NO: 2830057 - RNA, 18 nt, Human
ccccuagaaacccaagcu

SEQ ID NO: 2830058 - RNA, 19 nt, Human
ccccuagaaacccaagcuc

SEQ ID NO: 2830059 - RNA, 21 nt, Human
ccccuagaaacccaagcuccu

SEQ ID NO: 2830060 - RNA, 17 nt, Human
ccccuaaaccccugucc

SEQ ID NO: 2830061 - RNA, 16 nt, Human
ccccguuacagcuccc

SEQ ID NO: 2830062 - RNA, 21 nt, Human
ccccguuccugacaucacagc

SEQ ID NO: 2830063 - RNA, 20 nt, Human
ccccguggccaucccuguga

SEQ ID NO: 2830064 - RNA, 22 nt, Human
ccccguggccaucccugugagg

SEQ ID NO: 2830065 - RNA, 13 nt, Human
ccccgucucuguu

SEQ ID NO: 2830066 - RNA, 17 nt, Human
ccccuaccccuggcugu

SEQ ID NO: 2830067 - RNA, 15 nt, Human
ccccuacgcgccuug

SEQ ID NO: 2830068 - RNA, 18 nt, Human
ccccuacgcgccuugucu

SEQ ID NO: 2830069 - RNA, 17 nt, Human
cccugucccucccaccu

SEQ ID NO: 2830070 - RNA, 18 nt, Human
cccugucccucccaccuc

SEQ ID NO: 2830071 - RNA, 19 nt, Human
cccugucccucccaccucu

SEQ ID NO: 2830072 - RNA, 20 nt, Human
cccugucccucccaccucug

SEQ ID NO: 2830073 - RNA, 20 nt, Human
cccuguccccucccccuucc

SEQ ID NO: 2830074 - RNA, 10 nt, Human
cccugucccu

SEQ ID NO: 2830075 - RNA, 12 nt, Human
cccugucccucc

SEQ ID NO: 2830076 - RNA, 13 nt, Human
cccugucccuccc

SEQ ID NO: 2830077 - RNA, 14 nt, Human
cccugucccuccca

SEQ ID NO: 2830078 - RNA, 15 nt, Human
cccugucccucccac

SEQ ID NO: 2830079 - RNA, 16 nt, Human
cccugucccucccacc

SEQ ID NO: 2830080 - RNA, 13 nt, Human
cccugucccaugc

SEQ ID NO: 2830081 - RNA, 14 nt, Human
cccugucccaugca

SEQ ID NO: 2830082 - RNA, 15 nt, Human
cccugucccaugcag

SEQ ID NO: 2830083 - RNA, 17 nt, Human
cccugucccaugcaggc

SEQ ID NO: 2830084 - RNA, 19 nt, Human
cccugucccaugcaggccc

SEQ ID NO: 2830085 - RNA, 20 nt, Human
cccugucccaugcaggcccu

SEQ ID NO: 2830086 - RNA, 21 nt, Human
cccugucccaugcaggcccuu

SEQ ID NO: 2830087 - RNA, 23 nt, Human
cccugucccaugcaggcccuuug

SEQ ID NO: 2830088 - RNA, 19 nt, Human
cccuguaccuuuugaggag

SEQ ID NO: 2830089 - RNA, 16 nt, Human
cccuguaccucauccc

SEQ ID NO: 2830090 - RNA, 17 nt, Human
cccuguaccucauccca

SEQ ID NO: 2830091 - RNA, 20 nt, Human
cccuguaccucaucccauga

SEQ ID NO: 2830092 - RNA, 22 nt, Human
cccuguaccucaucccaugaga

SEQ ID NO: 2830093 - RNA, 18 nt, Human
cccuguacuguucugugu

SEQ ID NO: 2830094 - RNA, 18 nt, Human
ccccuccccugcugcagg

SEQ ID NO: 2830095 - RNA, 17 nt, Human
ccccucccgccccuucc

SEQ ID NO: 2830096 - RNA, 23 nt, Human
cccugguuuccugcccugggagg

SEQ ID NO: 2830097 - RNA, 22 nt, Human
cccugguuuccugcccugggag

SEQ ID NO: 2830098 - RNA, 21 nt, Human
cccuguuuaauauuuaaacag

SEQ ID NO: 2830099 - RNA, 17 nt, Human
cccuguuucaaucacug

SEQ ID NO: 2830100 - RNA, 19 nt, Human
cccuguuucaaucacuguc

SEQ ID NO: 2830101 - RNA, 17 nt, Human
cccuuaagcccuggccc

SEQ ID NO: 2830102 - RNA, 20 nt, Human
cccuuaagucacccuagccc

SEQ ID NO: 2830103 - RNA, 18 nt, Human
cccuuaauuacuuaaaaa

SEQ ID NO: 2830104 - RNA, 19 nt, Human
cccuuaauuacuuaaaaaa

SEQ ID NO: 2830105 - RNA, 20 nt, Human
cccuuaauuacuuaaaaaaa

SEQ ID NO: 2830106 - RNA, 21 nt, Human
cccugucccucccaccucugu

SEQ ID NO: 2830107 - RNA, 22 nt, Human
cccugucccucccaccucugug

SEQ ID NO: 2830108 - RNA, 19 nt, Human
cccuguguauacagcccug

SEQ ID NO: 2830109 - RNA, 19 nt, Human
cccuguguccaccuguggg

SEQ ID NO: 2830110 - RNA, 21 nt, Human
cccuguguccaccugugggug

SEQ ID NO: 2830111 - RNA, 13 nt, Human
cccuguugugcca

SEQ ID NO: 2830112 - RNA, 16 nt, Human
cccuguugugccacag

SEQ ID NO: 2830113 - RNA, 11 nt, Human
cccuguuuaau

SEQ ID NO: 2830114 - RNA, 14 nt, Human
cccuguuuaauauu

SEQ ID NO: 2830115 - RNA, 16 nt, Human
cccuguuuaauauuua

SEQ ID NO: 2830116 - RNA, 17 nt, Human
cccuguuuaauauuuaa

SEQ ID NO: 2830117 - RNA, 18 nt, Human
cccuguuuaauauuuaaa

SEQ ID NO: 2830118 - RNA, 19 nt, Human
cccuguuuaauauuuaaac

SEQ ID NO: 2830119 - RNA, 19 nt, Human
ccccagcccuccuuaucaa

SEQ ID NO: 2830120 - RNA, 19 nt, Human
ccccagcccuggcucugca

SEQ ID NO: 2830121 - RNA, 13 nt, Human
ccccagcccuggc

SEQ ID NO: 2830122 - RNA, 16 nt, Human
ccccagcccuggcucu

SEQ ID NO: 2830123 - RNA, 14 nt, Human
ccccagccucuggc

SEQ ID NO: 2830124 - RNA, 15 nt, Human
ccccagccucuggca

SEQ ID NO: 2830125 - RNA, 14 nt, Human
ccccagccuaugag

SEQ ID NO: 2830126 - RNA, 22 nt, Human
ccccagccuaugagcauccuga

SEQ ID NO: 2830127 - RNA, 23 nt, Human
ccccagccuaugagcauccugag

SEQ ID NO: 2830128 - RNA, 16 nt, Human
ccccagccucuggcau

SEQ ID NO: 2830129 - RNA, 18 nt, Human
ccccagcgucccagucuc

SEQ ID NO: 2830130 - RNA, 15 nt, Human
ccccacugacagccu

SEQ ID NO: 2830131 - RNA, 21 nt, Human
ccccacugacagccucccacc

SEQ ID NO: 2830132 - RNA, 15 nt, Human
ccccacugccagcag

SEQ ID NO: 2830133 - RNA, 11 nt, Human
ccccacugaug

SEQ ID NO: 2830134 - RNA, 13 nt, Human
ccccacugaugcu

SEQ ID NO: 2830135 - RNA, 14 nt, Human
ccccacugaugcug

SEQ ID NO: 2830136 - RNA, 15 nt, Human
ccccacugaugcugu

SEQ ID NO: 2830137 - RNA, 19 nt, Human
ccccacugaugcuguucuc

SEQ ID NO: 2830138 - RNA, 22 nt, Human
ccccacugccagcagcagcagg

SEQ ID NO: 2830139 - RNA, 19 nt, Human
ccccacugccagcagcagc

SEQ ID NO: 2830140 - RNA, 17 nt, Human
ccccacugccagcagca

SEQ ID NO: 2830141 - RNA, 16 nt, Human
ccccacugccagcagc

SEQ ID NO: 2830142 - RNA, 20 nt, Human
ccccaggaauuugggacccu

SEQ ID NO: 2830143 - RNA, 18 nt, Human
ccccaggaagcccaggag

SEQ ID NO: 2830144 - RNA, 14 nt, Human
ccccagcugugagc

SEQ ID NO: 2830145 - RNA, 15 nt, Human
ccccagcugugagcc

SEQ ID NO: 2830146 - RNA, 16 nt, Human
ccccagcugugagccu

SEQ ID NO: 2830147 - RNA, 19 nt, Human
ccccagcugugagccuugg

SEQ ID NO: 2830148 - RNA, 21 nt, Human
ccccagcugugagccuuggcu

SEQ ID NO: 2830149 - RNA, 23 nt, Human
ccccagcgucccagucucuggca

SEQ ID NO: 2830150 - RNA, 11 nt, Human
ccccagcuacc

SEQ ID NO: 2830151 - RNA, 22 nt, Human
ccccagcuacccuuuuucucca

SEQ ID NO: 2830152 - RNA, 14 nt, Human
ccccagcucaaugg

SEQ ID NO: 2830153 - RNA, 13 nt, Human
ccccagcucaggg

SEQ ID NO: 2830154 - RNA, 14 nt, Human
ccccagcucagggg

SEQ ID NO: 2830155 - RNA, 16 nt, Human
ccccagcucaggggca

SEQ ID NO: 2830156 - RNA, 17 nt, Human
ccccagcucaggggcag

SEQ ID NO: 2830157 - RNA, 21 nt, Human
ccccagcucaggggcagcuca

SEQ ID NO: 2830158 - RNA, 20 nt, Human
cccccaacucugagcccaug

SEQ ID NO: 2830159 - RNA, 21 nt, Human
cccccaacuugagauguauga

SEQ ID NO: 2830160 - RNA, 19 nt, Human
cccccaagcuguuuucuuc

SEQ ID NO: 2830161 - RNA, 23 nt, Human
cccccaaccaaguggcucccaca

SEQ ID NO: 2830162 - RNA, 11 nt, Human
ccccaggccca

SEQ ID NO: 2830163 - RNA, 16 nt, Human
ccccaggcccacucag

SEQ ID NO: 2830164 - RNA, 17 nt, Human
ccccaggcccacucagg

SEQ ID NO: 2830165 - RNA, 12 nt, Human
cccccagccuau

SEQ ID NO: 2830166 - RNA, 13 nt, Human
cccccagccuaug

SEQ ID NO: 2830167 - RNA, 23 nt, Human
cccccagcuuugcuaccaaagca

SEQ ID NO: 2830168 - RNA, 13 nt, Human
cccccaggaagcc

SEQ ID NO: 2830169 - RNA, 12 nt, Human
cccccagcccaa

SEQ ID NO: 2830170 - RNA, 15 nt, Human
cccccagcccaaagg

SEQ ID NO: 2830171 - RNA, 20 nt, Human
cccccagguuccgaagaaga

SEQ ID NO: 2830172 - RNA, 16 nt, Human
cccccaucucuucugg

SEQ ID NO: 2830173 - RNA, 22 nt, Human
cccccauguuguaaugcugcac

SEQ ID NO: 2830174 - RNA, 23 nt, Human
cccccauguuguaaugcugcacu

SEQ ID NO: 2830175 - RNA, 17 nt, Human
cccccauucucaucugc

SEQ ID NO: 2830176 - RNA, 20 nt, Human
cccccauucucaucugcacc

SEQ ID NO: 2830177 - RNA, 16 nt, Human
cccccaucuucgggac

SEQ ID NO: 2830178 - RNA, 21 nt, Human
cccccaucuucgggaccagga

SEQ ID NO: 2830179 - RNA, 18 nt, Human
cccccaucuucgggacca

SEQ ID NO: 2830180 - RNA, 12 nt, Human
cccccccuucca

SEQ ID NO: 2830181 - RNA, 13 nt, Human
cccccccuuccac

SEQ ID NO: 2830182 - RNA, 13 nt, Human
cccccccaugcag

SEQ ID NO: 2830183 - RNA, 12 nt, Human
ccccccagccuc

SEQ ID NO: 2830184 - RNA, 13 nt, Human
ccccccagccucu

SEQ ID NO: 2830185 - RNA, 12 nt, Human
ccccccagcuca

SEQ ID NO: 2830186 - RNA, 11 nt, Human
ccccccacucu

SEQ ID NO: 2830187 - RNA, 12 nt, Human
ccccccacucuc

SEQ ID NO: 2830188 - RNA, 13 nt, Human
cccccggcccccu

SEQ ID NO: 2830189 - RNA, 14 nt, Human
cccccggcccccug

SEQ ID NO: 2830190 - RNA, 15 nt, Human
cccccggcccccugg

SEQ ID NO: 2830191 - RNA, 17 nt, Human
cccccucucaggagcca

SEQ ID NO: 2830192 - RNA, 11 nt, Human
ccccccuucca

SEQ ID NO: 2830193 - RNA, 12 nt, Human
ccccccuuccac

SEQ ID NO: 2830194 - RNA, 13 nt, Human
ccccccuuccacu

SEQ ID NO: 2830195 - RNA, 12 nt, Human
ccccccucuguc

SEQ ID NO: 2830196 - RNA, 12 nt, Human
ccccccucccag

SEQ ID NO: 2830197 - RNA, 14 nt, Human
ccccccucccagag

SEQ ID NO: 2830198 - RNA, 13 nt, Human
cccccgcccccug

SEQ ID NO: 2830199 - RNA, 14 nt, Human
cccccgcccccugc

SEQ ID NO: 2830200 - RNA, 16 nt, Human
cccccgcccccugccc

SEQ ID NO: 2830201 - RNA, 12 nt, Human
cccccgcccccu

SEQ ID NO: 2830202 - RNA, 12 nt, Human
cccccgccacuc

SEQ ID NO: 2830203 - RNA, 18 nt, Human
cccccugcuggcucuucu

SEQ ID NO: 2830204 - RNA, 20 nt, Human
cccccugcuggcucuucugc

SEQ ID NO: 2830205 - RNA, 15 nt, Human
cccccuggccucugu

SEQ ID NO: 2830206 - RNA, 19 nt, Human
cccccuggccucugugccu

SEQ ID NO: 2830207 - RNA, 22 nt, Human
cccccuggccucugugccuucu

SEQ ID NO: 2830208 - RNA, 10 nt, Human
cccccugggc

SEQ ID NO: 2830209 - RNA, 21 nt, Human
ccccgucucugguuccucccc

SEQ ID NO: 2830210 - RNA, 20 nt, Human
ccccgucccccucuggcucc

SEQ ID NO: 2830211 - RNA, 16 nt, Human
ccccgucccccucugg

SEQ ID NO: 2830212 - RNA, 12 nt, Human
cccccugcuggc

SEQ ID NO: 2830213 - RNA, 15 nt, Human
cccccugcuggcucu

SEQ ID NO: 2830214 - RNA, 13 nt, Human
cccccugcccucc

SEQ ID NO: 2830215 - RNA, 21 nt, Human
cccccugccccccagccucug

SEQ ID NO: 2830216 - RNA, 16 nt, Human
cccccucugcccugcg

SEQ ID NO: 2830217 - RNA, 22 nt, Human
cccccugccccccagccucugg

SEQ ID NO: 2830218 - RNA, 14 nt, Human
cccccucugcccug

SEQ ID NO: 2830219 - RNA, 13 nt, Human
cccccucugcccu

SEQ ID NO: 2830220 - RNA, 15 nt, Human
ccgggcacucagaag

SEQ ID NO: 2830221 - RNA, 12 nt, Human
ccggcugcccuu

SEQ ID NO: 2830222 - RNA, 14 nt, Human
ccggacccaccuca

SEQ ID NO: 2830223 - RNA, 16 nt, Human
ccggaaugccacccac

SEQ ID NO: 2830224 - RNA, 16 nt, Human
ccggacacuccuagag

SEQ ID NO: 2830225 - RNA, 20 nt, Human
ccggaaugccacccacaucu

SEQ ID NO: 2830226 - RNA, 17 nt, Human
ccggacacuccuagaga

SEQ ID NO: 2830227 - RNA, 23 nt, Human
ccgcuuucuacccagcgagcccu

SEQ ID NO: 2830228 - RNA, 13 nt, Human
ccgcuuuggccug

SEQ ID NO: 2830229 - RNA, 14 nt, Human
ccgcuuuggccuga

SEQ ID NO: 2830230 - RNA, 16 nt, Human
ccgcuuuggccugagu

SEQ ID NO: 2830231 - RNA, 19 nt, Human
ccgcuuuuguucucgcaaa

SEQ ID NO: 2830232 - RNA, 19 nt, Human
ccgcuugaaaagcuagugu

SEQ ID NO: 2830233 - RNA, 23 nt, Human
ccgcuugaaaagcuaguguaccu

SEQ ID NO: 2830234 - RNA, 15 nt, Human
ccgcuucccuauuua

SEQ ID NO: 2830235 - RNA, 16 nt, Human
ccgcuucccuccugcc

SEQ ID NO: 2830236 - RNA, 20 nt, Human
ccgcugugagccccuggucc

SEQ ID NO: 2830237 - RNA, 15 nt, Human
ccgcugugagccccu

SEQ ID NO: 2830238 - RNA, 18 nt, Human
ccgcugugagccccuggu

SEQ ID NO: 2830239 - RNA, 19 nt, Human
ccgcugugagccccugguc

SEQ ID NO: 2830240 - RNA, 16 nt, Human
ccgcuguaagcuccuu

SEQ ID NO: 2830241 - RNA, 18 nt, Human
ccgcuguaagcuccuuug

SEQ ID NO: 2830242 - RNA, 20 nt, Human
ccgcuguaagcuccuuugug

SEQ ID NO: 2830243 - RNA, 16 nt, Human
ccgugccuucagcucu

SEQ ID NO: 2830244 - RNA, 17 nt, Human
ccgugccuucagcucua

SEQ ID NO: 2830245 - RNA, 19 nt, Human
ccgggcgcggccagccccg

SEQ ID NO: 2830246 - RNA, 15 nt, Human
ccgggcgcggccagc

SEQ ID NO: 2830247 - RNA, 17 nt, Human
ccgggcgcggccagccc

SEQ ID NO: 2830248 - RNA, 17 nt, Human
ccgugccgccugcacuc

SEQ ID NO: 2830249 - RNA, 14 nt, Human
ccgugccgccugca

SEQ ID NO: 2830250 - RNA, 21 nt, Human
ccgugccgccugcacuccuca

SEQ ID NO: 2830251 - RNA, 14 nt, Human
ccgugccuucagcu

SEQ ID NO: 2830252 - RNA, 15 nt, Human
ccgugccuucagcuc

SEQ ID NO: 2830253 - RNA, 19 nt, Human
ccgggccuggagaacuaga

SEQ ID NO: 2830254 - RNA, 23 nt, Human
ccgggccgaauccccucccuguc

SEQ ID NO: 2830255 - RNA, 14 nt, Human
ccgggccuguacag

SEQ ID NO: 2830256 - RNA, 21 nt, Human
ccuaaaccaaaaacugaaagu

SEQ ID NO: 2830257 - RNA, 15 nt, Human
ccuaaaccccugucc

SEQ ID NO: 2830258 - RNA, 17 nt, Human
ccuaaaccccuguccca

SEQ ID NO: 2830259 - RNA, 12 nt, Human
ccuaaaacaaau

SEQ ID NO: 2830260 - RNA, 17 nt, Human
ccuaaaacauaagauca

SEQ ID NO: 2830261 - RNA, 15 nt, Human
ccuaaaacuggccug

SEQ ID NO: 2830262 - RNA, 16 nt, Human
ccuaaaacuggccuga

SEQ ID NO: 2830263 - RNA, 20 nt, Human
ccuaaaacuggccugacuug

SEQ ID NO: 2830264 - RNA, 13 nt, Human
ccuaaaacaaaag

SEQ ID NO: 2830265 - RNA, 20 nt, Human
ccguuguuuacuuaaagauu

SEQ ID NO: 2830266 - RNA, 17 nt, Human
ccguuuaccuagaagaa

SEQ ID NO: 2830267 - RNA, 12 nt, Human
ccguuguuuacu

SEQ ID NO: 2830268 - RNA, 15 nt, Human
ccguggcuucccgcu

SEQ ID NO: 2830269 - RNA, 21 nt, Human
ccguggcuucccgcucagccc

SEQ ID NO: 2830270 - RNA, 13 nt, Human
ccgugggccuggg

SEQ ID NO: 2830271 - RNA, 23 nt, Human
ccguggcuucccgcucagcccuc

SEQ ID NO: 2830272 - RNA, 13 nt, Human
ccuaccccuggcu

SEQ ID NO: 2830273 - RNA, 15 nt, Human
ccuaccccuggcugu

SEQ ID NO: 2830274 - RNA, 13 nt, Human
ccuaccugaugga

SEQ ID NO: 2830275 - RNA, 17 nt, Human
ccuaccuucuucaggcu

SEQ ID NO: 2830276 - RNA, 16 nt, Human
ccuacgcgccuugucu

SEQ ID NO: 2830277 - RNA, 16 nt, Human
ccuaccugcucuccaa

SEQ ID NO: 2830278 - RNA, 20 nt, Human
ccuagagaacgcagcccuag

SEQ ID NO: 2830279 - RNA, 17 nt, Human
ccuagagaacgcagccc

SEQ ID NO: 2830280 - RNA, 18 nt, Human
ccuagagaacgcagcccu

SEQ ID NO: 2830281 - RNA, 19 nt, Human
ccuagagaacgcagcccua

SEQ ID NO: 2830282 - RNA, 21 nt, Human
ccuaccugauuggugcaaccc

SEQ ID NO: 2830283 - RNA, 14 nt, Human
ccuaccugcccugg

SEQ ID NO: 2830284 - RNA, 15 nt, Human
ccuaccugcccugga

SEQ ID NO: 2830285 - RNA, 12 nt, Human
ccuaccugguaa

SEQ ID NO: 2830286 - RNA, 16 nt, Human
ccuaccugugccugac

SEQ ID NO: 2830287 - RNA, 21 nt, Human
ccuaccugugugguacucuga

SEQ ID NO: 2830288 - RNA, 15 nt, Human
ccuaccugugccuga

SEQ ID NO: 2830289 - RNA, 14 nt, Human
ccuaccugugccug

SEQ ID NO: 2830290 - RNA, 12 nt, Human
ccuaccugcucu

SEQ ID NO: 2830291 - RNA, 13 nt, Human
ccuaccugcucuc

SEQ ID NO: 2830292 - RNA, 13 nt, Human
ccguuugcuuuug

SEQ ID NO: 2830293 - RNA, 18 nt, Human
ccuaauucgaugaaggcu

SEQ ID NO: 2830294 - RNA, 15 nt, Human
ccuaauucuucuguc

SEQ ID NO: 2830295 - RNA, 17 nt, Human
ccuaauuccacagcugc

SEQ ID NO: 2830296 - RNA, 16 nt, Human
ccuaauuccacagcug

SEQ ID NO: 2830297 - RNA, 15 nt, Human
ccuaauuccacagcu

SEQ ID NO: 2830298 - RNA, 14 nt, Human
ccuaauuccacagc

SEQ ID NO: 2830299 - RNA, 12 nt, Human
ccuaaagaaaaa

SEQ ID NO: 2830300 - RNA, 15 nt, Human
ccuaaaccuuugccc

SEQ ID NO: 2830301 - RNA, 18 nt, Human
ccuaaaacaaaagcucau

SEQ ID NO: 2830302 - RNA, 11 nt, Human
ccuaaacugua

SEQ ID NO: 2830303 - RNA, 13 nt, Human
ccuaaagagagua

SEQ ID NO: 2830304 - RNA, 23 nt, Human
ccuaaagagaguauuuuuauaca

SEQ ID NO: 2830305 - RNA, 12 nt, Human
ccuaaagagaua

SEQ ID NO: 2830306 - RNA, 13 nt, Human
ccuaauuccacag

SEQ ID NO: 2830307 - RNA, 16 nt, Human
ccuaaagugcugggau

SEQ ID NO: 2830308 - RNA, 21 nt, Human
ccuaaagugcugggauuacag

SEQ ID NO: 2830309 - RNA, 16 nt, Human
ccucacagucccacug

SEQ ID NO: 2830310 - RNA, 19 nt, Human
ccucacagucccacugugc

SEQ ID NO: 2830311 - RNA, 23 nt, Human
ccucacagucccacugugcaggu

SEQ ID NO: 2830312 - RNA, 19 nt, Human
ccucacccccagcuuugcu

SEQ ID NO: 2830313 - RNA, 17 nt, Human
ccucacccccagcuuug

SEQ ID NO: 2830314 - RNA, 17 nt, Human
ccucaccccgaggcccu

SEQ ID NO: 2830315 - RNA, 18 nt, Human
ccucaccccgaggcccug

SEQ ID NO: 2830316 - RNA, 19 nt, Human
ccucaccccgaggcccugc

SEQ ID NO: 2830317 - RNA, 20 nt, Human
ccucaccccgaggcccugca

SEQ ID NO: 2830318 - RNA, 21 nt, Human
ccucaccccgaggcccugcau

SEQ ID NO: 2830319 - RNA, 22 nt, Human
ccucaccccgaggcccugcaug

SEQ ID NO: 2830320 - RNA, 19 nt, Human
ccucaccccguuacagcuc

SEQ ID NO: 2830321 - RNA, 13 nt, Human
ccucacgcugggu

SEQ ID NO: 2830322 - RNA, 15 nt, Human
ccucaccuucugagu

SEQ ID NO: 2830323 - RNA, 22 nt, Human
ccucaccucuggacuggcuaga

SEQ ID NO: 2830324 - RNA, 20 nt, Human
ccucaccucuggacuggcua

SEQ ID NO: 2830325 - RNA, 18 nt, Human
ccucaccucuggacuggc

SEQ ID NO: 2830326 - RNA, 13 nt, Human
ccucaccucugga

SEQ ID NO: 2830327 - RNA, 12 nt, Human
ccucaccucugg

SEQ ID NO: 2830328 - RNA, 14 nt, Human
ccucaccuccucua

SEQ ID NO: 2830329 - RNA, 13 nt, Human
ccucaccucuacc

SEQ ID NO: 2830330 - RNA, 14 nt, Human
ccucaccucuaccc

SEQ ID NO: 2830331 - RNA, 16 nt, Human
ccucaccucuacccaa

SEQ ID NO: 2830332 - RNA, 13 nt, Human
ccucaccuccucu

SEQ ID NO: 2830333 - RNA, 21 nt, Human
ccucaccccuguccucacugc

SEQ ID NO: 2830334 - RNA, 22 nt, Human
ccucaccccuguccucacugcu

SEQ ID NO: 2830335 - RNA, 15 nt, Human
ccucaccccuguccu

SEQ ID NO: 2830336 - RNA, 19 nt, Human
ccucaccccuguccucacu

SEQ ID NO: 2830337 - RNA, 20 nt, Human
ccucaccccuguccucacug

SEQ ID NO: 2830338 - RNA, 12 nt, Human
ccuagagccaga

SEQ ID NO: 2830339 - RNA, 13 nt, Human
ccuagagccagac

SEQ ID NO: 2830340 - RNA, 14 nt, Human
ccuagagccagacc

SEQ ID NO: 2830341 - RNA, 15 nt, Human
ccuagagccagacca

SEQ ID NO: 2830342 - RNA, 16 nt, Human
ccuagagccagaccaa

SEQ ID NO: 2830343 - RNA, 21 nt, Human
ccuagagaagauaauuguuga

SEQ ID NO: 2830344 - RNA, 18 nt, Human
ccuagagccugccuggag

SEQ ID NO: 2830345 - RNA, 19 nt, Human
ccuagagccugccuggagc

SEQ ID NO: 2830346 - RNA, 13 nt, Human
ccuagagccugcc

SEQ ID NO: 2830347 - RNA, 14 nt, Human
ccuagagccugccu

SEQ ID NO: 2830348 - RNA, 17 nt, Human
ccuagagccugccugga

SEQ ID NO: 2830349 - RNA, 17 nt, Human
ccuaucaccuauuucca

SEQ ID NO: 2830350 - RNA, 16 nt, Human
ccuaucaccuauuucc

SEQ ID NO: 2830351 - RNA, 23 nt, Human
ccuauggcagaaaaaaugucugu

SEQ ID NO: 2830352 - RNA, 13 nt, Human
ccuaucauuuauu

SEQ ID NO: 2830353 - RNA, 17 nt, Human
ccuaucagaaguuucuc

SEQ ID NO: 2830354 - RNA, 13 nt, Human
ccucaauguuuga

SEQ ID NO: 2830355 - RNA, 19 nt, Human
ccucaauuuuugucucaga

SEQ ID NO: 2830356 - RNA, 21 nt, Human
ccucaauuuuugucucagaag

SEQ ID NO: 2830357 - RNA, 18 nt, Human
ccucaaucucaauccugc

SEQ ID NO: 2830358 - RNA, 22 nt, Human
ccuaugguauaaugguugacug

SEQ ID NO: 2830359 - RNA, 22 nt, Human
ccuauguaagaauucagaagac

SEQ ID NO: 2830360 - RNA, 14 nt, Human
ccuauguauuugca

SEQ ID NO: 2830361 - RNA, 15 nt, Human
ccucaguauauuuaa

SEQ ID NO: 2830362 - RNA, 16 nt, Human
ccucaguauauuuaaa

SEQ ID NO: 2830363 - RNA, 14 nt, Human
cugguccugugugc

SEQ ID NO: 2830364 - RNA, 21 nt, Human
cugguccugaggguccccacc

SEQ ID NO: 2830365 - RNA, 17 nt, Human
cugguccuuccaggccc

SEQ ID NO: 2830366 - RNA, 16 nt, Human
cugguccuuccaggcc

SEQ ID NO: 2830367 - RNA, 19 nt, Human
cugguccuuccaggccccc

SEQ ID NO: 2830368 - RNA, 14 nt, Human
cuggucccacucag

SEQ ID NO: 2830369 - RNA, 18 nt, Human
cuggucccacucagucca

SEQ ID NO: 2830370 - RNA, 15 nt, Human
cuggucccacucagu

SEQ ID NO: 2830371 - RNA, 13 nt, Human
cuggguuggaggg

SEQ ID NO: 2830372 - RNA, 13 nt, Human
cuggguuggaaaa

SEQ ID NO: 2830373 - RNA, 18 nt, Human
cuggguuggaaaacagua

SEQ ID NO: 2830374 - RNA, 13 nt, Human
cuggguaugugua

SEQ ID NO: 2830375 - RNA, 15 nt, Human
cuggguauuggaaau

SEQ ID NO: 2830376 - RNA, 19 nt, Human
cuggguauuggaaauggau

SEQ ID NO: 2830377 - RNA, 14 nt, Human
cugggucacacacg

SEQ ID NO: 2830378 - RNA, 13 nt, Human
cugggucagucug

SEQ ID NO: 2830379 - RNA, 17 nt, Human
cugggucagucuggugg

SEQ ID NO: 2830380 - RNA, 12 nt, Human
cugggucagugg

SEQ ID NO: 2830381 - RNA, 18 nt, Human
cugggucagucugguggg

SEQ ID NO: 2830382 - RNA, 21 nt, Human
cugggucagucuggugggagg

SEQ ID NO: 2830383 - RNA, 17 nt, Human
cugguucucaaugaaaa

SEQ ID NO: 2830384 - RNA, 16 nt, Human
cugguucucaaugaaa

SEQ ID NO: 2830385 - RNA, 15 nt, Human
cugguucucaaugaa

SEQ ID NO: 2830386 - RNA, 18 nt, Human
cugguucucaaugaaaaa

SEQ ID NO: 2830387 - RNA, 13 nt, Human
cugguucucaaug

SEQ ID NO: 2830388 - RNA, 23 nt, Human
cugguggcagugggagcugccug

SEQ ID NO: 2830389 - RNA, 19 nt, Human
cugguggcagugggagcug

SEQ ID NO: 2830390 - RNA, 18 nt, Human
cugguggacaguccuggg

SEQ ID NO: 2830391 - RNA, 17 nt, Human
cugguggacaguccugg

SEQ ID NO: 2830392 - RNA, 16 nt, Human
cugguggacaguccug

SEQ ID NO: 2830393 - RNA, 15 nt, Human
cugguggacaguccu

SEQ ID NO: 2830394 - RNA, 21 nt, Human
cugguggacaguccugggaga

SEQ ID NO: 2830395 - RNA, 19 nt, Human
cugguggacaguccuggga

SEQ ID NO: 2830396 - RNA, 15 nt, Human
cugguggacccaggg

SEQ ID NO: 2830397 - RNA, 18 nt, Human
cuggucucaaacuccuga

SEQ ID NO: 2830398 - RNA, 17 nt, Human
cuggugcuuccaaauau

SEQ ID NO: 2830399 - RNA, 12 nt, Human
cugguggacagu

SEQ ID NO: 2830400 - RNA, 12 nt, Human
cugggguggccu

SEQ ID NO: 2830401 - RNA, 13 nt, Human
cugggguggccug

SEQ ID NO: 2830402 - RNA, 17 nt, Human
cugggguggccugugug

SEQ ID NO: 2830403 - RNA, 18 nt, Human
cugggguggccugugugg

SEQ ID NO: 2830404 - RNA, 21 nt, Human
cugggguggccuguguggcca

SEQ ID NO: 2830405 - RNA, 14 nt, Human
cuggggugggaggu

SEQ ID NO: 2830406 - RNA, 20 nt, Human
cuggggugggaggucuugcu

SEQ ID NO: 2830407 - RNA, 21 nt, Human
cuggggugggaggucuugcua

SEQ ID NO: 2830408 - RNA, 18 nt, Human
cugggggccucagugcca

SEQ ID NO: 2830409 - RNA, 22 nt, Human
cugggauuacaggcgugagcca

SEQ ID NO: 2830410 - RNA, 20 nt, Human
cuggggugcugccugaaucc

SEQ ID NO: 2830411 - RNA, 17 nt, Human
cugggggccucagugcc

SEQ ID NO: 2830412 - RNA, 13 nt, Human
cugggggccucag

SEQ ID NO: 2830413 - RNA, 20 nt, Human
cuggguacuuguggacacag

SEQ ID NO: 2830414 - RNA, 23 nt, Human
cuggguacuuguggacacagcuc

SEQ ID NO: 2830415 - RNA, 21 nt, Human
cuggguacuuguggacacagc

SEQ ID NO: 2830416 - RNA, 19 nt, Human
cuggguacuuguggacaca

SEQ ID NO: 2830417 - RNA, 20 nt, Human
cugggcuucaguggcagcug

SEQ ID NO: 2830418 - RNA, 19 nt, Human
cugggcuucaguggcagcu

SEQ ID NO: 2830419 - RNA, 17 nt, Human
cugggcuucaguggcag

SEQ ID NO: 2830420 - RNA, 18 nt, Human
cugggcuucaguggcagc

SEQ ID NO: 2830421 - RNA, 22 nt, Human
cugggcggcgggcggcuggguc

SEQ ID NO: 2830422 - RNA, 23 nt, Human
cugggcguaguggcucacaccug

SEQ ID NO: 2830423 - RNA, 15 nt, Human
cugggcuaggggaca

SEQ ID NO: 2830424 - RNA, 20 nt, Human
cugggcuaggggacaucaga

SEQ ID NO: 2830425 - RNA, 18 nt, Human
cugggcuagguagaaaaa

SEQ ID NO: 2830426 - RNA, 20 nt, Human
cugggcuagguagaaaaagg

SEQ ID NO: 2830427 - RNA, 22 nt, Human
cugggcuagguagaaaaagggu

SEQ ID NO: 2830428 - RNA, 14 nt, Human
cugggcuauggaca

SEQ ID NO: 2830429 - RNA, 15 nt, Human
cugggcuauggacac

SEQ ID NO: 2830430 - RNA, 16 nt, Human
cugggcuauggacaca

SEQ ID NO: 2830431 - RNA, 17 nt, Human
cugggcuauggacacag

SEQ ID NO: 2830432 - RNA, 18 nt, Human
cugggcuauggacacagg

SEQ ID NO: 2830433 - RNA, 19 nt, Human
cugggcuauggacacaggg

SEQ ID NO: 2830434 - RNA, 20 nt, Human
cugggcuauggacacagggu

SEQ ID NO: 2830435 - RNA, 13 nt, Human
cugggcgacagag

SEQ ID NO: 2830436 - RNA, 23 nt, Human
cugggcuucaguggcagcugcuu

SEQ ID NO: 2830437 - RNA, 22 nt, Human
cugggcuucaguggcagcugcu

SEQ ID NO: 2830438 - RNA, 21 nt, Human
cugggcuucaguggcagcugc

SEQ ID NO: 2830439 - RNA, 13 nt, Human
cugggaaccuccc

SEQ ID NO: 2830440 - RNA, 15 nt, Human
cugggaaccucccag

SEQ ID NO: 2830441 - RNA, 16 nt, Human
cugggaaccucccaga

SEQ ID NO: 2830442 - RNA, 17 nt, Human
cugggaaccucccagag

SEQ ID NO: 2830443 - RNA, 18 nt, Human
cugggaaccucccagagg

SEQ ID NO: 2830444 - RNA, 21 nt, Human
cugggaaccucccagaggucc

SEQ ID NO: 2830445 - RNA, 22 nt, Human
cugggaaccucccagaggucca

SEQ ID NO: 2830446 - RNA, 23 nt, Human
cugggaaccucccagagguccag

SEQ ID NO: 2830447 - RNA, 19 nt, Human
cugggaagacgccugagcu

SEQ ID NO: 2830448 - RNA, 20 nt, Human
cugggaacucaccuggggcu

SEQ ID NO: 2830449 - RNA, 17 nt, Human
cugggaacucaccuggg

SEQ ID NO: 2830450 - RNA, 14 nt, Human
cugggagcucugca

SEQ ID NO: 2830451 - RNA, 15 nt, Human
cugggagcucugcag

SEQ ID NO: 2830452 - RNA, 13 nt, Human
cugggaagggaag

SEQ ID NO: 2830453 - RNA, 13 nt, Human
cugggagcucugc

SEQ ID NO: 2830454 - RNA, 19 nt, Human
cugggaagcugagggcaaa

SEQ ID NO: 2830455 - RNA, 20 nt, Human
cugggaagcugagggcaaau

SEQ ID NO: 2830456 - RNA, 13 nt, Human
cugggaaggccuc

SEQ ID NO: 2830457 - RNA, 22 nt, Human
cugggaggcauggcccuggggu

SEQ ID NO: 2830458 - RNA, 14 nt, Human
cugggaggaagcag

SEQ ID NO: 2830459 - RNA, 13 nt, Human
cugggaggaagca

SEQ ID NO: 2830460 - RNA, 14 nt, Human
cugggaggcaguga

SEQ ID NO: 2830461 - RNA, 13 nt, Human
cugggaggcaugg

SEQ ID NO: 2830462 - RNA, 19 nt, Human
cugggaggcauggcccugg

SEQ ID NO: 2830463 - RNA, 16 nt, Human
cugggaggcagugaug

SEQ ID NO: 2830464 - RNA, 12 nt, Human
cugggagugagc

SEQ ID NO: 2830465 - RNA, 13 nt, Human
cugggagugagcu

SEQ ID NO: 2830466 - RNA, 16 nt, Human
cugggagugagcuggu

SEQ ID NO: 2830467 - RNA, 21 nt, Human
cugggauuacaggcgugagcc

SEQ ID NO: 2830468 - RNA, 19 nt, Human
cugggaguggguggaggca

SEQ ID NO: 2830469 - RNA, 16 nt, Human
cugggaguguguggug

SEQ ID NO: 2830470 - RNA, 15 nt, Human
cugggaucacaggug

SEQ ID NO: 2830471 - RNA, 22 nt, Human
cugggaucacaggugucagcca

SEQ ID NO: 2830472 - RNA, 20 nt, Human
cugggauuacaggcuccugc

SEQ ID NO: 2830473 - RNA, 19 nt, Human
cugggauuacaggcuccug

SEQ ID NO: 2830474 - RNA, 19 nt, Human
cugggcaaugauggcaauu

SEQ ID NO: 2830475 - RNA, 22 nt, Human
cugggauuacaggcuccugcca

SEQ ID NO: 2830476 - RNA, 21 nt, Human
cugggauuacaggcuccugcc

SEQ ID NO: 2830477 - RNA, 16 nt, Human
cugggcacacgccucc

SEQ ID NO: 2830478 - RNA, 17 nt, Human
cugggcacacgccuccc

SEQ ID NO: 2830479 - RNA, 22 nt, Human
cugggcacacgccucccacugg

SEQ ID NO: 2830480 - RNA, 23 nt, Human
cugggcacacgccucccacuggg

SEQ ID NO: 2830481 - RNA, 17 nt, Human
cugggcacacucugcca

SEQ ID NO: 2830482 - RNA, 18 nt, Human
cugggcacacucugccag

SEQ ID NO: 2830483 - RNA, 21 nt, Human
cugggcacacucugccagcaa

SEQ ID NO: 2830484 - RNA, 22 nt, Human
cugggcacacucugccagcaaa

SEQ ID NO: 2830485 - RNA, 20 nt, Human
cuggcuguuggcugggggcc

SEQ ID NO: 2830486 - RNA, 21 nt, Human
cuggcuguuuggacuuuguau

SEQ ID NO: 2830487 - RNA, 14 nt, Human
cuggcuucacagau

SEQ ID NO: 2830488 - RNA, 21 nt, Human
cuggcuucaggcaauucuccu

SEQ ID NO: 2830489 - RNA, 22 nt, Human
cuggcuucaggcaauucuccug

SEQ ID NO: 2830490 - RNA, 14 nt, Human
cuggcuuauuuuaa

SEQ ID NO: 2830491 - RNA, 15 nt, Human
cuggcuuauuuuaau

SEQ ID NO: 2830492 - RNA, 16 nt, Human
cuggcuuauuuuaaug

SEQ ID NO: 2830493 - RNA, 22 nt, Human
cuggcuuauuuuaaugugauga

SEQ ID NO: 2830494 - RNA, 19 nt, Human
cuggcugggguggccugug

SEQ ID NO: 2830495 - RNA, 20 nt, Human
cuggcugggguggccugugu

SEQ ID NO: 2830496 - RNA, 21 nt, Human
cuggcugggguggccugugug

SEQ ID NO: 2830497 - RNA, 23 nt, Human
cuggcugggguggccuguguggc

SEQ ID NO: 2830498 - RNA, 19 nt, Human
cuggcuguuggcugggggc

SEQ ID NO: 2830499 - RNA, 15 nt, Human
cuggcuuuucacugc

SEQ ID NO: 2830500 - RNA, 16 nt, Human
cuggcuuuucacugcu

SEQ ID NO: 2830501 - RNA, 20 nt, Human
cuggcuucuggagcccuugg

SEQ ID NO: 2830502 - RNA, 16 nt, Human
cuggcuucuggagccc

SEQ ID NO: 2830503 - RNA, 15 nt, Human
cuggcuucuggagcc

SEQ ID NO: 2830504 - RNA, 14 nt, Human
cuggcuucuggagc

SEQ ID NO: 2830505 - RNA, 18 nt, Human
cuggcuuccuucucucaa

SEQ ID NO: 2830506 - RNA, 16 nt, Human
cuggcuucgcaaaaug

SEQ ID NO: 2830507 - RNA, 19 nt, Human
cugggaaaugagaaggcag

SEQ ID NO: 2830508 - RNA, 20 nt, Human
cugggaaaugagaaggcagc

SEQ ID NO: 2830509 - RNA, 19 nt, Human
cugggaacaccauagguca

SEQ ID NO: 2830510 - RNA, 23 nt, Human
cugggaaaugagaaggcagccac

SEQ ID NO: 2830511 - RNA, 16 nt, Human
cugggaaaugagcagg

SEQ ID NO: 2830512 - RNA, 21 nt, Human
cugggaaaugagaaggcagcc

SEQ ID NO: 2830513 - RNA, 22 nt, Human
cugggaaaugagaaggcagcca

SEQ ID NO: 2830514 - RNA, 17 nt, Human
cuggcuuuucacugcug

SEQ ID NO: 2830515 - RNA, 19 nt, Human
cuggcuuuucacugcuggc

SEQ ID NO: 2830516 - RNA, 20 nt, Human
cuggcuuuucacugcuggcu

SEQ ID NO: 2830517 - RNA, 22 nt, Human
cuggcuuuucacugcuggcugc

SEQ ID NO: 2830518 - RNA, 20 nt, Human
cuggcucuugauaccccccu

SEQ ID NO: 2830519 - RNA, 21 nt, Human
cuggcucuugauaccccccuc

SEQ ID NO: 2830520 - RNA, 22 nt, Human
cuggcucuugauaccccccucu

SEQ ID NO: 2830521 - RNA, 23 nt, Human
cuggcucuugauaccccccucug

SEQ ID NO: 2830522 - RNA, 19 nt, Human
cuggccugagaggggaagc

SEQ ID NO: 2830523 - RNA, 12 nt, Human
cuggccugacuu

SEQ ID NO: 2830524 - RNA, 18 nt, Human
cuggccugacuuggggga

SEQ ID NO: 2830525 - RNA, 14 nt, Human
cuggccucugugcc

SEQ ID NO: 2830526 - RNA, 15 nt, Human
cuggccucugugccu

SEQ ID NO: 2830527 - RNA, 16 nt, Human
cuggccucugugccuu

SEQ ID NO: 2830528 - RNA, 20 nt, Human
cuggccucugugccuucuuu

SEQ ID NO: 2830529 - RNA, 17 nt, Human
cuggcugggcauggacg

SEQ ID NO: 2830530 - RNA, 15 nt, Human
cuggcugggcaugga

SEQ ID NO: 2830531 - RNA, 14 nt, Human
cuggcugggcaugg

SEQ ID NO: 2830532 - RNA, 14 nt, Human
cuggcugccuuaga

SEQ ID NO: 2830533 - RNA, 19 nt, Human
cuggcugccuuagaaccuu

SEQ ID NO: 2830534 - RNA, 20 nt, Human
cuggcucuugugcuggaugg

SEQ ID NO: 2830535 - RNA, 20 nt, Human
cuggcucuuucgucacccuu

SEQ ID NO: 2830536 - RNA, 23 nt, Human
cuggcucuuucgucacccuugga

SEQ ID NO: 2830537 - RNA, 17 nt, Human
cuggcucuugugcugga

SEQ ID NO: 2830538 - RNA, 22 nt, Human
cuggcucuuuggagaucaagga

SEQ ID NO: 2830539 - RNA, 21 nt, Human
cuggcugccccaaccugcuga

SEQ ID NO: 2830540 - RNA, 16 nt, Human
cuggcacagggcagug

SEQ ID NO: 2830541 - RNA, 17 nt, Human
cuggcacagggcagugg

SEQ ID NO: 2830542 - RNA, 13 nt, Human
cuggauuuuguca

SEQ ID NO: 2830543 - RNA, 16 nt, Human
cuggcaaacaugaaaa

SEQ ID NO: 2830544 - RNA, 22 nt, Human
cuggcaaacaugaaaaaucggc

SEQ ID NO: 2830545 - RNA, 15 nt, Human
cuggcaauugucuau

SEQ ID NO: 2830546 - RNA, 18 nt, Human
cuggcaauugucuauuua

SEQ ID NO: 2830547 - RNA, 19 nt, Human
cuggcaauugucuauuuau

SEQ ID NO: 2830548 - RNA, 12 nt, Human
cuggcacacauc

SEQ ID NO: 2830549 - RNA, 21 nt, Human
cuggcacacaucaggaguuca

SEQ ID NO: 2830550 - RNA, 15 nt, Human
cuggaugucugccaa

SEQ ID NO: 2830551 - RNA, 16 nt, Human
cuggauucauugucuc

SEQ ID NO: 2830552 - RNA, 17 nt, Human
cuggauucauugucucu

SEQ ID NO: 2830553 - RNA, 14 nt, Human
cuggauucccagga

SEQ ID NO: 2830554 - RNA, 13 nt, Human
cuggauucccagg

SEQ ID NO: 2830555 - RNA, 23 nt, Human
cuggauuauucaaaaugauguau

SEQ ID NO: 2830556 - RNA, 19 nt, Human
cuggaugucugccaauuuu

SEQ ID NO: 2830557 - RNA, 15 nt, Human
cuggauguuuggaaa

SEQ ID NO: 2830558 - RNA, 12 nt, Human
cuggaugucuga

SEQ ID NO: 2830559 - RNA, 13 nt, Human
cuggaugucugaa

SEQ ID NO: 2830560 - RNA, 16 nt, Human
cuggaugucugaacuu

SEQ ID NO: 2830561 - RNA, 17 nt, Human
cuggaugucugaacuuu

SEQ ID NO: 2830562 - RNA, 21 nt, Human
cuggaugucugaacuuuggga

SEQ ID NO: 2830563 - RNA, 21 nt, Human
cuggauggaggaaaaccaagc

SEQ ID NO: 2830564 - RNA, 16 nt, Human
cuggaggccuuccagc

SEQ ID NO: 2830565 - RNA, 18 nt, Human
cuggaggccuuccagcug

SEQ ID NO: 2830566 - RNA, 19 nt, Human
cuggaggccuuccagcugc

SEQ ID NO: 2830567 - RNA, 20 nt, Human
cuggaggccuuccagcugcu

SEQ ID NO: 2830568 - RNA, 21 nt, Human
cuggaggccuuccagcugcug

SEQ ID NO: 2830569 - RNA, 22 nt, Human
cuggaggccuuccagcugcugu

SEQ ID NO: 2830570 - RNA, 16 nt, Human
cuggccagaugcacca

SEQ ID NO: 2830571 - RNA, 18 nt, Human
cuggccaacauggcgaaa

SEQ ID NO: 2830572 - RNA, 13 nt, Human
cuggcauuuuaua

SEQ ID NO: 2830573 - RNA, 17 nt, Human
cuggcauuuuauagaca

SEQ ID NO: 2830574 - RNA, 23 nt, Human
cuggcauuuuauagacacccugg

SEQ ID NO: 2830575 - RNA, 21 nt, Human
cuggcauuauguccacugugu

SEQ ID NO: 2830576 - RNA, 17 nt, Human
cuggcauucuuguacag

SEQ ID NO: 2830577 - RNA, 20 nt, Human
cuggcauuagaauuauuuaa

SEQ ID NO: 2830578 - RNA, 22 nt, Human
cuggcauuagaauuauuuaaac

SEQ ID NO: 2830579 - RNA, 19 nt, Human
cuggcauuauguccacugu

SEQ ID NO: 2830580 - RNA, 19 nt, Human
cuggcacugaauuaaucau

SEQ ID NO: 2830581 - RNA, 19 nt, Human
cuggcauuagaauuauuua

SEQ ID NO: 2830582 - RNA, 20 nt, Human
cuggccagaugcaccagccc

SEQ ID NO: 2830583 - RNA, 19 nt, Human
cuggccagaugcaccagcc

SEQ ID NO: 2830584 - RNA, 18 nt, Human
cuggccagaugcaccagc

SEQ ID NO: 2830585 - RNA, 17 nt, Human
cuggccagaugcaccag

SEQ ID NO: 2830586 - RNA, 21 nt, Human
cuggccagaugcaccagcccu

SEQ ID NO: 2830587 - RNA, 17 nt, Human
cuggccaacaugguaaa

SEQ ID NO: 2830588 - RNA, 22 nt, Human
cuggccauuugccaauuuuccu

SEQ ID NO: 2830589 - RNA, 19 nt, Human
cuggccucccacagacuca

SEQ ID NO: 2830590 - RNA, 17 nt, Human
cuggccucccacagacu

SEQ ID NO: 2830591 - RNA, 11 nt, Human
cuggccucugu

SEQ ID NO: 2830592 - RNA, 13 nt, Human
cuggccucugugc

SEQ ID NO: 2830593 - RNA, 17 nt, Human
cuggccucuggcucuca

SEQ ID NO: 2830594 - RNA, 20 nt, Human
cuggccucuaccacaagggc

SEQ ID NO: 2830595 - RNA, 15 nt, Human
cuggaagcacagcuu

SEQ ID NO: 2830596 - RNA, 18 nt, Human
cuggaagcacagcuucau

SEQ ID NO: 2830597 - RNA, 14 nt, Human
cuggaagcacagcu

SEQ ID NO: 2830598 - RNA, 15 nt, Human
cuggaaugcaguggu

SEQ ID NO: 2830599 - RNA, 20 nt, Human
cuggaauggaaggguucugg

SEQ ID NO: 2830600 - RNA, 22 nt, Human
cuggaaugguacaugucuucca

SEQ ID NO: 2830601 - RNA, 14 nt, Human
cuggaaugcagugg

SEQ ID NO: 2830602 - RNA, 13 nt, Human
cuggaauaagaag

SEQ ID NO: 2830603 - RNA, 19 nt, Human
cuggaauaagaagcaaaua

SEQ ID NO: 2830604 - RNA, 21 nt, Human
cuggaauaagaagcaaauaaa

SEQ ID NO: 2830605 - RNA, 17 nt, Human
cuggacacucagaccug

SEQ ID NO: 2830606 - RNA, 20 nt, Human
cuggaauuagcuuggggcca

SEQ ID NO: 2830607 - RNA, 22 nt, Human
cuggaauuagcuuggggccagg

SEQ ID NO: 2830608 - RNA, 23 nt, Human
cuggaauuccuaacuuuucaaug

SEQ ID NO: 2830609 - RNA, 18 nt, Human
cuggacacucagaccuga

SEQ ID NO: 2830610 - RNA, 13 nt, Human
cuggacagagggg

SEQ ID NO: 2830611 - RNA, 14 nt, Human
cuggacagagggga

SEQ ID NO: 2830612 - RNA, 19 nt, Human
cuggacagaggggacucug

SEQ ID NO: 2830613 - RNA, 20 nt, Human
cuggacagaggggacucugg

SEQ ID NO: 2830614 - RNA, 21 nt, Human
cuggacagaggggacucuggg

SEQ ID NO: 2830615 - RNA, 22 nt, Human
cuggacagaggggacucugggc

SEQ ID NO: 2830616 - RNA, 14 nt, Human
cugcucuuguuucu

SEQ ID NO: 2830617 - RNA, 19 nt, Human
cugcucuuuuauacuguac

SEQ ID NO: 2830618 - RNA, 20 nt, Human
cugcugaaaaccaucuggcc

SEQ ID NO: 2830619 - RNA, 21 nt, Human
cugcugaaaaccaucuggccu

SEQ ID NO: 2830620 - RNA, 22 nt, Human
cugcugaaaaccaucuggccug

SEQ ID NO: 2830621 - RNA, 23 nt, Human
cugcugaaaaccaucuggccugg

SEQ ID NO: 2830622 - RNA, 23 nt, Human
cugcucugaguuauguuaaaauc

SEQ ID NO: 2830623 - RNA, 12 nt, Human
cugcucugauga

SEQ ID NO: 2830624 - RNA, 19 nt, Human
cugcuuucugauguugccu

SEQ ID NO: 2830625 - RNA, 12 nt, Human
cugcuuucuccc

SEQ ID NO: 2830626 - RNA, 13 nt, Human
cugcuuucucccc

SEQ ID NO: 2830627 - RNA, 14 nt, Human
cugcuuucucccca

SEQ ID NO: 2830628 - RNA, 19 nt, Human
cugcuuugggcugcccugg

SEQ ID NO: 2830629 - RNA, 20 nt, Human
cugcuuugggcugcccuggu

SEQ ID NO: 2830630 - RNA, 17 nt, Human
cugcuuugggcugcccu

SEQ ID NO: 2830631 - RNA, 18 nt, Human
cugcuuugggcugcccug

SEQ ID NO: 2830632 - RNA, 13 nt, Human
cugcuuuuauauc

SEQ ID NO: 2830633 - RNA, 21 nt, Human
cugcuuugggcugcccuggug

SEQ ID NO: 2830634 - RNA, 22 nt, Human
cugcuuugggcugcccuggugc

SEQ ID NO: 2830635 - RNA, 23 nt, Human
cugcuuugggcugcccuggugcu

SEQ ID NO: 2830636 - RNA, 18 nt, Human
cuggagcuucauuuuggu

SEQ ID NO: 2830637 - RNA, 15 nt, Human
cuggagccaugggca

SEQ ID NO: 2830638 - RNA, 21 nt, Human
cuggagccaugggcacaaagg

SEQ ID NO: 2830639 - RNA, 16 nt, Human
cuggagagaaguggaa

SEQ ID NO: 2830640 - RNA, 14 nt, Human
cuggagagaaacaa

SEQ ID NO: 2830641 - RNA, 22 nt, Human
cuggagagaaacaauaaagaga

SEQ ID NO: 2830642 - RNA, 23 nt, Human
cuggagaggagggaugcugccug

SEQ ID NO: 2830643 - RNA, 16 nt, Human
cuggagauacuggugg

SEQ ID NO: 2830644 - RNA, 13 nt, Human
cuggagcagacca

SEQ ID NO: 2830645 - RNA, 15 nt, Human
cuggagcagaccacc

SEQ ID NO: 2830646 - RNA, 18 nt, Human
cuggagcagaccaccccg

SEQ ID NO: 2830647 - RNA, 22 nt, Human
cuggagcagaccaccccgccug

SEQ ID NO: 2830648 - RNA, 20 nt, Human
cuggacaguaucccacaucc

SEQ ID NO: 2830649 - RNA, 17 nt, Human
cuggacagucacugcca

SEQ ID NO: 2830650 - RNA, 23 nt, Human
cuggacagucacugccacuuugc

SEQ ID NO: 2830651 - RNA, 16 nt, Human
cuggacagucagcucu

SEQ ID NO: 2830652 - RNA, 19 nt, Human
cuggacagucagcucuuca

SEQ ID NO: 2830653 - RNA, 17 nt, Human
cuggacauaacauuuuc

SEQ ID NO: 2830654 - RNA, 18 nt, Human
cuggacauaacauuuuca

SEQ ID NO: 2830655 - RNA, 18 nt, Human
cuggacaguaucccacau

SEQ ID NO: 2830656 - RNA, 16 nt, Human
cuggacaguaucccac

SEQ ID NO: 2830657 - RNA, 15 nt, Human
cuggaccacugggca

SEQ ID NO: 2830658 - RNA, 14 nt, Human
cuggaccacugggc

SEQ ID NO: 2830659 - RNA, 18 nt, Human
cuggacauuugccuugcu

SEQ ID NO: 2830660 - RNA, 15 nt, Human
cuggacaugcugacu

SEQ ID NO: 2830661 - RNA, 22 nt, Human
cugcuuuuauuaaauuuguuga

SEQ ID NO: 2830662 - RNA, 15 nt, Human
cuggacggcauuccu

SEQ ID NO: 2830663 - RNA, 20 nt, Human
cuggacggcauuccugcuua

SEQ ID NO: 2830664 - RNA, 15 nt, Human
cuggacggggacugg

SEQ ID NO: 2830665 - RNA, 18 nt, Human
cuggacggggacugggga

SEQ ID NO: 2830666 - RNA, 19 nt, Human
cuggacggcauuccugcuu

SEQ ID NO: 2830667 - RNA, 17 nt, Human
cuggacggcauuccugc

SEQ ID NO: 2830668 - RNA, 23 nt, Human
cuggacuagagggaccucuccca

SEQ ID NO: 2830669 - RNA, 21 nt, Human
cuggacuagagggaccucucc

SEQ ID NO: 2830670 - RNA, 20 nt, Human
cuggacuagagggaccucuc

SEQ ID NO: 2830671 - RNA, 23 nt, Human
cuggacggggacuggggaugugg

SEQ ID NO: 2830672 - RNA, 16 nt, Human
cuggacgucuuucuuu

SEQ ID NO: 2830673 - RNA, 16 nt, Human
cuggacucaccucccc

SEQ ID NO: 2830674 - RNA, 22 nt, Human
cugcccugggaggcagugaugg

SEQ ID NO: 2830675 - RNA, 15 nt, Human
cugcccugggaggca

SEQ ID NO: 2830676 - RNA, 16 nt, Human
cugcccugccacuuug

SEQ ID NO: 2830677 - RNA, 11 nt, Human
cugcccuggga

SEQ ID NO: 2830678 - RNA, 13 nt, Human
cugcccugggagg

SEQ ID NO: 2830679 - RNA, 12 nt, Human
cugcccugggag

SEQ ID NO: 2830680 - RNA, 13 nt, Human
cugccucagccuc

SEQ ID NO: 2830681 - RNA, 12 nt, Human
cugccucagccu

SEQ ID NO: 2830682 - RNA, 23 nt, Human
cugccucacuuccuacaagagca

SEQ ID NO: 2830683 - RNA, 14 nt, Human
cugccucacuuccu

SEQ ID NO: 2830684 - RNA, 15 nt, Human
cugccucaccgcuuc

SEQ ID NO: 2830685 - RNA, 16 nt, Human
cugccucaccgcuucc

SEQ ID NO: 2830686 - RNA, 18 nt, Human
cugccucaccgcuucccu

SEQ ID NO: 2830687 - RNA, 14 nt, Human
cugccucagccucc

SEQ ID NO: 2830688 - RNA, 14 nt, Human
cugccugcccaggc

SEQ ID NO: 2830689 - RNA, 13 nt, Human
cugccugcccagg

SEQ ID NO: 2830690 - RNA, 15 nt, Human
cugccugcccaggcc

SEQ ID NO: 2830691 - RNA, 13 nt, Human
cugccugcccaca

SEQ ID NO: 2830692 - RNA, 18 nt, Human
cugccugcaauauuugaa

SEQ ID NO: 2830693 - RNA, 19 nt, Human
cugccugcaauauuugaau

SEQ ID NO: 2830694 - RNA, 16 nt, Human
cugccugcccacacag

SEQ ID NO: 2830695 - RNA, 17 nt, Human
cugccugcaauauuuga

SEQ ID NO: 2830696 - RNA, 16 nt, Human
cugccugauggaccug

SEQ ID NO: 2830697 - RNA, 23 nt, Human
cugccugaagucacacagugagu

SEQ ID NO: 2830698 - RNA, 12 nt, Human
cugccucuuccu

SEQ ID NO: 2830699 - RNA, 14 nt, Human
cugccucucuagga

SEQ ID NO: 2830700 - RNA, 17 nt, Human
cugccucugccuuagag

SEQ ID NO: 2830701 - RNA, 23 nt, Human
cugccucugccuuagaggagccc

SEQ ID NO: 2830702 - RNA, 18 nt, Human
cugcuccucuccccagca

SEQ ID NO: 2830703 - RNA, 13 nt, Human
cugcuccugcagc

SEQ ID NO: 2830704 - RNA, 14 nt, Human
cugcuccugcagca

SEQ ID NO: 2830705 - RNA, 16 nt, Human
cugcuccugcagcaug

SEQ ID NO: 2830706 - RNA, 15 nt, Human
cugcucgccuuagca

SEQ ID NO: 2830707 - RNA, 13 nt, Human
cugcuccuuggcu

SEQ ID NO: 2830708 - RNA, 19 nt, Human
cugcuccuuggcuuaccug

SEQ ID NO: 2830709 - RNA, 20 nt, Human
cugcuccuuggcuuaccuga

SEQ ID NO: 2830710 - RNA, 13 nt, Human
cugcuccuuuccc

SEQ ID NO: 2830711 - RNA, 14 nt, Human
cugcuccuuucccc

SEQ ID NO: 2830712 - RNA, 15 nt, Human
cugcuccuuuccccu

SEQ ID NO: 2830713 - RNA, 14 nt, Human
cugcucgcccuccu

SEQ ID NO: 2830714 - RNA, 15 nt, Human
cugcucgcccuccuu

SEQ ID NO: 2830715 - RNA, 17 nt, Human
cugcucgcccuccuuuc

SEQ ID NO: 2830716 - RNA, 18 nt, Human
cugcucgcccuccuuucu

SEQ ID NO: 2830717 - RNA, 19 nt, Human
cugcucgcccuccuuucug

SEQ ID NO: 2830718 - RNA, 22 nt, Human
cugcucgcccuccuuucugugc

SEQ ID NO: 2830719 - RNA, 23 nt, Human
cugcucgcccuccuuucugugcc

SEQ ID NO: 2830720 - RNA, 16 nt, Human
cugcucgccuuagcac

SEQ ID NO: 2830721 - RNA, 14 nt, Human
cugcucccugaagc

SEQ ID NO: 2830722 - RNA, 12 nt, Human
cugcucccucuc

SEQ ID NO: 2830723 - RNA, 16 nt, Human
cugcucccucuccccc

SEQ ID NO: 2830724 - RNA, 20 nt, Human
cugcucccucucccccuuac

SEQ ID NO: 2830725 - RNA, 13 nt, Human
cugcucccuaagc

SEQ ID NO: 2830726 - RNA, 17 nt, Human
cugcucccuaagccagc

SEQ ID NO: 2830727 - RNA, 19 nt, Human
cugcucccuaagccagccu

SEQ ID NO: 2830728 - RNA, 20 nt, Human
cugcucccuaagccagccug

SEQ ID NO: 2830729 - RNA, 21 nt, Human
cugcucccuaagccagccugg

SEQ ID NO: 2830730 - RNA, 17 nt, Human
cugcuccucuccccagc

SEQ ID NO: 2830731 - RNA, 16 nt, Human
cugcuccucuccccag

SEQ ID NO: 2830732 - RNA, 14 nt, Human
cugcuccgcugcuc

SEQ ID NO: 2830733 - RNA, 15 nt, Human
cugcuccgcugcucc

SEQ ID NO: 2830734 - RNA, 16 nt, Human
cugcuccgcugcuccu

SEQ ID NO: 2830735 - RNA, 17 nt, Human
cugcuccgcugcuccuu

SEQ ID NO: 2830736 - RNA, 18 nt, Human
cugcuccgcugcuccuug

SEQ ID NO: 2830737 - RNA, 21 nt, Human
cugcuccgcugcuccuuggcu

SEQ ID NO: 2830738 - RNA, 15 nt, Human
cugcucccugaagcc

SEQ ID NO: 2830739 - RNA, 16 nt, Human
cugcucccugaagcca

SEQ ID NO: 2830740 - RNA, 17 nt, Human
cugcucccugaagccag

SEQ ID NO: 2830741 - RNA, 18 nt, Human
cugcucccugaagccagc

SEQ ID NO: 2830742 - RNA, 19 nt, Human
cugcucccugaagccagcc

SEQ ID NO: 2830743 - RNA, 20 nt, Human
cugcucccugaagccagccu

SEQ ID NO: 2830744 - RNA, 21 nt, Human
cugcucccugaagccagccuu

SEQ ID NO: 2830745 - RNA, 22 nt, Human
cugcucccugaagccagccuuc

SEQ ID NO: 2830746 - RNA, 20 nt, Human
cugcggaaugaaccacaucu

SEQ ID NO: 2830747 - RNA, 15 nt, Human
cugccuuagaggagc

SEQ ID NO: 2830748 - RNA, 16 nt, Human
cugccuuagaggagcc

SEQ ID NO: 2830749 - RNA, 23 nt, Human
cugccuuagaggagcccacggcu

SEQ ID NO: 2830750 - RNA, 17 nt, Human
cugccuuaggccuaccu

SEQ ID NO: 2830751 - RNA, 19 nt, Human
cugccuuaggccuaccuga

SEQ ID NO: 2830752 - RNA, 16 nt, Human
cugccuuagucucagu

SEQ ID NO: 2830753 - RNA, 20 nt, Human
cugccuuagucucaguuugu

SEQ ID NO: 2830754 - RNA, 23 nt, Human
cugccuuagucucaguuugugug

SEQ ID NO: 2830755 - RNA, 15 nt, Human
cugcgguccacccag

SEQ ID NO: 2830756 - RNA, 23 nt, Human
cugcggaccccagcugugagccu

SEQ ID NO: 2830757 - RNA, 21 nt, Human
cugcggaaugaaccacaucuu

SEQ ID NO: 2830758 - RNA, 17 nt, Human
cugcgcuuuauuuucuu

SEQ ID NO: 2830759 - RNA, 14 nt, Human
cugcggaaaaggaa

SEQ ID NO: 2830760 - RNA, 13 nt, Human
cugcggaccccag

SEQ ID NO: 2830761 - RNA, 14 nt, Human
cugcggaccccagc

SEQ ID NO: 2830762 - RNA, 15 nt, Human
cugcggaccccagcu

SEQ ID NO: 2830763 - RNA, 16 nt, Human
cugcggaccccagcug

SEQ ID NO: 2830764 - RNA, 20 nt, Human
cugcggaccccagcugugag

SEQ ID NO: 2830765 - RNA, 16 nt, Human
cugcgguccacccagg

SEQ ID NO: 2830766 - RNA, 14 nt, Human
cugcgugggucaga

SEQ ID NO: 2830767 - RNA, 20 nt, Human
cugcguuuuggaagcucuga

SEQ ID NO: 2830768 - RNA, 16 nt, Human
cugcguugguccagag

SEQ ID NO: 2830769 - RNA, 17 nt, Human
cugcguugguccagagc

SEQ ID NO: 2830770 - RNA, 18 nt, Human
cugcguugguccagagcg

SEQ ID NO: 2830771 - RNA, 19 nt, Human
cugcguugguccagagcgg

SEQ ID NO: 2830772 - RNA, 13 nt, Human
cugcguucugcaa

SEQ ID NO: 2830773 - RNA, 15 nt, Human
cugcguucugcaagc

SEQ ID NO: 2830774 - RNA, 18 nt, Human
cugcccaggcugugcagc

SEQ ID NO: 2830775 - RNA, 12 nt, Human
cugcuccacgcg

SEQ ID NO: 2830776 - RNA, 13 nt, Human
cugcuccacgcgc

SEQ ID NO: 2830777 - RNA, 14 nt, Human
cugcuccacgcgcu

SEQ ID NO: 2830778 - RNA, 20 nt, Human
cugcuccacgcgcuucgacu

SEQ ID NO: 2830779 - RNA, 18 nt, Human
cugcuccagaauuuggaa

SEQ ID NO: 2830780 - RNA, 20 nt, Human
cugcuccagaauuuggaaau

SEQ ID NO: 2830781 - RNA, 21 nt, Human
cugcuccagaauuuggaaauc

SEQ ID NO: 2830782 - RNA, 22 nt, Human
cugcuccagaauuuggaaaucc

SEQ ID NO: 2830783 - RNA, 23 nt, Human
cugcuccagaauuuggaaauccu

SEQ ID NO: 2830784 - RNA, 21 nt, Human
cugccagcagcagcaggugau

SEQ ID NO: 2830785 - RNA, 13 nt, Human
cugccagccccac

SEQ ID NO: 2830786 - RNA, 15 nt, Human
cugccagccccacac

SEQ ID NO: 2830787 - RNA, 17 nt, Human
cugccagccccacacag

SEQ ID NO: 2830788 - RNA, 18 nt, Human
cugccagccccacacagc

SEQ ID NO: 2830789 - RNA, 19 nt, Human
cugccagccccacacagcu

SEQ ID NO: 2830790 - RNA, 20 nt, Human
cugccagccuggcuucugga

SEQ ID NO: 2830791 - RNA, 19 nt, Human
cugccagccuggcuucugg

SEQ ID NO: 2830792 - RNA, 16 nt, Human
cugccagccuggcuuc

SEQ ID NO: 2830793 - RNA, 15 nt, Human
cugccagccuggcuu

SEQ ID NO: 2830794 - RNA, 14 nt, Human
cugccagccuggcu

SEQ ID NO: 2830795 - RNA, 13 nt, Human
cugccagccuggc

SEQ ID NO: 2830796 - RNA, 12 nt, Human
cugccagccugg

SEQ ID NO: 2830797 - RNA, 14 nt, Human
cugccaugccagga

SEQ ID NO: 2830798 - RNA, 22 nt, Human
cugccaugccaggaaccugucc

SEQ ID NO: 2830799 - RNA, 18 nt, Human
cugccaugccaggaaccu

SEQ ID NO: 2830800 - RNA, 17 nt, Human
cugccaugccaggaacc

SEQ ID NO: 2830801 - RNA, 16 nt, Human
cugccaugccaggaac

SEQ ID NO: 2830802 - RNA, 23 nt, Human
cugccagccuggcuucuggagcc

SEQ ID NO: 2830803 - RNA, 22 nt, Human
cugccagccuggcuucuggagc

SEQ ID NO: 2830804 - RNA, 12 nt, Human
cugccagccaca

SEQ ID NO: 2830805 - RNA, 14 nt, Human
cugccacccugggg

SEQ ID NO: 2830806 - RNA, 12 nt, Human
cugccagcagca

SEQ ID NO: 2830807 - RNA, 11 nt, Human
cugccagcagc

SEQ ID NO: 2830808 - RNA, 19 nt, Human
cugccagcagcagcaggug

SEQ ID NO: 2830809 - RNA, 17 nt, Human
cugccagcagcagcagg

SEQ ID NO: 2830810 - RNA, 15 nt, Human
cugccagcagcagca

SEQ ID NO: 2830811 - RNA, 13 nt, Human
cugccagcagcag

SEQ ID NO: 2830812 - RNA, 20 nt, Human
cugccacccuggggagaaag

SEQ ID NO: 2830813 - RNA, 16 nt, Human
cugccacccuggggag

SEQ ID NO: 2830814 - RNA, 15 nt, Human
cugccacccugggga

SEQ ID NO: 2830815 - RNA, 22 nt, Human
cugccaccagagaccguccuca

SEQ ID NO: 2830816 - RNA, 15 nt, Human
cugccaccagagacc

SEQ ID NO: 2830817 - RNA, 21 nt, Human
cugccaccagagaccguccuc

SEQ ID NO: 2830818 - RNA, 19 nt, Human
cugccaccacgcccggcua

SEQ ID NO: 2830819 - RNA, 14 nt, Human
cugccaccagagac

SEQ ID NO: 2830820 - RNA, 16 nt, Human
cugccacauuagaacu

SEQ ID NO: 2830821 - RNA, 18 nt, Human
cugccacauuagaacuuc

SEQ ID NO: 2830822 - RNA, 12 nt, Human
cugcaggggcuc

SEQ ID NO: 2830823 - RNA, 21 nt, Human
cugccacacucuccaucaccc

SEQ ID NO: 2830824 - RNA, 13 nt, Human
cugccacacucug

SEQ ID NO: 2830825 - RNA, 15 nt, Human
cugccacacucugac

SEQ ID NO: 2830826 - RNA, 16 nt, Human
cugccacacucugacg

SEQ ID NO: 2830827 - RNA, 18 nt, Human
cugccacacucugacgca

SEQ ID NO: 2830828 - RNA, 13 nt, Human
cugccacacuuca

SEQ ID NO: 2830829 - RNA, 17 nt, Human
cugccacacuucaggcu

SEQ ID NO: 2830830 - RNA, 22 nt, Human
cugccacacuucaggcucuucu

SEQ ID NO: 2830831 - RNA, 21 nt, Human
cugcagggccaggacugagcc

SEQ ID NO: 2830832 - RNA, 14 nt, Human
cugcagggccagga

SEQ ID NO: 2830833 - RNA, 15 nt, Human
cugcagggccaggac

SEQ ID NO: 2830834 - RNA, 16 nt, Human
cugcagggccaggacu

SEQ ID NO: 2830835 - RNA, 17 nt, Human
cugcagggccaggacug

SEQ ID NO: 2830836 - RNA, 11 nt, Human
cugcaggggcu

SEQ ID NO: 2830837 - RNA, 12 nt, Human
cugcagggcugc

SEQ ID NO: 2830838 - RNA, 15 nt, Human
cugcccggcugcgga

SEQ ID NO: 2830839 - RNA, 11 nt, Human
cugcccggcug

SEQ ID NO: 2830840 - RNA, 10 nt, Human
cugcccuccc

SEQ ID NO: 2830841 - RNA, 14 nt, Human
cugcccuccccucu

SEQ ID NO: 2830842 - RNA, 21 nt, Human
cugcccgggaaggucaccagc

SEQ ID NO: 2830843 - RNA, 20 nt, Human
cugcccuccccucucugcac

SEQ ID NO: 2830844 - RNA, 16 nt, Human
cugcccucccuggagc

SEQ ID NO: 2830845 - RNA, 20 nt, Human
cugcccuccuuguccaccca

SEQ ID NO: 2830846 - RNA, 12 nt, Human
cugcccucgcac

SEQ ID NO: 2830847 - RNA, 22 nt, Human
cugcccucgcacggccccgaag

SEQ ID NO: 2830848 - RNA, 18 nt, Human
cugcccuccuuguccacc

SEQ ID NO: 2830849 - RNA, 17 nt, Human
cugcccuccuuaauuug

SEQ ID NO: 2830850 - RNA, 11 nt, Human
cugcccugaga

SEQ ID NO: 2830851 - RNA, 12 nt, Human
cugcccugagaa

SEQ ID NO: 2830852 - RNA, 19 nt, Human
cugcccugagaagcugcuc

SEQ ID NO: 2830853 - RNA, 21 nt, Human
cugcccugagaagcugcucca

SEQ ID NO: 2830854 - RNA, 13 nt, Human
cugcccugccacu

SEQ ID NO: 2830855 - RNA, 19 nt, Human
cugcccaggccugccuguu

SEQ ID NO: 2830856 - RNA, 17 nt, Human
cugcccaggccugccug

SEQ ID NO: 2830857 - RNA, 18 nt, Human
cugcccaggccugccugu

SEQ ID NO: 2830858 - RNA, 13 nt, Human
cugcccaggcccc

SEQ ID NO: 2830859 - RNA, 21 nt, Human
cugccauuugauuuuucuaac

SEQ ID NO: 2830860 - RNA, 23 nt, Human
cugcccaggaccaucuucccgag

SEQ ID NO: 2830861 - RNA, 19 nt, Human
cugccauuugcacccuccg

SEQ ID NO: 2830862 - RNA, 23 nt, Human
cugccaugccaggaaccuguccu

SEQ ID NO: 2830863 - RNA, 21 nt, Human
cugccauuugcacccuccgcc

SEQ ID NO: 2830864 - RNA, 20 nt, Human
cugccauuugcacccuccgc

SEQ ID NO: 2830865 - RNA, 17 nt, Human
cugcccaaaaauauggu

SEQ ID NO: 2830866 - RNA, 17 nt, Human
cugcccaaccugcucuc

SEQ ID NO: 2830867 - RNA, 15 nt, Human
cugcagagcaccuuu

SEQ ID NO: 2830868 - RNA, 15 nt, Human
cugcagaagcaaggg

SEQ ID NO: 2830869 - RNA, 23 nt, Human
cugcagaggggaaaccaguguag

SEQ ID NO: 2830870 - RNA, 20 nt, Human
cugcagagcaggaaacauga

SEQ ID NO: 2830871 - RNA, 17 nt, Human
cugcacuugcagacucu

SEQ ID NO: 2830872 - RNA, 16 nt, Human
cugcacuugcagacuc

SEQ ID NO: 2830873 - RNA, 14 nt, Human
cugcacuugcagac

SEQ ID NO: 2830874 - RNA, 14 nt, Human
cugcacuuccuguu

SEQ ID NO: 2830875 - RNA, 11 nt, Human
cugcagccuca

SEQ ID NO: 2830876 - RNA, 12 nt, Human
cugcagccagcu

SEQ ID NO: 2830877 - RNA, 14 nt, Human
cugcagccagcuca

SEQ ID NO: 2830878 - RNA, 22 nt, Human
cugcagccagcucacguccagg

SEQ ID NO: 2830879 - RNA, 21 nt, Human
cugcagaugccacccuagcca

SEQ ID NO: 2830880 - RNA, 19 nt, Human
cugcagaugccacccuagc

SEQ ID NO: 2830881 - RNA, 22 nt, Human
cugcagaugccacccuagccaa

SEQ ID NO: 2830882 - RNA, 17 nt, Human
cugcagauuugggcugg

SEQ ID NO: 2830883 - RNA, 16 nt, Human
cugcagaugccacccu

SEQ ID NO: 2830884 - RNA, 14 nt, Human
cugcagaugccacc

SEQ ID NO: 2830885 - RNA, 14 nt, Human
cugcagaguuugga

SEQ ID NO: 2830886 - RNA, 15 nt, Human
cugcagaguuuggau

SEQ ID NO: 2830887 - RNA, 23 nt, Human
cugcagaggggcuuucuggagag

SEQ ID NO: 2830888 - RNA, 13 nt, Human
cugcagaggguua

SEQ ID NO: 2830889 - RNA, 22 nt, Human
cugcagaggguuaggagugggu

SEQ ID NO: 2830890 - RNA, 22 nt, Human
cugcagaggggcuuucuggaga

SEQ ID NO: 2830891 - RNA, 20 nt, Human
cugcagaggggcuuucugga

SEQ ID NO: 2830892 - RNA, 19 nt, Human
cugcagaggggcuuucugg

SEQ ID NO: 2830893 - RNA, 22 nt, Human
cugcagggaguccgaaagggac

SEQ ID NO: 2830894 - RNA, 16 nt, Human
cugcagggccaagcac

SEQ ID NO: 2830895 - RNA, 13 nt, Human
cugcagggccagg

SEQ ID NO: 2830896 - RNA, 15 nt, Human
cugcagggacugcca

SEQ ID NO: 2830897 - RNA, 17 nt, Human
cugcagggacugccagu

SEQ ID NO: 2830898 - RNA, 20 nt, Human
cugcagccucaaccuccugg

SEQ ID NO: 2830899 - RNA, 19 nt, Human
cugcagccucaaccuccug

SEQ ID NO: 2830900 - RNA, 22 nt, Human
cugcagccucaaccuccugggc

SEQ ID NO: 2830901 - RNA, 18 nt, Human
cugcagauagaaagcauu

SEQ ID NO: 2830902 - RNA, 15 nt, Human
cugcaggcuuaauaa

SEQ ID NO: 2830903 - RNA, 23 nt, Human
cugcaggcuuaauaaaaaugaca

SEQ ID NO: 2830904 - RNA, 15 nt, Human
cugcaggcugagcca

SEQ ID NO: 2830905 - RNA, 16 nt, Human
cugcaggcugagccac

SEQ ID NO: 2830906 - RNA, 13 nt, Human
cugauucugggau

SEQ ID NO: 2830907 - RNA, 14 nt, Human
cugauucugggaug

SEQ ID NO: 2830908 - RNA, 16 nt, Human
cugauucugggaugcu

SEQ ID NO: 2830909 - RNA, 19 nt, Human
cugauucugggaugcuccu

SEQ ID NO: 2830910 - RNA, 14 nt, Human
cugauucucagggu

SEQ ID NO: 2830911 - RNA, 15 nt, Human
cugauucucaggguc

SEQ ID NO: 2830912 - RNA, 17 nt, Human
cugauucucagggucuc

SEQ ID NO: 2830913 - RNA, 18 nt, Human
cugauucucagggucucu

SEQ ID NO: 2830914 - RNA, 20 nt, Human
cugauucucagggucucugc

SEQ ID NO: 2830915 - RNA, 21 nt, Human
cugauucucagggucucugcu

SEQ ID NO: 2830916 - RNA, 12 nt, Human
cugcaaaauaga

SEQ ID NO: 2830917 - RNA, 13 nt, Human
cugcaaaaucugu

SEQ ID NO: 2830918 - RNA, 18 nt, Human
cugcaaaaggagagacuc

SEQ ID NO: 2830919 - RNA, 17 nt, Human
cugauuggcuuguagaa

SEQ ID NO: 2830920 - RNA, 15 nt, Human
cugauugaccugcuc

SEQ ID NO: 2830921 - RNA, 16 nt, Human
cugauugaccugcucc

SEQ ID NO: 2830922 - RNA, 17 nt, Human
cugauugaccugcuccg

SEQ ID NO: 2830923 - RNA, 20 nt, Human
cugauugaccugcuccgcug

SEQ ID NO: 2830924 - RNA, 17 nt, Human
cugauugagaaguucau

SEQ ID NO: 2830925 - RNA, 19 nt, Human
cugauugagaaguucauug

SEQ ID NO: 2830926 - RNA, 14 nt, Human
cugcaaacagaaca

SEQ ID NO: 2830927 - RNA, 15 nt, Human
cugcaaacagaacag

SEQ ID NO: 2830928 - RNA, 16 nt, Human
cugcaaacagaacagg

SEQ ID NO: 2830929 - RNA, 19 nt, Human
cugcaaacagaacaggguc

SEQ ID NO: 2830930 - RNA, 20 nt, Human
cugcaaacagaacaggguca

SEQ ID NO: 2830931 - RNA, 21 nt, Human
cugcaaacagaacagggucau

SEQ ID NO: 2830932 - RNA, 15 nt, Human
cugcaaacaaacacc

SEQ ID NO: 2830933 - RNA, 18 nt, Human
cugcaaacaaacaccuuc

SEQ ID NO: 2830934 - RNA, 23 nt, Human
cugcaaaauuugaugccaggaca

SEQ ID NO: 2830935 - RNA, 13 nt, Human
cugcaaacgcugc

SEQ ID NO: 2830936 - RNA, 12 nt, Human
cugcaauauuug

SEQ ID NO: 2830937 - RNA, 16 nt, Human
cugcaaacgcugccug

SEQ ID NO: 2830938 - RNA, 15 nt, Human
cugcaaacgcugccu

SEQ ID NO: 2830939 - RNA, 16 nt, Human
cugcaauauuugaauu

SEQ ID NO: 2830940 - RNA, 18 nt, Human
cugcaauauuugaauuuu

SEQ ID NO: 2830941 - RNA, 17 nt, Human
cugcaaacgcugccugc

SEQ ID NO: 2830942 - RNA, 19 nt, Human
cugcaauauuugaauuuua

SEQ ID NO: 2830943 - RNA, 16 nt, Human
cugcaaucauauguga

SEQ ID NO: 2830944 - RNA, 17 nt, Human
cugcaaucauaugugau

SEQ ID NO: 2830945 - RNA, 18 nt, Human
cugcaaucauaugugauc

SEQ ID NO: 2830946 - RNA, 19 nt, Human
cugcaaucauaugugaucu

SEQ ID NO: 2830947 - RNA, 15 nt, Human
cugcaauccugucuu

SEQ ID NO: 2830948 - RNA, 16 nt, Human
cugcaauccugucuuu

SEQ ID NO: 2830949 - RNA, 18 nt, Human
cugcaauuucauaugcug

SEQ ID NO: 2830950 - RNA, 20 nt, Human
cugcaauuucauaugcugua

SEQ ID NO: 2830951 - RNA, 13 nt, Human
cugcacaaagccc

SEQ ID NO: 2830952 - RNA, 21 nt, Human
cugcacaaagcccuuccaugu

SEQ ID NO: 2830953 - RNA, 16 nt, Human
cugcacaaacucacca

SEQ ID NO: 2830954 - RNA, 14 nt, Human
cugcaauuuucuaa

SEQ ID NO: 2830955 - RNA, 18 nt, Human
cugcacaaagcccuucca

SEQ ID NO: 2830956 - RNA, 20 nt, Human
cugcacaaagcccuuccaug

SEQ ID NO: 2830957 - RNA, 24 nt, Human
cugcaauucaaaaguuccaagagu

SEQ ID NO: 2830958 - RNA, 17 nt, Human
cugcaauuccccucugc

SEQ ID NO: 2830959 - RNA, 20 nt, Human
cugcaauuccccucugcugc

SEQ ID NO: 2830960 - RNA, 15 nt, Human
cugcaauuccccucu

SEQ ID NO: 2830961 - RNA, 16 nt, Human
cugcaauuccccucug

SEQ ID NO: 2830962 - RNA, 14 nt, Human
cugcaauucaaaag

SEQ ID NO: 2830963 - RNA, 18 nt, Human
cugcaauucaaaaguucc

SEQ ID NO: 2830964 - RNA, 21 nt, Human
cugcaauucaaaaguuccaag

SEQ ID NO: 2830965 - RNA, 22 nt, Human
cugcaauucaaaaguuccaaga

SEQ ID NO: 2830966 - RNA, 13 nt, Human
cugcaaugaaagg

SEQ ID NO: 2830967 - RNA, 23 nt, Human
cugcaauccugucuuucugagca

SEQ ID NO: 2830968 - RNA, 17 nt, Human
cugcaaugggcacuggg

SEQ ID NO: 2830969 - RNA, 21 nt, Human
cugcaaugggcacugggauga

SEQ ID NO: 2830970 - RNA, 20 nt, Human
cugcaauguaucccuucuca

SEQ ID NO: 2830971 - RNA, 18 nt, Human
cugcaaugugaucuaugu

SEQ ID NO: 2830972 - RNA, 18 nt, Human
cugcaaugugggcagaga

SEQ ID NO: 2830973 - RNA, 12 nt, Human
cugcacccagga

SEQ ID NO: 2830974 - RNA, 13 nt, Human
cugcacccaggag

SEQ ID NO: 2830975 - RNA, 14 nt, Human
cugcacccaggagg

SEQ ID NO: 2830976 - RNA, 15 nt, Human
cugcacccaggaggg

SEQ ID NO: 2830977 - RNA, 21 nt, Human
cugcacagugcaucucagccc

SEQ ID NO: 2830978 - RNA, 12 nt, Human
cugcaccagagc

SEQ ID NO: 2830979 - RNA, 13 nt, Human
cugcaccagagca

SEQ ID NO: 2830980 - RNA, 20 nt, Human
cugcaccagagcaaccucuc

SEQ ID NO: 2830981 - RNA, 13 nt, Human
cugcacagcggcc

SEQ ID NO: 2830982 - RNA, 19 nt, Human
cugcacagcggccccugca

SEQ ID NO: 2830983 - RNA, 18 nt, Human
cugcacagugcaucucag

SEQ ID NO: 2830984 - RNA, 14 nt, Human
cugauuaugucuuu

SEQ ID NO: 2830985 - RNA, 23 nt, Human
cugauuaugucuuuuauauuugu

SEQ ID NO: 2830986 - RNA, 17 nt, Human
cugauuauuuucuucau

SEQ ID NO: 2830987 - RNA, 12 nt, Human
cugauuagcuuu

SEQ ID NO: 2830988 - RNA, 15 nt, Human
cugauuagcuuugug

SEQ ID NO: 2830989 - RNA, 16 nt, Human
cugauuagcuuugugu

SEQ ID NO: 2830990 - RNA, 17 nt, Human
cugauuagcuuuguguu

SEQ ID NO: 2830991 - RNA, 18 nt, Human
cugauuagcuuuguguuu

SEQ ID NO: 2830992 - RNA, 21 nt, Human
cugauuaaguugucuaaacaa

SEQ ID NO: 2830993 - RNA, 15 nt, Human
cugauguuggaagag

SEQ ID NO: 2830994 - RNA, 15 nt, Human
cugauucccaagcuc

SEQ ID NO: 2830995 - RNA, 13 nt, Human
cugauucacugca

SEQ ID NO: 2830996 - RNA, 18 nt, Human
cugauucccaagcucugc

SEQ ID NO: 2830997 - RNA, 17 nt, Human
cugauucccaagcucug

SEQ ID NO: 2830998 - RNA, 20 nt, Human
cugauucccaagcucugcuc

SEQ ID NO: 2830999 - RNA, 19 nt, Human
cugauucccaagcucugcu

SEQ ID NO: 2831000 - RNA, 22 nt, Human
cugauucccaagcucugcuccu

SEQ ID NO: 2831001 - RNA, 20 nt, Human
cugauucacugcauggcucc

SEQ ID NO: 2831002 - RNA, 15 nt, Human
cugauucacugcaug

SEQ ID NO: 2831003 - RNA, 18 nt, Human
cugauucacugcauggcu

SEQ ID NO: 2831004 - RNA, 17 nt, Human
cugaguuuuucagaugu

SEQ ID NO: 2831005 - RNA, 19 nt, Human
cugauaaaacaacagcucg

SEQ ID NO: 2831006 - RNA, 18 nt, Human
cugauagaauuauuucac

SEQ ID NO: 2831007 - RNA, 18 nt, Human
cugaucaucgccagaggu

SEQ ID NO: 2831008 - RNA, 19 nt, Human
cugaucaucgccagaggug

SEQ ID NO: 2831009 - RNA, 14 nt, Human
cugauauaaauucu

SEQ ID NO: 2831010 - RNA, 16 nt, Human
cugauauaaauucugu

SEQ ID NO: 2831011 - RNA, 17 nt, Human
cugauauaaauucugug

SEQ ID NO: 2831012 - RNA, 18 nt, Human
cugauauaaauucugugg

SEQ ID NO: 2831013 - RNA, 14 nt, Human
cugauauacugugu

SEQ ID NO: 2831014 - RNA, 19 nt, Human
cugaugucccuagaaaaca

SEQ ID NO: 2831015 - RNA, 20 nt, Human
cugauguacaauuaaaaacc

SEQ ID NO: 2831016 - RNA, 20 nt, Human
cugauguguccucagggagc

SEQ ID NO: 2831017 - RNA, 12 nt, Human
cugaugucucua

SEQ ID NO: 2831018 - RNA, 18 nt, Human
cugaugucucuaaagcac

SEQ ID NO: 2831019 - RNA, 19 nt, Human
cugaugucucuaaagcacu

SEQ ID NO: 2831020 - RNA, 15 nt, Human
cugauguccucacca

SEQ ID NO: 2831021 - RNA, 20 nt, Human
cugauccugugaaguaagga

SEQ ID NO: 2831022 - RNA, 23 nt, Human
cugauccugugaaguaaggaugu

SEQ ID NO: 2831023 - RNA, 19 nt, Human
cugaaucgagugagacaaa

SEQ ID NO: 2831024 - RNA, 13 nt, Human
cugagugccuggc

SEQ ID NO: 2831025 - RNA, 14 nt, Human
cugagugccuggcc

SEQ ID NO: 2831026 - RNA, 16 nt, Human
cugagugccuggccaa

SEQ ID NO: 2831027 - RNA, 14 nt, Human
cugagugccuuuug

SEQ ID NO: 2831028 - RNA, 15 nt, Human
cugaguuuuguuuug

SEQ ID NO: 2831029 - RNA, 21 nt, Human
cugaguuuucucuuugugggg

SEQ ID NO: 2831030 - RNA, 16 nt, Human
cugagugccuuuuggu

SEQ ID NO: 2831031 - RNA, 15 nt, Human
cugagugccuuuugg

SEQ ID NO: 2831032 - RNA, 19 nt, Human
cugagugccuggccaaagg

SEQ ID NO: 2831033 - RNA, 13 nt, Human
cugaguccuggcc

SEQ ID NO: 2831034 - RNA, 14 nt, Human
cugaguccuggccc

SEQ ID NO: 2831035 - RNA, 15 nt, Human
cugaguccuggccca

SEQ ID NO: 2831036 - RNA, 20 nt, Human
cugagucccaggcugagccu

SEQ ID NO: 2831037 - RNA, 12 nt, Human
cugagggcaaau

SEQ ID NO: 2831038 - RNA, 13 nt, Human
cugagggcaaauc

SEQ ID NO: 2831039 - RNA, 19 nt, Human
cugagggcaaauccagucc

SEQ ID NO: 2831040 - RNA, 20 nt, Human
cugagggcagaaagguucug

SEQ ID NO: 2831041 - RNA, 23 nt, Human
cugagggcagaaagguucugccc

SEQ ID NO: 2831042 - RNA, 21 nt, Human
cugagggaccaacugggccca

SEQ ID NO: 2831043 - RNA, 20 nt, Human
cugagggaccaacugggccc

SEQ ID NO: 2831044 - RNA, 19 nt, Human
cugagggaccaacugggcc

SEQ ID NO: 2831045 - RNA, 12 nt, Human
cugagggaccaa

SEQ ID NO: 2831046 - RNA, 18 nt, Human
cugagggaccaacugggc

SEQ ID NO: 2831047 - RNA, 16 nt, Human
cugagggaccaacugg

SEQ ID NO: 2831048 - RNA, 21 nt, Human
cugaggcuuuggauuugacau

SEQ ID NO: 2831049 - RNA, 16 nt, Human
cugagggaaagugcau

SEQ ID NO: 2831050 - RNA, 18 nt, Human
cugaggcuuuggauuuga

SEQ ID NO: 2831051 - RNA, 17 nt, Human
cugaggcuuuggauuug

SEQ ID NO: 2831052 - RNA, 15 nt, Human
cugaggcuuuggauu

SEQ ID NO: 2831053 - RNA, 14 nt, Human
cugaggcuuuggau

SEQ ID NO: 2831054 - RNA, 14 nt, Human
cugacccagugaga

SEQ ID NO: 2831055 - RNA, 13 nt, Human
cugacccagugag

SEQ ID NO: 2831056 - RNA, 22 nt, Human
cugaagucacugcacagugcau

SEQ ID NO: 2831057 - RNA, 17 nt, Human
cugaagucacugcacag

SEQ ID NO: 2831058 - RNA, 16 nt, Human
cugaagucacugcaca

SEQ ID NO: 2831059 - RNA, 15 nt, Human
cugaagucacacagu

SEQ ID NO: 2831060 - RNA, 17 nt, Human
cugaaguagugugcagu

SEQ ID NO: 2831061 - RNA, 16 nt, Human
cugaaguacuaacaca

SEQ ID NO: 2831062 - RNA, 17 nt, Human
cugaaguacuaacacaa

SEQ ID NO: 2831063 - RNA, 14 nt, Human
cugaagucacacag

SEQ ID NO: 2831064 - RNA, 22 nt, Human
cugaagguggccacuuuaagag

SEQ ID NO: 2831065 - RNA, 18 nt, Human
cugaagugagcacagccu

SEQ ID NO: 2831066 - RNA, 19 nt, Human
cugaagugagcacagccua

SEQ ID NO: 2831067 - RNA, 21 nt, Human
cugaagugagcacagccuagg

SEQ ID NO: 2831068 - RNA, 16 nt, Human
cugaagugcuuagugu

SEQ ID NO: 2831069 - RNA, 12 nt, Human
cugaauaaaugg

SEQ ID NO: 2831070 - RNA, 14 nt, Human
cugaauaaauggua

SEQ ID NO: 2831071 - RNA, 17 nt, Human
cugaauaaaugguagua

SEQ ID NO: 2831072 - RNA, 18 nt, Human
cucuuuggcuccccugua

SEQ ID NO: 2831073 - RNA, 23 nt, Human
cugaaccgcacagcucaggaggc

SEQ ID NO: 2831074 - RNA, 21 nt, Human
cugaaccgcacagcucaggag

SEQ ID NO: 2831075 - RNA, 20 nt, Human
cugaaccgcacagcucagga

SEQ ID NO: 2831076 - RNA, 19 nt, Human
cugaaccgcacagcucagg

SEQ ID NO: 2831077 - RNA, 18 nt, Human
cugaaccgcacagcucag

SEQ ID NO: 2831078 - RNA, 17 nt, Human
cugaaccgcacagcuca

SEQ ID NO: 2831079 - RNA, 15 nt, Human
cugaaccgcacagcu

SEQ ID NO: 2831080 - RNA, 21 nt, Human
cugaagacucauucuucugua

SEQ ID NO: 2831081 - RNA, 19 nt, Human
cugaagacucauucuucug

SEQ ID NO: 2831082 - RNA, 22 nt, Human
cugaacuucaggauaauaaagu

SEQ ID NO: 2831083 - RNA, 19 nt, Human
cugaagaggaacugggccu

SEQ ID NO: 2831084 - RNA, 22 nt, Human
cugaagagacaguuauuuauag

SEQ ID NO: 2831085 - RNA, 14 nt, Human
cugaacuuugaaga

SEQ ID NO: 2831086 - RNA, 18 nt, Human
cugaacuuugaagacccg

SEQ ID NO: 2831087 - RNA, 14 nt, Human
cugaagacugagga

SEQ ID NO: 2831088 - RNA, 15 nt, Human
cugaagacugaggac

SEQ ID NO: 2831089 - RNA, 14 nt, Human
cugaagacuugccc

SEQ ID NO: 2831090 - RNA, 19 nt, Human
cugacagacacaggcccgg

SEQ ID NO: 2831091 - RNA, 21 nt, Human
cugacagacacaggcccggcu

SEQ ID NO: 2831092 - RNA, 19 nt, Human
cugacagacagcccuccau

SEQ ID NO: 2831093 - RNA, 17 nt, Human
cugacagacagcccucc

SEQ ID NO: 2831094 - RNA, 11 nt, Human
cugacaggcaa

SEQ ID NO: 2831095 - RNA, 19 nt, Human
cugacagcugucccugccc

SEQ ID NO: 2831096 - RNA, 17 nt, Human
cugaauauacagcaggu

SEQ ID NO: 2831097 - RNA, 15 nt, Human
cugaauagaaauggg

SEQ ID NO: 2831098 - RNA, 16 nt, Human
cugaauagaaauggga

SEQ ID NO: 2831099 - RNA, 18 nt, Human
cugaauauuuuuugaggc

SEQ ID NO: 2831100 - RNA, 20 nt, Human
cugaauccauuaaaaauggg

SEQ ID NO: 2831101 - RNA, 19 nt, Human
cugaaucccccuugccacc

SEQ ID NO: 2831102 - RNA, 20 nt, Human
cugaaucccccuugccaccc

SEQ ID NO: 2831103 - RNA, 21 nt, Human
cugaaucccccuugccacccc

SEQ ID NO: 2831104 - RNA, 22 nt, Human
cugaaucccccuugccacccca

SEQ ID NO: 2831105 - RNA, 19 nt, Human
cugacaggcaaugcuggcu

SEQ ID NO: 2831106 - RNA, 18 nt, Human
cugacaggcaaugcuggc

SEQ ID NO: 2831107 - RNA, 17 nt, Human
cugacaggcaaugcugg

SEQ ID NO: 2831108 - RNA, 16 nt, Human
cugacaggcaaugcug

SEQ ID NO: 2831109 - RNA, 20 nt, Human
cugacaggcaaugcuggcug

SEQ ID NO: 2831110 - RNA, 17 nt, Human
cugacauuguuggccaa

SEQ ID NO: 2831111 - RNA, 14 nt, Human
cugacauugccaaa

SEQ ID NO: 2831112 - RNA, 16 nt, Human
cugacauugccaaaaa

SEQ ID NO: 2831113 - RNA, 17 nt, Human
cugacauugccaaaaag

SEQ ID NO: 2831114 - RNA, 20 nt, Human
cugacauugccaaaaaggau

SEQ ID NO: 2831115 - RNA, 21 nt, Human
cugacauugccaaaaaggaua

SEQ ID NO: 2831116 - RNA, 11 nt, Human
cugacccacug

SEQ ID NO: 2831117 - RNA, 23 nt, Human
cugaccauccacucuacccuccc

SEQ ID NO: 2831118 - RNA, 22 nt, Human
cugaccauccacucuacccucc

SEQ ID NO: 2831119 - RNA, 19 nt, Human
cugaccauccacucuaccc

SEQ ID NO: 2831120 - RNA, 22 nt, Human
cugaccauauugugcuucacag

SEQ ID NO: 2831121 - RNA, 23 nt, Human
cugaccaguuuaaccugaugcag

SEQ ID NO: 2831122 - RNA, 16 nt, Human
cugaccauccacucua

SEQ ID NO: 2831123 - RNA, 15 nt, Human
cugaccauccacucu

SEQ ID NO: 2831124 - RNA, 13 nt, Human
cucuucuccuuuc

SEQ ID NO: 2831125 - RNA, 15 nt, Human
cucuucuccuuucac

SEQ ID NO: 2831126 - RNA, 16 nt, Human
cucuucuccuuucaca

SEQ ID NO: 2831127 - RNA, 23 nt, Human
cucuucuggggcaggcugggcca

SEQ ID NO: 2831128 - RNA, 21 nt, Human
cucuucuggggcaggcugggc

SEQ ID NO: 2831129 - RNA, 19 nt, Human
cucuucuggggcaggcugg

SEQ ID NO: 2831130 - RNA, 11 nt, Human
cucuucuggcu

SEQ ID NO: 2831131 - RNA, 14 nt, Human
cucuucuggcucaa

SEQ ID NO: 2831132 - RNA, 18 nt, Human
cucuucugcuccacccuu

SEQ ID NO: 2831133 - RNA, 16 nt, Human
cucuucugcuccaccc

SEQ ID NO: 2831134 - RNA, 15 nt, Human
cucuucugcuccacc

SEQ ID NO: 2831135 - RNA, 14 nt, Human
cucuucugcuccac

SEQ ID NO: 2831136 - RNA, 20 nt, Human
cucuucugcuccacccuugg

SEQ ID NO: 2831137 - RNA, 19 nt, Human
cucuucugcuccacccuug

SEQ ID NO: 2831138 - RNA, 21 nt, Human
cucuucugcuccacccuuggc

SEQ ID NO: 2831139 - RNA, 13 nt, Human
cucuucugcucca

SEQ ID NO: 2831140 - RNA, 19 nt, Human
cucuucauacuuuuuuuca

SEQ ID NO: 2831141 - RNA, 13 nt, Human
cucuucauacuuu

SEQ ID NO: 2831142 - RNA, 12 nt, Human
cucuucuccagg

SEQ ID NO: 2831143 - RNA, 19 nt, Human
cucuucuccacuggaugga

SEQ ID NO: 2831144 - RNA, 16 nt, Human
cucuucuccccagagu

SEQ ID NO: 2831145 - RNA, 15 nt, Human
cucuucuccacugga

SEQ ID NO: 2831146 - RNA, 17 nt, Human
cucuucuccacuggaug

SEQ ID NO: 2831147 - RNA, 14 nt, Human
cucuucuccacugg

SEQ ID NO: 2831148 - RNA, 19 nt, Human
cucuguucugcacacagca

SEQ ID NO: 2831149 - RNA, 21 nt, Human
cucuguucugcacacagcacg

SEQ ID NO: 2831150 - RNA, 20 nt, Human
cucuguucugcacacagcac

SEQ ID NO: 2831151 - RNA, 20 nt, Human
cucuuaaagcugccuguagu

SEQ ID NO: 2831152 - RNA, 12 nt, Human
cucuuaaaguug

SEQ ID NO: 2831153 - RNA, 18 nt, Human
cucuuaaaguuggaauuu

SEQ ID NO: 2831154 - RNA, 22 nt, Human
cucuuaaaguuggaauuuacca

SEQ ID NO: 2831155 - RNA, 17 nt, Human
cucuuaaacuugugaau

SEQ ID NO: 2831156 - RNA, 13 nt, Human
cucuguugacugg

SEQ ID NO: 2831157 - RNA, 17 nt, Human
cucuguugacuggcugu

SEQ ID NO: 2831158 - RNA, 19 nt, Human
cucuguugacuggcugugu

SEQ ID NO: 2831159 - RNA, 17 nt, Human
cucuucaggccucccuc

SEQ ID NO: 2831160 - RNA, 20 nt, Human
cucuucaggccucccucucu

SEQ ID NO: 2831161 - RNA, 19 nt, Human
cucuucaggccucccucuc

SEQ ID NO: 2831162 - RNA, 18 nt, Human
cucuucaggccucccucu

SEQ ID NO: 2831163 - RNA, 19 nt, Human
cucuucaguuaagccuuug

SEQ ID NO: 2831164 - RNA, 23 nt, Human
cucuucaguuaagccuuuggaaa

SEQ ID NO: 2831165 - RNA, 20 nt, Human
cucuucaguuaagccuuugg

SEQ ID NO: 2831166 - RNA, 14 nt, Human
cucuuucacauugu

SEQ ID NO: 2831167 - RNA, 15 nt, Human
cucuuucacauuguu

SEQ ID NO: 2831168 - RNA, 16 nt, Human
cucuuucacauuguuu

SEQ ID NO: 2831169 - RNA, 11 nt, Human
cucuuucaaag

SEQ ID NO: 2831170 - RNA, 23 nt, Human
cucuugugcuggauggagcccag

SEQ ID NO: 2831171 - RNA, 14 nt, Human
cucuugugcuggau

SEQ ID NO: 2831172 - RNA, 13 nt, Human
cucuuuauuuucc

SEQ ID NO: 2831173 - RNA, 22 nt, Human
cucuuuauuuuccccuaucauu

SEQ ID NO: 2831174 - RNA, 20 nt, Human
cucuuguauaagauccuaga

SEQ ID NO: 2831175 - RNA, 21 nt, Human
cucuuguauaagauccuagau

SEQ ID NO: 2831176 - RNA, 14 nt, Human
cucuugucccacgu

SEQ ID NO: 2831177 - RNA, 16 nt, Human
cucuugucccacgugu

SEQ ID NO: 2831178 - RNA, 18 nt, Human
cucuugucccacgugucu

SEQ ID NO: 2831179 - RNA, 21 nt, Human
cucuugucccacgugucuucc

SEQ ID NO: 2831180 - RNA, 23 nt, Human
cucuugucccacgugucuuccac

SEQ ID NO: 2831181 - RNA, 21 nt, Human
cucuuguccucaguccauuua

SEQ ID NO: 2831182 - RNA, 22 nt, Human
cucuuguccucaguccauuuau

SEQ ID NO: 2831183 - RNA, 20 nt, Human
cucuuguagcccaggcugga

SEQ ID NO: 2831184 - RNA, 12 nt, Human
cucuuucugggc

SEQ ID NO: 2831185 - RNA, 13 nt, Human
cucuuucuguaua

SEQ ID NO: 2831186 - RNA, 11 nt, Human
cucuuucugua

SEQ ID NO: 2831187 - RNA, 22 nt, Human
cucuugucuggcaaaagaaaaa

SEQ ID NO: 2831188 - RNA, 12 nt, Human
cucuuucucucc

SEQ ID NO: 2831189 - RNA, 13 nt, Human
cucuuucucuccc

SEQ ID NO: 2831190 - RNA, 14 nt, Human
cucuuucucucccc

SEQ ID NO: 2831191 - RNA, 15 nt, Human
cucuuucucucccca

SEQ ID NO: 2831192 - RNA, 13 nt, Human
cucuuucucucuu

SEQ ID NO: 2831193 - RNA, 14 nt, Human
cucuuucucucuuc

SEQ ID NO: 2831194 - RNA, 16 nt, Human
cucuuucucucuuccc

SEQ ID NO: 2831195 - RNA, 17 nt, Human
cucuuucucucuucccu

SEQ ID NO: 2831196 - RNA, 12 nt, Human
cucuuucucuuu

SEQ ID NO: 2831197 - RNA, 13 nt, Human
cucuuucucuuuc

SEQ ID NO: 2831198 - RNA, 14 nt, Human
cucuuucucuuucu

SEQ ID NO: 2831199 - RNA, 18 nt, Human
cucuuucucuuucuuccu

SEQ ID NO: 2831200 - RNA, 15 nt, Human
cucuugaccucaggu

SEQ ID NO: 2831201 - RNA, 13 nt, Human
cucuugaccucag

SEQ ID NO: 2831202 - RNA, 16 nt, Human
cucuugaccucaggug

SEQ ID NO: 2831203 - RNA, 16 nt, Human
cucuugaccuuguaga

SEQ ID NO: 2831204 - RNA, 18 nt, Human
cucuugaacuccugaccu

SEQ ID NO: 2831205 - RNA, 17 nt, Human
cucuugguguuaaaaca

SEQ ID NO: 2831206 - RNA, 22 nt, Human
cucuugguguuaaaacacuucu

SEQ ID NO: 2831207 - RNA, 14 nt, Human
cucuuggcuccacu

SEQ ID NO: 2831208 - RNA, 21 nt, Human
cucuugggaacugaacucacu

SEQ ID NO: 2831209 - RNA, 12 nt, Human
cucuccuguaag

SEQ ID NO: 2831210 - RNA, 19 nt, Human
cucuccuguaagccaaaga

SEQ ID NO: 2831211 - RNA, 20 nt, Human
cucuccuguaagccaaagaa

SEQ ID NO: 2831212 - RNA, 12 nt, Human
cucuccccacac

SEQ ID NO: 2831213 - RNA, 14 nt, Human
cucucccauuuccu

SEQ ID NO: 2831214 - RNA, 18 nt, Human
cucuccccaacccccauu

SEQ ID NO: 2831215 - RNA, 20 nt, Human
cucuccccaacccccauucu

SEQ ID NO: 2831216 - RNA, 15 nt, Human
cucuccccacacuaa

SEQ ID NO: 2831217 - RNA, 14 nt, Human
cucuccccaccccu

SEQ ID NO: 2831218 - RNA, 17 nt, Human
cucuccccaccccuacc

SEQ ID NO: 2831219 - RNA, 19 nt, Human
cucuccccaccccuacccc

SEQ ID NO: 2831220 - RNA, 22 nt, Human
cucuccccaccccuaccccugg

SEQ ID NO: 2831221 - RNA, 14 nt, Human
cucuccccacacua

SEQ ID NO: 2831222 - RNA, 13 nt, Human
cucuccccacacu

SEQ ID NO: 2831223 - RNA, 13 nt, Human
cucuccuuugaaa

SEQ ID NO: 2831224 - RNA, 21 nt, Human
cucuccuuugaaaccugcucu

SEQ ID NO: 2831225 - RNA, 10 nt, Human
cucuccuuuu

SEQ ID NO: 2831226 - RNA, 11 nt, Human
cucuccuuuuc

SEQ ID NO: 2831227 - RNA, 12 nt, Human
cucuccuuuucu

SEQ ID NO: 2831228 - RNA, 13 nt, Human
cucuccuuuucuu

SEQ ID NO: 2831229 - RNA, 17 nt, Human
cucuccuuuucuuuugu

SEQ ID NO: 2831230 - RNA, 18 nt, Human
cucuccuuuucuuuuguu

SEQ ID NO: 2831231 - RNA, 19 nt, Human
cucuccuuuucuuuuguua

SEQ ID NO: 2831232 - RNA, 21 nt, Human
cucuccuuuucuuuuguuacu

SEQ ID NO: 2831233 - RNA, 22 nt, Human
cucuccuuuucuuuuguuacug

SEQ ID NO: 2831234 - RNA, 17 nt, Human
cucucgcaccuuuccaa

SEQ ID NO: 2831235 - RNA, 19 nt, Human
cucucgcaccuuuccaaag

SEQ ID NO: 2831236 - RNA, 15 nt, Human
cucucgcaucuuccc

SEQ ID NO: 2831237 - RNA, 16 nt, Human
cucucgcaucuuccca

SEQ ID NO: 2831238 - RNA, 17 nt, Human
cucucgcaucuucccaa

SEQ ID NO: 2831239 - RNA, 22 nt, Human
cucucggaaggcuggcugggca

SEQ ID NO: 2831240 - RNA, 19 nt, Human
cucucggaaggcuggcugg

SEQ ID NO: 2831241 - RNA, 18 nt, Human
cucucggaaggcuggcug

SEQ ID NO: 2831242 - RNA, 16 nt, Human
cucucggaaggcuggc

SEQ ID NO: 2831243 - RNA, 18 nt, Human
cucucgcaccuuuccaaa

SEQ ID NO: 2831244 - RNA, 13 nt, Human
cucucuacagugc

SEQ ID NO: 2831245 - RNA, 15 nt, Human
cucucuacagugcca

SEQ ID NO: 2831246 - RNA, 19 nt, Human
cucucuacaaacucccacu

SEQ ID NO: 2831247 - RNA, 14 nt, Human
cucucggcucccca

SEQ ID NO: 2831248 - RNA, 15 nt, Human
cucucggcuccccau

SEQ ID NO: 2831249 - RNA, 16 nt, Human
cucucggcuccccaug

SEQ ID NO: 2831250 - RNA, 19 nt, Human
cucucggguugugugucug

SEQ ID NO: 2831251 - RNA, 16 nt, Human
cucucgguugaaaccu

SEQ ID NO: 2831252 - RNA, 17 nt, Human
cucucggcuccccaugu

SEQ ID NO: 2831253 - RNA, 18 nt, Human
cucucggcuccccaugug

SEQ ID NO: 2831254 - RNA, 18 nt, Human
cucucugcaccguacugu

SEQ ID NO: 2831255 - RNA, 18 nt, Human
cucucugaguccuggccc

SEQ ID NO: 2831256 - RNA, 19 nt, Human
cucucugaguccuggccca

SEQ ID NO: 2831257 - RNA, 20 nt, Human
cucucugaguccuggcccaa

SEQ ID NO: 2831258 - RNA, 14 nt, Human
cucuccaggcacca

SEQ ID NO: 2831259 - RNA, 20 nt, Human
cucuccagauguuuccagac

SEQ ID NO: 2831260 - RNA, 15 nt, Human
cucuccacugccuuc

SEQ ID NO: 2831261 - RNA, 11 nt, Human
cucucccaggg

SEQ ID NO: 2831262 - RNA, 15 nt, Human
cucucccaaguccac

SEQ ID NO: 2831263 - RNA, 20 nt, Human
cucucccacgggaccugggg

SEQ ID NO: 2831264 - RNA, 21 nt, Human
cucucccacgggaccuggggc

SEQ ID NO: 2831265 - RNA, 17 nt, Human
cucuaaucgaaagaaaa

SEQ ID NO: 2831266 - RNA, 19 nt, Human
cucuaaauucuuuauuucu

SEQ ID NO: 2831267 - RNA, 14 nt, Human
cucuaagguugggc

SEQ ID NO: 2831268 - RNA, 13 nt, Human
cucuaauaaaaca

SEQ ID NO: 2831269 - RNA, 12 nt, Human
cucuaauaagaa

SEQ ID NO: 2831270 - RNA, 14 nt, Human
cucuaauaagaaaa

SEQ ID NO: 2831271 - RNA, 15 nt, Human
cucuaauaagaaaac

SEQ ID NO: 2831272 - RNA, 18 nt, Human
cucuaauaagaaaaccac

SEQ ID NO: 2831273 - RNA, 12 nt, Human
cucucaguguuu

SEQ ID NO: 2831274 - RNA, 13 nt, Human
cucucaguguuuu

SEQ ID NO: 2831275 - RNA, 18 nt, Human
cucucaguguuuuggacu

SEQ ID NO: 2831276 - RNA, 22 nt, Human
cucucaguguuuuggacuccau

SEQ ID NO: 2831277 - RNA, 18 nt, Human
cucucaguuaaaauguga

SEQ ID NO: 2831278 - RNA, 22 nt, Human
cucucauauauagacagcuuug

SEQ ID NO: 2831279 - RNA, 23 nt, Human
cucuccaagucucaguggcuuca

SEQ ID NO: 2831280 - RNA, 13 nt, Human
cucucaucucagg

SEQ ID NO: 2831281 - RNA, 20 nt, Human
cucuccaagucucaguggcu

SEQ ID NO: 2831282 - RNA, 11 nt, Human
cucucaucuga

SEQ ID NO: 2831283 - RNA, 14 nt, Human
cucucaucugaggc

SEQ ID NO: 2831284 - RNA, 15 nt, Human
cucucaucugaggca

SEQ ID NO: 2831285 - RNA, 19 nt, Human
cucucauccuccaguaccu

SEQ ID NO: 2831286 - RNA, 16 nt, Human
cucuccacugccuucg

SEQ ID NO: 2831287 - RNA, 19 nt, Human
cucugccaacuucuucaga

SEQ ID NO: 2831288 - RNA, 13 nt, Human
cucugcaucccag

SEQ ID NO: 2831289 - RNA, 14 nt, Human
cucugcaucccagc

SEQ ID NO: 2831290 - RNA, 15 nt, Human
cucugcaucccagca

SEQ ID NO: 2831291 - RNA, 22 nt, Human
cucugcaauuccccucugcugc

SEQ ID NO: 2831292 - RNA, 23 nt, Human
cucugcaauuccccucugcugcu

SEQ ID NO: 2831293 - RNA, 18 nt, Human
cucugcaauuccccucug

SEQ ID NO: 2831294 - RNA, 19 nt, Human
cucugcaauuccccucugc

SEQ ID NO: 2831295 - RNA, 20 nt, Human
cucugcaauuccccucugcu

SEQ ID NO: 2831296 - RNA, 21 nt, Human
cucugcaauuccccucugcug

SEQ ID NO: 2831297 - RNA, 17 nt, Human
cucugcaaugggcacug

SEQ ID NO: 2831298 - RNA, 15 nt, Human
cucugcaauuccccu

SEQ ID NO: 2831299 - RNA, 18 nt, Human
cucugcaaugggcacugg

SEQ ID NO: 2831300 - RNA, 23 nt, Human
cucugcaaugggcacugggauga

SEQ ID NO: 2831301 - RNA, 16 nt, Human
cucugcaauuccccuc

SEQ ID NO: 2831302 - RNA, 17 nt, Human
cucugcaauuccccucu

SEQ ID NO: 2831303 - RNA, 20 nt, Human
cucugauuuucaaagcuuuu

SEQ ID NO: 2831304 - RNA, 22 nt, Human
cucugauuuucaaagcuuuuuc

SEQ ID NO: 2831305 - RNA, 17 nt, Human
cucugcaaaaggagaga

SEQ ID NO: 2831306 - RNA, 18 nt, Human
cucugcaaaaggagagac

SEQ ID NO: 2831307 - RNA, 15 nt, Human
cucugauuuucaaag

SEQ ID NO: 2831308 - RNA, 19 nt, Human
cucugauuuucaaagcuuu

SEQ ID NO: 2831309 - RNA, 18 nt, Human
cucugauuuucaaagcuu

SEQ ID NO: 2831310 - RNA, 17 nt, Human
cucugaugaagaggagu

SEQ ID NO: 2831311 - RNA, 13 nt, Human
cucugauauggga

SEQ ID NO: 2831312 - RNA, 14 nt, Human
cucugauaugggac

SEQ ID NO: 2831313 - RNA, 15 nt, Human
cucugauaugggacu

SEQ ID NO: 2831314 - RNA, 16 nt, Human
cucugauaugggacug

SEQ ID NO: 2831315 - RNA, 17 nt, Human
cucugauaugggacuga

SEQ ID NO: 2831316 - RNA, 19 nt, Human
cucugauaugggacugagc

SEQ ID NO: 2831317 - RNA, 21 nt, Human
cucugauaugggacugagccu

SEQ ID NO: 2831318 - RNA, 15 nt, Human
cucugagcgggaggc

SEQ ID NO: 2831319 - RNA, 16 nt, Human
cucugagcgggaggca

SEQ ID NO: 2831320 - RNA, 17 nt, Human
cucugagcgggaggcag

SEQ ID NO: 2831321 - RNA, 15 nt, Human
cucugagccuuggga

SEQ ID NO: 2831322 - RNA, 16 nt, Human
cucugagcaaaugugg

SEQ ID NO: 2831323 - RNA, 18 nt, Human
cucugagagucuagauuc

SEQ ID NO: 2831324 - RNA, 19 nt, Human
cucugagagucuagauucu

SEQ ID NO: 2831325 - RNA, 22 nt, Human
cucugagagucuagauucucug

SEQ ID NO: 2831326 - RNA, 12 nt, Human
cucugagcccau

SEQ ID NO: 2831327 - RNA, 13 nt, Human
cucugagcccaug

SEQ ID NO: 2831328 - RNA, 21 nt, Human
cucugagcccauguucugccc

SEQ ID NO: 2831329 - RNA, 22 nt, Human
cucugagcccauguucugcccc

SEQ ID NO: 2831330 - RNA, 21 nt, Human
cucugagaucuaaggauguca

SEQ ID NO: 2831331 - RNA, 22 nt, Human
cucugagaucuaaggaugucac

SEQ ID NO: 2831332 - RNA, 20 nt, Human
cucugaggcucuuucugggc

SEQ ID NO: 2831333 - RNA, 19 nt, Human
cucugaggcucuuucuggg

SEQ ID NO: 2831334 - RNA, 15 nt, Human
cucugagaagaggag

SEQ ID NO: 2831335 - RNA, 16 nt, Human
cucugagaagaggagc

SEQ ID NO: 2831336 - RNA, 18 nt, Human
cucugagaagaggagccc

SEQ ID NO: 2831337 - RNA, 19 nt, Human
cucugacuuaagcaaaaga

SEQ ID NO: 2831338 - RNA, 20 nt, Human
cucugacuuaagcaaaagaa

SEQ ID NO: 2831339 - RNA, 22 nt, Human
cucugacuuaagcaaaagaaaa

SEQ ID NO: 2831340 - RNA, 13 nt, Human
cucucugcuguac

SEQ ID NO: 2831341 - RNA, 12 nt, Human
cucucugcagcu

SEQ ID NO: 2831342 - RNA, 13 nt, Human
cucucugcagcug

SEQ ID NO: 2831343 - RNA, 14 nt, Human
cucucugcagcugc

SEQ ID NO: 2831344 - RNA, 15 nt, Human
cucucugcagcugcc

SEQ ID NO: 2831345 - RNA, 16 nt, Human
cucucugcagcugccg

SEQ ID NO: 2831346 - RNA, 12 nt, Human
cucucugcccua

SEQ ID NO: 2831347 - RNA, 21 nt, Human
cucucugcccuaaugcgcagg

SEQ ID NO: 2831348 - RNA, 13 nt, Human
cucucugcccuaa

SEQ ID NO: 2831349 - RNA, 14 nt, Human
cucugccuccucuu

SEQ ID NO: 2831350 - RNA, 12 nt, Human
cucugcccugcg

SEQ ID NO: 2831351 - RNA, 22 nt, Human
cucugcccucauuacugggccu

SEQ ID NO: 2831352 - RNA, 23 nt, Human
cucugcccucauuacugggccuu

SEQ ID NO: 2831353 - RNA, 11 nt, Human
cucugcccugc

SEQ ID NO: 2831354 - RNA, 23 nt, Human
cucugcccuaaugcgcaggcugg

SEQ ID NO: 2831355 - RNA, 23 nt, Human
cucugccaccagagaccguccuc

SEQ ID NO: 2831356 - RNA, 11 nt, Human
cucugccacca

SEQ ID NO: 2831357 - RNA, 23 nt, Human
cucugccaacuucuucagagcug

SEQ ID NO: 2831358 - RNA, 14 nt, Human
cucugccacacucu

SEQ ID NO: 2831359 - RNA, 15 nt, Human
cucugccacacucug

SEQ ID NO: 2831360 - RNA, 17 nt, Human
cucugccacacucugac

SEQ ID NO: 2831361 - RNA, 14 nt, Human
cucugccaccagag

SEQ ID NO: 2831362 - RNA, 16 nt, Human
cucugccaccagagac

SEQ ID NO: 2831363 - RNA, 17 nt, Human
cucugccaccagagacc

SEQ ID NO: 2831364 - RNA, 18 nt, Human
cucugccaccagagaccg

SEQ ID NO: 2831365 - RNA, 14 nt, Human
cucugccagccaca

SEQ ID NO: 2831366 - RNA, 13 nt, Human
cucugccagggca

SEQ ID NO: 2831367 - RNA, 15 nt, Human
cucugccagggcagu

SEQ ID NO: 2831368 - RNA, 18 nt, Human
cucugccagggcagugcu

SEQ ID NO: 2831369 - RNA, 19 nt, Human
cucugccagggcagugcua

SEQ ID NO: 2831370 - RNA, 22 nt, Human
cucugccagggcagugcuagug

SEQ ID NO: 2831371 - RNA, 22 nt, Human
cucugccagaagauccccucag

SEQ ID NO: 2831372 - RNA, 17 nt, Human
cucugccagaagauccc

SEQ ID NO: 2831373 - RNA, 23 nt, Human
cucugccagaagauccccucagg

SEQ ID NO: 2831374 - RNA, 15 nt, Human
cucugccagcaaaga

SEQ ID NO: 2831375 - RNA, 16 nt, Human
cucugccagcaaagag

SEQ ID NO: 2831376 - RNA, 12 nt, Human
cucugccccagc

SEQ ID NO: 2831377 - RNA, 18 nt, Human
cucugccccagcucuggc

SEQ ID NO: 2831378 - RNA, 17 nt, Human
cucugccccagcucugg

SEQ ID NO: 2831379 - RNA, 16 nt, Human
cucugccccagcucug

SEQ ID NO: 2831380 - RNA, 13 nt, Human
cucugccccagcu

SEQ ID NO: 2831381 - RNA, 21 nt, Human
cucugccccagcucuggcuuc

SEQ ID NO: 2831382 - RNA, 19 nt, Human
cucugccccagcucuggcu

SEQ ID NO: 2831383 - RNA, 22 nt, Human
cucugcccuaaugcgcaggcug

SEQ ID NO: 2831384 - RNA, 14 nt, Human
cucugccucugaca

SEQ ID NO: 2831385 - RNA, 15 nt, Human
cucugccuccucuuc

SEQ ID NO: 2831386 - RNA, 16 nt, Human
cucugccuccucuuca

SEQ ID NO: 2831387 - RNA, 16 nt, Human
cucugccuccuggguu

SEQ ID NO: 2831388 - RNA, 20 nt, Human
cucugccuucgaggucagag

SEQ ID NO: 2831389 - RNA, 13 nt, Human
cucugccuugccu

SEQ ID NO: 2831390 - RNA, 14 nt, Human
cucugccuugccuu

SEQ ID NO: 2831391 - RNA, 15 nt, Human
cucugccuugccuuu

SEQ ID NO: 2831392 - RNA, 23 nt, Human
cucugccuugccuuuagccccuc

SEQ ID NO: 2831393 - RNA, 15 nt, Human
cucugccuuugacau

SEQ ID NO: 2831394 - RNA, 19 nt, Human
cucugccuuugacauuuaa

SEQ ID NO: 2831395 - RNA, 23 nt, Human
cucugccuuugacauuuaauuua

SEQ ID NO: 2831396 - RNA, 14 nt, Human
cucugcggacccca

SEQ ID NO: 2831397 - RNA, 15 nt, Human
cucugcggaccccag

SEQ ID NO: 2831398 - RNA, 16 nt, Human
cucugcggaccccagc

SEQ ID NO: 2831399 - RNA, 17 nt, Human
cucugcggaccccagcu

SEQ ID NO: 2831400 - RNA, 19 nt, Human
cucugcggaccccagcugu

SEQ ID NO: 2831401 - RNA, 20 nt, Human
cucugcggaccccagcugug

SEQ ID NO: 2831402 - RNA, 15 nt, Human
cucugcuuuggaaau

SEQ ID NO: 2831403 - RNA, 14 nt, Human
cucuggacucuaaa

SEQ ID NO: 2831404 - RNA, 16 nt, Human
cucuggacucuaaaga

SEQ ID NO: 2831405 - RNA, 21 nt, Human
cucuggacucuaaagaccaaa

SEQ ID NO: 2831406 - RNA, 13 nt, Human
cucuggacuggcu

SEQ ID NO: 2831407 - RNA, 18 nt, Human
cucuggaagcccuggaga

SEQ ID NO: 2831408 - RNA, 19 nt, Human
cucuggaagcccuggagac

SEQ ID NO: 2831409 - RNA, 16 nt, Human
cucuggacaaagcguu

SEQ ID NO: 2831410 - RNA, 15 nt, Human
cucuggagacagccc

SEQ ID NO: 2831411 - RNA, 16 nt, Human
cucuggagacagcccc

SEQ ID NO: 2831412 - RNA, 17 nt, Human
cucuggagacagcccca

SEQ ID NO: 2831413 - RNA, 18 nt, Human
cucuggagacagccccag

SEQ ID NO: 2831414 - RNA, 19 nt, Human
cucuggagacagccccaga

SEQ ID NO: 2831415 - RNA, 19 nt, Human
cucuggacuggcuagaguc

SEQ ID NO: 2831416 - RNA, 16 nt, Human
cucuggacuggcuaga

SEQ ID NO: 2831417 - RNA, 15 nt, Human
cucuggacuggcuag

SEQ ID NO: 2831418 - RNA, 14 nt, Human
cucuggacuggcua

SEQ ID NO: 2831419 - RNA, 15 nt, Human
cucuggagagaaaca

SEQ ID NO: 2831420 - RNA, 20 nt, Human
cucuggagacagccccagag

SEQ ID NO: 2831421 - RNA, 24 nt, Human
cucuggagacagccccagagcagg

SEQ ID NO: 2831422 - RNA, 12 nt, Human
cucuggagagaa

SEQ ID NO: 2831423 - RNA, 13 nt, Human
cucuggagagaaa

SEQ ID NO: 2831424 - RNA, 12 nt, Human
cuccacccugcu

SEQ ID NO: 2831425 - RNA, 11 nt, Human
cuccacccugc

SEQ ID NO: 2831426 - RNA, 23 nt, Human
cuccacagcgagggcagcugcua

SEQ ID NO: 2831427 - RNA, 22 nt, Human
cuccacagcgagggcagcugcu

SEQ ID NO: 2831428 - RNA, 21 nt, Human
cuccacagcgagggcagcugc

SEQ ID NO: 2831429 - RNA, 20 nt, Human
cuccacagcgagggcagcug

SEQ ID NO: 2831430 - RNA, 15 nt, Human
cuccacagcuaccuc

SEQ ID NO: 2831431 - RNA, 19 nt, Human
cuccacagcgagggcagcu

SEQ ID NO: 2831432 - RNA, 16 nt, Human
cuccacagcgagggca

SEQ ID NO: 2831433 - RNA, 14 nt, Human
cuccacagcgaggg

SEQ ID NO: 2831434 - RNA, 13 nt, Human
cuccacagcgagg

SEQ ID NO: 2831435 - RNA, 15 nt, Human
cuccacagccgcagc

SEQ ID NO: 2831436 - RNA, 14 nt, Human
cuccacagccgcag

SEQ ID NO: 2831437 - RNA, 14 nt, Human
cucauuuaaauauc

SEQ ID NO: 2831438 - RNA, 20 nt, Human
cuccagcucaccagccccag

SEQ ID NO: 2831439 - RNA, 19 nt, Human
cuccagcucaccagcccca

SEQ ID NO: 2831440 - RNA, 13 nt, Human
cuccagccugagc

SEQ ID NO: 2831441 - RNA, 21 nt, Human
cuccagcaacuucuucuccau

SEQ ID NO: 2831442 - RNA, 11 nt, Human
cuccagcacaa

SEQ ID NO: 2831443 - RNA, 16 nt, Human
cuccagcacaaacaca

SEQ ID NO: 2831444 - RNA, 18 nt, Human
cuccagcacaaacacaag

SEQ ID NO: 2831445 - RNA, 19 nt, Human
cuccagcacaaacacaagg

SEQ ID NO: 2831446 - RNA, 21 nt, Human
cuccagcacaaacacaagguc

SEQ ID NO: 2831447 - RNA, 14 nt, Human
cuccagccccuuuc

SEQ ID NO: 2831448 - RNA, 17 nt, Human
cuccagccccuuuccaa

SEQ ID NO: 2831449 - RNA, 18 nt, Human
cuccagccccuuuccaaa

SEQ ID NO: 2831450 - RNA, 19 nt, Human
cuccagccccuuuccaaaa

SEQ ID NO: 2831451 - RNA, 14 nt, Human
cuccagcccgggag

SEQ ID NO: 2831452 - RNA, 15 nt, Human
cuccagcccgggagc

SEQ ID NO: 2831453 - RNA, 16 nt, Human
cuccagcccgggagcc

SEQ ID NO: 2831454 - RNA, 19 nt, Human
cuccagcccgggagccuag

SEQ ID NO: 2831455 - RNA, 20 nt, Human
cuccagcccgggagccuagg

SEQ ID NO: 2831456 - RNA, 21 nt, Human
cuccagcccgggagccuagga

SEQ ID NO: 2831457 - RNA, 22 nt, Human
cuccagcccgggagccuaggac

SEQ ID NO: 2831458 - RNA, 23 nt, Human
cuccagcccgggagccuaggacc

SEQ ID NO: 2831459 - RNA, 15 nt, Human
cuccagcaacuucuu

SEQ ID NO: 2831460 - RNA, 21 nt, Human
cuccagcaacacagccugggc

SEQ ID NO: 2831461 - RNA, 20 nt, Human
cuccagcaacacagccuggg

SEQ ID NO: 2831462 - RNA, 18 nt, Human
cuccagcaacacagccug

SEQ ID NO: 2831463 - RNA, 17 nt, Human
cuccagcaacacagccu

SEQ ID NO: 2831464 - RNA, 16 nt, Human
cuccacugccucugga

SEQ ID NO: 2831465 - RNA, 19 nt, Human
cuccagaccccuggcuuuu

SEQ ID NO: 2831466 - RNA, 20 nt, Human
cuccagaccccuggcuuuuc

SEQ ID NO: 2831467 - RNA, 14 nt, Human
cuccagaccccugg

SEQ ID NO: 2831468 - RNA, 15 nt, Human
cuccagaccccuggc

SEQ ID NO: 2831469 - RNA, 17 nt, Human
cuccagaccccuggcuu

SEQ ID NO: 2831470 - RNA, 18 nt, Human
cuccagaccccuggcuuu

SEQ ID NO: 2831471 - RNA, 11 nt, Human
cuccacugccu

SEQ ID NO: 2831472 - RNA, 19 nt, Human
cuccacucucuaccagaua

SEQ ID NO: 2831473 - RNA, 14 nt, Human
cuccacucucuacc

SEQ ID NO: 2831474 - RNA, 14 nt, Human
cucccaggcgcccc

SEQ ID NO: 2831475 - RNA, 19 nt, Human
cucccaaguuuccauagca

SEQ ID NO: 2831476 - RNA, 14 nt, Human
cucccaagggaugg

SEQ ID NO: 2831477 - RNA, 18 nt, Human
cucccaagggauggugcc

SEQ ID NO: 2831478 - RNA, 22 nt, Human
cucccaaguagcugggauuaca

SEQ ID NO: 2831479 - RNA, 14 nt, Human
cuccaugugggcua

SEQ ID NO: 2831480 - RNA, 17 nt, Human
cuccauucaauuucagg

SEQ ID NO: 2831481 - RNA, 18 nt, Human
cuccauucaauuucaggc

SEQ ID NO: 2831482 - RNA, 21 nt, Human
cuccauucaauuucaggcucc

SEQ ID NO: 2831483 - RNA, 21 nt, Human
cuccauguuggucaggcuggu

SEQ ID NO: 2831484 - RNA, 14 nt, Human
cuccauuaaagucu

SEQ ID NO: 2831485 - RNA, 15 nt, Human
cuccauuaaagucug

SEQ ID NO: 2831486 - RNA, 16 nt, Human
cuccauuaaagucuga

SEQ ID NO: 2831487 - RNA, 20 nt, Human
cuccauuaaagucugaauca

SEQ ID NO: 2831488 - RNA, 13 nt, Human
cuccauucuauuu

SEQ ID NO: 2831489 - RNA, 14 nt, Human
cuccauucuauuuu

SEQ ID NO: 2831490 - RNA, 17 nt, Human
cuccauucuauuuuaga

SEQ ID NO: 2831491 - RNA, 23 nt, Human
cuccauugguccuuuuuuuuucu

SEQ ID NO: 2831492 - RNA, 20 nt, Human
cuccaucgcugucaucucag

SEQ ID NO: 2831493 - RNA, 17 nt, Human
cuccaucuaaacugccc

SEQ ID NO: 2831494 - RNA, 13 nt, Human
cuccaucuccacu

SEQ ID NO: 2831495 - RNA, 14 nt, Human
cuccaucucaugua

SEQ ID NO: 2831496 - RNA, 23 nt, Human
cuccaucucauguaucaucugga

SEQ ID NO: 2831497 - RNA, 18 nt, Human
cuccaucuaaacugcccc

SEQ ID NO: 2831498 - RNA, 11 nt, Human
cuccaggcucc

SEQ ID NO: 2831499 - RNA, 19 nt, Human
cuccagcuggguuggaaaa

SEQ ID NO: 2831500 - RNA, 14 nt, Human
cuccagccugagca

SEQ ID NO: 2831501 - RNA, 21 nt, Human
cuccagccugcccaagcccag

SEQ ID NO: 2831502 - RNA, 23 nt, Human
cuccagccugcccaagcccaggc

SEQ ID NO: 2831503 - RNA, 16 nt, Human
cuccagcucagaaccc

SEQ ID NO: 2831504 - RNA, 17 nt, Human
cuccagcucagaaccca

SEQ ID NO: 2831505 - RNA, 19 nt, Human
cuccagcucagaacccagg

SEQ ID NO: 2831506 - RNA, 20 nt, Human
cuccagcucagaacccaggg

SEQ ID NO: 2831507 - RNA, 21 nt, Human
cuccagcucagaacccagggc

SEQ ID NO: 2831508 - RNA, 22 nt, Human
cuccagcucagaacccagggcu

SEQ ID NO: 2831509 - RNA, 23 nt, Human
cuccagcucagaacccagggcuc

SEQ ID NO: 2831510 - RNA, 24 nt, Human
cuccagcucagaacccagggcucu

SEQ ID NO: 2831511 - RNA, 15 nt, Human
cuccaggccugcagc

SEQ ID NO: 2831512 - RNA, 17 nt, Human
cuccaggccugcagcag

SEQ ID NO: 2831513 - RNA, 22 nt, Human
cuccaggccugcagcaggagug

SEQ ID NO: 2831514 - RNA, 14 nt, Human
cuccaggcccgucu

SEQ ID NO: 2831515 - RNA, 15 nt, Human
cuccaggcccgucug

SEQ ID NO: 2831516 - RNA, 16 nt, Human
cuccaggcccgucugu

SEQ ID NO: 2831517 - RNA, 17 nt, Human
cuccaggcccgucuguc

SEQ ID NO: 2831518 - RNA, 18 nt, Human
cuccaggcccgucugucc

SEQ ID NO: 2831519 - RNA, 19 nt, Human
cuccaggcccgucugucca

SEQ ID NO: 2831520 - RNA, 20 nt, Human
cuccaggcccgucuguccau

SEQ ID NO: 2831521 - RNA, 23 nt, Human
cuccaggcccgucuguccaucug

SEQ ID NO: 2831522 - RNA, 13 nt, Human
cuccaggcaggcu

SEQ ID NO: 2831523 - RNA, 15 nt, Human
cuccaggcaggcuaa

SEQ ID NO: 2831524 - RNA, 15 nt, Human
cucaucuaugaggaa

SEQ ID NO: 2831525 - RNA, 19 nt, Human
cucaucuaugaggaaaggu

SEQ ID NO: 2831526 - RNA, 20 nt, Human
cucaucuaugaggaaagguu

SEQ ID NO: 2831527 - RNA, 12 nt, Human
cucaucucaggu

SEQ ID NO: 2831528 - RNA, 14 nt, Human
cucauccugcaggc

SEQ ID NO: 2831529 - RNA, 12 nt, Human
cucauauuuugu

SEQ ID NO: 2831530 - RNA, 13 nt, Human
cucauauuuugua

SEQ ID NO: 2831531 - RNA, 21 nt, Human
cucauauuuuguauauaucug

SEQ ID NO: 2831532 - RNA, 14 nt, Human
cucaucaacaaaga

SEQ ID NO: 2831533 - RNA, 15 nt, Human
cucaucaacaaagaa

SEQ ID NO: 2831534 - RNA, 18 nt, Human
cucaucaacaaagaaaua

SEQ ID NO: 2831535 - RNA, 14 nt, Human
cucaucauuugugg

SEQ ID NO: 2831536 - RNA, 16 nt, Human
cucauauuuuguauau

SEQ ID NO: 2831537 - RNA, 20 nt, Human
cucauccaaacaauuuaaaa

SEQ ID NO: 2831538 - RNA, 20 nt, Human
cucauauggucuaccaguuu

SEQ ID NO: 2831539 - RNA, 15 nt, Human
cucauauuuaaagac

SEQ ID NO: 2831540 - RNA, 12 nt, Human
cucauauuuaaa

SEQ ID NO: 2831541 - RNA, 13 nt, Human
cucauauuuaaag

SEQ ID NO: 2831542 - RNA, 13 nt, Human
cucauccugcagg

SEQ ID NO: 2831543 - RNA, 18 nt, Human
cucauccugaacagcaug

SEQ ID NO: 2831544 - RNA, 22 nt, Human
cucauccccaggggucccagcc

SEQ ID NO: 2831545 - RNA, 14 nt, Human
cucauccccagggg

SEQ ID NO: 2831546 - RNA, 13 nt, Human
cucauccccaggg

SEQ ID NO: 2831547 - RNA, 16 nt, Human
cucauccagggcucug

SEQ ID NO: 2831548 - RNA, 21 nt, Human
cucaucccaugagacccuggu

SEQ ID NO: 2831549 - RNA, 22 nt, Human
cucaucccaugagacccuggug

SEQ ID NO: 2831550 - RNA, 24 nt, Human
cucauccaccccaucccuccccag

SEQ ID NO: 2831551 - RNA, 15 nt, Human
cucauccagggcucu

SEQ ID NO: 2831552 - RNA, 13 nt, Human
cucauccacccca

SEQ ID NO: 2831553 - RNA, 15 nt, Human
cucauccaccccauc

SEQ ID NO: 2831554 - RNA, 16 nt, Human
cucauccaccccaucc

SEQ ID NO: 2831555 - RNA, 19 nt, Human
cucauccaccccaucccuc

SEQ ID NO: 2831556 - RNA, 12 nt, Human
cucauucuucug

SEQ ID NO: 2831557 - RNA, 14 nt, Human
cucauucuucugua

SEQ ID NO: 2831558 - RNA, 13 nt, Human
cucauucuucugu

SEQ ID NO: 2831559 - RNA, 21 nt, Human
cucauuccaccuucccaugcc

SEQ ID NO: 2831560 - RNA, 18 nt, Human
cucauuccaccuucccau

SEQ ID NO: 2831561 - RNA, 17 nt, Human
cucauuccaacagugag

SEQ ID NO: 2831562 - RNA, 18 nt, Human
cucauuccaacagugagu

SEQ ID NO: 2831563 - RNA, 13 nt, Human
cucauucauuuua

SEQ ID NO: 2831564 - RNA, 15 nt, Human
cucauucauuuuaua

SEQ ID NO: 2831565 - RNA, 21 nt, Human
cucauucauuuuauauugaaa

SEQ ID NO: 2831566 - RNA, 22 nt, Human
cucauucauuuuauauugaaaa

SEQ ID NO: 2831567 - RNA, 23 nt, Human
cucauucuucuguacgucugaca

SEQ ID NO: 2831568 - RNA, 17 nt, Human
cucauugacaagaacug

SEQ ID NO: 2831569 - RNA, 14 nt, Human
cucauucuuguuuu

SEQ ID NO: 2831570 - RNA, 10 nt, Human
cucauugaaa

SEQ ID NO: 2831571 - RNA, 11 nt, Human
cucauugaaau

SEQ ID NO: 2831572 - RNA, 12 nt, Human
cucauugaaaug

SEQ ID NO: 2831573 - RNA, 13 nt, Human
cucauugaaaugu

SEQ ID NO: 2831574 - RNA, 14 nt, Human
cucauugaaauguc

SEQ ID NO: 2831575 - RNA, 15 nt, Human
cucauugaaauguca

SEQ ID NO: 2831576 - RNA, 16 nt, Human
cucauugaaaugucac

SEQ ID NO: 2831577 - RNA, 20 nt, Human
cucauugcugagccucugcu

SEQ ID NO: 2831578 - RNA, 18 nt, Human
cucauugcugagccucug

SEQ ID NO: 2831579 - RNA, 19 nt, Human
cucauugcugagccucugc

SEQ ID NO: 2831580 - RNA, 12 nt, Human
cucauugggguu

SEQ ID NO: 2831581 - RNA, 18 nt, Human
cucauugacaagaacuga

SEQ ID NO: 2831582 - RNA, 16 nt, Human
cucaggugucccugca

SEQ ID NO: 2831583 - RNA, 15 nt, Human
cucaggugucccugc

SEQ ID NO: 2831584 - RNA, 19 nt, Human
cucaggggucacugaggcc

SEQ ID NO: 2831585 - RNA, 17 nt, Human
cucaggguauugcuugc

SEQ ID NO: 2831586 - RNA, 19 nt, Human
cucaggucacauaaaacuu

SEQ ID NO: 2831587 - RNA, 17 nt, Human
cucagguagaagguuga

SEQ ID NO: 2831588 - RNA, 23 nt, Human
cucagguagaagguugacacagu

SEQ ID NO: 2831589 - RNA, 17 nt, Human
cucaggucccugcaggg

SEQ ID NO: 2831590 - RNA, 18 nt, Human
cucaggucccugcagggc

SEQ ID NO: 2831591 - RNA, 18 nt, Human
cucaggggccagaggaac

SEQ ID NO: 2831592 - RNA, 20 nt, Human
cucaggggccagaggaacug

SEQ ID NO: 2831593 - RNA, 19 nt, Human
cucaggggaaaacuguuac

SEQ ID NO: 2831594 - RNA, 13 nt, Human
cucaggggcagcu

SEQ ID NO: 2831595 - RNA, 14 nt, Human
cucaggggcagcuc

SEQ ID NO: 2831596 - RNA, 13 nt, Human
cucaggggccaga

SEQ ID NO: 2831597 - RNA, 17 nt, Human
cucaggggccagaggaa

SEQ ID NO: 2831598 - RNA, 12 nt, Human
cuaaaagcacac

SEQ ID NO: 2831599 - RNA, 12 nt, Human
cuaaaagcaccu

SEQ ID NO: 2831600 - RNA, 15 nt, Human
cuaaaagccacccca

SEQ ID NO: 2831601 - RNA, 12 nt, Human
cuaaaagcaaaa

SEQ ID NO: 2831602 - RNA, 20 nt, Human
cuaaaagcaaaauaaaaacu

SEQ ID NO: 2831603 - RNA, 22 nt, Human
cuaaaagcaaaauaaaaacuau

SEQ ID NO: 2831604 - RNA, 17 nt, Human
cguuuuuuaaauguaua

SEQ ID NO: 2831605 - RNA, 13 nt, Human
cguuuuuccuuua

SEQ ID NO: 2831606 - RNA, 19 nt, Human
cucauaguaugguggcugg

SEQ ID NO: 2831607 - RNA, 18 nt, Human
cucauaguaugguggcug

SEQ ID NO: 2831608 - RNA, 20 nt, Human
cucauaguaugguggcuggg

SEQ ID NO: 2831609 - RNA, 12 nt, Human
cucauaauuccu

SEQ ID NO: 2831610 - RNA, 21 nt, Human
cucauaauuccuacagcacua

SEQ ID NO: 2831611 - RNA, 16 nt, Human
cucauaaauuuacuuu

SEQ ID NO: 2831612 - RNA, 21 nt, Human
cucaguucagaaucacuucug

SEQ ID NO: 2831613 - RNA, 15 nt, Human
cucauaacucauugu

SEQ ID NO: 2831614 - RNA, 18 nt, Human
cucaggugucccugcacu

SEQ ID NO: 2831615 - RNA, 17 nt, Human
cucaggugucccugcac

SEQ ID NO: 2831616 - RNA, 19 nt, Human
cucaggugucccugcacuu

SEQ ID NO: 2831617 - RNA, 12 nt, Human
cucaguguuuug

SEQ ID NO: 2831618 - RNA, 17 nt, Human
cucaguguuuuggacuc

SEQ ID NO: 2831619 - RNA, 22 nt, Human
cucaguguuuuggacuccaucu

SEQ ID NO: 2831620 - RNA, 23 nt, Human
cucaguguuuuggacuccaucuc

SEQ ID NO: 2831621 - RNA, 16 nt, Human
cucaguuaaaauguga

SEQ ID NO: 2831622 - RNA, 15 nt, Human
cucaguucagaauca

SEQ ID NO: 2831623 - RNA, 18 nt, Human
cucaguucccuuggccuc

SEQ ID NO: 2831624 - RNA, 17 nt, Human
cucaguucccuuggccu

SEQ ID NO: 2831625 - RNA, 16 nt, Human
cucaguucccuuggcc

SEQ ID NO: 2831626 - RNA, 15 nt, Human
cucaguucccuuggc

SEQ ID NO: 2831627 - RNA, 14 nt, Human
cucaguucccuugg

SEQ ID NO: 2831628 - RNA, 19 nt, Human
cucggacuuagcugggaga

SEQ ID NO: 2831629 - RNA, 18 nt, Human
cucggacuuagcugggag

SEQ ID NO: 2831630 - RNA, 22 nt, Human
cucgcuuggacggcugggcaca

SEQ ID NO: 2831631 - RNA, 11 nt, Human
cucgcuuguaa

SEQ ID NO: 2831632 - RNA, 12 nt, Human
cucgcuuguaaa

SEQ ID NO: 2831633 - RNA, 13 nt, Human
cucgcuuguaaau

SEQ ID NO: 2831634 - RNA, 14 nt, Human
cucgcuuguaaaua

SEQ ID NO: 2831635 - RNA, 20 nt, Human
cucgcuuguaaauaccagga

SEQ ID NO: 2831636 - RNA, 21 nt, Human
cucgcuuguaaauaccaggau

SEQ ID NO: 2831637 - RNA, 21 nt, Human
cucgcuauugucaccagggcu

SEQ ID NO: 2831638 - RNA, 20 nt, Human
cucggaaggcuggcugggca

SEQ ID NO: 2831639 - RNA, 16 nt, Human
cucggaaggcuggcug

SEQ ID NO: 2831640 - RNA, 17 nt, Human
cucgcuuuguugcccag

SEQ ID NO: 2831641 - RNA, 20 nt, Human
cucggaaauuaaaguuugcu

SEQ ID NO: 2831642 - RNA, 18 nt, Human
cucggaaccgcucaccua

SEQ ID NO: 2831643 - RNA, 20 nt, Human
cucggaaccgcucaccuaga

SEQ ID NO: 2831644 - RNA, 21 nt, Human
cucggaaccgcucaccuagag

SEQ ID NO: 2831645 - RNA, 23 nt, Human
cucggaaccgcucaccuagagcc

SEQ ID NO: 2831646 - RNA, 18 nt, Human
cucggacuaagccuaccu

SEQ ID NO: 2831647 - RNA, 22 nt, Human
cucggacuaagccuaccugcuc

SEQ ID NO: 2831648 - RNA, 18 nt, Human
cucggagcaucccggagg

SEQ ID NO: 2831649 - RNA, 22 nt, Human
cucggagcaucccggaggaaau

SEQ ID NO: 2831650 - RNA, 15 nt, Human
cucggccucccaaag

SEQ ID NO: 2831651 - RNA, 21 nt, Human
cucggcaacuaagcagucccu

SEQ ID NO: 2831652 - RNA, 22 nt, Human
cucggccuccuaaagugcuggg

SEQ ID NO: 2831653 - RNA, 22 nt, Human
cucggccuggucaggcccuggu

SEQ ID NO: 2831654 - RNA, 23 nt, Human
cucggccucccaaagugcuggga

SEQ ID NO: 2831655 - RNA, 22 nt, Human
cucggccucccaaagugcuggg

SEQ ID NO: 2831656 - RNA, 20 nt, Human
cucggccucccaaagugcug

SEQ ID NO: 2831657 - RNA, 18 nt, Human
cucggccucccaaagugc

SEQ ID NO: 2831658 - RNA, 11 nt, Human
cucuaaagcac

SEQ ID NO: 2831659 - RNA, 19 nt, Human
cucgcuauugucaccaggg

SEQ ID NO: 2831660 - RNA, 14 nt, Human
cucgcaucauugca

SEQ ID NO: 2831661 - RNA, 16 nt, Human
cucgcaucauugcaga

SEQ ID NO: 2831662 - RNA, 17 nt, Human
cucgcaucauugcagau

SEQ ID NO: 2831663 - RNA, 14 nt, Human
cucgcaucuuccca

SEQ ID NO: 2831664 - RNA, 15 nt, Human
cucgcaucuucccaa

SEQ ID NO: 2831665 - RNA, 17 nt, Human
cucgccccaccggcgcg

SEQ ID NO: 2831666 - RNA, 13 nt, Human
cucgaggugccuu

SEQ ID NO: 2831667 - RNA, 14 nt, Human
cucgaggugccuuc

SEQ ID NO: 2831668 - RNA, 15 nt, Human
cucgaggugccuucu

SEQ ID NO: 2831669 - RNA, 20 nt, Human
cucgaggugccuucuucagg

SEQ ID NO: 2831670 - RNA, 21 nt, Human
cucgaggugccuucuucaggg

SEQ ID NO: 2831671 - RNA, 14 nt, Human
cucgauccaaauug

SEQ ID NO: 2831672 - RNA, 15 nt, Human
cucgauccaaauugu

SEQ ID NO: 2831673 - RNA, 19 nt, Human
cucgauccaaauugugcuu

SEQ ID NO: 2831674 - RNA, 21 nt, Human
cucgauccaaauugugcuucu

SEQ ID NO: 2831675 - RNA, 20 nt, Human
cucgaagcgcgccacucgcu

SEQ ID NO: 2831676 - RNA, 17 nt, Human
cucgaagcgcgccacuc

SEQ ID NO: 2831677 - RNA, 13 nt, Human
cucgaagcgcgcc

SEQ ID NO: 2831678 - RNA, 12 nt, Human
cucgaagcgcgc

SEQ ID NO: 2831679 - RNA, 19 nt, Human
cucgacaucacuguucaug

SEQ ID NO: 2831680 - RNA, 20 nt, Human
cuccuucuguccuacucugu

SEQ ID NO: 2831681 - RNA, 15 nt, Human
cuccuucuguccuac

SEQ ID NO: 2831682 - RNA, 14 nt, Human
cuccuucuguccua

SEQ ID NO: 2831683 - RNA, 13 nt, Human
cuccuucucccuu

SEQ ID NO: 2831684 - RNA, 19 nt, Human
cuccuucagacacccucaa

SEQ ID NO: 2831685 - RNA, 13 nt, Human
cuccuucagacac

SEQ ID NO: 2831686 - RNA, 14 nt, Human
cuccuucagacacc

SEQ ID NO: 2831687 - RNA, 20 nt, Human
cuccugacgucugaagcuug

SEQ ID NO: 2831688 - RNA, 12 nt, Human
cuccuucagaca

SEQ ID NO: 2831689 - RNA, 19 nt, Human
cuccuucgcaggcaugucc

SEQ ID NO: 2831690 - RNA, 18 nt, Human
cuccuucguaucccgagu

SEQ ID NO: 2831691 - RNA, 19 nt, Human
cuccuucguaucccgaguc

SEQ ID NO: 2831692 - RNA, 22 nt, Human
cuccuucguaucccgagucugg

SEQ ID NO: 2831693 - RNA, 16 nt, Human
cucgaacuggcugcaa

SEQ ID NO: 2831694 - RNA, 10 nt, Human
cuccuuggcc

SEQ ID NO: 2831695 - RNA, 11 nt, Human
cuccuuggccu

SEQ ID NO: 2831696 - RNA, 12 nt, Human
cuccuuggccua

SEQ ID NO: 2831697 - RNA, 14 nt, Human
cuccuuggccuagc

SEQ ID NO: 2831698 - RNA, 17 nt, Human
cuccuuggccuagccca

SEQ ID NO: 2831699 - RNA, 22 nt, Human
cuccuuggccuagcccacccug

SEQ ID NO: 2831700 - RNA, 13 nt, Human
cuccuuggcuuac

SEQ ID NO: 2831701 - RNA, 16 nt, Human
cuccuuggcuuaccug

SEQ ID NO: 2831702 - RNA, 17 nt, Human
cuccuuggcuuaccuga

SEQ ID NO: 2831703 - RNA, 19 nt, Human
cuccuuggcuuaccugacc

SEQ ID NO: 2831704 - RNA, 20 nt, Human
cuccuuggcuuaccugaccu

SEQ ID NO: 2831705 - RNA, 21 nt, Human
cuccuuggcuuaccugaccuc

SEQ ID NO: 2831706 - RNA, 17 nt, Human
cuccuugcuuguuacau

SEQ ID NO: 2831707 - RNA, 17 nt, Human
cuccuugagagaccagg

SEQ ID NO: 2831708 - RNA, 20 nt, Human
cuccuugagagaccaggcaa

SEQ ID NO: 2831709 - RNA, 12 nt, Human
cuccuugcaguu

SEQ ID NO: 2831710 - RNA, 13 nt, Human
cuccuugcaguuc

SEQ ID NO: 2831711 - RNA, 16 nt, Human
cuccuugcaucaaggg

SEQ ID NO: 2831712 - RNA, 15 nt, Human
cuccuugaauaucuu

SEQ ID NO: 2831713 - RNA, 20 nt, Human
cuccuugaauaucuuucgau

SEQ ID NO: 2831714 - RNA, 16 nt, Human
cuccuguuagcuccuc

SEQ ID NO: 2831715 - RNA, 23 nt, Human
cuccuguuagcuccucacugugg

SEQ ID NO: 2831716 - RNA, 17 nt, Human
cuccuuaacacugagcu

SEQ ID NO: 2831717 - RNA, 20 nt, Human
cuccuuaacacugagcuguc

SEQ ID NO: 2831718 - RNA, 18 nt, Human
cuccuguuuauucccauc

SEQ ID NO: 2831719 - RNA, 18 nt, Human
cuccuguuucccuucccu

SEQ ID NO: 2831720 - RNA, 20 nt, Human
cuccuguuucccuucccuuc

SEQ ID NO: 2831721 - RNA, 23 nt, Human
cuccugaggggcaucugccccuc

SEQ ID NO: 2831722 - RNA, 14 nt, Human
cuccugccaaggag

SEQ ID NO: 2831723 - RNA, 13 nt, Human
cuccugccacauu

SEQ ID NO: 2831724 - RNA, 21 nt, Human
cuccugccacauuagaacuuc

SEQ ID NO: 2831725 - RNA, 11 nt, Human
cuccugugugu

SEQ ID NO: 2831726 - RNA, 23 nt, Human
cuccugugucuugcaauggcagc

SEQ ID NO: 2831727 - RNA, 15 nt, Human
cuccugugucuugca

SEQ ID NO: 2831728 - RNA, 18 nt, Human
cuccugccaguguggaac

SEQ ID NO: 2831729 - RNA, 11 nt, Human
cuccugccacc

SEQ ID NO: 2831730 - RNA, 17 nt, Human
cucccuuuccuuccuaa

SEQ ID NO: 2831731 - RNA, 17 nt, Human
cuccuaguuugggagga

SEQ ID NO: 2831732 - RNA, 14 nt, Human
cuccuauaaucugu

SEQ ID NO: 2831733 - RNA, 15 nt, Human
cuccuauaaucuguc

SEQ ID NO: 2831734 - RNA, 16 nt, Human
cuccuauaaucuguca

SEQ ID NO: 2831735 - RNA, 17 nt, Human
cuccuauaaucugucaa

SEQ ID NO: 2831736 - RNA, 18 nt, Human
cuccuauaaucugucaaa

SEQ ID NO: 2831737 - RNA, 21 nt, Human
cuccuauaaucugucaaaaca

SEQ ID NO: 2831738 - RNA, 22 nt, Human
cuccuauaaucugucaaaacac

SEQ ID NO: 2831739 - RNA, 23 nt, Human
cuccuauaaucugucaaaacacu

SEQ ID NO: 2831740 - RNA, 19 nt, Human
cuccuaguuugaccucaca

SEQ ID NO: 2831741 - RNA, 23 nt, Human
cuccuaguuugaccucacaguga

SEQ ID NO: 2831742 - RNA, 11 nt, Human
cucccuuaccc

SEQ ID NO: 2831743 - RNA, 14 nt, Human
cucccuuccgaccc

SEQ ID NO: 2831744 - RNA, 17 nt, Human
cucccuuccgacccucu

SEQ ID NO: 2831745 - RNA, 19 nt, Human
cucccuuccgacccucugg

SEQ ID NO: 2831746 - RNA, 20 nt, Human
cucccuuccgacccucuggg

SEQ ID NO: 2831747 - RNA, 21 nt, Human
cucccuuccgacccucuggga

SEQ ID NO: 2831748 - RNA, 22 nt, Human
cucccuuccgacccucugggaa

SEQ ID NO: 2831749 - RNA, 23 nt, Human
cucccuuccgacccucugggaac

SEQ ID NO: 2831750 - RNA, 13 nt, Human
cucccuucggugg

SEQ ID NO: 2831751 - RNA, 17 nt, Human
cucccuucgguggaaga

SEQ ID NO: 2831752 - RNA, 21 nt, Human
cucccuucgguggaagagcuc

SEQ ID NO: 2831753 - RNA, 22 nt, Human
cucccuucgguggaagagcuca

SEQ ID NO: 2831754 - RNA, 23 nt, Human
cucccauccccuggacugggagg

SEQ ID NO: 2831755 - RNA, 17 nt, Human
cucccauaaccgcugau

SEQ ID NO: 2831756 - RNA, 20 nt, Human
cucccauaaccgcugauucu

SEQ ID NO: 2831757 - RNA, 13 nt, Human
cuccauccugcug

SEQ ID NO: 2831758 - RNA, 20 nt, Human
cucccaguccaaauguccuc

SEQ ID NO: 2831759 - RNA, 11 nt, Human
cucccaguccc

SEQ ID NO: 2831760 - RNA, 20 nt, Human
cucccaguccccagcccuuc

SEQ ID NO: 2831761 - RNA, 16 nt, Human
cucccaguaccuccug

SEQ ID NO: 2831762 - RNA, 21 nt, Human
cucccagguguuaacauucca

SEQ ID NO: 2831763 - RNA, 22 nt, Human
cucccagguguuaacauuccaa

SEQ ID NO: 2831764 - RNA, 17 nt, Human
cucccaguuaugaauca

SEQ ID NO: 2831765 - RNA, 12 nt, Human
cucccuggcucc

SEQ ID NO: 2831766 - RNA, 11 nt, Human
cucccuggcuc

SEQ ID NO: 2831767 - RNA, 12 nt, Human
cucccuucaacc

SEQ ID NO: 2831768 - RNA, 18 nt, Human
cucccuucaaccauuccc

SEQ ID NO: 2831769 - RNA, 19 nt, Human
cucccuucaaccauucccc

SEQ ID NO: 2831770 - RNA, 20 nt, Human
cucccuucaaccauucccca

SEQ ID NO: 2831771 - RNA, 15 nt, Human
cucccuggcucccau

SEQ ID NO: 2831772 - RNA, 14 nt, Human
cucccuggcuccca

SEQ ID NO: 2831773 - RNA, 22 nt, Human
cuccucaccucuggacuggcua

SEQ ID NO: 2831774 - RNA, 13 nt, Human
cuccucacugccc

SEQ ID NO: 2831775 - RNA, 15 nt, Human
cuccucacugcccgc

SEQ ID NO: 2831776 - RNA, 16 nt, Human
cuccucacugcccgca

SEQ ID NO: 2831777 - RNA, 17 nt, Human
cuccucacugcccgcac

SEQ ID NO: 2831778 - RNA, 18 nt, Human
cuccucacugcccgcaca

SEQ ID NO: 2831779 - RNA, 14 nt, Human
cuccucacuggcca

SEQ ID NO: 2831780 - RNA, 18 nt, Human
cuccucacuggccauccc

SEQ ID NO: 2831781 - RNA, 20 nt, Human
cuccucacuggccaucccuc

SEQ ID NO: 2831782 - RNA, 13 nt, Human
cuccucccuguua

SEQ ID NO: 2831783 - RNA, 19 nt, Human
cuccucccuguuauuuuca

SEQ ID NO: 2831784 - RNA, 20 nt, Human
cuccucccuguuauuuucaa

SEQ ID NO: 2831785 - RNA, 22 nt, Human
cuccucccuguuauuuucaagu

SEQ ID NO: 2831786 - RNA, 13 nt, Human
cuccucguuccuu

SEQ ID NO: 2831787 - RNA, 19 nt, Human
cuccucguuccuuucuccu

SEQ ID NO: 2831788 - RNA, 19 nt, Human
cuccucuagcugugggggu

SEQ ID NO: 2831789 - RNA, 17 nt, Human
cuccucuagcugugggg

SEQ ID NO: 2831790 - RNA, 18 nt, Human
cuccucuagcuguggggg

SEQ ID NO: 2831791 - RNA, 18 nt, Human
cuccucccuuuccuuccu

SEQ ID NO: 2831792 - RNA, 19 nt, Human
cuccucggaaccgcucacc

SEQ ID NO: 2831793 - RNA, 22 nt, Human
cuccucggaaccgcucaccuag

SEQ ID NO: 2831794 - RNA, 23 nt, Human
cuccucggaaccgcucaccuaga

SEQ ID NO: 2831795 - RNA, 12 nt, Human
cuccucuuuaaa

SEQ ID NO: 2831796 - RNA, 13 nt, Human
cuccucuuuaaaa

SEQ ID NO: 2831797 - RNA, 15 nt, Human
cuccucuuuaaaaca

SEQ ID NO: 2831798 - RNA, 16 nt, Human
cuccucuuuaaaacaa

SEQ ID NO: 2831799 - RNA, 18 nt, Human
cuccucuuuaaaacaaaa

SEQ ID NO: 2831800 - RNA, 19 nt, Human
cuccucuuuaaaacaaaac

SEQ ID NO: 2831801 - RNA, 12 nt, Human
cuccucuuucuc

SEQ ID NO: 2831802 - RNA, 13 nt, Human
cuccucuuucucu

SEQ ID NO: 2831803 - RNA, 14 nt, Human
cuccucuuucucuc

SEQ ID NO: 2831804 - RNA, 15 nt, Human
cuccucuuucucucc

SEQ ID NO: 2831805 - RNA, 16 nt, Human
cuccucuuucucuccc

SEQ ID NO: 2831806 - RNA, 17 nt, Human
cuccucuuucucucccc

SEQ ID NO: 2831807 - RNA, 20 nt, Human
cuccucuuucucuccccaac

SEQ ID NO: 2831808 - RNA, 19 nt, Human
cuccucuugccacugccuc

SEQ ID NO: 2831809 - RNA, 18 nt, Human
cuccucuugccacugccu

SEQ ID NO: 2831810 - RNA, 13 nt, Human
cuccucucagccc

SEQ ID NO: 2831811 - RNA, 14 nt, Human
cuccucucaguguu

SEQ ID NO: 2831812 - RNA, 15 nt, Human
cuccucucaguguuu

SEQ ID NO: 2831813 - RNA, 22 nt, Human
cuccugaguagcugggauuaca

SEQ ID NO: 2831814 - RNA, 21 nt, Human
cuccugaguagcuggauuaca

SEQ ID NO: 2831815 - RNA, 17 nt, Human
cuccugaguagcuggga

SEQ ID NO: 2831816 - RNA, 22 nt, Human
cuccugaggggcaucugccccu

SEQ ID NO: 2831817 - RNA, 21 nt, Human
cuccugaggggcaucugcccc

SEQ ID NO: 2831818 - RNA, 20 nt, Human
cuccugaggggcaucugccc

SEQ ID NO: 2831819 - RNA, 19 nt, Human
cuccugaggggcaucugcc

SEQ ID NO: 2831820 - RNA, 16 nt, Human
cuccugaggggcaucu

SEQ ID NO: 2831821 - RNA, 16 nt, Human
cuccugaggcuuugga

SEQ ID NO: 2831822 - RNA, 17 nt, Human
cuccugaggcuuuggau

SEQ ID NO: 2831823 - RNA, 19 nt, Human
cuccugagggaggaccugg

SEQ ID NO: 2831824 - RNA, 20 nt, Human
cuccugagggaggaccuggg

SEQ ID NO: 2831825 - RNA, 23 nt, Human
cuccugagggaggaccuggggca

SEQ ID NO: 2831826 - RNA, 14 nt, Human
cuccugacagaagg

SEQ ID NO: 2831827 - RNA, 18 nt, Human
cuccugacagaaggugcc

SEQ ID NO: 2831828 - RNA, 16 nt, Human
cuccugacagaaggug

SEQ ID NO: 2831829 - RNA, 19 nt, Human
cuccugacagaaggugcca

SEQ ID NO: 2831830 - RNA, 23 nt, Human
cuccugaaccgcacagcucagga

SEQ ID NO: 2831831 - RNA, 21 nt, Human
cuccugaaccgcacagcucag

SEQ ID NO: 2831832 - RNA, 20 nt, Human
cuccugaaccgcacagcuca

SEQ ID NO: 2831833 - RNA, 19 nt, Human
cuccugaaccgcacagcuc

SEQ ID NO: 2831834 - RNA, 18 nt, Human
cuccugaaccgcacagcu

SEQ ID NO: 2831835 - RNA, 15 nt, Human
cuccugaccucaagu

SEQ ID NO: 2831836 - RNA, 14 nt, Human
cuccugaccucagg

SEQ ID NO: 2831837 - RNA, 14 nt, Human
cuccugaccuuagg

SEQ ID NO: 2831838 - RNA, 15 nt, Human
cuccugacuguaaca

SEQ ID NO: 2831839 - RNA, 16 nt, Human
cuccugagaaauguua

SEQ ID NO: 2831840 - RNA, 17 nt, Human
cuucgacuuuucuuaac

SEQ ID NO: 2831841 - RNA, 18 nt, Human
cuucgacuuuucuuaaca

SEQ ID NO: 2831842 - RNA, 18 nt, Human
cuucgggcgucugugugc

SEQ ID NO: 2831843 - RNA, 16 nt, Human
cuucggccagagcuga

SEQ ID NO: 2831844 - RNA, 16 nt, Human
cuucggccaggucaca

SEQ ID NO: 2831845 - RNA, 19 nt, Human
cuucguucuuuuuaaguua

SEQ ID NO: 2831846 - RNA, 14 nt, Human
cuucucaucacaca

SEQ ID NO: 2831847 - RNA, 15 nt, Human
cuucucaucacacac

SEQ ID NO: 2831848 - RNA, 16 nt, Human
cuucucaucacacaca

SEQ ID NO: 2831849 - RNA, 18 nt, Human
cuucguuuacuaugccug

SEQ ID NO: 2831850 - RNA, 21 nt, Human
cuucguuuacuaugccugugu

SEQ ID NO: 2831851 - RNA, 19 nt, Human
cuucguuuacuaugccugu

SEQ ID NO: 2831852 - RNA, 18 nt, Human
cuucuaaacuuccccauc

SEQ ID NO: 2831853 - RNA, 19 nt, Human
cuucuaaacccaauccaaa

SEQ ID NO: 2831854 - RNA, 22 nt, Human
cuucuaaacuuccccaucuucu

SEQ ID NO: 2831855 - RNA, 19 nt, Human
cuucuaaacuuccccaucu

SEQ ID NO: 2831856 - RNA, 20 nt, Human
cuuccuugcuguccuaggcc

SEQ ID NO: 2831857 - RNA, 19 nt, Human
cuuccuugcuguccuaggc

SEQ ID NO: 2831858 - RNA, 15 nt, Human
cuucgaaaccuggga

SEQ ID NO: 2831859 - RNA, 15 nt, Human
cuucgcuccuguguc

SEQ ID NO: 2831860 - RNA, 14 nt, Human
cuucgcuccugugu

SEQ ID NO: 2831861 - RNA, 13 nt, Human
cuucgcuccugug

SEQ ID NO: 2831862 - RNA, 14 nt, Human
cuuccuuccugcuu

SEQ ID NO: 2831863 - RNA, 13 nt, Human
cuuccuuccuguu

SEQ ID NO: 2831864 - RNA, 17 nt, Human
cuuccuucuguaaauac

SEQ ID NO: 2831865 - RNA, 17 nt, Human
cuuccuugaccuuccuc

SEQ ID NO: 2831866 - RNA, 18 nt, Human
cuuccuugaccuuccucu

SEQ ID NO: 2831867 - RNA, 18 nt, Human
cuuccuugagacacggag

SEQ ID NO: 2831868 - RNA, 20 nt, Human
cuuccuugagacacggagcc

SEQ ID NO: 2831869 - RNA, 23 nt, Human
cuuccuugagacacggagcccag

SEQ ID NO: 2831870 - RNA, 17 nt, Human
cuuccuugcuguccuag

SEQ ID NO: 2831871 - RNA, 23 nt, Human
cuuccuacccacaccucugccag

SEQ ID NO: 2831872 - RNA, 16 nt, Human
cuuccuacccuccugc

SEQ ID NO: 2831873 - RNA, 15 nt, Human
cuuccuaccuauccc

SEQ ID NO: 2831874 - RNA, 16 nt, Human
cuucuccccagaguuc

SEQ ID NO: 2831875 - RNA, 12 nt, Human
cuucuccccaga

SEQ ID NO: 2831876 - RNA, 13 nt, Human
cuucuccccagaa

SEQ ID NO: 2831877 - RNA, 14 nt, Human
cuucuccccagaau

SEQ ID NO: 2831878 - RNA, 12 nt, Human
cuucucccagaa

SEQ ID NO: 2831879 - RNA, 13 nt, Human
cuucucccagaau

SEQ ID NO: 2831880 - RNA, 16 nt, Human
cuucucccagaauccc

SEQ ID NO: 2831881 - RNA, 20 nt, Human
cuucucccagaaucccagcc

SEQ ID NO: 2831882 - RNA, 23 nt, Human
cuucucccagaaucccagccggc

SEQ ID NO: 2831883 - RNA, 20 nt, Human
cuucccuuuuaaacacauuu

SEQ ID NO: 2831884 - RNA, 20 nt, Human
cuucuccuuucacaaccuuc

SEQ ID NO: 2831885 - RNA, 22 nt, Human
cuucuccuuucacaaccuucug

SEQ ID NO: 2831886 - RNA, 14 nt, Human
cuucuccuuucaca

SEQ ID NO: 2831887 - RNA, 17 nt, Human
cuucuccuuucacaacc

SEQ ID NO: 2831888 - RNA, 15 nt, Human
cuucuccacccugcu

SEQ ID NO: 2831889 - RNA, 14 nt, Human
cuucuccacccugc

SEQ ID NO: 2831890 - RNA, 14 nt, Human
cuucuccaggcugu

SEQ ID NO: 2831891 - RNA, 14 nt, Human
cuucuccaaggaaa

SEQ ID NO: 2831892 - RNA, 17 nt, Human
cuucuccaggcuguauc

SEQ ID NO: 2831893 - RNA, 19 nt, Human
cuucuccaauucugcccaa

SEQ ID NO: 2831894 - RNA, 13 nt, Human
cuucuccaggguc

SEQ ID NO: 2831895 - RNA, 19 nt, Human
cuucuccaggguccacagg

SEQ ID NO: 2831896 - RNA, 20 nt, Human
cuucuccaggucucacgggc

SEQ ID NO: 2831897 - RNA, 21 nt, Human
cuucugccauauucuguuggc

SEQ ID NO: 2831898 - RNA, 20 nt, Human
cuucucucagacuuacuuua

SEQ ID NO: 2831899 - RNA, 13 nt, Human
cuucugccuuuuc

SEQ ID NO: 2831900 - RNA, 15 nt, Human
cuucugcgccucagg

SEQ ID NO: 2831901 - RNA, 16 nt, Human
cuucugcgccucaggc

SEQ ID NO: 2831902 - RNA, 21 nt, Human
cuucugccuuagucucaguuu

SEQ ID NO: 2831903 - RNA, 19 nt, Human
cuucugccuuagucucagu

SEQ ID NO: 2831904 - RNA, 20 nt, Human
cuucugccuuagucucaguu

SEQ ID NO: 2831905 - RNA, 17 nt, Human
cuucugccauauucugu

SEQ ID NO: 2831906 - RNA, 15 nt, Human
cuucugccauauucu

SEQ ID NO: 2831907 - RNA, 17 nt, Human
cuucugcuucagccucc

SEQ ID NO: 2831908 - RNA, 16 nt, Human
cuucugcuucagccuc

SEQ ID NO: 2831909 - RNA, 14 nt, Human
cuucugcuccaccc

SEQ ID NO: 2831910 - RNA, 12 nt, Human
cuucugcuccac

SEQ ID NO: 2831911 - RNA, 10 nt, Human
cuucugcucc

SEQ ID NO: 2831912 - RNA, 18 nt, Human
cuucugcuucagccuccc

SEQ ID NO: 2831913 - RNA, 13 nt, Human
cuucugcuccacc

SEQ ID NO: 2831914 - RNA, 14 nt, Human
cuucuggaaacugu

SEQ ID NO: 2831915 - RNA, 18 nt, Human
cuucuggaaacugugaag

SEQ ID NO: 2831916 - RNA, 16 nt, Human
cuucuggaauuuguuc

SEQ ID NO: 2831917 - RNA, 18 nt, Human
cuucuggaauuuguucaa

SEQ ID NO: 2831918 - RNA, 15 nt, Human
cuucuggacaggcuc

SEQ ID NO: 2831919 - RNA, 18 nt, Human
cuucuggacaggcucugc

SEQ ID NO: 2831920 - RNA, 21 nt, Human
cuucuggacaggcucugcuuc

SEQ ID NO: 2831921 - RNA, 13 nt, Human
cuucuggagcccu

SEQ ID NO: 2831922 - RNA, 11 nt, Human
cuucuggagcc

SEQ ID NO: 2831923 - RNA, 14 nt, Human
cuucagcccccagc

SEQ ID NO: 2831924 - RNA, 15 nt, Human
cuucagcccccagcc

SEQ ID NO: 2831925 - RNA, 16 nt, Human
cuucagcccccagccc

SEQ ID NO: 2831926 - RNA, 17 nt, Human
cuucagcccccagcccc

SEQ ID NO: 2831927 - RNA, 18 nt, Human
cuucagcccccagccccu

SEQ ID NO: 2831928 - RNA, 20 nt, Human
cuucagcccccagccccucc

SEQ ID NO: 2831929 - RNA, 21 nt, Human
cuucagcccccagccccuccc

SEQ ID NO: 2831930 - RNA, 16 nt, Human
cuuauuuucauguaua

SEQ ID NO: 2831931 - RNA, 17 nt, Human
cuuauuuuugacagugu

SEQ ID NO: 2831932 - RNA, 13 nt, Human
cuuauuuuuccua

SEQ ID NO: 2831933 - RNA, 16 nt, Human
cuuauuuuucuaaacg

SEQ ID NO: 2831934 - RNA, 17 nt, Human
cuucagccaccucucuu

SEQ ID NO: 2831935 - RNA, 15 nt, Human
cuucagccaccucuc

SEQ ID NO: 2831936 - RNA, 15 nt, Human
cuucaaaaacuguuu

SEQ ID NO: 2831937 - RNA, 15 nt, Human
cuucaaaaguaaugc

SEQ ID NO: 2831938 - RNA, 17 nt, Human
cuucaaaaguaaugccu

SEQ ID NO: 2831939 - RNA, 20 nt, Human
cuucaaaaguaaugccucug

SEQ ID NO: 2831940 - RNA, 21 nt, Human
cuucaaaaguaaugccucugu

SEQ ID NO: 2831941 - RNA, 21 nt, Human
cuucagcauucccucccauca

SEQ ID NO: 2831942 - RNA, 16 nt, Human
cuucagcguaaaaugg

SEQ ID NO: 2831943 - RNA, 17 nt, Human
cuucagcguaaaauggu

SEQ ID NO: 2831944 - RNA, 20 nt, Human
cuucagcuagcuuuuaggaa

SEQ ID NO: 2831945 - RNA, 21 nt, Human
cuucagcuagcuuuuaggaaa

SEQ ID NO: 2831946 - RNA, 17 nt, Human
cuucagcucacgcuuca

SEQ ID NO: 2831947 - RNA, 20 nt, Human
cuucagcucacgcuucacag

SEQ ID NO: 2831948 - RNA, 11 nt, Human
cuucagcucca

SEQ ID NO: 2831949 - RNA, 15 nt, Human
cuucagcuccagccc

SEQ ID NO: 2831950 - RNA, 16 nt, Human
cuucagcuccagcccc

SEQ ID NO: 2831951 - RNA, 19 nt, Human
cuucagcuccagccccuuu

SEQ ID NO: 2831952 - RNA, 23 nt, Human
cuucagcuccagccccuuuccaa

SEQ ID NO: 2831953 - RNA, 15 nt, Human
cuucagcuccaggga

SEQ ID NO: 2831954 - RNA, 13 nt, Human
cuucagcuccagg

SEQ ID NO: 2831955 - RNA, 23 nt, Human
cuucagcuccagggaauccaagc

SEQ ID NO: 2831956 - RNA, 15 nt, Human
cuucagcucuuuuug

SEQ ID NO: 2831957 - RNA, 15 nt, Human
cuucaggccucccuc

SEQ ID NO: 2831958 - RNA, 12 nt, Human
cuucaggccucc

SEQ ID NO: 2831959 - RNA, 14 nt, Human
cuucaggcucuucu

SEQ ID NO: 2831960 - RNA, 16 nt, Human
cuucagggcugcuggg

SEQ ID NO: 2831961 - RNA, 20 nt, Human
cuucaggccucccucucucu

SEQ ID NO: 2831962 - RNA, 17 nt, Human
cuucaggggcacuucau

SEQ ID NO: 2831963 - RNA, 19 nt, Human
cuucaggggcacuucauug

SEQ ID NO: 2831964 - RNA, 15 nt, Human
cuucaggcucuucuc

SEQ ID NO: 2831965 - RNA, 16 nt, Human
cuucaggcucuucucc

SEQ ID NO: 2831966 - RNA, 17 nt, Human
cuucaggcucuucuccu

SEQ ID NO: 2831967 - RNA, 18 nt, Human
cuucaggcucuucuccuu

SEQ ID NO: 2831968 - RNA, 18 nt, Human
cuucauuuccugugucuu

SEQ ID NO: 2831969 - RNA, 18 nt, Human
cuucauuucauuguauga

SEQ ID NO: 2831970 - RNA, 19 nt, Human
cuucauuucauuguaugau

SEQ ID NO: 2831971 - RNA, 14 nt, Human
cuucauuucauugu

SEQ ID NO: 2831972 - RNA, 15 nt, Human
cuucauuucauugua

SEQ ID NO: 2831973 - RNA, 16 nt, Human
cuucauuucauuguau

SEQ ID NO: 2831974 - RNA, 17 nt, Human
cuucauuucauuguaug

SEQ ID NO: 2831975 - RNA, 15 nt, Human
cuuccaaauaauaaa

SEQ ID NO: 2831976 - RNA, 17 nt, Human
cuuccaaauaauaaagu

SEQ ID NO: 2831977 - RNA, 19 nt, Human
cuuccaaauaauaaagucu

SEQ ID NO: 2831978 - RNA, 20 nt, Human
cuuccaaauaauaaagucua

SEQ ID NO: 2831979 - RNA, 13 nt, Human
cuucauuuggaga

SEQ ID NO: 2831980 - RNA, 14 nt, Human
cuucauuuggagau

SEQ ID NO: 2831981 - RNA, 19 nt, Human
cuuccaaaugcaauuugau

SEQ ID NO: 2831982 - RNA, 21 nt, Human
cuuccaaaguaaaauugcugu

SEQ ID NO: 2831983 - RNA, 12 nt, Human
cuuccagcuccu

SEQ ID NO: 2831984 - RNA, 13 nt, Human
cuuccagcuccug

SEQ ID NO: 2831985 - RNA, 15 nt, Human
cuuccagcuccugua

SEQ ID NO: 2831986 - RNA, 12 nt, Human
cuuccagcugcu

SEQ ID NO: 2831987 - RNA, 13 nt, Human
cuuccagcugcug

SEQ ID NO: 2831988 - RNA, 14 nt, Human
cuuccagcugcugu

SEQ ID NO: 2831989 - RNA, 16 nt, Human
cuuccagcugcugucu

SEQ ID NO: 2831990 - RNA, 21 nt, Human
cuuccagcugcugucuucugg

SEQ ID NO: 2831991 - RNA, 22 nt, Human
cuuccagguguuacuguaauuc

SEQ ID NO: 2831992 - RNA, 20 nt, Human
cuuccagguguuacuguaau

SEQ ID NO: 2831993 - RNA, 19 nt, Human
cuuccagguguuacuguaa

SEQ ID NO: 2831994 - RNA, 16 nt, Human
cuuccagguguuacug

SEQ ID NO: 2831995 - RNA, 19 nt, Human
cuuccaggugcccagcuau

SEQ ID NO: 2831996 - RNA, 16 nt, Human
cuuccaggugcccagc

SEQ ID NO: 2831997 - RNA, 14 nt, Human
cuuccagcuccugu

SEQ ID NO: 2831998 - RNA, 18 nt, Human
cuucccagguucaagcga

SEQ ID NO: 2831999 - RNA, 14 nt, Human
cuucccaguggcug

SEQ ID NO: 2832000 - RNA, 15 nt, Human
cuucccgcucagccc

SEQ ID NO: 2832001 - RNA, 15 nt, Human
cuucccgccagaggg

SEQ ID NO: 2832002 - RNA, 19 nt, Human
cuucccgccagagggcuug

SEQ ID NO: 2832003 - RNA, 15 nt, Human
cuucccucaguccca

SEQ ID NO: 2832004 - RNA, 13 nt, Human
cuucccuauuuau

SEQ ID NO: 2832005 - RNA, 15 nt, Human
cuucccucacaccgc

SEQ ID NO: 2832006 - RNA, 16 nt, Human
cuucccgcucagcccu

SEQ ID NO: 2832007 - RNA, 17 nt, Human
cuucccgcucagcccuc

SEQ ID NO: 2832008 - RNA, 13 nt, Human
cuuccgacccucu

SEQ ID NO: 2832009 - RNA, 15 nt, Human
cuuccgacccucugg

SEQ ID NO: 2832010 - RNA, 17 nt, Human
cuuccgacccucuggga

SEQ ID NO: 2832011 - RNA, 18 nt, Human
cuuccgacccucugggaa

SEQ ID NO: 2832012 - RNA, 19 nt, Human
cuuccgacccucugggaac

SEQ ID NO: 2832013 - RNA, 21 nt, Human
cuuccgacccucugggaaccu

SEQ ID NO: 2832014 - RNA, 22 nt, Human
cuuccgacccucugggaaccuc

SEQ ID NO: 2832015 - RNA, 23 nt, Human
cuuccgacccucugggaaccucc

SEQ ID NO: 2832016 - RNA, 22 nt, Human
cuuccgauggaugaaucuccca

SEQ ID NO: 2832017 - RNA, 14 nt, Human
cuucccucuucccu

SEQ ID NO: 2832018 - RNA, 15 nt, Human
cuucccucuucccuc

SEQ ID NO: 2832019 - RNA, 14 nt, Human
cuuccgccccugcc

SEQ ID NO: 2832020 - RNA, 15 nt, Human
cuuccgccccugccu

SEQ ID NO: 2832021 - RNA, 16 nt, Human
cuuccgccccugccug

SEQ ID NO: 2832022 - RNA, 17 nt, Human
cuuccgccccugccugc

SEQ ID NO: 2832023 - RNA, 18 nt, Human
cuuccgccccugccugcc

SEQ ID NO: 2832024 - RNA, 20 nt, Human
cuuccgccccugccugccau

SEQ ID NO: 2832025 - RNA, 22 nt, Human
cuuccgccccugccugccaugu

SEQ ID NO: 2832026 - RNA, 15 nt, Human
cuuccgccccuuccc

SEQ ID NO: 2832027 - RNA, 18 nt, Human
cuuccgccccuucccuuc

SEQ ID NO: 2832028 - RNA, 19 nt, Human
cuuccgccccuucccuucc

SEQ ID NO: 2832029 - RNA, 18 nt, Human
cuuccuacaagagcagcc

SEQ ID NO: 2832030 - RNA, 16 nt, Human
cuuccgguagggaggc

SEQ ID NO: 2832031 - RNA, 21 nt, Human
cuuccuaauuucccuucuugc

SEQ ID NO: 2832032 - RNA, 22 nt, Human
cuuccuaauuucccuucuugca

SEQ ID NO: 2832033 - RNA, 23 nt, Human
cuuccuaauuucccuucuugcau

SEQ ID NO: 2832034 - RNA, 24 nt, Human
cuuccuacaagagcagccuguggc

SEQ ID NO: 2832035 - RNA, 22 nt, Human
cuuccuacaagagcagccugug

SEQ ID NO: 2832036 - RNA, 21 nt, Human
cuuccuacaagagcagccugu

SEQ ID NO: 2832037 - RNA, 16 nt, Human
cuuccuacccacaccu

SEQ ID NO: 2832038 - RNA, 18 nt, Human
cuuccuacccacaccucu

SEQ ID NO: 2832039 - RNA, 19 nt, Human
cuuccuacccacaccucug

SEQ ID NO: 2832040 - RNA, 22 nt, Human
cuuccuacccacaccucugcca

SEQ ID NO: 2832041 - RNA, 19 nt, Human
cuuauaagugaagugauac

SEQ ID NO: 2832042 - RNA, 17 nt, Human
cuuauaagguguuuucu

SEQ ID NO: 2832043 - RNA, 20 nt, Human
cuuauaagguguuuucugug

SEQ ID NO: 2832044 - RNA, 21 nt, Human
cuuauaagguguuuucugugu

SEQ ID NO: 2832045 - RNA, 22 nt, Human
cuuauaagguguuuucugugua

SEQ ID NO: 2832046 - RNA, 23 nt, Human
cuuauaagguguuuucuguguaa

SEQ ID NO: 2832047 - RNA, 13 nt, Human
cuuauaaaucaua

SEQ ID NO: 2832048 - RNA, 18 nt, Human
cuuauaaaucauauugau

SEQ ID NO: 2832049 - RNA, 21 nt, Human
cuuauaaaucauauugaugaa

SEQ ID NO: 2832050 - RNA, 22 nt, Human
cuuauaaaucauauugaugaaa

SEQ ID NO: 2832051 - RNA, 20 nt, Human
cuuauaauaaaggacuguaa

SEQ ID NO: 2832052 - RNA, 13 nt, Human
cuuauaauacucu

SEQ ID NO: 2832053 - RNA, 16 nt, Human
cuuauaauacucuguu

SEQ ID NO: 2832054 - RNA, 19 nt, Human
cuuauaauacucuguugua

SEQ ID NO: 2832055 - RNA, 16 nt, Human
cuuauaauaaaggacu

SEQ ID NO: 2832056 - RNA, 14 nt, Human
cuuauaauaaagga

SEQ ID NO: 2832057 - RNA, 21 nt, Human
cuuagguggcaagcugugacu

SEQ ID NO: 2832058 - RNA, 20 nt, Human
cuuaggugauccacucgccu

SEQ ID NO: 2832059 - RNA, 20 nt, Human
cuuauaagugaagugauacu

SEQ ID NO: 2832060 - RNA, 17 nt, Human
cuuauaauaaaggacug

SEQ ID NO: 2832061 - RNA, 14 nt, Human
cuuauaguucuagg

SEQ ID NO: 2832062 - RNA, 15 nt, Human
cuuauaguucuaggc

SEQ ID NO: 2832063 - RNA, 19 nt, Human
cuuauauucaaccauggac

SEQ ID NO: 2832064 - RNA, 21 nt, Human
cuuauauucaaccauggacuu

SEQ ID NO: 2832065 - RNA, 16 nt, Human
cuuauauugaagacaa

SEQ ID NO: 2832066 - RNA, 18 nt, Human
cuuauauugaagacaauu

SEQ ID NO: 2832067 - RNA, 23 nt, Human
cuuauauugaagacaauuugaua

SEQ ID NO: 2832068 - RNA, 12 nt, Human
cuuauacacauu

SEQ ID NO: 2832069 - RNA, 23 nt, Human
cuuauagucaauguuucuuuuau

SEQ ID NO: 2832070 - RNA, 19 nt, Human
cuuauaguacaugauaaau

SEQ ID NO: 2832071 - RNA, 13 nt, Human
cuuauagguggcc

SEQ ID NO: 2832072 - RNA, 14 nt, Human
cuuauagguguugg

SEQ ID NO: 2832073 - RNA, 17 nt, Human
cuuauaguacaugauaa

SEQ ID NO: 2832074 - RNA, 13 nt, Human
cuuauaguacaug

SEQ ID NO: 2832075 - RNA, 12 nt, Human
cuuauuuucaag

SEQ ID NO: 2832076 - RNA, 19 nt, Human
cuuauuuucaagaaacuga

SEQ ID NO: 2832077 - RNA, 18 nt, Human
cuuauuuucaagaaacug

SEQ ID NO: 2832078 - RNA, 15 nt, Human
cuuauuuucaagaaa

SEQ ID NO: 2832079 - RNA, 14 nt, Human
cuuauuuucaagaa

SEQ ID NO: 2832080 - RNA, 15 nt, Human
cuuaugauugcagau

SEQ ID NO: 2832081 - RNA, 18 nt, Human
cuuaugacuugcuacuuu

SEQ ID NO: 2832082 - RNA, 13 nt, Human
cuuaugagaaacu

SEQ ID NO: 2832083 - RNA, 14 nt, Human
cuuaugcaaaaugg

SEQ ID NO: 2832084 - RNA, 15 nt, Human
cuuaugcaaaaugga

SEQ ID NO: 2832085 - RNA, 16 nt, Human
cuuaugcaaaauggaa

SEQ ID NO: 2832086 - RNA, 20 nt, Human
cuuauuguggauaacaaaga

SEQ ID NO: 2832087 - RNA, 23 nt, Human
cuuaugauucagauuguuaucua

SEQ ID NO: 2832088 - RNA, 15 nt, Human
cuuaugaauauauuu

SEQ ID NO: 2832089 - RNA, 12 nt, Human
cuuaugaauguu

SEQ ID NO: 2832090 - RNA, 14 nt, Human
cuuaugaauguuuc

SEQ ID NO: 2832091 - RNA, 15 nt, Human
cuuaugaauguuucc

SEQ ID NO: 2832092 - RNA, 17 nt, Human
cuuaugaauguuuccgg

SEQ ID NO: 2832093 - RNA, 21 nt, Human
cuuaugacaucacuuguacaa

SEQ ID NO: 2832094 - RNA, 20 nt, Human
cuuaugaggguccucuacuu

SEQ ID NO: 2832095 - RNA, 22 nt, Human
cuuaugacaucacuuguacaaa

SEQ ID NO: 2832096 - RNA, 22 nt, Human
cuuaucugugcucaggacucag

SEQ ID NO: 2832097 - RNA, 15 nt, Human
cuuaucucucugugc

SEQ ID NO: 2832098 - RNA, 16 nt, Human
cuuaucugugcucagg

SEQ ID NO: 2832099 - RNA, 14 nt, Human
cuuaucugugcuca

SEQ ID NO: 2832100 - RNA, 12 nt, Human
cuuaucucucug

SEQ ID NO: 2832101 - RNA, 16 nt, Human
cuuaucuccaagacca

SEQ ID NO: 2832102 - RNA, 14 nt, Human
cuuaucuccaagac

SEQ ID NO: 2832103 - RNA, 13 nt, Human
cuuaucuccaaga

SEQ ID NO: 2832104 - RNA, 13 nt, Human
cuuaucucucugu

SEQ ID NO: 2832105 - RNA, 14 nt, Human
cuuaucucucugug

SEQ ID NO: 2832106 - RNA, 21 nt, Human
cuuaucucucugugcugugga

SEQ ID NO: 2832107 - RNA, 12 nt, Human
cuuaucucuuuu

SEQ ID NO: 2832108 - RNA, 21 nt, Human
cuuaucucuuuuauauuugua

SEQ ID NO: 2832109 - RNA, 18 nt, Human
cuuaucugagcugagcca

SEQ ID NO: 2832110 - RNA, 20 nt, Human
cuuaucugagcugagccagg

SEQ ID NO: 2832111 - RNA, 21 nt, Human
cuuaucugagcugagccaggc

SEQ ID NO: 2832112 - RNA, 22 nt, Human
cuuaucugagcugagccaggcu

SEQ ID NO: 2832113 - RNA, 21 nt, Human
cuuaucaaggacucugguuuc

SEQ ID NO: 2832114 - RNA, 16 nt, Human
cuuaucaaaggacacc

SEQ ID NO: 2832115 - RNA, 21 nt, Human
cuuaucucagucaugcauaaa

SEQ ID NO: 2832116 - RNA, 22 nt, Human
cuuaucucagucaugcauaaau

SEQ ID NO: 2832117 - RNA, 23 nt, Human
cuuaucucagucaugcauaaaua

SEQ ID NO: 2832118 - RNA, 14 nt, Human
cuuaucaaaggaca

SEQ ID NO: 2832119 - RNA, 14 nt, Human
cuuauauuucccua

SEQ ID NO: 2832120 - RNA, 19 nt, Human
cuuauauuucccuaaaaua

SEQ ID NO: 2832121 - RNA, 23 nt, Human
cuuauauuucccuaaaauacauu

SEQ ID NO: 2832122 - RNA, 15 nt, Human
cuuauauuuucguau

SEQ ID NO: 2832123 - RNA, 19 nt, Human
cuuauauuuucguaugaaa

SEQ ID NO: 2832124 - RNA, 20 nt, Human
cuuauauuuucguaugaaaa

SEQ ID NO: 2832125 - RNA, 21 nt, Human
cuuauauuuucguaugaaaau

SEQ ID NO: 2832126 - RNA, 22 nt, Human
cuuauauuuucguaugaaaaug

SEQ ID NO: 2832127 - RNA, 22 nt, Human
cuuagggugaaccacuucauuc

SEQ ID NO: 2832128 - RNA, 14 nt, Human
cuuagaguuucugu

SEQ ID NO: 2832129 - RNA, 17 nt, Human
cuuagaguuucuguuug

SEQ ID NO: 2832130 - RNA, 18 nt, Human
cuuagaguuucuguuuga

SEQ ID NO: 2832131 - RNA, 22 nt, Human
cuuagaguuucuguuugauucu

SEQ ID NO: 2832132 - RNA, 23 nt, Human
cuuagaguuucuguuugauucuu

SEQ ID NO: 2832133 - RNA, 19 nt, Human
cuuagagggauuucuuugc

SEQ ID NO: 2832134 - RNA, 20 nt, Human
cuuagagggauuucuuugcu

SEQ ID NO: 2832135 - RNA, 21 nt, Human
cuuagagggauuucuuugcug

SEQ ID NO: 2832136 - RNA, 16 nt, Human
cuuagacauaacaaaa

SEQ ID NO: 2832137 - RNA, 15 nt, Human
cuuagaagucacaca

SEQ ID NO: 2832138 - RNA, 17 nt, Human
cuuagaaauugcauuuc

SEQ ID NO: 2832139 - RNA, 15 nt, Human
cuuagaaccuuucuu

SEQ ID NO: 2832140 - RNA, 15 nt, Human
cuuacuaauguaaaa

SEQ ID NO: 2832141 - RNA, 18 nt, Human
cuuacuaauguaaaauga

SEQ ID NO: 2832142 - RNA, 16 nt, Human
cuuacuacacugagga

SEQ ID NO: 2832143 - RNA, 21 nt, Human
cuuacuauucauuaaauguuu

SEQ ID NO: 2832144 - RNA, 23 nt, Human
cuuacuauucauuaaauguuuga

SEQ ID NO: 2832145 - RNA, 11 nt, Human
cuuacuauuuc

SEQ ID NO: 2832146 - RNA, 13 nt, Human
cuuacuauuucug

SEQ ID NO: 2832147 - RNA, 22 nt, Human
cuuacuauuucugggucuuuug

SEQ ID NO: 2832148 - RNA, 12 nt, Human
cuuacuauuuug

SEQ ID NO: 2832149 - RNA, 22 nt, Human
cuuacuauuuugacaguuauuu

SEQ ID NO: 2832150 - RNA, 14 nt, Human
cuuacuaaaauaua

SEQ ID NO: 2832151 - RNA, 15 nt, Human
cuuacuaaaauauau

SEQ ID NO: 2832152 - RNA, 22 nt, Human
cuuacuaaaauauauauagaaa

SEQ ID NO: 2832153 - RNA, 16 nt, Human
cuuacgaauauuuuca

SEQ ID NO: 2832154 - RNA, 17 nt, Human
cuuacgaauauuuucag

SEQ ID NO: 2832155 - RNA, 20 nt, Human
cuuacgaauauuuucaguaa

SEQ ID NO: 2832156 - RNA, 15 nt, Human
cuuacgaucaggcac

SEQ ID NO: 2832157 - RNA, 16 nt, Human
cuuacgaucaggcaca

SEQ ID NO: 2832158 - RNA, 17 nt, Human
cuuacgaucaggcacag

SEQ ID NO: 2832159 - RNA, 21 nt, Human
cuuacgaucaggcacagguca

SEQ ID NO: 2832160 - RNA, 14 nt, Human
cuuacgcuuuguca

SEQ ID NO: 2832161 - RNA, 18 nt, Human
cuuacggccaucucuuug

SEQ ID NO: 2832162 - RNA, 16 nt, Human
cuuacuguggaggaag

SEQ ID NO: 2832163 - RNA, 17 nt, Human
cuuacuguggaggaagg

SEQ ID NO: 2832164 - RNA, 18 nt, Human
cuuacuguggaggaagga

SEQ ID NO: 2832165 - RNA, 15 nt, Human
cuuacuguaccuguu

SEQ ID NO: 2832166 - RNA, 18 nt, Human
cuuacuguaccuguuccu

SEQ ID NO: 2832167 - RNA, 23 nt, Human
cuuacuguaccuguuccuuagac

SEQ ID NO: 2832168 - RNA, 12 nt, Human
cuuacuccuccu

SEQ ID NO: 2832169 - RNA, 13 nt, Human
cuuacuccuccuc

SEQ ID NO: 2832170 - RNA, 14 nt, Human
cuuacuccuccucu

SEQ ID NO: 2832171 - RNA, 15 nt, Human
cuuacuccuccucuu

SEQ ID NO: 2832172 - RNA, 16 nt, Human
cuuacuccuccucuuu

SEQ ID NO: 2832173 - RNA, 18 nt, Human
cuuacuccuccucuuucu

SEQ ID NO: 2832174 - RNA, 22 nt, Human
cuuacuccuccucuuucucucc

SEQ ID NO: 2832175 - RNA, 23 nt, Human
cuuacuccuccucuuucucuccc

SEQ ID NO: 2832176 - RNA, 20 nt, Human
cuuacuuuccuuuccccagc

SEQ ID NO: 2832177 - RNA, 21 nt, Human
cuuacuuuccuuuccccagcc

SEQ ID NO: 2832178 - RNA, 22 nt, Human
cuuacuuuccuuuccccagccc

SEQ ID NO: 2832179 - RNA, 23 nt, Human
cuuacuuuccuuuccccagccca

SEQ ID NO: 2832180 - RNA, 14 nt, Human
cuuacuucuugccc

SEQ ID NO: 2832181 - RNA, 15 nt, Human
cuuacuucuugcccu

SEQ ID NO: 2832182 - RNA, 16 nt, Human
cuuacuucuugcccug

SEQ ID NO: 2832183 - RNA, 19 nt, Human
cuuacuuacuaaaauauau

SEQ ID NO: 2832184 - RNA, 16 nt, Human
cuuacuuacuaaaaua

SEQ ID NO: 2832185 - RNA, 19 nt, Human
cuuacuguggaggaaggau

SEQ ID NO: 2832186 - RNA, 17 nt, Human
cuguuuuggguagcugc

SEQ ID NO: 2832187 - RNA, 17 nt, Human
cuguuuugaaggcaaaa

SEQ ID NO: 2832188 - RNA, 18 nt, Human
cuguuuucuucuauucca

SEQ ID NO: 2832189 - RNA, 12 nt, Human
cuguuuucuucu

SEQ ID NO: 2832190 - RNA, 20 nt, Human
cuguuuuguacauagauuua

SEQ ID NO: 2832191 - RNA, 14 nt, Human
cuguuuuuccauag

SEQ ID NO: 2832192 - RNA, 18 nt, Human
cuguuuuuccauaguuuu

SEQ ID NO: 2832193 - RNA, 21 nt, Human
cuguuuuucuggguggccucg

SEQ ID NO: 2832194 - RNA, 15 nt, Human
cuguuuuucugggug

SEQ ID NO: 2832195 - RNA, 17 nt, Human
cuguuuuguuuggcaag

SEQ ID NO: 2832196 - RNA, 22 nt, Human
cuguuuauggccucagcugccu

SEQ ID NO: 2832197 - RNA, 21 nt, Human
cuguuuauggccacauuuaau

SEQ ID NO: 2832198 - RNA, 21 nt, Human
cuguuuauggccucagcugcc

SEQ ID NO: 2832199 - RNA, 19 nt, Human
cuguuuauggccucagcug

SEQ ID NO: 2832200 - RNA, 18 nt, Human
cuguuuauggccucagcu

SEQ ID NO: 2832201 - RNA, 17 nt, Human
cuguuuauggccucagc

SEQ ID NO: 2832202 - RNA, 12 nt, Human
cuguuucccagc

SEQ ID NO: 2832203 - RNA, 11 nt, Human
cuguuuccugu

SEQ ID NO: 2832204 - RNA, 15 nt, Human
cuguuucccagcagu

SEQ ID NO: 2832205 - RNA, 21 nt, Human
cuguuucccagcaguggacuc

SEQ ID NO: 2832206 - RNA, 16 nt, Human
cuguuucccuucccuu

SEQ ID NO: 2832207 - RNA, 19 nt, Human
cuguuucccuucccuucca

SEQ ID NO: 2832208 - RNA, 21 nt, Human
cuguuucccuucccuuccacu

SEQ ID NO: 2832209 - RNA, 22 nt, Human
cuguuucucuugagcuggccuc

SEQ ID NO: 2832210 - RNA, 21 nt, Human
cuguuucucuugagcuggccu

SEQ ID NO: 2832211 - RNA, 12 nt, Human
cuguuucugaaa

SEQ ID NO: 2832212 - RNA, 15 nt, Human
cuguuucugaaaaga

SEQ ID NO: 2832213 - RNA, 16 nt, Human
cuguuucugaaaagaa

SEQ ID NO: 2832214 - RNA, 17 nt, Human
cuguuucugaaaagaaa

SEQ ID NO: 2832215 - RNA, 18 nt, Human
cuguuucugaaaagaaau

SEQ ID NO: 2832216 - RNA, 19 nt, Human
cuguuucugaaaagaaaua

SEQ ID NO: 2832217 - RNA, 21 nt, Human
cuguuucugaaaagaaauaau

SEQ ID NO: 2832218 - RNA, 20 nt, Human
cuguuucucuugagcuggcc

SEQ ID NO: 2832219 - RNA, 17 nt, Human
cuguuucucuugagcug

SEQ ID NO: 2832220 - RNA, 16 nt, Human
cuguuucucuugagcu

SEQ ID NO: 2832221 - RNA, 15 nt, Human
cuguuucucuugagc

SEQ ID NO: 2832222 - RNA, 11 nt, Human
cuguuucucau

SEQ ID NO: 2832223 - RNA, 21 nt, Human
cuguuucucugccgcuaccuc

SEQ ID NO: 2832224 - RNA, 15 nt, Human
cuguuuccuuuuaug

SEQ ID NO: 2832225 - RNA, 13 nt, Human
cuguuuccuuuua

SEQ ID NO: 2832226 - RNA, 17 nt, Human
cuguuuaccauuuuuca

SEQ ID NO: 2832227 - RNA, 16 nt, Human
cuguuuauggccucag

SEQ ID NO: 2832228 - RNA, 15 nt, Human
cuguuuauggccuca

SEQ ID NO: 2832229 - RNA, 14 nt, Human
cuguuuauggccuc

SEQ ID NO: 2832230 - RNA, 13 nt, Human
cuguuuauggccu

SEQ ID NO: 2832231 - RNA, 16 nt, Human
cuguuuauauguguug

SEQ ID NO: 2832232 - RNA, 20 nt, Human
cuguuuauauguguugaaaa

SEQ ID NO: 2832233 - RNA, 22 nt, Human
cugguucuucauuuauugagca

SEQ ID NO: 2832234 - RNA, 23 nt, Human
cugguucugaugaugugccuggg

SEQ ID NO: 2832235 - RNA, 13 nt, Human
cugguugaagaag

SEQ ID NO: 2832236 - RNA, 19 nt, Human
cugguugaagaagaugauc

SEQ ID NO: 2832237 - RNA, 17 nt, Human
cugguugaugccuguga

SEQ ID NO: 2832238 - RNA, 15 nt, Human
cuguuuaauguucug

SEQ ID NO: 2832239 - RNA, 21 nt, Human
cuguuuaauauuuaaacagca

SEQ ID NO: 2832240 - RNA, 23 nt, Human
cuuaauccguaguuauuuugcac

SEQ ID NO: 2832241 - RNA, 22 nt, Human
cuuaaucagguccucagagaau

SEQ ID NO: 2832242 - RNA, 20 nt, Human
cuuaaucagguccucagaga

SEQ ID NO: 2832243 - RNA, 20 nt, Human
cuuaauaaaaacuuacacuc

SEQ ID NO: 2832244 - RNA, 14 nt, Human
cuuaauaaaaauga

SEQ ID NO: 2832245 - RNA, 16 nt, Human
cuuaauaaaaaugaca

SEQ ID NO: 2832246 - RNA, 17 nt, Human
cuuaauaaaaaugacag

SEQ ID NO: 2832247 - RNA, 18 nt, Human
cuuaauaaaaaugacaga

SEQ ID NO: 2832248 - RNA, 20 nt, Human
cuuaauaaaaaugacagacu

SEQ ID NO: 2832249 - RNA, 21 nt, Human
cuuaauaaaaaugacagacug

SEQ ID NO: 2832250 - RNA, 16 nt, Human
cuuaaguuuauacucu

SEQ ID NO: 2832251 - RNA, 12 nt, Human
cuuaagagaaau

SEQ ID NO: 2832252 - RNA, 16 nt, Human
cuuaagagaaauggca

SEQ ID NO: 2832253 - RNA, 17 nt, Human
cuuaagagaugccucau

SEQ ID NO: 2832254 - RNA, 14 nt, Human
cuuaagcaaaagaa

SEQ ID NO: 2832255 - RNA, 15 nt, Human
cuuaagcaaaagaaa

SEQ ID NO: 2832256 - RNA, 17 nt, Human
cuuaagcaaaagaaaaa

SEQ ID NO: 2832257 - RNA, 18 nt, Human
cuuaagcaaaagaaaaag

SEQ ID NO: 2832258 - RNA, 11 nt, Human
cuuaagcacaa

SEQ ID NO: 2832259 - RNA, 20 nt, Human
cuuaagucacccuagcccuc

SEQ ID NO: 2832260 - RNA, 13 nt, Human
cuuaagcccuggc

SEQ ID NO: 2832261 - RNA, 14 nt, Human
cuuaagcccuggcc

SEQ ID NO: 2832262 - RNA, 16 nt, Human
cuuaagcccuggcccc

SEQ ID NO: 2832263 - RNA, 11 nt, Human
cuuaacuauuc

SEQ ID NO: 2832264 - RNA, 22 nt, Human
cuuaacuuaaauuuuaauuuau

SEQ ID NO: 2832265 - RNA, 21 nt, Human
cuuaaauuugauuuacauaua

SEQ ID NO: 2832266 - RNA, 13 nt, Human
cuuaacccaagga

SEQ ID NO: 2832267 - RNA, 14 nt, Human
cuuaacccaaggag

SEQ ID NO: 2832268 - RNA, 16 nt, Human
cuuaacccaaggagca

SEQ ID NO: 2832269 - RNA, 17 nt, Human
cuuaacccaaggagcac

SEQ ID NO: 2832270 - RNA, 16 nt, Human
cuuaaauuuuaauuua

SEQ ID NO: 2832271 - RNA, 23 nt, Human
cuuaaauuggguucaugaugcag

SEQ ID NO: 2832272 - RNA, 15 nt, Human
cuguuuuuuuuucau

SEQ ID NO: 2832273 - RNA, 16 nt, Human
cuguuuuuuuuucauu

SEQ ID NO: 2832274 - RNA, 19 nt, Human
cuuaaaaaaaaaaaaaagc

SEQ ID NO: 2832275 - RNA, 20 nt, Human
cuuaaaaaaaaaaaaaagcu

SEQ ID NO: 2832276 - RNA, 21 nt, Human
cuuaaaaaaaaaaaaaagcuu

SEQ ID NO: 2832277 - RNA, 22 nt, Human
cuuaaaaaaaaaaaaaagcuuu

SEQ ID NO: 2832278 - RNA, 23 nt, Human
cuuaaaaaaaaaaaaaagcuuua

SEQ ID NO: 2832279 - RNA, 13 nt, Human
cuguuuuuuaguu

SEQ ID NO: 2832280 - RNA, 13 nt, Human
cuguuuuuguugu

SEQ ID NO: 2832281 - RNA, 14 nt, Human
cuguuuuuguugug

SEQ ID NO: 2832282 - RNA, 20 nt, Human
cuguuuuuguuuauuucauu

SEQ ID NO: 2832283 - RNA, 15 nt, Human
cuuaaauaucuuuua

SEQ ID NO: 2832284 - RNA, 16 nt, Human
cuuaaauaucuuuuau

SEQ ID NO: 2832285 - RNA, 22 nt, Human
cuuaaauaucuuuuauguuuga

SEQ ID NO: 2832286 - RNA, 13 nt, Human
cuuaaauauaguu

SEQ ID NO: 2832287 - RNA, 15 nt, Human
cuuaaauauaguucc

SEQ ID NO: 2832288 - RNA, 22 nt, Human
cuuaaauauaguuccuaagaag

SEQ ID NO: 2832289 - RNA, 21 nt, Human
cuuaaauguagcaauggcacu

SEQ ID NO: 2832290 - RNA, 22 nt, Human
gaaaagucaaggguaggguggg

SEQ ID NO: 2832291 - RNA, 12 nt, Human
gaaaaguauuuu

SEQ ID NO: 2832292 - RNA, 14 nt, Human
gaaaaguauuuuga

SEQ ID NO: 2832293 - RNA, 17 nt, Human
gaaaaguauuuugaagu

SEQ ID NO: 2832294 - RNA, 18 nt, Human
gaaaaguauuuugaaguu

SEQ ID NO: 2832295 - RNA, 19 nt, Human
gaaaaguauuuugaaguuu

SEQ ID NO: 2832296 - RNA, 23 nt, Human
gaaaaguauuuugaaguuuacau

SEQ ID NO: 2832297 - RNA, 18 nt, Human
gaaaagucacuuacuauu

SEQ ID NO: 2832298 - RNA, 23 nt, Human
gaaaaguagacaaucauuguuuu

SEQ ID NO: 2832299 - RNA, 14 nt, Human
gaaaaccccagcau

SEQ ID NO: 2832300 - RNA, 21 nt, Human
gaaaaccuaaguccuuuaugu

SEQ ID NO: 2832301 - RNA, 13 nt, Human
gaaaacggagcug

SEQ ID NO: 2832302 - RNA, 14 nt, Human
gaaaacggagcuga

SEQ ID NO: 2832303 - RNA, 13 nt, Human
gaaaaccucuccu

SEQ ID NO: 2832304 - RNA, 19 nt, Human
gaaaagggaaguugugccu

SEQ ID NO: 2832305 - RNA, 23 nt, Human
gaaaagguagcuuaccugacaca

SEQ ID NO: 2832306 - RNA, 23 nt, Human
gaaaagguucuucaucccuuucc

SEQ ID NO: 2832307 - RNA, 19 nt, Human
gaaaacaaaauuuuauuuu

SEQ ID NO: 2832308 - RNA, 11 nt, Human
cuuuuuuacuc

SEQ ID NO: 2832309 - RNA, 13 nt, Human
cuuuuuuacucau

SEQ ID NO: 2832310 - RNA, 19 nt, Human
cuuuuuuacucauugaaau

SEQ ID NO: 2832311 - RNA, 20 nt, Human
cuuuuuuacucauugaaaug

SEQ ID NO: 2832312 - RNA, 21 nt, Human
cuuuuuuacucauugaaaugu

SEQ ID NO: 2832313 - RNA, 23 nt, Human
cuuuuuuacucauugaaauguca

SEQ ID NO: 2832314 - RNA, 20 nt, Human
cuuuuuuaagauuuuucuca

SEQ ID NO: 2832315 - RNA, 21 nt, Human
cuuuuuuaagauuuuucucaa

SEQ ID NO: 2832316 - RNA, 16 nt, Human
cuuuuuuaauaaacua

SEQ ID NO: 2832317 - RNA, 20 nt, Human
gaaaaauagugucuuuguga

SEQ ID NO: 2832318 - RNA, 17 nt, Human
gaaaaauagugucuuug

SEQ ID NO: 2832319 - RNA, 19 nt, Human
gaaaaauaacuucaagcaa

SEQ ID NO: 2832320 - RNA, 16 nt, Human
gaaaaauagcaacuug

SEQ ID NO: 2832321 - RNA, 17 nt, Human
gaaaaauagcaacuugu

SEQ ID NO: 2832322 - RNA, 19 nt, Human
gaaaaauauauacuaaaca

SEQ ID NO: 2832323 - RNA, 20 nt, Human
gaaaaauucagcaaaccauu

SEQ ID NO: 2832324 - RNA, 15 nt, Human
gaaaaaucacuugau

SEQ ID NO: 2832325 - RNA, 21 nt, Human
gaaaaaucacuugauucauaa

SEQ ID NO: 2832326 - RNA, 20 nt, Human
cuuuguuuucugacuaauua

SEQ ID NO: 2832327 - RNA, 24 nt, Human
cuuuguuuugauguuuguggccuc

SEQ ID NO: 2832328 - RNA, 17 nt, Human
cuuuguuuucugacuaa

SEQ ID NO: 2832329 - RNA, 23 nt, Human
cuuuguuuugauguuuguggccu

SEQ ID NO: 2832330 - RNA, 19 nt, Human
cuuuguuuugauguuugug

SEQ ID NO: 2832331 - RNA, 17 nt, Human
cuuuguuuuacugucuu

SEQ ID NO: 2832332 - RNA, 16 nt, Human
cuuugugguuuuaugg

SEQ ID NO: 2832333 - RNA, 17 nt, Human
cuuuguguagcuuugcu

SEQ ID NO: 2832334 - RNA, 11 nt, Human
cuuuguugcac

SEQ ID NO: 2832335 - RNA, 15 nt, Human
cuuuguugcacugaa

SEQ ID NO: 2832336 - RNA, 16 nt, Human
cuuuguugcccaggcu

SEQ ID NO: 2832337 - RNA, 15 nt, Human
cuuuucugcagaggg

SEQ ID NO: 2832338 - RNA, 12 nt, Human
cuuuucugcaga

SEQ ID NO: 2832339 - RNA, 14 nt, Human
cuuuugaacccagg

SEQ ID NO: 2832340 - RNA, 13 nt, Human
cuuuugaacccag

SEQ ID NO: 2832341 - RNA, 14 nt, Human
cuuuucuuuuucuc

SEQ ID NO: 2832342 - RNA, 14 nt, Human
cuuuucuuccuggc

SEQ ID NO: 2832343 - RNA, 15 nt, Human
cuuuucuuccuggcu

SEQ ID NO: 2832344 - RNA, 14 nt, Human
cuuuucuucuaugu

SEQ ID NO: 2832345 - RNA, 22 nt, Human
cuuuucuuuuguuacuguucuu

SEQ ID NO: 2832346 - RNA, 14 nt, Human
cuuuucuuuuuaca

SEQ ID NO: 2832347 - RNA, 15 nt, Human
cuuuucuuuuuacau

SEQ ID NO: 2832348 - RNA, 16 nt, Human
cuuuucuuuuuacaua

SEQ ID NO: 2832349 - RNA, 23 nt, Human
cuuuucuuuuuacauaacugccu

SEQ ID NO: 2832350 - RNA, 12 nt, Human
cuuuucuguuuc

SEQ ID NO: 2832351 - RNA, 19 nt, Human
cuuuucuguuuccuguacc

SEQ ID NO: 2832352 - RNA, 13 nt, Human
cuuuucuuaacaa

SEQ ID NO: 2832353 - RNA, 18 nt, Human
cuuuucuuaacaaccugg

SEQ ID NO: 2832354 - RNA, 19 nt, Human
cuuuucuuaacaaccuggc

SEQ ID NO: 2832355 - RNA, 14 nt, Human
cuuuucuuacuccu

SEQ ID NO: 2832356 - RNA, 15 nt, Human
cuuuucuuacuccuc

SEQ ID NO: 2832357 - RNA, 17 nt, Human
cuuuucuuacuccuccu

SEQ ID NO: 2832358 - RNA, 18 nt, Human
cuuuucuuacuccuccuc

SEQ ID NO: 2832359 - RNA, 19 nt, Human
cuuuucuuacuccuccucu

SEQ ID NO: 2832360 - RNA, 23 nt, Human
cuuuucuuacuccuccucuuucu

SEQ ID NO: 2832361 - RNA, 17 nt, Human
cuuuuuuaaaaaagcaa

SEQ ID NO: 2832362 - RNA, 18 nt, Human
cuuuuuuaaaaucaacuu

SEQ ID NO: 2832363 - RNA, 13 nt, Human
cuuuuuuaaauaa

SEQ ID NO: 2832364 - RNA, 14 nt, Human
cuuuuuuaaauaaa

SEQ ID NO: 2832365 - RNA, 15 nt, Human
cuuuuuuaaauaaac

SEQ ID NO: 2832366 - RNA, 17 nt, Human
cuuuuuuaaauaaacuu

SEQ ID NO: 2832367 - RNA, 18 nt, Human
cuuuuuuaaauaaacuuu

SEQ ID NO: 2832368 - RNA, 19 nt, Human
cuuuuuuaaauaaacuuuu

SEQ ID NO: 2832369 - RNA, 15 nt, Human
cuuuuucauccccuu

SEQ ID NO: 2832370 - RNA, 16 nt, Human
cuuuuucauccccuua

SEQ ID NO: 2832371 - RNA, 17 nt, Human
cuuuuucauccccuuac

SEQ ID NO: 2832372 - RNA, 23 nt, Human
cuuuuugaaaugaaauuuaaaca

SEQ ID NO: 2832373 - RNA, 19 nt, Human
cuuuuugaauguuauuugu

SEQ ID NO: 2832374 - RNA, 11 nt, Human
cuuuuugaaug

SEQ ID NO: 2832375 - RNA, 16 nt, Human
cuuuuuaaaguguuuc

SEQ ID NO: 2832376 - RNA, 18 nt, Human
cuuuucugucucucucuu

SEQ ID NO: 2832377 - RNA, 20 nt, Human
cuuuugaaguaguuuguaua

SEQ ID NO: 2832378 - RNA, 22 nt, Human
cuuuugaacuggcaauugucua

SEQ ID NO: 2832379 - RNA, 20 nt, Human
cuuuugaacccaggaguuca

SEQ ID NO: 2832380 - RNA, 18 nt, Human
cuuuugaacccaggaguu

SEQ ID NO: 2832381 - RNA, 14 nt, Human
cuuuugaauuguua

SEQ ID NO: 2832382 - RNA, 16 nt, Human
cuuuugaauuguuaca

SEQ ID NO: 2832383 - RNA, 14 nt, Human
cuuuugaauuguuu

SEQ ID NO: 2832384 - RNA, 13 nt, Human
cuuuugaauauuc

SEQ ID NO: 2832385 - RNA, 22 nt, Human
cuuuugaaguaguuuguauaac

SEQ ID NO: 2832386 - RNA, 16 nt, Human
cuuuuuauuucugcau

SEQ ID NO: 2832387 - RNA, 13 nt, Human
cuuuuuauuucug

SEQ ID NO: 2832388 - RNA, 17 nt, Human
cuuuuuaaaacacaugu

SEQ ID NO: 2832389 - RNA, 22 nt, Human
cuuuuuaaaagguauuuugaau

SEQ ID NO: 2832390 - RNA, 22 nt, Human
cuuuuuaaaauggugcuuaagu

SEQ ID NO: 2832391 - RNA, 14 nt, Human
cuuuuuaaagcuua

SEQ ID NO: 2832392 - RNA, 15 nt, Human
cuuuuuaaagcuuau

SEQ ID NO: 2832393 - RNA, 14 nt, Human
cuuuuuaaaacaca

SEQ ID NO: 2832394 - RNA, 19 nt, Human
cuuuuuaaaaauagacacu

SEQ ID NO: 2832395 - RNA, 19 nt, Human
cuuuccucaaauguugaca

SEQ ID NO: 2832396 - RNA, 19 nt, Human
cuuuaguaccugaaaagua

SEQ ID NO: 2832397 - RNA, 17 nt, Human
cuuuaguaccugaaaag

SEQ ID NO: 2832398 - RNA, 22 nt, Human
cuuuaguaccugaaaaguaacu

SEQ ID NO: 2832399 - RNA, 17 nt, Human
cuuuaguaucaguguuu

SEQ ID NO: 2832400 - RNA, 21 nt, Human
cuuuaguaugacgcugauaca

SEQ ID NO: 2832401 - RNA, 22 nt, Human
cuuuaguaugacgcugauacau

SEQ ID NO: 2832402 - RNA, 15 nt, Human
cuuuaggucuuugua

SEQ ID NO: 2832403 - RNA, 16 nt, Human
cuuuaggucuuuguaa

SEQ ID NO: 2832404 - RNA, 17 nt, Human
cuuuaggucuuuguaag

SEQ ID NO: 2832405 - RNA, 13 nt, Human
cuuuaggcuuuca

SEQ ID NO: 2832406 - RNA, 17 nt, Human
cuuuaggcuuucagcuu

SEQ ID NO: 2832407 - RNA, 18 nt, Human
cuuuaggcuuucagcuua

SEQ ID NO: 2832408 - RNA, 13 nt, Human
cuuuagagaacug

SEQ ID NO: 2832409 - RNA, 15 nt, Human
cuuuagagaacugaa

SEQ ID NO: 2832410 - RNA, 16 nt, Human
cuuuagagaacugaaa

SEQ ID NO: 2832411 - RNA, 17 nt, Human
cuuuagagaacugaaaa

SEQ ID NO: 2832412 - RNA, 19 nt, Human
cuuuagagaacugaaaaga

SEQ ID NO: 2832413 - RNA, 20 nt, Human
cuuuagagaacugaaaagag

SEQ ID NO: 2832414 - RNA, 22 nt, Human
cuuuagcgcucaauaggaccag

SEQ ID NO: 2832415 - RNA, 17 nt, Human
cuuucucuuucucucuu

SEQ ID NO: 2832416 - RNA, 14 nt, Human
cuuucucuuucuuc

SEQ ID NO: 2832417 - RNA, 15 nt, Human
cuuucucuuucuucc

SEQ ID NO: 2832418 - RNA, 16 nt, Human
cuuucucuuucuuccu

SEQ ID NO: 2832419 - RNA, 18 nt, Human
cuuucucuuucuuccuuu

SEQ ID NO: 2832420 - RNA, 12 nt, Human
cuuucucuuuuc

SEQ ID NO: 2832421 - RNA, 17 nt, Human
cuuuccuccuuuaucac

SEQ ID NO: 2832422 - RNA, 17 nt, Human
cuuucucuuuucuaaaa

SEQ ID NO: 2832423 - RNA, 20 nt, Human
cuuucucuuuucuaaaagac

SEQ ID NO: 2832424 - RNA, 19 nt, Human
cuuucucuuuucucuuuuu

SEQ ID NO: 2832425 - RNA, 14 nt, Human
cuuucugaccuuca

SEQ ID NO: 2832426 - RNA, 18 nt, Human
cuuucugaccuucagcuc

SEQ ID NO: 2832427 - RNA, 21 nt, Human
cuuucugagcacacuuuagug

SEQ ID NO: 2832428 - RNA, 17 nt, Human
cuuucugagcacacuuu

SEQ ID NO: 2832429 - RNA, 20 nt, Human
cuuucugagcacacuuuagu

SEQ ID NO: 2832430 - RNA, 18 nt, Human
cuuucuguauauacuuuu

SEQ ID NO: 2832431 - RNA, 20 nt, Human
cuuucuguauauacuuuuuu

SEQ ID NO: 2832432 - RNA, 19 nt, Human
cuuucuguauauacuuuuu

SEQ ID NO: 2832433 - RNA, 23 nt, Human
cuuucugucccuucugucccuca

SEQ ID NO: 2832434 - RNA, 18 nt, Human
cuuucugucccuucuguc

SEQ ID NO: 2832435 - RNA, 18 nt, Human
cuuucugccgaccccuag

SEQ ID NO: 2832436 - RNA, 15 nt, Human
cuuucugcagaaaca

SEQ ID NO: 2832437 - RNA, 15 nt, Human
cuuucugcaguuuuu

SEQ ID NO: 2832438 - RNA, 19 nt, Human
cuuucugcaguuuuucagg

SEQ ID NO: 2832439 - RNA, 20 nt, Human
cuuucugcaguuuuucagga

SEQ ID NO: 2832440 - RNA, 21 nt, Human
cuuucugcaguuuuucaggag

SEQ ID NO: 2832441 - RNA, 13 nt, Human
cuuucugugcccu

SEQ ID NO: 2832442 - RNA, 14 nt, Human
cuuucugugcccua

SEQ ID NO: 2832443 - RNA, 22 nt, Human
cuuucugugcccuacucauugg

SEQ ID NO: 2832444 - RNA, 21 nt, Human
cuuucugugugcaccuuacca

SEQ ID NO: 2832445 - RNA, 12 nt, Human
cuuucugugugc

SEQ ID NO: 2832446 - RNA, 15 nt, Human
cuuucugugugcacc

SEQ ID NO: 2832447 - RNA, 15 nt, Human
cuuucuucuauuuua

SEQ ID NO: 2832448 - RNA, 11 nt, Human
cuuucuuccuu

SEQ ID NO: 2832449 - RNA, 12 nt, Human
cuuucuuccuuu

SEQ ID NO: 2832450 - RNA, 16 nt, Human
cuuucuuccucugcug

SEQ ID NO: 2832451 - RNA, 21 nt, Human
cuuugaaagacuuccaaagaa

SEQ ID NO: 2832452 - RNA, 17 nt, Human
cuuugaaaccugcucug

SEQ ID NO: 2832453 - RNA, 19 nt, Human
cuuugaaaccugcucugua

SEQ ID NO: 2832454 - RNA, 20 nt, Human
cuuugaaaccugcucuguag

SEQ ID NO: 2832455 - RNA, 19 nt, Human
cuuucuuuuuuuuuuuuga

SEQ ID NO: 2832456 - RNA, 16 nt, Human
cuuucuuuuuuucccc

SEQ ID NO: 2832457 - RNA, 18 nt, Human
cuuucuuuuuuucccccc

SEQ ID NO: 2832458 - RNA, 19 nt, Human
cuuucuuuuuuuccccccc

SEQ ID NO: 2832459 - RNA, 23 nt, Human
cuuugaaaaaguuaaugcuuaag

SEQ ID NO: 2832460 - RNA, 23 nt, Human
cuuugaaaaaucacuugauucau

SEQ ID NO: 2832461 - RNA, 16 nt, Human
cuuucuucuauuuuau

SEQ ID NO: 2832462 - RNA, 12 nt, Human
cuuucuugacaa

SEQ ID NO: 2832463 - RNA, 20 nt, Human
cuuucuugacaaaaccuaac

SEQ ID NO: 2832464 - RNA, 22 nt, Human
cuuucuugacaaaaccuaacuu

SEQ ID NO: 2832465 - RNA, 14 nt, Human
cuuucuugcucccu

SEQ ID NO: 2832466 - RNA, 16 nt, Human
cuuucuugcucccuuc

SEQ ID NO: 2832467 - RNA, 17 nt, Human
cuuucuugcucccuuca

SEQ ID NO: 2832468 - RNA, 19 nt, Human
cuuucuugcucccuucagc

SEQ ID NO: 2832469 - RNA, 20 nt, Human
cuuucuugcucccuucagcc

SEQ ID NO: 2832470 - RNA, 15 nt, Human
cuuucuuuaaauguu

SEQ ID NO: 2832471 - RNA, 16 nt, Human
cuuucuuuaaauguuu

SEQ ID NO: 2832472 - RNA, 13 nt, Human
cuuucuuuaaauu

SEQ ID NO: 2832473 - RNA, 18 nt, Human
cuuucuuuugauucuucc

SEQ ID NO: 2832474 - RNA, 18 nt, Human
cuuugcuuugucuggaag

SEQ ID NO: 2832475 - RNA, 17 nt, Human
cuuuggaaaaauguuug

SEQ ID NO: 2832476 - RNA, 18 nt, Human
cuuuggaaaaauguuugu

SEQ ID NO: 2832477 - RNA, 16 nt, Human
cuuugcuuugcccagc

SEQ ID NO: 2832478 - RNA, 17 nt, Human
cuuugcaucguccccuc

SEQ ID NO: 2832479 - RNA, 18 nt, Human
cuuugcaucguccccucc

SEQ ID NO: 2832480 - RNA, 22 nt, Human
cuuugcaucguccccuccccca

SEQ ID NO: 2832481 - RNA, 18 nt, Human
cuuugcauaugagccgug

SEQ ID NO: 2832482 - RNA, 21 nt, Human
cuuugcauaugagccgugaac

SEQ ID NO: 2832483 - RNA, 14 nt, Human
cuuugcauuuggaa

SEQ ID NO: 2832484 - RNA, 15 nt, Human
cuuugcauuuggaau

SEQ ID NO: 2832485 - RNA, 16 nt, Human
cuuugcauuuggaauu

SEQ ID NO: 2832486 - RNA, 22 nt, Human
cuuugcauuuggaauuuuugcu

SEQ ID NO: 2832487 - RNA, 14 nt, Human
cuuugacauuuaau

SEQ ID NO: 2832488 - RNA, 17 nt, Human
cuuugacauuuaauuua

SEQ ID NO: 2832489 - RNA, 18 nt, Human
cuuugacauuuaauuuag

SEQ ID NO: 2832490 - RNA, 14 nt, Human
cuuugacacucugc

SEQ ID NO: 2832491 - RNA, 13 nt, Human
cuuugaaauaccu

SEQ ID NO: 2832492 - RNA, 14 nt, Human
cuuugaaauaccuc

SEQ ID NO: 2832493 - RNA, 15 nt, Human
cuuugaaauaccuca

SEQ ID NO: 2832494 - RNA, 16 nt, Human
cuuugaaauaccucau

SEQ ID NO: 2832495 - RNA, 18 nt, Human
cuuugaaauaccucaugu

SEQ ID NO: 2832496 - RNA, 19 nt, Human
cuuugaaauaccucauguu

SEQ ID NO: 2832497 - RNA, 20 nt, Human
cuuugaaauaccucauguuu

SEQ ID NO: 2832498 - RNA, 21 nt, Human
cuuugaaauaccucauguuua

SEQ ID NO: 2832499 - RNA, 16 nt, Human
cuuuguguagcuuugc

SEQ ID NO: 2832500 - RNA, 12 nt, Human
cuuuguggggcu

SEQ ID NO: 2832501 - RNA, 13 nt, Human
cuuuguggggcuu

SEQ ID NO: 2832502 - RNA, 16 nt, Human
cuuuguggggcuuggc

SEQ ID NO: 2832503 - RNA, 21 nt, Human
cuuuguggggcuuggcgugga

SEQ ID NO: 2832504 - RNA, 13 nt, Human
cuuugugauaauu

SEQ ID NO: 2832505 - RNA, 15 nt, Human
cuuugugauaauuua

SEQ ID NO: 2832506 - RNA, 16 nt, Human
cuuugugauaauuuaa

SEQ ID NO: 2832507 - RNA, 17 nt, Human
cuuugugauaauuuaag

SEQ ID NO: 2832508 - RNA, 18 nt, Human
cuuugugauaauuuaaga

SEQ ID NO: 2832509 - RNA, 13 nt, Human
cuuuguggcuucc

SEQ ID NO: 2832510 - RNA, 13 nt, Human
cuuugggcccugc

SEQ ID NO: 2832511 - RNA, 14 nt, Human
cuuugggcccugca

SEQ ID NO: 2832512 - RNA, 15 nt, Human
cuuugggcccugcau

SEQ ID NO: 2832513 - RNA, 17 nt, Human
cuuugggcccugcaugu

SEQ ID NO: 2832514 - RNA, 18 nt, Human
cuuugggccucugcuucu

SEQ ID NO: 2832515 - RNA, 18 nt, Human
cuuugggaggcugaggcg

SEQ ID NO: 2832516 - RNA, 15 nt, Human
cuuugggauuuaauu

SEQ ID NO: 2832517 - RNA, 19 nt, Human
cuuugggauuuaauuucca

SEQ ID NO: 2832518 - RNA, 20 nt, Human
cuuugggauuuaauuuccag

SEQ ID NO: 2832519 - RNA, 17 nt, Human
cuuugggaggcugaggc

SEQ ID NO: 2832520 - RNA, 13 nt, Human
cuuuggcaguguu

SEQ ID NO: 2832521 - RNA, 15 nt, Human
cuuuggauuugacau

SEQ ID NO: 2832522 - RNA, 13 nt, Human
cuuuggauuugac

SEQ ID NO: 2832523 - RNA, 17 nt, Human
cuuuggauuugacauug

SEQ ID NO: 2832524 - RNA, 16 nt, Human
cuuuggauuugacauu

SEQ ID NO: 2832525 - RNA, 12 nt, Human
cuuguacaaaau

SEQ ID NO: 2832526 - RNA, 14 nt, Human
cuuguagaauuguu

SEQ ID NO: 2832527 - RNA, 15 nt, Human
cuuguagaauuguua

SEQ ID NO: 2832528 - RNA, 17 nt, Human
cuuguagaauuguuaua

SEQ ID NO: 2832529 - RNA, 13 nt, Human
cuuguacaaaaua

SEQ ID NO: 2832530 - RNA, 14 nt, Human
cuuguaauuuccag

SEQ ID NO: 2832531 - RNA, 16 nt, Human
cuuguaauuuuuauuu

SEQ ID NO: 2832532 - RNA, 15 nt, Human
cuuggggccuaugca

SEQ ID NO: 2832533 - RNA, 19 nt, Human
cuugguuucucucuacagu

SEQ ID NO: 2832534 - RNA, 20 nt, Human
cuugguuucucucuacagug

SEQ ID NO: 2832535 - RNA, 23 nt, Human
cuugguuucucucuacagugcca

SEQ ID NO: 2832536 - RNA, 16 nt, Human
cuugguuggcuggccu

SEQ ID NO: 2832537 - RNA, 15 nt, Human
cuugguuggcuggcc

SEQ ID NO: 2832538 - RNA, 21 nt, Human
cuugggggaacgaugugucug

SEQ ID NO: 2832539 - RNA, 22 nt, Human
cuugggggaacgaugugucugu

SEQ ID NO: 2832540 - RNA, 14 nt, Human
cuuggacuauuaua

SEQ ID NO: 2832541 - RNA, 22 nt, Human
cuuggacaagacaaaccaaguc

SEQ ID NO: 2832542 - RNA, 22 nt, Human
cuuggacuauuauaauuuaaug

SEQ ID NO: 2832543 - RNA, 11 nt, Human
cuuggacucau

SEQ ID NO: 2832544 - RNA, 21 nt, Human
cuuggaaguuucauauauugu

SEQ ID NO: 2832545 - RNA, 17 nt, Human
cuuggaauuccauuuga

SEQ ID NO: 2832546 - RNA, 18 nt, Human
cuuggaaguugcauggca

SEQ ID NO: 2832547 - RNA, 16 nt, Human
cuuggaaguacaugaa

SEQ ID NO: 2832548 - RNA, 22 nt, Human
cuuggaaguacaugaauacaaa

SEQ ID NO: 2832549 - RNA, 13 nt, Human
cuuggacacugua

SEQ ID NO: 2832550 - RNA, 15 nt, Human
cuuggagacccugca

SEQ ID NO: 2832551 - RNA, 14 nt, Human
cuuggagaccuuac

SEQ ID NO: 2832552 - RNA, 16 nt, Human
cuuggagaccuuaccc

SEQ ID NO: 2832553 - RNA, 15 nt, Human
cuuggagagacacag

SEQ ID NO: 2832554 - RNA, 16 nt, Human
cuuggagagacacagc

SEQ ID NO: 2832555 - RNA, 22 nt, Human
cuuggagccaauggagacuguc

SEQ ID NO: 2832556 - RNA, 15 nt, Human
cuugggaggcuuccc

SEQ ID NO: 2832557 - RNA, 16 nt, Human
cuugggaggcuucccc

SEQ ID NO: 2832558 - RNA, 14 nt, Human
cuugggaguuuuga

SEQ ID NO: 2832559 - RNA, 12 nt, Human
cuuguucuguca

SEQ ID NO: 2832560 - RNA, 17 nt, Human
cuuguucugucacucag

SEQ ID NO: 2832561 - RNA, 13 nt, Human
cuuguuagaaaac

SEQ ID NO: 2832562 - RNA, 16 nt, Human
cuuguuagaaaacaaa

SEQ ID NO: 2832563 - RNA, 23 nt, Human
cuuguuagaaaacaaaauuuuau

SEQ ID NO: 2832564 - RNA, 17 nt, Human
cuuguuacccaugaaaa

SEQ ID NO: 2832565 - RNA, 18 nt, Human
cuuguuacccaugaaaaa

SEQ ID NO: 2832566 - RNA, 19 nt, Human
cuuguuacccaugaaaaac

SEQ ID NO: 2832567 - RNA, 16 nt, Human
cuuguccucaguccau

SEQ ID NO: 2832568 - RNA, 22 nt, Human
cuuguccucaguccauuuauau

SEQ ID NO: 2832569 - RNA, 18 nt, Human
cuuguccuagcuugggag

SEQ ID NO: 2832570 - RNA, 23 nt, Human
cuuguccuuuuguaccauggugu

SEQ ID NO: 2832571 - RNA, 15 nt, Human
cuuguccuuucccuu

SEQ ID NO: 2832572 - RNA, 14 nt, Human
cuuguccuuucccu

SEQ ID NO: 2832573 - RNA, 18 nt, Human
cuuguagcccaggcugga

SEQ ID NO: 2832574 - RNA, 23 nt, Human
cuuguagcggaugauucuucaag

SEQ ID NO: 2832575 - RNA, 13 nt, Human
cuuguagcuguaa

SEQ ID NO: 2832576 - RNA, 14 nt, Human
cuuguagcuguaaa

SEQ ID NO: 2832577 - RNA, 15 nt, Human
cuuguagcuguaaaa

SEQ ID NO: 2832578 - RNA, 16 nt, Human
cuuguagcuguaaaac

SEQ ID NO: 2832579 - RNA, 17 nt, Human
cuuuaaaaaaauuuaag

SEQ ID NO: 2832580 - RNA, 18 nt, Human
cuuuaaaaaaauuuaagu

SEQ ID NO: 2832581 - RNA, 19 nt, Human
cuuuaaaaaaauuuaagug

SEQ ID NO: 2832582 - RNA, 23 nt, Human
cuuuaaaaaagaaaagugcauau

SEQ ID NO: 2832583 - RNA, 12 nt, Human
cuuguuucuugg

SEQ ID NO: 2832584 - RNA, 14 nt, Human
cuuguuucuuuuca

SEQ ID NO: 2832585 - RNA, 14 nt, Human
cuuguuucucaacu

SEQ ID NO: 2832586 - RNA, 12 nt, Human
cuuguuuauuga

SEQ ID NO: 2832587 - RNA, 19 nt, Human
cuuguuuauugaguuugua

SEQ ID NO: 2832588 - RNA, 23 nt, Human
cuuguuuauugaguuuguaggua

SEQ ID NO: 2832589 - RNA, 16 nt, Human
cuuguuuauuuugugg

SEQ ID NO: 2832590 - RNA, 18 nt, Human
cuuguuuaucagauacau

SEQ ID NO: 2832591 - RNA, 21 nt, Human
cuuguuuaucagauacaucac

SEQ ID NO: 2832592 - RNA, 22 nt, Human
cuuguuuaucagauacaucacu

SEQ ID NO: 2832593 - RNA, 12 nt, Human
cuuguugcuuug

SEQ ID NO: 2832594 - RNA, 13 nt, Human
cuuguugcuuugu

SEQ ID NO: 2832595 - RNA, 14 nt, Human
cuuguugcuuuguu

SEQ ID NO: 2832596 - RNA, 15 nt, Human
cuuguugcuuuguug

SEQ ID NO: 2832597 - RNA, 16 nt, Human
cuuguugcuuuguugc

SEQ ID NO: 2832598 - RNA, 18 nt, Human
cuuguugcuuuguugcac

SEQ ID NO: 2832599 - RNA, 21 nt, Human
cuuguugcuuuguugcacuga

SEQ ID NO: 2832600 - RNA, 14 nt, Human
cuuuaaaacaaaac

SEQ ID NO: 2832601 - RNA, 15 nt, Human
cuuuaaaacaaaaca

SEQ ID NO: 2832602 - RNA, 17 nt, Human
cuuuaaaacaaaacaaa

SEQ ID NO: 2832603 - RNA, 20 nt, Human
cuuuaaaagacaaaucaaag

SEQ ID NO: 2832604 - RNA, 13 nt, Human
cuuuaaaagagag

SEQ ID NO: 2832605 - RNA, 15 nt, Human
cuuuaaaagagagag

SEQ ID NO: 2832606 - RNA, 16 nt, Human
cuuuaaaagagagaga

SEQ ID NO: 2832607 - RNA, 21 nt, Human
cuuuaaaagagagagagagaa

SEQ ID NO: 2832608 - RNA, 16 nt, Human
cuuuacccuugagccc

SEQ ID NO: 2832609 - RNA, 18 nt, Human
cuuuacccuugagcccuc

SEQ ID NO: 2832610 - RNA, 19 nt, Human
cuuuacccuugagcccucc

SEQ ID NO: 2832611 - RNA, 20 nt, Human
cuuuacccuugagcccuccc

SEQ ID NO: 2832612 - RNA, 22 nt, Human
cuuuacccuugagcccucccca

SEQ ID NO: 2832613 - RNA, 21 nt, Human
cuuuaaaaagcuccaaaugca

SEQ ID NO: 2832614 - RNA, 17 nt, Human
cuuuaaaaaauauuuau

SEQ ID NO: 2832615 - RNA, 18 nt, Human
cuuuaaaaaauauuuauu

SEQ ID NO: 2832616 - RNA, 19 nt, Human
cuuuaaaaaauauuuauua

SEQ ID NO: 2832617 - RNA, 22 nt, Human
cuuuaaaaaauuaaucugggcc

SEQ ID NO: 2832618 - RNA, 22 nt, Human
cuugcucugcugacagacacag

SEQ ID NO: 2832619 - RNA, 14 nt, Human
cuuggaagcuccgc

SEQ ID NO: 2832620 - RNA, 20 nt, Human
cuuggaagcuccgcuuucua

SEQ ID NO: 2832621 - RNA, 18 nt, Human
cuugcugagcuguuuaua

SEQ ID NO: 2832622 - RNA, 14 nt, Human
cuugcuucuuacug

SEQ ID NO: 2832623 - RNA, 15 nt, Human
cuugcuucuuacuga

SEQ ID NO: 2832624 - RNA, 19 nt, Human
cuugcuucuuacugauaau

SEQ ID NO: 2832625 - RNA, 20 nt, Human
cuugcuucuuacugauaauu

SEQ ID NO: 2832626 - RNA, 21 nt, Human
cuugccaccccacccucccug

SEQ ID NO: 2832627 - RNA, 22 nt, Human
cuugccaccccacccucccugg

SEQ ID NO: 2832628 - RNA, 23 nt, Human
cuugccaccccacccucccugga

SEQ ID NO: 2832629 - RNA, 19 nt, Human
cuugccacuaagccaugaa

SEQ ID NO: 2832630 - RNA, 13 nt, Human
cuugccaccccac

SEQ ID NO: 2832631 - RNA, 18 nt, Human
cuugccaccccacccucc

SEQ ID NO: 2832632 - RNA, 20 nt, Human
cuugccaccccacccucccu

SEQ ID NO: 2832633 - RNA, 15 nt, Human
cuugcauccaacucc

SEQ ID NO: 2832634 - RNA, 14 nt, Human
cuugcaugaagaga

SEQ ID NO: 2832635 - RNA, 20 nt, Human
cuugcaugaagagaagcaau

SEQ ID NO: 2832636 - RNA, 12 nt, Human
cuugcagcagga

SEQ ID NO: 2832637 - RNA, 13 nt, Human
cuugcagcaggau

SEQ ID NO: 2832638 - RNA, 23 nt, Human
cuugcagcaggaucuagaggggg

SEQ ID NO: 2832639 - RNA, 18 nt, Human
cuugcagcuaaggagggg

SEQ ID NO: 2832640 - RNA, 19 nt, Human
cuugcauccaacuccagga

SEQ ID NO: 2832641 - RNA, 14 nt, Human
cuugcauccuuccu

SEQ ID NO: 2832642 - RNA, 15 nt, Human
cuugcauccuuccua

SEQ ID NO: 2832643 - RNA, 16 nt, Human
cuugcauccuuccuau

SEQ ID NO: 2832644 - RNA, 17 nt, Human
cuugcauccuuccuaua

SEQ ID NO: 2832645 - RNA, 20 nt, Human
cuugcauccuuccuauaacu

SEQ ID NO: 2832646 - RNA, 21 nt, Human
cuugcagacucuacagaggcc

SEQ ID NO: 2832647 - RNA, 20 nt, Human
cuugcaccccucacucuggc

SEQ ID NO: 2832648 - RNA, 20 nt, Human
cuugcagacucuacagaggc

SEQ ID NO: 2832649 - RNA, 14 nt, Human
cuugcaccccucac

SEQ ID NO: 2832650 - RNA, 16 nt, Human
cuugcaccccucacuc

SEQ ID NO: 2832651 - RNA, 18 nt, Human
cuugcaccccucacucug

SEQ ID NO: 2832652 - RNA, 18 nt, Human
cuugcaauggcagccuug

SEQ ID NO: 2832653 - RNA, 17 nt, Human
cuugcaauggcagccuu

SEQ ID NO: 2832654 - RNA, 16 nt, Human
cuugcaauggcagccu

SEQ ID NO: 2832655 - RNA, 15 nt, Human
cuugcaauggcagcc

SEQ ID NO: 2832656 - RNA, 14 nt, Human
cuugagcccaggag

SEQ ID NO: 2832657 - RNA, 15 nt, Human
cuugagcccaggagu

SEQ ID NO: 2832658 - RNA, 16 nt, Human
cuugagcccuccccag

SEQ ID NO: 2832659 - RNA, 17 nt, Human
cuugagcccuccccagg

SEQ ID NO: 2832660 - RNA, 20 nt, Human
cuugagcccuccccaggaau

SEQ ID NO: 2832661 - RNA, 21 nt, Human
cuugagcccuccccaggaauu

SEQ ID NO: 2832662 - RNA, 14 nt, Human
cuugagagaccagg

SEQ ID NO: 2832663 - RNA, 13 nt, Human
cuugagcccagga

SEQ ID NO: 2832664 - RNA, 16 nt, Human
cuugagagaccaggca

SEQ ID NO: 2832665 - RNA, 12 nt, Human
cuugagcccagg

SEQ ID NO: 2832666 - RNA, 17 nt, Human
cuugaggguugggcugg

SEQ ID NO: 2832667 - RNA, 15 nt, Human
cuugaggguugggcu

SEQ ID NO: 2832668 - RNA, 17 nt, Human
cuugagacacggagccc

SEQ ID NO: 2832669 - RNA, 22 nt, Human
cuugagacacggagcccagccc

SEQ ID NO: 2832670 - RNA, 23 nt, Human
cuugagaagaccucaccuagaaa

SEQ ID NO: 2832671 - RNA, 22 nt, Human
cuugagaaauauggacacuuaa

SEQ ID NO: 2832672 - RNA, 18 nt, Human
cuucuggcagauucaaau

SEQ ID NO: 2832673 - RNA, 20 nt, Human
cuucuggcuuccuucucuca

SEQ ID NO: 2832674 - RNA, 17 nt, Human
cuucugggagcaggaac

SEQ ID NO: 2832675 - RNA, 14 nt, Human
cuucuggcuuccuu

SEQ ID NO: 2832676 - RNA, 12 nt, Human
cuucuggcucaa

SEQ ID NO: 2832677 - RNA, 22 nt, Human
cuucuggcucccucuucuuuca

SEQ ID NO: 2832678 - RNA, 15 nt, Human
cuucuggccuuuccu

SEQ ID NO: 2832679 - RNA, 21 nt, Human
cuucuggccuuuccucucucc

SEQ ID NO: 2832680 - RNA, 22 nt, Human
cuucuggccuuuccucucuccu

SEQ ID NO: 2832681 - RNA, 19 nt, Human
cuucuggccucccacagac

SEQ ID NO: 2832682 - RNA, 11 nt, Human
cuucuggccuu

SEQ ID NO: 2832683 - RNA, 16 nt, Human
cuucuggccucccaca

SEQ ID NO: 2832684 - RNA, 14 nt, Human
cuucuggccuccca

SEQ ID NO: 2832685 - RNA, 15 nt, Human
cuucuggccucccac

SEQ ID NO: 2832686 - RNA, 14 nt, Human
cuucuggagcccuu

SEQ ID NO: 2832687 - RNA, 17 nt, Human
cuucuggcacuuggaga

SEQ ID NO: 2832688 - RNA, 16 nt, Human
gacugauucugggaug

SEQ ID NO: 2832689 - RNA, 20 nt, Human
gacugccagucccccugccc

SEQ ID NO: 2832690 - RNA, 18 nt, Human
gacugcaagaggcuccug

SEQ ID NO: 2832691 - RNA, 15 nt, Human
gacugcacagcggcc

SEQ ID NO: 2832692 - RNA, 18 nt, Human
gacugcacagcggccccu

SEQ ID NO: 2832693 - RNA, 14 nt, Human
gacugcacccagga

SEQ ID NO: 2832694 - RNA, 15 nt, Human
gacugcacccaggag

SEQ ID NO: 2832695 - RNA, 16 nt, Human
gacugcacccaggagg

SEQ ID NO: 2832696 - RNA, 15 nt, Human
gacugagggacucug

SEQ ID NO: 2832697 - RNA, 21 nt, Human
gacugagggacucugaagccu

SEQ ID NO: 2832698 - RNA, 21 nt, Human
gacugacuuguuugucuucca

SEQ ID NO: 2832699 - RNA, 12 nt, Human
gacugaggacaa

SEQ ID NO: 2832700 - RNA, 15 nt, Human
gacugaggacaaagu

SEQ ID NO: 2832701 - RNA, 22 nt, Human
gacugagccccgcagaccuccc

SEQ ID NO: 2832702 - RNA, 23 nt, Human
gacugagccuggcccauagaaac

SEQ ID NO: 2832703 - RNA, 15 nt, Human
gacuacaggcaccca

SEQ ID NO: 2832704 - RNA, 13 nt, Human
gacuacaggcacc

SEQ ID NO: 2832705 - RNA, 18 nt, Human
gacuacaggcacccacca

SEQ ID NO: 2832706 - RNA, 15 nt, Human
gacuaauuaggcaag

SEQ ID NO: 2832707 - RNA, 21 nt, Human
gacuaauuaggguacauuuau

SEQ ID NO: 2832708 - RNA, 21 nt, Human
gacucuacagaggccaugggc

SEQ ID NO: 2832709 - RNA, 15 nt, Human
gacucuacagaggcc

SEQ ID NO: 2832710 - RNA, 14 nt, Human
gacucuaaagacca

SEQ ID NO: 2832711 - RNA, 15 nt, Human
gacucuaaagaccaa

SEQ ID NO: 2832712 - RNA, 16 nt, Human
gacucuaaagaccaaa

SEQ ID NO: 2832713 - RNA, 17 nt, Human
gacucuaaagaccaaac

SEQ ID NO: 2832714 - RNA, 19 nt, Human
gacucuaaagaccaaacuu

SEQ ID NO: 2832715 - RNA, 21 nt, Human
gacucuaaauucuuuauuucu

SEQ ID NO: 2832716 - RNA, 23 nt, Human
gacucuaaauucuuuauuucugu

SEQ ID NO: 2832717 - RNA, 14 nt, Human
gacugacagcaugu

SEQ ID NO: 2832718 - RNA, 20 nt, Human
gacugacagcaugugcccuc

SEQ ID NO: 2832719 - RNA, 21 nt, Human
gacugacagcaugugcccucc

SEQ ID NO: 2832720 - RNA, 23 nt, Human
gacugacagcaugugcccuccug

SEQ ID NO: 2832721 - RNA, 16 nt, Human
gacugcuaguguucug

SEQ ID NO: 2832722 - RNA, 17 nt, Human
gacugcuaguguucugu

SEQ ID NO: 2832723 - RNA, 18 nt, Human
gacugcuaguguucuguc

SEQ ID NO: 2832724 - RNA, 20 nt, Human
gacugcuaguguucugucua

SEQ ID NO: 2832725 - RNA, 21 nt, Human
gacugcuccccagcccuggcu

SEQ ID NO: 2832726 - RNA, 24 nt, Human
gacugcuccccagcccuggcucug

SEQ ID NO: 2832727 - RNA, 15 nt, Human
gacugcuccccagcc

SEQ ID NO: 2832728 - RNA, 19 nt, Human
gacugcuccccagcccugg

SEQ ID NO: 2832729 - RNA, 20 nt, Human
gacugcuccccagcccuggc

SEQ ID NO: 2832730 - RNA, 22 nt, Human
gacugcgggaugguccuggggc

SEQ ID NO: 2832731 - RNA, 14 nt, Human
gacugcguucugca

SEQ ID NO: 2832732 - RNA, 15 nt, Human
gacugcguucugcaa

SEQ ID NO: 2832733 - RNA, 16 nt, Human
gacugcguucugcaag

SEQ ID NO: 2832734 - RNA, 21 nt, Human
gacugcgggaugguccugggg

SEQ ID NO: 2832735 - RNA, 21 nt, Human
gacugccucugccacacucug

SEQ ID NO: 2832736 - RNA, 23 nt, Human
gacuggcuagaguccucacuccc

SEQ ID NO: 2832737 - RNA, 21 nt, Human
gacuggcuagaguccucacuc

SEQ ID NO: 2832738 - RNA, 20 nt, Human
gacuggcuagaguccucacu

SEQ ID NO: 2832739 - RNA, 17 nt, Human
gacuggcuagaguccuc

SEQ ID NO: 2832740 - RNA, 22 nt, Human
gacuggccccugggucagucug

SEQ ID NO: 2832741 - RNA, 16 nt, Human
gacuggccccuggguc

SEQ ID NO: 2832742 - RNA, 14 nt, Human
gacuggccccuggg

SEQ ID NO: 2832743 - RNA, 17 nt, Human
gacuggcuggcugcagu

SEQ ID NO: 2832744 - RNA, 16 nt, Human
gacuggcuggcugcag

SEQ ID NO: 2832745 - RNA, 14 nt, Human
gacuggcuggcugc

SEQ ID NO: 2832746 - RNA, 16 nt, Human
gacuuaauagaaacau

SEQ ID NO: 2832747 - RNA, 14 nt, Human
gacuuaaugugauu

SEQ ID NO: 2832748 - RNA, 15 nt, Human
gacuuaaugugauua

SEQ ID NO: 2832749 - RNA, 23 nt, Human
gacuuaaugugauuacugcucua

SEQ ID NO: 2832750 - RNA, 14 nt, Human
gacuucagcucugu

SEQ ID NO: 2832751 - RNA, 14 nt, Human
gacuucacuuauua

SEQ ID NO: 2832752 - RNA, 22 nt, Human
gacuuaguugcguuacacccuu

SEQ ID NO: 2832753 - RNA, 15 nt, Human
gacuuagcugggaga

SEQ ID NO: 2832754 - RNA, 16 nt, Human
gacuuauaguacauga

SEQ ID NO: 2832755 - RNA, 18 nt, Human
gacuuauaguacaugaua

SEQ ID NO: 2832756 - RNA, 17 nt, Human
gacuuauaguacaugau

SEQ ID NO: 2832757 - RNA, 17 nt, Human
gacuuauuucuucaaau

SEQ ID NO: 2832758 - RNA, 18 nt, Human
gacuuauuucuucaaauc

SEQ ID NO: 2832759 - RNA, 13 nt, Human
gacuuaugggccc

SEQ ID NO: 2832760 - RNA, 15 nt, Human
gacuuauuacaauuu

SEQ ID NO: 2832761 - RNA, 20 nt, Human
gacuuauuguggauaacaaa

SEQ ID NO: 2832762 - RNA, 22 nt, Human
gacuuauuguggauaacaaaga

SEQ ID NO: 2832763 - RNA, 23 nt, Human
gacuuauuguggauaacaaagau

SEQ ID NO: 2832764 - RNA, 16 nt, Human
gacuuagaaagcaggg

SEQ ID NO: 2832765 - RNA, 18 nt, Human
gacuuagaaagcaggggc

SEQ ID NO: 2832766 - RNA, 19 nt, Human
gacuuagaaagcaggggcu

SEQ ID NO: 2832767 - RNA, 12 nt, Human
gacuuacucuaa

SEQ ID NO: 2832768 - RNA, 14 nt, Human
gacuuagaaagcag

SEQ ID NO: 2832769 - RNA, 14 nt, Human
gacuuacucuaaga

SEQ ID NO: 2832770 - RNA, 15 nt, Human
gacuuacucuaagau

SEQ ID NO: 2832771 - RNA, 20 nt, Human
gacuaaaugccuaguuuuua

SEQ ID NO: 2832772 - RNA, 14 nt, Human
gacuaaauucguga

SEQ ID NO: 2832773 - RNA, 20 nt, Human
gacuaaauuuggggacagau

SEQ ID NO: 2832774 - RNA, 23 nt, Human
gacuaacuagacaccaaaguucu

SEQ ID NO: 2832775 - RNA, 21 nt, Human
gacuaacuagacaccaaaguu

SEQ ID NO: 2832776 - RNA, 19 nt, Human
gacuaaccccaacgcacag

SEQ ID NO: 2832777 - RNA, 22 nt, Human
gacuaaccccaacgcacaggaa

SEQ ID NO: 2832778 - RNA, 23 nt, Human
gacuaaccccaacgcacaggaaa

SEQ ID NO: 2832779 - RNA, 15 nt, Human
gacuaagccuaccug

SEQ ID NO: 2832780 - RNA, 18 nt, Human
gacuaagccuaccugcuc

SEQ ID NO: 2832781 - RNA, 21 nt, Human
gacuaagccuaccugcucucc

SEQ ID NO: 2832782 - RNA, 18 nt, Human
gacguuuacaagcccccc

SEQ ID NO: 2832783 - RNA, 21 nt, Human
gacguucggggcaugcugggg

SEQ ID NO: 2832784 - RNA, 12 nt, Human
gacguuucucau

SEQ ID NO: 2832785 - RNA, 23 nt, Human
gacguuucucauuuguuuuucuc

SEQ ID NO: 2832786 - RNA, 23 nt, Human
gaccuuuauuggguaucaagaca

SEQ ID NO: 2832787 - RNA, 13 nt, Human
gacgcuuugucug

SEQ ID NO: 2832788 - RNA, 13 nt, Human
gacggagucccac

SEQ ID NO: 2832789 - RNA, 23 nt, Human
gacggagucccaccuuggcugca

SEQ ID NO: 2832790 - RNA, 22 nt, Human
gacgugauucaauucaacacuc

SEQ ID NO: 2832791 - RNA, 21 nt, Human
gaccugggguugucagcucuc

SEQ ID NO: 2832792 - RNA, 14 nt, Human
gacgucuuucuuuu

SEQ ID NO: 2832793 - RNA, 22 nt, Human
gacgucuuucuuuuuuuccccc

SEQ ID NO: 2832794 - RNA, 18 nt, Human
gacguggaaccucugucu

SEQ ID NO: 2832795 - RNA, 20 nt, Human
gacguggaaccucugucuca

SEQ ID NO: 2832796 - RNA, 22 nt, Human
gacguggaaccucugucucauc

SEQ ID NO: 2832797 - RNA, 20 nt, Human
gacguggagcgggguaugaa

SEQ ID NO: 2832798 - RNA, 18 nt, Human
gacgugcaccuguacuca

SEQ ID NO: 2832799 - RNA, 11 nt, Human
gacggcccugc

SEQ ID NO: 2832800 - RNA, 12 nt, Human
gacggcccugca

SEQ ID NO: 2832801 - RNA, 13 nt, Human
gacggcccugcaa

SEQ ID NO: 2832802 - RNA, 20 nt, Human
gacggccugaugcucccucc

SEQ ID NO: 2832803 - RNA, 15 nt, Human
gacggccugaugcuc

SEQ ID NO: 2832804 - RNA, 22 nt, Human
gacggcacggucuucccucuuc

SEQ ID NO: 2832805 - RNA, 23 nt, Human
gacggccugaugcucccuccccu

SEQ ID NO: 2832806 - RNA, 22 nt, Human
gacggccugaugcucccucccc

SEQ ID NO: 2832807 - RNA, 12 nt, Human
gacggcugggca

SEQ ID NO: 2832808 - RNA, 13 nt, Human
gacggcugggcac

SEQ ID NO: 2832809 - RNA, 14 nt, Human
gaccuugaacuggg

SEQ ID NO: 2832810 - RNA, 23 nt, Human
gaccuucuaggacgccacccagc

SEQ ID NO: 2832811 - RNA, 19 nt, Human
gaccuucuagaauuauaag

SEQ ID NO: 2832812 - RNA, 13 nt, Human
gaccuuaggccuu

SEQ ID NO: 2832813 - RNA, 15 nt, Human
gaccuuaggccuucc

SEQ ID NO: 2832814 - RNA, 16 nt, Human
gaccuuaggccuuccu

SEQ ID NO: 2832815 - RNA, 18 nt, Human
gaccuuaggccuuccucu

SEQ ID NO: 2832816 - RNA, 21 nt, Human
gaccuuaggccuuccucucuc

SEQ ID NO: 2832817 - RNA, 22 nt, Human
gaccuuaccccuggcuguuugg

SEQ ID NO: 2832818 - RNA, 18 nt, Human
gaccuuacgaucaggcac

SEQ ID NO: 2832819 - RNA, 19 nt, Human
gaccuuacgaucaggcaca

SEQ ID NO: 2832820 - RNA, 12 nt, Human
gaccuuccucug

SEQ ID NO: 2832821 - RNA, 17 nt, Human
gaccuuccucuggggcu

SEQ ID NO: 2832822 - RNA, 18 nt, Human
gaccuuccucuggggcuc

SEQ ID NO: 2832823 - RNA, 21 nt, Human
gaccuuccucuggggcucuag

SEQ ID NO: 2832824 - RNA, 22 nt, Human
gaccuuccauaaugcuacuguc

SEQ ID NO: 2832825 - RNA, 13 nt, Human
gaccuucagcuca

SEQ ID NO: 2832826 - RNA, 18 nt, Human
gaccuucagcucacgcuu

SEQ ID NO: 2832827 - RNA, 16 nt, Human
gaccuucauuucaugu

SEQ ID NO: 2832828 - RNA, 17 nt, Human
gaccuucauuucaugua

SEQ ID NO: 2832829 - RNA, 12 nt, Human
gaccuuccucau

SEQ ID NO: 2832830 - RNA, 14 nt, Human
gaccuuccucaucc

SEQ ID NO: 2832831 - RNA, 22 nt, Human
gaccuuccucauccaccccauc

SEQ ID NO: 2832832 - RNA, 23 nt, Human
gaccuuccucauccaccccaucc

SEQ ID NO: 2832833 - RNA, 20 nt, Human
gacccugcgaaggggcccug

SEQ ID NO: 2832834 - RNA, 18 nt, Human
gaccuggcaaggacacag

SEQ ID NO: 2832835 - RNA, 13 nt, Human
gaccuggggcaca

SEQ ID NO: 2832836 - RNA, 14 nt, Human
gaccuggggcacag

SEQ ID NO: 2832837 - RNA, 15 nt, Human
gaccuggggcacagu

SEQ ID NO: 2832838 - RNA, 20 nt, Human
gaccuggggcacaguccagg

SEQ ID NO: 2832839 - RNA, 21 nt, Human
gaccuggggcacaguccagga

SEQ ID NO: 2832840 - RNA, 22 nt, Human
gaccuggggcacaguccaggaa

SEQ ID NO: 2832841 - RNA, 17 nt, Human
gaccugguacccuccug

SEQ ID NO: 2832842 - RNA, 19 nt, Human
gaccugguacccuccuggc

SEQ ID NO: 2832843 - RNA, 21 nt, Human
gaccugguacccuccuggcuc

SEQ ID NO: 2832844 - RNA, 17 nt, Human
gaccuggcaaggacaca

SEQ ID NO: 2832845 - RNA, 13 nt, Human
gaccuguauuuaa

SEQ ID NO: 2832846 - RNA, 16 nt, Human
gaccuguauuuaagca

SEQ ID NO: 2832847 - RNA, 19 nt, Human
gaccuguauuuaagcaaau

SEQ ID NO: 2832848 - RNA, 22 nt, Human
gaccuguauuuaagcaaauacu

SEQ ID NO: 2832849 - RNA, 13 nt, Human
gaccugguuuuua

SEQ ID NO: 2832850 - RNA, 18 nt, Human
gaccugguuaaacaaacc

SEQ ID NO: 2832851 - RNA, 23 nt, Human
gaccugguacccuccuggcucuu

SEQ ID NO: 2832852 - RNA, 17 nt, Human
gaccuguuuaugagaug

SEQ ID NO: 2832853 - RNA, 21 nt, Human
gaccagacaccuugacagggc

SEQ ID NO: 2832854 - RNA, 22 nt, Human
gaccagacaccuugacagggca

SEQ ID NO: 2832855 - RNA, 16 nt, Human
gaccaccaccucagag

SEQ ID NO: 2832856 - RNA, 22 nt, Human
gaccaccaccccaacaaaccau

SEQ ID NO: 2832857 - RNA, 17 nt, Human
gaccacaucuuuaucug

SEQ ID NO: 2832858 - RNA, 23 nt, Human
gaccacaucuuuaucuguucuug

SEQ ID NO: 2832859 - RNA, 23 nt, Human
gaccagacaccuugacagggcac

SEQ ID NO: 2832860 - RNA, 21 nt, Human
gaccagaggagccuuuuuaaa

SEQ ID NO: 2832861 - RNA, 19 nt, Human
gaccagaggagccuuuuua

SEQ ID NO: 2832862 - RNA, 18 nt, Human
gaccagaggagccuuuuu

SEQ ID NO: 2832863 - RNA, 15 nt, Human
gaccagaggagccuu

SEQ ID NO: 2832864 - RNA, 12 nt, Human
gaccacucagcc

SEQ ID NO: 2832865 - RNA, 13 nt, Human
gaccacucagccc

SEQ ID NO: 2832866 - RNA, 14 nt, Human
gaccacucagcccc

SEQ ID NO: 2832867 - RNA, 15 nt, Human
gaccacucagccccu

SEQ ID NO: 2832868 - RNA, 16 nt, Human
gaccacucagccccua

SEQ ID NO: 2832869 - RNA, 17 nt, Human
gaccacucagccccuag

SEQ ID NO: 2832870 - RNA, 19 nt, Human
gaccacucagccccuagga

SEQ ID NO: 2832871 - RNA, 13 nt, Human
gaccaauugugcu

SEQ ID NO: 2832872 - RNA, 15 nt, Human
gaccaauugugcugc

SEQ ID NO: 2832873 - RNA, 17 nt, Human
gaccaauugugcugcca

SEQ ID NO: 2832874 - RNA, 18 nt, Human
gaccaauugugcugccau

SEQ ID NO: 2832875 - RNA, 16 nt, Human
gaccacacccuguacu

SEQ ID NO: 2832876 - RNA, 16 nt, Human
gaccaauuauugauau

SEQ ID NO: 2832877 - RNA, 18 nt, Human
gaccaauuauugauauau

SEQ ID NO: 2832878 - RNA, 20 nt, Human
gaccaauuauugauauauau

SEQ ID NO: 2832879 - RNA, 14 nt, Human
gaccacacuccagc

SEQ ID NO: 2832880 - RNA, 22 nt, Human
gaccacacuccagcugggauca

SEQ ID NO: 2832881 - RNA, 16 nt, Human
gaccacacuccagcug

SEQ ID NO: 2832882 - RNA, 11 nt, Human
gaccaaggaac

SEQ ID NO: 2832883 - RNA, 15 nt, Human
gaccaaggaacaaaa

SEQ ID NO: 2832884 - RNA, 16 nt, Human
gaccaaggaacaaaaa

SEQ ID NO: 2832885 - RNA, 23 nt, Human
gaccaaggaacaaaaaaaccaca

SEQ ID NO: 2832886 - RNA, 20 nt, Human
gaccaauaaaauuucuaaga

SEQ ID NO: 2832887 - RNA, 21 nt, Human
gaccaauaaaauuucuaagag

SEQ ID NO: 2832888 - RNA, 18 nt, Human
gaccaaggggugggccac

SEQ ID NO: 2832889 - RNA, 16 nt, Human
gaccaauagcccacag

SEQ ID NO: 2832890 - RNA, 13 nt, Human
gacaucagcuggu

SEQ ID NO: 2832891 - RNA, 14 nt, Human
gacaucagcaaaca

SEQ ID NO: 2832892 - RNA, 21 nt, Human
gacaucaguuccuuugugugu

SEQ ID NO: 2832893 - RNA, 18 nt, Human
gacaucaugaauuuuaca

SEQ ID NO: 2832894 - RNA, 22 nt, Human
gacaucacuuguacaaaauaaa

SEQ ID NO: 2832895 - RNA, 20 nt, Human
gacaucagagguucuuugag

SEQ ID NO: 2832896 - RNA, 16 nt, Human
gacaucacuuguacaa

SEQ ID NO: 2832897 - RNA, 12 nt, Human
gacaucagccag

SEQ ID NO: 2832898 - RNA, 13 nt, Human
gacaucagccagc

SEQ ID NO: 2832899 - RNA, 14 nt, Human
gacaucagccagcu

SEQ ID NO: 2832900 - RNA, 15 nt, Human
gacaucagccagcug

SEQ ID NO: 2832901 - RNA, 16 nt, Human
gacaucagccagcugc

SEQ ID NO: 2832902 - RNA, 17 nt, Human
gacaucagccagcugcc

SEQ ID NO: 2832903 - RNA, 11 nt, Human
gacaucacugu

SEQ ID NO: 2832904 - RNA, 19 nt, Human
gacccacuggacucaccuc

SEQ ID NO: 2832905 - RNA, 18 nt, Human
gacccacuucucaucaca

SEQ ID NO: 2832906 - RNA, 19 nt, Human
gacccacuucucaucacac

SEQ ID NO: 2832907 - RNA, 21 nt, Human
gacccacuucucaucacacac

SEQ ID NO: 2832908 - RNA, 22 nt, Human
gacccacuucucaucacacaca

SEQ ID NO: 2832909 - RNA, 23 nt, Human
gacccacuucucaucacacacau

SEQ ID NO: 2832910 - RNA, 18 nt, Human
gacccacugguuccuucu

SEQ ID NO: 2832911 - RNA, 20 nt, Human
gacccacugguuccuucuuc

SEQ ID NO: 2832912 - RNA, 20 nt, Human
gacccagcauggguuagugc

SEQ ID NO: 2832913 - RNA, 18 nt, Human
gacccauagaucuucuga

SEQ ID NO: 2832914 - RNA, 12 nt, Human
gacccagugaga

SEQ ID NO: 2832915 - RNA, 22 nt, Human
gacccagugagauuacagagga

SEQ ID NO: 2832916 - RNA, 23 nt, Human
gacccagugagauuacagaggaa

SEQ ID NO: 2832917 - RNA, 22 nt, Human
gacccauguaaauaccagacug

SEQ ID NO: 2832918 - RNA, 19 nt, Human
gacccccgcccccugcccu

SEQ ID NO: 2832919 - RNA, 23 nt, Human
gaccccaaacaccuuccagcucc

SEQ ID NO: 2832920 - RNA, 17 nt, Human
gaccccccgugggcucc

SEQ ID NO: 2832921 - RNA, 11 nt, Human
gacccccgccc

SEQ ID NO: 2832922 - RNA, 15 nt, Human
gacccccgcccccug

SEQ ID NO: 2832923 - RNA, 16 nt, Human
gacccccgcccccugc

SEQ ID NO: 2832924 - RNA, 18 nt, Human
gacccccgcccccugccc

SEQ ID NO: 2832925 - RNA, 17 nt, Human
gacagauucagucuugc

SEQ ID NO: 2832926 - RNA, 20 nt, Human
gacagauucagucuugccuu

SEQ ID NO: 2832927 - RNA, 18 nt, Human
gacaggcaagcaccuccu

SEQ ID NO: 2832928 - RNA, 17 nt, Human
gacaggcaagcaccucc

SEQ ID NO: 2832929 - RNA, 13 nt, Human
gacaggcaagcac

SEQ ID NO: 2832930 - RNA, 12 nt, Human
gacagcaggcag

SEQ ID NO: 2832931 - RNA, 14 nt, Human
gacagcaggcagcg

SEQ ID NO: 2832932 - RNA, 17 nt, Human
gacagcaggcagcgcca

SEQ ID NO: 2832933 - RNA, 19 nt, Human
gacagaugccccagagcug

SEQ ID NO: 2832934 - RNA, 19 nt, Human
gacaggcaaugcuggcugu

SEQ ID NO: 2832935 - RNA, 18 nt, Human
gacaggcaaugcuggcug

SEQ ID NO: 2832936 - RNA, 21 nt, Human
gacaggcaagcaccuccugcc

SEQ ID NO: 2832937 - RNA, 20 nt, Human
gacaggcaagcaccuccugc

SEQ ID NO: 2832938 - RNA, 21 nt, Human
gacaggcauguucucugagga

SEQ ID NO: 2832939 - RNA, 20 nt, Human
gacaggcauguucucugagg

SEQ ID NO: 2832940 - RNA, 23 nt, Human
gacaggcaaugcuggcuguuggc

SEQ ID NO: 2832941 - RNA, 14 nt, Human
gacauaacguuuuu

SEQ ID NO: 2832942 - RNA, 15 nt, Human
gacauaacagugcag

SEQ ID NO: 2832943 - RNA, 15 nt, Human
gacaucacuuguaca

SEQ ID NO: 2832944 - RNA, 13 nt, Human
gacaucacagcag

SEQ ID NO: 2832945 - RNA, 14 nt, Human
gacaucacagcagc

SEQ ID NO: 2832946 - RNA, 15 nt, Human
gacaucacagcagcc

SEQ ID NO: 2832947 - RNA, 18 nt, Human
gacaucacagcagccucc

SEQ ID NO: 2832948 - RNA, 16 nt, Human
gacauaacguuuuucc

SEQ ID NO: 2832949 - RNA, 21 nt, Human
gacauaacguuuuuccuuuaa

SEQ ID NO: 2832950 - RNA, 18 nt, Human
gacaguugucuagagaua

SEQ ID NO: 2832951 - RNA, 14 nt, Human
gacaguuuuucugu

SEQ ID NO: 2832952 - RNA, 11 nt, Human
gacauaaagcc

SEQ ID NO: 2832953 - RNA, 12 nt, Human
gacauaaagcca

SEQ ID NO: 2832954 - RNA, 18 nt, Human
gacauaaagccauguuuc

SEQ ID NO: 2832955 - RNA, 12 nt, Human
gacaguuucuua

SEQ ID NO: 2832956 - RNA, 17 nt, Human
gacaguuuaucaugaag

SEQ ID NO: 2832957 - RNA, 18 nt, Human
gacaguuuaucaugaagc

SEQ ID NO: 2832958 - RNA, 19 nt, Human
gacaguuuaucaugaagcc

SEQ ID NO: 2832959 - RNA, 20 nt, Human
gacaguuuaucaugaagccu

SEQ ID NO: 2832960 - RNA, 21 nt, Human
gacaguuuaucaugaagccug

SEQ ID NO: 2832961 - RNA, 23 nt, Human
gacaguuuaucaugaagccugug

SEQ ID NO: 2832962 - RNA, 14 nt, Human
gacaguuucuuagc

SEQ ID NO: 2832963 - RNA, 20 nt, Human
gacaguuucuuagcuuuuua

SEQ ID NO: 2832964 - RNA, 21 nt, Human
gacaguuucuuagcuuuuuaa

SEQ ID NO: 2832965 - RNA, 23 nt, Human
gacaguuucuuagcuuuuuaauu

SEQ ID NO: 2832966 - RNA, 13 nt, Human
gacaguuuguaaa

SEQ ID NO: 2832967 - RNA, 15 nt, Human
gacaguuuguaaaug

SEQ ID NO: 2832968 - RNA, 16 nt, Human
gacaguuuguaaaugu

SEQ ID NO: 2832969 - RNA, 17 nt, Human
gacaguuuguaaauguu

SEQ ID NO: 2832970 - RNA, 18 nt, Human
gacaguuuguaaauguua

SEQ ID NO: 2832971 - RNA, 19 nt, Human
gacaguuuguaaauguuau

SEQ ID NO: 2832972 - RNA, 20 nt, Human
gacaguuuguaaauguuauu

SEQ ID NO: 2832973 - RNA, 22 nt, Human
gacaggcauguucucugaggac

SEQ ID NO: 2832974 - RNA, 14 nt, Human
gacagggcauggcc

SEQ ID NO: 2832975 - RNA, 15 nt, Human
gacagggcauggcca

SEQ ID NO: 2832976 - RNA, 20 nt, Human
gacagggcauggccaggugg

SEQ ID NO: 2832977 - RNA, 10 nt, Human
gacagggcca

SEQ ID NO: 2832978 - RNA, 11 nt, Human
gacagggccag

SEQ ID NO: 2832979 - RNA, 12 nt, Human
gacagggccagu

SEQ ID NO: 2832980 - RNA, 13 nt, Human
gacagggccagug

SEQ ID NO: 2832981 - RNA, 22 nt, Human
gacagggcauggccagguggcc

SEQ ID NO: 2832982 - RNA, 14 nt, Human
gacaguucaagaaa

SEQ ID NO: 2832983 - RNA, 15 nt, Human
gacaguucacacccu

SEQ ID NO: 2832984 - RNA, 17 nt, Human
gacaguucacacccugc

SEQ ID NO: 2832985 - RNA, 18 nt, Human
gacaguucacacccugca

SEQ ID NO: 2832986 - RNA, 19 nt, Human
gacaguucacacccugcaa

SEQ ID NO: 2832987 - RNA, 14 nt, Human
gacagggccagugg

SEQ ID NO: 2832988 - RNA, 16 nt, Human
gacagggccagugggg

SEQ ID NO: 2832989 - RNA, 19 nt, Human
gacagggccaguggggccu

SEQ ID NO: 2832990 - RNA, 20 nt, Human
gacagggccaguggggccug

SEQ ID NO: 2832991 - RNA, 21 nt, Human
gacagggccaguggggccugu

SEQ ID NO: 2832992 - RNA, 22 nt, Human
gacagggccaguggggccugug

SEQ ID NO: 2832993 - RNA, 14 nt, Human
gacaguucugaaga

SEQ ID NO: 2832994 - RNA, 15 nt, Human
gacaguucugaagaa

SEQ ID NO: 2832995 - RNA, 20 nt, Human
gacagagacccucugccacc

SEQ ID NO: 2832996 - RNA, 15 nt, Human
gacagagaccuccug

SEQ ID NO: 2832997 - RNA, 16 nt, Human
gacagagaccuccugc

SEQ ID NO: 2832998 - RNA, 18 nt, Human
gacagacaucucugcacc

SEQ ID NO: 2832999 - RNA, 18 nt, Human
gacagaccacaucuuuau

SEQ ID NO: 2833000 - RNA, 22 nt, Human
gacagaccacaucuuuaucugu

SEQ ID NO: 2833001 - RNA, 22 nt, Human
gacagacugcaagaggcuccug

SEQ ID NO: 2833002 - RNA, 12 nt, Human
gacagagaaggg

SEQ ID NO: 2833003 - RNA, 22 nt, Human
gacagagaauaugucugcuccu

SEQ ID NO: 2833004 - RNA, 23 nt, Human
gacagacacuucuaaaugaagug

SEQ ID NO: 2833005 - RNA, 16 nt, Human
gacagacagcccucca

SEQ ID NO: 2833006 - RNA, 20 nt, Human
gacacuauaguuuaaaacac

SEQ ID NO: 2833007 - RNA, 23 nt, Human
gacacuauaguuuaaaacacauu

SEQ ID NO: 2833008 - RNA, 16 nt, Human
gacagagugagacucu

SEQ ID NO: 2833009 - RNA, 21 nt, Human
gacagagucucacuguugccc

SEQ ID NO: 2833010 - RNA, 19 nt, Human
gacagagugagacucuguc

SEQ ID NO: 2833011 - RNA, 20 nt, Human
gacagaugccccagagcugu

SEQ ID NO: 2833012 - RNA, 23 nt, Human
gacagaggcagccccauucugcc

SEQ ID NO: 2833013 - RNA, 15 nt, Human
gacagaggaugagcu

SEQ ID NO: 2833014 - RNA, 15 nt, Human
gacagaggggacucu

SEQ ID NO: 2833015 - RNA, 16 nt, Human
gacagaggggacucug

SEQ ID NO: 2833016 - RNA, 17 nt, Human
gacagaggggacucugg

SEQ ID NO: 2833017 - RNA, 19 nt, Human
gacagaggggacucugggc

SEQ ID NO: 2833018 - RNA, 20 nt, Human
gacagaggggacucugggcu

SEQ ID NO: 2833019 - RNA, 21 nt, Human
gacagaggggacucugggcua

SEQ ID NO: 2833020 - RNA, 12 nt, Human
gacagaggccug

SEQ ID NO: 2833021 - RNA, 13 nt, Human
gacagaggccugc

SEQ ID NO: 2833022 - RNA, 15 nt, Human
gacagaggccugccc

SEQ ID NO: 2833023 - RNA, 18 nt, Human
gaauuucauaucuacaga

SEQ ID NO: 2833024 - RNA, 17 nt, Human
gacacgccuuccccuca

SEQ ID NO: 2833025 - RNA, 21 nt, Human
gacacgccuuccccucagcca

SEQ ID NO: 2833026 - RNA, 21 nt, Human
gacacgcgccccccucccaga

SEQ ID NO: 2833027 - RNA, 22 nt, Human
gacacgcgccccccucccagag

SEQ ID NO: 2833028 - RNA, 23 nt, Human
gacacgcgccccccucccagagg

SEQ ID NO: 2833029 - RNA, 22 nt, Human
gacagacacaggcccggcucca

SEQ ID NO: 2833030 - RNA, 20 nt, Human
gacagacacaggcccggcuc

SEQ ID NO: 2833031 - RNA, 17 nt, Human
gacagacacaggcccgg

SEQ ID NO: 2833032 - RNA, 15 nt, Human
gacacggagcccagc

SEQ ID NO: 2833033 - RNA, 14 nt, Human
gacacuagaaaacu

SEQ ID NO: 2833034 - RNA, 17 nt, Human
gaaguaucuaaaagugu

SEQ ID NO: 2833035 - RNA, 19 nt, Human
gaaguaucuaaaaguguca

SEQ ID NO: 2833036 - RNA, 19 nt, Human
gaaguaguuuguauaacuu

SEQ ID NO: 2833037 - RNA, 12 nt, Human
gaagucauaugu

SEQ ID NO: 2833038 - RNA, 15 nt, Human
gaagucaugaagccc

SEQ ID NO: 2833039 - RNA, 19 nt, Human
gaagucaugaagcccaagu

SEQ ID NO: 2833040 - RNA, 15 nt, Human
gaaguaguucuguuu

SEQ ID NO: 2833041 - RNA, 20 nt, Human
gaaguaguucuguuuggugu

SEQ ID NO: 2833042 - RNA, 18 nt, Human
gaaguagcuugcucccug

SEQ ID NO: 2833043 - RNA, 19 nt, Human
gaaguagcuugcucccugu

SEQ ID NO: 2833044 - RNA, 18 nt, Human
gaagucucuagguucuga

SEQ ID NO: 2833045 - RNA, 18 nt, Human
gaagucgucuuaacucac

SEQ ID NO: 2833046 - RNA, 19 nt, Human
gaagggggggcuacauuau

SEQ ID NO: 2833047 - RNA, 20 nt, Human
gaagggggggcuacauuaua

SEQ ID NO: 2833048 - RNA, 12 nt, Human
gaaggugcugga

SEQ ID NO: 2833049 - RNA, 14 nt, Human
gaaggugcuggagg

SEQ ID NO: 2833050 - RNA, 16 nt, Human
gaaggugcuggaggug

SEQ ID NO: 2833051 - RNA, 17 nt, Human
gaaggugcuggaggugg

SEQ ID NO: 2833052 - RNA, 18 nt, Human
gaaggugcuggagguggg

SEQ ID NO: 2833053 - RNA, 19 nt, Human
gaaggugcuggagguggga

SEQ ID NO: 2833054 - RNA, 20 nt, Human
gaaggugcuggaggugggag

SEQ ID NO: 2833055 - RNA, 21 nt, Human
gaaggugcuggaggugggagc

SEQ ID NO: 2833056 - RNA, 23 nt, Human
gaaggugcuggaggugggagcag

SEQ ID NO: 2833057 - RNA, 23 nt, Human
gaagguggaccuuuuaaaguguu

SEQ ID NO: 2833058 - RNA, 19 nt, Human
gaaguacuugccagaaguu

SEQ ID NO: 2833059 - RNA, 23 nt, Human
gaaguacuugccagaaguugugg

SEQ ID NO: 2833060 - RNA, 23 nt, Human
gaagguggugggggugcagauga

SEQ ID NO: 2833061 - RNA, 16 nt, Human
gaaguacaugaauaca

SEQ ID NO: 2833062 - RNA, 20 nt, Human
gaauaggcauuaacacaaag

SEQ ID NO: 2833063 - RNA, 14 nt, Human
gaauauuuuaucuu

SEQ ID NO: 2833064 - RNA, 21 nt, Human
gaauauuuucaguaauguuau

SEQ ID NO: 2833065 - RNA, 22 nt, Human
gaauauuuuuugaggcuaaaga

SEQ ID NO: 2833066 - RNA, 15 nt, Human
gaaucaaaaauugaa

SEQ ID NO: 2833067 - RNA, 21 nt, Human
gaaucaaaaauugaagagaga

SEQ ID NO: 2833068 - RNA, 21 nt, Human
gaaucaagaugucagacuggc

SEQ ID NO: 2833069 - RNA, 20 nt, Human
gaaucaagaugucagacugg

SEQ ID NO: 2833070 - RNA, 18 nt, Human
gaaucaagagcugcccuc

SEQ ID NO: 2833071 - RNA, 19 nt, Human
gaaucaagagcugcccucc

SEQ ID NO: 2833072 - RNA, 14 nt, Human
gaaucaagagcugc

SEQ ID NO: 2833073 - RNA, 15 nt, Human
gaaucaagagcugcc

SEQ ID NO: 2833074 - RNA, 16 nt, Human
gaaucaagagcugccc

SEQ ID NO: 2833075 - RNA, 17 nt, Human
gaaucaagagcugcccu

SEQ ID NO: 2833076 - RNA, 22 nt, Human
gaauagcugggacuacaggugu

SEQ ID NO: 2833077 - RNA, 23 nt, Human
gaauagcugggacuacaggugug

SEQ ID NO: 2833078 - RNA, 19 nt, Human
gaauaccauuaaaacugcu

SEQ ID NO: 2833079 - RNA, 20 nt, Human
gaauaccauuaaaacugcuu

SEQ ID NO: 2833080 - RNA, 21 nt, Human
gaauaccauuaaaacugcuuu

SEQ ID NO: 2833081 - RNA, 22 nt, Human
gaauaccauuaaaacugcuuuu

SEQ ID NO: 2833082 - RNA, 12 nt, Human
gaauaagagacc

SEQ ID NO: 2833083 - RNA, 20 nt, Human
gaauaagagaccuguuuuaa

SEQ ID NO: 2833084 - RNA, 22 nt, Human
gaauaagagaccuguuuuaaaa

SEQ ID NO: 2833085 - RNA, 14 nt, Human
gaauaauaagcagg

SEQ ID NO: 2833086 - RNA, 16 nt, Human
gaauaauaagcaggau

SEQ ID NO: 2833087 - RNA, 23 nt, Human
gaauaauaagcaggauguuggcc

SEQ ID NO: 2833088 - RNA, 22 nt, Human
gaauaauaauuagguuaacauu

SEQ ID NO: 2833089 - RNA, 21 nt, Human
gaauaacucuguggcauuauu

SEQ ID NO: 2833090 - RNA, 11 nt, Human
gaauaagaaaa

SEQ ID NO: 2833091 - RNA, 23 nt, Human
gaauaagaaaacaaucacacuca

SEQ ID NO: 2833092 - RNA, 17 nt, Human
gaauaagaaaguuucac

SEQ ID NO: 2833093 - RNA, 16 nt, Human
gaauaagaauggagca

SEQ ID NO: 2833094 - RNA, 22 nt, Human
gaauacaauauauagcuggcaa

SEQ ID NO: 2833095 - RNA, 12 nt, Human
gaauacagcagc

SEQ ID NO: 2833096 - RNA, 16 nt, Human
gaauacagcagcaaga

SEQ ID NO: 2833097 - RNA, 18 nt, Human
gaauacagcagcaagaaa

SEQ ID NO: 2833098 - RNA, 20 nt, Human
gaauacagcagcaagaaaaa

SEQ ID NO: 2833099 - RNA, 21 nt, Human
gaauacagcagcaagaaaaaa

SEQ ID NO: 2833100 - RNA, 21 nt, Human
gaauaaaaggcuugaagcugu

SEQ ID NO: 2833101 - RNA, 12 nt, Human
gaauaaaagugc

SEQ ID NO: 2833102 - RNA, 14 nt, Human
gaauaaaaaagaaa

SEQ ID NO: 2833103 - RNA, 14 nt, Human
gaauaaaauccuaa

SEQ ID NO: 2833104 - RNA, 20 nt, Human
gaauaaaauccuaagacaca

SEQ ID NO: 2833105 - RNA, 23 nt, Human
gaauaaaauccuaagacacaaau

SEQ ID NO: 2833106 - RNA, 13 nt, Human
gaaguuuucugua

SEQ ID NO: 2833107 - RNA, 16 nt, Human
gaaguuuguccauuug

SEQ ID NO: 2833108 - RNA, 20 nt, Human
gaaguuuguccauuuguaaa

SEQ ID NO: 2833109 - RNA, 21 nt, Human
gaaguuuguccauuuguaaaa

SEQ ID NO: 2833110 - RNA, 14 nt, Human
gaaguaguccuugg

SEQ ID NO: 2833111 - RNA, 13 nt, Human
gaaguuuuacauu

SEQ ID NO: 2833112 - RNA, 19 nt, Human
gaauuuauugcacauuguu

SEQ ID NO: 2833113 - RNA, 13 nt, Human
gaauuuaaauaua

SEQ ID NO: 2833114 - RNA, 14 nt, Human
gaauuuaaauauaa

SEQ ID NO: 2833115 - RNA, 15 nt, Human
gaauuuaaauauaau

SEQ ID NO: 2833116 - RNA, 17 nt, Human
gaauuuaaauauaauuc

SEQ ID NO: 2833117 - RNA, 20 nt, Human
gaauuuaaauauaauucugu

SEQ ID NO: 2833118 - RNA, 22 nt, Human
gaauuuaaauauaauucuguaa

SEQ ID NO: 2833119 - RNA, 23 nt, Human
gaauuuaaauauaauucuguaaa

SEQ ID NO: 2833120 - RNA, 16 nt, Human
gaauuuacuggacaua

SEQ ID NO: 2833121 - RNA, 13 nt, Human
gaauuuauaauuc

SEQ ID NO: 2833122 - RNA, 16 nt, Human
gaauuuauaauucagu

SEQ ID NO: 2833123 - RNA, 18 nt, Human
gaauuuauaauucaguau

SEQ ID NO: 2833124 - RNA, 23 nt, Human
gaauuuauaccuaccuguguggu

SEQ ID NO: 2833125 - RNA, 13 nt, Human
gaauuuauaccuc

SEQ ID NO: 2833126 - RNA, 20 nt, Human
gaauuuaucacacuucugug

SEQ ID NO: 2833127 - RNA, 22 nt, Human
gaauuuaucacacuucugugag

SEQ ID NO: 2833128 - RNA, 12 nt, Human
gaauugugcaaa

SEQ ID NO: 2833129 - RNA, 21 nt, Human
gaauugaucauuuucccccca

SEQ ID NO: 2833130 - RNA, 12 nt, Human
gaauugauuugc

SEQ ID NO: 2833131 - RNA, 14 nt, Human
gaauucuuuugcca

SEQ ID NO: 2833132 - RNA, 17 nt, Human
gaauugauuugcauuga

SEQ ID NO: 2833133 - RNA, 15 nt, Human
gaauugauuugcauu

SEQ ID NO: 2833134 - RNA, 14 nt, Human
gaauugauuugcau

SEQ ID NO: 2833135 - RNA, 13 nt, Human
gaauugauuugca

SEQ ID NO: 2833136 - RNA, 12 nt, Human
gaauuguuacau

SEQ ID NO: 2833137 - RNA, 20 nt, Human
gaauuguuuucuuuaaagau

SEQ ID NO: 2833138 - RNA, 22 nt, Human
gaauuguugacaaauguaaaca

SEQ ID NO: 2833139 - RNA, 9 nt, Human
gaauuguuu

SEQ ID NO: 2833140 - RNA, 23 nt, Human
gaauucuugaaggaaaaugauac

SEQ ID NO: 2833141 - RNA, 13 nt, Human
gaauugaaacacu

SEQ ID NO: 2833142 - RNA, 14 nt, Human
gaauugaaacacuu

SEQ ID NO: 2833143 - RNA, 20 nt, Human
gaauugaaacacuuuuuugg

SEQ ID NO: 2833144 - RNA, 18 nt, Human
gaauucucagugccaacu

SEQ ID NO: 2833145 - RNA, 17 nt, Human
gaauugagaugauuaaa

SEQ ID NO: 2833146 - RNA, 20 nt, Human
gaauugaucauuuucccccc

SEQ ID NO: 2833147 - RNA, 17 nt, Human
gaauuccauuugaggau

SEQ ID NO: 2833148 - RNA, 18 nt, Human
gaauuccuaacuuuucaa

SEQ ID NO: 2833149 - RNA, 17 nt, Human
gaauuccuagaauuaaa

SEQ ID NO: 2833150 - RNA, 23 nt, Human
gaauucaaacuggggccuccaga

SEQ ID NO: 2833151 - RNA, 23 nt, Human
gaauucagaagaccccugacuca

SEQ ID NO: 2833152 - RNA, 17 nt, Human
gaaugggaucaugaaag

SEQ ID NO: 2833153 - RNA, 21 nt, Human
gaaugggaucaugaaaguaga

SEQ ID NO: 2833154 - RNA, 20 nt, Human
gaauggauuggauuauuuaa

SEQ ID NO: 2833155 - RNA, 19 nt, Human
gaauggauuggauuauuua

SEQ ID NO: 2833156 - RNA, 21 nt, Human
gaauggaaggguucuggcugc

SEQ ID NO: 2833157 - RNA, 22 nt, Human
gaauggaaggguucuggcugcc

SEQ ID NO: 2833158 - RNA, 15 nt, Human
gaauggacauccugu

SEQ ID NO: 2833159 - RNA, 19 nt, Human
gaauggacauccuguauaa

SEQ ID NO: 2833160 - RNA, 16 nt, Human
gaauggacuuuggaag

SEQ ID NO: 2833161 - RNA, 19 nt, Human
gaauggacuuuggaagcag

SEQ ID NO: 2833162 - RNA, 21 nt, Human
gaauggacuuuggaagcaggg

SEQ ID NO: 2833163 - RNA, 11 nt, Human
gaauggagcag

SEQ ID NO: 2833164 - RNA, 21 nt, Human
gaauggagcaguacaugggaa

SEQ ID NO: 2833165 - RNA, 22 nt, Human
gaauggauaaaauaaugcugca

SEQ ID NO: 2833166 - RNA, 20 nt, Human
gaaugguacaugucuuccau

SEQ ID NO: 2833167 - RNA, 22 nt, Human
gaauguaaaagaacuuacugau

SEQ ID NO: 2833168 - RNA, 13 nt, Human
gaauguauuuauu

SEQ ID NO: 2833169 - RNA, 16 nt, Human
gaauguauuuauuugg

SEQ ID NO: 2833170 - RNA, 14 nt, Human
gaauguauguaaug

SEQ ID NO: 2833171 - RNA, 17 nt, Human
gaauguauguaaugugu

SEQ ID NO: 2833172 - RNA, 14 nt, Human
gaauguaucuguga

SEQ ID NO: 2833173 - RNA, 15 nt, Human
gaauguaucugugaa

SEQ ID NO: 2833174 - RNA, 16 nt, Human
gaauguaucugugaag

SEQ ID NO: 2833175 - RNA, 17 nt, Human
gaauguaucugugaagu

SEQ ID NO: 2833176 - RNA, 18 nt, Human
gaaugaaccacaucuugc

SEQ ID NO: 2833177 - RNA, 22 nt, Human
gaaugaaccacaucuugcucug

SEQ ID NO: 2833178 - RNA, 23 nt, Human
gaaugaaccacaucuugcucugc

SEQ ID NO: 2833179 - RNA, 17 nt, Human
gaaugaaccuucuggcc

SEQ ID NO: 2833180 - RNA, 14 nt, Human
gaaucuuuguuaag

SEQ ID NO: 2833181 - RNA, 15 nt, Human
gaaugaaccacugcc

SEQ ID NO: 2833182 - RNA, 15 nt, Human
gaaugaaccuucugg

SEQ ID NO: 2833183 - RNA, 15 nt, Human
gaaugaaaacucauu

SEQ ID NO: 2833184 - RNA, 13 nt, Human
gaaugaaaagaca

SEQ ID NO: 2833185 - RNA, 20 nt, Human
gaaugaaaagacaagaaaau

SEQ ID NO: 2833186 - RNA, 15 nt, Human
gaaugaaaaaacagu

SEQ ID NO: 2833187 - RNA, 12 nt, Human
gaaugaaaaaug

SEQ ID NO: 2833188 - RNA, 13 nt, Human
gaaugaaaaauga

SEQ ID NO: 2833189 - RNA, 14 nt, Human
gaaugaaaaaugaa

SEQ ID NO: 2833190 - RNA, 17 nt, Human
gaaugaaaaaugaaaga

SEQ ID NO: 2833191 - RNA, 19 nt, Human
gaaugaaaaaugaaagaug

SEQ ID NO: 2833192 - RNA, 20 nt, Human
gaaugaaaaaugaaagauga

SEQ ID NO: 2833193 - RNA, 21 nt, Human
gaaugaaaaaugaaagaugau

SEQ ID NO: 2833194 - RNA, 22 nt, Human
gaaugaaaaaugaaagaugauu

SEQ ID NO: 2833195 - RNA, 11 nt, Human
gaaugcagugg

SEQ ID NO: 2833196 - RNA, 13 nt, Human
gaaugcuuuagga

SEQ ID NO: 2833197 - RNA, 18 nt, Human
gaaugcuuuuugaauguu

SEQ ID NO: 2833198 - RNA, 20 nt, Human
gaaugccagugugcugaugg

SEQ ID NO: 2833199 - RNA, 21 nt, Human
gaaugccauagucaaagagag

SEQ ID NO: 2833200 - RNA, 23 nt, Human
gaaugccauagucaaagagaguu

SEQ ID NO: 2833201 - RNA, 17 nt, Human
gaaugccacccacaucu

SEQ ID NO: 2833202 - RNA, 12 nt, Human
gaaugcauugau

SEQ ID NO: 2833203 - RNA, 20 nt, Human
gaaugcauugauauugugaa

SEQ ID NO: 2833204 - RNA, 21 nt, Human
gaaugcauugauauugugaac

SEQ ID NO: 2833205 - RNA, 14 nt, Human
gaaugcauaaaaug

SEQ ID NO: 2833206 - RNA, 20 nt, Human
gaagauaauguaaagguuuu

SEQ ID NO: 2833207 - RNA, 13 nt, Human
gaagauaauuguu

SEQ ID NO: 2833208 - RNA, 16 nt, Human
gaagauaauuguugaa

SEQ ID NO: 2833209 - RNA, 17 nt, Human
gaagauaauuguugaaa

SEQ ID NO: 2833210 - RNA, 19 nt, Human
gaagauaauuguugaaauu

SEQ ID NO: 2833211 - RNA, 18 nt, Human
gaagaggguguguuugaa

SEQ ID NO: 2833212 - RNA, 17 nt, Human
gaagaggguuuuaggua

SEQ ID NO: 2833213 - RNA, 17 nt, Human
gaagcauuuacuuugug

SEQ ID NO: 2833214 - RNA, 22 nt, Human
gaagcauuccuucuuugauaau

SEQ ID NO: 2833215 - RNA, 15 nt, Human
gaagcauuccuucuu

SEQ ID NO: 2833216 - RNA, 18 nt, Human
gaagcauuccuucuuuga

SEQ ID NO: 2833217 - RNA, 15 nt, Human
gaagcauucagagag

SEQ ID NO: 2833218 - RNA, 16 nt, Human
gaagcauucagagagc

SEQ ID NO: 2833219 - RNA, 17 nt, Human
gaagcauucagagagca

SEQ ID NO: 2833220 - RNA, 23 nt, Human
gaagauguugaagaauacaguua

SEQ ID NO: 2833221 - RNA, 18 nt, Human
gaagauguugagaaaccu

SEQ ID NO: 2833222 - RNA, 15 nt, Human
gaagcauucucccca

SEQ ID NO: 2833223 - RNA, 17 nt, Human
gaagcauucuccccagu

SEQ ID NO: 2833224 - RNA, 19 nt, Human
gaagcauucuccccagugu

SEQ ID NO: 2833225 - RNA, 11 nt, Human
gaagcccuguu

SEQ ID NO: 2833226 - RNA, 14 nt, Human
gaagcccuguugug

SEQ ID NO: 2833227 - RNA, 23 nt, Human
gaagcccuguugugccacagagu

SEQ ID NO: 2833228 - RNA, 13 nt, Human
gaagcccuggaga

SEQ ID NO: 2833229 - RNA, 13 nt, Human
gaagcccucccag

SEQ ID NO: 2833230 - RNA, 15 nt, Human
gaagcccucccaggu

SEQ ID NO: 2833231 - RNA, 19 nt, Human
gaagcauguuucauguuuu

SEQ ID NO: 2833232 - RNA, 22 nt, Human
gaagaacuagcauauagccauu

SEQ ID NO: 2833233 - RNA, 16 nt, Human
gaagacuggaagcuaa

SEQ ID NO: 2833234 - RNA, 15 nt, Human
gaagacuggaagcua

SEQ ID NO: 2833235 - RNA, 17 nt, Human
gaagacuggaagcuaau

SEQ ID NO: 2833236 - RNA, 16 nt, Human
gaacucagcugucugu

SEQ ID NO: 2833237 - RNA, 20 nt, Human
gaacucagcugucuguggcu

SEQ ID NO: 2833238 - RNA, 21 nt, Human
gaacucagcugucuguggcuu

SEQ ID NO: 2833239 - RNA, 14 nt, Human
gaacucaucacugu

SEQ ID NO: 2833240 - RNA, 16 nt, Human
gaacucaucacugugg

SEQ ID NO: 2833241 - RNA, 17 nt, Human
gaacucaucacuguggc

SEQ ID NO: 2833242 - RNA, 18 nt, Human
gaacucaucacuguggcu

SEQ ID NO: 2833243 - RNA, 19 nt, Human
gaacucaucacuguggcug

SEQ ID NO: 2833244 - RNA, 15 nt, Human
gaacuuuuucuuuuc

SEQ ID NO: 2833245 - RNA, 18 nt, Human
gaacucaucccuaaugcu

SEQ ID NO: 2833246 - RNA, 22 nt, Human
gaacucaucccuaaugcugcag

SEQ ID NO: 2833247 - RNA, 11 nt, Human
gaacuuuggga

SEQ ID NO: 2833248 - RNA, 14 nt, Human
gaacuuugggaagc

SEQ ID NO: 2833249 - RNA, 15 nt, Human
gaacuuuuuuaaaua

SEQ ID NO: 2833250 - RNA, 16 nt, Human
gaacuuuuuuaaauaa

SEQ ID NO: 2833251 - RNA, 17 nt, Human
gaacuuuuuuaaauaaa

SEQ ID NO: 2833252 - RNA, 18 nt, Human
gaacuuuuuuaaauaaac

SEQ ID NO: 2833253 - RNA, 19 nt, Human
gaacuuuuuuaaauaaacu

SEQ ID NO: 2833254 - RNA, 20 nt, Human
gaacuuuuuuaaauaaacuu

SEQ ID NO: 2833255 - RNA, 21 nt, Human
gaacuuuuuuaaauaaacuuu

SEQ ID NO: 2833256 - RNA, 22 nt, Human
gaacuuuuuuaaauaaacuuuu

SEQ ID NO: 2833257 - RNA, 23 nt, Human
gaacuuuuuuaaauaaacuuuuu

SEQ ID NO: 2833258 - RNA, 10 nt, Human
gaagaaaaaa

SEQ ID NO: 2833259 - RNA, 11 nt, Human
gaagaaaaaaa

SEQ ID NO: 2833260 - RNA, 20 nt, Human
gaagaaaaaaacgaaaacag

SEQ ID NO: 2833261 - RNA, 14 nt, Human
gaagaaaaaaaucu

SEQ ID NO: 2833262 - RNA, 16 nt, Human
gaagaaaaaaaucuuc

SEQ ID NO: 2833263 - RNA, 21 nt, Human
gaagaaaaaaaucuucuccag

SEQ ID NO: 2833264 - RNA, 23 nt, Human
gaagaaaaaaaucuucuccagau

SEQ ID NO: 2833265 - RNA, 15 nt, Human
gaagagaaccagcca

SEQ ID NO: 2833266 - RNA, 14 nt, Human
gaagagaagcugcu

SEQ ID NO: 2833267 - RNA, 15 nt, Human
gaagagaagcugcug

SEQ ID NO: 2833268 - RNA, 16 nt, Human
gaagagaagcugcuga

SEQ ID NO: 2833269 - RNA, 17 nt, Human
gaagagaagcugcugac

SEQ ID NO: 2833270 - RNA, 20 nt, Human
gaagagaagcugcugaccaa

SEQ ID NO: 2833271 - RNA, 22 nt, Human
gaacuuuuccucuguaucacug

SEQ ID NO: 2833272 - RNA, 22 nt, Human
gaagagagaaggggcgggaaua

SEQ ID NO: 2833273 - RNA, 18 nt, Human
gaagagagauauaucuga

SEQ ID NO: 2833274 - RNA, 19 nt, Human
gaagagagauauaucugaa

SEQ ID NO: 2833275 - RNA, 23 nt, Human
gaagagagauauaucugaaaacu

SEQ ID NO: 2833276 - RNA, 14 nt, Human
gaagagaggggaag

SEQ ID NO: 2833277 - RNA, 13 nt, Human
gaagagcaaaaau

SEQ ID NO: 2833278 - RNA, 16 nt, Human
gaagagcaaaaauauc

SEQ ID NO: 2833279 - RNA, 17 nt, Human
gaagagcaaaaauaucc

SEQ ID NO: 2833280 - RNA, 21 nt, Human
gaagagcaaaaauaucccuuc

SEQ ID NO: 2833281 - RNA, 22 nt, Human
gaagagcaaaaauaucccuucc

SEQ ID NO: 2833282 - RNA, 13 nt, Human
gaagagaggagag

SEQ ID NO: 2833283 - RNA, 14 nt, Human
gaagagaggagagg

SEQ ID NO: 2833284 - RNA, 19 nt, Human
gaagagaggagaggagaga

SEQ ID NO: 2833285 - RNA, 21 nt, Human
gaagagaggagaggagagagg

SEQ ID NO: 2833286 - RNA, 12 nt, Human
gaagagccacag

SEQ ID NO: 2833287 - RNA, 13 nt, Human
gaagagccacagu

SEQ ID NO: 2833288 - RNA, 15 nt, Human
gaagaggagcccuca

SEQ ID NO: 2833289 - RNA, 13 nt, Human
gaaaauaguuugu

SEQ ID NO: 2833290 - RNA, 14 nt, Human
gaaaauaguuuguu

SEQ ID NO: 2833291 - RNA, 21 nt, Human
gaaaauauaaaacaaauaaaa

SEQ ID NO: 2833292 - RNA, 19 nt, Human
gaaaaaucacaauuuuuaa

SEQ ID NO: 2833293 - RNA, 23 nt, Human
gaaaauaaaucaaugcuauaacu

SEQ ID NO: 2833294 - RNA, 20 nt, Human
gaaaauaaagacaaccauau

SEQ ID NO: 2833295 - RNA, 22 nt, Human
gaaaauaaagacaaccauauuu

SEQ ID NO: 2833296 - RNA, 23 nt, Human
gaaaauaaagacaaccauauuua

SEQ ID NO: 2833297 - RNA, 18 nt, Human
gaaauuguacauauuugu

SEQ ID NO: 2833298 - RNA, 19 nt, Human
gaaauuuauuaguuaauau

SEQ ID NO: 2833299 - RNA, 21 nt, Human
gaaauuuauuaguuaauauau

SEQ ID NO: 2833300 - RNA, 11 nt, Human
gaaauuucaga

SEQ ID NO: 2833301 - RNA, 21 nt, Human
gaacagcuaugggagccccag

SEQ ID NO: 2833302 - RNA, 23 nt, Human
gaacagcuaugggagccccaggg

SEQ ID NO: 2833303 - RNA, 22 nt, Human
gaacagcuaugggagccccagg

SEQ ID NO: 2833304 - RNA, 17 nt, Human
gaacagauucacacugu

SEQ ID NO: 2833305 - RNA, 21 nt, Human
gaacagauucacacugucugg

SEQ ID NO: 2833306 - RNA, 18 nt, Human
gaacacucuuuugcuuua

SEQ ID NO: 2833307 - RNA, 16 nt, Human
gaacacucuuuugcuu

SEQ ID NO: 2833308 - RNA, 21 nt, Human
gaaauuucagauucccagagc

SEQ ID NO: 2833309 - RNA, 23 nt, Human
gaacacugcacucuuaagcuucc

SEQ ID NO: 2833310 - RNA, 13 nt, Human
gaacacugcccuc

SEQ ID NO: 2833311 - RNA, 17 nt, Human
gaacacugcccucgcac

SEQ ID NO: 2833312 - RNA, 22 nt, Human
gaacagaucuuuuacuuuggcc

SEQ ID NO: 2833313 - RNA, 13 nt, Human
gaacagcauggca

SEQ ID NO: 2833314 - RNA, 16 nt, Human
gaacagcauggcacuc

SEQ ID NO: 2833315 - RNA, 18 nt, Human
gaacagcauggcacuccc

SEQ ID NO: 2833316 - RNA, 19 nt, Human
gaacagcauggcacucccu

SEQ ID NO: 2833317 - RNA, 20 nt, Human
gaacagcauggcacucccuc

SEQ ID NO: 2833318 - RNA, 22 nt, Human
gaacauaaaaaggacaucagca

SEQ ID NO: 2833319 - RNA, 18 nt, Human
gaacauaaaaaggacauc

SEQ ID NO: 2833320 - RNA, 16 nt, Human
gaacauaaaaaggaca

SEQ ID NO: 2833321 - RNA, 21 nt, Human
gaacagcgaaguagcuugcuc

SEQ ID NO: 2833322 - RNA, 14 nt, Human
gaacauaaaaagga

SEQ ID NO: 2833323 - RNA, 18 nt, Human
gaacagugcuugccacag

SEQ ID NO: 2833324 - RNA, 20 nt, Human
gaacaucaucaaggcacugc

SEQ ID NO: 2833325 - RNA, 23 nt, Human
gaacaucaccgacgcgucuccug

SEQ ID NO: 2833326 - RNA, 17 nt, Human
gaacauccaaccuuccc

SEQ ID NO: 2833327 - RNA, 21 nt, Human
gaacaucaucaaggcacugcc

SEQ ID NO: 2833328 - RNA, 22 nt, Human
gaacaucaucaaggcacugccu

SEQ ID NO: 2833329 - RNA, 18 nt, Human
gaacauccaaccuuccca

SEQ ID NO: 2833330 - RNA, 15 nt, Human
gaacaucauuagaac

SEQ ID NO: 2833331 - RNA, 21 nt, Human
gaacauaaagguaaaacaaaa

SEQ ID NO: 2833332 - RNA, 12 nt, Human
gaacgcagcccu

SEQ ID NO: 2833333 - RNA, 16 nt, Human
gaacgaugugucugua

SEQ ID NO: 2833334 - RNA, 22 nt, Human
gaacgcagcccuagagccugcc

SEQ ID NO: 2833335 - RNA, 23 nt, Human
gaacgcagcccuagagccugccu

SEQ ID NO: 2833336 - RNA, 16 nt, Human
gaacgcagcccuagag

SEQ ID NO: 2833337 - RNA, 17 nt, Human
gaacgcagcccuagagc

SEQ ID NO: 2833338 - RNA, 20 nt, Human
gaacgcagcccuagagccug

SEQ ID NO: 2833339 - RNA, 21 nt, Human
gaacgcagcccuagagccugc

SEQ ID NO: 2833340 - RNA, 12 nt, Human
gaacuaaagaag

SEQ ID NO: 2833341 - RNA, 19 nt, Human
gaacuaaagguggccacaa

SEQ ID NO: 2833342 - RNA, 14 nt, Human
gaacucacuggggc

SEQ ID NO: 2833343 - RNA, 16 nt, Human
gaacucacuggggccu

SEQ ID NO: 2833344 - RNA, 16 nt, Human
gaacucaccuggggcu

SEQ ID NO: 2833345 - RNA, 21 nt, Human
gaacucaccuggggcugcugg

SEQ ID NO: 2833346 - RNA, 22 nt, Human
gaacucaccuggggcugcuggc

SEQ ID NO: 2833347 - RNA, 18 nt, Human
gaacucagaucugucuga

SEQ ID NO: 2833348 - RNA, 16 nt, Human
gaacuaauaaauacau

SEQ ID NO: 2833349 - RNA, 17 nt, Human
gaacuaauaaauacaua

SEQ ID NO: 2833350 - RNA, 19 nt, Human
gaacuaauuucuucuccug

SEQ ID NO: 2833351 - RNA, 17 nt, Human
gaacuaagaaacuuuug

SEQ ID NO: 2833352 - RNA, 18 nt, Human
gaacuaagaaacuuuugu

SEQ ID NO: 2833353 - RNA, 22 nt, Human
gaacuaagaaacuuuuguaaag

SEQ ID NO: 2833354 - RNA, 23 nt, Human
gaacuaagaaacuuuuguaaaga

SEQ ID NO: 2833355 - RNA, 12 nt, Human
gaacuaaauguu

SEQ ID NO: 2833356 - RNA, 13 nt, Human
gaacuaaauguuc

SEQ ID NO: 2833357 - RNA, 14 nt, Human
gaacuaaauguucu

SEQ ID NO: 2833358 - RNA, 15 nt, Human
gaacuaaauguucua

SEQ ID NO: 2833359 - RNA, 16 nt, Human
gaacuaaauguucuau

SEQ ID NO: 2833360 - RNA, 13 nt, Human
gaacuaacacgug

SEQ ID NO: 2833361 - RNA, 18 nt, Human
gaacuaacacgugaugug

SEQ ID NO: 2833362 - RNA, 22 nt, Human
gaacuacgcuugcucauuuuuu

SEQ ID NO: 2833363 - RNA, 19 nt, Human
gaacuagacugccuggguu

SEQ ID NO: 2833364 - RNA, 16 nt, Human
gaacuagagaugugca

SEQ ID NO: 2833365 - RNA, 17 nt, Human
gaacuagagaugugcaa

SEQ ID NO: 2833366 - RNA, 14 nt, Human
gaaccucuucccca

SEQ ID NO: 2833367 - RNA, 13 nt, Human
gaaccucuucccc

SEQ ID NO: 2833368 - RNA, 12 nt, Human
gaaccucugucu

SEQ ID NO: 2833369 - RNA, 14 nt, Human
gaaccucugucuca

SEQ ID NO: 2833370 - RNA, 15 nt, Human
gaaccucugucucau

SEQ ID NO: 2833371 - RNA, 18 nt, Human
gaaccucugucucauccu

SEQ ID NO: 2833372 - RNA, 22 nt, Human
gaaccucugucucauccuccug

SEQ ID NO: 2833373 - RNA, 18 nt, Human
gaaccucaggcuuccuug

SEQ ID NO: 2833374 - RNA, 12 nt, Human
gaaccucccaga

SEQ ID NO: 2833375 - RNA, 13 nt, Human
gaaccucccagag

SEQ ID NO: 2833376 - RNA, 14 nt, Human
gaaccucccagagg

SEQ ID NO: 2833377 - RNA, 18 nt, Human
gaaccucccagaggucca

SEQ ID NO: 2833378 - RNA, 19 nt, Human
gaaccucccagagguccag

SEQ ID NO: 2833379 - RNA, 21 nt, Human
gaaccucccagagguccagcc

SEQ ID NO: 2833380 - RNA, 22 nt, Human
gaaccucccagagguccagccc

SEQ ID NO: 2833381 - RNA, 14 nt, Human
gaaccucaggcuuc

SEQ ID NO: 2833382 - RNA, 11 nt, Human
gaaccucaggc

SEQ ID NO: 2833383 - RNA, 15 nt, Human
gaaccuaugaagcaa

SEQ ID NO: 2833384 - RNA, 21 nt, Human
gaaccucaccccgaggcccug

SEQ ID NO: 2833385 - RNA, 22 nt, Human
gaaccucaccccgaggcccugc

SEQ ID NO: 2833386 - RNA, 23 nt, Human
gaaccucaccccgaggcccugca

SEQ ID NO: 2833387 - RNA, 11 nt, Human
gaaccucaccu

SEQ ID NO: 2833388 - RNA, 20 nt, Human
gaacauuucuguaaauacca

SEQ ID NO: 2833389 - RNA, 13 nt, Human
gaacauuugugau

SEQ ID NO: 2833390 - RNA, 15 nt, Human
gaacauuugugauau

SEQ ID NO: 2833391 - RNA, 19 nt, Human
gaacaugugagagguuuga

SEQ ID NO: 2833392 - RNA, 20 nt, Human
gaacauuccaaggaguugga

SEQ ID NO: 2833393 - RNA, 10 nt, Human
gaacauugua

SEQ ID NO: 2833394 - RNA, 16 nt, Human
gaacauuuauuuuaug

SEQ ID NO: 2833395 - RNA, 17 nt, Human
gaacauuuauuuuauga

SEQ ID NO: 2833396 - RNA, 18 nt, Human
gaacauuuauuuuaugag

SEQ ID NO: 2833397 - RNA, 19 nt, Human
gaacauuuauuuuaugaga

SEQ ID NO: 2833398 - RNA, 21 nt, Human
gaacauuuauuuuaugagaaa

SEQ ID NO: 2833399 - RNA, 22 nt, Human
gaacauuuauuuuaugagaaau

SEQ ID NO: 2833400 - RNA, 17 nt, Human
gauccucuccuuugaaa

SEQ ID NO: 2833401 - RNA, 21 nt, Human
gauccucuccuuugaaaccug

SEQ ID NO: 2833402 - RNA, 16 nt, Human
gauccucccaggcuuc

SEQ ID NO: 2833403 - RNA, 23 nt, Human
gaucuaaggaugucacagggcca

SEQ ID NO: 2833404 - RNA, 14 nt, Human
gaucuaaggcuguu

SEQ ID NO: 2833405 - RNA, 13 nt, Human
gaucuacaugaau

SEQ ID NO: 2833406 - RNA, 21 nt, Human
gaucuacaugaaugcaaaaca

SEQ ID NO: 2833407 - RNA, 12 nt, Human
gauccugugaag

SEQ ID NO: 2833408 - RNA, 22 nt, Human
gauccugugaggagccccaucu

SEQ ID NO: 2833409 - RNA, 23 nt, Human
gauccugugaggagccccaucug

SEQ ID NO: 2833410 - RNA, 20 nt, Human
gauccugucuuuaaggaaaa

SEQ ID NO: 2833411 - RNA, 19 nt, Human
gauccugucuuuaaggaaa

SEQ ID NO: 2833412 - RNA, 16 nt, Human
gauccugucuuuaagg

SEQ ID NO: 2833413 - RNA, 22 nt, Human
gauccuggguacugaaagccuu

SEQ ID NO: 2833414 - RNA, 23 nt, Human
gaucuacaugaggaacuguagau

SEQ ID NO: 2833415 - RNA, 21 nt, Human
gaucuaaggaugucacagggc

SEQ ID NO: 2833416 - RNA, 18 nt, Human
gaucuagaauaaucuugc

SEQ ID NO: 2833417 - RNA, 17 nt, Human
gauccucccaccucagc

SEQ ID NO: 2833418 - RNA, 16 nt, Human
gauccucccaccucag

SEQ ID NO: 2833419 - RNA, 20 nt, Human
gaucagcuuucaaagcauuu

SEQ ID NO: 2833420 - RNA, 15 nt, Human
gauccuagauccuaa

SEQ ID NO: 2833421 - RNA, 23 nt, Human
gauccuaaugaaugcauaaaaug

SEQ ID NO: 2833422 - RNA, 19 nt, Human
gauccuaacugaagagaca

SEQ ID NO: 2833423 - RNA, 20 nt, Human
gauccuaacugaagagacag

SEQ ID NO: 2833424 - RNA, 16 nt, Human
gauccuaagcaucuaa

SEQ ID NO: 2833425 - RNA, 19 nt, Human
gauccuaagcaucuaaguu

SEQ ID NO: 2833426 - RNA, 13 nt, Human
gaucauccacugu

SEQ ID NO: 2833427 - RNA, 15 nt, Human
gaucaucaacaagau

SEQ ID NO: 2833428 - RNA, 21 nt, Human
gaucaucaacaagauuuccuu

SEQ ID NO: 2833429 - RNA, 13 nt, Human
gaucaucaugcag

SEQ ID NO: 2833430 - RNA, 18 nt, Human
gaucauagguauuucaaa

SEQ ID NO: 2833431 - RNA, 17 nt, Human
gaucauagguauuucaa

SEQ ID NO: 2833432 - RNA, 19 nt, Human
gaucauaaaguuagaaucu

SEQ ID NO: 2833433 - RNA, 13 nt, Human
gaucauaaggcuu

SEQ ID NO: 2833434 - RNA, 17 nt, Human
gaucauaaggcuucaaa

SEQ ID NO: 2833435 - RNA, 15 nt, Human
gaucauaagugaauu

SEQ ID NO: 2833436 - RNA, 17 nt, Human
gaucauaagugaauuua

SEQ ID NO: 2833437 - RNA, 19 nt, Human
gaucauaagugaauuuaua

SEQ ID NO: 2833438 - RNA, 14 nt, Human
gaucccucucugga

SEQ ID NO: 2833439 - RNA, 19 nt, Human
gaucccugucuuuccuaag

SEQ ID NO: 2833440 - RNA, 23 nt, Human
gaugcaccagcccuuagcaggga

SEQ ID NO: 2833441 - RNA, 15 nt, Human
gaugcaccagcccuu

SEQ ID NO: 2833442 - RNA, 14 nt, Human
gaugcaccagcccu

SEQ ID NO: 2833443 - RNA, 15 nt, Human
gaugaccuggauaac

SEQ ID NO: 2833444 - RNA, 14 nt, Human
gaugagaacaaagc

SEQ ID NO: 2833445 - RNA, 15 nt, Human
gaugagaacaaagcu

SEQ ID NO: 2833446 - RNA, 17 nt, Human
gaugagaacaaagcugu

SEQ ID NO: 2833447 - RNA, 22 nt, Human
gaugagaacaaagcuguuaaac

SEQ ID NO: 2833448 - RNA, 21 nt, Human
gaugagaauuucuaaaaagau

SEQ ID NO: 2833449 - RNA, 22 nt, Human
gaugagaauuucuaaaaagauu

SEQ ID NO: 2833450 - RNA, 14 nt, Human
gaugagagcccaga

SEQ ID NO: 2833451 - RNA, 15 nt, Human
gaugagagcccagag

SEQ ID NO: 2833452 - RNA, 17 nt, Human
gaugagagcccagaggu

SEQ ID NO: 2833453 - RNA, 18 nt, Human
gaugagagcccagaggua

SEQ ID NO: 2833454 - RNA, 16 nt, Human
gaugccugguggcagc

SEQ ID NO: 2833455 - RNA, 15 nt, Human
gaugccugguggcag

SEQ ID NO: 2833456 - RNA, 14 nt, Human
gaugccugguggca

SEQ ID NO: 2833457 - RNA, 22 nt, Human
gaugcaggugagcccauggccc

SEQ ID NO: 2833458 - RNA, 13 nt, Human
gaugcagucuccu

SEQ ID NO: 2833459 - RNA, 17 nt, Human
gaugcagucuccucuuu

SEQ ID NO: 2833460 - RNA, 19 nt, Human
gaugcagucuccucuuuaa

SEQ ID NO: 2833461 - RNA, 21 nt, Human
gaugcagucuccucuuuaaaa

SEQ ID NO: 2833462 - RNA, 21 nt, Human
gaugcaggauuuguucucugu

SEQ ID NO: 2833463 - RNA, 22 nt, Human
gaugcaggauuuguucucuguc

SEQ ID NO: 2833464 - RNA, 21 nt, Human
gaugcaggcacuuauuguaaa

SEQ ID NO: 2833465 - RNA, 22 nt, Human
gaugcaggcacuuauuguaaau

SEQ ID NO: 2833466 - RNA, 21 nt, Human
gaugagagcccagagguaaca

SEQ ID NO: 2833467 - RNA, 21 nt, Human
gaugaaaugaggucagagccu

SEQ ID NO: 2833468 - RNA, 15 nt, Human
gaugaaaugagguca

SEQ ID NO: 2833469 - RNA, 23 nt, Human
gaucuugaguauaagaaaugcau

SEQ ID NO: 2833470 - RNA, 15 nt, Human
gaucuugcagaaguu

SEQ ID NO: 2833471 - RNA, 13 nt, Human
gaucuugaaugug

SEQ ID NO: 2833472 - RNA, 14 nt, Human
gaucuugaaugugg

SEQ ID NO: 2833473 - RNA, 22 nt, Human
gaucuugaauguggucucagga

SEQ ID NO: 2833474 - RNA, 23 nt, Human
gaucuugaauguggucucaggau

SEQ ID NO: 2833475 - RNA, 12 nt, Human
gaucuucugaaa

SEQ ID NO: 2833476 - RNA, 14 nt, Human
gaucuucugaaaug

SEQ ID NO: 2833477 - RNA, 15 nt, Human
gaucuucugaaauga

SEQ ID NO: 2833478 - RNA, 16 nt, Human
gaucuucugaaaugaa

SEQ ID NO: 2833479 - RNA, 18 nt, Human
gaucuucugaaaugaaac

SEQ ID NO: 2833480 - RNA, 20 nt, Human
gaucuucugggagcaggaac

SEQ ID NO: 2833481 - RNA, 16 nt, Human
gaucugucacaccagc

SEQ ID NO: 2833482 - RNA, 20 nt, Human
gaucuguauauacaauaaca

SEQ ID NO: 2833483 - RNA, 15 nt, Human
gaucuguauauacaa

SEQ ID NO: 2833484 - RNA, 20 nt, Human
gaucugucacaccagccaua

SEQ ID NO: 2833485 - RNA, 17 nt, Human
gaucugucacaccagcc

SEQ ID NO: 2833486 - RNA, 18 nt, Human
gaucugucacaccagcca

SEQ ID NO: 2833487 - RNA, 19 nt, Human
gaucugucacaccagccau

SEQ ID NO: 2833488 - RNA, 20 nt, Human
gaugaaaucuuacagcuggg

SEQ ID NO: 2833489 - RNA, 16 nt, Human
gaugaaauguaaauac

SEQ ID NO: 2833490 - RNA, 18 nt, Human
gaugaacucugaacuuug

SEQ ID NO: 2833491 - RNA, 19 nt, Human
gaucuuggcuuacugcagc

SEQ ID NO: 2833492 - RNA, 23 nt, Human
gaugaaauuuucuagacuuucug

SEQ ID NO: 2833493 - RNA, 14 nt, Human
gaugaauacauuuu

SEQ ID NO: 2833494 - RNA, 23 nt, Human
gaugaaugaggucccaggcagag

SEQ ID NO: 2833495 - RNA, 19 nt, Human
gaugaaugaggucccaggc

SEQ ID NO: 2833496 - RNA, 13 nt, Human
gaugaaugagaau

SEQ ID NO: 2833497 - RNA, 17 nt, Human
gaugaaguuuuacauug

SEQ ID NO: 2833498 - RNA, 13 nt, Human
gaugaaucacugu

SEQ ID NO: 2833499 - RNA, 20 nt, Human
gaugaaucacuguuuuuaga

SEQ ID NO: 2833500 - RNA, 19 nt, Human
gaugaaucucccacuccag

SEQ ID NO: 2833501 - RNA, 23 nt, Human
gaugaaguuuuacauuguugagc

SEQ ID NO: 2833502 - RNA, 22 nt, Human
gaugaaguuuuacauuguugag

SEQ ID NO: 2833503 - RNA, 14 nt, Human
gaugaauguauuua

SEQ ID NO: 2833504 - RNA, 20 nt, Human
gaugaauuaggggacacugu

SEQ ID NO: 2833505 - RNA, 22 nt, Human
gaugaauugcguuggucucugc

SEQ ID NO: 2833506 - RNA, 23 nt, Human
gaugacccugcgaaggggcccug

SEQ ID NO: 2833507 - RNA, 17 nt, Human
gaugaccucauuaaccg

SEQ ID NO: 2833508 - RNA, 21 nt, Human
gauaaaauaaugcugcaaacu

SEQ ID NO: 2833509 - RNA, 13 nt, Human
gaguucuggaaaa

SEQ ID NO: 2833510 - RNA, 16 nt, Human
gauaaaaugacuacuu

SEQ ID NO: 2833511 - RNA, 18 nt, Human
gauaaaaugacuacuuag

SEQ ID NO: 2833512 - RNA, 16 nt, Human
gauaaacaacaaggug

SEQ ID NO: 2833513 - RNA, 18 nt, Human
gauaaacaacaagguggu

SEQ ID NO: 2833514 - RNA, 16 nt, Human
gauaaauuccacugga

SEQ ID NO: 2833515 - RNA, 11 nt, Human
gauaacaaaga

SEQ ID NO: 2833516 - RNA, 12 nt, Human
gauaacaaagau

SEQ ID NO: 2833517 - RNA, 13 nt, Human
gauaacaaagaua

SEQ ID NO: 2833518 - RNA, 17 nt, Human
gauaacaaagauaucuu

SEQ ID NO: 2833519 - RNA, 18 nt, Human
gauaacaaagauaucuuu

SEQ ID NO: 2833520 - RNA, 22 nt, Human
gauaacaaagauaucuuuucuu

SEQ ID NO: 2833521 - RNA, 20 nt, Human
gauaacaaugcagcaaggcc

SEQ ID NO: 2833522 - RNA, 17 nt, Human
gauaauaauauuguuuu

SEQ ID NO: 2833523 - RNA, 18 nt, Human
gauaauaauauuguuuuu

SEQ ID NO: 2833524 - RNA, 19 nt, Human
gauaauaauauuguuuuuc

SEQ ID NO: 2833525 - RNA, 20 nt, Human
gauaauaauauuguuuuucu

SEQ ID NO: 2833526 - RNA, 12 nt, Human
gauaauaauggg

SEQ ID NO: 2833527 - RNA, 23 nt, Human
gauaaguucuuaugccauguuaa

SEQ ID NO: 2833528 - RNA, 21 nt, Human
gauaacgcuuaaaggaaguca

SEQ ID NO: 2833529 - RNA, 23 nt, Human
gauaaccuauaugauuuauaguu

SEQ ID NO: 2833530 - RNA, 17 nt, Human
gauaaccuauaugauuu

SEQ ID NO: 2833531 - RNA, 15 nt, Human
gauaaccagcuguaa

SEQ ID NO: 2833532 - RNA, 19 nt, Human
gauaaaagggcaaaucugc

SEQ ID NO: 2833533 - RNA, 17 nt, Human
gauaacauuuguguguu

SEQ ID NO: 2833534 - RNA, 10 nt, Human
gagugugugu

SEQ ID NO: 2833535 - RNA, 15 nt, Human
gagugugugugugca

SEQ ID NO: 2833536 - RNA, 14 nt, Human
gagugugugugugu

SEQ ID NO: 2833537 - RNA, 19 nt, Human
gaguguguguuugugcuga

SEQ ID NO: 2833538 - RNA, 18 nt, Human
gaguguguuuuauaaacu

SEQ ID NO: 2833539 - RNA, 14 nt, Human
gaguguuauguauu

SEQ ID NO: 2833540 - RNA, 15 nt, Human
gaguguuauguauuu

SEQ ID NO: 2833541 - RNA, 14 nt, Human
gaguuauugagauu

SEQ ID NO: 2833542 - RNA, 22 nt, Human
gaguucaauaaaugucuguuga

SEQ ID NO: 2833543 - RNA, 11 nt, Human
gaguucuacau

SEQ ID NO: 2833544 - RNA, 19 nt, Human
gaguucgaggcugcaguca

SEQ ID NO: 2833545 - RNA, 18 nt, Human
gaguucggcucugggugg

SEQ ID NO: 2833546 - RNA, 21 nt, Human
gaguucgagaccagccuggcc

SEQ ID NO: 2833547 - RNA, 20 nt, Human
gaguucgagaccagccuggc

SEQ ID NO: 2833548 - RNA, 19 nt, Human
gaguucgagaccagccugg

SEQ ID NO: 2833549 - RNA, 18 nt, Human
gaguucgagaccagccug

SEQ ID NO: 2833550 - RNA, 17 nt, Human
gaguucgagaccagccu

SEQ ID NO: 2833551 - RNA, 21 nt, Human
gaguucagaguccuuaaaaug

SEQ ID NO: 2833552 - RNA, 18 nt, Human
gacuuccucgccucuccc

SEQ ID NO: 2833553 - RNA, 19 nt, Human
gacuuccucgccucuccca

SEQ ID NO: 2833554 - RNA, 21 nt, Human
gacuucccuaacacuuacccc

SEQ ID NO: 2833555 - RNA, 14 nt, Human
gacuuccuuacuaa

SEQ ID NO: 2833556 - RNA, 17 nt, Human
gaguguguaugccaaga

SEQ ID NO: 2833557 - RNA, 12 nt, Human
gacuuccaaaga

SEQ ID NO: 2833558 - RNA, 15 nt, Human
gacuuccaaagaaug

SEQ ID NO: 2833559 - RNA, 16 nt, Human
gacuuccaaagaaugu

SEQ ID NO: 2833560 - RNA, 23 nt, Human
gacuucauugucccucuucacuc

SEQ ID NO: 2833561 - RNA, 14 nt, Human
gaucacuggagccc

SEQ ID NO: 2833562 - RNA, 13 nt, Human
gaucaggcacagg

SEQ ID NO: 2833563 - RNA, 15 nt, Human
gaucaggcacagguc

SEQ ID NO: 2833564 - RNA, 16 nt, Human
gaucaggcacagguca

SEQ ID NO: 2833565 - RNA, 17 nt, Human
gaucaggcacaggucag

SEQ ID NO: 2833566 - RNA, 20 nt, Human
gaucacggcucacugcagcc

SEQ ID NO: 2833567 - RNA, 23 nt, Human
gaucacggcucacugcagccuca

SEQ ID NO: 2833568 - RNA, 16 nt, Human
gaucacugccacacuc

SEQ ID NO: 2833569 - RNA, 13 nt, Human
gaucacugccaga

SEQ ID NO: 2833570 - RNA, 15 nt, Human
gaucacugccacacu

SEQ ID NO: 2833571 - RNA, 13 nt, Human
gaucacugccaca

SEQ ID NO: 2833572 - RNA, 13 nt, Human
gaucacugaauuu

SEQ ID NO: 2833573 - RNA, 16 nt, Human
gaucacugaauuuaua

SEQ ID NO: 2833574 - RNA, 17 nt, Human
gaucacugaauuuauaa

SEQ ID NO: 2833575 - RNA, 13 nt, Human
gaucacuggagcc

SEQ ID NO: 2833576 - RNA, 12 nt, Human
gaucacuggagc

SEQ ID NO: 2833577 - RNA, 18 nt, Human
gaucacuagccugucauc

SEQ ID NO: 2833578 - RNA, 19 nt, Human
gaucaccauguauuuugua

SEQ ID NO: 2833579 - RNA, 16 nt, Human
gaucacauguggacuu

SEQ ID NO: 2833580 - RNA, 21 nt, Human
gauaucuggccuaaaaucuug

SEQ ID NO: 2833581 - RNA, 20 nt, Human
gauaucuagcuaguaauaua

SEQ ID NO: 2833582 - RNA, 21 nt, Human
gauaucuagcuaguaauauau

SEQ ID NO: 2833583 - RNA, 21 nt, Human
gauaucccugauccuaacuga

SEQ ID NO: 2833584 - RNA, 16 nt, Human
gauauccuuaucagag

SEQ ID NO: 2833585 - RNA, 18 nt, Human
gauauccuuaucagagcu

SEQ ID NO: 2833586 - RNA, 23 nt, Human
gauagugggcaccccacugcaau

SEQ ID NO: 2833587 - RNA, 17 nt, Human
gauaggagccugcuggu

SEQ ID NO: 2833588 - RNA, 18 nt, Human
gauaggaaugugaaagca

SEQ ID NO: 2833589 - RNA, 15 nt, Human
gauaggaccuugggc

SEQ ID NO: 2833590 - RNA, 17 nt, Human
gauaggaccuugggcca

SEQ ID NO: 2833591 - RNA, 18 nt, Human
gauaggaccuugggccaa

SEQ ID NO: 2833592 - RNA, 20 nt, Human
gauagcuuuauuuuuuaagu

SEQ ID NO: 2833593 - RNA, 15 nt, Human
gauaauucuuauuuu

SEQ ID NO: 2833594 - RNA, 18 nt, Human
gauaauucuagcuuugag

SEQ ID NO: 2833595 - RNA, 18 nt, Human
gauaauugcauucaucuu

SEQ ID NO: 2833596 - RNA, 11 nt, Human
gauaauugcua

SEQ ID NO: 2833597 - RNA, 14 nt, Human
gauaauugcuauuu

SEQ ID NO: 2833598 - RNA, 16 nt, Human
gauaauugcuauuuau

SEQ ID NO: 2833599 - RNA, 22 nt, Human
gauaauugcuauuuauuuuuac

SEQ ID NO: 2833600 - RNA, 14 nt, Human
gauaauuguugaaa

SEQ ID NO: 2833601 - RNA, 16 nt, Human
gauaauuguugaaauu

SEQ ID NO: 2833602 - RNA, 12 nt, Human
gauaauuuaaga

SEQ ID NO: 2833603 - RNA, 23 nt, Human
gauaauauuacuguuuauuucug

SEQ ID NO: 2833604 - RNA, 18 nt, Human
gauaauauuguggugcca

SEQ ID NO: 2833605 - RNA, 22 nt, Human
gauaauaaauugaaauugugaa

SEQ ID NO: 2833606 - RNA, 23 nt, Human
gauaauaucuuugugauaauuua

SEQ ID NO: 2833607 - RNA, 12 nt, Human
gauaauagauuc

SEQ ID NO: 2833608 - RNA, 13 nt, Human
gauaauagauucu

SEQ ID NO: 2833609 - RNA, 14 nt, Human
gauaauagauucuc

SEQ ID NO: 2833610 - RNA, 22 nt, Human
gauaauaguuuuuucuuuuaac

SEQ ID NO: 2833611 - RNA, 13 nt, Human
gauauauaucaua

SEQ ID NO: 2833612 - RNA, 23 nt, Human
gauauauauuauaaauauauaua

SEQ ID NO: 2833613 - RNA, 12 nt, Human
gauauaucugaa

SEQ ID NO: 2833614 - RNA, 14 nt, Human
gauauaucugaaaa

SEQ ID NO: 2833615 - RNA, 16 nt, Human
gauauaucugaaaacu

SEQ ID NO: 2833616 - RNA, 18 nt, Human
gauauaucugaaaacugg

SEQ ID NO: 2833617 - RNA, 23 nt, Human
gauaguggggagacuucuuggcu

SEQ ID NO: 2833618 - RNA, 15 nt, Human
gauagggcugggcaa

SEQ ID NO: 2833619 - RNA, 21 nt, Human
gauagggcugggcaaggaaaa

SEQ ID NO: 2833620 - RNA, 22 nt, Human
gauagggcugggcaaggaaaaa

SEQ ID NO: 2833621 - RNA, 21 nt, Human
gauaguuaucuguucuuuuga

SEQ ID NO: 2833622 - RNA, 15 nt, Human
gauaguucacccccu

SEQ ID NO: 2833623 - RNA, 14 nt, Human
gauaguuuucuccu

SEQ ID NO: 2833624 - RNA, 14 nt, Human
gauauaaaaugugc

SEQ ID NO: 2833625 - RNA, 15 nt, Human
gauauaaaaugugca

SEQ ID NO: 2833626 - RNA, 19 nt, Human
gcaagcaacacagaggaau

SEQ ID NO: 2833627 - RNA, 21 nt, Human
gcaagcaacuugcaggcucca

SEQ ID NO: 2833628 - RNA, 22 nt, Human
gcaagcaacuugcaggcuccau

SEQ ID NO: 2833629 - RNA, 13 nt, Human
gcaagauugcuua

SEQ ID NO: 2833630 - RNA, 20 nt, Human
gcaacuucuucuccaucccu

SEQ ID NO: 2833631 - RNA, 15 nt, Human
gcaacuugaaauuau

SEQ ID NO: 2833632 - RNA, 19 nt, Human
gcaacuugaaauuauaucu

SEQ ID NO: 2833633 - RNA, 18 nt, Human
gcaacuucuucuccaucc

SEQ ID NO: 2833634 - RNA, 14 nt, Human
gcaacuucuucucc

SEQ ID NO: 2833635 - RNA, 12 nt, Human
gcaacuguuaug

SEQ ID NO: 2833636 - RNA, 18 nt, Human
gcaacuguuaugaaauaa

SEQ ID NO: 2833637 - RNA, 20 nt, Human
gcaacuguuaugaaauaaag

SEQ ID NO: 2833638 - RNA, 21 nt, Human
gcaacuguuaugaaauaaaga

SEQ ID NO: 2833639 - RNA, 16 nt, Human
gcaacuucaguccugg

SEQ ID NO: 2833640 - RNA, 17 nt, Human
gcaacuucaguccuggg

SEQ ID NO: 2833641 - RNA, 19 nt, Human
gcaacuucaguccugggag

SEQ ID NO: 2833642 - RNA, 20 nt, Human
gcaacuuuuguguaaugaaa

SEQ ID NO: 2833643 - RNA, 17 nt, Human
gcaagaaaaaaaaaugc

SEQ ID NO: 2833644 - RNA, 18 nt, Human
gcaagaaaaaaaaaugcc

SEQ ID NO: 2833645 - RNA, 14 nt, Human
gcaagcacaucugc

SEQ ID NO: 2833646 - RNA, 17 nt, Human
gcaagcaagcucucuug

SEQ ID NO: 2833647 - RNA, 14 nt, Human
gcaagauugcuuaa

SEQ ID NO: 2833648 - RNA, 18 nt, Human
gcaagcaagaaacacugg

SEQ ID NO: 2833649 - RNA, 16 nt, Human
gcaagcaccuccugcc

SEQ ID NO: 2833650 - RNA, 15 nt, Human
gcaagcaccuccugc

SEQ ID NO: 2833651 - RNA, 20 nt, Human
gcaagcaccuccugccucga

SEQ ID NO: 2833652 - RNA, 18 nt, Human
gcaagcaccuccugccuc

SEQ ID NO: 2833653 - RNA, 16 nt, Human
gcaagcaugcuuguga

SEQ ID NO: 2833654 - RNA, 15 nt, Human
gcaagcaugcuugug

SEQ ID NO: 2833655 - RNA, 11 nt, Human
gcaagcaugcu

SEQ ID NO: 2833656 - RNA, 13 nt, Human
gcaaggcugugcu

SEQ ID NO: 2833657 - RNA, 18 nt, Human
gcaaggcugugcucccug

SEQ ID NO: 2833658 - RNA, 20 nt, Human
gcaaggaccaggacucccuc

SEQ ID NO: 2833659 - RNA, 21 nt, Human
gcaaggacacagaugaaacac

SEQ ID NO: 2833660 - RNA, 12 nt, Human
gcaaggcugugc

SEQ ID NO: 2833661 - RNA, 21 nt, Human
gcaagggaauuucuucaacuc

SEQ ID NO: 2833662 - RNA, 15 nt, Human
gcaaggaccaggacu

SEQ ID NO: 2833663 - RNA, 14 nt, Human
gcaaggaccaggac

SEQ ID NO: 2833664 - RNA, 14 nt, Human
gcaaggaaggaaag

SEQ ID NO: 2833665 - RNA, 13 nt, Human
gcaaggaaggaaa

SEQ ID NO: 2833666 - RNA, 15 nt, Human
gcaaggaaggaaaga

SEQ ID NO: 2833667 - RNA, 9 nt, Human
gcaaggaaa

SEQ ID NO: 2833668 - RNA, 11 nt, Human
gcaaggaaaaa

SEQ ID NO: 2833669 - RNA, 14 nt, Human
gcaagcucucuugc

SEQ ID NO: 2833670 - RNA, 22 nt, Human
gcaagcugccgaaccaaaagaa

SEQ ID NO: 2833671 - RNA, 12 nt, Human
gcaagcuggccu

SEQ ID NO: 2833672 - RNA, 14 nt, Human
gcaagcuggccucu

SEQ ID NO: 2833673 - RNA, 16 nt, Human
gcaaggaaaaacaggu

SEQ ID NO: 2833674 - RNA, 14 nt, Human
gcaaggaaaaagaa

SEQ ID NO: 2833675 - RNA, 16 nt, Human
gcaaggaaaaagaaaa

SEQ ID NO: 2833676 - RNA, 17 nt, Human
gcaaggaaaaagaaaau

SEQ ID NO: 2833677 - RNA, 18 nt, Human
gcaaggaaaaagaaaaua

SEQ ID NO: 2833678 - RNA, 19 nt, Human
gcaaggaaaaagaaaauaa

SEQ ID NO: 2833679 - RNA, 10 nt, Human
gcaaggaaag

SEQ ID NO: 2833680 - RNA, 14 nt, Human
gcaauccugucuuu

SEQ ID NO: 2833681 - RNA, 21 nt, Human
gcaaucuccccuugauuuaaa

SEQ ID NO: 2833682 - RNA, 23 nt, Human
gcaaucuccccuugauuuaaaca

SEQ ID NO: 2833683 - RNA, 23 nt, Human
gcaaugaaaagucguuuuccaaa

SEQ ID NO: 2833684 - RNA, 16 nt, Human
gcaaugaaagguacua

SEQ ID NO: 2833685 - RNA, 18 nt, Human
gcaaugaaagguacuaua

SEQ ID NO: 2833686 - RNA, 23 nt, Human
gcaaugaaagguacuauauuugc

SEQ ID NO: 2833687 - RNA, 12 nt, Human
gcaaucuuugaa

SEQ ID NO: 2833688 - RNA, 13 nt, Human
gcaaucuuugaaa

SEQ ID NO: 2833689 - RNA, 17 nt, Human
gcaaucuuugaaagacu

SEQ ID NO: 2833690 - RNA, 18 nt, Human
gcaaucuuugaaagacuu

SEQ ID NO: 2833691 - RNA, 18 nt, Human
gcaaugacagguaaauua

SEQ ID NO: 2833692 - RNA, 19 nt, Human
gcaagguuaagcaaggugg

SEQ ID NO: 2833693 - RNA, 13 nt, Human
gcaagguuccaca

SEQ ID NO: 2833694 - RNA, 14 nt, Human
gcaagguuccacag

SEQ ID NO: 2833695 - RNA, 16 nt, Human
gcaagguuccacagag

SEQ ID NO: 2833696 - RNA, 17 nt, Human
gcaagguuccacagagu

SEQ ID NO: 2833697 - RNA, 23 nt, Human
gcaagguuccacagaguaagaca

SEQ ID NO: 2833698 - RNA, 17 nt, Human
gcaauccucucaccuca

SEQ ID NO: 2833699 - RNA, 14 nt, Human
gcaaguagauaaau

SEQ ID NO: 2833700 - RNA, 18 nt, Human
gcaaguagauaaauauuu

SEQ ID NO: 2833701 - RNA, 19 nt, Human
gcaaguagauaaauauuug

SEQ ID NO: 2833702 - RNA, 15 nt, Human
gcaacugacacuccc

SEQ ID NO: 2833703 - RNA, 19 nt, Human
gcaacugacacucccaccc

SEQ ID NO: 2833704 - RNA, 15 nt, Human
gcaacucuugauuau

SEQ ID NO: 2833705 - RNA, 11 nt, Human
gcaacugggac

SEQ ID NO: 2833706 - RNA, 12 nt, Human
gcaaaucuugaa

SEQ ID NO: 2833707 - RNA, 16 nt, Human
gcaaaugacaugcacu

SEQ ID NO: 2833708 - RNA, 19 nt, Human
gcaaaugacaugcacugac

SEQ ID NO: 2833709 - RNA, 14 nt, Human
gcaaaugcccaagg

SEQ ID NO: 2833710 - RNA, 20 nt, Human
gcaaaugcccaagggaaaga

SEQ ID NO: 2833711 - RNA, 16 nt, Human
gcaaaguucuguguuu

SEQ ID NO: 2833712 - RNA, 21 nt, Human
gcaaaugucagauacaaugua

SEQ ID NO: 2833713 - RNA, 22 nt, Human
gcaaagaaagugggaggucagg

SEQ ID NO: 2833714 - RNA, 23 nt, Human
gcaaagaaagugggaggucagga

SEQ ID NO: 2833715 - RNA, 23 nt, Human
gcaaacuuuguaugucauuuccu

SEQ ID NO: 2833716 - RNA, 22 nt, Human
gcaaagacuauucccuucuaac

SEQ ID NO: 2833717 - RNA, 16 nt, Human
gcaaagaggacucgcu

SEQ ID NO: 2833718 - RNA, 20 nt, Human
gcaaagaggacucgcuugua

SEQ ID NO: 2833719 - RNA, 21 nt, Human
gcaaagaggacucgcuuguaa

SEQ ID NO: 2833720 - RNA, 23 nt, Human
gcaaagaggacucgcuuguaaau

SEQ ID NO: 2833721 - RNA, 21 nt, Human
gcaaagacuauucccuucuaa

SEQ ID NO: 2833722 - RNA, 21 nt, Human
gcaaagucaugcaaaggcugg

SEQ ID NO: 2833723 - RNA, 16 nt, Human
gcaaagucaugcaaag

SEQ ID NO: 2833724 - RNA, 22 nt, Human
gcaaagucaugcaaaggcuggg

SEQ ID NO: 2833725 - RNA, 23 nt, Human
gcaaagucaugcaaaggcuggga

SEQ ID NO: 2833726 - RNA, 18 nt, Human
gcaaauacuuagcaaaaa

SEQ ID NO: 2833727 - RNA, 22 nt, Human
gcaaauacuuagcaaaaagugg

SEQ ID NO: 2833728 - RNA, 11 nt, Human
gcaaauauaaa

SEQ ID NO: 2833729 - RNA, 14 nt, Human
gcaaauauaaaacu

SEQ ID NO: 2833730 - RNA, 14 nt, Human
gcaaauauaaacau

SEQ ID NO: 2833731 - RNA, 23 nt, Human
gcaaaguucccuacuuccuguga

SEQ ID NO: 2833732 - RNA, 13 nt, Human
gauuuuaaacuag

SEQ ID NO: 2833733 - RNA, 14 nt, Human
gauuuuaaacuaga

SEQ ID NO: 2833734 - RNA, 15 nt, Human
gauuuuaaacuagau

SEQ ID NO: 2833735 - RNA, 17 nt, Human
gauuuuaaacuagauga

SEQ ID NO: 2833736 - RNA, 21 nt, Human
gauuuuaaacuagaugaccuc

SEQ ID NO: 2833737 - RNA, 22 nt, Human
gauuuuaaacuagaugaccuca

SEQ ID NO: 2833738 - RNA, 23 nt, Human
gauuuuaaacuagaugaccucau

SEQ ID NO: 2833739 - RNA, 18 nt, Human
gcaaacgcugccugcccg

SEQ ID NO: 2833740 - RNA, 16 nt, Human
gcaaacgcugccugcc

SEQ ID NO: 2833741 - RNA, 15 nt, Human
gcaaacgcugccugc

SEQ ID NO: 2833742 - RNA, 14 nt, Human
gcaaacgcugccug

SEQ ID NO: 2833743 - RNA, 16 nt, Human
gcaaaccauuuuuaaa

SEQ ID NO: 2833744 - RNA, 18 nt, Human
gcaaacuuaauguucuua

SEQ ID NO: 2833745 - RNA, 17 nt, Human
gcaaacgcugccugccg

SEQ ID NO: 2833746 - RNA, 22 nt, Human
gaugcggccauucaaggggagc

SEQ ID NO: 2833747 - RNA, 16 nt, Human
gaugcgcagccccauc

SEQ ID NO: 2833748 - RNA, 19 nt, Human
gaugcgcagccccaucugu

SEQ ID NO: 2833749 - RNA, 13 nt, Human
gaugcggccaaga

SEQ ID NO: 2833750 - RNA, 20 nt, Human
gaugccugugaacugaacuc

SEQ ID NO: 2833751 - RNA, 18 nt, Human
gaugccuuuuuuguaguu

SEQ ID NO: 2833752 - RNA, 22 nt, Human
gaugccuuuuuuguaguuuuuu

SEQ ID NO: 2833753 - RNA, 22 nt, Human
gaugcgagcgcuaucuucacau

SEQ ID NO: 2833754 - RNA, 20 nt, Human
gauguucuaaggcucugaga

SEQ ID NO: 2833755 - RNA, 14 nt, Human
gauguucuaaggcu

SEQ ID NO: 2833756 - RNA, 16 nt, Human
gauguucuaaggcucu

SEQ ID NO: 2833757 - RNA, 18 nt, Human
gauguucuaaggcucuga

SEQ ID NO: 2833758 - RNA, 19 nt, Human
gauguucuaaggcucugag

SEQ ID NO: 2833759 - RNA, 18 nt, Human
gaugcguuguuacaggaa

SEQ ID NO: 2833760 - RNA, 20 nt, Human
gaugcguuguuacaggaagu

SEQ ID NO: 2833761 - RNA, 13 nt, Human
gauguucuaaggc

SEQ ID NO: 2833762 - RNA, 14 nt, Human
gauuaauggcacug

SEQ ID NO: 2833763 - RNA, 16 nt, Human
gauuaauggcacugau

SEQ ID NO: 2833764 - RNA, 18 nt, Human
gauguuuguggccucaga

SEQ ID NO: 2833765 - RNA, 17 nt, Human
gauuaaggugaugugau

SEQ ID NO: 2833766 - RNA, 18 nt, Human
gauuaagauuuuacaaaa

SEQ ID NO: 2833767 - RNA, 12 nt, Human
gauguuuccaga

SEQ ID NO: 2833768 - RNA, 21 nt, Human
gauguuuauucuucuagaguu

SEQ ID NO: 2833769 - RNA, 23 nt, Human
gauguuuauucuucuagaguuca

SEQ ID NO: 2833770 - RNA, 13 nt, Human
gauguuuccagac

SEQ ID NO: 2833771 - RNA, 19 nt, Human
gauguuuccagacuuccuu

SEQ ID NO: 2833772 - RNA, 19 nt, Human
gauguuuauucuucuagag

SEQ ID NO: 2833773 - RNA, 18 nt, Human
gauguuuauucuucuaga

SEQ ID NO: 2833774 - RNA, 17 nt, Human
gauguuuguggccucag

SEQ ID NO: 2833775 - RNA, 16 nt, Human
gauguuuguggccuca

SEQ ID NO: 2833776 - RNA, 15 nt, Human
gauguuuguggccuc

SEQ ID NO: 2833777 - RNA, 14 nt, Human
gauguuuguggccu

SEQ ID NO: 2833778 - RNA, 13 nt, Human
gauguuuguggcc

SEQ ID NO: 2833779 - RNA, 22 nt, Human
gauguuugcucuuguuuuuauu

SEQ ID NO: 2833780 - RNA, 20 nt, Human
gauuaauuugcaucugaaau

SEQ ID NO: 2833781 - RNA, 14 nt, Human
gauuaauugcugca

SEQ ID NO: 2833782 - RNA, 21 nt, Human
gauuacaagcgugagccacug

SEQ ID NO: 2833783 - RNA, 13 nt, Human
gauuacaagcgug

SEQ ID NO: 2833784 - RNA, 15 nt, Human
gauucccaagcucug

SEQ ID NO: 2833785 - RNA, 23 nt, Human
gauuccaaagaguagaauugcau

SEQ ID NO: 2833786 - RNA, 19 nt, Human
gauuccaaagaguagaauu

SEQ ID NO: 2833787 - RNA, 18 nt, Human
gauuccaaagaguagaau

SEQ ID NO: 2833788 - RNA, 19 nt, Human
gauucauuuuuaaucauga

SEQ ID NO: 2833789 - RNA, 17 nt, Human
gauucaugauuuauaaa

SEQ ID NO: 2833790 - RNA, 10 nt, Human
gauucauuuu

SEQ ID NO: 2833791 - RNA, 12 nt, Human
gauucaugauuu

SEQ ID NO: 2833792 - RNA, 21 nt, Human
gauucaugccaauuagcaauu

SEQ ID NO: 2833793 - RNA, 11 nt, Human
gauucaugugg

SEQ ID NO: 2833794 - RNA, 18 nt, Human
gauucauguuauauuuaa

SEQ ID NO: 2833795 - RNA, 15 nt, Human
gauucauucucauaa

SEQ ID NO: 2833796 - RNA, 20 nt, Human
gauucauucucauaauuccu

SEQ ID NO: 2833797 - RNA, 17 nt, Human
gauucauuuauaagaag

SEQ ID NO: 2833798 - RNA, 11 nt, Human
gauucagucuu

SEQ ID NO: 2833799 - RNA, 13 nt, Human
gauucagucuugc

SEQ ID NO: 2833800 - RNA, 14 nt, Human
gauucagucuugcc

SEQ ID NO: 2833801 - RNA, 15 nt, Human
gauucagucuugccu

SEQ ID NO: 2833802 - RNA, 17 nt, Human
gauucagucuugccuua

SEQ ID NO: 2833803 - RNA, 18 nt, Human
gauucagucuugccuuac

SEQ ID NO: 2833804 - RNA, 23 nt, Human
gauucagucuugccuuacacaaa

SEQ ID NO: 2833805 - RNA, 17 nt, Human
gauucagguauguugcc

SEQ ID NO: 2833806 - RNA, 18 nt, Human
gauucaggugcagaggaa

SEQ ID NO: 2833807 - RNA, 20 nt, Human
gauucaggugcagaggaagu

SEQ ID NO: 2833808 - RNA, 16 nt, Human
gauucauaguaacuuc

SEQ ID NO: 2833809 - RNA, 22 nt, Human
gauucaucuacccugcugaccu

SEQ ID NO: 2833810 - RNA, 22 nt, Human
gauucaguuuucauuugguuca

SEQ ID NO: 2833811 - RNA, 15 nt, Human
gauucaguuuucauu

SEQ ID NO: 2833812 - RNA, 13 nt, Human
gauucaggaaugu

SEQ ID NO: 2833813 - RNA, 16 nt, Human
gauucaggcugcuugg

SEQ ID NO: 2833814 - RNA, 13 nt, Human
gauucaggcugcu

SEQ ID NO: 2833815 - RNA, 12 nt, Human
gauucaggcugc

SEQ ID NO: 2833816 - RNA, 16 nt, Human
gauuucaugcuaucuc

SEQ ID NO: 2833817 - RNA, 20 nt, Human
gauuucaugcuaucucugug

SEQ ID NO: 2833818 - RNA, 18 nt, Human
gauuucaugcuaucucug

SEQ ID NO: 2833819 - RNA, 19 nt, Human
gauuuguuaaugauagcua

SEQ ID NO: 2833820 - RNA, 13 nt, Human
gauuugaacucag

SEQ ID NO: 2833821 - RNA, 23 nt, Human
gauuucuuuuguaauaaacuauu

SEQ ID NO: 2833822 - RNA, 16 nt, Human
gauuugaacucagauc

SEQ ID NO: 2833823 - RNA, 22 nt, Human
gauuugaacucagaucugucug

SEQ ID NO: 2833824 - RNA, 13 nt, Human
gauuugaacacuu

SEQ ID NO: 2833825 - RNA, 20 nt, Human
gauuugaacacuuggugcug

SEQ ID NO: 2833826 - RNA, 22 nt, Human
gauuucuuuuguaauaaacuau

SEQ ID NO: 2833827 - RNA, 17 nt, Human
gauuucuuugcuguaag

SEQ ID NO: 2833828 - RNA, 19 nt, Human
gauuucuuugcuguaagau

SEQ ID NO: 2833829 - RNA, 18 nt, Human
gauuucuuuucuuccugg

SEQ ID NO: 2833830 - RNA, 19 nt, Human
gauuucuuuucuuccuggc

SEQ ID NO: 2833831 - RNA, 15 nt, Human
gauuuccagccaggg

SEQ ID NO: 2833832 - RNA, 13 nt, Human
gauuucuuaaaua

SEQ ID NO: 2833833 - RNA, 11 nt, Human
gauuucuuagg

SEQ ID NO: 2833834 - RNA, 12 nt, Human
gauuucuuaggg

SEQ ID NO: 2833835 - RNA, 15 nt, Human
gauuuccaaguaaua

SEQ ID NO: 2833836 - RNA, 18 nt, Human
gauuuccaaguaauauaa

SEQ ID NO: 2833837 - RNA, 20 nt, Human
gauuuccaaguaauauaaug

SEQ ID NO: 2833838 - RNA, 16 nt, Human
gauuguuaaaauaacu

SEQ ID NO: 2833839 - RNA, 15 nt, Human
gauuguuaauuucag

SEQ ID NO: 2833840 - RNA, 13 nt, Human
gauugggacagag

SEQ ID NO: 2833841 - RNA, 16 nt, Human
gauuggcuuguagaau

SEQ ID NO: 2833842 - RNA, 20 nt, Human
gauuggcuuguagaauuguu

SEQ ID NO: 2833843 - RNA, 15 nt, Human
gauuuaaaacaugua

SEQ ID NO: 2833844 - RNA, 12 nt, Human
gauuguuuuauc

SEQ ID NO: 2833845 - RNA, 18 nt, Human
gauuguuuuaucaugaca

SEQ ID NO: 2833846 - RNA, 22 nt, Human
gauuguuuuuuaaaaauggaua

SEQ ID NO: 2833847 - RNA, 16 nt, Human
gauuuaaaaacuggaa

SEQ ID NO: 2833848 - RNA, 17 nt, Human
gauuguuugcucugaga

SEQ ID NO: 2833849 - RNA, 13 nt, Human
gauuguuguuugc

SEQ ID NO: 2833850 - RNA, 18 nt, Human
gauuguuuccucuuccaa

SEQ ID NO: 2833851 - RNA, 11 nt, Human
gauuguuucua

SEQ ID NO: 2833852 - RNA, 15 nt, Human
gauuguuucuauaca

SEQ ID NO: 2833853 - RNA, 18 nt, Human
gauuguuucuauacaaau

SEQ ID NO: 2833854 - RNA, 15 nt, Human
gauuuaaacacacag

SEQ ID NO: 2833855 - RNA, 16 nt, Human
gauuuaaacacacaga

SEQ ID NO: 2833856 - RNA, 17 nt, Human
gauuuaaacacacagau

SEQ ID NO: 2833857 - RNA, 18 nt, Human
gauugcaacaggcugggc

SEQ ID NO: 2833858 - RNA, 17 nt, Human
gauugcaacaggcuggg

SEQ ID NO: 2833859 - RNA, 15 nt, Human
gauugcaacaggcug

SEQ ID NO: 2833860 - RNA, 15 nt, Human
gauugcuaugaauga

SEQ ID NO: 2833861 - RNA, 13 nt, Human
gauugcuaauugc

SEQ ID NO: 2833862 - RNA, 17 nt, Human
gauugcuaauugcuguu

SEQ ID NO: 2833863 - RNA, 21 nt, Human
gauugcuaauugcuguugaaa

SEQ ID NO: 2833864 - RNA, 13 nt, Human
gauugcugccacu

SEQ ID NO: 2833865 - RNA, 16 nt, Human
gauugcugccacuuuu

SEQ ID NO: 2833866 - RNA, 19 nt, Human
gauugcuugagcccaggag

SEQ ID NO: 2833867 - RNA, 16 nt, Human
gauugcuugagcccag

SEQ ID NO: 2833868 - RNA, 18 nt, Human
gauugcuuaaaauagcaa

SEQ ID NO: 2833869 - RNA, 17 nt, Human
gauugcuuaaaauagca

SEQ ID NO: 2833870 - RNA, 14 nt, Human
gauugcuuaaaaua

SEQ ID NO: 2833871 - RNA, 22 nt, Human
gauugcugccacuuuuuaacua

SEQ ID NO: 2833872 - RNA, 13 nt, Human
gauuggcauggcu

SEQ ID NO: 2833873 - RNA, 17 nt, Human
gauucccaagcucugcu

SEQ ID NO: 2833874 - RNA, 16 nt, Human
gauucccaagcucugc

SEQ ID NO: 2833875 - RNA, 16 nt, Human
gauugcaacaggcugg

SEQ ID NO: 2833876 - RNA, 20 nt, Human
gauucuuuuuaaaguguuuc

SEQ ID NO: 2833877 - RNA, 14 nt, Human
gauucuuuuucuga

SEQ ID NO: 2833878 - RNA, 14 nt, Human
gauugaaaacuuuu

SEQ ID NO: 2833879 - RNA, 15 nt, Human
gauugaaaacuuuuc

SEQ ID NO: 2833880 - RNA, 16 nt, Human
gcagaagacaaaaaga

SEQ ID NO: 2833881 - RNA, 14 nt, Human
gcagaagacaccag

SEQ ID NO: 2833882 - RNA, 15 nt, Human
gcagaagacaccaga

SEQ ID NO: 2833883 - RNA, 22 nt, Human
gcagaagaaugggaauauuuua

SEQ ID NO: 2833884 - RNA, 13 nt, Human
gcagaagaaagga

SEQ ID NO: 2833885 - RNA, 14 nt, Human
gcagaagaaaggaa

SEQ ID NO: 2833886 - RNA, 15 nt, Human
gcagaagaaaggaac

SEQ ID NO: 2833887 - RNA, 16 nt, Human
gcagaagaaaggaaca

SEQ ID NO: 2833888 - RNA, 23 nt, Human
gcagaacugccauuauuuucugu

SEQ ID NO: 2833889 - RNA, 12 nt, Human
gcagaagagggu

SEQ ID NO: 2833890 - RNA, 14 nt, Human
gcagaagagggugu

SEQ ID NO: 2833891 - RNA, 16 nt, Human
gcagaagagggugugu

SEQ ID NO: 2833892 - RNA, 21 nt, Human
gcagaagcaagggggugaugu

SEQ ID NO: 2833893 - RNA, 16 nt, Human
gcagaagacaccagag

SEQ ID NO: 2833894 - RNA, 18 nt, Human
gcagaagacaccagagca

SEQ ID NO: 2833895 - RNA, 20 nt, Human
gcagaagacaccagagcaga

SEQ ID NO: 2833896 - RNA, 21 nt, Human
gcagaagacaccagagcagau

SEQ ID NO: 2833897 - RNA, 16 nt, Human
gcacuguaugcuggac

SEQ ID NO: 2833898 - RNA, 15 nt, Human
gcacuguaugcugga

SEQ ID NO: 2833899 - RNA, 19 nt, Human
gcacuguaguucuaagacu

SEQ ID NO: 2833900 - RNA, 15 nt, Human
gcacuggggagcccg

SEQ ID NO: 2833901 - RNA, 18 nt, Human
gcacuggggagcccgucu

SEQ ID NO: 2833902 - RNA, 19 nt, Human
gcacuggggagcccgucuc

SEQ ID NO: 2833903 - RNA, 22 nt, Human
gcacuggggagcccgucucagu

SEQ ID NO: 2833904 - RNA, 16 nt, Human
gcacuguaguucuaag

SEQ ID NO: 2833905 - RNA, 17 nt, Human
gcacuguaguucuaaga

SEQ ID NO: 2833906 - RNA, 18 nt, Human
gcacuguaguucuaagac

SEQ ID NO: 2833907 - RNA, 14 nt, Human
gcacugauauuuua

SEQ ID NO: 2833908 - RNA, 18 nt, Human
gcacuaaggugugcucug

SEQ ID NO: 2833909 - RNA, 20 nt, Human
gcacuaacguugagccccug

SEQ ID NO: 2833910 - RNA, 20 nt, Human
gcacuaccacuccugccaag

SEQ ID NO: 2833911 - RNA, 21 nt, Human
gcacuaccacuccugccaagg

SEQ ID NO: 2833912 - RNA, 16 nt, Human
gcacuaccgauucuuu

SEQ ID NO: 2833913 - RNA, 12 nt, Human
gcacuacugggu

SEQ ID NO: 2833914 - RNA, 14 nt, Human
gcacuacugggugu

SEQ ID NO: 2833915 - RNA, 16 nt, Human
gcacuacuggguguca

SEQ ID NO: 2833916 - RNA, 17 nt, Human
gcacuacugggugucau

SEQ ID NO: 2833917 - RNA, 18 nt, Human
gcacuacugggugucauu

SEQ ID NO: 2833918 - RNA, 19 nt, Human
gcacuacugggugucauuu

SEQ ID NO: 2833919 - RNA, 21 nt, Human
gcacuacugggugucauuuca

SEQ ID NO: 2833920 - RNA, 17 nt, Human
gcacugaggaccagcca

SEQ ID NO: 2833921 - RNA, 13 nt, Human
gcacuagccuuug

SEQ ID NO: 2833922 - RNA, 16 nt, Human
gcacuagagaaugcac

SEQ ID NO: 2833923 - RNA, 18 nt, Human
gcacuagagaaugcacag

SEQ ID NO: 2833924 - RNA, 20 nt, Human
gcacuagagaaugcacagau

SEQ ID NO: 2833925 - RNA, 15 nt, Human
gcacuagccuuuggc

SEQ ID NO: 2833926 - RNA, 16 nt, Human
gcacuagccuuuggcu

SEQ ID NO: 2833927 - RNA, 18 nt, Human
gcacuagccuuuggcucu

SEQ ID NO: 2833928 - RNA, 20 nt, Human
gcacuagccuuuggcucugg

SEQ ID NO: 2833929 - RNA, 22 nt, Human
gcacuagccuuuggcucuggag

SEQ ID NO: 2833930 - RNA, 17 nt, Human
gcacuaggcacccagcu

SEQ ID NO: 2833931 - RNA, 21 nt, Human
gcacuaggcacccagcugcca

SEQ ID NO: 2833932 - RNA, 21 nt, Human
gcacuagccuuuggcucugga

SEQ ID NO: 2833933 - RNA, 19 nt, Human
gcacuagguucaauucccu

SEQ ID NO: 2833934 - RNA, 17 nt, Human
gcacuaaggugugcucu

SEQ ID NO: 2833935 - RNA, 19 nt, Human
gcacuaacguugagccccu

SEQ ID NO: 2833936 - RNA, 17 nt, Human
gcacuaaaucagagaca

SEQ ID NO: 2833937 - RNA, 22 nt, Human
gcaccugcccccugguggacag

SEQ ID NO: 2833938 - RNA, 19 nt, Human
gcaccugcaaucccagcua

SEQ ID NO: 2833939 - RNA, 14 nt, Human
gcaccugccagccu

SEQ ID NO: 2833940 - RNA, 13 nt, Human
gcaccugccagcc

SEQ ID NO: 2833941 - RNA, 18 nt, Human
gcaccugcccccuggugg

SEQ ID NO: 2833942 - RNA, 17 nt, Human
gcaccugcccccuggug

SEQ ID NO: 2833943 - RNA, 16 nt, Human
gcaccugcccccuggu

SEQ ID NO: 2833944 - RNA, 15 nt, Human
gcaccugcccccugg

SEQ ID NO: 2833945 - RNA, 22 nt, Human
gcaccugccagccuggcuucug

SEQ ID NO: 2833946 - RNA, 17 nt, Human
gcaccugccagccuggc

SEQ ID NO: 2833947 - RNA, 16 nt, Human
gcaccugccagccugg

SEQ ID NO: 2833948 - RNA, 15 nt, Human
gcaccugccagccug

SEQ ID NO: 2833949 - RNA, 19 nt, Human
gcaaugacagguaaauuaa

SEQ ID NO: 2833950 - RNA, 16 nt, Human
gcaaugacaucucagg

SEQ ID NO: 2833951 - RNA, 19 nt, Human
gcaaugacaucucaggggc

SEQ ID NO: 2833952 - RNA, 21 nt, Human
gcaaugacaucucaggggcca

SEQ ID NO: 2833953 - RNA, 21 nt, Human
gcacagcggggccccagggcu

SEQ ID NO: 2833954 - RNA, 15 nt, Human
gcacagcucaggagg

SEQ ID NO: 2833955 - RNA, 19 nt, Human
gcacagcugaaaguucuug

SEQ ID NO: 2833956 - RNA, 20 nt, Human
gcacagcucaggaggcgccc

SEQ ID NO: 2833957 - RNA, 14 nt, Human
gcacagcucccugc

SEQ ID NO: 2833958 - RNA, 16 nt, Human
gcacagcucccugcca

SEQ ID NO: 2833959 - RNA, 17 nt, Human
gcacagcucccugccaa

SEQ ID NO: 2833960 - RNA, 23 nt, Human
gcacagcucccugccaaacugaa

SEQ ID NO: 2833961 - RNA, 12 nt, Human
gcacagcucagg

SEQ ID NO: 2833962 - RNA, 13 nt, Human
gcacaugcuggcc

SEQ ID NO: 2833963 - RNA, 14 nt, Human
gcacaugcuggcca

SEQ ID NO: 2833964 - RNA, 15 nt, Human
gcacaugcuggccag

SEQ ID NO: 2833965 - RNA, 16 nt, Human
gcacaugcuggccagc

SEQ ID NO: 2833966 - RNA, 18 nt, Human
gcacaugcuggccagccu

SEQ ID NO: 2833967 - RNA, 19 nt, Human
gcacaugcuggccagccug

SEQ ID NO: 2833968 - RNA, 21 nt, Human
gcacaugcuggccagccuggg

SEQ ID NO: 2833969 - RNA, 22 nt, Human
gcacaugcuggccagccugggg

SEQ ID NO: 2833970 - RNA, 23 nt, Human
gcacaugcuggccagccuggggc

SEQ ID NO: 2833971 - RNA, 13 nt, Human
gcacaugcuucaa

SEQ ID NO: 2833972 - RNA, 15 nt, Human
gcacaggaugcuggc

SEQ ID NO: 2833973 - RNA, 16 nt, Human
gcacaggaugcuggcc

SEQ ID NO: 2833974 - RNA, 17 nt, Human
gcacaggaugcuggccu

SEQ ID NO: 2833975 - RNA, 14 nt, Human
gcacaggcccccuu

SEQ ID NO: 2833976 - RNA, 16 nt, Human
gcacagcuucauuucc

SEQ ID NO: 2833977 - RNA, 16 nt, Human
gcacagcuguaguggg

SEQ ID NO: 2833978 - RNA, 23 nt, Human
gcacagcuguagugggguucuag

SEQ ID NO: 2833979 - RNA, 16 nt, Human
gcacaggacugauucu

SEQ ID NO: 2833980 - RNA, 21 nt, Human
gcacaggacugauucugggau

SEQ ID NO: 2833981 - RNA, 23 nt, Human
gcaccacccuagucccuuccccu

SEQ ID NO: 2833982 - RNA, 17 nt, Human
gcacccacccugggacc

SEQ ID NO: 2833983 - RNA, 13 nt, Human
gcacccacccugg

SEQ ID NO: 2833984 - RNA, 14 nt, Human
gcacccacccuggg

SEQ ID NO: 2833985 - RNA, 21 nt, Human
gcacaugucuuguacaugugu

SEQ ID NO: 2833986 - RNA, 13 nt, Human
gcacaugucuugu

SEQ ID NO: 2833987 - RNA, 20 nt, Human
gcacaugucuuguacaugug

SEQ ID NO: 2833988 - RNA, 22 nt, Human
gcaccacccuagucccuucccc

SEQ ID NO: 2833989 - RNA, 20 nt, Human
gcaccacccuagucccuucc

SEQ ID NO: 2833990 - RNA, 11 nt, Human
gcaccacccua

SEQ ID NO: 2833991 - RNA, 15 nt, Human
gcaccuccugccucg

SEQ ID NO: 2833992 - RNA, 14 nt, Human
gcaccuccugccuc

SEQ ID NO: 2833993 - RNA, 17 nt, Human
gcacccggccccugcug

SEQ ID NO: 2833994 - RNA, 15 nt, Human
gcacccggccccugc

SEQ ID NO: 2833995 - RNA, 14 nt, Human
gcacccggccccug

SEQ ID NO: 2833996 - RNA, 14 nt, Human
gcacccagcccaga

SEQ ID NO: 2833997 - RNA, 20 nt, Human
gcacccaggaggggaacacu

SEQ ID NO: 2833998 - RNA, 22 nt, Human
gcagauggaaugcuguguuaaa

SEQ ID NO: 2833999 - RNA, 18 nt, Human
gcagauggaaugcugugu

SEQ ID NO: 2834000 - RNA, 23 nt, Human
gcagaugcuagcgcguugccugu

SEQ ID NO: 2834001 - RNA, 18 nt, Human
gcagaugccacccuagcc

SEQ ID NO: 2834002 - RNA, 17 nt, Human
gcagaugccacccuagc

SEQ ID NO: 2834003 - RNA, 16 nt, Human
gcagaugccacccuag

SEQ ID NO: 2834004 - RNA, 14 nt, Human
gcagaugccacccu

SEQ ID NO: 2834005 - RNA, 18 nt, Human
gcagaugcagagagccau

SEQ ID NO: 2834006 - RNA, 19 nt, Human
gcagaugcaaugacucagg

SEQ ID NO: 2834007 - RNA, 15 nt, Human
gcagaugcagagagc

SEQ ID NO: 2834008 - RNA, 17 nt, Human
gcagaugcagagagcca

SEQ ID NO: 2834009 - RNA, 13 nt, Human
gcagaugcaauga

SEQ ID NO: 2834010 - RNA, 16 nt, Human
gcagcaaggcccugcu

SEQ ID NO: 2834011 - RNA, 17 nt, Human
gcagcaaggcccugcug

SEQ ID NO: 2834012 - RNA, 19 nt, Human
gcagcaaggcccugcugcc

SEQ ID NO: 2834013 - RNA, 14 nt, Human
gcagcaagaaaaaa

SEQ ID NO: 2834014 - RNA, 15 nt, Human
gcagcaagaaaaaaa

SEQ ID NO: 2834015 - RNA, 19 nt, Human
gcagcaagaaaaaaaaaug

SEQ ID NO: 2834016 - RNA, 20 nt, Human
gcagcaagaaaaaaaaaugc

SEQ ID NO: 2834017 - RNA, 23 nt, Human
gcagauuuuuauauuaguugcuu

SEQ ID NO: 2834018 - RNA, 14 nt, Human
gcagcaaaaauaua

SEQ ID NO: 2834019 - RNA, 15 nt, Human
gcagcaaaaauauaa

SEQ ID NO: 2834020 - RNA, 16 nt, Human
gcagcaaaaauauaaa

SEQ ID NO: 2834021 - RNA, 18 nt, Human
gcagcaaaaauauaaaau

SEQ ID NO: 2834022 - RNA, 19 nt, Human
gcagcaaaaauauaaaaua

SEQ ID NO: 2834023 - RNA, 15 nt, Human
gcagcacggacaaua

SEQ ID NO: 2834024 - RNA, 18 nt, Human
gcagcacggacaauaaac

SEQ ID NO: 2834025 - RNA, 19 nt, Human
gcagcacggacaauaaacc

SEQ ID NO: 2834026 - RNA, 18 nt, Human
gcagagucacaagccucg

SEQ ID NO: 2834027 - RNA, 15 nt, Human
gcagagugcacagcu

SEQ ID NO: 2834028 - RNA, 16 nt, Human
gcagagugcacagcug

SEQ ID NO: 2834029 - RNA, 17 nt, Human
gcagagugcacagcugu

SEQ ID NO: 2834030 - RNA, 18 nt, Human
gcagagugcacagcuguc

SEQ ID NO: 2834031 - RNA, 23 nt, Human
gcagagucacacgggggcagcug

SEQ ID NO: 2834032 - RNA, 13 nt, Human
gcagagucacacg

SEQ ID NO: 2834033 - RNA, 14 nt, Human
gcagagucacacgg

SEQ ID NO: 2834034 - RNA, 23 nt, Human
gcagagaaugaaagggcccagag

SEQ ID NO: 2834035 - RNA, 22 nt, Human
gcagagaaugaaagggcccaga

SEQ ID NO: 2834036 - RNA, 12 nt, Human
gcagagaauaua

SEQ ID NO: 2834037 - RNA, 23 nt, Human
gcagagaauauaacaugaaauga

SEQ ID NO: 2834038 - RNA, 20 nt, Human
gcagagaaucauacuuagca

SEQ ID NO: 2834039 - RNA, 12 nt, Human
gcagaaggaaac

SEQ ID NO: 2834040 - RNA, 21 nt, Human
gcagagaaugaaagggcccag

SEQ ID NO: 2834041 - RNA, 20 nt, Human
gcagagaaugaaagggccca

SEQ ID NO: 2834042 - RNA, 19 nt, Human
gcagagaaugaaagggccc

SEQ ID NO: 2834043 - RNA, 15 nt, Human
gcagaagcccugaug

SEQ ID NO: 2834044 - RNA, 22 nt, Human
gcagccugcuucccaccucccu

SEQ ID NO: 2834045 - RNA, 23 nt, Human
gcagccugcuucccaccucccug

SEQ ID NO: 2834046 - RNA, 17 nt, Human
gcaccuccuugucacuu

SEQ ID NO: 2834047 - RNA, 20 nt, Human
gcagccuggagacccacccc

SEQ ID NO: 2834048 - RNA, 14 nt, Human
gcagcgaccgcccc

SEQ ID NO: 2834049 - RNA, 22 nt, Human
gcagccucaaccuccugggcua

SEQ ID NO: 2834050 - RNA, 21 nt, Human
gcagccucaaccuccugggcu

SEQ ID NO: 2834051 - RNA, 13 nt, Human
gcagccugagucc

SEQ ID NO: 2834052 - RNA, 18 nt, Human
gcagccgugccuucagcu

SEQ ID NO: 2834053 - RNA, 20 nt, Human
gcagccucaaccuccugggc

SEQ ID NO: 2834054 - RNA, 19 nt, Human
gcagccucaaccuccuggg

SEQ ID NO: 2834055 - RNA, 14 nt, Human
gcagccgugccuuc

SEQ ID NO: 2834056 - RNA, 15 nt, Human
gcagccgugccuuca

SEQ ID NO: 2834057 - RNA, 17 nt, Human
gcagccgugccuucagc

SEQ ID NO: 2834058 - RNA, 13 nt, Human
gcagcagaaaacu

SEQ ID NO: 2834059 - RNA, 14 nt, Human
gcagcagaaaacuu

SEQ ID NO: 2834060 - RNA, 21 nt, Human
gcagcaggugauuggaccagg

SEQ ID NO: 2834061 - RNA, 21 nt, Human
gcaggagauugagaaggagag

SEQ ID NO: 2834062 - RNA, 22 nt, Human
gcaggagauugagaaggagaga

SEQ ID NO: 2834063 - RNA, 14 nt, Human
gcaggagccugagc

SEQ ID NO: 2834064 - RNA, 23 nt, Human
gcaggagauugagaaggagagaa

SEQ ID NO: 2834065 - RNA, 22 nt, Human
gcaggagggcccuaccugauug

SEQ ID NO: 2834066 - RNA, 18 nt, Human
gcaggagggcccuaccug

SEQ ID NO: 2834067 - RNA, 15 nt, Human
gcaggaguggugcag

SEQ ID NO: 2834068 - RNA, 18 nt, Human
gcaggaguggugcagaca

SEQ ID NO: 2834069 - RNA, 19 nt, Human
gcaggaguggugcagacag

SEQ ID NO: 2834070 - RNA, 24 nt, Human
gcagcgaguuguggaaagccucug

SEQ ID NO: 2834071 - RNA, 22 nt, Human
gcagcgagcuaugaucgcgcca

SEQ ID NO: 2834072 - RNA, 13 nt, Human
gcagcgagggcgg

SEQ ID NO: 2834073 - RNA, 14 nt, Human
gcagcgagggcgga

SEQ ID NO: 2834074 - RNA, 21 nt, Human
gcagcgagggcggagccggcc

SEQ ID NO: 2834075 - RNA, 16 nt, Human
gcagcgaccgcccccu

SEQ ID NO: 2834076 - RNA, 17 nt, Human
gcagcgaccgcccccuc

SEQ ID NO: 2834077 - RNA, 18 nt, Human
gcagcgaccgcccccucc

SEQ ID NO: 2834078 - RNA, 22 nt, Human
gcagcgaccgcccccuccucua

SEQ ID NO: 2834079 - RNA, 16 nt, Human
gcaggaccucccuucc

SEQ ID NO: 2834080 - RNA, 18 nt, Human
gcaggaccucccuuccga

SEQ ID NO: 2834081 - RNA, 21 nt, Human
gcaggaccucccuuccgaccc

SEQ ID NO: 2834082 - RNA, 22 nt, Human
gcaggaccucccuuccgacccu

SEQ ID NO: 2834083 - RNA, 12 nt, Human
gcaggaccucug

SEQ ID NO: 2834084 - RNA, 14 nt, Human
gcaggagauugaga

SEQ ID NO: 2834085 - RNA, 20 nt, Human
gcaggaccugccuguagccc

SEQ ID NO: 2834086 - RNA, 18 nt, Human
gcaggagauugagaagga

SEQ ID NO: 2834087 - RNA, 19 nt, Human
gcaggagauugagaaggag

SEQ ID NO: 2834088 - RNA, 16 nt, Human
gcaggaccugccugua

SEQ ID NO: 2834089 - RNA, 15 nt, Human
gcaggaccugccugu

SEQ ID NO: 2834090 - RNA, 14 nt, Human
gcaggaccugccug

SEQ ID NO: 2834091 - RNA, 20 nt, Human
gcaggaccucugaaacccug

SEQ ID NO: 2834092 - RNA, 20 nt, Human
gcaggcuacacugacacugg

SEQ ID NO: 2834093 - RNA, 20 nt, Human
gcaggcuaaggcguggagcu

SEQ ID NO: 2834094 - RNA, 21 nt, Human
gcaggcuaaggcguggagcug

SEQ ID NO: 2834095 - RNA, 22 nt, Human
gcaggcuaaggcguggagcugc

SEQ ID NO: 2834096 - RNA, 16 nt, Human
gcaggcuacacugaca

SEQ ID NO: 2834097 - RNA, 17 nt, Human
gcagggagggccugggc

SEQ ID NO: 2834098 - RNA, 14 nt, Human
gcagggagggccug

SEQ ID NO: 2834099 - RNA, 20 nt, Human
gcaggaucucagaucacugc

SEQ ID NO: 2834100 - RNA, 16 nt, Human
gcaggauggccuggcc

SEQ ID NO: 2834101 - RNA, 24 nt, Human
gcaggauggccuggccagggccug

SEQ ID NO: 2834102 - RNA, 18 nt, Human
gcaggauucagccggagg

SEQ ID NO: 2834103 - RNA, 16 nt, Human
gcaggauuuguucucu

SEQ ID NO: 2834104 - RNA, 17 nt, Human
gcaggauuuguucucug

SEQ ID NO: 2834105 - RNA, 19 nt, Human
gcaggauuuguucucuguc

SEQ ID NO: 2834106 - RNA, 22 nt, Human
gcaggauuuguucucuguccag

SEQ ID NO: 2834107 - RNA, 16 nt, Human
gcaggcgguggggaga

SEQ ID NO: 2834108 - RNA, 19 nt, Human
gcaggcguucagcucacug

SEQ ID NO: 2834109 - RNA, 17 nt, Human
gcaggcuaaggcgugga

SEQ ID NO: 2834110 - RNA, 12 nt, Human
gcagggcucagc

SEQ ID NO: 2834111 - RNA, 12 nt, Human
gcaggggcucug

SEQ ID NO: 2834112 - RNA, 13 nt, Human
gcaggggcucugg

SEQ ID NO: 2834113 - RNA, 14 nt, Human
gcaggggcucugga

SEQ ID NO: 2834114 - RNA, 16 nt, Human
gcaggggcucuggaga

SEQ ID NO: 2834115 - RNA, 17 nt, Human
gcaggggcucuggagag

SEQ ID NO: 2834116 - RNA, 18 nt, Human
gcaggggcucuggagaga

SEQ ID NO: 2834117 - RNA, 21 nt, Human
gcaggggcucuggagagaaac

SEQ ID NO: 2834118 - RNA, 19 nt, Human
gcaggggcucuggagagaa

SEQ ID NO: 2834119 - RNA, 20 nt, Human
gcaggggcucuggagagaaa

SEQ ID NO: 2834120 - RNA, 22 nt, Human
gcaggggcucuggagagaaaca

SEQ ID NO: 2834121 - RNA, 15 nt, Human
gcaggggcugcagua

SEQ ID NO: 2834122 - RNA, 22 nt, Human
gcagggagggccugggccccag

SEQ ID NO: 2834123 - RNA, 18 nt, Human
gcagggagggccugggcc

SEQ ID NO: 2834124 - RNA, 16 nt, Human
gcagggccucacacgg

SEQ ID NO: 2834125 - RNA, 16 nt, Human
gcagugggagcugccu

SEQ ID NO: 2834126 - RNA, 22 nt, Human
gcagugcgcgugcacguggaga

SEQ ID NO: 2834127 - RNA, 19 nt, Human
gcagugcuagugagcuggg

SEQ ID NO: 2834128 - RNA, 22 nt, Human
gcagugcuagugagcugggcau

SEQ ID NO: 2834129 - RNA, 20 nt, Human
gcaggggugacggcccucau

SEQ ID NO: 2834130 - RNA, 16 nt, Human
gcagggggacugcuug

SEQ ID NO: 2834131 - RNA, 21 nt, Human
gcaggggguggacaaacugga

SEQ ID NO: 2834132 - RNA, 22 nt, Human
gcaggugauuggaccaggccau

SEQ ID NO: 2834133 - RNA, 21 nt, Human
gcaggugauuggaccaggcca

SEQ ID NO: 2834134 - RNA, 18 nt, Human
gcaggugauuggaccagg

SEQ ID NO: 2834135 - RNA, 16 nt, Human
gcaggugcuauuguua

SEQ ID NO: 2834136 - RNA, 16 nt, Human
gcaguucuaguuugca

SEQ ID NO: 2834137 - RNA, 16 nt, Human
gcauagcaagacacau

SEQ ID NO: 2834138 - RNA, 21 nt, Human
gcaguucuaguuugcauuccu

SEQ ID NO: 2834139 - RNA, 14 nt, Human
gcauagcaaacaga

SEQ ID NO: 2834140 - RNA, 18 nt, Human
gcauagcuacguggcacu

SEQ ID NO: 2834141 - RNA, 14 nt, Human
gcauauagagauga

SEQ ID NO: 2834142 - RNA, 17 nt, Human
gcauauaggugauguuu

SEQ ID NO: 2834143 - RNA, 19 nt, Human
gcauauaggugauguuugc

SEQ ID NO: 2834144 - RNA, 18 nt, Human
gcagugggagcugccugu

SEQ ID NO: 2834145 - RNA, 17 nt, Human
gcagugggagcugccug

SEQ ID NO: 2834146 - RNA, 21 nt, Human
gcaguguuccccaucuggguc

SEQ ID NO: 2834147 - RNA, 20 nt, Human
gcaguguuccccaucugggu

SEQ ID NO: 2834148 - RNA, 17 nt, Human
gcaguuaauuagcauuc

SEQ ID NO: 2834149 - RNA, 16 nt, Human
gcaguguucgcuuggc

SEQ ID NO: 2834150 - RNA, 17 nt, Human
gcaguguucgcuuggcu

SEQ ID NO: 2834151 - RNA, 22 nt, Human
gcaguguucgcuuggcuccaug

SEQ ID NO: 2834152 - RNA, 12 nt, Human
gcauauguugaa

SEQ ID NO: 2834153 - RNA, 17 nt, Human
gcauauguugaauacuu

SEQ ID NO: 2834154 - RNA, 14 nt, Human
gcauauguugaaua

SEQ ID NO: 2834155 - RNA, 21 nt, Human
gcauauguugaauacuuuuua

SEQ ID NO: 2834156 - RNA, 20 nt, Human
gcauauguugaauacuuuuu

SEQ ID NO: 2834157 - RNA, 19 nt, Human
gcauauguugaauacuuuu

SEQ ID NO: 2834158 - RNA, 18 nt, Human
gcauauguugaauacuuu

SEQ ID NO: 2834159 - RNA, 22 nt, Human
gcauauucuuuucugcaaaaua

SEQ ID NO: 2834160 - RNA, 17 nt, Human
gcauuggauacagcagu

SEQ ID NO: 2834161 - RNA, 18 nt, Human
gcauuggauacagcagua

SEQ ID NO: 2834162 - RNA, 20 nt, Human
gcauuggauacagcaguaga

SEQ ID NO: 2834163 - RNA, 20 nt, Human
gcauugcuuuuauuuugaaa

SEQ ID NO: 2834164 - RNA, 13 nt, Human
gcauuuuauagac

SEQ ID NO: 2834165 - RNA, 20 nt, Human
gcauuuggguaauuuagauu

SEQ ID NO: 2834166 - RNA, 22 nt, Human
gcauuccuucuuugauaauguu

SEQ ID NO: 2834167 - RNA, 23 nt, Human
gcauuccuucuuugauaauguua

SEQ ID NO: 2834168 - RNA, 16 nt, Human
gcauuccuuugucuuc

SEQ ID NO: 2834169 - RNA, 14 nt, Human
gcauucuauugccu

SEQ ID NO: 2834170 - RNA, 15 nt, Human
gcauucuauugccuu

SEQ ID NO: 2834171 - RNA, 16 nt, Human
gcauucuauugccuuc

SEQ ID NO: 2834172 - RNA, 18 nt, Human
gcauucuauugccuucuu

SEQ ID NO: 2834173 - RNA, 20 nt, Human
gcauucuauugccuucuuug

SEQ ID NO: 2834174 - RNA, 22 nt, Human
gcauucuauugccuucuuugaa

SEQ ID NO: 2834175 - RNA, 13 nt, Human
gcauucucacucc

SEQ ID NO: 2834176 - RNA, 15 nt, Human
gcauucucacuccua

SEQ ID NO: 2834177 - RNA, 18 nt, Human
gcauucucacuccuaccu

SEQ ID NO: 2834178 - RNA, 21 nt, Human
gcauucuccccaguguauguc

SEQ ID NO: 2834179 - RNA, 16 nt, Human
gcauucuccuggaugc

SEQ ID NO: 2834180 - RNA, 16 nt, Human
gcauugauucaguauu

SEQ ID NO: 2834181 - RNA, 17 nt, Human
gcauugauauugugaac

SEQ ID NO: 2834182 - RNA, 18 nt, Human
gcauugauauugugaaca

SEQ ID NO: 2834183 - RNA, 13 nt, Human
gcauugcuuucgu

SEQ ID NO: 2834184 - RNA, 12 nt, Human
gcauugcuguua

SEQ ID NO: 2834185 - RNA, 12 nt, Human
gcauugccuggc

SEQ ID NO: 2834186 - RNA, 20 nt, Human
gcauugccuggccuuccugu

SEQ ID NO: 2834187 - RNA, 14 nt, Human
gcauugcuagauaa

SEQ ID NO: 2834188 - RNA, 15 nt, Human
gcauugcuagauaaa

SEQ ID NO: 2834189 - RNA, 16 nt, Human
gcauugcuagauaaaa

SEQ ID NO: 2834190 - RNA, 17 nt, Human
gcauugcuagauaaaag

SEQ ID NO: 2834191 - RNA, 18 nt, Human
gcauugcuagauaaaagc

SEQ ID NO: 2834192 - RNA, 18 nt, Human
gcauuuucaccccacccu

SEQ ID NO: 2834193 - RNA, 18 nt, Human
gcauuuuccagcacuuug

SEQ ID NO: 2834194 - RNA, 13 nt, Human
gccaaaaggaaaa

SEQ ID NO: 2834195 - RNA, 14 nt, Human
gccaaaaggaaaaa

SEQ ID NO: 2834196 - RNA, 17 nt, Human
gccaaaaggaaaaagcu

SEQ ID NO: 2834197 - RNA, 18 nt, Human
gccaaaaggaaaaagcuc

SEQ ID NO: 2834198 - RNA, 19 nt, Human
gccaaaaggaaaaagcucc

SEQ ID NO: 2834199 - RNA, 23 nt, Human
gccaaaaggaaaaagcuccaugu

SEQ ID NO: 2834200 - RNA, 15 nt, Human
gccaaaagcugcuca

SEQ ID NO: 2834201 - RNA, 14 nt, Human
gccaaaagcugcuc

SEQ ID NO: 2834202 - RNA, 16 nt, Human
gccaaaagcuagacag

SEQ ID NO: 2834203 - RNA, 21 nt, Human
gccaaaagcuagacagauccc

SEQ ID NO: 2834204 - RNA, 17 nt, Human
gccaaacucugccagcc

SEQ ID NO: 2834205 - RNA, 18 nt, Human
gccaaacucugccagcca

SEQ ID NO: 2834206 - RNA, 12 nt, Human
gccaaacugcug

SEQ ID NO: 2834207 - RNA, 13 nt, Human
gccaaacugcugg

SEQ ID NO: 2834208 - RNA, 14 nt, Human
gccaaacugcugga

SEQ ID NO: 2834209 - RNA, 23 nt, Human
gccaaacugcuggacgucuuucu

SEQ ID NO: 2834210 - RNA, 13 nt, Human
gccaaagaaauga

SEQ ID NO: 2834211 - RNA, 17 nt, Human
gccaaagaaaugaacau

SEQ ID NO: 2834212 - RNA, 18 nt, Human
gccaaagaaaugaacauu

SEQ ID NO: 2834213 - RNA, 22 nt, Human
gccaaagaaaugaacauuccaa

SEQ ID NO: 2834214 - RNA, 15 nt, Human
gccaaacagccacac

SEQ ID NO: 2834215 - RNA, 16 nt, Human
gcaugcuggggcaagu

SEQ ID NO: 2834216 - RNA, 12 nt, Human
gcaugccuugug

SEQ ID NO: 2834217 - RNA, 13 nt, Human
gcaugccuugugc

SEQ ID NO: 2834218 - RNA, 16 nt, Human
gcauggagacgcauuu

SEQ ID NO: 2834219 - RNA, 18 nt, Human
gcauguugaccaugucua

SEQ ID NO: 2834220 - RNA, 20 nt, Human
gcauguugaccaugucuaug

SEQ ID NO: 2834221 - RNA, 15 nt, Human
gcauuagaauuauuu

SEQ ID NO: 2834222 - RNA, 14 nt, Human
gcauguuuuguaua

SEQ ID NO: 2834223 - RNA, 15 nt, Human
gcauguuuuguauac

SEQ ID NO: 2834224 - RNA, 16 nt, Human
gcauguuuuguauaca

SEQ ID NO: 2834225 - RNA, 17 nt, Human
gcauguuuuguauacaa

SEQ ID NO: 2834226 - RNA, 18 nt, Human
gcauguuuuguauacaaa

SEQ ID NO: 2834227 - RNA, 20 nt, Human
gcauguuuuguauacaaaua

SEQ ID NO: 2834228 - RNA, 18 nt, Human
gcauguuuugugcauuug

SEQ ID NO: 2834229 - RNA, 15 nt, Human
gcauguuucauguuu

SEQ ID NO: 2834230 - RNA, 20 nt, Human
gcauguuucauguuuuguga

SEQ ID NO: 2834231 - RNA, 15 nt, Human
gcauguuuccagcag

SEQ ID NO: 2834232 - RNA, 14 nt, Human
gcauguuugaaaug

SEQ ID NO: 2834233 - RNA, 15 nt, Human
gcauguuugaaauga

SEQ ID NO: 2834234 - RNA, 18 nt, Human
gcauguuugaaaugaggu

SEQ ID NO: 2834235 - RNA, 18 nt, Human
gcauguuuuccagcuccu

SEQ ID NO: 2834236 - RNA, 19 nt, Human
gcauguuuuccagcuccuc

SEQ ID NO: 2834237 - RNA, 18 nt, Human
gcauuagggaugccuccu

SEQ ID NO: 2834238 - RNA, 14 nt, Human
gcauuagcacagau

SEQ ID NO: 2834239 - RNA, 17 nt, Human
gcauuagcacagauuuu

SEQ ID NO: 2834240 - RNA, 19 nt, Human
gcauuagcacagauuuuaa

SEQ ID NO: 2834241 - RNA, 20 nt, Human
gcauuagcacagauuuuaau

SEQ ID NO: 2834242 - RNA, 21 nt, Human
gcauuagcacagauuuuaauu

SEQ ID NO: 2834243 - RNA, 22 nt, Human
gcauuagcacagauuuuaauug

SEQ ID NO: 2834244 - RNA, 20 nt, Human
gcauuagauuucucauuugc

SEQ ID NO: 2834245 - RNA, 17 nt, Human
gcauuagaauuauuuaa

SEQ ID NO: 2834246 - RNA, 18 nt, Human
gcauuagaauuauuuaaa

SEQ ID NO: 2834247 - RNA, 22 nt, Human
gcaucacagggcagagccggga

SEQ ID NO: 2834248 - RNA, 21 nt, Human
gcaucacagggcagagccggg

SEQ ID NO: 2834249 - RNA, 17 nt, Human
gcaucacagggcagagc

SEQ ID NO: 2834250 - RNA, 16 nt, Human
gcaucacagggcagag

SEQ ID NO: 2834251 - RNA, 15 nt, Human
gcaucacagggcaga

SEQ ID NO: 2834252 - RNA, 14 nt, Human
gcaucacagggcag

SEQ ID NO: 2834253 - RNA, 18 nt, Human
gcaucaaggggucacuua

SEQ ID NO: 2834254 - RNA, 22 nt, Human
gcaucaaggggucacuuacaga

SEQ ID NO: 2834255 - RNA, 21 nt, Human
gcaucaaggucagcaugagga

SEQ ID NO: 2834256 - RNA, 13 nt, Human
gcaucaccucagg

SEQ ID NO: 2834257 - RNA, 18 nt, Human
gcaugccaacaagaaugc

SEQ ID NO: 2834258 - RNA, 20 nt, Human
gcaugccaacaagaaugcau

SEQ ID NO: 2834259 - RNA, 21 nt, Human
gcaugccaacaagaaugcauu

SEQ ID NO: 2834260 - RNA, 23 nt, Human
gcaugccaacaagaaugcauuga

SEQ ID NO: 2834261 - RNA, 14 nt, Human
gcaugcaccugcaa

SEQ ID NO: 2834262 - RNA, 23 nt, Human
gcaucaagaggugggagggcccu

SEQ ID NO: 2834263 - RNA, 16 nt, Human
gcccuccuuguccacc

SEQ ID NO: 2834264 - RNA, 15 nt, Human
gcccuccuuguccac

SEQ ID NO: 2834265 - RNA, 18 nt, Human
gcccuccugugcuggggg

SEQ ID NO: 2834266 - RNA, 12 nt, Human
gcccuccugugc

SEQ ID NO: 2834267 - RNA, 19 nt, Human
gcccuccccauggagccag

SEQ ID NO: 2834268 - RNA, 21 nt, Human
gcccggagauuggacggccug

SEQ ID NO: 2834269 - RNA, 19 nt, Human
gcccggagauuggacggcc

SEQ ID NO: 2834270 - RNA, 18 nt, Human
gcccuccccauggagcca

SEQ ID NO: 2834271 - RNA, 13 nt, Human
gcccuccccuccc

SEQ ID NO: 2834272 - RNA, 12 nt, Human
gcccuccccucc

SEQ ID NO: 2834273 - RNA, 16 nt, Human
gcccuccccuccccug

SEQ ID NO: 2834274 - RNA, 17 nt, Human
gcccuccccuccccugc

SEQ ID NO: 2834275 - RNA, 18 nt, Human
gcccuccccuccccugcu

SEQ ID NO: 2834276 - RNA, 19 nt, Human
gcccuccccuccccugcug

SEQ ID NO: 2834277 - RNA, 15 nt, Human
gcccuccccucucug

SEQ ID NO: 2834278 - RNA, 20 nt, Human
gcccuccccuccccugcugc

SEQ ID NO: 2834279 - RNA, 21 nt, Human
gcccuccccuccccugcugca

SEQ ID NO: 2834280 - RNA, 18 nt, Human
gcccuccccucucugcac

SEQ ID NO: 2834281 - RNA, 19 nt, Human
gcccuccccucucugcacc

SEQ ID NO: 2834282 - RNA, 19 nt, Human
gcccuccuacccugcgccc

SEQ ID NO: 2834283 - RNA, 24 nt, Human
gcccuccuacccugcgcccagucc

SEQ ID NO: 2834284 - RNA, 19 nt, Human
gcccucccuccccagcucc

SEQ ID NO: 2834285 - RNA, 15 nt, Human
gcccucccugccccu

SEQ ID NO: 2834286 - RNA, 18 nt, Human
gcccuccuacccugcgcc

SEQ ID NO: 2834287 - RNA, 22 nt, Human
gcccuccccuccccugcugcag

SEQ ID NO: 2834288 - RNA, 15 nt, Human
gcccggcuccaggcu

SEQ ID NO: 2834289 - RNA, 14 nt, Human
gcccggcuccaggc

SEQ ID NO: 2834290 - RNA, 13 nt, Human
gcccggcuccagg

SEQ ID NO: 2834291 - RNA, 12 nt, Human
gcccggcuccag

SEQ ID NO: 2834292 - RNA, 14 nt, Human
gcccggaccuuggc

SEQ ID NO: 2834293 - RNA, 18 nt, Human
gcccgcggggacauuggg

SEQ ID NO: 2834294 - RNA, 22 nt, Human
gcccgcucuacaucuucugccu

SEQ ID NO: 2834295 - RNA, 12 nt, Human
gccccuucccuu

SEQ ID NO: 2834296 - RNA, 13 nt, Human
gccccuucccuuc

SEQ ID NO: 2834297 - RNA, 23 nt, Human
gccccuucuagguggcaaggcug

SEQ ID NO: 2834298 - RNA, 14 nt, Human
gccccuuccuuuaa

SEQ ID NO: 2834299 - RNA, 16 nt, Human
gccccuucucucccug

SEQ ID NO: 2834300 - RNA, 17 nt, Human
gccccuucucucccugc

SEQ ID NO: 2834301 - RNA, 19 nt, Human
gccccuucucucccugcca

SEQ ID NO: 2834302 - RNA, 23 nt, Human
gccccuucucucccugccagagg

SEQ ID NO: 2834303 - RNA, 13 nt, Human
gccccugcacaaa

SEQ ID NO: 2834304 - RNA, 17 nt, Human
gccccuucccccuccaa

SEQ ID NO: 2834305 - RNA, 15 nt, Human
gccccugcagcacgg

SEQ ID NO: 2834306 - RNA, 23 nt, Human
gccccugcagcacggacaauaaa

SEQ ID NO: 2834307 - RNA, 20 nt, Human
gccccuagcccaggagagag

SEQ ID NO: 2834308 - RNA, 21 nt, Human
gccccuagcccaggagagaga

SEQ ID NO: 2834309 - RNA, 14 nt, Human
gccccuagcccagg

SEQ ID NO: 2834310 - RNA, 15 nt, Human
gccccuagcccagga

SEQ ID NO: 2834311 - RNA, 18 nt, Human
gccccuagcccaggagag

SEQ ID NO: 2834312 - RNA, 19 nt, Human
gccccuagcccaggagaga

SEQ ID NO: 2834313 - RNA, 13 nt, Human
gccccuagcccag

SEQ ID NO: 2834314 - RNA, 18 nt, Human
gccccuagaaacccaagc

SEQ ID NO: 2834315 - RNA, 19 nt, Human
gccccuagaaacccaagcu

SEQ ID NO: 2834316 - RNA, 21 nt, Human
gccccuagaaacccaagcucc

SEQ ID NO: 2834317 - RNA, 18 nt, Human
gccccucccaagcuggcu

SEQ ID NO: 2834318 - RNA, 19 nt, Human
gccccucccaagcuggcug

SEQ ID NO: 2834319 - RNA, 16 nt, Human
gccccucaaccuccug

SEQ ID NO: 2834320 - RNA, 14 nt, Human
gccccgucucuguu

SEQ ID NO: 2834321 - RNA, 17 nt, Human
gccccgucccccucugg

SEQ ID NO: 2834322 - RNA, 21 nt, Human
gccccgucccccucuggcucc

SEQ ID NO: 2834323 - RNA, 18 nt, Human
gccccggucaccuagcaa

SEQ ID NO: 2834324 - RNA, 15 nt, Human
gccccggcccugggc

SEQ ID NO: 2834325 - RNA, 17 nt, Human
gccccggcccugggcuc

SEQ ID NO: 2834326 - RNA, 21 nt, Human
gccccggcccugggcucggag

SEQ ID NO: 2834327 - RNA, 17 nt, Human
gccccggccaccucugc

SEQ ID NO: 2834328 - RNA, 18 nt, Human
gccccggccaccucugcg

SEQ ID NO: 2834329 - RNA, 14 nt, Human
gccccggcccuggg

SEQ ID NO: 2834330 - RNA, 15 nt, Human
gccccggaucagagc

SEQ ID NO: 2834331 - RNA, 16 nt, Human
gccccggaucagagca

SEQ ID NO: 2834332 - RNA, 17 nt, Human
gccccggaucagagcag

SEQ ID NO: 2834333 - RNA, 18 nt, Human
gccccggaucagagcagg

SEQ ID NO: 2834334 - RNA, 21 nt, Human
gccccggaucagagcaggacc

SEQ ID NO: 2834335 - RNA, 22 nt, Human
gccccggaucagagcaggaccu

SEQ ID NO: 2834336 - RNA, 23 nt, Human
gccccggaucagagcaggaccuc

SEQ ID NO: 2834337 - RNA, 13 nt, Human
gccccggccaccu

SEQ ID NO: 2834338 - RNA, 14 nt, Human
gccccggccaccuc

SEQ ID NO: 2834339 - RNA, 15 nt, Human
gccccggccaccucu

SEQ ID NO: 2834340 - RNA, 16 nt, Human
gccccggccaccucug

SEQ ID NO: 2834341 - RNA, 17 nt, Human
gccccgcgccuccuucc

SEQ ID NO: 2834342 - RNA, 23 nt, Human
gccccauucugccugcccaggcc

SEQ ID NO: 2834343 - RNA, 22 nt, Human
gccccauucugccugcccaggc

SEQ ID NO: 2834344 - RNA, 23 nt, Human
gccccgaggccuucucugaagga

SEQ ID NO: 2834345 - RNA, 22 nt, Human
gccccgaggccuucucugaagg

SEQ ID NO: 2834346 - RNA, 15 nt, Human
gccccgcagaccucc

SEQ ID NO: 2834347 - RNA, 15 nt, Human
gccccgcaccuguac

SEQ ID NO: 2834348 - RNA, 18 nt, Human
gccccgcagaccucccca

SEQ ID NO: 2834349 - RNA, 19 nt, Human
gccccgcagaccuccccag

SEQ ID NO: 2834350 - RNA, 13 nt, Human
gccccgccgccug

SEQ ID NO: 2834351 - RNA, 20 nt, Human
gccccgcagaccuccccagc

SEQ ID NO: 2834352 - RNA, 21 nt, Human
gccccgcagaccuccccagcc

SEQ ID NO: 2834353 - RNA, 15 nt, Human
gccccgcccucuucc

SEQ ID NO: 2834354 - RNA, 16 nt, Human
gccccgcccucuuccu

SEQ ID NO: 2834355 - RNA, 17 nt, Human
gccccgcccucuuccug

SEQ ID NO: 2834356 - RNA, 18 nt, Human
gccccgcccucuuccuga

SEQ ID NO: 2834357 - RNA, 22 nt, Human
gccccgcccucuuccugacgaa

SEQ ID NO: 2834358 - RNA, 15 nt, Human
gcccaggcuggcgug

SEQ ID NO: 2834359 - RNA, 14 nt, Human
gcccaggcuggcgu

SEQ ID NO: 2834360 - RNA, 16 nt, Human
gcccaggcuggcgugc

SEQ ID NO: 2834361 - RNA, 20 nt, Human
gcccagucuggaaugcagug

SEQ ID NO: 2834362 - RNA, 22 nt, Human
gcccagucuggaaugcaguggu

SEQ ID NO: 2834363 - RNA, 17 nt, Human
gcccagguuucuggucu

SEQ ID NO: 2834364 - RNA, 14 nt, Human
gcccagguuucugg

SEQ ID NO: 2834365 - RNA, 23 nt, Human
gcccagguuucuggucucuaggc

SEQ ID NO: 2834366 - RNA, 18 nt, Human
gcccagucuuucaugugu

SEQ ID NO: 2834367 - RNA, 11 nt, Human
gcccaggcugg

SEQ ID NO: 2834368 - RNA, 17 nt, Human
gcccaggccugccuguu

SEQ ID NO: 2834369 - RNA, 12 nt, Human
gcccaggcggga

SEQ ID NO: 2834370 - RNA, 22 nt, Human
gcccaggcgggagcgguggccc

SEQ ID NO: 2834371 - RNA, 12 nt, Human
gcccaggcucca

SEQ ID NO: 2834372 - RNA, 12 nt, Human
gcccaccugccu

SEQ ID NO: 2834373 - RNA, 13 nt, Human
gcccaccugccug

SEQ ID NO: 2834374 - RNA, 18 nt, Human
gcccaccuccccacgccc

SEQ ID NO: 2834375 - RNA, 19 nt, Human
gcccagcuauaccugugcc

SEQ ID NO: 2834376 - RNA, 20 nt, Human
gcccagcuauaccugugccu

SEQ ID NO: 2834377 - RNA, 20 nt, Human
gcccaccugcccaucacagg

SEQ ID NO: 2834378 - RNA, 15 nt, Human
gcccaccugcccauc

SEQ ID NO: 2834379 - RNA, 14 nt, Human
gcccaccugcccau

SEQ ID NO: 2834380 - RNA, 13 nt, Human
gcccaccugccca

SEQ ID NO: 2834381 - RNA, 10 nt, Human
gcccaccucc

SEQ ID NO: 2834382 - RNA, 12 nt, Human
gcccaccucccc

SEQ ID NO: 2834383 - RNA, 15 nt, Human
gcccaccuccccacg

SEQ ID NO: 2834384 - RNA, 17 nt, Human
gcccaccuccccacgcc

SEQ ID NO: 2834385 - RNA, 21 nt, Human
gcccaccuccccacgcccucc

SEQ ID NO: 2834386 - RNA, 11 nt, Human
gcccaccugcc

SEQ ID NO: 2834387 - RNA, 24 nt, Human
gcccagcugcaccugccagccugg

SEQ ID NO: 2834388 - RNA, 23 nt, Human
gcccagcugcaccugccagccug

SEQ ID NO: 2834389 - RNA, 18 nt, Human
gcccagcugcaccugcca

SEQ ID NO: 2834390 - RNA, 15 nt, Human
gcccagcugcaccug

SEQ ID NO: 2834391 - RNA, 14 nt, Human
gcccagcugcaccu

SEQ ID NO: 2834392 - RNA, 13 nt, Human
gcccagcugcacc

SEQ ID NO: 2834393 - RNA, 21 nt, Human
gccccagugcccacaggauca

SEQ ID NO: 2834394 - RNA, 17 nt, Human
gccccagugcccacagg

SEQ ID NO: 2834395 - RNA, 16 nt, Human
gccccagugcccacag

SEQ ID NO: 2834396 - RNA, 15 nt, Human
gccccagugcccaca

SEQ ID NO: 2834397 - RNA, 21 nt, Human
gccccauucugccugcccagg

SEQ ID NO: 2834398 - RNA, 20 nt, Human
gccccauucugccugcccag

SEQ ID NO: 2834399 - RNA, 18 nt, Human
gccccauucugccugccc

SEQ ID NO: 2834400 - RNA, 17 nt, Human
gccccauucugccugcc

SEQ ID NO: 2834401 - RNA, 15 nt, Human
gccccaucugugcau

SEQ ID NO: 2834402 - RNA, 15 nt, Human
gccccaucuucaccc

SEQ ID NO: 2834403 - RNA, 16 nt, Human
gccccaucuucaccca

SEQ ID NO: 2834404 - RNA, 20 nt, Human
gccccaugccuguccagccu

SEQ ID NO: 2834405 - RNA, 17 nt, Human
gccccaugccuguccag

SEQ ID NO: 2834406 - RNA, 23 nt, Human
gccccaugccuguccagccuggg

SEQ ID NO: 2834407 - RNA, 16 nt, Human
gccccaugccugucca

SEQ ID NO: 2834408 - RNA, 14 nt, Human
gccccaugccuguc

SEQ ID NO: 2834409 - RNA, 12 nt, Human
gcccauccuucc

SEQ ID NO: 2834410 - RNA, 13 nt, Human
gcccauccuuccc

SEQ ID NO: 2834411 - RNA, 12 nt, Human
gcccaucccugc

SEQ ID NO: 2834412 - RNA, 14 nt, Human
gcccaucccugccu

SEQ ID NO: 2834413 - RNA, 16 nt, Human
gcccaucccugccugg

SEQ ID NO: 2834414 - RNA, 18 nt, Human
gcccaucccugccugguc

SEQ ID NO: 2834415 - RNA, 19 nt, Human
gcccaucccugccugguca

SEQ ID NO: 2834416 - RNA, 22 nt, Human
gcccaucuaugucccuugcugu

SEQ ID NO: 2834417 - RNA, 13 nt, Human
gcccaucucggag

SEQ ID NO: 2834418 - RNA, 14 nt, Human
gcccaucucggagc

SEQ ID NO: 2834419 - RNA, 18 nt, Human
gcccaucucggagcaucc

SEQ ID NO: 2834420 - RNA, 20 nt, Human
gcccaucucggagcaucccg

SEQ ID NO: 2834421 - RNA, 23 nt, Human
gcccaucucggagcaucccggag

SEQ ID NO: 2834422 - RNA, 17 nt, Human
gcccaugcacuggggac

SEQ ID NO: 2834423 - RNA, 17 nt, Human
gcccaugaguccuugaa

SEQ ID NO: 2834424 - RNA, 19 nt, Human
gcccaugcccaccugccca

SEQ ID NO: 2834425 - RNA, 15 nt, Human
gcccaugcccaccug

SEQ ID NO: 2834426 - RNA, 14 nt, Human
gcccaugcccaccu

SEQ ID NO: 2834427 - RNA, 13 nt, Human
gcccaugcccacc

SEQ ID NO: 2834428 - RNA, 13 nt, Human
gccccagcucugg

SEQ ID NO: 2834429 - RNA, 14 nt, Human
gccccagcucuggc

SEQ ID NO: 2834430 - RNA, 16 nt, Human
gcccacaggaggcaag

SEQ ID NO: 2834431 - RNA, 17 nt, Human
gcccacaggaggcaagc

SEQ ID NO: 2834432 - RNA, 22 nt, Human
gcccacaggaggcaagcaagcu

SEQ ID NO: 2834433 - RNA, 24 nt, Human
gcccacaggaggcaagcaagcucu

SEQ ID NO: 2834434 - RNA, 20 nt, Human
gcccacagcacagcucccug

SEQ ID NO: 2834435 - RNA, 22 nt, Human
gcccacagcacagcucccugcc

SEQ ID NO: 2834436 - RNA, 11 nt, Human
gcccacacaca

SEQ ID NO: 2834437 - RNA, 12 nt, Human
gcccacacacag

SEQ ID NO: 2834438 - RNA, 13 nt, Human
gcccacacacagg

SEQ ID NO: 2834439 - RNA, 14 nt, Human
gcccacacacaggu

SEQ ID NO: 2834440 - RNA, 15 nt, Human
gcccacacacaggug

SEQ ID NO: 2834441 - RNA, 17 nt, Human
gcccaaagucuguguga

SEQ ID NO: 2834442 - RNA, 19 nt, Human
gcccaaaggggacaggccu

SEQ ID NO: 2834443 - RNA, 20 nt, Human
gcccaaaggggacaggccuc

SEQ ID NO: 2834444 - RNA, 21 nt, Human
gcccaaaggggacaggccuca

SEQ ID NO: 2834445 - RNA, 18 nt, Human
gcccacaggaucagucug

SEQ ID NO: 2834446 - RNA, 13 nt, Human
gcccacaggauca

SEQ ID NO: 2834447 - RNA, 19 nt, Human
gcccacaggaucagucuga

SEQ ID NO: 2834448 - RNA, 12 nt, Human
gcccacccugcu

SEQ ID NO: 2834449 - RNA, 15 nt, Human
gcccacccugcugcc

SEQ ID NO: 2834450 - RNA, 18 nt, Human
gcccacccugcugccuuc

SEQ ID NO: 2834451 - RNA, 16 nt, Human
gccauuuauuuauuga

SEQ ID NO: 2834452 - RNA, 13 nt, Human
gccauuuauuuau

SEQ ID NO: 2834453 - RNA, 21 nt, Human
gccauuuaugugagugugugu

SEQ ID NO: 2834454 - RNA, 11 nt, Human
gccauuuaaaa

SEQ ID NO: 2834455 - RNA, 18 nt, Human
gccauuuaaaaaguugua

SEQ ID NO: 2834456 - RNA, 13 nt, Human
gccauuugauacc

SEQ ID NO: 2834457 - RNA, 17 nt, Human
gccauuugauuuuucua

SEQ ID NO: 2834458 - RNA, 23 nt, Human
gccauuugcacccuccgccuuca

SEQ ID NO: 2834459 - RNA, 20 nt, Human
gccauuugcacccuccgccu

SEQ ID NO: 2834460 - RNA, 15 nt, Human
gccauuugcuuuuuc

SEQ ID NO: 2834461 - RNA, 22 nt, Human
gccauggcgugucccucucgga

SEQ ID NO: 2834462 - RNA, 17 nt, Human
gccauggcgugucccuc

SEQ ID NO: 2834463 - RNA, 16 nt, Human
gccauggcgugucccu

SEQ ID NO: 2834464 - RNA, 13 nt, Human
gccauggaguugu

SEQ ID NO: 2834465 - RNA, 19 nt, Human
gccauggaguugugaucau

SEQ ID NO: 2834466 - RNA, 18 nt, Human
gccauccccagggggcau

SEQ ID NO: 2834467 - RNA, 22 nt, Human
gccauggagagcuggagccugg

SEQ ID NO: 2834468 - RNA, 23 nt, Human
gccauggagagcuggagccuggu

SEQ ID NO: 2834469 - RNA, 15 nt, Human
gccauggagagcugg

SEQ ID NO: 2834470 - RNA, 16 nt, Human
gccauggagagcugga

SEQ ID NO: 2834471 - RNA, 18 nt, Human
gccauggagagcuggagc

SEQ ID NO: 2834472 - RNA, 20 nt, Human
gccauggagagcuggagccu

SEQ ID NO: 2834473 - RNA, 14 nt, Human
gccauccagguuca

SEQ ID NO: 2834474 - RNA, 16 nt, Human
gccauccccagggggc

SEQ ID NO: 2834475 - RNA, 20 nt, Human
gccauccagguucagcuugu

SEQ ID NO: 2834476 - RNA, 19 nt, Human
gccauccagguucagcuug

SEQ ID NO: 2834477 - RNA, 13 nt, Human
gccagucuugugu

SEQ ID NO: 2834478 - RNA, 13 nt, Human
gccaggugcagug

SEQ ID NO: 2834479 - RNA, 14 nt, Human
gccaggugcagugg

SEQ ID NO: 2834480 - RNA, 18 nt, Human
gccaguccugccuggcca

SEQ ID NO: 2834481 - RNA, 20 nt, Human
gccaguccugccuggccagg

SEQ ID NO: 2834482 - RNA, 19 nt, Human
gccaguccugccuggccag

SEQ ID NO: 2834483 - RNA, 22 nt, Human
gccaggaaccuguccuaaggaa

SEQ ID NO: 2834484 - RNA, 15 nt, Human
gccaggaaccugucc

SEQ ID NO: 2834485 - RNA, 19 nt, Human
gccagggcccugcagaggg

SEQ ID NO: 2834486 - RNA, 17 nt, Human
gccagggcccugcagag

SEQ ID NO: 2834487 - RNA, 16 nt, Human
gccagggcccugcaga

SEQ ID NO: 2834488 - RNA, 15 nt, Human
gccagggcccugcag

SEQ ID NO: 2834489 - RNA, 13 nt, Human
gccagggcccugc

SEQ ID NO: 2834490 - RNA, 15 nt, Human
gccagggccuggaag

SEQ ID NO: 2834491 - RNA, 16 nt, Human
gccagggccuggaaga

SEQ ID NO: 2834492 - RNA, 11 nt, Human
gccagggcugc

SEQ ID NO: 2834493 - RNA, 22 nt, Human
gccagggccuggaagacagaga

SEQ ID NO: 2834494 - RNA, 10 nt, Human
gccagggcug

SEQ ID NO: 2834495 - RNA, 20 nt, Human
gccaggguggucuugaucuc

SEQ ID NO: 2834496 - RNA, 14 nt, Human
gccagggcugcccu

SEQ ID NO: 2834497 - RNA, 17 nt, Human
gccagggcugcccugag

SEQ ID NO: 2834498 - RNA, 18 nt, Human
gccagggcugcccugaga

SEQ ID NO: 2834499 - RNA, 19 nt, Human
gccagggcugcccugagaa

SEQ ID NO: 2834500 - RNA, 15 nt, Human
gccaggucccccugc

SEQ ID NO: 2834501 - RNA, 16 nt, Human
gccaggucccccugca

SEQ ID NO: 2834502 - RNA, 17 nt, Human
gccaggucccccugcag

SEQ ID NO: 2834503 - RNA, 18 nt, Human
gccaggucccccugcagc

SEQ ID NO: 2834504 - RNA, 19 nt, Human
gccaggucccccugcagcu

SEQ ID NO: 2834505 - RNA, 16 nt, Human
gccagguauggcucug

SEQ ID NO: 2834506 - RNA, 15 nt, Human
gccaggucacacgac

SEQ ID NO: 2834507 - RNA, 15 nt, Human
gccacguuccacagu

SEQ ID NO: 2834508 - RNA, 16 nt, Human
gccacggccaggccag

SEQ ID NO: 2834509 - RNA, 22 nt, Human
gccacucagaguucuauacugu

SEQ ID NO: 2834510 - RNA, 13 nt, Human
gccacucagcuuc

SEQ ID NO: 2834511 - RNA, 15 nt, Human
gccacggccaggcca

SEQ ID NO: 2834512 - RNA, 14 nt, Human
gccacggccaggcc

SEQ ID NO: 2834513 - RNA, 17 nt, Human
gccaaauccgcucucuu

SEQ ID NO: 2834514 - RNA, 18 nt, Human
gccaaauccgcucucuuc

SEQ ID NO: 2834515 - RNA, 19 nt, Human
gccaaauccgcucucuucc

SEQ ID NO: 2834516 - RNA, 20 nt, Human
gccaaauccgcucucuuccu

SEQ ID NO: 2834517 - RNA, 22 nt, Human
gccaaauccgcucucuuccugc

SEQ ID NO: 2834518 - RNA, 23 nt, Human
gccaaauccgcucucuuccugcc

SEQ ID NO: 2834519 - RNA, 22 nt, Human
gccaaaugcucucucaaauugu

SEQ ID NO: 2834520 - RNA, 20 nt, Human
gccaaaggcugguggcaagu

SEQ ID NO: 2834521 - RNA, 19 nt, Human
gccaaagggaaauaucauu

SEQ ID NO: 2834522 - RNA, 18 nt, Human
gccagagggagugacaga

SEQ ID NO: 2834523 - RNA, 14 nt, Human
gccagaggaacugu

SEQ ID NO: 2834524 - RNA, 18 nt, Human
gccagaggaacuguccag

SEQ ID NO: 2834525 - RNA, 20 nt, Human
gccagaggaacuguccagag

SEQ ID NO: 2834526 - RNA, 21 nt, Human
gccagaggaacuguccagaga

SEQ ID NO: 2834527 - RNA, 17 nt, Human
gccagagggagugacag

SEQ ID NO: 2834528 - RNA, 14 nt, Human
gccagagccgggca

SEQ ID NO: 2834529 - RNA, 17 nt, Human
gccagagcugaagaguu

SEQ ID NO: 2834530 - RNA, 15 nt, Human
gccagagcugggagg

SEQ ID NO: 2834531 - RNA, 18 nt, Human
gccacugcaccgggccac

SEQ ID NO: 2834532 - RNA, 17 nt, Human
gccacugcaccgggcca

SEQ ID NO: 2834533 - RNA, 16 nt, Human
gccacugauauucaga

SEQ ID NO: 2834534 - RNA, 15 nt, Human
gccacucagcuuccu

SEQ ID NO: 2834535 - RNA, 16 nt, Human
gccacucauuccugua

SEQ ID NO: 2834536 - RNA, 21 nt, Human
gccacucaggaggcugaggca

SEQ ID NO: 2834537 - RNA, 20 nt, Human
gccacucaggaggcugaggc

SEQ ID NO: 2834538 - RNA, 19 nt, Human
gccacugaagcugggauuc

SEQ ID NO: 2834539 - RNA, 17 nt, Human
gccacugaagcugggau

SEQ ID NO: 2834540 - RNA, 19 nt, Human
gccacuccagaccccuggc

SEQ ID NO: 2834541 - RNA, 16 nt, Human
gccacuccagaccccu

SEQ ID NO: 2834542 - RNA, 18 nt, Human
gccacuccagaccccugg

SEQ ID NO: 2834543 - RNA, 13 nt, Human
gccagcugccucc

SEQ ID NO: 2834544 - RNA, 13 nt, Human
gccagcucccucu

SEQ ID NO: 2834545 - RNA, 16 nt, Human
gccagcucagucccau

SEQ ID NO: 2834546 - RNA, 13 nt, Human
gccagcuggagaa

SEQ ID NO: 2834547 - RNA, 22 nt, Human
gccagcuuggggccaccaaagc

SEQ ID NO: 2834548 - RNA, 18 nt, Human
gccagcuuggggccacca

SEQ ID NO: 2834549 - RNA, 21 nt, Human
gccagccuucuuccaucccag

SEQ ID NO: 2834550 - RNA, 19 nt, Human
gccagcgggaauggcagcu

SEQ ID NO: 2834551 - RNA, 23 nt, Human
gccagcuacuuccuccuccccac

SEQ ID NO: 2834552 - RNA, 17 nt, Human
gccagcucacagugcug

SEQ ID NO: 2834553 - RNA, 19 nt, Human
gccagcucacagugcugug

SEQ ID NO: 2834554 - RNA, 20 nt, Human
gccagccugucccauggaca

SEQ ID NO: 2834555 - RNA, 12 nt, Human
gccagccuucuu

SEQ ID NO: 2834556 - RNA, 19 nt, Human
gccagccuucuuccauccc

SEQ ID NO: 2834557 - RNA, 22 nt, Human
gccagcccggccgcuccaccag

SEQ ID NO: 2834558 - RNA, 21 nt, Human
gccagcccggccgcuccacca

SEQ ID NO: 2834559 - RNA, 22 nt, Human
gccagaggaacuguccagagag

SEQ ID NO: 2834560 - RNA, 23 nt, Human
gccagaggaacuguccagagagc

SEQ ID NO: 2834561 - RNA, 20 nt, Human
gccagagggagugacagagg

SEQ ID NO: 2834562 - RNA, 19 nt, Human
gccagagggagugacagag

SEQ ID NO: 2834563 - RNA, 12 nt, Human
gccagaugcugc

SEQ ID NO: 2834564 - RNA, 15 nt, Human
gccagaugcugcaga

SEQ ID NO: 2834565 - RNA, 15 nt, Human
gccagauggcccgga

SEQ ID NO: 2834566 - RNA, 17 nt, Human
gccagccccacccagga

SEQ ID NO: 2834567 - RNA, 17 nt, Human
gccagccccggcccugg

SEQ ID NO: 2834568 - RNA, 19 nt, Human
gccagccccacccaggagg

SEQ ID NO: 2834569 - RNA, 18 nt, Human
gccagccccacccaggag

SEQ ID NO: 2834570 - RNA, 21 nt, Human
gccagccccggcccugggcuc

SEQ ID NO: 2834571 - RNA, 13 nt, Human
gccagccccucca

SEQ ID NO: 2834572 - RNA, 18 nt, Human
gccagccccggcccuggg

SEQ ID NO: 2834573 - RNA, 19 nt, Human
gccagccccggcccugggc

SEQ ID NO: 2834574 - RNA, 20 nt, Human
gccuuggcuguuggcaguga

SEQ ID NO: 2834575 - RNA, 15 nt, Human
gccuugggcugcucc

SEQ ID NO: 2834576 - RNA, 14 nt, Human
gccuugggcugcuc

SEQ ID NO: 2834577 - RNA, 22 nt, Human
gccuugggcugcuccucauggu

SEQ ID NO: 2834578 - RNA, 18 nt, Human
gccuugggcugcuccuca

SEQ ID NO: 2834579 - RNA, 16 nt, Human
gccuugggcugcuccu

SEQ ID NO: 2834580 - RNA, 17 nt, Human
gccuuggggaggacaaa

SEQ ID NO: 2834581 - RNA, 20 nt, Human
gccuuggggaggacaaaacu

SEQ ID NO: 2834582 - RNA, 21 nt, Human
gccuuggggaggacaaaacuu

SEQ ID NO: 2834583 - RNA, 23 nt, Human
gccuuggggaggacaaaacuucu

SEQ ID NO: 2834584 - RNA, 21 nt, Human
gccuuuagugaucacagcagc

SEQ ID NO: 2834585 - RNA, 22 nt, Human
gccuuuagugaucacagcagcu

SEQ ID NO: 2834586 - RNA, 19 nt, Human
gccuuuagugaucacagca

SEQ ID NO: 2834587 - RNA, 21 nt, Human
gccuuuaauggacuuauuucu

SEQ ID NO: 2834588 - RNA, 20 nt, Human
gccuuuacauggacagaauu

SEQ ID NO: 2834589 - RNA, 16 nt, Human
gccuuuacugacccug

SEQ ID NO: 2834590 - RNA, 21 nt, Human
gccuuuacugacccuggggcu

SEQ ID NO: 2834591 - RNA, 23 nt, Human
gccuuuacugacccuggggcugg

SEQ ID NO: 2834592 - RNA, 23 nt, Human
gccuucccccucccagggccagg

SEQ ID NO: 2834593 - RNA, 12 nt, Human
gccuuccccuca

SEQ ID NO: 2834594 - RNA, 18 nt, Human
gccuuccccucagccaca

SEQ ID NO: 2834595 - RNA, 18 nt, Human
gccuucccccucccaggg

SEQ ID NO: 2834596 - RNA, 14 nt, Human
gccuucagcuccag

SEQ ID NO: 2834597 - RNA, 17 nt, Human
gccuucagaaccaucca

SEQ ID NO: 2834598 - RNA, 13 nt, Human
gccuucagcucca

SEQ ID NO: 2834599 - RNA, 13 nt, Human
gccuucagcucua

SEQ ID NO: 2834600 - RNA, 20 nt, Human
gccuucacuccggugugccu

SEQ ID NO: 2834601 - RNA, 18 nt, Human
gccuucacauuccccugg

SEQ ID NO: 2834602 - RNA, 22 nt, Human
gccuucacauuccccuggggac

SEQ ID NO: 2834603 - RNA, 22 nt, Human
gccuuuuuaaaacacauguuuu

SEQ ID NO: 2834604 - RNA, 16 nt, Human
gccuuuugcagaagag

SEQ ID NO: 2834605 - RNA, 21 nt, Human
gccuuuugggggugggucugg

SEQ ID NO: 2834606 - RNA, 12 nt, Human
gccuuuuguaua

SEQ ID NO: 2834607 - RNA, 13 nt, Human
gccuuuuguauac

SEQ ID NO: 2834608 - RNA, 14 nt, Human
gccuuuuguauaca

SEQ ID NO: 2834609 - RNA, 22 nt, Human
gccuuuuguauacauccugggu

SEQ ID NO: 2834610 - RNA, 13 nt, Human
gcgaccgcccccu

SEQ ID NO: 2834611 - RNA, 14 nt, Human
gcgaccgcccccuc

SEQ ID NO: 2834612 - RNA, 15 nt, Human
gcgaccgcccccucc

SEQ ID NO: 2834613 - RNA, 22 nt, Human
gcgaccgcccuccgcgaaaaua

SEQ ID NO: 2834614 - RNA, 15 nt, Human
gcgaccuuccucauc

SEQ ID NO: 2834615 - RNA, 22 nt, Human
gcgaccuuccucauccacccca

SEQ ID NO: 2834616 - RNA, 18 nt, Human
gccuuuuuaaaacacaug

SEQ ID NO: 2834617 - RNA, 16 nt, Human
gcgacauagcccaucc

SEQ ID NO: 2834618 - RNA, 17 nt, Human
gcgacauagcccauccc

SEQ ID NO: 2834619 - RNA, 18 nt, Human
gcgacauagcccaucccu

SEQ ID NO: 2834620 - RNA, 21 nt, Human
gcgacauagcccaucccugcc

SEQ ID NO: 2834621 - RNA, 13 nt, Human
gccuuuuaacauu

SEQ ID NO: 2834622 - RNA, 14 nt, Human
gccuuuuaacauuu

SEQ ID NO: 2834623 - RNA, 15 nt, Human
gccuuuuaacauuuu

SEQ ID NO: 2834624 - RNA, 16 nt, Human
gccuuuuaacauuuug

SEQ ID NO: 2834625 - RNA, 20 nt, Human
gccuuuuaacauuuuguucu

SEQ ID NO: 2834626 - RNA, 21 nt, Human
gccuuuuaacauuuuguucuu

SEQ ID NO: 2834627 - RNA, 16 nt, Human
gccuuuuaagaagaaa

SEQ ID NO: 2834628 - RNA, 14 nt, Human
gccuuuuauagcua

SEQ ID NO: 2834629 - RNA, 17 nt, Human
gccuuuucuuuaacuuu

SEQ ID NO: 2834630 - RNA, 12 nt, Human
gccuuuugaaag

SEQ ID NO: 2834631 - RNA, 13 nt, Human
gccuuuucccucu

SEQ ID NO: 2834632 - RNA, 20 nt, Human
gccuuuucccucuuuggcuc

SEQ ID NO: 2834633 - RNA, 13 nt, Human
gccuuugggaaau

SEQ ID NO: 2834634 - RNA, 15 nt, Human
gccuuugggagcagg

SEQ ID NO: 2834635 - RNA, 15 nt, Human
gccuuucaaauuuag

SEQ ID NO: 2834636 - RNA, 14 nt, Human
gccuuuaugguuuc

SEQ ID NO: 2834637 - RNA, 12 nt, Human
gccuggagcccu

SEQ ID NO: 2834638 - RNA, 13 nt, Human
gccuggagcccuc

SEQ ID NO: 2834639 - RNA, 14 nt, Human
gccuggagcccucc

SEQ ID NO: 2834640 - RNA, 20 nt, Human
gccuggagcccuccgccuuc

SEQ ID NO: 2834641 - RNA, 22 nt, Human
gccuggagcccuccgccuucac

SEQ ID NO: 2834642 - RNA, 13 nt, Human
gccugguugaaga

SEQ ID NO: 2834643 - RNA, 15 nt, Human
gccugguugaagaag

SEQ ID NO: 2834644 - RNA, 19 nt, Human
gccugguugaagaagauga

SEQ ID NO: 2834645 - RNA, 17 nt, Human
gccugguggcagcugcg

SEQ ID NO: 2834646 - RNA, 16 nt, Human
gccugguggcagcugc

SEQ ID NO: 2834647 - RNA, 19 nt, Human
gccugucauccuuggucuu

SEQ ID NO: 2834648 - RNA, 14 nt, Human
gccuguccagccug

SEQ ID NO: 2834649 - RNA, 13 nt, Human
gccuguccagccu

SEQ ID NO: 2834650 - RNA, 12 nt, Human
gccuguccagcc

SEQ ID NO: 2834651 - RNA, 15 nt, Human
gccugguggcagcug

SEQ ID NO: 2834652 - RNA, 14 nt, Human
gccugguggcagcu

SEQ ID NO: 2834653 - RNA, 11 nt, Human
gccuggagccc

SEQ ID NO: 2834654 - RNA, 23 nt, Human
gccuggaccugccuccugccugc

SEQ ID NO: 2834655 - RNA, 15 nt, Human
gccuggagacccacc

SEQ ID NO: 2834656 - RNA, 24 nt, Human
gccuggagacccaccccaccugca

SEQ ID NO: 2834657 - RNA, 11 nt, Human
gccuggaccug

SEQ ID NO: 2834658 - RNA, 14 nt, Human
gccuggaccugccu

SEQ ID NO: 2834659 - RNA, 15 nt, Human
gccuggaccugccuc

SEQ ID NO: 2834660 - RNA, 16 nt, Human
gccuggaccugccucc

SEQ ID NO: 2834661 - RNA, 17 nt, Human
gccuggaccugccuccu

SEQ ID NO: 2834662 - RNA, 18 nt, Human
gccuggaccugccuccug

SEQ ID NO: 2834663 - RNA, 19 nt, Human
gccuggaccugccuccugc

SEQ ID NO: 2834664 - RNA, 20 nt, Human
gccuuagaagucacacagua

SEQ ID NO: 2834665 - RNA, 16 nt, Human
gccuuagaaccuuucu

SEQ ID NO: 2834666 - RNA, 20 nt, Human
gccuuagaaauguaaacugc

SEQ ID NO: 2834667 - RNA, 22 nt, Human
gccuuagaaauguaaacugcca

SEQ ID NO: 2834668 - RNA, 23 nt, Human
gccuuagaaauguaaacugccau

SEQ ID NO: 2834669 - RNA, 17 nt, Human
gccuguccagccugggc

SEQ ID NO: 2834670 - RNA, 15 nt, Human
gccuguccagccugg

SEQ ID NO: 2834671 - RNA, 20 nt, Human
gccugucccacccccacccc

SEQ ID NO: 2834672 - RNA, 21 nt, Human
gccugucccauggacacucca

SEQ ID NO: 2834673 - RNA, 22 nt, Human
gccugucccauggacacuccag

SEQ ID NO: 2834674 - RNA, 21 nt, Human
gccuuagccgcccaugcacug

SEQ ID NO: 2834675 - RNA, 13 nt, Human
gccuuagaggagc

SEQ ID NO: 2834676 - RNA, 15 nt, Human
gccuuagaggagccc

SEQ ID NO: 2834677 - RNA, 22 nt, Human
gccuuagggaagcuggccugag

SEQ ID NO: 2834678 - RNA, 15 nt, Human
gccuuagucucaguu

SEQ ID NO: 2834679 - RNA, 15 nt, Human
gccuuagggaagcug

SEQ ID NO: 2834680 - RNA, 15 nt, Human
gccuuaggccuaccu

SEQ ID NO: 2834681 - RNA, 22 nt, Human
gccuuagucucaguuugugugu

SEQ ID NO: 2834682 - RNA, 12 nt, Human
gccuuagugggc

SEQ ID NO: 2834683 - RNA, 18 nt, Human
gccuuagucucaguuugu

SEQ ID NO: 2834684 - RNA, 12 nt, Human
gccuuauuaaag

SEQ ID NO: 2834685 - RNA, 23 nt, Human
gcuagagcagcccaaauuuuucu

SEQ ID NO: 2834686 - RNA, 15 nt, Human
gcuagacacccauuu

SEQ ID NO: 2834687 - RNA, 22 nt, Human
gcuacccuuuuucuccagcugg

SEQ ID NO: 2834688 - RNA, 14 nt, Human
gcuaccguugacuu

SEQ ID NO: 2834689 - RNA, 18 nt, Human
gcuacccuuuuucuccag

SEQ ID NO: 2834690 - RNA, 19 nt, Human
gcuacccuuuuucuccagc

SEQ ID NO: 2834691 - RNA, 20 nt, Human
gcuacccuuuuucuccagcu

SEQ ID NO: 2834692 - RNA, 21 nt, Human
gcuacccuuuuucuccagcug

SEQ ID NO: 2834693 - RNA, 17 nt, Human
gcuacccacuucuaaau

SEQ ID NO: 2834694 - RNA, 15 nt, Human
gcuacccaaaagaga

SEQ ID NO: 2834695 - RNA, 16 nt, Human
gcuacccaaaagagaa

SEQ ID NO: 2834696 - RNA, 19 nt, Human
gcuacccaaaagagaaaaa

SEQ ID NO: 2834697 - RNA, 23 nt, Human
gcuacccaaaagagaaaaaaaau

SEQ ID NO: 2834698 - RNA, 16 nt, Human
gcuacccuuuuucucc

SEQ ID NO: 2834699 - RNA, 14 nt, Human
gcuacccuuuuccu

SEQ ID NO: 2834700 - RNA, 19 nt, Human
gcuacccuuuuccuuugug

SEQ ID NO: 2834701 - RNA, 20 nt, Human
gcuacccuuuuccuuugugg

SEQ ID NO: 2834702 - RNA, 20 nt, Human
gcuaccaaagcaccuuagcu

SEQ ID NO: 2834703 - RNA, 11 nt, Human
gcuacauuaua

SEQ ID NO: 2834704 - RNA, 13 nt, Human
gcuacauuauaaa

SEQ ID NO: 2834705 - RNA, 15 nt, Human
gcuacauuauaaacg

SEQ ID NO: 2834706 - RNA, 17 nt, Human
gcuacauuauaaacgcu

SEQ ID NO: 2834707 - RNA, 16 nt, Human
gcgucgcccucccagg

SEQ ID NO: 2834708 - RNA, 15 nt, Human
gcgugagaccugccc

SEQ ID NO: 2834709 - RNA, 14 nt, Human
gcgugagccacugc

SEQ ID NO: 2834710 - RNA, 15 nt, Human
gcgugagccacugca

SEQ ID NO: 2834711 - RNA, 16 nt, Human
gcgugagaccugcccc

SEQ ID NO: 2834712 - RNA, 13 nt, Human
gcuaacauuuuaa

SEQ ID NO: 2834713 - RNA, 22 nt, Human
gcuaacccccuucuacugagcc

SEQ ID NO: 2834714 - RNA, 19 nt, Human
gcuaaccuuauccugcauu

SEQ ID NO: 2834715 - RNA, 20 nt, Human
gcuaaccuuauccugcauug

SEQ ID NO: 2834716 - RNA, 21 nt, Human
gcuaaccuuauccugcauugu

SEQ ID NO: 2834717 - RNA, 22 nt, Human
gcuaaccuuauccugcauuguu

SEQ ID NO: 2834718 - RNA, 14 nt, Human
gcuaacauuuuaaa

SEQ ID NO: 2834719 - RNA, 17 nt, Human
gcuaacauuuuaaauaa

SEQ ID NO: 2834720 - RNA, 23 nt, Human
gcuaacauuuuaaauaaaagaaa

SEQ ID NO: 2834721 - RNA, 22 nt, Human
gcuaacccagguccccucauuc

SEQ ID NO: 2834722 - RNA, 11 nt, Human
gcuaacugaac

SEQ ID NO: 2834723 - RNA, 15 nt, Human
gcuaacugaacuuug

SEQ ID NO: 2834724 - RNA, 17 nt, Human
gcuaacugaacuuugaa

SEQ ID NO: 2834725 - RNA, 18 nt, Human
gcuaacugaacuuugaag

SEQ ID NO: 2834726 - RNA, 21 nt, Human
gcuaacauuuuaaauaaaaga

SEQ ID NO: 2834727 - RNA, 21 nt, Human
gcuaacccccuucuacugagc

SEQ ID NO: 2834728 - RNA, 18 nt, Human
gcguccguggguugcuaa

SEQ ID NO: 2834729 - RNA, 20 nt, Human
gcggucucaggcugguggga

SEQ ID NO: 2834730 - RNA, 14 nt, Human
gcgcuucccagcac

SEQ ID NO: 2834731 - RNA, 22 nt, Human
gcggucucaggcuggugggagg

SEQ ID NO: 2834732 - RNA, 19 nt, Human
gcggucuucaacauccugc

SEQ ID NO: 2834733 - RNA, 23 nt, Human
gcggucuucaacauccugccagc

SEQ ID NO: 2834734 - RNA, 23 nt, Human
gcgguccacccaggagccccgag

SEQ ID NO: 2834735 - RNA, 19 nt, Human
gcggggacucgguaagcac

SEQ ID NO: 2834736 - RNA, 20 nt, Human
gcgguccacccaggagcccc

SEQ ID NO: 2834737 - RNA, 23 nt, Human
gcggggacagcuccuucuguccu

SEQ ID NO: 2834738 - RNA, 23 nt, Human
gcggacagccacggccaggccag

SEQ ID NO: 2834739 - RNA, 20 nt, Human
gcggaacaaggagucagaca

SEQ ID NO: 2834740 - RNA, 14 nt, Human
gcgcuuugggaggc

SEQ ID NO: 2834741 - RNA, 19 nt, Human
gcggggacagcuccuucug

SEQ ID NO: 2834742 - RNA, 18 nt, Human
gcggggacagcuccuucu

SEQ ID NO: 2834743 - RNA, 19 nt, Human
gcggacagccacggccagg

SEQ ID NO: 2834744 - RNA, 16 nt, Human
gcggacagccacggcc

SEQ ID NO: 2834745 - RNA, 19 nt, Human
gcggaaugaaccacaucuu

SEQ ID NO: 2834746 - RNA, 18 nt, Human
gcgcuguuuuuguugugu

SEQ ID NO: 2834747 - RNA, 21 nt, Human
gcgcuguuuuuguugugugug

SEQ ID NO: 2834748 - RNA, 22 nt, Human
gcgcuguuuuuguugugugugc

SEQ ID NO: 2834749 - RNA, 18 nt, Human
gcgccuacaggagugagc

SEQ ID NO: 2834750 - RNA, 17 nt, Human
gcgcccaguccuuccac

SEQ ID NO: 2834751 - RNA, 17 nt, Human
gcgcccaccuccccacg

SEQ ID NO: 2834752 - RNA, 12 nt, Human
gcgcccaccucc

SEQ ID NO: 2834753 - RNA, 13 nt, Human
gcgcccaccuccc

SEQ ID NO: 2834754 - RNA, 19 nt, Human
gcgccaguguaauccccca

SEQ ID NO: 2834755 - RNA, 23 nt, Human
gcgccaguguaaucccccaggag

SEQ ID NO: 2834756 - RNA, 23 nt, Human
gcgccacucgcuucccccauagc

SEQ ID NO: 2834757 - RNA, 13 nt, Human
gcgacuaauuuca

SEQ ID NO: 2834758 - RNA, 23 nt, Human
gcgacuaauuucaaaaugcuuuu

SEQ ID NO: 2834759 - RNA, 21 nt, Human
gcgacuaauuucaaaaugcuu

SEQ ID NO: 2834760 - RNA, 23 nt, Human
gcgaccuuccucauccaccccau

SEQ ID NO: 2834761 - RNA, 21 nt, Human
gcgccuacaggagugagcacu

SEQ ID NO: 2834762 - RNA, 20 nt, Human
gcgccuacaggagugagcac

SEQ ID NO: 2834763 - RNA, 20 nt, Human
gcgccucaggcugcuggggc

SEQ ID NO: 2834764 - RNA, 20 nt, Human
gcgcucugccucaccgcuuc

SEQ ID NO: 2834765 - RNA, 23 nt, Human
gcgcucuguggaugccagggccg

SEQ ID NO: 2834766 - RNA, 15 nt, Human
gcgcugggcacuucc

SEQ ID NO: 2834767 - RNA, 16 nt, Human
gcgcugggcacuuccc

SEQ ID NO: 2834768 - RNA, 18 nt, Human
gcgcugggcacuucccug

SEQ ID NO: 2834769 - RNA, 19 nt, Human
gcgcugggcacuucccugc

SEQ ID NO: 2834770 - RNA, 20 nt, Human
gcgcugggcacuucccugcu

SEQ ID NO: 2834771 - RNA, 22 nt, Human
gcgcugggcacuucccugcugc

SEQ ID NO: 2834772 - RNA, 17 nt, Human
gcgcuggguauuggaaa

SEQ ID NO: 2834773 - RNA, 19 nt, Human
gccucccgaauagcuggga

SEQ ID NO: 2834774 - RNA, 18 nt, Human
gccucccgaauagcuggg

SEQ ID NO: 2834775 - RNA, 23 nt, Human
gccucccgaguagcugggacuac

SEQ ID NO: 2834776 - RNA, 21 nt, Human
gccucccgaguagcugggacu

SEQ ID NO: 2834777 - RNA, 20 nt, Human
gccucccgaauagcugggac

SEQ ID NO: 2834778 - RNA, 14 nt, Human
gccucagccuccca

SEQ ID NO: 2834779 - RNA, 12 nt, Human
gccucagccucc

SEQ ID NO: 2834780 - RNA, 22 nt, Human
gccucagccucccaaagugcug

SEQ ID NO: 2834781 - RNA, 12 nt, Human
gccuccccaccu

SEQ ID NO: 2834782 - RNA, 13 nt, Human
gccucucccaccc

SEQ ID NO: 2834783 - RNA, 16 nt, Human
gccucuccaggcacca

SEQ ID NO: 2834784 - RNA, 23 nt, Human
gccucuccaggcaccaucucccu

SEQ ID NO: 2834785 - RNA, 22 nt, Human
gccucccugaaaauguuuuucu

SEQ ID NO: 2834786 - RNA, 11 nt, Human
gccucccugaa

SEQ ID NO: 2834787 - RNA, 14 nt, Human
gccucccucaaccc

SEQ ID NO: 2834788 - RNA, 13 nt, Human
gccucccucaacc

SEQ ID NO: 2834789 - RNA, 16 nt, Human
gccucccuagccagca

SEQ ID NO: 2834790 - RNA, 21 nt, Human
gccucccucugaccugcaggc

SEQ ID NO: 2834791 - RNA, 20 nt, Human
gccucccucugaccugcagg

SEQ ID NO: 2834792 - RNA, 14 nt, Human
gccucccucugacc

SEQ ID NO: 2834793 - RNA, 12 nt, Human
gccucccucuga

SEQ ID NO: 2834794 - RNA, 23 nt, Human
gccucccucucucuucugcucca

SEQ ID NO: 2834795 - RNA, 22 nt, Human
gccucccucucucuucugcucc

SEQ ID NO: 2834796 - RNA, 21 nt, Human
gccucccucucucuucugcuc

SEQ ID NO: 2834797 - RNA, 16 nt, Human
gccucccucucucuuc

SEQ ID NO: 2834798 - RNA, 13 nt, Human
gccucucucccuc

SEQ ID NO: 2834799 - RNA, 14 nt, Human
gccucucucccucu

SEQ ID NO: 2834800 - RNA, 21 nt, Human
gccucucccuaggagaagagu

SEQ ID NO: 2834801 - RNA, 12 nt, Human
gccucugcauuc

SEQ ID NO: 2834802 - RNA, 14 nt, Human
gccugaaaggagcc

SEQ ID NO: 2834803 - RNA, 18 nt, Human
gccugaaauuucaccauu

SEQ ID NO: 2834804 - RNA, 23 nt, Human
gccugaaaggagcccuuaucugu

SEQ ID NO: 2834805 - RNA, 17 nt, Human
gccugaaaggagcccuu

SEQ ID NO: 2834806 - RNA, 20 nt, Human
gccugaagaguccucugaau

SEQ ID NO: 2834807 - RNA, 21 nt, Human
gccugaaggaggugagagaag

SEQ ID NO: 2834808 - RNA, 18 nt, Human
gccugaagaguccucuga

SEQ ID NO: 2834809 - RNA, 16 nt, Human
gccugagaggggaagc

SEQ ID NO: 2834810 - RNA, 16 nt, Human
gccucugacacacagc

SEQ ID NO: 2834811 - RNA, 15 nt, Human
gccucugacacacag

SEQ ID NO: 2834812 - RNA, 17 nt, Human
gccugcuggucacagcc

SEQ ID NO: 2834813 - RNA, 18 nt, Human
gccugcuggucacagccu

SEQ ID NO: 2834814 - RNA, 19 nt, Human
gccugcuggucacagccuc

SEQ ID NO: 2834815 - RNA, 21 nt, Human
gccugcuggucacagccuccu

SEQ ID NO: 2834816 - RNA, 12 nt, Human
gccugcccaggc

SEQ ID NO: 2834817 - RNA, 11 nt, Human
gccugcccagg

SEQ ID NO: 2834818 - RNA, 13 nt, Human
gccugcccaccug

SEQ ID NO: 2834819 - RNA, 14 nt, Human
gccugcccaccugc

SEQ ID NO: 2834820 - RNA, 15 nt, Human
gccugcccaccugcc

SEQ ID NO: 2834821 - RNA, 16 nt, Human
gccugcccaccugccu

SEQ ID NO: 2834822 - RNA, 17 nt, Human
gccugcccaccugccug

SEQ ID NO: 2834823 - RNA, 18 nt, Human
gccugcccaccugccugg

SEQ ID NO: 2834824 - RNA, 19 nt, Human
gccugcccaccugccuggc

SEQ ID NO: 2834825 - RNA, 20 nt, Human
gccugcccaccugccuggcc

SEQ ID NO: 2834826 - RNA, 21 nt, Human
gccugcccaccugccuggccg

SEQ ID NO: 2834827 - RNA, 22 nt, Human
gccugagcccuacucccugcag

SEQ ID NO: 2834828 - RNA, 10 nt, Human
gccugcagcc

SEQ ID NO: 2834829 - RNA, 22 nt, Human
gccugagcaacagagugagacc

SEQ ID NO: 2834830 - RNA, 18 nt, Human
gccugagcaacucuugau

SEQ ID NO: 2834831 - RNA, 11 nt, Human
gccugcagccc

SEQ ID NO: 2834832 - RNA, 17 nt, Human
gccugcaggaccugccu

SEQ ID NO: 2834833 - RNA, 16 nt, Human
gccugcaggaccugcc

SEQ ID NO: 2834834 - RNA, 14 nt, Human
gccugcaggaccug

SEQ ID NO: 2834835 - RNA, 21 nt, Human
gccugcaggaccugccuguag

SEQ ID NO: 2834836 - RNA, 20 nt, Human
gccugcaggaccugccugua

SEQ ID NO: 2834837 - RNA, 19 nt, Human
gccugcaggaccugccugu

SEQ ID NO: 2834838 - RNA, 18 nt, Human
gccugcaggaccugccug

SEQ ID NO: 2834839 - RNA, 10 nt, Human
gccugccaug

SEQ ID NO: 2834840 - RNA, 14 nt, Human
gccugccauguacc

SEQ ID NO: 2834841 - RNA, 15 nt, Human
gccugccauguaccu

SEQ ID NO: 2834842 - RNA, 20 nt, Human
gccugccauguaccuccccu

SEQ ID NO: 2834843 - RNA, 17 nt, Human
gccugcccaagcccagg

SEQ ID NO: 2834844 - RNA, 20 nt, Human
gccugcccaagcccaggcca

SEQ ID NO: 2834845 - RNA, 21 nt, Human
gccugcccaagcccaggccac

SEQ ID NO: 2834846 - RNA, 19 nt, Human
gccccaucggucaccuugu

SEQ ID NO: 2834847 - RNA, 22 nt, Human
gcccuuccucuccacugccuuc

SEQ ID NO: 2834848 - RNA, 12 nt, Human
gcccucuuccug

SEQ ID NO: 2834849 - RNA, 13 nt, Human
gcccucuuccuga

SEQ ID NO: 2834850 - RNA, 13 nt, Human
gccgaccuuagau

SEQ ID NO: 2834851 - RNA, 22 nt, Human
gcccuugcaguucagcaccacc

SEQ ID NO: 2834852 - RNA, 21 nt, Human
gcccuugcaguucagcaccac

SEQ ID NO: 2834853 - RNA, 20 nt, Human
gcccuugcaguucagcacca

SEQ ID NO: 2834854 - RNA, 19 nt, Human
gcccuugcaguucagcacc

SEQ ID NO: 2834855 - RNA, 14 nt, Human
gcccuugagggaga

SEQ ID NO: 2834856 - RNA, 16 nt, Human
gcccuucuuccccuuc

SEQ ID NO: 2834857 - RNA, 22 nt, Human
gccgacugcacagcggccccug

SEQ ID NO: 2834858 - RNA, 16 nt, Human
gccgcaaaccacacug

SEQ ID NO: 2834859 - RNA, 17 nt, Human
gccgcaaaccacacugg

SEQ ID NO: 2834860 - RNA, 19 nt, Human
gccgcaaaccacacuggac

SEQ ID NO: 2834861 - RNA, 21 nt, Human
gccgcaaaccacacuggacuc

SEQ ID NO: 2834862 - RNA, 16 nt, Human
gccgaggguccuggcu

SEQ ID NO: 2834863 - RNA, 20 nt, Human
gccgaggguccuggcuccug

SEQ ID NO: 2834864 - RNA, 18 nt, Human
gccgaggguccuggcucc

SEQ ID NO: 2834865 - RNA, 22 nt, Human
gccgauauacucuagaugaagu

SEQ ID NO: 2834866 - RNA, 17 nt, Human
gccgauauacucuagau

SEQ ID NO: 2834867 - RNA, 17 nt, Human
gccgauucaccugagca

SEQ ID NO: 2834868 - RNA, 13 nt, Human
gccgauggagaca

SEQ ID NO: 2834869 - RNA, 21 nt, Human
gccgauggagacaccaaccga

SEQ ID NO: 2834870 - RNA, 22 nt, Human
gccgggcacauugagcugugca

SEQ ID NO: 2834871 - RNA, 19 nt, Human
gccgggccgaauccccucc

SEQ ID NO: 2834872 - RNA, 16 nt, Human
gccggggacagaggcc

SEQ ID NO: 2834873 - RNA, 23 nt, Human
gccggggacagaggccugcccgg

SEQ ID NO: 2834874 - RNA, 19 nt, Human
gccggggacagaggccugc

SEQ ID NO: 2834875 - RNA, 21 nt, Human
gccggggacagaggccugccc

SEQ ID NO: 2834876 - RNA, 22 nt, Human
gccgggguggagcaugggccug

SEQ ID NO: 2834877 - RNA, 17 nt, Human
gccuaaaaaugcaacuu

SEQ ID NO: 2834878 - RNA, 18 nt, Human
gccuaaaacuggccugac

SEQ ID NO: 2834879 - RNA, 23 nt, Human
gccuaaaagugggcuugauucug

SEQ ID NO: 2834880 - RNA, 12 nt, Human
gccuaaaaucuu

SEQ ID NO: 2834881 - RNA, 13 nt, Human
gccuaaaaucuug

SEQ ID NO: 2834882 - RNA, 20 nt, Human
gccuaaaaucuuggaaguac

SEQ ID NO: 2834883 - RNA, 13 nt, Human
gccguuguuuacu

SEQ ID NO: 2834884 - RNA, 14 nt, Human
gccuaaaaaugcaa

SEQ ID NO: 2834885 - RNA, 20 nt, Human
gccguugauguuggcuggga

SEQ ID NO: 2834886 - RNA, 17 nt, Human
gccguugauguuggcug

SEQ ID NO: 2834887 - RNA, 19 nt, Human
gccguugauguuggcuggg

SEQ ID NO: 2834888 - RNA, 11 nt, Human
gccguggcuuc

SEQ ID NO: 2834889 - RNA, 12 nt, Human
gccguggcuucc

SEQ ID NO: 2834890 - RNA, 18 nt, Human
gccguugaagaggaaggg

SEQ ID NO: 2834891 - RNA, 13 nt, Human
gccguggcuuccc

SEQ ID NO: 2834892 - RNA, 11 nt, Human
gccgucucaac

SEQ ID NO: 2834893 - RNA, 12 nt, Human
gccgucucugga

SEQ ID NO: 2834894 - RNA, 16 nt, Human
gccgugcauuagcaca

SEQ ID NO: 2834895 - RNA, 19 nt, Human
gccgugcauuagcacagau

SEQ ID NO: 2834896 - RNA, 15 nt, Human
gccgugaacugugca

SEQ ID NO: 2834897 - RNA, 16 nt, Human
gccgugaacugugcau

SEQ ID NO: 2834898 - RNA, 20 nt, Human
gccuaaaggauagaucaaag

SEQ ID NO: 2834899 - RNA, 15 nt, Human
gccuaagacauguaa

SEQ ID NO: 2834900 - RNA, 22 nt, Human
gccuaaaagugggcuugauucu

SEQ ID NO: 2834901 - RNA, 18 nt, Human
gccuaacuacuaguuuuu

SEQ ID NO: 2834902 - RNA, 17 nt, Human
gccuauuuaccugcagg

SEQ ID NO: 2834903 - RNA, 20 nt, Human
gccuauuuaccugcaggcug

SEQ ID NO: 2834904 - RNA, 15 nt, Human
gccucaaaggcccgc

SEQ ID NO: 2834905 - RNA, 12 nt, Human
gccucaaaaugu

SEQ ID NO: 2834906 - RNA, 13 nt, Human
gccucaaaaugug

SEQ ID NO: 2834907 - RNA, 14 nt, Human
gccucaaaaugugu

SEQ ID NO: 2834908 - RNA, 17 nt, Human
gccucaaaggcccgcuc

SEQ ID NO: 2834909 - RNA, 18 nt, Human
gccuaagcauugccuggc

SEQ ID NO: 2834910 - RNA, 21 nt, Human
gccuaagcauugccuggccuu

SEQ ID NO: 2834911 - RNA, 21 nt, Human
gccucagcauccuggcacccg

SEQ ID NO: 2834912 - RNA, 17 nt, Human
gccucagcauccuggca

SEQ ID NO: 2834913 - RNA, 18 nt, Human
gccucagcauccuggcac

SEQ ID NO: 2834914 - RNA, 24 nt, Human
gccucaagugauucuccugccuca

SEQ ID NO: 2834915 - RNA, 22 nt, Human
gccucaagugauucuccugccu

SEQ ID NO: 2834916 - RNA, 23 nt, Human
gccucacacgguuugaagccugg

SEQ ID NO: 2834917 - RNA, 21 nt, Human
ggcagcuugaggguugggcug

SEQ ID NO: 2834918 - RNA, 19 nt, Human
ggcagcugcgguccaccca

SEQ ID NO: 2834919 - RNA, 13 nt, Human
ggcagguccaggg

SEQ ID NO: 2834920 - RNA, 23 nt, Human
ggcaggaaggagagccugcugca

SEQ ID NO: 2834921 - RNA, 18 nt, Human
ggcagaggaugucucaaa

SEQ ID NO: 2834922 - RNA, 20 nt, Human
ggcagguagccagggggacu

SEQ ID NO: 2834923 - RNA, 14 nt, Human
ggcaggaaggcuga

SEQ ID NO: 2834924 - RNA, 16 nt, Human
ggcaggaaggagagcc

SEQ ID NO: 2834925 - RNA, 15 nt, Human
ggcaggaaggagagc

SEQ ID NO: 2834926 - RNA, 14 nt, Human
ggcagcuuucuaga

SEQ ID NO: 2834927 - RNA, 23 nt, Human
ggcaggucuugaacuccuggccu

SEQ ID NO: 2834928 - RNA, 15 nt, Human
ggcagguccuggcca

SEQ ID NO: 2834929 - RNA, 21 nt, Human
ggcagaguuuguguguugucu

SEQ ID NO: 2834930 - RNA, 23 nt, Human
ggcagauacaggaaaagcugcug

SEQ ID NO: 2834931 - RNA, 20 nt, Human
ggcagauaaucagccucuua

SEQ ID NO: 2834932 - RNA, 19 nt, Human
ggcagauaaucagccucuu

SEQ ID NO: 2834933 - RNA, 18 nt, Human
ggcagauaaucagccucu

SEQ ID NO: 2834934 - RNA, 15 nt, Human
ggcagauaaucagcc

SEQ ID NO: 2834935 - RNA, 13 nt, Human
ggcagagcuucuu

SEQ ID NO: 2834936 - RNA, 17 nt, Human
ggcagagcuuggacugg

SEQ ID NO: 2834937 - RNA, 21 nt, Human
ggcagagcuuggacuggaugc

SEQ ID NO: 2834938 - RNA, 20 nt, Human
ggcagaucugugccccaugc

SEQ ID NO: 2834939 - RNA, 16 nt, Human
ggcagaugacaagaug

SEQ ID NO: 2834940 - RNA, 18 nt, Human
ggcagaucugugccccau

SEQ ID NO: 2834941 - RNA, 17 nt, Human
ggcagaucugugcccca

SEQ ID NO: 2834942 - RNA, 16 nt, Human
ggcagaucugugcccc

SEQ ID NO: 2834943 - RNA, 15 nt, Human
ggcagaucugugccc

SEQ ID NO: 2834944 - RNA, 14 nt, Human
ggcagaucaccuga

SEQ ID NO: 2834945 - RNA, 18 nt, Human
ggcagaucaccugagguc

SEQ ID NO: 2834946 - RNA, 15 nt, Human
ggcagcaauuuaaau

SEQ ID NO: 2834947 - RNA, 16 nt, Human
ggcagcaauuuaaaug

SEQ ID NO: 2834948 - RNA, 21 nt, Human
ggcagcaccugucuccuuuca

SEQ ID NO: 2834949 - RNA, 13 nt, Human
ggcagcagaaaac

SEQ ID NO: 2834950 - RNA, 14 nt, Human
ggcagcagaaaacu

SEQ ID NO: 2834951 - RNA, 22 nt, Human
ggauccccucugucuacaaaua

SEQ ID NO: 2834952 - RNA, 17 nt, Human
ggcaaccugauuguaaa

SEQ ID NO: 2834953 - RNA, 18 nt, Human
ggcaaccugauuguaaac

SEQ ID NO: 2834954 - RNA, 19 nt, Human
ggcaaccuugucucuaugc

SEQ ID NO: 2834955 - RNA, 15 nt, Human
ggcaaccuugucucu

SEQ ID NO: 2834956 - RNA, 18 nt, Human
ggcaacuaagcagucccu

SEQ ID NO: 2834957 - RNA, 19 nt, Human
ggcaacuaagcagucccug

SEQ ID NO: 2834958 - RNA, 12 nt, Human
ggcaacuggcca

SEQ ID NO: 2834959 - RNA, 18 nt, Human
ggcaacuugggaacuaga

SEQ ID NO: 2834960 - RNA, 23 nt, Human
ggcaacuugggaacuagacuccc

SEQ ID NO: 2834961 - RNA, 19 nt, Human
ggcaacccccagccugcua

SEQ ID NO: 2834962 - RNA, 21 nt, Human
ggaucaucuaauucucugugg

SEQ ID NO: 2834963 - RNA, 12 nt, Human
ggaucaugaaag

SEQ ID NO: 2834964 - RNA, 19 nt, Human
ggaucaugaaaguagacag

SEQ ID NO: 2834965 - RNA, 21 nt, Human
ggaucaugguguaauaagaca

SEQ ID NO: 2834966 - RNA, 16 nt, Human
ggaucaugguguaaua

SEQ ID NO: 2834967 - RNA, 19 nt, Human
ggaucaugguguaauaaga

SEQ ID NO: 2834968 - RNA, 21 nt, Human
ggaucagucugauucccaagc

SEQ ID NO: 2834969 - RNA, 21 nt, Human
ggaucaguuaacuauugcauu

SEQ ID NO: 2834970 - RNA, 12 nt, Human
ggaucaguuuuu

SEQ ID NO: 2834971 - RNA, 13 nt, Human
ggaucauaaaguu

SEQ ID NO: 2834972 - RNA, 19 nt, Human
ggaucaucaacaagauuuc

SEQ ID NO: 2834973 - RNA, 18 nt, Human
ggaucaucaugcagcuca

SEQ ID NO: 2834974 - RNA, 21 nt, Human
ggaucagaugaacucuuagaa

SEQ ID NO: 2834975 - RNA, 12 nt, Human
ggaucagaauag

SEQ ID NO: 2834976 - RNA, 15 nt, Human
ggaucagagcaggac

SEQ ID NO: 2834977 - RNA, 16 nt, Human
ggaucagagcaggacc

SEQ ID NO: 2834978 - RNA, 17 nt, Human
ggaucagagcaggaccu

SEQ ID NO: 2834979 - RNA, 18 nt, Human
ggaucagagcaggaccuc

SEQ ID NO: 2834980 - RNA, 22 nt, Human
ggaucagagcaggaccucccuu

SEQ ID NO: 2834981 - RNA, 13 nt, Human
ggaucagccagga

SEQ ID NO: 2834982 - RNA, 16 nt, Human
ggaucagaugaacucu

SEQ ID NO: 2834983 - RNA, 23 nt, Human
ggcaccuccuacgucaaacauga

SEQ ID NO: 2834984 - RNA, 22 nt, Human
ggcaccuauagucccagcuacu

SEQ ID NO: 2834985 - RNA, 19 nt, Human
ggcaccuauagucccagcu

SEQ ID NO: 2834986 - RNA, 18 nt, Human
ggcaccuauagucccagc

SEQ ID NO: 2834987 - RNA, 16 nt, Human
ggcacccggccccugc

SEQ ID NO: 2834988 - RNA, 15 nt, Human
ggcacccggccccug

SEQ ID NO: 2834989 - RNA, 19 nt, Human
ggcaacuggccauuugcca

SEQ ID NO: 2834990 - RNA, 21 nt, Human
ggcaacuucaguccugggaga

SEQ ID NO: 2834991 - RNA, 23 nt, Human
ggcaacuucaguccugggagacc

SEQ ID NO: 2834992 - RNA, 13 nt, Human
ggcaaggcugugc

SEQ ID NO: 2834993 - RNA, 14 nt, Human
ggcaaggcugugcu

SEQ ID NO: 2834994 - RNA, 22 nt, Human
ggcaagucccugacucucugug

SEQ ID NO: 2834995 - RNA, 23 nt, Human
ggcaagucccugacucucuguga

SEQ ID NO: 2834996 - RNA, 13 nt, Human
ggcaagugugggc

SEQ ID NO: 2834997 - RNA, 13 nt, Human
ggccaugggccuc

SEQ ID NO: 2834998 - RNA, 21 nt, Human
ggccauggagagcuggagccu

SEQ ID NO: 2834999 - RNA, 13 nt, Human
ggccauggcagaa

SEQ ID NO: 2835000 - RNA, 16 nt, Human
ggccaggcugcucuug

SEQ ID NO: 2835001 - RNA, 22 nt, Human
ggccauggagagcuggagccug

SEQ ID NO: 2835002 - RNA, 24 nt, Human
ggcccccacauuugugccgacacu

SEQ ID NO: 2835003 - RNA, 20 nt, Human
ggcccccaccacacauccca

SEQ ID NO: 2835004 - RNA, 21 nt, Human
ggcccccaccacacaucccag

SEQ ID NO: 2835005 - RNA, 22 nt, Human
ggcccccaccacacaucccagc

SEQ ID NO: 2835006 - RNA, 15 nt, Human
ggccccccagcucag

SEQ ID NO: 2835007 - RNA, 17 nt, Human
ggccccccagcucaggg

SEQ ID NO: 2835008 - RNA, 19 nt, Human
ggccccccagcucaggggc

SEQ ID NO: 2835009 - RNA, 21 nt, Human
ggccccccagcucaggggcag

SEQ ID NO: 2835010 - RNA, 23 nt, Human
ggccccccagcucaggggcagcu

SEQ ID NO: 2835011 - RNA, 13 nt, Human
ggcccccugcccg

SEQ ID NO: 2835012 - RNA, 11 nt, Human
ggcccccugcc

SEQ ID NO: 2835013 - RNA, 20 nt, Human
ggcccccucucaggagccau

SEQ ID NO: 2835014 - RNA, 14 nt, Human
ggccccccugcccu

SEQ ID NO: 2835015 - RNA, 16 nt, Human
ggccccccugcccugu

SEQ ID NO: 2835016 - RNA, 17 nt, Human
ggccccggaucagagca

SEQ ID NO: 2835017 - RNA, 18 nt, Human
ggccccggaucagagcag

SEQ ID NO: 2835018 - RNA, 23 nt, Human
ggccccggaucagagcaggaccu

SEQ ID NO: 2835019 - RNA, 24 nt, Human
ggccccggaucagagcaggaccuc

SEQ ID NO: 2835020 - RNA, 14 nt, Human
ggccccgccgccug

SEQ ID NO: 2835021 - RNA, 15 nt, Human
ggccccgccgccugg

SEQ ID NO: 2835022 - RNA, 18 nt, Human
ggccccgccgccugguac

SEQ ID NO: 2835023 - RNA, 17 nt, Human
ggcccccuggucucugg

SEQ ID NO: 2835024 - RNA, 18 nt, Human
ggcccccuggucucuggu

SEQ ID NO: 2835025 - RNA, 12 nt, Human
ggccccugccac

SEQ ID NO: 2835026 - RNA, 16 nt, Human
ggccccugccacccug

SEQ ID NO: 2835027 - RNA, 13 nt, Human
ggccccugccacc

SEQ ID NO: 2835028 - RNA, 13 nt, Human
ggccccugcccgg

SEQ ID NO: 2835029 - RNA, 18 nt, Human
ggccccugccacccuggg

SEQ ID NO: 2835030 - RNA, 17 nt, Human
ggccccugccacccugg

SEQ ID NO: 2835031 - RNA, 13 nt, Human
ggccaauccccag

SEQ ID NO: 2835032 - RNA, 14 nt, Human
ggccccucugaccu

SEQ ID NO: 2835033 - RNA, 17 nt, Human
ggccaauggaaaccuca

SEQ ID NO: 2835034 - RNA, 22 nt, Human
ggccaauggaaaccucacgcug

SEQ ID NO: 2835035 - RNA, 23 nt, Human
ggcauguucucugaggacacuaa

SEQ ID NO: 2835036 - RNA, 15 nt, Human
ggcagugagugagcc

SEQ ID NO: 2835037 - RNA, 16 nt, Human
ggcagugagugagccu

SEQ ID NO: 2835038 - RNA, 18 nt, Human
ggcagugagugagccugg

SEQ ID NO: 2835039 - RNA, 19 nt, Human
ggcagugagugagccuggc

SEQ ID NO: 2835040 - RNA, 24 nt, Human
ggcagugcuagugagcugggcaug

SEQ ID NO: 2835041 - RNA, 16 nt, Human
ggcauguuuccagcag

SEQ ID NO: 2835042 - RNA, 19 nt, Human
ggcauguuuugugcauuug

SEQ ID NO: 2835043 - RNA, 16 nt, Human
ggcauuaacacaaagg

SEQ ID NO: 2835044 - RNA, 16 nt, Human
ggcauuaauguuucua

SEQ ID NO: 2835045 - RNA, 17 nt, Human
ggcauuaauguuucuau

SEQ ID NO: 2835046 - RNA, 20 nt, Human
ggcauuauguccacugugua

SEQ ID NO: 2835047 - RNA, 20 nt, Human
ggcauuagaauuauuuaaac

SEQ ID NO: 2835048 - RNA, 17 nt, Human
ggcauuagaauuauuua

SEQ ID NO: 2835049 - RNA, 19 nt, Human
ggcauuagaauuauuuaaa

SEQ ID NO: 2835050 - RNA, 14 nt, Human
ggcagucucucucu

SEQ ID NO: 2835051 - RNA, 16 nt, Human
ggccaggccagaggga

SEQ ID NO: 2835052 - RNA, 14 nt, Human
ggccaggccagagg

SEQ ID NO: 2835053 - RNA, 20 nt, Human
ggccaggaguuugagaccag

SEQ ID NO: 2835054 - RNA, 15 nt, Human
ggccaggagcucuuc

SEQ ID NO: 2835055 - RNA, 15 nt, Human
ggccaggcagaucug

SEQ ID NO: 2835056 - RNA, 22 nt, Human
ggccaggcagaucugugcccca

SEQ ID NO: 2835057 - RNA, 12 nt, Human
ggccaggcaggu

SEQ ID NO: 2835058 - RNA, 11 nt, Human
ggccaggcugg

SEQ ID NO: 2835059 - RNA, 17 nt, Human
ggccaggccagcugccu

SEQ ID NO: 2835060 - RNA, 15 nt, Human
ggccaggccagcugc

SEQ ID NO: 2835061 - RNA, 11 nt, Human
ggccaggcagg

SEQ ID NO: 2835062 - RNA, 13 nt, Human
ggccaggagcucu

SEQ ID NO: 2835063 - RNA, 19 nt, Human
ggccaggaguuugagacca

SEQ ID NO: 2835064 - RNA, 14 nt, Human
ggccacugaagaua

SEQ ID NO: 2835065 - RNA, 13 nt, Human
ggccacugcuccc

SEQ ID NO: 2835066 - RNA, 20 nt, Human
ggccacugcucccuaagcca

SEQ ID NO: 2835067 - RNA, 22 nt, Human
ggccacugcucccuaagccagc

SEQ ID NO: 2835068 - RNA, 13 nt, Human
ggccaccugccug

SEQ ID NO: 2835069 - RNA, 14 nt, Human
ggccaccugccugc

SEQ ID NO: 2835070 - RNA, 15 nt, Human
ggccaccugccugcg

SEQ ID NO: 2835071 - RNA, 21 nt, Human
ggccaccugccugcgucuucc

SEQ ID NO: 2835072 - RNA, 21 nt, Human
ggagccgagaucacgccacug

SEQ ID NO: 2835073 - RNA, 13 nt, Human
ggagcccuugggu

SEQ ID NO: 2835074 - RNA, 12 nt, Human
ggaggagcaaag

SEQ ID NO: 2835075 - RNA, 13 nt, Human
ggaggagaaugag

SEQ ID NO: 2835076 - RNA, 17 nt, Human
ggaggagcaaaggcuga

SEQ ID NO: 2835077 - RNA, 15 nt, Human
ggaggagcacaguuu

SEQ ID NO: 2835078 - RNA, 20 nt, Human
ggaggaggacccuggaaaug

SEQ ID NO: 2835079 - RNA, 22 nt, Human
ggaggagcuuuguuuugggggu

SEQ ID NO: 2835080 - RNA, 17 nt, Human
ggaggagcagugcaggc

SEQ ID NO: 2835081 - RNA, 15 nt, Human
ggaggagcuucuggg

SEQ ID NO: 2835082 - RNA, 21 nt, Human
ggaggaucacuggagcccagg

SEQ ID NO: 2835083 - RNA, 20 nt, Human
ggaggaucacuggagcccag

SEQ ID NO: 2835084 - RNA, 19 nt, Human
ggaggaucacuggagccca

SEQ ID NO: 2835085 - RNA, 17 nt, Human
ggaggaucacuggagcc

SEQ ID NO: 2835086 - RNA, 16 nt, Human
ggaggaucacuggagc

SEQ ID NO: 2835087 - RNA, 15 nt, Human
ggaggagugagacag

SEQ ID NO: 2835088 - RNA, 20 nt, Human
ggaggagguggcagcccugu

SEQ ID NO: 2835089 - RNA, 15 nt, Human
ggaggauguucuggg

SEQ ID NO: 2835090 - RNA, 20 nt, Human
ggaggaugucccugggccag

SEQ ID NO: 2835091 - RNA, 21 nt, Human
ggaggaugucccugggccagg

SEQ ID NO: 2835092 - RNA, 20 nt, Human
ggaggaucuuuugaacccag

SEQ ID NO: 2835093 - RNA, 22 nt, Human
ggaggaucacuggagcccagga

SEQ ID NO: 2835094 - RNA, 15 nt, Human
ggaggaggguugugc

SEQ ID NO: 2835095 - RNA, 18 nt, Human
ggaggaucaguuuuuugu

SEQ ID NO: 2835096 - RNA, 16 nt, Human
ggagggagcagacagg

SEQ ID NO: 2835097 - RNA, 21 nt, Human
ggagggcacauuccuugccug

SEQ ID NO: 2835098 - RNA, 21 nt, Human
ggagugacagaggcagcccca

SEQ ID NO: 2835099 - RNA, 19 nt, Human
ggagugacagaggcagccc

SEQ ID NO: 2835100 - RNA, 18 nt, Human
ggagugacagaggcagcc

SEQ ID NO: 2835101 - RNA, 17 nt, Human
ggagugacagaggcagc

SEQ ID NO: 2835102 - RNA, 14 nt, Human
ggagugagcugguu

SEQ ID NO: 2835103 - RNA, 12 nt, Human
ggagugagcugg

SEQ ID NO: 2835104 - RNA, 13 nt, Human
ggaucacuggagc

SEQ ID NO: 2835105 - RNA, 18 nt, Human
ggaucacaggugucagcc

SEQ ID NO: 2835106 - RNA, 22 nt, Human
ggaucacaggugucagccauug

SEQ ID NO: 2835107 - RNA, 19 nt, Human
ggaucacgacgcugcagag

SEQ ID NO: 2835108 - RNA, 17 nt, Human
ggauaggagccugcugg

SEQ ID NO: 2835109 - RNA, 19 nt, Human
ggaucacuggagcccagga

SEQ ID NO: 2835110 - RNA, 18 nt, Human
ggaucacuggagcccagg

SEQ ID NO: 2835111 - RNA, 17 nt, Human
ggaucacuggagcccag

SEQ ID NO: 2835112 - RNA, 14 nt, Human
ggaucacuggagcc

SEQ ID NO: 2835113 - RNA, 14 nt, Human
ggauaggagccugc

SEQ ID NO: 2835114 - RNA, 15 nt, Human
ggauaggagccugcu

SEQ ID NO: 2835115 - RNA, 13 nt, Human
ggauagcauuuuu

SEQ ID NO: 2835116 - RNA, 16 nt, Human
ggagugacagaggcag

SEQ ID NO: 2835117 - RNA, 11 nt, Human
ggagugacaga

SEQ ID NO: 2835118 - RNA, 18 nt, Human
ggagucuggagugggcag

SEQ ID NO: 2835119 - RNA, 18 nt, Human
ggagucuguccugugacg

SEQ ID NO: 2835120 - RNA, 21 nt, Human
ggagucccaccuuggcugcag

SEQ ID NO: 2835121 - RNA, 20 nt, Human
ggagucccaccuuggcugca

SEQ ID NO: 2835122 - RNA, 17 nt, Human
ggagucccaaggaaagc

SEQ ID NO: 2835123 - RNA, 16 nt, Human
ggagucccaaggaaag

SEQ ID NO: 2835124 - RNA, 15 nt, Human
ggaguccaggcacag

SEQ ID NO: 2835125 - RNA, 16 nt, Human
ggaguccaggcacagg

SEQ ID NO: 2835126 - RNA, 17 nt, Human
ggaguccaggcacagga

SEQ ID NO: 2835127 - RNA, 17 nt, Human
ggaggggaaaaaaaugu

SEQ ID NO: 2835128 - RNA, 18 nt, Human
ggaggggaaaaaaauguu

SEQ ID NO: 2835129 - RNA, 13 nt, Human
ggaggggaagcug

SEQ ID NO: 2835130 - RNA, 14 nt, Human
ggaggggaagcugc

SEQ ID NO: 2835131 - RNA, 17 nt, Human
ggaggggaagcugcagc

SEQ ID NO: 2835132 - RNA, 22 nt, Human
ggacccagggaacagccacucc

SEQ ID NO: 2835133 - RNA, 16 nt, Human
ggacccagggaacagc

SEQ ID NO: 2835134 - RNA, 12 nt, Human
ggacccaggcuc

SEQ ID NO: 2835135 - RNA, 13 nt, Human
ggacccaggcucc

SEQ ID NO: 2835136 - RNA, 17 nt, Human
ggacccaggcuccgccc

SEQ ID NO: 2835137 - RNA, 23 nt, Human
ggacccagccgccaucagcccaa

SEQ ID NO: 2835138 - RNA, 17 nt, Human
ggacccagcgggcaggu

SEQ ID NO: 2835139 - RNA, 18 nt, Human
ggacccagcgggcagguu

SEQ ID NO: 2835140 - RNA, 15 nt, Human
ggaccaggacucccu

SEQ ID NO: 2835141 - RNA, 17 nt, Human
ggaccaggacucccucc

SEQ ID NO: 2835142 - RNA, 12 nt, Human
ggaccccagaga

SEQ ID NO: 2835143 - RNA, 21 nt, Human
ggaccccagagauucccaagc

SEQ ID NO: 2835144 - RNA, 19 nt, Human
ggacccauagaucuucuga

SEQ ID NO: 2835145 - RNA, 20 nt, Human
ggacccauagaucuucugaa

SEQ ID NO: 2835146 - RNA, 15 nt, Human
ggaccucucccaggg

SEQ ID NO: 2835147 - RNA, 14 nt, Human
ggaccucucccagg

SEQ ID NO: 2835148 - RNA, 12 nt, Human
ggaccucuccca

SEQ ID NO: 2835149 - RNA, 20 nt, Human
ggaccucuacuuuccaggcu

SEQ ID NO: 2835150 - RNA, 19 nt, Human
ggaaggaggggaagcugca

SEQ ID NO: 2835151 - RNA, 20 nt, Human
ggaaggaggggaagcugcag

SEQ ID NO: 2835152 - RNA, 20 nt, Human
ggaaggaggguacagcuggg

SEQ ID NO: 2835153 - RNA, 17 nt, Human
ggaaggagagccugcug

SEQ ID NO: 2835154 - RNA, 16 nt, Human
ggaaggagagccugcu

SEQ ID NO: 2835155 - RNA, 15 nt, Human
ggaaggagagccugc

SEQ ID NO: 2835156 - RNA, 14 nt, Human
ggaaggagagccug

SEQ ID NO: 2835157 - RNA, 16 nt, Human
ggaaggaggagccgac

SEQ ID NO: 2835158 - RNA, 11 nt, Human
ggacucugccu

SEQ ID NO: 2835159 - RNA, 21 nt, Human
ggacucugcaucccagcaccu

SEQ ID NO: 2835160 - RNA, 17 nt, Human
ggacucuggugccucca

SEQ ID NO: 2835161 - RNA, 18 nt, Human
ggacucuggugccuccag

SEQ ID NO: 2835162 - RNA, 13 nt, Human
ggacucugaggcu

SEQ ID NO: 2835163 - RNA, 11 nt, Human
ggacucugagg

SEQ ID NO: 2835164 - RNA, 21 nt, Human
ggacucugaggcucuuucugg

SEQ ID NO: 2835165 - RNA, 13 nt, Human
ggacucugcacau

SEQ ID NO: 2835166 - RNA, 21 nt, Human
ggacucugcacaugucuugua

SEQ ID NO: 2835167 - RNA, 15 nt, Human
ggacucugcacauga

SEQ ID NO: 2835168 - RNA, 20 nt, Human
ggacucugcacaugucuugu

SEQ ID NO: 2835169 - RNA, 14 nt, Human
ggacucgcuuguaa

SEQ ID NO: 2835170 - RNA, 16 nt, Human
ggacucgcuuguaaau

SEQ ID NO: 2835171 - RNA, 17 nt, Human
ggacucugaagccucug

SEQ ID NO: 2835172 - RNA, 19 nt, Human
ggacucugaagccucuggg

SEQ ID NO: 2835173 - RNA, 15 nt, Human
ggacucugagcggga

SEQ ID NO: 2835174 - RNA, 19 nt, Human
ggacucugagcgggaggca

SEQ ID NO: 2835175 - RNA, 21 nt, Human
ggacucugagcgggaggcaga

SEQ ID NO: 2835176 - RNA, 20 nt, Human
ggaccuuacgaucaggcaca

SEQ ID NO: 2835177 - RNA, 21 nt, Human
ggaccuuacgaucaggcacag

SEQ ID NO: 2835178 - RNA, 17 nt, Human
ggaccugguacccuccu

SEQ ID NO: 2835179 - RNA, 18 nt, Human
ggaccuguauuuaagcaa

SEQ ID NO: 2835180 - RNA, 20 nt, Human
ggaccuguauuuaagcaaau

SEQ ID NO: 2835181 - RNA, 22 nt, Human
ggaccuguauuuaagcaaauac

SEQ ID NO: 2835182 - RNA, 23 nt, Human
ggaccuguauuuaagcaaauacu

SEQ ID NO: 2835183 - RNA, 18 nt, Human
ggaccuuaggccuuccuc

SEQ ID NO: 2835184 - RNA, 21 nt, Human
ggaccuuaggccuuccucucu

SEQ ID NO: 2835185 - RNA, 15 nt, Human
ggacuccucugucca

SEQ ID NO: 2835186 - RNA, 14 nt, Human
ggacuccucugucc

SEQ ID NO: 2835187 - RNA, 12 nt, Human
ggacuccucugu

SEQ ID NO: 2835188 - RNA, 19 nt, Human
ggaccugaaauuccaaagu

SEQ ID NO: 2835189 - RNA, 22 nt, Human
ggaccugccuccugccugcccc

SEQ ID NO: 2835190 - RNA, 14 nt, Human
ggaccugccuguag

SEQ ID NO: 2835191 - RNA, 19 nt, Human
ggaccugccuccugccugc

SEQ ID NO: 2835192 - RNA, 13 nt, Human
ggaccuggggcac

SEQ ID NO: 2835193 - RNA, 15 nt, Human
ggaccuggggcacag

SEQ ID NO: 2835194 - RNA, 16 nt, Human
ggaccuggggcacagu

SEQ ID NO: 2835195 - RNA, 21 nt, Human
ggaccuggggcacaguccagg

SEQ ID NO: 2835196 - RNA, 15 nt, Human
ggaccugccuguagc

SEQ ID NO: 2835197 - RNA, 23 nt, Human
ggaccugccuccugccugccccu

SEQ ID NO: 2835198 - RNA, 13 nt, Human
ggagauggaguuc

SEQ ID NO: 2835199 - RNA, 17 nt, Human
ggagauuggacggccug

SEQ ID NO: 2835200 - RNA, 20 nt, Human
ggagauugagaaggagagaa

SEQ ID NO: 2835201 - RNA, 21 nt, Human
ggagauugagaaggagagaaa

SEQ ID NO: 2835202 - RNA, 14 nt, Human
ggagauugagaagg

SEQ ID NO: 2835203 - RNA, 16 nt, Human
ggagauugagaaggag

SEQ ID NO: 2835204 - RNA, 17 nt, Human
ggagauugagaaggaga

SEQ ID NO: 2835205 - RNA, 21 nt, Human
ggagauuuugagguaaagaua

SEQ ID NO: 2835206 - RNA, 16 nt, Human
ggagcccgucucagug

SEQ ID NO: 2835207 - RNA, 13 nt, Human
ggagcccucaucu

SEQ ID NO: 2835208 - RNA, 18 nt, Human
ggagcccuccgccuucac

SEQ ID NO: 2835209 - RNA, 22 nt, Human
ggagcccuuaucugugcucagg

SEQ ID NO: 2835210 - RNA, 20 nt, Human
ggagcccuuaucugugcuca

SEQ ID NO: 2835211 - RNA, 20 nt, Human
ggagaccgggguauccuggg

SEQ ID NO: 2835212 - RNA, 21 nt, Human
ggagaccucuccuuccuaccc

SEQ ID NO: 2835213 - RNA, 10 nt, Human
ggagacuaga

SEQ ID NO: 2835214 - RNA, 19 nt, Human
ggagacguggaaccucugu

SEQ ID NO: 2835215 - RNA, 23 nt, Human
ggagacguggaaccucugucuca

SEQ ID NO: 2835216 - RNA, 22 nt, Human
ggagagcuggagccuggugccc

SEQ ID NO: 2835217 - RNA, 18 nt, Human
ggagagcuggugcccgga

SEQ ID NO: 2835218 - RNA, 17 nt, Human
ggagagcuggugcccgg

SEQ ID NO: 2835219 - RNA, 15 nt, Human
ggagagcuggugccc

SEQ ID NO: 2835220 - RNA, 19 nt, Human
ggagacuagauugccuuug

SEQ ID NO: 2835221 - RNA, 14 nt, Human
ggagacuagauugc

SEQ ID NO: 2835222 - RNA, 13 nt, Human
ggagagcuggagc

SEQ ID NO: 2835223 - RNA, 17 nt, Human
ggagagcuggagccugg

SEQ ID NO: 2835224 - RNA, 18 nt, Human
ggagagcuggagccuggu

SEQ ID NO: 2835225 - RNA, 15 nt, Human
ggacugucauagaaa

SEQ ID NO: 2835226 - RNA, 13 nt, Human
ggagacccugcaa

SEQ ID NO: 2835227 - RNA, 16 nt, Human
ggagacccugcaaaca

SEQ ID NO: 2835228 - RNA, 21 nt, Human
ggagacccugcaaacagaaca

SEQ ID NO: 2835229 - RNA, 22 nt, Human
ggagacccugcaaacagaacag

SEQ ID NO: 2835230 - RNA, 23 nt, Human
ggagacccugcaaacagaacagg

SEQ ID NO: 2835231 - RNA, 20 nt, Human
ggacucugggcuauggacac

SEQ ID NO: 2835232 - RNA, 14 nt, Human
ggacugguuugaga

SEQ ID NO: 2835233 - RNA, 11 nt, Human
ggacugggagg

SEQ ID NO: 2835234 - RNA, 12 nt, Human
ggacugggaggu

SEQ ID NO: 2835235 - RNA, 15 nt, Human
ggacugggggccaga

SEQ ID NO: 2835236 - RNA, 17 nt, Human
ggacuggggauguggga

SEQ ID NO: 2835237 - RNA, 23 nt, Human
ggacuggggaugugggagggagc

SEQ ID NO: 2835238 - RNA, 12 nt, Human
ggacugccucug

SEQ ID NO: 2835239 - RNA, 13 nt, Human
ggacugccucugc

SEQ ID NO: 2835240 - RNA, 14 nt, Human
ggacugccucugcc

SEQ ID NO: 2835241 - RNA, 15 nt, Human
ggacugccucugcca

SEQ ID NO: 2835242 - RNA, 22 nt, Human
ggacugccucugccacacucug

SEQ ID NO: 2835243 - RNA, 21 nt, Human
ggacugccagucccccugccc

SEQ ID NO: 2835244 - RNA, 22 nt, Human
gcugguucaggguuggccccug

SEQ ID NO: 2835245 - RNA, 20 nt, Human
gcugucaaaacaaguuuuuc

SEQ ID NO: 2835246 - RNA, 14 nt, Human
gcugguuagaaaug

SEQ ID NO: 2835247 - RNA, 18 nt, Human
gcugucaaguuccuuugg

SEQ ID NO: 2835248 - RNA, 15 nt, Human
gcugguucaggguug

SEQ ID NO: 2835249 - RNA, 14 nt, Human
gcuggucccacuca

SEQ ID NO: 2835250 - RNA, 20 nt, Human
gcuggucccacucaguccau

SEQ ID NO: 2835251 - RNA, 21 nt, Human
gcugguggacccagggaacag

SEQ ID NO: 2835252 - RNA, 16 nt, Human
gcugguggacccaggg

SEQ ID NO: 2835253 - RNA, 18 nt, Human
gcuggugucaccugaaga

SEQ ID NO: 2835254 - RNA, 14 nt, Human
gcuggugggagggg

SEQ ID NO: 2835255 - RNA, 16 nt, Human
gcuggugucaccugaa

SEQ ID NO: 2835256 - RNA, 12 nt, Human
gcuggugggagg

SEQ ID NO: 2835257 - RNA, 13 nt, Human
gcuggugggaggg

SEQ ID NO: 2835258 - RNA, 12 nt, Human
gcugucucugcu

SEQ ID NO: 2835259 - RNA, 13 nt, Human
gcugucucugcuc

SEQ ID NO: 2835260 - RNA, 14 nt, Human
gcugucucugcucg

SEQ ID NO: 2835261 - RNA, 12 nt, Human
gcugucugcagc

SEQ ID NO: 2835262 - RNA, 14 nt, Human
gcugucugcagccu

SEQ ID NO: 2835263 - RNA, 15 nt, Human
gcugucugcagccuu

SEQ ID NO: 2835264 - RNA, 13 nt, Human
gcugucuucugga

SEQ ID NO: 2835265 - RNA, 23 nt, Human
gcugucuucuggacaggcucugc

SEQ ID NO: 2835266 - RNA, 24 nt, Human
gcugucuucuggacaggcucugcu

SEQ ID NO: 2835267 - RNA, 14 nt, Human
gcugucuguggcuu

SEQ ID NO: 2835268 - RNA, 15 nt, Human
gcugucuguggcuuc

SEQ ID NO: 2835269 - RNA, 23 nt, Human
gcugugguuuccaucugaaagua

SEQ ID NO: 2835270 - RNA, 13 nt, Human
gcugucccucacu

SEQ ID NO: 2835271 - RNA, 16 nt, Human
gcugucccucccccuu

SEQ ID NO: 2835272 - RNA, 15 nt, Human
gcugucccucccccu

SEQ ID NO: 2835273 - RNA, 13 nt, Human
gcugucacaggcg

SEQ ID NO: 2835274 - RNA, 16 nt, Human
gcugucaccaaggaaa

SEQ ID NO: 2835275 - RNA, 17 nt, Human
gcugucaccaaggaaac

SEQ ID NO: 2835276 - RNA, 13 nt, Human
gcugucaccucuc

SEQ ID NO: 2835277 - RNA, 19 nt, Human
gcugggcuucaguggcagc

SEQ ID NO: 2835278 - RNA, 18 nt, Human
gcugggcuucaguggcag

SEQ ID NO: 2835279 - RNA, 14 nt, Human
gcuggggccucaga

SEQ ID NO: 2835280 - RNA, 15 nt, Human
gcuggggccucagac

SEQ ID NO: 2835281 - RNA, 16 nt, Human
gcuggggccucagacg

SEQ ID NO: 2835282 - RNA, 17 nt, Human
gcuggggccucagacga

SEQ ID NO: 2835283 - RNA, 19 nt, Human
gcuggucccacucagucca

SEQ ID NO: 2835284 - RNA, 15 nt, Human
gcuggucccacucag

SEQ ID NO: 2835285 - RNA, 14 nt, Human
gcugggguggccug

SEQ ID NO: 2835286 - RNA, 18 nt, Human
gcugggguggccugugug

SEQ ID NO: 2835287 - RNA, 19 nt, Human
gcugggguggccugugugg

SEQ ID NO: 2835288 - RNA, 20 nt, Human
gcugggguggccuguguggc

SEQ ID NO: 2835289 - RNA, 20 nt, Human
gcugggggccucagugccac

SEQ ID NO: 2835290 - RNA, 19 nt, Human
gcugggggccucagugcca

SEQ ID NO: 2835291 - RNA, 18 nt, Human
gcugggggcaacuggcca

SEQ ID NO: 2835292 - RNA, 14 nt, Human
gcugggggcaacug

SEQ ID NO: 2835293 - RNA, 20 nt, Human
gcugggggaaugagcccaga

SEQ ID NO: 2835294 - RNA, 21 nt, Human
gcugggggaaugagcccagag

SEQ ID NO: 2835295 - RNA, 22 nt, Human
gcugggggaaugagcccagaga

SEQ ID NO: 2835296 - RNA, 23 nt, Human
gcugggggcaggagggcccuacc

SEQ ID NO: 2835297 - RNA, 20 nt, Human
gcugggggcaggagggcccu

SEQ ID NO: 2835298 - RNA, 13 nt, Human
gcugggggcagga

SEQ ID NO: 2835299 - RNA, 16 nt, Human
gcugggacuggccagg

SEQ ID NO: 2835300 - RNA, 15 nt, Human
gcugggacuggccag

SEQ ID NO: 2835301 - RNA, 15 nt, Human
gcugggagcucugca

SEQ ID NO: 2835302 - RNA, 16 nt, Human
gcugggagcucugcag

SEQ ID NO: 2835303 - RNA, 17 nt, Human
gcugggcuucaguggca

SEQ ID NO: 2835304 - RNA, 18 nt, Human
gcugggauggugggcuuc

SEQ ID NO: 2835305 - RNA, 20 nt, Human
gcugggauggugggcuucag

SEQ ID NO: 2835306 - RNA, 23 nt, Human
gcugggauggugggcuucagggc

SEQ ID NO: 2835307 - RNA, 20 nt, Human
gcugggauuacaggcuccug

SEQ ID NO: 2835308 - RNA, 19 nt, Human
gcugggauuacaggcuccu

SEQ ID NO: 2835309 - RNA, 18 nt, Human
gcugggauuacaggcgug

SEQ ID NO: 2835310 - RNA, 17 nt, Human
gcugggauuacaggcgu

SEQ ID NO: 2835311 - RNA, 21 nt, Human
gcuagaggccagccccaccca

SEQ ID NO: 2835312 - RNA, 20 nt, Human
gcuagaggccagccccaccc

SEQ ID NO: 2835313 - RNA, 19 nt, Human
gcuagaggccagccccacc

SEQ ID NO: 2835314 - RNA, 18 nt, Human
gcuagaggccagccccac

SEQ ID NO: 2835315 - RNA, 18 nt, Human
gcugcccuggugcugcca

SEQ ID NO: 2835316 - RNA, 19 nt, Human
gcugcccuggugcugccac

SEQ ID NO: 2835317 - RNA, 20 nt, Human
gcugcccuggugcugccaca

SEQ ID NO: 2835318 - RNA, 22 nt, Human
gcugcccuggugcugccacacu

SEQ ID NO: 2835319 - RNA, 20 nt, Human
gcugcccuugggccaccccu

SEQ ID NO: 2835320 - RNA, 18 nt, Human
gcugcccuugggccaccc

SEQ ID NO: 2835321 - RNA, 17 nt, Human
gcugcccuuucugggca

SEQ ID NO: 2835322 - RNA, 13 nt, Human
gcugcccuugggc

SEQ ID NO: 2835323 - RNA, 18 nt, Human
gcugcccuguaccccagc

SEQ ID NO: 2835324 - RNA, 23 nt, Human
gcugcccuggugcugccacacuu

SEQ ID NO: 2835325 - RNA, 16 nt, Human
gcugcgguccacccag

SEQ ID NO: 2835326 - RNA, 19 nt, Human
gcugcgcccuuaccuuccc

SEQ ID NO: 2835327 - RNA, 21 nt, Human
gcugccuuggcucagacaugu

SEQ ID NO: 2835328 - RNA, 23 nt, Human
gcugccuuggcucagacauguuu

SEQ ID NO: 2835329 - RNA, 17 nt, Human
gcugccuuggcucagac

SEQ ID NO: 2835330 - RNA, 19 nt, Human
gcugccuuggcucagacau

SEQ ID NO: 2835331 - RNA, 16 nt, Human
gcugccuuggcucaga

SEQ ID NO: 2835332 - RNA, 14 nt, Human
gcugccuuggcuca

SEQ ID NO: 2835333 - RNA, 18 nt, Human
gcugcuauuuauuuuccu

SEQ ID NO: 2835334 - RNA, 19 nt, Human
gcugcuauuuauuuuccua

SEQ ID NO: 2835335 - RNA, 20 nt, Human
gcugcucagggaaaagcagc

SEQ ID NO: 2835336 - RNA, 21 nt, Human
gcugcucagggaaaagcagcu

SEQ ID NO: 2835337 - RNA, 14 nt, Human
gcugcuccaggccu

SEQ ID NO: 2835338 - RNA, 15 nt, Human
gcugcuccaggccug

SEQ ID NO: 2835339 - RNA, 16 nt, Human
gcugcuccaggccugc

SEQ ID NO: 2835340 - RNA, 19 nt, Human
gcugcuccaggccugcagc

SEQ ID NO: 2835341 - RNA, 22 nt, Human
gcugcuccaggccugcagcagg

SEQ ID NO: 2835342 - RNA, 23 nt, Human
gcugcuccaggccugcagcagga

SEQ ID NO: 2835343 - RNA, 17 nt, Human
gcugcuagaacuuuuuu

SEQ ID NO: 2835344 - RNA, 18 nt, Human
gcugcuagaacuuuuuua

SEQ ID NO: 2835345 - RNA, 19 nt, Human
gcugcuagaacuuuuuuaa

SEQ ID NO: 2835346 - RNA, 21 nt, Human
gcugcuagaacuuuuuuaaau

SEQ ID NO: 2835347 - RNA, 22 nt, Human
gcugcuagaacuuuuuuaaaua

SEQ ID NO: 2835348 - RNA, 19 nt, Human
gcugcgguccacccaggag

SEQ ID NO: 2835349 - RNA, 18 nt, Human
gcugcgguccacccagga

SEQ ID NO: 2835350 - RNA, 17 nt, Human
gcugcgguccacccagg

SEQ ID NO: 2835351 - RNA, 23 nt, Human
gcugcuuccgguagggaggcagc

SEQ ID NO: 2835352 - RNA, 20 nt, Human
gcugcuguuacuguuaacca

SEQ ID NO: 2835353 - RNA, 18 nt, Human
gcugcuuagacauaacaa

SEQ ID NO: 2835354 - RNA, 19 nt, Human
gcuagcaaauggcagaacc

SEQ ID NO: 2835355 - RNA, 22 nt, Human
gcuggaccuugaacuggguacu

SEQ ID NO: 2835356 - RNA, 21 nt, Human
gcuggaccuugaacuggguac

SEQ ID NO: 2835357 - RNA, 14 nt, Human
gcuggauggagccc

SEQ ID NO: 2835358 - RNA, 16 nt, Human
gcuggauggagcccag

SEQ ID NO: 2835359 - RNA, 18 nt, Human
gcuggauggagcccaggc

SEQ ID NO: 2835360 - RNA, 18 nt, Human
gcuggaugucugccaauu

SEQ ID NO: 2835361 - RNA, 21 nt, Human
gcuggaugucugccaauuuuu

SEQ ID NO: 2835362 - RNA, 15 nt, Human
gcuggaugauggucu

SEQ ID NO: 2835363 - RNA, 18 nt, Human
gcuggaccuugaacuggg

SEQ ID NO: 2835364 - RNA, 16 nt, Human
gcuggaccuugaacug

SEQ ID NO: 2835365 - RNA, 16 nt, Human
gcuggccccagggcac

SEQ ID NO: 2835366 - RNA, 18 nt, Human
gcuggccccagggcaccc

SEQ ID NO: 2835367 - RNA, 20 nt, Human
gcuggccccagggcacccug

SEQ ID NO: 2835368 - RNA, 13 nt, Human
gcuggccccgccg

SEQ ID NO: 2835369 - RNA, 22 nt, Human
gcuggccccgccgccugguacu

SEQ ID NO: 2835370 - RNA, 23 nt, Human
gcuggccccgccgccugguacuc

SEQ ID NO: 2835371 - RNA, 24 nt, Human
gcuggccccgccgccugguacuca

SEQ ID NO: 2835372 - RNA, 14 nt, Human
gcuggccccuuugg

SEQ ID NO: 2835373 - RNA, 21 nt, Human
gcuggccccuuugggcccugc

SEQ ID NO: 2835374 - RNA, 22 nt, Human
gcuggccccuuugggcccugca

SEQ ID NO: 2835375 - RNA, 23 nt, Human
gcuggccccuuugggcccugcau

SEQ ID NO: 2835376 - RNA, 16 nt, Human
gcuggauuacaggcau

SEQ ID NO: 2835377 - RNA, 22 nt, Human
gcuggaugucugccaauuuuug

SEQ ID NO: 2835378 - RNA, 14 nt, Human
gcuggccuggacag

SEQ ID NO: 2835379 - RNA, 23 nt, Human
gcuggccucuggcucucaugggg

SEQ ID NO: 2835380 - RNA, 18 nt, Human
gcuggccucuggcucuca

SEQ ID NO: 2835381 - RNA, 19 nt, Human
gcuggccucucuagcacaa

SEQ ID NO: 2835382 - RNA, 15 nt, Human
gcuggccucucuagc

SEQ ID NO: 2835383 - RNA, 14 nt, Human
gcuggccucuacca

SEQ ID NO: 2835384 - RNA, 16 nt, Human
gcuggccucuaccaca

SEQ ID NO: 2835385 - RNA, 18 nt, Human
gcuggccgugggccuggg

SEQ ID NO: 2835386 - RNA, 17 nt, Human
gcuggccgggagccuga

SEQ ID NO: 2835387 - RNA, 12 nt, Human
gcuggcccugcc

SEQ ID NO: 2835388 - RNA, 20 nt, Human
gcugggacuacaggcaccca

SEQ ID NO: 2835389 - RNA, 19 nt, Human
gcugggacuacaggcaccc

SEQ ID NO: 2835390 - RNA, 18 nt, Human
gcugggacuacaggcacc

SEQ ID NO: 2835391 - RNA, 13 nt, Human
gcugggacuacag

SEQ ID NO: 2835392 - RNA, 19 nt, Human
gcugggacuacagguguga

SEQ ID NO: 2835393 - RNA, 14 nt, Human
gcugggacuggcca

SEQ ID NO: 2835394 - RNA, 18 nt, Human
ggaaagugcuuuccagaa

SEQ ID NO: 2835395 - RNA, 17 nt, Human
ggaacagacuggaagca

SEQ ID NO: 2835396 - RNA, 17 nt, Human
ggaaauauugcuggggu

SEQ ID NO: 2835397 - RNA, 22 nt, Human
ggaaaagagcgcaucaggccug

SEQ ID NO: 2835398 - RNA, 21 nt, Human
ggaaagggguuggggugacag

SEQ ID NO: 2835399 - RNA, 22 nt, Human
ggaaagggguuggggugacagu

SEQ ID NO: 2835400 - RNA, 19 nt, Human
gcuuuuacugaacuuucuu

SEQ ID NO: 2835401 - RNA, 18 nt, Human
ggaacgggguccuucaag

SEQ ID NO: 2835402 - RNA, 21 nt, Human
ggaaccucaggguauugcuug

SEQ ID NO: 2835403 - RNA, 13 nt, Human
ggaaccucccaga

SEQ ID NO: 2835404 - RNA, 14 nt, Human
ggaaccucccagag

SEQ ID NO: 2835405 - RNA, 15 nt, Human
ggaaccucccagagg

SEQ ID NO: 2835406 - RNA, 16 nt, Human
ggaaccucccagaggu

SEQ ID NO: 2835407 - RNA, 22 nt, Human
ggaaccucccagagguccagcc

SEQ ID NO: 2835408 - RNA, 23 nt, Human
ggaaccucccagagguccagccc

SEQ ID NO: 2835409 - RNA, 17 nt, Human
ggaacucaccuggggcu

SEQ ID NO: 2835410 - RNA, 20 nt, Human
ggaacuagacugccuggguu

SEQ ID NO: 2835411 - RNA, 18 nt, Human
ggaacuagacugccuggg

SEQ ID NO: 2835412 - RNA, 14 nt, Human
ggaacuaauaaaua

SEQ ID NO: 2835413 - RNA, 23 nt, Human
ggaacuagacucccaagcuggac

SEQ ID NO: 2835414 - RNA, 22 nt, Human
ggaacggugaaggugacagcag

SEQ ID NO: 2835415 - RNA, 20 nt, Human
ggaacagacuggaagcacag

SEQ ID NO: 2835416 - RNA, 19 nt, Human
ggaacagacuggaagcaca

SEQ ID NO: 2835417 - RNA, 19 nt, Human
ggaacagcuaugggagccc

SEQ ID NO: 2835418 - RNA, 21 nt, Human
ggaacagcacuggggagucuu

SEQ ID NO: 2835419 - RNA, 11 nt, Human
ggaacagcaga

SEQ ID NO: 2835420 - RNA, 17 nt, Human
ggaacagcacuggggag

SEQ ID NO: 2835421 - RNA, 14 nt, Human
ggaaccgcucaccu

SEQ ID NO: 2835422 - RNA, 19 nt, Human
ggaaccgcucaccuagagc

SEQ ID NO: 2835423 - RNA, 20 nt, Human
ggaaccgcucaccuagagcc

SEQ ID NO: 2835424 - RNA, 21 nt, Human
ggaaccgcucaccuagagcca

SEQ ID NO: 2835425 - RNA, 18 nt, Human
ggaaccguugccaaccga

SEQ ID NO: 2835426 - RNA, 20 nt, Human
ggaaauauuuugauaauaaa

SEQ ID NO: 2835427 - RNA, 17 nt, Human
ggaagcacagcuucauu

SEQ ID NO: 2835428 - RNA, 14 nt, Human
ggaagauuucuaaa

SEQ ID NO: 2835429 - RNA, 18 nt, Human
ggaagauuucuaaauaaa

SEQ ID NO: 2835430 - RNA, 16 nt, Human
ggaagauccugugagg

SEQ ID NO: 2835431 - RNA, 19 nt, Human
ggaagauccugugaggagc

SEQ ID NO: 2835432 - RNA, 14 nt, Human
ggaagaggaaaauu

SEQ ID NO: 2835433 - RNA, 20 nt, Human
ggaagagcucaagggacaag

SEQ ID NO: 2835434 - RNA, 22 nt, Human
ggaagagcucaagggacaagga

SEQ ID NO: 2835435 - RNA, 23 nt, Human
ggaagagcucaagggacaaggac

SEQ ID NO: 2835436 - RNA, 14 nt, Human
ggaagauauacaug

SEQ ID NO: 2835437 - RNA, 14 nt, Human
ggaagagugugugu

SEQ ID NO: 2835438 - RNA, 13 nt, Human
ggaacuccuuggc

SEQ ID NO: 2835439 - RNA, 15 nt, Human
ggaacuccuuggccu

SEQ ID NO: 2835440 - RNA, 16 nt, Human
ggaacuccuuggccua

SEQ ID NO: 2835441 - RNA, 17 nt, Human
ggaacuccuuggccuag

SEQ ID NO: 2835442 - RNA, 18 nt, Human
ggaacucuaucugggccu

SEQ ID NO: 2835443 - RNA, 19 nt, Human
ggaacucuaucugggccug

SEQ ID NO: 2835444 - RNA, 21 nt, Human
ggaacucuaucugggccuggg

SEQ ID NO: 2835445 - RNA, 23 nt, Human
ggaacucuaucugggccugggcu

SEQ ID NO: 2835446 - RNA, 11 nt, Human
ggaacucugac

SEQ ID NO: 2835447 - RNA, 12 nt, Human
ggaacucugaca

SEQ ID NO: 2835448 - RNA, 13 nt, Human
ggaacucugacaa

SEQ ID NO: 2835449 - RNA, 14 nt, Human
ggaacucugacaag

SEQ ID NO: 2835450 - RNA, 21 nt, Human
ggaacuccuaaaccuuugccc

SEQ ID NO: 2835451 - RNA, 22 nt, Human
ggaacuccuaaaccuuugcccc

SEQ ID NO: 2835452 - RNA, 19 nt, Human
ggaagagcagaacggagcc

SEQ ID NO: 2835453 - RNA, 15 nt, Human
ggaagcaccccaugc

SEQ ID NO: 2835454 - RNA, 13 nt, Human
ggaagcaccccau

SEQ ID NO: 2835455 - RNA, 22 nt, Human
ggaagcaccccaugccaaagcu

SEQ ID NO: 2835456 - RNA, 13 nt, Human
ggaagcagcuuuc

SEQ ID NO: 2835457 - RNA, 15 nt, Human
ggaagccaaauuuau

SEQ ID NO: 2835458 - RNA, 20 nt, Human
ggaagcauucagagagcagc

SEQ ID NO: 2835459 - RNA, 16 nt, Human
ggaagcauucagagag

SEQ ID NO: 2835460 - RNA, 18 nt, Human
ggaagcauucagagagca

SEQ ID NO: 2835461 - RNA, 18 nt, Human
gcuguucaacaucacuga

SEQ ID NO: 2835462 - RNA, 12 nt, Human
gcuucugggguc

SEQ ID NO: 2835463 - RNA, 18 nt, Human
gcuucugggguccccagg

SEQ ID NO: 2835464 - RNA, 19 nt, Human
gcuucugggguccccaggg

SEQ ID NO: 2835465 - RNA, 20 nt, Human
gcuucugggguccccagggc

SEQ ID NO: 2835466 - RNA, 21 nt, Human
gcuucugggguccccagggcu

SEQ ID NO: 2835467 - RNA, 16 nt, Human
gcuugccacagagcgg

SEQ ID NO: 2835468 - RNA, 14 nt, Human
gcuugccacagagc

SEQ ID NO: 2835469 - RNA, 19 nt, Human
gcuugcagugagccgagau

SEQ ID NO: 2835470 - RNA, 19 nt, Human
gcuugaguuaggaaugaga

SEQ ID NO: 2835471 - RNA, 14 nt, Human
gcuugauucugcag

SEQ ID NO: 2835472 - RNA, 22 nt, Human
gcuugcagagaugaggccgcca

SEQ ID NO: 2835473 - RNA, 22 nt, Human
gcuugaggguugggcugguguc

SEQ ID NO: 2835474 - RNA, 14 nt, Human
gcuugauauuuucu

SEQ ID NO: 2835475 - RNA, 13 nt, Human
gcuugaugaagca

SEQ ID NO: 2835476 - RNA, 14 nt, Human
gcuugaugaagcaa

SEQ ID NO: 2835477 - RNA, 19 nt, Human
gcuugaugaagcaaggaag

SEQ ID NO: 2835478 - RNA, 20 nt, Human
gcuugaugaagcaaggaaga

SEQ ID NO: 2835479 - RNA, 16 nt, Human
gcuucuguugcugccu

SEQ ID NO: 2835480 - RNA, 20 nt, Human
gcuucugugaugagcugauc

SEQ ID NO: 2835481 - RNA, 19 nt, Human
gcuucugugaugagcugau

SEQ ID NO: 2835482 - RNA, 18 nt, Human
gcuucugugaugagcuga

SEQ ID NO: 2835483 - RNA, 17 nt, Human
gcuucugugaugagcug

SEQ ID NO: 2835484 - RNA, 16 nt, Human
gcuucugugaugagcu

SEQ ID NO: 2835485 - RNA, 15 nt, Human
gcuuugggcugcccu

SEQ ID NO: 2835486 - RNA, 16 nt, Human
gcuuugggcugcccug

SEQ ID NO: 2835487 - RNA, 17 nt, Human
gcuuuuaaccaucugau

SEQ ID NO: 2835488 - RNA, 15 nt, Human
gcuuuuaauuaaaua

SEQ ID NO: 2835489 - RNA, 22 nt, Human
ggaaaaccaagccguggcuucc

SEQ ID NO: 2835490 - RNA, 13 nt, Human
ggaaaacuuauuu

SEQ ID NO: 2835491 - RNA, 23 nt, Human
ggaaaacuuauuuuauauuuucc

SEQ ID NO: 2835492 - RNA, 22 nt, Human
ggaaaacuugcagcuaaggagg

SEQ ID NO: 2835493 - RNA, 9 nt, Human
ggaaaagaa

SEQ ID NO: 2835494 - RNA, 12 nt, Human
ggaaaagaaaaa

SEQ ID NO: 2835495 - RNA, 13 nt, Human
ggaaaagaaaaaa

SEQ ID NO: 2835496 - RNA, 14 nt, Human
ggaaaagaaaaaaa

SEQ ID NO: 2835497 - RNA, 22 nt, Human
ggaaaagaaaaaaaaaagaaga

SEQ ID NO: 2835498 - RNA, 23 nt, Human
ggaaaagaaaaaaaaaagaagaa

SEQ ID NO: 2835499 - RNA, 20 nt, Human
ggaaaacuccaccuucccac

SEQ ID NO: 2835500 - RNA, 16 nt, Human
ggaaaaccugaagacu

SEQ ID NO: 2835501 - RNA, 21 nt, Human
ggaaaaccaagccguggcuuc

SEQ ID NO: 2835502 - RNA, 13 nt, Human
ggaaaaagaaaau

SEQ ID NO: 2835503 - RNA, 14 nt, Human
ggaaaaagaaaaua

SEQ ID NO: 2835504 - RNA, 20 nt, Human
ggaaaaagaaaauaaagaca

SEQ ID NO: 2835505 - RNA, 19 nt, Human
ggaaaaaccacccccaaau

SEQ ID NO: 2835506 - RNA, 23 nt, Human
ggaaaaagcuccaugugccucuu

SEQ ID NO: 2835507 - RNA, 13 nt, Human
gcuuggcagcuga

SEQ ID NO: 2835508 - RNA, 15 nt, Human
gcuuggcccuuuccu

SEQ ID NO: 2835509 - RNA, 16 nt, Human
gcuuggccuaucuccu

SEQ ID NO: 2835510 - RNA, 12 nt, Human
gcuuuacaugca

SEQ ID NO: 2835511 - RNA, 14 nt, Human
gcuuuaccaaacag

SEQ ID NO: 2835512 - RNA, 16 nt, Human
gcuuuaccaaacagca

SEQ ID NO: 2835513 - RNA, 17 nt, Human
gcuuuaccaaacagcaa

SEQ ID NO: 2835514 - RNA, 21 nt, Human
gcuuuaccaaacagcaaacca

SEQ ID NO: 2835515 - RNA, 12 nt, Human
gcuuuacacaca

SEQ ID NO: 2835516 - RNA, 16 nt, Human
gcuuuacacacacaga

SEQ ID NO: 2835517 - RNA, 20 nt, Human
gcuuuaugauaauagauucu

SEQ ID NO: 2835518 - RNA, 21 nt, Human
gcuuuaugauaauagauucuc

SEQ ID NO: 2835519 - RNA, 11 nt, Human
gcuuuaugauu

SEQ ID NO: 2835520 - RNA, 12 nt, Human
gcuuuaugauuu

SEQ ID NO: 2835521 - RNA, 14 nt, Human
gcuuuaugauuuuc

SEQ ID NO: 2835522 - RNA, 15 nt, Human
gcuuuaugauuuuca

SEQ ID NO: 2835523 - RNA, 16 nt, Human
gcuuuaugauuuucau

SEQ ID NO: 2835524 - RNA, 18 nt, Human
gcuuuaugauuuucauaa

SEQ ID NO: 2835525 - RNA, 22 nt, Human
gcuuuaugguccuaaaagcaaa

SEQ ID NO: 2835526 - RNA, 17 nt, Human
gcuuuauuccagaaugc

SEQ ID NO: 2835527 - RNA, 12 nt, Human
gcuuuauguuca

SEQ ID NO: 2835528 - RNA, 23 nt, Human
gcuuuauguucauuuguuuguuu

SEQ ID NO: 2835529 - RNA, 21 nt, Human
gcuuuauuuguuuuuuuuguu

SEQ ID NO: 2835530 - RNA, 13 nt, Human
gcuuuauucuuca

SEQ ID NO: 2835531 - RNA, 22 nt, Human
gcuuuauucuucagauacaaac

SEQ ID NO: 2835532 - RNA, 17 nt, Human
gcuuuggacccaaggaa

SEQ ID NO: 2835533 - RNA, 18 nt, Human
gcuuuggacccaaggaaa

SEQ ID NO: 2835534 - RNA, 19 nt, Human
gcuuuggacccaaggaaaa

SEQ ID NO: 2835535 - RNA, 13 nt, Human
gcuuuauuuuuua

SEQ ID NO: 2835536 - RNA, 17 nt, Human
gcuuuggauuugacauu

SEQ ID NO: 2835537 - RNA, 22 nt, Human
gcuuugggaauguuuuuagcug

SEQ ID NO: 2835538 - RNA, 14 nt, Human
gcuuuggccugagu

SEQ ID NO: 2835539 - RNA, 14 nt, Human
gcuuugggcugccc

SEQ ID NO: 2835540 - RNA, 12 nt, Human
ggcuuguuuauu

SEQ ID NO: 2835541 - RNA, 15 nt, Human
ggcuuguuuauuuug

SEQ ID NO: 2835542 - RNA, 15 nt, Human
ggcuuguuguaaagc

SEQ ID NO: 2835543 - RNA, 16 nt, Human
ggcuuguagaauuguu

SEQ ID NO: 2835544 - RNA, 19 nt, Human
ggcuuguagaauuguuaua

SEQ ID NO: 2835545 - RNA, 15 nt, Human
ggcuuuucucagcug

SEQ ID NO: 2835546 - RNA, 14 nt, Human
ggcuuuucucagcu

SEQ ID NO: 2835547 - RNA, 19 nt, Human
ggcuuuucacugcuggcug

SEQ ID NO: 2835548 - RNA, 22 nt, Human
ggcuuuucacugcuggcugccu

SEQ ID NO: 2835549 - RNA, 22 nt, Human
ggcuuucauuauuaguacugcu

SEQ ID NO: 2835550 - RNA, 13 nt, Human
ggcuuuccuugug

SEQ ID NO: 2835551 - RNA, 20 nt, Human
ggcuuuccuuguggcagagg

SEQ ID NO: 2835552 - RNA, 19 nt, Human
ggcuuucguccacagcuuc

SEQ ID NO: 2835553 - RNA, 20 nt, Human
ggcuuucguccacagcuucc

SEQ ID NO: 2835554 - RNA, 21 nt, Human
ggcuuucguccacagcuuccu

SEQ ID NO: 2835555 - RNA, 22 nt, Human
ggcuuucguccacagcuuccug

SEQ ID NO: 2835556 - RNA, 23 nt, Human
ggcuuucguccacagcuuccugu

SEQ ID NO: 2835557 - RNA, 15 nt, Human
ggcuuucucuuuucu

SEQ ID NO: 2835558 - RNA, 20 nt, Human
ggcuuuaugauaauagauuc

SEQ ID NO: 2835559 - RNA, 22 nt, Human
ggcuuuaugauaauagauucuc

SEQ ID NO: 2835560 - RNA, 19 nt, Human
ggcuuucagaaaacgggaa

SEQ ID NO: 2835561 - RNA, 12 nt, Human
ggcuuucagcuu

SEQ ID NO: 2835562 - RNA, 13 nt, Human
ggcuuucagcuua

SEQ ID NO: 2835563 - RNA, 14 nt, Human
ggcuuuucacugcu

SEQ ID NO: 2835564 - RNA, 13 nt, Human
ggcuuuucacugc

SEQ ID NO: 2835565 - RNA, 15 nt, Human
ggcuuuucacugcug

SEQ ID NO: 2835566 - RNA, 17 nt, Human
ggcuuuucacugcuggc

SEQ ID NO: 2835567 - RNA, 13 nt, Human
ggcuuacacccac

SEQ ID NO: 2835568 - RNA, 19 nt, Human
ggcuuaccugaccucuugc

SEQ ID NO: 2835569 - RNA, 22 nt, Human
ggcuuaccugaccucuugcugu

SEQ ID NO: 2835570 - RNA, 23 nt, Human
ggcuuaccugaccucuugcuguc

SEQ ID NO: 2835571 - RNA, 14 nt, Human
ggcuugaagcugug

SEQ ID NO: 2835572 - RNA, 15 nt, Human
ggcuugacucaggau

SEQ ID NO: 2835573 - RNA, 17 nt, Human
ggcuugacucaggauuu

SEQ ID NO: 2835574 - RNA, 13 nt, Human
ggcuugaagcugu

SEQ ID NO: 2835575 - RNA, 20 nt, Human
ggcuugagcccccgcgccca

SEQ ID NO: 2835576 - RNA, 21 nt, Human
ggcuugagaaauauggacacu

SEQ ID NO: 2835577 - RNA, 18 nt, Human
ggcuucuuuucuuuguau

SEQ ID NO: 2835578 - RNA, 23 nt, Human
ggcuuauauucaaccauggacuu

SEQ ID NO: 2835579 - RNA, 14 nt, Human
ggcuuauauucaac

SEQ ID NO: 2835580 - RNA, 23 nt, Human
ggcuuaguguuuuaaaacaccuc

SEQ ID NO: 2835581 - RNA, 16 nt, Human
ggcuuauccagcuggu

SEQ ID NO: 2835582 - RNA, 20 nt, Human
ggcuuauuuauuaacaggau

SEQ ID NO: 2835583 - RNA, 12 nt, Human
ggcuuauuuuaa

SEQ ID NO: 2835584 - RNA, 17 nt, Human
ggcuuauuuuaauguga

SEQ ID NO: 2835585 - RNA, 18 nt, Human
ggcuuauuuuaaugugau

SEQ ID NO: 2835586 - RNA, 20 nt, Human
ggcuuauuuuaaugugauga

SEQ ID NO: 2835587 - RNA, 21 nt, Human
ggcuuauuuuaaugugaugau

SEQ ID NO: 2835588 - RNA, 15 nt, Human
ggcuuauauucaacc

SEQ ID NO: 2835589 - RNA, 20 nt, Human
ggcuuauauucaaccaugga

SEQ ID NO: 2835590 - RNA, 21 nt, Human
ggcuuauauucaaccauggac

SEQ ID NO: 2835591 - RNA, 22 nt, Human
ggcuuauauucaaccauggacu

SEQ ID NO: 2835592 - RNA, 17 nt, Human
ggcugggcuucaguggc

SEQ ID NO: 2835593 - RNA, 13 nt, Human
ggcugggcuucag

SEQ ID NO: 2835594 - RNA, 15 nt, Human
ggcuuaaaacaacac

SEQ ID NO: 2835595 - RNA, 19 nt, Human
ggcuuaagaaaucuaguau

SEQ ID NO: 2835596 - RNA, 13 nt, Human
ggcuuaauaaaaa

SEQ ID NO: 2835597 - RNA, 14 nt, Human
ggcuuaauaaaaau

SEQ ID NO: 2835598 - RNA, 22 nt, Human
ggcuuaauaaaaaugacagacu

SEQ ID NO: 2835599 - RNA, 12 nt, Human
ggcugggcuuca

SEQ ID NO: 2835600 - RNA, 13 nt, Human
ggcugggcccccc

SEQ ID NO: 2835601 - RNA, 19 nt, Human
ggcugggccccccagcuca

SEQ ID NO: 2835602 - RNA, 21 nt, Human
ggcugggccccccagcucagg

SEQ ID NO: 2835603 - RNA, 22 nt, Human
ggcugggccccccagcucaggg

SEQ ID NO: 2835604 - RNA, 20 nt, Human
ggcugggccauguccaaaga

SEQ ID NO: 2835605 - RNA, 17 nt, Human
ggcugggccauguccaa

SEQ ID NO: 2835606 - RNA, 21 nt, Human
ggcugggccauguccaaagag

SEQ ID NO: 2835607 - RNA, 15 nt, Human
gggaauggcagcugc

SEQ ID NO: 2835608 - RNA, 17 nt, Human
gggaauuucuucaacuc

SEQ ID NO: 2835609 - RNA, 23 nt, Human
gggacaaggacuaggguccuggg

SEQ ID NO: 2835610 - RNA, 15 nt, Human
gggaaugauaugcau

SEQ ID NO: 2835611 - RNA, 12 nt, Human
gggacccugcuu

SEQ ID NO: 2835612 - RNA, 13 nt, Human
gggacccugcuuu

SEQ ID NO: 2835613 - RNA, 14 nt, Human
gggaccccugagcu

SEQ ID NO: 2835614 - RNA, 16 nt, Human
gggacucaaugcacug

SEQ ID NO: 2835615 - RNA, 17 nt, Human
gggacuacaggcaccca

SEQ ID NO: 2835616 - RNA, 16 nt, Human
gggaccucucccaggg

SEQ ID NO: 2835617 - RNA, 12 nt, Human
gggaccucuccc

SEQ ID NO: 2835618 - RNA, 14 nt, Human
gggacguuucucau

SEQ ID NO: 2835619 - RNA, 18 nt, Human
gggaaggcacagggagaa

SEQ ID NO: 2835620 - RNA, 22 nt, Human
gggaaggcagggagggccuggg

SEQ ID NO: 2835621 - RNA, 11 nt, Human
gggaaggccuc

SEQ ID NO: 2835622 - RNA, 15 nt, Human
gggaaggccugacuu

SEQ ID NO: 2835623 - RNA, 13 nt, Human
gggaaggccugac

SEQ ID NO: 2835624 - RNA, 14 nt, Human
gggaagggacacac

SEQ ID NO: 2835625 - RNA, 19 nt, Human
gggaagucccugggaggcc

SEQ ID NO: 2835626 - RNA, 14 nt, Human
gggaaguccucccu

SEQ ID NO: 2835627 - RNA, 21 nt, Human
gggaaucuaauauccccaaau

SEQ ID NO: 2835628 - RNA, 21 nt, Human
gggaaggugggguccuggagc

SEQ ID NO: 2835629 - RNA, 15 nt, Human
gggaaguaguccuug

SEQ ID NO: 2835630 - RNA, 16 nt, Human
gggaaguaguccuugg

SEQ ID NO: 2835631 - RNA, 19 nt, Human
gggaaggucaccagcacca

SEQ ID NO: 2835632 - RNA, 17 nt, Human
gggaaugccugagugcc

SEQ ID NO: 2835633 - RNA, 21 nt, Human
gggaaugccugagugccuggc

SEQ ID NO: 2835634 - RNA, 14 nt, Human
gggaaugagcccag

SEQ ID NO: 2835635 - RNA, 15 nt, Human
gggaaugagcccaga

SEQ ID NO: 2835636 - RNA, 16 nt, Human
gggaaugagcccagag

SEQ ID NO: 2835637 - RNA, 17 nt, Human
gggaaugagcccagaga

SEQ ID NO: 2835638 - RNA, 18 nt, Human
gggaaugagcccagagaa

SEQ ID NO: 2835639 - RNA, 21 nt, Human
gggaaugagcccagagaacag

SEQ ID NO: 2835640 - RNA, 22 nt, Human
gggaaugagcccagagaacagc

SEQ ID NO: 2835641 - RNA, 13 nt, Human
ggcuuuucuguuu

SEQ ID NO: 2835642 - RNA, 21 nt, Human
gggaagggggggcuacauuau

SEQ ID NO: 2835643 - RNA, 17 nt, Human
gggaagggucauagaaa

SEQ ID NO: 2835644 - RNA, 16 nt, Human
gggaaggguuugaauu

SEQ ID NO: 2835645 - RNA, 18 nt, Human
gggaaggggacccccgcc

SEQ ID NO: 2835646 - RNA, 14 nt, Human
gggaaggggcggug

SEQ ID NO: 2835647 - RNA, 23 nt, Human
ggcugcaaaggguaucaggugcu

SEQ ID NO: 2835648 - RNA, 22 nt, Human
ggcugcaaaggguaucaggugc

SEQ ID NO: 2835649 - RNA, 18 nt, Human
ggcugcaaaggguaucag

SEQ ID NO: 2835650 - RNA, 15 nt, Human
ggcugauggaguaaa

SEQ ID NO: 2835651 - RNA, 24 nt, Human
ggcugcaaaggguaucaggugcug

SEQ ID NO: 2835652 - RNA, 21 nt, Human
ggcugaguucuggucaaagaa

SEQ ID NO: 2835653 - RNA, 17 nt, Human
ggccccugcccggcugc

SEQ ID NO: 2835654 - RNA, 16 nt, Human
ggccccugcccggcug

SEQ ID NO: 2835655 - RNA, 20 nt, Human
ggccccugcccggcugcgga

SEQ ID NO: 2835656 - RNA, 16 nt, Human
ggcucuggacucuaaa

SEQ ID NO: 2835657 - RNA, 18 nt, Human
ggcucuggacucuaaaga

SEQ ID NO: 2835658 - RNA, 17 nt, Human
ggccccugcauccccuu

SEQ ID NO: 2835659 - RNA, 12 nt, Human
ggcucuggagac

SEQ ID NO: 2835660 - RNA, 15 nt, Human
ggcucuggagacagc

SEQ ID NO: 2835661 - RNA, 16 nt, Human
ggcucuggagacagcc

SEQ ID NO: 2835662 - RNA, 17 nt, Human
ggcucuggagacagccc

SEQ ID NO: 2835663 - RNA, 19 nt, Human
ggcucuggagacagcccca

SEQ ID NO: 2835664 - RNA, 21 nt, Human
ggcucuggagacagccccaga

SEQ ID NO: 2835665 - RNA, 14 nt, Human
ggcucuggagagaa

SEQ ID NO: 2835666 - RNA, 14 nt, Human
ggcugagggcagcu

SEQ ID NO: 2835667 - RNA, 15 nt, Human
ggcucuggagagaaa

SEQ ID NO: 2835668 - RNA, 14 nt, Human
ggcugagcccuggc

SEQ ID NO: 2835669 - RNA, 13 nt, Human
ggcugagcccugg

SEQ ID NO: 2835670 - RNA, 12 nt, Human
ggcugagcccug

SEQ ID NO: 2835671 - RNA, 16 nt, Human
ggcugagcccuggcag

SEQ ID NO: 2835672 - RNA, 15 nt, Human
ggcugagcccuggca

SEQ ID NO: 2835673 - RNA, 11 nt, Human
ggcugggccau

SEQ ID NO: 2835674 - RNA, 23 nt, Human
ggcuggaacagauucacacuguc

SEQ ID NO: 2835675 - RNA, 16 nt, Human
ggcuggaaggggucca

SEQ ID NO: 2835676 - RNA, 22 nt, Human
ggcuggaacagauucacacugu

SEQ ID NO: 2835677 - RNA, 13 nt, Human
ggcugcagggagu

SEQ ID NO: 2835678 - RNA, 12 nt, Human
ggcugcagggag

SEQ ID NO: 2835679 - RNA, 15 nt, Human
ggcugcagcuggaca

SEQ ID NO: 2835680 - RNA, 16 nt, Human
ggcugcagcuggacag

SEQ ID NO: 2835681 - RNA, 17 nt, Human
ggcugcagcuggacaga

SEQ ID NO: 2835682 - RNA, 18 nt, Human
ggcugcagcuggacagag

SEQ ID NO: 2835683 - RNA, 19 nt, Human
ggcugcagcuggacagagg

SEQ ID NO: 2835684 - RNA, 24 nt, Human
ggcugcagcuggacagaggggacu

SEQ ID NO: 2835685 - RNA, 12 nt, Human
ggcugcugccca

SEQ ID NO: 2835686 - RNA, 14 nt, Human
ggcugcugcccagg

SEQ ID NO: 2835687 - RNA, 22 nt, Human
ggcugcugggggcaacuggcca

SEQ ID NO: 2835688 - RNA, 11 nt, Human
ggcugcuggga

SEQ ID NO: 2835689 - RNA, 21 nt, Human
ggcugcuggggccucagacga

SEQ ID NO: 2835690 - RNA, 13 nt, Human
ggcugcuggccug

SEQ ID NO: 2835691 - RNA, 15 nt, Human
gggcccugcagaggg

SEQ ID NO: 2835692 - RNA, 11 nt, Human
gggcccugcau

SEQ ID NO: 2835693 - RNA, 12 nt, Human
gggcccugcaug

SEQ ID NO: 2835694 - RNA, 14 nt, Human
gggcccugcaugua

SEQ ID NO: 2835695 - RNA, 18 nt, Human
gggcccugcauguagugu

SEQ ID NO: 2835696 - RNA, 19 nt, Human
gggcccugcccuggcaggg

SEQ ID NO: 2835697 - RNA, 22 nt, Human
gggccccaaacgggcugcccug

SEQ ID NO: 2835698 - RNA, 11 nt, Human
gggcccagggg

SEQ ID NO: 2835699 - RNA, 14 nt, Human
gggccccagaggcu

SEQ ID NO: 2835700 - RNA, 13 nt, Human
gggcccaggcagg

SEQ ID NO: 2835701 - RNA, 13 nt, Human
gggcccaggaggg

SEQ ID NO: 2835702 - RNA, 11 nt, Human
gggccccagcu

SEQ ID NO: 2835703 - RNA, 15 nt, Human
gggccccccagcuca

SEQ ID NO: 2835704 - RNA, 22 nt, Human
gggccccccagcucaggggcag

SEQ ID NO: 2835705 - RNA, 23 nt, Human
gggccccccagcucaggggcagc

SEQ ID NO: 2835706 - RNA, 13 nt, Human
gggccccccugcc

SEQ ID NO: 2835707 - RNA, 17 nt, Human
gggccccccugcccugu

SEQ ID NO: 2835708 - RNA, 15 nt, Human
gggccccccugcccu

SEQ ID NO: 2835709 - RNA, 19 nt, Human
gggcagugcuagugagcug

SEQ ID NO: 2835710 - RNA, 23 nt, Human
gggcagugcuagugagcugggca

SEQ ID NO: 2835711 - RNA, 21 nt, Human
gggcagugggacccauagauc

SEQ ID NO: 2835712 - RNA, 22 nt, Human
gggcauagaugcaggugagccc

SEQ ID NO: 2835713 - RNA, 17 nt, Human
gggcauauccaccaccu

SEQ ID NO: 2835714 - RNA, 23 nt, Human
gggcauaucggcucacaaagaga

SEQ ID NO: 2835715 - RNA, 19 nt, Human
gggcauccauaccagcucg

SEQ ID NO: 2835716 - RNA, 20 nt, Human
gggcauccauaccagcucgc

SEQ ID NO: 2835717 - RNA, 14 nt, Human
gggcaucuauggga

SEQ ID NO: 2835718 - RNA, 19 nt, Human
gggcaucugccccuccccc

SEQ ID NO: 2835719 - RNA, 17 nt, Human
gggcaucugccccuccc

SEQ ID NO: 2835720 - RNA, 14 nt, Human
gggcaucugccccu

SEQ ID NO: 2835721 - RNA, 17 nt, Human
gggcaugcuggggcaag

SEQ ID NO: 2835722 - RNA, 14 nt, Human
gggcaugcuggggc

SEQ ID NO: 2835723 - RNA, 20 nt, Human
gggcaugccccggccaccuc

SEQ ID NO: 2835724 - RNA, 22 nt, Human
gggcaugccccggccaccucug

SEQ ID NO: 2835725 - RNA, 23 nt, Human
gggcaugccccggccaccucugc

SEQ ID NO: 2835726 - RNA, 13 nt, Human
gggcaugccuugu

SEQ ID NO: 2835727 - RNA, 14 nt, Human
gggcaugccuugug

SEQ ID NO: 2835728 - RNA, 20 nt, Human
gggcaucugccccuccccca

SEQ ID NO: 2835729 - RNA, 16 nt, Human
gggcaugccccggcca

SEQ ID NO: 2835730 - RNA, 20 nt, Human
gggcaugagcauuggauaca

SEQ ID NO: 2835731 - RNA, 22 nt, Human
gggcauggacguucggggcaug

SEQ ID NO: 2835732 - RNA, 20 nt, Human
gggcauggacguucggggca

SEQ ID NO: 2835733 - RNA, 15 nt, Human
gggcauggccaggug

SEQ ID NO: 2835734 - RNA, 17 nt, Human
gggcauggccagguggc

SEQ ID NO: 2835735 - RNA, 20 nt, Human
gggcauggccagguggccac

SEQ ID NO: 2835736 - RNA, 18 nt, Human
gggcaugguaccagcccu

SEQ ID NO: 2835737 - RNA, 19 nt, Human
gggcaugguaccagcccug

SEQ ID NO: 2835738 - RNA, 20 nt, Human
gggcaugguaccagcccugg

SEQ ID NO: 2835739 - RNA, 14 nt, Human
gggcaugugggcuu

SEQ ID NO: 2835740 - RNA, 13 nt, Human
gggcauugacaaa

SEQ ID NO: 2835741 - RNA, 16 nt, Human
gggccacagagaaagu

SEQ ID NO: 2835742 - RNA, 21 nt, Human
gggccaauucaauacaaacaa

SEQ ID NO: 2835743 - RNA, 17 nt, Human
gggccaagacuuggcaa

SEQ ID NO: 2835744 - RNA, 22 nt, Human
gggccaacuugagggcccagag

SEQ ID NO: 2835745 - RNA, 23 nt, Human
gggccaacuugagggcccagagc

SEQ ID NO: 2835746 - RNA, 21 nt, Human
gggcauuucuugcgagccucg

SEQ ID NO: 2835747 - RNA, 21 nt, Human
gggccaaauccgcucucuucc

SEQ ID NO: 2835748 - RNA, 22 nt, Human
gggccaaauccgcucucuuccu

SEQ ID NO: 2835749 - RNA, 23 nt, Human
gggccaaauccgcucucuuccug

SEQ ID NO: 2835750 - RNA, 13 nt, Human
gggccaaaaggaa

SEQ ID NO: 2835751 - RNA, 15 nt, Human
gggccaaaaggaaaa

SEQ ID NO: 2835752 - RNA, 17 nt, Human
gggccaaaaggaaaaag

SEQ ID NO: 2835753 - RNA, 23 nt, Human
gggccacagagaaaguacuucuc

SEQ ID NO: 2835754 - RNA, 13 nt, Human
gggccaccccucc

SEQ ID NO: 2835755 - RNA, 19 nt, Human
gggccaccaaagcugccca

SEQ ID NO: 2835756 - RNA, 20 nt, Human
gggccaccaggaucagccag

SEQ ID NO: 2835757 - RNA, 17 nt, Human
gggccaccaaagcugcc

SEQ ID NO: 2835758 - RNA, 16 nt, Human
gggccaccaaagcugc

SEQ ID NO: 2835759 - RNA, 14 nt, Human
gggccaccaaagcu

SEQ ID NO: 2835760 - RNA, 14 nt, Human
gggccaccccuccu

SEQ ID NO: 2835761 - RNA, 13 nt, Human
gggccaccugccu

SEQ ID NO: 2835762 - RNA, 14 nt, Human
gggccaccugccug

SEQ ID NO: 2835763 - RNA, 15 nt, Human
gggccaccugccugc

SEQ ID NO: 2835764 - RNA, 17 nt, Human
gggcccagagagggugg

SEQ ID NO: 2835765 - RNA, 23 nt, Human
gggcccaagacagaugccccaga

SEQ ID NO: 2835766 - RNA, 18 nt, Human
gggcccaaggcggccccu

SEQ ID NO: 2835767 - RNA, 19 nt, Human
gggcccaaggcggccccuc

SEQ ID NO: 2835768 - RNA, 19 nt, Human
gggcccaagacagaugccc

SEQ ID NO: 2835769 - RNA, 14 nt, Human
gggcccagauucua

SEQ ID NO: 2835770 - RNA, 13 nt, Human
gggcccagaucug

SEQ ID NO: 2835771 - RNA, 14 nt, Human
gggcccagaggcug

SEQ ID NO: 2835772 - RNA, 14 nt, Human
gggcccagagcagg

SEQ ID NO: 2835773 - RNA, 19 nt, Human
gggcccacgugguuggggc

SEQ ID NO: 2835774 - RNA, 12 nt, Human
gggcccagagca

SEQ ID NO: 2835775 - RNA, 15 nt, Human
gggcaccagccagcg

SEQ ID NO: 2835776 - RNA, 20 nt, Human
gggcacuuuaaaugaagcua

SEQ ID NO: 2835777 - RNA, 14 nt, Human
gggcacuucccugc

SEQ ID NO: 2835778 - RNA, 18 nt, Human
gggcacuucccugcugcc

SEQ ID NO: 2835779 - RNA, 20 nt, Human
gggcacucagaagacacuga

SEQ ID NO: 2835780 - RNA, 13 nt, Human
gggcacugguggc

SEQ ID NO: 2835781 - RNA, 16 nt, Human
gggcacugguggcccg

SEQ ID NO: 2835782 - RNA, 13 nt, Human
gggcacuggccca

SEQ ID NO: 2835783 - RNA, 14 nt, Human
gggcacuggcccag

SEQ ID NO: 2835784 - RNA, 15 nt, Human
gggcacuggcccagg

SEQ ID NO: 2835785 - RNA, 13 nt, Human
gggcaggggcugg

SEQ ID NO: 2835786 - RNA, 14 nt, Human
gggcagggugaccc

SEQ ID NO: 2835787 - RNA, 14 nt, Human
gggcagguggggug

SEQ ID NO: 2835788 - RNA, 21 nt, Human
gggcagguucugccugcuuug

SEQ ID NO: 2835789 - RNA, 19 nt, Human
gggcacucagaagacacug

SEQ ID NO: 2835790 - RNA, 16 nt, Human
gggcacucagaagaca

SEQ ID NO: 2835791 - RNA, 12 nt, Human
gggcacccaccc

SEQ ID NO: 2835792 - RNA, 20 nt, Human
gggcacccuguggcccuggc

SEQ ID NO: 2835793 - RNA, 19 nt, Human
gggcaccuauagucccagc

SEQ ID NO: 2835794 - RNA, 14 nt, Human
gggcaccggggccu

SEQ ID NO: 2835795 - RNA, 15 nt, Human
gggcacaguccagga

SEQ ID NO: 2835796 - RNA, 16 nt, Human
gggcacaguccaggaa

SEQ ID NO: 2835797 - RNA, 23 nt, Human
gggcacaccgggcacucagaaga

SEQ ID NO: 2835798 - RNA, 15 nt, Human
gggcacacgccuccc

SEQ ID NO: 2835799 - RNA, 12 nt, Human
gggcacacacug

SEQ ID NO: 2835800 - RNA, 13 nt, Human
gggcacacacugu

SEQ ID NO: 2835801 - RNA, 19 nt, Human
gggcacacgccucccacug

SEQ ID NO: 2835802 - RNA, 15 nt, Human
gggcacagcaucugu

SEQ ID NO: 2835803 - RNA, 13 nt, Human
gggcacacucugc

SEQ ID NO: 2835804 - RNA, 15 nt, Human
gggcacacucugcca

SEQ ID NO: 2835805 - RNA, 22 nt, Human
gggcacacucugccagcaaaga

SEQ ID NO: 2835806 - RNA, 14 nt, Human
gggagugagcuggu

SEQ ID NO: 2835807 - RNA, 11 nt, Human
gggagugagcu

SEQ ID NO: 2835808 - RNA, 18 nt, Human
gggagugacagaggcagc

SEQ ID NO: 2835809 - RNA, 20 nt, Human
gggagguggagguugcauug

SEQ ID NO: 2835810 - RNA, 11 nt, Human
gggagugggug

SEQ ID NO: 2835811 - RNA, 22 nt, Human
gggaguugucaagucucugcug

SEQ ID NO: 2835812 - RNA, 15 nt, Human
gggauaaaaugacua

SEQ ID NO: 2835813 - RNA, 20 nt, Human
gggauaacccuacacccaga

SEQ ID NO: 2835814 - RNA, 22 nt, Human
gggauacaaccucccucuuguu

SEQ ID NO: 2835815 - RNA, 16 nt, Human
gggaggugaccccagg

SEQ ID NO: 2835816 - RNA, 19 nt, Human
gggacugaaaaccucuccu

SEQ ID NO: 2835817 - RNA, 18 nt, Human
gggacugaaaaccucucc

SEQ ID NO: 2835818 - RNA, 17 nt, Human
gggacucagcccugagg

SEQ ID NO: 2835819 - RNA, 16 nt, Human
gggacucagcccugag

SEQ ID NO: 2835820 - RNA, 15 nt, Human
gggacuagccccugu

SEQ ID NO: 2835821 - RNA, 20 nt, Human
gggacucugaagccucuggg

SEQ ID NO: 2835822 - RNA, 19 nt, Human
gggacucugagcgggaggc

SEQ ID NO: 2835823 - RNA, 21 nt, Human
gggacucugagcgggaggcag

SEQ ID NO: 2835824 - RNA, 22 nt, Human
gggacucugagcgggaggcaga

SEQ ID NO: 2835825 - RNA, 23 nt, Human
gggacucugagcgggaggcagag

SEQ ID NO: 2835826 - RNA, 19 nt, Human
gggacucugaagccucugg

SEQ ID NO: 2835827 - RNA, 20 nt, Human
gggcaacccccagccugcua

SEQ ID NO: 2835828 - RNA, 19 nt, Human
gggaucccugucuuuccua

SEQ ID NO: 2835829 - RNA, 11 nt, Human
gggaugaaaga

SEQ ID NO: 2835830 - RNA, 15 nt, Human
gggaugaaagagaag

SEQ ID NO: 2835831 - RNA, 14 nt, Human
gggcaaggaaaaag

SEQ ID NO: 2835832 - RNA, 16 nt, Human
gggcaaggaaaaagaa

SEQ ID NO: 2835833 - RNA, 20 nt, Human
gggcaaggaaaaagaaaaua

SEQ ID NO: 2835834 - RNA, 24 nt, Human
gggcaagucccugacucucuguga

SEQ ID NO: 2835835 - RNA, 22 nt, Human
gggcaagucuuuaggucuuugu

SEQ ID NO: 2835836 - RNA, 15 nt, Human
gggcacaaagggccc

SEQ ID NO: 2835837 - RNA, 17 nt, Human
gggcaauuggaacaaag

SEQ ID NO: 2835838 - RNA, 17 nt, Human
gggcacaaagggcccag

SEQ ID NO: 2835839 - RNA, 21 nt, Human
gggcacaacugcaauaacuuc

SEQ ID NO: 2835840 - RNA, 16 nt, Human
gggcacaaagggccca

SEQ ID NO: 2835841 - RNA, 23 nt, Human
gggaucaaaguucugcuuucucc

SEQ ID NO: 2835842 - RNA, 18 nt, Human
gggaucaucaugcagcuc

SEQ ID NO: 2835843 - RNA, 13 nt, Human
gggaucaugaaag

SEQ ID NO: 2835844 - RNA, 17 nt, Human
gggaucacaggugucag

SEQ ID NO: 2835845 - RNA, 13 nt, Human
gggauagagagag

SEQ ID NO: 2835846 - RNA, 13 nt, Human
gggauacugcagg

SEQ ID NO: 2835847 - RNA, 18 nt, Human
ggugccuuucaaauuuag

SEQ ID NO: 2835848 - RNA, 19 nt, Human
ggugccuuucaaauuuaga

SEQ ID NO: 2835849 - RNA, 15 nt, Human
ggugcuacgccugca

SEQ ID NO: 2835850 - RNA, 16 nt, Human
ggugagaggggaacag

SEQ ID NO: 2835851 - RNA, 14 nt, Human
ggugagaugcugga

SEQ ID NO: 2835852 - RNA, 17 nt, Human
ggugagaugcuggagaa

SEQ ID NO: 2835853 - RNA, 21 nt, Human
ggugagaugcuggagaagaga

SEQ ID NO: 2835854 - RNA, 22 nt, Human
ggugagaugcuggagaagagag

SEQ ID NO: 2835855 - RNA, 23 nt, Human
ggugagaugcuggagaagagagg

SEQ ID NO: 2835856 - RNA, 21 nt, Human
ggugagaauugggcggcucug

SEQ ID NO: 2835857 - RNA, 13 nt, Human
ggugaggagcaca

SEQ ID NO: 2835858 - RNA, 22 nt, Human
ggugagcccauggcccucccag

SEQ ID NO: 2835859 - RNA, 19 nt, Human
ggugagcagaaguggagcu

SEQ ID NO: 2835860 - RNA, 19 nt, Human
ggugagcccauggcccucc

SEQ ID NO: 2835861 - RNA, 20 nt, Human
ggugccuucuucagggccug

SEQ ID NO: 2835862 - RNA, 17 nt, Human
ggugccugucccacccc

SEQ ID NO: 2835863 - RNA, 13 nt, Human
ggugccuguccca

SEQ ID NO: 2835864 - RNA, 12 nt, Human
gguggccucggg

SEQ ID NO: 2835865 - RNA, 22 nt, Human
gguggccucgggacaccugccc

SEQ ID NO: 2835866 - RNA, 16 nt, Human
gguggcggccccagca

SEQ ID NO: 2835867 - RNA, 19 nt, Human
gguggcgggcaccuauagu

SEQ ID NO: 2835868 - RNA, 19 nt, Human
gguggcgggugccuguaau

SEQ ID NO: 2835869 - RNA, 23 nt, Human
gguggccucuccuuguggccugg

SEQ ID NO: 2835870 - RNA, 23 nt, Human
gguggccacuccagaccccuggc

SEQ ID NO: 2835871 - RNA, 21 nt, Human
gguggcaugcaccugcaaucc

SEQ ID NO: 2835872 - RNA, 20 nt, Human
gguggccacuccagaccccu

SEQ ID NO: 2835873 - RNA, 21 nt, Human
gguggccacuccagaccccug

SEQ ID NO: 2835874 - RNA, 22 nt, Human
gguggccacuccagaccccugg

SEQ ID NO: 2835875 - RNA, 16 nt, Human
gguggcagugggagcu

SEQ ID NO: 2835876 - RNA, 15 nt, Human
gguggcauacgccug

SEQ ID NO: 2835877 - RNA, 22 nt, Human
gguggcagugggagcugccugu

SEQ ID NO: 2835878 - RNA, 19 nt, Human
gguggcagugggagcugcc

SEQ ID NO: 2835879 - RNA, 21 nt, Human
ggugcugccauccagguucag

SEQ ID NO: 2835880 - RNA, 15 nt, Human
ggugcugccauccag

SEQ ID NO: 2835881 - RNA, 22 nt, Human
ggugcugaguagaugcgcagcc

SEQ ID NO: 2835882 - RNA, 12 nt, Human
ggugagaaaaaa

SEQ ID NO: 2835883 - RNA, 23 nt, Human
ggugagaaaccuguaucuuucua

SEQ ID NO: 2835884 - RNA, 16 nt, Human
ggugacgguugggagc

SEQ ID NO: 2835885 - RNA, 12 nt, Human
ggugacggcccu

SEQ ID NO: 2835886 - RNA, 19 nt, Human
ggugacggcccucaucuau

SEQ ID NO: 2835887 - RNA, 22 nt, Human
ggugacugguuaucacaccauc

SEQ ID NO: 2835888 - RNA, 19 nt, Human
ggugacuucacagugaagu

SEQ ID NO: 2835889 - RNA, 15 nt, Human
ggugacaugugaaac

SEQ ID NO: 2835890 - RNA, 18 nt, Human
ggugacaugugaaaccuu

SEQ ID NO: 2835891 - RNA, 21 nt, Human
ggugaccucugccugaaguca

SEQ ID NO: 2835892 - RNA, 14 nt, Human
ggucugacccacug

SEQ ID NO: 2835893 - RNA, 13 nt, Human
ggucugccaggcc

SEQ ID NO: 2835894 - RNA, 14 nt, Human
ggucugccaggccc

SEQ ID NO: 2835895 - RNA, 15 nt, Human
ggucugccaggcccc

SEQ ID NO: 2835896 - RNA, 17 nt, Human
ggucugccaggccccca

SEQ ID NO: 2835897 - RNA, 21 nt, Human
ggugacagagugagacucugu

SEQ ID NO: 2835898 - RNA, 12 nt, Human
ggugacaguggc

SEQ ID NO: 2835899 - RNA, 14 nt, Human
ggugacaugugaaa

SEQ ID NO: 2835900 - RNA, 17 nt, Human
ggugacagcagucgguu

SEQ ID NO: 2835901 - RNA, 12 nt, Human
ggugacagucau

SEQ ID NO: 2835902 - RNA, 18 nt, Human
ggugacagucaucaucag

SEQ ID NO: 2835903 - RNA, 19 nt, Human
ggugacagucaucaucagg

SEQ ID NO: 2835904 - RNA, 20 nt, Human
ggugacagucaucaucaggg

SEQ ID NO: 2835905 - RNA, 21 nt, Human
ggugacagucaucaucagggc

SEQ ID NO: 2835906 - RNA, 22 nt, Human
ggugacagucaucaucagggcc

SEQ ID NO: 2835907 - RNA, 23 nt, Human
ggugacagucaucaucagggccu

SEQ ID NO: 2835908 - RNA, 13 nt, Human
ggucuauuccagc

SEQ ID NO: 2835909 - RNA, 14 nt, Human
ggucuauuccagcu

SEQ ID NO: 2835910 - RNA, 15 nt, Human
ggucuauuccagcuc

SEQ ID NO: 2835911 - RNA, 16 nt, Human
ggucuauuccagcuca

SEQ ID NO: 2835912 - RNA, 17 nt, Human
ggucuauuccagcucau

SEQ ID NO: 2835913 - RNA, 18 nt, Human
ggucuauuccagcucauu

SEQ ID NO: 2835914 - RNA, 20 nt, Human
ggucuauuccagcucauuca

SEQ ID NO: 2835915 - RNA, 17 nt, Human
ggucucaaacuccugac

SEQ ID NO: 2835916 - RNA, 14 nt, Human
ggucagguuuaaca

SEQ ID NO: 2835917 - RNA, 15 nt, Human
ggucagguuuaacau

SEQ ID NO: 2835918 - RNA, 17 nt, Human
ggucagguuuaacauuu

SEQ ID NO: 2835919 - RNA, 18 nt, Human
ggucucacaguguugccc

SEQ ID NO: 2835920 - RNA, 23 nt, Human
ggucucaaacuccugggcucagg

SEQ ID NO: 2835921 - RNA, 21 nt, Human
ggucucaaacuccugggcuca

SEQ ID NO: 2835922 - RNA, 23 nt, Human
ggucucacucugucgcccagucu

SEQ ID NO: 2835923 - RNA, 22 nt, Human
ggucucacucugucgcccaguc

SEQ ID NO: 2835924 - RNA, 21 nt, Human
ggucucacaguguugcccagg

SEQ ID NO: 2835925 - RNA, 20 nt, Human
ggucucacaguguugcccag

SEQ ID NO: 2835926 - RNA, 19 nt, Human
ggucucacaguguugccca

SEQ ID NO: 2835927 - RNA, 21 nt, Human
ggucucgcuuuguugcccagg

SEQ ID NO: 2835928 - RNA, 20 nt, Human
ggucucgcuuuguugcccag

SEQ ID NO: 2835929 - RNA, 19 nt, Human
ggucucgcuuuguugccca

SEQ ID NO: 2835930 - RNA, 15 nt, Human
ggucucuaggcuggg

SEQ ID NO: 2835931 - RNA, 16 nt, Human
ggucucuaggcugggg

SEQ ID NO: 2835932 - RNA, 17 nt, Human
ggucucuaggcugggga

SEQ ID NO: 2835933 - RNA, 16 nt, Human
ggucucccacguggga

SEQ ID NO: 2835934 - RNA, 18 nt, Human
ggucucaggcugguggga

SEQ ID NO: 2835935 - RNA, 21 nt, Human
ggucucaggauauccuuauca

SEQ ID NO: 2835936 - RNA, 22 nt, Human
ggucucaggauauccuuaucag

SEQ ID NO: 2835937 - RNA, 20 nt, Human
ggucucuuacuuuccuuucc

SEQ ID NO: 2835938 - RNA, 14 nt, Human
ggucucuucuccca

SEQ ID NO: 2835939 - RNA, 15 nt, Human
ggucucuucucccag

SEQ ID NO: 2835940 - RNA, 16 nt, Human
ggucucuucucccaga

SEQ ID NO: 2835941 - RNA, 17 nt, Human
ggucucuucucccagaa

SEQ ID NO: 2835942 - RNA, 10 nt, Human
ggucucuuuu

SEQ ID NO: 2835943 - RNA, 20 nt, Human
ggucucuuuuguaaauuaaa

SEQ ID NO: 2835944 - RNA, 12 nt, Human
ggucucugcugc

SEQ ID NO: 2835945 - RNA, 16 nt, Human
ggucucucccucaggu

SEQ ID NO: 2835946 - RNA, 17 nt, Human
ggucucucccucaggug

SEQ ID NO: 2835947 - RNA, 13 nt, Human
ggucucugcugcc

SEQ ID NO: 2835948 - RNA, 14 nt, Human
ggucucugcugccg

SEQ ID NO: 2835949 - RNA, 10 nt, Human
ggucucuggu

SEQ ID NO: 2835950 - RNA, 19 nt, Human
ggucucuguugacuggcug

SEQ ID NO: 2835951 - RNA, 19 nt, Human
ggucucucucucucuacaa

SEQ ID NO: 2835952 - RNA, 20 nt, Human
ggucucugcauuuuucugca

SEQ ID NO: 2835953 - RNA, 22 nt, Human
ggucucugcauuuuucugcaga

SEQ ID NO: 2835954 - RNA, 23 nt, Human
ggucucugcauuuuucugcagaa

SEQ ID NO: 2835955 - RNA, 18 nt, Human
ggucucuaggcuggggaa

SEQ ID NO: 2835956 - RNA, 14 nt, Human
ggucucuauuucau

SEQ ID NO: 2835957 - RNA, 14 nt, Human
gguuaucucugugu

SEQ ID NO: 2835958 - RNA, 17 nt, Human
gguuaucgaaauaacaa

SEQ ID NO: 2835959 - RNA, 15 nt, Human
gguuauaguaacauc

SEQ ID NO: 2835960 - RNA, 22 nt, Human
gguuaguggauggaaggggcug

SEQ ID NO: 2835961 - RNA, 21 nt, Human
gguuaguggauggaaggggcu

SEQ ID NO: 2835962 - RNA, 20 nt, Human
gguuaggaguucgagaccag

SEQ ID NO: 2835963 - RNA, 18 nt, Human
gguuagauguugccaugu

SEQ ID NO: 2835964 - RNA, 18 nt, Human
gguuagauucaaggcccc

SEQ ID NO: 2835965 - RNA, 13 nt, Human
gguuagauguugc

SEQ ID NO: 2835966 - RNA, 14 nt, Human
gguuaaauacugug

SEQ ID NO: 2835967 - RNA, 17 nt, Human
gguuagcagagcuggac

SEQ ID NO: 2835968 - RNA, 16 nt, Human
gguuacagagaccuau

SEQ ID NO: 2835969 - RNA, 22 nt, Human
gguuacaguaugcuugcucuaa

SEQ ID NO: 2835970 - RNA, 21 nt, Human
gguuaagcauuaccacucagg

SEQ ID NO: 2835971 - RNA, 17 nt, Human
gguuaaucuuuccugau

SEQ ID NO: 2835972 - RNA, 22 nt, Human
gguuaauuuuuacauggagaaa

SEQ ID NO: 2835973 - RNA, 21 nt, Human
gguuaaaacuguacauuuaaa

SEQ ID NO: 2835974 - RNA, 22 nt, Human
gguuaaaacuguacauuuaaaa

SEQ ID NO: 2835975 - RNA, 13 nt, Human
gguguuuucugug

SEQ ID NO: 2835976 - RNA, 17 nt, Human
gguguuuucuguguaac

SEQ ID NO: 2835977 - RNA, 23 nt, Human
gguuaaaaaaaggcauuguuuga

SEQ ID NO: 2835978 - RNA, 20 nt, Human
gguuaaaaaaauggcaguga

SEQ ID NO: 2835979 - RNA, 22 nt, Human
gguguuuuucuuguaaaugugu

SEQ ID NO: 2835980 - RNA, 19 nt, Human
gguguuuuuuaugaagugc

SEQ ID NO: 2835981 - RNA, 22 nt, Human
gguguuuuuuaugaagugcgug

SEQ ID NO: 2835982 - RNA, 24 nt, Human
gguuauuucucaacaaagcacagu

SEQ ID NO: 2835983 - RNA, 17 nt, Human
gguuauguaucagaaga

SEQ ID NO: 2835984 - RNA, 22 nt, Human
gguuauguguaugugccauuua

SEQ ID NO: 2835985 - RNA, 20 nt, Human
gguuauugaaaauaugaugu

SEQ ID NO: 2835986 - RNA, 15 nt, Human
gguuaucugucccag

SEQ ID NO: 2835987 - RNA, 12 nt, Human
gguuaugaaaga

SEQ ID NO: 2835988 - RNA, 21 nt, Human
gguuaugaaagaauauauuua

SEQ ID NO: 2835989 - RNA, 23 nt, Human
gguuaucgaaauaacaauguuaa

SEQ ID NO: 2835990 - RNA, 15 nt, Human
gguucacuaaagcag

SEQ ID NO: 2835991 - RNA, 20 nt, Human
gguucacgugcagcucaagg

SEQ ID NO: 2835992 - RNA, 22 nt, Human
gguugauaguuuaccugaauaa

SEQ ID NO: 2835993 - RNA, 13 nt, Human
gguugauuaaggc

SEQ ID NO: 2835994 - RNA, 20 nt, Human
gguugauuaaggcaguacaa

SEQ ID NO: 2835995 - RNA, 19 nt, Human
gguugaggggcuccuggaa

SEQ ID NO: 2835996 - RNA, 18 nt, Human
gguugaggggcuccugga

SEQ ID NO: 2835997 - RNA, 23 nt, Human
gguugagaauggaaaccacaacu

SEQ ID NO: 2835998 - RNA, 16 nt, Human
gguugacuuucaggua

SEQ ID NO: 2835999 - RNA, 14 nt, Human
gguucuuucuuccu

SEQ ID NO: 2836000 - RNA, 16 nt, Human
gguucuuucuuccucu

SEQ ID NO: 2836001 - RNA, 16 nt, Human
gguguaugguucugug

SEQ ID NO: 2836002 - RNA, 17 nt, Human
ggugucaagagggucug

SEQ ID NO: 2836003 - RNA, 19 nt, Human
ggugucaagagggucugag

SEQ ID NO: 2836004 - RNA, 11 nt, Human
ggugucacccc

SEQ ID NO: 2836005 - RNA, 13 nt, Human
ggugucaccccag

SEQ ID NO: 2836006 - RNA, 14 nt, Human
ggugucaccccaga

SEQ ID NO: 2836007 - RNA, 15 nt, Human
ggugucaccccagag

SEQ ID NO: 2836008 - RNA, 16 nt, Human
ggugucaccccagagc

SEQ ID NO: 2836009 - RNA, 17 nt, Human
ggugucaccccagagcc

SEQ ID NO: 2836010 - RNA, 21 nt, Human
ggugucaccccagagccacac

SEQ ID NO: 2836011 - RNA, 22 nt, Human
ggugucaccccagagccacaca

SEQ ID NO: 2836012 - RNA, 13 nt, Human
gguguauuuaaac

SEQ ID NO: 2836013 - RNA, 16 nt, Human
gguguauuuaaacuau

SEQ ID NO: 2836014 - RNA, 19 nt, Human
ggugucaccugaagacuca

SEQ ID NO: 2836015 - RNA, 19 nt, Human
ggugucacauggugccccu

SEQ ID NO: 2836016 - RNA, 13 nt, Human
ggugucacugucc

SEQ ID NO: 2836017 - RNA, 14 nt, Human
ggugucacuguccc

SEQ ID NO: 2836018 - RNA, 20 nt, Human
ggugucacugucccuccugg

SEQ ID NO: 2836019 - RNA, 21 nt, Human
ggugucacugucccuccuggu

SEQ ID NO: 2836020 - RNA, 20 nt, Human
ggugucagccauugcaccca

SEQ ID NO: 2836021 - RNA, 17 nt, Human
ggugucaguauccaggc

SEQ ID NO: 2836022 - RNA, 14 nt, Human
ggugucauuucauu

SEQ ID NO: 2836023 - RNA, 17 nt, Human
ggugucauuucauucca

SEQ ID NO: 2836024 - RNA, 18 nt, Human
ggugucauuucauuccau

SEQ ID NO: 2836025 - RNA, 12 nt, Human
gguguagccagg

SEQ ID NO: 2836026 - RNA, 18 nt, Human
gguguaauaagacauaac

SEQ ID NO: 2836027 - RNA, 15 nt, Human
gguguaauaagacau

SEQ ID NO: 2836028 - RNA, 16 nt, Human
gguguaauaagacaua

SEQ ID NO: 2836029 - RNA, 14 nt, Human
gguguaauaagaca

SEQ ID NO: 2836030 - RNA, 15 nt, Human
gguggugaccucugc

SEQ ID NO: 2836031 - RNA, 14 nt, Human
gguggugaccucug

SEQ ID NO: 2836032 - RNA, 16 nt, Human
gguggugaccucugcc

SEQ ID NO: 2836033 - RNA, 13 nt, Human
ggugguggagcca

SEQ ID NO: 2836034 - RNA, 20 nt, Human
gguggugggaaccaugaaga

SEQ ID NO: 2836035 - RNA, 19 nt, Human
gguggcucacgccuguaau

SEQ ID NO: 2836036 - RNA, 19 nt, Human
gguggcucacaccuguaau

SEQ ID NO: 2836037 - RNA, 14 nt, Human
ggugggguccugga

SEQ ID NO: 2836038 - RNA, 23 nt, Human
ggugggguccuggagcagaccac

SEQ ID NO: 2836039 - RNA, 12 nt, Human
ggugggugcuca

SEQ ID NO: 2836040 - RNA, 13 nt, Human
ggugggugcucag

SEQ ID NO: 2836041 - RNA, 14 nt, Human
ggugggugcucaga

SEQ ID NO: 2836042 - RNA, 16 nt, Human
ggugguacccucugga

SEQ ID NO: 2836043 - RNA, 21 nt, Human
ggggauuuccagccagggcug

SEQ ID NO: 2836044 - RNA, 13 nt, Human
ggggaggggaagu

SEQ ID NO: 2836045 - RNA, 18 nt, Human
ggggaggggcugugggcg

SEQ ID NO: 2836046 - RNA, 16 nt, Human
ggggaggcggcacucc

SEQ ID NO: 2836047 - RNA, 18 nt, Human
ggggaggcggcacuccaa

SEQ ID NO: 2836048 - RNA, 14 nt, Human
ggggaaaaaaaugu

SEQ ID NO: 2836049 - RNA, 19 nt, Human
ggggaggaucacuggagcc

SEQ ID NO: 2836050 - RNA, 13 nt, Human
gggcuugugaaca

SEQ ID NO: 2836051 - RNA, 19 nt, Human
gggcuuucguccacagcuu

SEQ ID NO: 2836052 - RNA, 15 nt, Human
gggcuuucuggagag

SEQ ID NO: 2836053 - RNA, 15 nt, Human
gggcuuugugugaag

SEQ ID NO: 2836054 - RNA, 20 nt, Human
gggcuuugugugaaggcaga

SEQ ID NO: 2836055 - RNA, 14 nt, Human
gggcuuucuggaga

SEQ ID NO: 2836056 - RNA, 13 nt, Human
gggccuggggccu

SEQ ID NO: 2836057 - RNA, 14 nt, Human
gggccuggggccug

SEQ ID NO: 2836058 - RNA, 16 nt, Human
gggccuggggccugag

SEQ ID NO: 2836059 - RNA, 17 nt, Human
gggccuggggccugaga

SEQ ID NO: 2836060 - RNA, 18 nt, Human
gggccuggggccugagag

SEQ ID NO: 2836061 - RNA, 19 nt, Human
gggccuggggccugagaga

SEQ ID NO: 2836062 - RNA, 11 nt, Human
gggccugggcc

SEQ ID NO: 2836063 - RNA, 14 nt, Human
ggggcaucugcccc

SEQ ID NO: 2836064 - RNA, 13 nt, Human
ggggcaguggcaa

SEQ ID NO: 2836065 - RNA, 13 nt, Human
ggggcguccaggc

SEQ ID NO: 2836066 - RNA, 17 nt, Human
ggggcacaguccaggaa

SEQ ID NO: 2836067 - RNA, 19 nt, Human
ggggcacaguccaggaaca

SEQ ID NO: 2836068 - RNA, 14 nt, Human
ggggcucuggagag

SEQ ID NO: 2836069 - RNA, 16 nt, Human
ggggcucuggagagaa

SEQ ID NO: 2836070 - RNA, 17 nt, Human
ggggcucuggagagaaa

SEQ ID NO: 2836071 - RNA, 13 nt, Human
ggggcucuggaga

SEQ ID NO: 2836072 - RNA, 16 nt, Human
ggggcucucagcucag

SEQ ID NO: 2836073 - RNA, 20 nt, Human
ggggcucucagcucagcgcc

SEQ ID NO: 2836074 - RNA, 22 nt, Human
ggggcucuaggguugcuggagc

SEQ ID NO: 2836075 - RNA, 23 nt, Human
ggggcucuaggguugcuggagcc

SEQ ID NO: 2836076 - RNA, 21 nt, Human
ggggcuccuggaaaggcucag

SEQ ID NO: 2836077 - RNA, 14 nt, Human
ggggcuacaagagg

SEQ ID NO: 2836078 - RNA, 15 nt, Human
ggggcuacaagaggg

SEQ ID NO: 2836079 - RNA, 17 nt, Human
ggggcgugaggucccag

SEQ ID NO: 2836080 - RNA, 16 nt, Human
ggggcuacaagaggga

SEQ ID NO: 2836081 - RNA, 17 nt, Human
ggggcuacaagagggaa

SEQ ID NO: 2836082 - RNA, 13 nt, Human
ggggcuccuggaa

SEQ ID NO: 2836083 - RNA, 12 nt, Human
ggggcuccugga

SEQ ID NO: 2836084 - RNA, 11 nt, Human
ggggcuccugg

SEQ ID NO: 2836085 - RNA, 19 nt, Human
gggguuucgcagccugagu

SEQ ID NO: 2836086 - RNA, 18 nt, Human
gggguuugccauuugaua

SEQ ID NO: 2836087 - RNA, 13 nt, Human
ggguaaacugugg

SEQ ID NO: 2836088 - RNA, 13 nt, Human
ggguaagagagga

SEQ ID NO: 2836089 - RNA, 16 nt, Human
ggguaaggcccccucu

SEQ ID NO: 2836090 - RNA, 16 nt, Human
ggguaagggauuucuu

SEQ ID NO: 2836091 - RNA, 20 nt, Human
ggguaagggauuucuuaggg

SEQ ID NO: 2836092 - RNA, 21 nt, Human
ggguaagggauuucuuagggg

SEQ ID NO: 2836093 - RNA, 20 nt, Human
gggguguuugggaggcugcg

SEQ ID NO: 2836094 - RNA, 16 nt, Human
gggguguuaauuuaug

SEQ ID NO: 2836095 - RNA, 13 nt, Human
ggggugucuuuuu

SEQ ID NO: 2836096 - RNA, 19 nt, Human
gggguguggcuccuuccca

SEQ ID NO: 2836097 - RNA, 15 nt, Human
gggguuaucucugug

SEQ ID NO: 2836098 - RNA, 13 nt, Human
gggguuaugugga

SEQ ID NO: 2836099 - RNA, 17 nt, Human
gggguuggggugacagu

SEQ ID NO: 2836100 - RNA, 15 nt, Human
gggguuguguuguca

SEQ ID NO: 2836101 - RNA, 14 nt, Human
gggucucacucugu

SEQ ID NO: 2836102 - RNA, 12 nt, Human
gggucucacucu

SEQ ID NO: 2836103 - RNA, 21 nt, Human
gggucugaggaauccagaccc

SEQ ID NO: 2836104 - RNA, 12 nt, Human
gggucugaggaa

SEQ ID NO: 2836105 - RNA, 12 nt, Human
gggucucugcug

SEQ ID NO: 2836106 - RNA, 13 nt, Human
gggucucugcugc

SEQ ID NO: 2836107 - RNA, 14 nt, Human
gggucucucccuca

SEQ ID NO: 2836108 - RNA, 17 nt, Human
gggucucucccucaggu

SEQ ID NO: 2836109 - RNA, 18 nt, Human
gggucucucccucaggug

SEQ ID NO: 2836110 - RNA, 14 nt, Human
gggucucugcugcc

SEQ ID NO: 2836111 - RNA, 15 nt, Human
gggucucugcugccg

SEQ ID NO: 2836112 - RNA, 18 nt, Human
gggucucugcugccgccc

SEQ ID NO: 2836113 - RNA, 17 nt, Human
gggucucuuuuguaaau

SEQ ID NO: 2836114 - RNA, 21 nt, Human
gggucucuuuuguaaauuaaa

SEQ ID NO: 2836115 - RNA, 23 nt, Human
gggucugggcggcgggcggcugg

SEQ ID NO: 2836116 - RNA, 16 nt, Human
gggggacuagccccug

SEQ ID NO: 2836117 - RNA, 20 nt, Human
gggggacucugagcgggagg

SEQ ID NO: 2836118 - RNA, 21 nt, Human
gggggacucugagcgggaggc

SEQ ID NO: 2836119 - RNA, 19 nt, Human
gggggacugcugcugccug

SEQ ID NO: 2836120 - RNA, 18 nt, Human
ggggcucuggagagaaac

SEQ ID NO: 2836121 - RNA, 17 nt, Human
gggguggccugcaguga

SEQ ID NO: 2836122 - RNA, 13 nt, Human
gggguggccugug

SEQ ID NO: 2836123 - RNA, 15 nt, Human
gggguggccugugug

SEQ ID NO: 2836124 - RNA, 11 nt, Human
ggggugcugcc

SEQ ID NO: 2836125 - RNA, 12 nt, Human
ggucaccuuguu

SEQ ID NO: 2836126 - RNA, 19 nt, Human
ggucagaagaguugugcac

SEQ ID NO: 2836127 - RNA, 14 nt, Human
ggucaggcagccag

SEQ ID NO: 2836128 - RNA, 17 nt, Human
ggucaggcagccaguga

SEQ ID NO: 2836129 - RNA, 19 nt, Human
ggucaggcagccagugaga

SEQ ID NO: 2836130 - RNA, 11 nt, Human
ggucagagccu

SEQ ID NO: 2836131 - RNA, 13 nt, Human
ggucaggcccugg

SEQ ID NO: 2836132 - RNA, 14 nt, Human
ggucaggcccugga

SEQ ID NO: 2836133 - RNA, 16 nt, Human
ggucaggcccuggaac

SEQ ID NO: 2836134 - RNA, 17 nt, Human
ggucaggcccuggaacu

SEQ ID NO: 2836135 - RNA, 18 nt, Human
ggucaggcccuggaacuc

SEQ ID NO: 2836136 - RNA, 14 nt, Human
ggucaggcccuggu

SEQ ID NO: 2836137 - RNA, 16 nt, Human
ggucagggagugcugg

SEQ ID NO: 2836138 - RNA, 20 nt, Human
ggucagggagugcuggcuca

SEQ ID NO: 2836139 - RNA, 23 nt, Human
ggucagggagugcuggcucacag

SEQ ID NO: 2836140 - RNA, 17 nt, Human
ggucaggggugacacag

SEQ ID NO: 2836141 - RNA, 18 nt, Human
ggucaggggugacacaga

SEQ ID NO: 2836142 - RNA, 12 nt, Human
ggucaggcuggu

SEQ ID NO: 2836143 - RNA, 18 nt, Human
ggucaggcuggucucaaa

SEQ ID NO: 2836144 - RNA, 21 nt, Human
gguauuuuuuuguaauugcuu

SEQ ID NO: 2836145 - RNA, 11 nt, Human
ggucaacagaa

SEQ ID NO: 2836146 - RNA, 17 nt, Human
ggucaacagaaugaaaa

SEQ ID NO: 2836147 - RNA, 18 nt, Human
ggucaacagaaugaaaaa

SEQ ID NO: 2836148 - RNA, 20 nt, Human
ggucaacagaaugaaaaaug

SEQ ID NO: 2836149 - RNA, 21 nt, Human
ggucaacagaaugaaaaauga

SEQ ID NO: 2836150 - RNA, 18 nt, Human
ggucaacagcuaugcugg

SEQ ID NO: 2836151 - RNA, 16 nt, Human
gguauuuugaauacca

SEQ ID NO: 2836152 - RNA, 15 nt, Human
gguauuuuguuucuu

SEQ ID NO: 2836153 - RNA, 18 nt, Human
gguauuuuguuucuuuua

SEQ ID NO: 2836154 - RNA, 19 nt, Human
gguauuuuucagagauuua

SEQ ID NO: 2836155 - RNA, 18 nt, Human
gguauuuuugcccugagu

SEQ ID NO: 2836156 - RNA, 23 nt, Human
ggucaacaucuuuuacauucugc

SEQ ID NO: 2836157 - RNA, 16 nt, Human
ggucacaggacucugc

SEQ ID NO: 2836158 - RNA, 18 nt, Human
ggucacaggacucugccu

SEQ ID NO: 2836159 - RNA, 15 nt, Human
ggucacuuaaaaugu

SEQ ID NO: 2836160 - RNA, 21 nt, Human
ggucacuuaaaaugugcagua

SEQ ID NO: 2836161 - RNA, 19 nt, Human
ggucacugaggccugagac

SEQ ID NO: 2836162 - RNA, 20 nt, Human
ggucacugaggccugagacc

SEQ ID NO: 2836163 - RNA, 22 nt, Human
ggucacugaggccugagaccca

SEQ ID NO: 2836164 - RNA, 23 nt, Human
ggucacugaggccugagacccag

SEQ ID NO: 2836165 - RNA, 24 nt, Human
ggucacugaggccugagacccagg

SEQ ID NO: 2836166 - RNA, 13 nt, Human
gguacccacugcu

SEQ ID NO: 2836167 - RNA, 11 nt, Human
gguacccacug

SEQ ID NO: 2836168 - RNA, 18 nt, Human
gguaccagcccuggggcu

SEQ ID NO: 2836169 - RNA, 17 nt, Human
gguacuuguggacacag

SEQ ID NO: 2836170 - RNA, 16 nt, Human
gguacuuguggacaca

SEQ ID NO: 2836171 - RNA, 17 nt, Human
gguagagccacaaaaga

SEQ ID NO: 2836172 - RNA, 14 nt, Human
gguauuuauaauau

SEQ ID NO: 2836173 - RNA, 18 nt, Human
gguagaguuuacagcucu

SEQ ID NO: 2836174 - RNA, 14 nt, Human
gguagccaggggga

SEQ ID NO: 2836175 - RNA, 15 nt, Human
gggugcagcugagaa

SEQ ID NO: 2836176 - RNA, 14 nt, Human
gggugcagcaguga

SEQ ID NO: 2836177 - RNA, 18 nt, Human
gggugcuaguggugggca

SEQ ID NO: 2836178 - RNA, 12 nt, Human
gggugcucagaa

SEQ ID NO: 2836179 - RNA, 13 nt, Human
gggugcucagaau

SEQ ID NO: 2836180 - RNA, 18 nt, Human
gggugcucagaauaaggc

SEQ ID NO: 2836181 - RNA, 21 nt, Human
gggugcucagaauaaggcagg

SEQ ID NO: 2836182 - RNA, 17 nt, Human
gggugagggucccaugu

SEQ ID NO: 2836183 - RNA, 20 nt, Human
gggugagaugcuggagaaga

SEQ ID NO: 2836184 - RNA, 15 nt, Human
gggugagaugcugga

SEQ ID NO: 2836185 - RNA, 18 nt, Human
gggugagaugcuggagaa

SEQ ID NO: 2836186 - RNA, 13 nt, Human
gggugacggcccu

SEQ ID NO: 2836187 - RNA, 18 nt, Human
gggugacggcccucaucu

SEQ ID NO: 2836188 - RNA, 13 nt, Human
gggugauuccuaa

SEQ ID NO: 2836189 - RNA, 23 nt, Human
gggugauuuuaugaucaguguug

SEQ ID NO: 2836190 - RNA, 16 nt, Human
gggugacaagagccug

SEQ ID NO: 2836191 - RNA, 13 nt, Human
gggugacacagac

SEQ ID NO: 2836192 - RNA, 14 nt, Human
gggugacacagacu

SEQ ID NO: 2836193 - RNA, 13 nt, Human
gggugacagucau

SEQ ID NO: 2836194 - RNA, 18 nt, Human
gggugacagucaucauca

SEQ ID NO: 2836195 - RNA, 20 nt, Human
gggugacagucaucaucagg

SEQ ID NO: 2836196 - RNA, 22 nt, Human
gggugacagucaucaucagggc

SEQ ID NO: 2836197 - RNA, 19 nt, Human
gggugaagagaaccgagca

SEQ ID NO: 2836198 - RNA, 23 nt, Human
gggucuucccuaccucaggcagg

SEQ ID NO: 2836199 - RNA, 15 nt, Human
gggucugugugaaug

SEQ ID NO: 2836200 - RNA, 17 nt, Human
gggucugugugaaugug

SEQ ID NO: 2836201 - RNA, 24 nt, Human
gggucugugugaaugugggcacug

SEQ ID NO: 2836202 - RNA, 20 nt, Human
gggucuucagcauucccucc

SEQ ID NO: 2836203 - RNA, 21 nt, Human
gggucuucagcauucccuccc

SEQ ID NO: 2836204 - RNA, 18 nt, Human
ggguuagauguugccaug

SEQ ID NO: 2836205 - RNA, 20 nt, Human
ggguuauguguaugugccau

SEQ ID NO: 2836206 - RNA, 13 nt, Human
ggguucaggggac

SEQ ID NO: 2836207 - RNA, 23 nt, Human
ggguucaagcgauucuucugcuu

SEQ ID NO: 2836208 - RNA, 20 nt, Human
ggguucaccugggcugaggc

SEQ ID NO: 2836209 - RNA, 13 nt, Human
ggguuaucucugu

SEQ ID NO: 2836210 - RNA, 18 nt, Human
ggguuauguaucagaaga

SEQ ID NO: 2836211 - RNA, 19 nt, Human
ggguuauguaucagaagag

SEQ ID NO: 2836212 - RNA, 22 nt, Human
ggguucaagcgauucuucugcu

SEQ ID NO: 2836213 - RNA, 18 nt, Human
ggguguuguauggggagg

SEQ ID NO: 2836214 - RNA, 17 nt, Human
ggguuaaaucaaagaua

SEQ ID NO: 2836215 - RNA, 22 nt, Human
ggguuacaguaugcuugcucua

SEQ ID NO: 2836216 - RNA, 15 nt, Human
ggguguuaauuuaug

SEQ ID NO: 2836217 - RNA, 21 nt, Human
ggguuccuuccucugagccuu

SEQ ID NO: 2836218 - RNA, 20 nt, Human
ggguuccuuccucugagccu

SEQ ID NO: 2836219 - RNA, 14 nt, Human
ggguucaugaugca

SEQ ID NO: 2836220 - RNA, 15 nt, Human
ggguucaugaugcag

SEQ ID NO: 2836221 - RNA, 19 nt, Human
ggguuccuuccucugagcc

SEQ ID NO: 2836222 - RNA, 14 nt, Human
ggguuccucuuccc

SEQ ID NO: 2836223 - RNA, 14 nt, Human
ggguugcuggagcc

SEQ ID NO: 2836224 - RNA, 15 nt, Human
ggguugcuggagccu

SEQ ID NO: 2836225 - RNA, 12 nt, Human
ggguugaaaauu

SEQ ID NO: 2836226 - RNA, 23 nt, Human
ggguugaaaauucaaaaaguguu

SEQ ID NO: 2836227 - RNA, 11 nt, Human
ggguugauuaa

SEQ ID NO: 2836228 - RNA, 17 nt, Human
ggguugauuaaggcagu

SEQ ID NO: 2836229 - RNA, 19 nt, Human
ggguugauuaaggcaguac

SEQ ID NO: 2836230 - RNA, 19 nt, Human
ggguucuuucuuccucugc

SEQ ID NO: 2836231 - RNA, 17 nt, Human
ggguucuuucuuccucu

SEQ ID NO: 2836232 - RNA, 16 nt, Human
ggguucuuucuuccuc

SEQ ID NO: 2836233 - RNA, 20 nt, Human
uauauuuuuauauuuaguua

SEQ ID NO: 2836234 - RNA, 18 nt, Human
uauauuuuuauauuuagu

SEQ ID NO: 2836235 - RNA, 17 nt, Human
uaucaggugcugccauc

SEQ ID NO: 2836236 - RNA, 15 nt, Human
uaucaggucucccac

SEQ ID NO: 2836237 - RNA, 23 nt, Human
uaucaggucucccacgugggaga

SEQ ID NO: 2836238 - RNA, 14 nt, Human
uaucagcuucagaa

SEQ ID NO: 2836239 - RNA, 18 nt, Human
uaucagcuacuuaagaga

SEQ ID NO: 2836240 - RNA, 19 nt, Human
uaucagcuacuuaagagaa

SEQ ID NO: 2836241 - RNA, 20 nt, Human
uaucagcuacuuaagagaaa

SEQ ID NO: 2836242 - RNA, 21 nt, Human
uaucagcuacuuaagagaaau

SEQ ID NO: 2836243 - RNA, 16 nt, Human
uaucaugucaaacgug

SEQ ID NO: 2836244 - RNA, 22 nt, Human
uaucauguaaagaaaugucuua

SEQ ID NO: 2836245 - RNA, 11 nt, Human
uaucaugaagc

SEQ ID NO: 2836246 - RNA, 19 nt, Human
uaucaucuggauaggagcc

SEQ ID NO: 2836247 - RNA, 12 nt, Human
uaucaugaagcc

SEQ ID NO: 2836248 - RNA, 13 nt, Human
uaucaugaagccu

SEQ ID NO: 2836249 - RNA, 14 nt, Human
uaucaugaagccug

SEQ ID NO: 2836250 - RNA, 16 nt, Human
uaucaugaagccugug

SEQ ID NO: 2836251 - RNA, 16 nt, Human
uaucauccacauuguu

SEQ ID NO: 2836252 - RNA, 17 nt, Human
uaucauccacauuguuu

SEQ ID NO: 2836253 - RNA, 22 nt, Human
uaucauccacauuguuuuaaaa

SEQ ID NO: 2836254 - RNA, 12 nt, Human
uaucaguuugau

SEQ ID NO: 2836255 - RNA, 13 nt, Human
uaucaguuugauc

SEQ ID NO: 2836256 - RNA, 22 nt, Human
uaucaguuugaucacacuauuu

SEQ ID NO: 2836257 - RNA, 17 nt, Human
uaucaguguuuuaaauu

SEQ ID NO: 2836258 - RNA, 19 nt, Human
uaucaguguuuuaaauucu

SEQ ID NO: 2836259 - RNA, 20 nt, Human
uaucaguguuuuaaauucug

SEQ ID NO: 2836260 - RNA, 21 nt, Human
uaucaguguuuuaaauucuga

SEQ ID NO: 2836261 - RNA, 13 nt, Human
uaucuaaaagugu

SEQ ID NO: 2836262 - RNA, 23 nt, Human
uaucuaaaagugucaccuuuucu

SEQ ID NO: 2836263 - RNA, 12 nt, Human
uaucuaaaugau

SEQ ID NO: 2836264 - RNA, 16 nt, Human
uaucucuuuuauauuu

SEQ ID NO: 2836265 - RNA, 21 nt, Human
uaucucuuuuauauuuguagg

SEQ ID NO: 2836266 - RNA, 12 nt, Human
uaucucuguguu

SEQ ID NO: 2836267 - RNA, 12 nt, Human
uaucuaaaguua

SEQ ID NO: 2836268 - RNA, 13 nt, Human
uaucuaaaguuau

SEQ ID NO: 2836269 - RNA, 14 nt, Human
uaucuaaaguuaua

SEQ ID NO: 2836270 - RNA, 18 nt, Human
uaucuaaaguuauauuuc

SEQ ID NO: 2836271 - RNA, 19 nt, Human
uaucuaaaguuauauuuca

SEQ ID NO: 2836272 - RNA, 20 nt, Human
uaucuaaaguuauauuucag

SEQ ID NO: 2836273 - RNA, 12 nt, Human
uaucuaaaguuu

SEQ ID NO: 2836274 - RNA, 15 nt, Human
uaucuaaaguuuguu

SEQ ID NO: 2836275 - RNA, 17 nt, Human
uaucggcucacaaagag

SEQ ID NO: 2836276 - RNA, 20 nt, Human
uaucgaaauaacaauguuaa

SEQ ID NO: 2836277 - RNA, 21 nt, Human
uaucgaaauaacaauguuaag

SEQ ID NO: 2836278 - RNA, 15 nt, Human
uaucgaaauaacaau

SEQ ID NO: 2836279 - RNA, 16 nt, Human
uaucgaaauaacaaug

SEQ ID NO: 2836280 - RNA, 18 nt, Human
uaucgaaauaacaauguu

SEQ ID NO: 2836281 - RNA, 19 nt, Human
uaucgaaauaacaauguua

SEQ ID NO: 2836282 - RNA, 16 nt, Human
uaucgaucucuuauuu

SEQ ID NO: 2836283 - RNA, 16 nt, Human
uaucgauguuuuauua

SEQ ID NO: 2836284 - RNA, 22 nt, Human
uaucgauguuuuauuauuucua

SEQ ID NO: 2836285 - RNA, 20 nt, Human
uaucgcugacuucauggaau

SEQ ID NO: 2836286 - RNA, 21 nt, Human
uaucaugucaaacgugaaaau

SEQ ID NO: 2836287 - RNA, 18 nt, Human
uauccugccaaaaucauu

SEQ ID NO: 2836288 - RNA, 22 nt, Human
uauccugggggacccaauguag

SEQ ID NO: 2836289 - RNA, 13 nt, Human
uauccugugacug

SEQ ID NO: 2836290 - RNA, 22 nt, Human
uauccugcuucugauaugcagu

SEQ ID NO: 2836291 - RNA, 15 nt, Human
uauccugcuguucua

SEQ ID NO: 2836292 - RNA, 18 nt, Human
uauccuuuucuucuaugu

SEQ ID NO: 2836293 - RNA, 14 nt, Human
uaucgaaauaacaa

SEQ ID NO: 2836294 - RNA, 22 nt, Human
uauccuuuguggcaccuuuucu

SEQ ID NO: 2836295 - RNA, 14 nt, Human
uauccugugacugu

SEQ ID NO: 2836296 - RNA, 16 nt, Human
uauccugugacugucu

SEQ ID NO: 2836297 - RNA, 17 nt, Human
uauccugugacugucuc

SEQ ID NO: 2836298 - RNA, 23 nt, Human
uauccugugacugucucacuuaa

SEQ ID NO: 2836299 - RNA, 12 nt, Human
uauauuuauuua

SEQ ID NO: 2836300 - RNA, 16 nt, Human
uauauuuauuuaaagc

SEQ ID NO: 2836301 - RNA, 22 nt, Human
uauauuuauuuaaagcauugcu

SEQ ID NO: 2836302 - RNA, 21 nt, Human
uauauguauauuuuuuuaauu

SEQ ID NO: 2836303 - RNA, 16 nt, Human
uauauuucagauguaa

SEQ ID NO: 2836304 - RNA, 19 nt, Human
uauauuucagauguaaugu

SEQ ID NO: 2836305 - RNA, 20 nt, Human
uauauuucccuaaaauacau

SEQ ID NO: 2836306 - RNA, 14 nt, Human
uauauguacuguuu

SEQ ID NO: 2836307 - RNA, 19 nt, Human
uauauguaccguaggcuuu

SEQ ID NO: 2836308 - RNA, 12 nt, Human
uauauguacaug

SEQ ID NO: 2836309 - RNA, 15 nt, Human
uauauggcauuugca

SEQ ID NO: 2836310 - RNA, 16 nt, Human
uauauggcaagaaagc

SEQ ID NO: 2836311 - RNA, 17 nt, Human
uauaugccuuuuuccua

SEQ ID NO: 2836312 - RNA, 18 nt, Human
uauaugccuuuuuccuag

SEQ ID NO: 2836313 - RNA, 16 nt, Human
uauauuugugcuauag

SEQ ID NO: 2836314 - RNA, 17 nt, Human
uauauuugugcuauagu

SEQ ID NO: 2836315 - RNA, 20 nt, Human
uauauuugugcuauaguauu

SEQ ID NO: 2836316 - RNA, 21 nt, Human
uauauuugugcuauaguauuu

SEQ ID NO: 2836317 - RNA, 22 nt, Human
uauauuugugcuauaguauuug

SEQ ID NO: 2836318 - RNA, 15 nt, Human
uauauuuuaccauac

SEQ ID NO: 2836319 - RNA, 16 nt, Human
uauauuuguguauuua

SEQ ID NO: 2836320 - RNA, 14 nt, Human
uauauuucuuuguu

SEQ ID NO: 2836321 - RNA, 20 nt, Human
uauauuuguguauuuaacag

SEQ ID NO: 2836322 - RNA, 22 nt, Human
uauauggaugauucagaaauug

SEQ ID NO: 2836323 - RNA, 16 nt, Human
uauaugaauaaagugu

SEQ ID NO: 2836324 - RNA, 15 nt, Human
uauaugauuuauagu

SEQ ID NO: 2836325 - RNA, 16 nt, Human
uauaugauuuauaguu

SEQ ID NO: 2836326 - RNA, 21 nt, Human
uauaugauuuauaguuuguac

SEQ ID NO: 2836327 - RNA, 19 nt, Human
uauaugaggacuugugucu

SEQ ID NO: 2836328 - RNA, 13 nt, Human
uauaugauggggg

SEQ ID NO: 2836329 - RNA, 13 nt, Human
uauauagagaugu

SEQ ID NO: 2836330 - RNA, 14 nt, Human
uauauagagauguu

SEQ ID NO: 2836331 - RNA, 16 nt, Human
uauauagagauguuuu

SEQ ID NO: 2836332 - RNA, 19 nt, Human
uauauagagauguuuuuaa

SEQ ID NO: 2836333 - RNA, 22 nt, Human
uauaugaauuuaaauauaauuc

SEQ ID NO: 2836334 - RNA, 14 nt, Human
uauaugagaagaau

SEQ ID NO: 2836335 - RNA, 15 nt, Human
uauaugagaagaaua

SEQ ID NO: 2836336 - RNA, 16 nt, Human
uauaugagaagaauag

SEQ ID NO: 2836337 - RNA, 17 nt, Human
uauaugagaagaauagc

SEQ ID NO: 2836338 - RNA, 20 nt, Human
uauaugagaagaauagccua

SEQ ID NO: 2836339 - RNA, 13 nt, Human
uauauacauaugu

SEQ ID NO: 2836340 - RNA, 14 nt, Human
uauauacauaugua

SEQ ID NO: 2836341 - RNA, 15 nt, Human
uauauacauauguag

SEQ ID NO: 2836342 - RNA, 16 nt, Human
uauauacauauguaga

SEQ ID NO: 2836343 - RNA, 17 nt, Human
uauauacauauguagac

SEQ ID NO: 2836344 - RNA, 14 nt, Human
uauauacaguaacu

SEQ ID NO: 2836345 - RNA, 17 nt, Human
uauauacaguaacuuua

SEQ ID NO: 2836346 - RNA, 22 nt, Human
uauauacaguaacuuuaugugu

SEQ ID NO: 2836347 - RNA, 22 nt, Human
uauauacaauaacauaauuugu

SEQ ID NO: 2836348 - RNA, 13 nt, Human
uauauacaauaau

SEQ ID NO: 2836349 - RNA, 16 nt, Human
uauauacaauaaugga

SEQ ID NO: 2836350 - RNA, 13 nt, Human
uauauacacacac

SEQ ID NO: 2836351 - RNA, 14 nt, Human
uauauacacacaca

SEQ ID NO: 2836352 - RNA, 12 nt, Human
uauauacacaua

SEQ ID NO: 2836353 - RNA, 13 nt, Human
uauauacacauau

SEQ ID NO: 2836354 - RNA, 14 nt, Human
uauauacacauaua

SEQ ID NO: 2836355 - RNA, 18 nt, Human
uauauacacauauaccua

SEQ ID NO: 2836356 - RNA, 16 nt, Human
uauauacagaggaaau

SEQ ID NO: 2836357 - RNA, 23 nt, Human
uauauacagaggaaaucuguaac

SEQ ID NO: 2836358 - RNA, 18 nt, Human
uauauacgcaucuauaaa

SEQ ID NO: 2836359 - RNA, 17 nt, Human
uauauacgaacaaaaca

SEQ ID NO: 2836360 - RNA, 17 nt, Human
uauauagaaauauauac

SEQ ID NO: 2836361 - RNA, 13 nt, Human
uauauagaaugcu

SEQ ID NO: 2836362 - RNA, 14 nt, Human
uauauagaaugcug

SEQ ID NO: 2836363 - RNA, 16 nt, Human
uauauagacagcuuug

SEQ ID NO: 2836364 - RNA, 21 nt, Human
uauauacuugugguuuucaaa

SEQ ID NO: 2836365 - RNA, 23 nt, Human
uauauacaguaacuuuaugugua

SEQ ID NO: 2836366 - RNA, 23 nt, Human
uauauacauacacuuguauaaau

SEQ ID NO: 2836367 - RNA, 13 nt, Human
uauauacaugugu

SEQ ID NO: 2836368 - RNA, 14 nt, Human
uauauacaugugug

SEQ ID NO: 2836369 - RNA, 15 nt, Human
uauauacaugugugu

SEQ ID NO: 2836370 - RNA, 16 nt, Human
uauauacaugugugua

SEQ ID NO: 2836371 - RNA, 17 nt, Human
uauauacauguguguau

SEQ ID NO: 2836372 - RNA, 18 nt, Human
uauauacauguguguaua

SEQ ID NO: 2836373 - RNA, 18 nt, Human
uauacuugugguuuucaa

SEQ ID NO: 2836374 - RNA, 12 nt, Human
uauauaauaucu

SEQ ID NO: 2836375 - RNA, 13 nt, Human
uauauaauaucua

SEQ ID NO: 2836376 - RNA, 17 nt, Human
uauauaauaucuaaagu

SEQ ID NO: 2836377 - RNA, 19 nt, Human
uauauaauaucuaaaguua

SEQ ID NO: 2836378 - RNA, 17 nt, Human
uauauacaauaacauaa

SEQ ID NO: 2836379 - RNA, 16 nt, Human
uauauacaauaacaua

SEQ ID NO: 2836380 - RNA, 13 nt, Human
uauauaauucacu

SEQ ID NO: 2836381 - RNA, 21 nt, Human
uauauaauucacucaagcacu

SEQ ID NO: 2836382 - RNA, 22 nt, Human
uauacuuaaauggaaaaaauga

SEQ ID NO: 2836383 - RNA, 13 nt, Human
uauacuugaacaa

SEQ ID NO: 2836384 - RNA, 14 nt, Human
uauacuugaacaaa

SEQ ID NO: 2836385 - RNA, 15 nt, Human
uauacuugaacaaaa

SEQ ID NO: 2836386 - RNA, 16 nt, Human
uauacuugaacaaaag

SEQ ID NO: 2836387 - RNA, 17 nt, Human
uauacuugaacaaaagg

SEQ ID NO: 2836388 - RNA, 21 nt, Human
uauacuugaacaaaaggguca

SEQ ID NO: 2836389 - RNA, 23 nt, Human
uauacuugaacaaaagggucaga

SEQ ID NO: 2836390 - RNA, 15 nt, Human
uauacuguaauuuag

SEQ ID NO: 2836391 - RNA, 14 nt, Human
uauacuguaauuua

SEQ ID NO: 2836392 - RNA, 13 nt, Human
uauacuguucuuc

SEQ ID NO: 2836393 - RNA, 18 nt, Human
uauacugugugcuuguuu

SEQ ID NO: 2836394 - RNA, 22 nt, Human
uauacuguaauuuaguuauuga

SEQ ID NO: 2836395 - RNA, 13 nt, Human
uauacuguacaau

SEQ ID NO: 2836396 - RNA, 15 nt, Human
uauacuguacaauaa

SEQ ID NO: 2836397 - RNA, 17 nt, Human
uauacuguacaauaaaa

SEQ ID NO: 2836398 - RNA, 21 nt, Human
uauacuguacaauaaaaacau

SEQ ID NO: 2836399 - RNA, 22 nt, Human
uauacuguacaauaaaaacauu

SEQ ID NO: 2836400 - RNA, 21 nt, Human
uagucacauggccuaugcaca

SEQ ID NO: 2836401 - RNA, 13 nt, Human
uagugaugguucc

SEQ ID NO: 2836402 - RNA, 16 nt, Human
uaggcgugagaagcau

SEQ ID NO: 2836403 - RNA, 13 nt, Human
uaggcuaauguca

SEQ ID NO: 2836404 - RNA, 14 nt, Human
uaggcuaaugucaa

SEQ ID NO: 2836405 - RNA, 22 nt, Human
uaggccucucaccucugugccu

SEQ ID NO: 2836406 - RNA, 16 nt, Human
uaggccuuuuaacauu

SEQ ID NO: 2836407 - RNA, 18 nt, Human
uaggccuuuuaacauuuu

SEQ ID NO: 2836408 - RNA, 14 nt, Human
uagugcuauauaua

SEQ ID NO: 2836409 - RNA, 15 nt, Human
uagugcuauauauau

SEQ ID NO: 2836410 - RNA, 21 nt, Human
uagugcuauauauauaaauau

SEQ ID NO: 2836411 - RNA, 22 nt, Human
uagugcuauauauauaaauauu

SEQ ID NO: 2836412 - RNA, 12 nt, Human
uagugcugggau

SEQ ID NO: 2836413 - RNA, 13 nt, Human
uaguggaaaaaca

SEQ ID NO: 2836414 - RNA, 14 nt, Human
uaguggaaaaacac

SEQ ID NO: 2836415 - RNA, 23 nt, Human
uaguggaaaaacacauggggaaa

SEQ ID NO: 2836416 - RNA, 17 nt, Human
uaguggaaacauuuaua

SEQ ID NO: 2836417 - RNA, 14 nt, Human
uagugaugguuccc

SEQ ID NO: 2836418 - RNA, 18 nt, Human
uagugaugguuccccugu

SEQ ID NO: 2836419 - RNA, 16 nt, Human
uagucacacguggucu

SEQ ID NO: 2836420 - RNA, 18 nt, Human
uaguugucaguauuauuc

SEQ ID NO: 2836421 - RNA, 21 nt, Human
uaguuguccauauuuucacag

SEQ ID NO: 2836422 - RNA, 17 nt, Human
uaguugucucucuucag

SEQ ID NO: 2836423 - RNA, 17 nt, Human
uaguugucuuuccuggc

SEQ ID NO: 2836424 - RNA, 18 nt, Human
uaguuucagauauauauc

SEQ ID NO: 2836425 - RNA, 11 nt, Human
uaguuucaagc

SEQ ID NO: 2836426 - RNA, 17 nt, Human
uaguuucauaauugugu

SEQ ID NO: 2836427 - RNA, 22 nt, Human
uaguuuaccugaauaaauggua

SEQ ID NO: 2836428 - RNA, 11 nt, Human
uaguuuacugu

SEQ ID NO: 2836429 - RNA, 13 nt, Human
uaguuuacuguuu

SEQ ID NO: 2836430 - RNA, 14 nt, Human
uaguuuacuguuuu

SEQ ID NO: 2836431 - RNA, 13 nt, Human
uaguuucugaggc

SEQ ID NO: 2836432 - RNA, 17 nt, Human
uaguugcguuacacccu

SEQ ID NO: 2836433 - RNA, 14 nt, Human
uaguugcuuuguua

SEQ ID NO: 2836434 - RNA, 17 nt, Human
uaguugcuuuugaagga

SEQ ID NO: 2836435 - RNA, 18 nt, Human
uaguugcuuuugaaggaa

SEQ ID NO: 2836436 - RNA, 21 nt, Human
uaguugcuuuugaaggaauac

SEQ ID NO: 2836437 - RNA, 15 nt, Human
uaguuggugagaaac

SEQ ID NO: 2836438 - RNA, 21 nt, Human
uaguguaccuccucucagugu

SEQ ID NO: 2836439 - RNA, 22 nt, Human
uaguguaccuccucucaguguu

SEQ ID NO: 2836440 - RNA, 23 nt, Human
uaguguaccuccucucaguguuu

SEQ ID NO: 2836441 - RNA, 18 nt, Human
uaguguaagcuagaagaa

SEQ ID NO: 2836442 - RNA, 14 nt, Human
uaguguaauaagac

SEQ ID NO: 2836443 - RNA, 17 nt, Human
uaguguaauaagacuua

SEQ ID NO: 2836444 - RNA, 15 nt, Human
uaguguaauauacca

SEQ ID NO: 2836445 - RNA, 23 nt, Human
uaguggucuuuguaagaguguag

SEQ ID NO: 2836446 - RNA, 13 nt, Human
uaguguaaaauaa

SEQ ID NO: 2836447 - RNA, 19 nt, Human
uaguguaaaauaagaauga

SEQ ID NO: 2836448 - RNA, 22 nt, Human
uaguguaaaauaagaaugauuu

SEQ ID NO: 2836449 - RNA, 14 nt, Human
uaguguaguauucu

SEQ ID NO: 2836450 - RNA, 19 nt, Human
uaguguaguauucuucccu

SEQ ID NO: 2836451 - RNA, 15 nt, Human
uaguggauggaaggg

SEQ ID NO: 2836452 - RNA, 11 nt, Human
uaguguaaaau

SEQ ID NO: 2836453 - RNA, 19 nt, Human
uaguggucuuuguaagagu

SEQ ID NO: 2836454 - RNA, 21 nt, Human
uaguggucuuuguaagagugu

SEQ ID NO: 2836455 - RNA, 20 nt, Human
uagugguuuaucagcaaaaa

SEQ ID NO: 2836456 - RNA, 18 nt, Human
uaguggauggaaggggcu

SEQ ID NO: 2836457 - RNA, 18 nt, Human
uaguggucuuuguaagag

SEQ ID NO: 2836458 - RNA, 21 nt, Human
uauaauuccuauauccuguga

SEQ ID NO: 2836459 - RNA, 12 nt, Human
uauaauucugua

SEQ ID NO: 2836460 - RNA, 17 nt, Human
uauacccccugcaaagc

SEQ ID NO: 2836461 - RNA, 15 nt, Human
uauaccuauaaugug

SEQ ID NO: 2836462 - RNA, 17 nt, Human
uauaccuauaaugugug

SEQ ID NO: 2836463 - RNA, 18 nt, Human
uauaccuauaaugugugu

SEQ ID NO: 2836464 - RNA, 19 nt, Human
uauaccuauaaugugugua

SEQ ID NO: 2836465 - RNA, 21 nt, Human
uauaccuauaauguguguaug

SEQ ID NO: 2836466 - RNA, 15 nt, Human
uauaccucaaacuau

SEQ ID NO: 2836467 - RNA, 20 nt, Human
uauacucuuauagacaacau

SEQ ID NO: 2836468 - RNA, 18 nt, Human
uauacucuagaugaaguu

SEQ ID NO: 2836469 - RNA, 18 nt, Human
uauacuccaguguacaua

SEQ ID NO: 2836470 - RNA, 22 nt, Human
uauacuccaguguacauagugu

SEQ ID NO: 2836471 - RNA, 22 nt, Human
uauacucuuucuguauauacuu

SEQ ID NO: 2836472 - RNA, 19 nt, Human
uauacucuuucuguauaua

SEQ ID NO: 2836473 - RNA, 17 nt, Human
uauacucuuucuguaua

SEQ ID NO: 2836474 - RNA, 16 nt, Human
uauacucuuucuguau

SEQ ID NO: 2836475 - RNA, 20 nt, Human
uauacuauaguaccaguagg

SEQ ID NO: 2836476 - RNA, 13 nt, Human
uauaccugugccu

SEQ ID NO: 2836477 - RNA, 14 nt, Human
uauaccugugccuc

SEQ ID NO: 2836478 - RNA, 17 nt, Human
uauacuauaguaccagu

SEQ ID NO: 2836479 - RNA, 17 nt, Human
uauaauggaagagaaau

SEQ ID NO: 2836480 - RNA, 21 nt, Human
uauaauggaagagaaaucuca

SEQ ID NO: 2836481 - RNA, 15 nt, Human
uauaaugguugacug

SEQ ID NO: 2836482 - RNA, 22 nt, Human
uauaauuccuauauccugugac

SEQ ID NO: 2836483 - RNA, 20 nt, Human
uauaauucacucaagcacug

SEQ ID NO: 2836484 - RNA, 23 nt, Human
uauaauucacucaagcacugaua

SEQ ID NO: 2836485 - RNA, 13 nt, Human
uauaauucaguau

SEQ ID NO: 2836486 - RNA, 16 nt, Human
uauaauucaguauguu

SEQ ID NO: 2836487 - RNA, 22 nt, Human
uauaauucaguauguuuuacac

SEQ ID NO: 2836488 - RNA, 23 nt, Human
uauaauucaguauguuuuacacu

SEQ ID NO: 2836489 - RNA, 11 nt, Human
uauaaugaacc

SEQ ID NO: 2836490 - RNA, 21 nt, Human
uaguuugcucauacuacauug

SEQ ID NO: 2836491 - RNA, 14 nt, Human
uauaaaucauauug

SEQ ID NO: 2836492 - RNA, 18 nt, Human
uauaaaucauauugauga

SEQ ID NO: 2836493 - RNA, 21 nt, Human
uauaaaucauauugaugaaaa

SEQ ID NO: 2836494 - RNA, 22 nt, Human
uauaaaucauauugaugaaaag

SEQ ID NO: 2836495 - RNA, 11 nt, Human
uauaaauucug

SEQ ID NO: 2836496 - RNA, 12 nt, Human
uauaaauucugu

SEQ ID NO: 2836497 - RNA, 13 nt, Human
uauaaauucugug

SEQ ID NO: 2836498 - RNA, 17 nt, Human
uauaaauucuguggguc

SEQ ID NO: 2836499 - RNA, 19 nt, Human
uauaaauauauauaaagaa

SEQ ID NO: 2836500 - RNA, 20 nt, Human
uauaaauauauauaaagaau

SEQ ID NO: 2836501 - RNA, 19 nt, Human
uauaaauaggagaggauga

SEQ ID NO: 2836502 - RNA, 17 nt, Human
uauaaauauaagccuuu

SEQ ID NO: 2836503 - RNA, 17 nt, Human
uauaaauaggagaggau

SEQ ID NO: 2836504 - RNA, 14 nt, Human
uaguuuuaguuuuc

SEQ ID NO: 2836505 - RNA, 13 nt, Human
uaguuuguuuaau

SEQ ID NO: 2836506 - RNA, 21 nt, Human
uaguuuguuuaaugugaacuu

SEQ ID NO: 2836507 - RNA, 14 nt, Human
uaguuuuaaacuca

SEQ ID NO: 2836508 - RNA, 16 nt, Human
uaguuuuaaacucauu

SEQ ID NO: 2836509 - RNA, 16 nt, Human
uaguuugggcuucagc

SEQ ID NO: 2836510 - RNA, 18 nt, Human
uaguuuggggcaaaaauc

SEQ ID NO: 2836511 - RNA, 17 nt, Human
uaguuuguacaugcauu

SEQ ID NO: 2836512 - RNA, 14 nt, Human
uaguuuguauaacu

SEQ ID NO: 2836513 - RNA, 17 nt, Human
uaguuuguauaacuucu

SEQ ID NO: 2836514 - RNA, 18 nt, Human
uaguuuguauaacuucuu

SEQ ID NO: 2836515 - RNA, 12 nt, Human
uaguuugucuau

SEQ ID NO: 2836516 - RNA, 15 nt, Human
uaguuugucuauuuu

SEQ ID NO: 2836517 - RNA, 18 nt, Human
uaguuugucuauuuuaaa

SEQ ID NO: 2836518 - RNA, 22 nt, Human
uaguuugucuauuuuaaaauaa

SEQ ID NO: 2836519 - RNA, 18 nt, Human
uaguuugcauuccugaua

SEQ ID NO: 2836520 - RNA, 11 nt, Human
uaguuuggauu

SEQ ID NO: 2836521 - RNA, 11 nt, Human
uaguuugcauu

SEQ ID NO: 2836522 - RNA, 17 nt, Human
uaguuugcauuccugau

SEQ ID NO: 2836523 - RNA, 22 nt, Human
uaggaaguugacuuauaguaca

SEQ ID NO: 2836524 - RNA, 16 nt, Human
uaggaaguuuucugua

SEQ ID NO: 2836525 - RNA, 17 nt, Human
uaggaaguuuucuguag

SEQ ID NO: 2836526 - RNA, 22 nt, Human
uaggaaguuuucuguagucauu

SEQ ID NO: 2836527 - RNA, 18 nt, Human
uaggaaggucucauucuu

SEQ ID NO: 2836528 - RNA, 21 nt, Human
uaggaaggucucauucuucca

SEQ ID NO: 2836529 - RNA, 17 nt, Human
uaggaaguugacuuaua

SEQ ID NO: 2836530 - RNA, 17 nt, Human
uaggccguuccuucaaa

SEQ ID NO: 2836531 - RNA, 14 nt, Human
uaggccuggccaga

SEQ ID NO: 2836532 - RNA, 13 nt, Human
uaggccuggccag

SEQ ID NO: 2836533 - RNA, 14 nt, Human
uaggccaugaaaaa

SEQ ID NO: 2836534 - RNA, 20 nt, Human
uaggccaugaaaaaaaugau

SEQ ID NO: 2836535 - RNA, 14 nt, Human
uaggaacuucagag

SEQ ID NO: 2836536 - RNA, 15 nt, Human
uaggaacuucagaga

SEQ ID NO: 2836537 - RNA, 16 nt, Human
uaggaacuucagagau

SEQ ID NO: 2836538 - RNA, 12 nt, Human
uagcuggagccu

SEQ ID NO: 2836539 - RNA, 16 nt, Human
uagcuggcaagaaugg

SEQ ID NO: 2836540 - RNA, 15 nt, Human
uagcugggauuacag

SEQ ID NO: 2836541 - RNA, 15 nt, Human
uagcugggauuuuaa

SEQ ID NO: 2836542 - RNA, 21 nt, Human
uagcugggauuuuaaacuaga

SEQ ID NO: 2836543 - RNA, 23 nt, Human
uagcugggauuuuaaacuagaug

SEQ ID NO: 2836544 - RNA, 15 nt, Human
uagcccuuucugugu

SEQ ID NO: 2836545 - RNA, 17 nt, Human
uagcccuuucugugugc

SEQ ID NO: 2836546 - RNA, 13 nt, Human
uagcccuuucugu

SEQ ID NO: 2836547 - RNA, 14 nt, Human
uagcccuuucugug

SEQ ID NO: 2836548 - RNA, 21 nt, Human
uagccuauuuaccugcaggcu

SEQ ID NO: 2836549 - RNA, 16 nt, Human
uagccuaggugacaga

SEQ ID NO: 2836550 - RNA, 14 nt, Human
uagccugcacuuug

SEQ ID NO: 2836551 - RNA, 23 nt, Human
uagccugcacuuugaugucaugu

SEQ ID NO: 2836552 - RNA, 13 nt, Human
uagccucccugaa

SEQ ID NO: 2836553 - RNA, 14 nt, Human
uagccucauaguua

SEQ ID NO: 2836554 - RNA, 12 nt, Human
uagccucccuga

SEQ ID NO: 2836555 - RNA, 16 nt, Human
uagcaggggcugcagu

SEQ ID NO: 2836556 - RNA, 18 nt, Human
uagcccucacccuggggc

SEQ ID NO: 2836557 - RNA, 15 nt, Human
uagcccucucccucu

SEQ ID NO: 2836558 - RNA, 22 nt, Human
uagcccucucccucuaggcucu

SEQ ID NO: 2836559 - RNA, 17 nt, Human
uagccauugaucauaaa

SEQ ID NO: 2836560 - RNA, 17 nt, Human
uagccauguuaacauga

SEQ ID NO: 2836561 - RNA, 19 nt, Human
uagccauguuaacaugaca

SEQ ID NO: 2836562 - RNA, 16 nt, Human
uagcaguaaaagauga

SEQ ID NO: 2836563 - RNA, 20 nt, Human
uagcaguaaaagaugaaguu

SEQ ID NO: 2836564 - RNA, 13 nt, Human
uagcauaagggcu

SEQ ID NO: 2836565 - RNA, 20 nt, Human
uagcagugucuguaaaagag

SEQ ID NO: 2836566 - RNA, 17 nt, Human
uagcagugugaaguaca

SEQ ID NO: 2836567 - RNA, 21 nt, Human
uagcagugugaaguacaauaa

SEQ ID NO: 2836568 - RNA, 12 nt, Human
uagcccaggaga

SEQ ID NO: 2836569 - RNA, 17 nt, Human
uagcccagcgcucugcc

SEQ ID NO: 2836570 - RNA, 18 nt, Human
uagcccagcgcucugccu

SEQ ID NO: 2836571 - RNA, 13 nt, Human
uagcccaggagag

SEQ ID NO: 2836572 - RNA, 14 nt, Human
uagcccaggagaga

SEQ ID NO: 2836573 - RNA, 15 nt, Human
uagcccaggagagag

SEQ ID NO: 2836574 - RNA, 16 nt, Human
uagcccaggagagaga

SEQ ID NO: 2836575 - RNA, 15 nt, Human
uagcccacucugcuc

SEQ ID NO: 2836576 - RNA, 13 nt, Human
uagcccacccugc

SEQ ID NO: 2836577 - RNA, 14 nt, Human
uagcccacccugcu

SEQ ID NO: 2836578 - RNA, 15 nt, Human
uagcccacccugcug

SEQ ID NO: 2836579 - RNA, 18 nt, Human
uagcccacccugcugccu

SEQ ID NO: 2836580 - RNA, 14 nt, Human
uagcccaggcugga

SEQ ID NO: 2836581 - RNA, 19 nt, Human
uagcccaggcuggagugca

SEQ ID NO: 2836582 - RNA, 22 nt, Human
uagcccaggagagagaaagcca

SEQ ID NO: 2836583 - RNA, 17 nt, Human
uagcccaggagagagaa

SEQ ID NO: 2836584 - RNA, 18 nt, Human
uagcccaggagagagaaa

SEQ ID NO: 2836585 - RNA, 12 nt, Human
uagcccaucccu

SEQ ID NO: 2836586 - RNA, 14 nt, Human
uagcccaucccugc

SEQ ID NO: 2836587 - RNA, 15 nt, Human
uagcccaucccugcc

SEQ ID NO: 2836588 - RNA, 16 nt, Human
uagcccaucccugccu

SEQ ID NO: 2836589 - RNA, 17 nt, Human
uagcccaucccugccug

SEQ ID NO: 2836590 - RNA, 18 nt, Human
uagcccaucccugccugg

SEQ ID NO: 2836591 - RNA, 20 nt, Human
uagcccaucccugccugguc

SEQ ID NO: 2836592 - RNA, 21 nt, Human
uagcccaucccugccugguca

SEQ ID NO: 2836593 - RNA, 13 nt, Human
uagcucuuuccuu

SEQ ID NO: 2836594 - RNA, 15 nt, Human
uagcugccacuugaa

SEQ ID NO: 2836595 - RNA, 21 nt, Human
uagcugccacuugaacaaaau

SEQ ID NO: 2836596 - RNA, 15 nt, Human
uagcugcccauuucg

SEQ ID NO: 2836597 - RNA, 23 nt, Human
uagcugcccauuucgugagcccc

SEQ ID NO: 2836598 - RNA, 23 nt, Human
uagcugccuagcaagcuggccuc

SEQ ID NO: 2836599 - RNA, 11 nt, Human
uagcugggacu

SEQ ID NO: 2836600 - RNA, 20 nt, Human
uagcugggacuacaggcacc

SEQ ID NO: 2836601 - RNA, 18 nt, Human
uagcugggacuacaggug

SEQ ID NO: 2836602 - RNA, 22 nt, Human
uagcugggagaaagagagagcu

SEQ ID NO: 2836603 - RNA, 16 nt, Human
uagcuccucacugugg

SEQ ID NO: 2836604 - RNA, 19 nt, Human
uagccuccuucgcaggcau

SEQ ID NO: 2836605 - RNA, 20 nt, Human
uagccucgccgucugugaau

SEQ ID NO: 2836606 - RNA, 13 nt, Human
uagaguuuaacac

SEQ ID NO: 2836607 - RNA, 15 nt, Human
uagaguuuacagcuc

SEQ ID NO: 2836608 - RNA, 17 nt, Human
uagaguuuacagcucug

SEQ ID NO: 2836609 - RNA, 13 nt, Human
uagaguuucuguu

SEQ ID NO: 2836610 - RNA, 15 nt, Human
uagaguuucuguuug

SEQ ID NO: 2836611 - RNA, 20 nt, Human
uagaguuucuguuugauucu

SEQ ID NO: 2836612 - RNA, 21 nt, Human
uagaguuucuguuugauucuu

SEQ ID NO: 2836613 - RNA, 23 nt, Human
uagaguuucuguuugauucuuuu

SEQ ID NO: 2836614 - RNA, 12 nt, Human
uagaguuuaaca

SEQ ID NO: 2836615 - RNA, 17 nt, Human
uagaguuugcuauuaga

SEQ ID NO: 2836616 - RNA, 14 nt, Human
uagagucagccuuc

SEQ ID NO: 2836617 - RNA, 13 nt, Human
uagagucagccuu

SEQ ID NO: 2836618 - RNA, 14 nt, Human
uagaguauaugcac

SEQ ID NO: 2836619 - RNA, 13 nt, Human
uagaguccaaggu

SEQ ID NO: 2836620 - RNA, 16 nt, Human
uagaguccaagguuua

SEQ ID NO: 2836621 - RNA, 17 nt, Human
uagagaggaagauugaa

SEQ ID NO: 2836622 - RNA, 21 nt, Human
uagagaguuguuguguacaga

SEQ ID NO: 2836623 - RNA, 16 nt, Human
uagagagagaccacuu

SEQ ID NO: 2836624 - RNA, 16 nt, Human
uagagaacuguggccg

SEQ ID NO: 2836625 - RNA, 12 nt, Human
uagagaacugaa

SEQ ID NO: 2836626 - RNA, 13 nt, Human
uagagaacugaaa

SEQ ID NO: 2836627 - RNA, 14 nt, Human
uagagaacugaaaa

SEQ ID NO: 2836628 - RNA, 15 nt, Human
uagagaacugaaaag

SEQ ID NO: 2836629 - RNA, 16 nt, Human
uagagaacugaaaaga

SEQ ID NO: 2836630 - RNA, 21 nt, Human
uagagaacugaaaagagagca

SEQ ID NO: 2836631 - RNA, 22 nt, Human
uagagaacugaaaagagagcag

SEQ ID NO: 2836632 - RNA, 17 nt, Human
uagagacuuuuuucuag

SEQ ID NO: 2836633 - RNA, 21 nt, Human
uagagacuuuuuucuaguaca

SEQ ID NO: 2836634 - RNA, 16 nt, Human
uagagacugguuucuc

SEQ ID NO: 2836635 - RNA, 16 nt, Human
uagagguuuuguuguu

SEQ ID NO: 2836636 - RNA, 19 nt, Human
uagagguuuuguuguuuua

SEQ ID NO: 2836637 - RNA, 18 nt, Human
uagaguaaauacagguag

SEQ ID NO: 2836638 - RNA, 13 nt, Human
uagaguaagaaau

SEQ ID NO: 2836639 - RNA, 14 nt, Human
uagaguaagaaauu

SEQ ID NO: 2836640 - RNA, 15 nt, Human
uagaguaagaaauuu

SEQ ID NO: 2836641 - RNA, 21 nt, Human
uagaguaagaaauuucagguu

SEQ ID NO: 2836642 - RNA, 17 nt, Human
uagacugccuggguucc

SEQ ID NO: 2836643 - RNA, 19 nt, Human
uagacuggaaaaaaugagc

SEQ ID NO: 2836644 - RNA, 17 nt, Human
uagacugccgugcauua

SEQ ID NO: 2836645 - RNA, 16 nt, Human
uagacuggaaguucau

SEQ ID NO: 2836646 - RNA, 11 nt, Human
uagagacaggg

SEQ ID NO: 2836647 - RNA, 16 nt, Human
uagagaacgcagcccu

SEQ ID NO: 2836648 - RNA, 17 nt, Human
uagagaacgcagcccua

SEQ ID NO: 2836649 - RNA, 19 nt, Human
uagagaacgcagcccuaga

SEQ ID NO: 2836650 - RNA, 11 nt, Human
uagacuuucug

SEQ ID NO: 2836651 - RNA, 12 nt, Human
uagacuuucugu

SEQ ID NO: 2836652 - RNA, 20 nt, Human
uagagaacacgcguauuuac

SEQ ID NO: 2836653 - RNA, 15 nt, Human
uagacuuuaggcuuu

SEQ ID NO: 2836654 - RNA, 16 nt, Human
uagacuuuaggcuuuc

SEQ ID NO: 2836655 - RNA, 18 nt, Human
uagacuuuaggcuuucag

SEQ ID NO: 2836656 - RNA, 21 nt, Human
uagacuuuaggcuuucagcuu

SEQ ID NO: 2836657 - RNA, 12 nt, Human
uagacucuucac

SEQ ID NO: 2836658 - RNA, 16 nt, Human
uagacucuucacuguu

SEQ ID NO: 2836659 - RNA, 22 nt, Human
uagacugacuuguuugucuucc

SEQ ID NO: 2836660 - RNA, 23 nt, Human
uagaccgcucucuuuucuguacu

SEQ ID NO: 2836661 - RNA, 13 nt, Human
uagaccguuauaa

SEQ ID NO: 2836662 - RNA, 21 nt, Human
uagaaccauguugguugcacu

SEQ ID NO: 2836663 - RNA, 23 nt, Human
uagaaccauguugguugcacuuu

SEQ ID NO: 2836664 - RNA, 23 nt, Human
uagaaccaggcaacuugggaacu

SEQ ID NO: 2836665 - RNA, 20 nt, Human
uagaaccaccaacaagcaag

SEQ ID NO: 2836666 - RNA, 22 nt, Human
uagaaccaccaacaagcaagcu

SEQ ID NO: 2836667 - RNA, 12 nt, Human
uagaaccaggca

SEQ ID NO: 2836668 - RNA, 21 nt, Human
uagaugucuagguacuucagg

SEQ ID NO: 2836669 - RNA, 12 nt, Human
uagaugucuuuu

SEQ ID NO: 2836670 - RNA, 14 nt, Human
uagaugucuuuuau

SEQ ID NO: 2836671 - RNA, 17 nt, Human
uagaugucuuuuauagu

SEQ ID NO: 2836672 - RNA, 18 nt, Human
uagauguuccaguaaucu

SEQ ID NO: 2836673 - RNA, 14 nt, Human
uagauggugaaauu

SEQ ID NO: 2836674 - RNA, 15 nt, Human
uagauggugaaauuu

SEQ ID NO: 2836675 - RNA, 16 nt, Human
uagauaaauauuugac

SEQ ID NO: 2836676 - RNA, 19 nt, Human
uagauaaauauuugacuug

SEQ ID NO: 2836677 - RNA, 19 nt, Human
uagauaacgcuuaaaggaa

SEQ ID NO: 2836678 - RNA, 15 nt, Human
uagauaaaagcugaa

SEQ ID NO: 2836679 - RNA, 22 nt, Human
uagcagccccgggagggcggca

SEQ ID NO: 2836680 - RNA, 23 nt, Human
uagcagagaaugaaagggcccag

SEQ ID NO: 2836681 - RNA, 19 nt, Human
uagcagagaaugaaagggc

SEQ ID NO: 2836682 - RNA, 12 nt, Human
uagcagaugguu

SEQ ID NO: 2836683 - RNA, 14 nt, Human
uagcagaugguuuc

SEQ ID NO: 2836684 - RNA, 21 nt, Human
uagcagaugguuuccacauuu

SEQ ID NO: 2836685 - RNA, 23 nt, Human
uagcagauuguuuccucuuccaa

SEQ ID NO: 2836686 - RNA, 17 nt, Human
uagcagcaaaaauauaa

SEQ ID NO: 2836687 - RNA, 18 nt, Human
uagcagcaaaaauauaaa

SEQ ID NO: 2836688 - RNA, 20 nt, Human
uagcagcaaaaauauaaaau

SEQ ID NO: 2836689 - RNA, 21 nt, Human
uagcagcaaaaauauaaaaua

SEQ ID NO: 2836690 - RNA, 22 nt, Human
uagcagagggguaagagaggau

SEQ ID NO: 2836691 - RNA, 16 nt, Human
uagcagaagaaaggaa

SEQ ID NO: 2836692 - RNA, 17 nt, Human
uagcagaagaaaggaac

SEQ ID NO: 2836693 - RNA, 21 nt, Human
uagcagaagaaaggaacauuu

SEQ ID NO: 2836694 - RNA, 22 nt, Human
uagcagaagaaaggaacauuua

SEQ ID NO: 2836695 - RNA, 23 nt, Human
uagauugaaaacuuuucucagau

SEQ ID NO: 2836696 - RNA, 18 nt, Human
uagauugaaaacuuuucu

SEQ ID NO: 2836697 - RNA, 23 nt, Human
uagauucucuuguauaagauccu

SEQ ID NO: 2836698 - RNA, 20 nt, Human
uagauugaaaacuuuucuca

SEQ ID NO: 2836699 - RNA, 21 nt, Human
uagauugaaaacuuuucucag

SEQ ID NO: 2836700 - RNA, 16 nt, Human
uagauuguuaaaauaa

SEQ ID NO: 2836701 - RNA, 12 nt, Human
uagauuguaaac

SEQ ID NO: 2836702 - RNA, 15 nt, Human
uagauguugccaugu

SEQ ID NO: 2836703 - RNA, 14 nt, Human
uagauguugccaug

SEQ ID NO: 2836704 - RNA, 20 nt, Human
uagauguuuauucuucuaga

SEQ ID NO: 2836705 - RNA, 21 nt, Human
uagauguuuauucuucuagag

SEQ ID NO: 2836706 - RNA, 13 nt, Human
uagauguuucaca

SEQ ID NO: 2836707 - RNA, 14 nt, Human
uagauuaaauaaaa

SEQ ID NO: 2836708 - RNA, 13 nt, Human
uagauuaaauaua

SEQ ID NO: 2836709 - RNA, 15 nt, Human
uagauuaaauauaga

SEQ ID NO: 2836710 - RNA, 18 nt, Human
uagauuaaauauagauua

SEQ ID NO: 2836711 - RNA, 20 nt, Human
uagauuaaauauagauuaga

SEQ ID NO: 2836712 - RNA, 22 nt, Human
uagauuaaauauagauuagaaa

SEQ ID NO: 2836713 - RNA, 20 nt, Human
uagauucuacauauucuuua

SEQ ID NO: 2836714 - RNA, 15 nt, Human
uagauucuaaagauu

SEQ ID NO: 2836715 - RNA, 17 nt, Human
uagauucuaaagauucu

SEQ ID NO: 2836716 - RNA, 16 nt, Human
uagauguuuugguaga

SEQ ID NO: 2836717 - RNA, 20 nt, Human
uagauguuuugguagauuaa

SEQ ID NO: 2836718 - RNA, 21 nt, Human
uagauguuuugguagauuaaa

SEQ ID NO: 2836719 - RNA, 18 nt, Human
uagauucuaaagauucua

SEQ ID NO: 2836720 - RNA, 22 nt, Human
uagauucucuggcuguaaggcu

SEQ ID NO: 2836721 - RNA, 23 nt, Human
uagauucucuggcuguaaggcuc

SEQ ID NO: 2836722 - RNA, 19 nt, Human
uagauucucugugucuaag

SEQ ID NO: 2836723 - RNA, 20 nt, Human
uagauucucugugucuaaga

SEQ ID NO: 2836724 - RNA, 21 nt, Human
uagauucucugugucuaagau

SEQ ID NO: 2836725 - RNA, 22 nt, Human
uagauucucugugucuaagauu

SEQ ID NO: 2836726 - RNA, 23 nt, Human
uagauucucugugucuaagauuc

SEQ ID NO: 2836727 - RNA, 22 nt, Human
uacugauuauuuucuucaucca

SEQ ID NO: 2836728 - RNA, 18 nt, Human
uacugauucacugcaugg

SEQ ID NO: 2836729 - RNA, 16 nt, Human
uacugauugagaaguu

SEQ ID NO: 2836730 - RNA, 20 nt, Human
uacugaguauguggaaggca

SEQ ID NO: 2836731 - RNA, 23 nt, Human
uacugagggaccaacugggccca

SEQ ID NO: 2836732 - RNA, 17 nt, Human
uacuccucuuuacacug

SEQ ID NO: 2836733 - RNA, 11 nt, Human
uacuccugacu

SEQ ID NO: 2836734 - RNA, 12 nt, Human
uacuccugacuc

SEQ ID NO: 2836735 - RNA, 13 nt, Human
uacuccugacucc

SEQ ID NO: 2836736 - RNA, 13 nt, Human
uacuccuccucuu

SEQ ID NO: 2836737 - RNA, 15 nt, Human
uacuccuccucuuuc

SEQ ID NO: 2836738 - RNA, 16 nt, Human
uacuccuccucuuucu

SEQ ID NO: 2836739 - RNA, 18 nt, Human
uacuccuccucuuucucu

SEQ ID NO: 2836740 - RNA, 19 nt, Human
uacuccuccucuuucucuc

SEQ ID NO: 2836741 - RNA, 22 nt, Human
uacuccuccucuuucucucccc

SEQ ID NO: 2836742 - RNA, 23 nt, Human
uacuccuccucuuucucucccca

SEQ ID NO: 2836743 - RNA, 15 nt, Human
uacucacugaagccu

SEQ ID NO: 2836744 - RNA, 20 nt, Human
uacuaccuugaaaauaagaa

SEQ ID NO: 2836745 - RNA, 16 nt, Human
uacuaccuugaaaaua

SEQ ID NO: 2836746 - RNA, 18 nt, Human
uacuacauugaguagaca

SEQ ID NO: 2836747 - RNA, 15 nt, Human
uacuaccaaugccaa

SEQ ID NO: 2836748 - RNA, 14 nt, Human
uacuacaguuuuua

SEQ ID NO: 2836749 - RNA, 14 nt, Human
uacuaccuugaaaa

SEQ ID NO: 2836750 - RNA, 13 nt, Human
uacuaccuugaaa

SEQ ID NO: 2836751 - RNA, 13 nt, Human
uacuaccugugua

SEQ ID NO: 2836752 - RNA, 22 nt, Human
uacuaccuguguauauaguuuu

SEQ ID NO: 2836753 - RNA, 17 nt, Human
uacucagaagccugagg

SEQ ID NO: 2836754 - RNA, 16 nt, Human
uacucagaagccugag

SEQ ID NO: 2836755 - RNA, 19 nt, Human
uacucagaagccugaggcu

SEQ ID NO: 2836756 - RNA, 12 nt, Human
uacucagccugc

SEQ ID NO: 2836757 - RNA, 13 nt, Human
uacucagccugcu

SEQ ID NO: 2836758 - RNA, 16 nt, Human
uacucagccugcugcc

SEQ ID NO: 2836759 - RNA, 15 nt, Human
uacucagggcuccuc

SEQ ID NO: 2836760 - RNA, 16 nt, Human
uacucagggcuccucc

SEQ ID NO: 2836761 - RNA, 17 nt, Human
uacucagggcuccuccc

SEQ ID NO: 2836762 - RNA, 18 nt, Human
uacucagggcuccuccca

SEQ ID NO: 2836763 - RNA, 19 nt, Human
uacucagggcuccucccag

SEQ ID NO: 2836764 - RNA, 20 nt, Human
uacucagggcuccucccagc

SEQ ID NO: 2836765 - RNA, 21 nt, Human
uacucagggcuccucccagcu

SEQ ID NO: 2836766 - RNA, 21 nt, Human
uacucaguuuauguuguacaa

SEQ ID NO: 2836767 - RNA, 15 nt, Human
uacuacacauuuuua

SEQ ID NO: 2836768 - RNA, 22 nt, Human
uacuacacauuuuuaaauuguu

SEQ ID NO: 2836769 - RNA, 20 nt, Human
uacuacacuccaugucaggu

SEQ ID NO: 2836770 - RNA, 13 nt, Human
uacuacacugagg

SEQ ID NO: 2836771 - RNA, 15 nt, Human
uacuacacugaggag

SEQ ID NO: 2836772 - RNA, 15 nt, Human
uacuacagcuaugaa

SEQ ID NO: 2836773 - RNA, 15 nt, Human
uacgaauauuuucag

SEQ ID NO: 2836774 - RNA, 22 nt, Human
uaccuugaaaauaagaauagaa

SEQ ID NO: 2836775 - RNA, 14 nt, Human
uaccuucucccuca

SEQ ID NO: 2836776 - RNA, 15 nt, Human
uaccuucuucaggcu

SEQ ID NO: 2836777 - RNA, 12 nt, Human
uaccuucuuuca

SEQ ID NO: 2836778 - RNA, 22 nt, Human
uaccuucucccucauuucagga

SEQ ID NO: 2836779 - RNA, 16 nt, Human
uaccuugaccuuugua

SEQ ID NO: 2836780 - RNA, 18 nt, Human
uaccuugaccuuuguaca

SEQ ID NO: 2836781 - RNA, 16 nt, Human
uaccuugacuguugau

SEQ ID NO: 2836782 - RNA, 18 nt, Human
uacccaugacuuuauaug

SEQ ID NO: 2836783 - RNA, 23 nt, Human
uacccauacacccccucuucuga

SEQ ID NO: 2836784 - RNA, 20 nt, Human
uacccaucuaguacuugaaa

SEQ ID NO: 2836785 - RNA, 21 nt, Human
uacccaucuaguacuugaaaa

SEQ ID NO: 2836786 - RNA, 16 nt, Human
uacccagcuaaauaau

SEQ ID NO: 2836787 - RNA, 21 nt, Human
uacccagcuaaauaaucuuac

SEQ ID NO: 2836788 - RNA, 16 nt, Human
uacccaggaccaagcc

SEQ ID NO: 2836789 - RNA, 21 nt, Human
uacccaggaccaagccacagc

SEQ ID NO: 2836790 - RNA, 16 nt, Human
uacccagggccugcag

SEQ ID NO: 2836791 - RNA, 18 nt, Human
uacccaggguggagugca

SEQ ID NO: 2836792 - RNA, 20 nt, Human
uacccaggguggagugcagu

SEQ ID NO: 2836793 - RNA, 16 nt, Human
uacccauacacccccu

SEQ ID NO: 2836794 - RNA, 21 nt, Human
uaccuuucacagcuuuuauca

SEQ ID NO: 2836795 - RNA, 22 nt, Human
uaccuuguuauuuaacccauuu

SEQ ID NO: 2836796 - RNA, 12 nt, Human
uacuguguacug

SEQ ID NO: 2836797 - RNA, 13 nt, Human
uacuguguacugu

SEQ ID NO: 2836798 - RNA, 15 nt, Human
uacuguguacuguau

SEQ ID NO: 2836799 - RNA, 18 nt, Human
uacuguguacuguauaga

SEQ ID NO: 2836800 - RNA, 16 nt, Human
uacugugucauaaaca

SEQ ID NO: 2836801 - RNA, 16 nt, Human
uacuguguaauauaaa

SEQ ID NO: 2836802 - RNA, 14 nt, Human
uacuguguguguga

SEQ ID NO: 2836803 - RNA, 21 nt, Human
uacugugugcuuguuuuauaa

SEQ ID NO: 2836804 - RNA, 13 nt, Human
uacuguguggaac

SEQ ID NO: 2836805 - RNA, 19 nt, Human
uacuguguggaacuuuuau

SEQ ID NO: 2836806 - RNA, 18 nt, Human
uacugugugugugaauga

SEQ ID NO: 2836807 - RNA, 17 nt, Human
uacugugugugugaaug

SEQ ID NO: 2836808 - RNA, 19 nt, Human
uacugugugugugaaugaa

SEQ ID NO: 2836809 - RNA, 12 nt, Human
uacuguucuaaa

SEQ ID NO: 2836810 - RNA, 13 nt, Human
uacuguucuaaag

SEQ ID NO: 2836811 - RNA, 14 nt, Human
uacuguucuaaagc

SEQ ID NO: 2836812 - RNA, 16 nt, Human
uacuguucugugucuu

SEQ ID NO: 2836813 - RNA, 11 nt, Human
uacuguuggug

SEQ ID NO: 2836814 - RNA, 21 nt, Human
uacuguucuaaagcucugaca

SEQ ID NO: 2836815 - RNA, 14 nt, Human
uacuguucuguguc

SEQ ID NO: 2836816 - RNA, 15 nt, Human
uacuguucuaaagcu

SEQ ID NO: 2836817 - RNA, 17 nt, Human
uacuguucuaaagcucu

SEQ ID NO: 2836818 - RNA, 18 nt, Human
uacuguucuaaagcucug

SEQ ID NO: 2836819 - RNA, 19 nt, Human
uacuguucuaaagcucuga

SEQ ID NO: 2836820 - RNA, 17 nt, Human
uacuguucugugucuuu

SEQ ID NO: 2836821 - RNA, 10 nt, Human
uacuguucuu

SEQ ID NO: 2836822 - RNA, 17 nt, Human
uacuguucuucauuuua

SEQ ID NO: 2836823 - RNA, 12 nt, Human
uacuguucuugc

SEQ ID NO: 2836824 - RNA, 13 nt, Human
uacuguucuugcu

SEQ ID NO: 2836825 - RNA, 14 nt, Human
uacuguucuugcug

SEQ ID NO: 2836826 - RNA, 15 nt, Human
uacuguucuugcugc

SEQ ID NO: 2836827 - RNA, 16 nt, Human
uacuguucuugcugcu

SEQ ID NO: 2836828 - RNA, 17 nt, Human
uacuguucuugcugcua

SEQ ID NO: 2836829 - RNA, 18 nt, Human
uacuguucuugcugcuag

SEQ ID NO: 2836830 - RNA, 19 nt, Human
uacuguucuugcugcuaga

SEQ ID NO: 2836831 - RNA, 20 nt, Human
uacuguucuugcugcuagaa

SEQ ID NO: 2836832 - RNA, 21 nt, Human
uacuguucuugcugcuagaac

SEQ ID NO: 2836833 - RNA, 22 nt, Human
uacuguucuugcugcuagaacu

SEQ ID NO: 2836834 - RNA, 23 nt, Human
uacuguucuugcugcuagaacuu

SEQ ID NO: 2836835 - RNA, 20 nt, Human
uacuguugauaauucuuauu

SEQ ID NO: 2836836 - RNA, 22 nt, Human
uacuguugauaauucuuauuuu

SEQ ID NO: 2836837 - RNA, 15 nt, Human
uacugcagcuuuaca

SEQ ID NO: 2836838 - RNA, 19 nt, Human
uacugcagcuuuacaugca

SEQ ID NO: 2836839 - RNA, 22 nt, Human
uacugcagcuuuacaugcaauu

SEQ ID NO: 2836840 - RNA, 23 nt, Human
uacugcagcuuuacaugcaauuu

SEQ ID NO: 2836841 - RNA, 10 nt, Human
uacugcaggg

SEQ ID NO: 2836842 - RNA, 12 nt, Human
uacugcagggcc

SEQ ID NO: 2836843 - RNA, 14 nt, Human
uacugcagggccag

SEQ ID NO: 2836844 - RNA, 16 nt, Human
uacugcagggccagga

SEQ ID NO: 2836845 - RNA, 18 nt, Human
uacugcagggccaggacu

SEQ ID NO: 2836846 - RNA, 19 nt, Human
uacugcagggccaggacug

SEQ ID NO: 2836847 - RNA, 11 nt, Human
uacugcaguug

SEQ ID NO: 2836848 - RNA, 19 nt, Human
uacugcaguugaaagggca

SEQ ID NO: 2836849 - RNA, 23 nt, Human
uacuguggaggaaggauuguaaa

SEQ ID NO: 2836850 - RNA, 14 nt, Human
uacuguaugugaug

SEQ ID NO: 2836851 - RNA, 16 nt, Human
uacuguaugugaugaa

SEQ ID NO: 2836852 - RNA, 18 nt, Human
uacuuguggacacagcuc

SEQ ID NO: 2836853 - RNA, 15 nt, Human
uacuuguggacacag

SEQ ID NO: 2836854 - RNA, 19 nt, Human
uacuuguggacacagcucu

SEQ ID NO: 2836855 - RNA, 18 nt, Human
uacuuuacacaauucuua

SEQ ID NO: 2836856 - RNA, 14 nt, Human
uacuuguggacaca

SEQ ID NO: 2836857 - RNA, 17 nt, Human
uacuugguccaacugca

SEQ ID NO: 2836858 - RNA, 13 nt, Human
uacuugguuugug

SEQ ID NO: 2836859 - RNA, 14 nt, Human
uacuugguuugugu

SEQ ID NO: 2836860 - RNA, 20 nt, Human
uacuugguuuguguucuucu

SEQ ID NO: 2836861 - RNA, 14 nt, Human
uacuuacauucucu

SEQ ID NO: 2836862 - RNA, 15 nt, Human
uacuuacauucucua

SEQ ID NO: 2836863 - RNA, 22 nt, Human
uacuuacauucucuaauaagaa

SEQ ID NO: 2836864 - RNA, 15 nt, Human
uacuuacuaaaauau

SEQ ID NO: 2836865 - RNA, 16 nt, Human
uacuuagaguuucugu

SEQ ID NO: 2836866 - RNA, 18 nt, Human
uacuuagaguuucuguuu

SEQ ID NO: 2836867 - RNA, 19 nt, Human
uacuuagaguuucuguuug

SEQ ID NO: 2836868 - RNA, 20 nt, Human
uacuuagaguuucuguuuga

SEQ ID NO: 2836869 - RNA, 17 nt, Human
uacuuagcaaaaagugg

SEQ ID NO: 2836870 - RNA, 14 nt, Human
uacuuagcauccua

SEQ ID NO: 2836871 - RNA, 15 nt, Human
uacuuagcauccuaa

SEQ ID NO: 2836872 - RNA, 19 nt, Human
uacuuagcauccuaagaaa

SEQ ID NO: 2836873 - RNA, 20 nt, Human
uacuuagcauccuaagaaau

SEQ ID NO: 2836874 - RNA, 21 nt, Human
uacuuagcauccuaagaaaua

SEQ ID NO: 2836875 - RNA, 22 nt, Human
uacuuagcauccuaagaaauau

SEQ ID NO: 2836876 - RNA, 17 nt, Human
uacuuacuaaaauauau

SEQ ID NO: 2836877 - RNA, 18 nt, Human
uacuuagcaaaguuuuac

SEQ ID NO: 2836878 - RNA, 22 nt, Human
uacuugaagucuaaaagcagaa

SEQ ID NO: 2836879 - RNA, 23 nt, Human
uacuugaagucuaaaagcagaaa

SEQ ID NO: 2836880 - RNA, 18 nt, Human
uacuugaguguaauguuu

SEQ ID NO: 2836881 - RNA, 20 nt, Human
uacuugcagcucccauucua

SEQ ID NO: 2836882 - RNA, 22 nt, Human
uacuugcagcucccauucuaug

SEQ ID NO: 2836883 - RNA, 14 nt, Human
uacuugccagaagu

SEQ ID NO: 2836884 - RNA, 15 nt, Human
uacuugccagaaguu

SEQ ID NO: 2836885 - RNA, 14 nt, Human
uagaaagcaggggc

SEQ ID NO: 2836886 - RNA, 22 nt, Human
uagaaagcaggggcuacaagag

SEQ ID NO: 2836887 - RNA, 15 nt, Human
uagaaagcauuacau

SEQ ID NO: 2836888 - RNA, 12 nt, Human
uagaaagaaagu

SEQ ID NO: 2836889 - RNA, 15 nt, Human
uacuuuaguaugacg

SEQ ID NO: 2836890 - RNA, 14 nt, Human
uacuuuagaagcac

SEQ ID NO: 2836891 - RNA, 16 nt, Human
uacuuuacucauuuuu

SEQ ID NO: 2836892 - RNA, 14 nt, Human
uacuuuaucacuuu

SEQ ID NO: 2836893 - RNA, 18 nt, Human
uacuuuaucacuuuuuga

SEQ ID NO: 2836894 - RNA, 20 nt, Human
uacuuuaucacuuuuugaac

SEQ ID NO: 2836895 - RNA, 20 nt, Human
uacuuucauccugacucugc

SEQ ID NO: 2836896 - RNA, 18 nt, Human
uagaaagcugacauugcc

SEQ ID NO: 2836897 - RNA, 21 nt, Human
uagaaagcugacauugccaaa

SEQ ID NO: 2836898 - RNA, 15 nt, Human
uagaaagcaggggcu

SEQ ID NO: 2836899 - RNA, 19 nt, Human
uagaaauaaaggaugugau

SEQ ID NO: 2836900 - RNA, 20 nt, Human
uagaaaguucaaaaagucua

SEQ ID NO: 2836901 - RNA, 21 nt, Human
uagaaauaaaagugaaugaaa

SEQ ID NO: 2836902 - RNA, 23 nt, Human
uagaaauaaaagugaaugaaaga

SEQ ID NO: 2836903 - RNA, 15 nt, Human
uagaaauaauaugca

SEQ ID NO: 2836904 - RNA, 16 nt, Human
uagaaauaagugguua

SEQ ID NO: 2836905 - RNA, 22 nt, Human
uagaaauaagugguuauuucuc

SEQ ID NO: 2836906 - RNA, 16 nt, Human
uagaaauaauaugcau

SEQ ID NO: 2836907 - RNA, 23 nt, Human
uagaaauaagugguuauuucuca

SEQ ID NO: 2836908 - RNA, 11 nt, Human
uagaaauaagu

SEQ ID NO: 2836909 - RNA, 12 nt, Human
uagaaauaagug

SEQ ID NO: 2836910 - RNA, 20 nt, Human
uagaaauaaaggaugugauu

SEQ ID NO: 2836911 - RNA, 17 nt, Human
uagaacagauaaucagu

SEQ ID NO: 2836912 - RNA, 23 nt, Human
uagaacagagaaagaggaagcuu

SEQ ID NO: 2836913 - RNA, 16 nt, Human
uagaacacuaacucac

SEQ ID NO: 2836914 - RNA, 15 nt, Human
uagaacacaggcaaa

SEQ ID NO: 2836915 - RNA, 16 nt, Human
uagaacaaaggacaga

SEQ ID NO: 2836916 - RNA, 20 nt, Human
uagaacaaaggacagaguau

SEQ ID NO: 2836917 - RNA, 17 nt, Human
uagaacaauuuucuugu

SEQ ID NO: 2836918 - RNA, 22 nt, Human
uagaaauuagaaaaaaauuacu

SEQ ID NO: 2836919 - RNA, 23 nt, Human
uagaaauuagaaaaaaauuacua

SEQ ID NO: 2836920 - RNA, 19 nt, Human
uagaaauuacacccaaaga

SEQ ID NO: 2836921 - RNA, 15 nt, Human
uagaaaugugaauga

SEQ ID NO: 2836922 - RNA, 19 nt, Human
uagaaauguaacuuuugua

SEQ ID NO: 2836923 - RNA, 15 nt, Human
uagaaauguaaacug

SEQ ID NO: 2836924 - RNA, 16 nt, Human
uagaaauguaaacugc

SEQ ID NO: 2836925 - RNA, 18 nt, Human
uagaaauguaaacugcca

SEQ ID NO: 2836926 - RNA, 19 nt, Human
uagaaauguaaacugccau

SEQ ID NO: 2836927 - RNA, 14 nt, Human
uagaaauaguuuga

SEQ ID NO: 2836928 - RNA, 19 nt, Human
uaccaaugcuuuuaucaaa

SEQ ID NO: 2836929 - RNA, 15 nt, Human
uaccaccacgcccgg

SEQ ID NO: 2836930 - RNA, 16 nt, Human
uaccauugcuguucua

SEQ ID NO: 2836931 - RNA, 23 nt, Human
uaccauuuugggguacccacugc

SEQ ID NO: 2836932 - RNA, 20 nt, Human
uaccauuuuuuaaggaaaca

SEQ ID NO: 2836933 - RNA, 23 nt, Human
uaccauuuccucagcuuaucucu

SEQ ID NO: 2836934 - RNA, 14 nt, Human
uaccauuuuucauu

SEQ ID NO: 2836935 - RNA, 16 nt, Human
uaccauuucagagagg

SEQ ID NO: 2836936 - RNA, 15 nt, Human
uaccauuugccuccc

SEQ ID NO: 2836937 - RNA, 21 nt, Human
uaccauuugcuacuguacaua

SEQ ID NO: 2836938 - RNA, 15 nt, Human
uaccauuucagagag

SEQ ID NO: 2836939 - RNA, 12 nt, Human
uaccauuucaga

SEQ ID NO: 2836940 - RNA, 13 nt, Human
uaccaaugcugca

SEQ ID NO: 2836941 - RNA, 17 nt, Human
uaccacacaucuaugau

SEQ ID NO: 2836942 - RNA, 14 nt, Human
uaccaaugccaaga

SEQ ID NO: 2836943 - RNA, 21 nt, Human
uaccaaugccaagauaauuca

SEQ ID NO: 2836944 - RNA, 20 nt, Human
uaccaaguauagccuauggc

SEQ ID NO: 2836945 - RNA, 14 nt, Human
uaccaacuuucugu

SEQ ID NO: 2836946 - RNA, 15 nt, Human
uaccaacuuucugua

SEQ ID NO: 2836947 - RNA, 17 nt, Human
uaccaacuuucuguaaa

SEQ ID NO: 2836948 - RNA, 19 nt, Human
uaccaacuuucuguaaacu

SEQ ID NO: 2836949 - RNA, 21 nt, Human
uaccaagaugccaucuguguc

SEQ ID NO: 2836950 - RNA, 18 nt, Human
uacccacaccucugccag

SEQ ID NO: 2836951 - RNA, 17 nt, Human
uacccacaccucugcca

SEQ ID NO: 2836952 - RNA, 18 nt, Human
uacccaagggcagaaagu

SEQ ID NO: 2836953 - RNA, 15 nt, Human
uacccaauagcugcc

SEQ ID NO: 2836954 - RNA, 13 nt, Human
uacccaauuuccc

SEQ ID NO: 2836955 - RNA, 19 nt, Human
uacccacaccucugccaga

SEQ ID NO: 2836956 - RNA, 18 nt, Human
uacccacauguacagaca

SEQ ID NO: 2836957 - RNA, 23 nt, Human
uacccaacggcccugcagccagc

SEQ ID NO: 2836958 - RNA, 21 nt, Human
uaccauuuuuuaaggaaacaa

SEQ ID NO: 2836959 - RNA, 17 nt, Human
uacccaaaacaagccug

SEQ ID NO: 2836960 - RNA, 15 nt, Human
uacccaaaagagaaa

SEQ ID NO: 2836961 - RNA, 17 nt, Human
uacccaaaagagaaaaa

SEQ ID NO: 2836962 - RNA, 16 nt, Human
uacccaaacccuaggu

SEQ ID NO: 2836963 - RNA, 20 nt, Human
uacccaaacccuagguuccc

SEQ ID NO: 2836964 - RNA, 18 nt, Human
uacccagcgagcccuggu

SEQ ID NO: 2836965 - RNA, 16 nt, Human
uacccagcgagcccug

SEQ ID NO: 2836966 - RNA, 14 nt, Human
uacccacugcucug

SEQ ID NO: 2836967 - RNA, 13 nt, Human
uacccacugcucu

SEQ ID NO: 2836968 - RNA, 12 nt, Human
uacccacugcuc

SEQ ID NO: 2836969 - RNA, 11 nt, Human
uacccacugcu

SEQ ID NO: 2836970 - RNA, 22 nt, Human
uacccaccuagaacacuaacuc

SEQ ID NO: 2836971 - RNA, 15 nt, Human
uacccaccuagaaca

SEQ ID NO: 2836972 - RNA, 12 nt, Human
uacccaccuaga

SEQ ID NO: 2836973 - RNA, 16 nt, Human
uacaugcaauuuauua

SEQ ID NO: 2836974 - RNA, 19 nt, Human
uacaugcaauuuauuaaaa

SEQ ID NO: 2836975 - RNA, 16 nt, Human
uacaugcaaaaagaaa

SEQ ID NO: 2836976 - RNA, 18 nt, Human
uacaugcaaaaagaaaug

SEQ ID NO: 2836977 - RNA, 19 nt, Human
uacaugcaaaaagaaauga

SEQ ID NO: 2836978 - RNA, 23 nt, Human
uacauuuggagacacaacuauuu

SEQ ID NO: 2836979 - RNA, 12 nt, Human
uacagcccagag

SEQ ID NO: 2836980 - RNA, 14 nt, Human
uacauuuggaacua

SEQ ID NO: 2836981 - RNA, 20 nt, Human
uacaugcaauuuauuaaaau

SEQ ID NO: 2836982 - RNA, 12 nt, Human
uaccaaacagca

SEQ ID NO: 2836983 - RNA, 14 nt, Human
uaccaaacagcaaa

SEQ ID NO: 2836984 - RNA, 15 nt, Human
uaccaaacagcaaac

SEQ ID NO: 2836985 - RNA, 21 nt, Human
uaccaaacagcaaaccaagag

SEQ ID NO: 2836986 - RNA, 19 nt, Human
uaccaaagugaccuaccca

SEQ ID NO: 2836987 - RNA, 15 nt, Human
uaccaaaguuuuauc

SEQ ID NO: 2836988 - RNA, 17 nt, Human
uaccaaaguuuuaucaa

SEQ ID NO: 2836989 - RNA, 18 nt, Human
uaccaaaguuuuaucaag

SEQ ID NO: 2836990 - RNA, 13 nt, Human
uaccaacuuucug

SEQ ID NO: 2836991 - RNA, 18 nt, Human
uacauuuggauaaacaac

SEQ ID NO: 2836992 - RNA, 16 nt, Human
uacauuugugagauuc

SEQ ID NO: 2836993 - RNA, 13 nt, Human
uacauuuuguugu

SEQ ID NO: 2836994 - RNA, 16 nt, Human
uacauuuuguuguaaa

SEQ ID NO: 2836995 - RNA, 17 nt, Human
uacauuuuguuguaaaa

SEQ ID NO: 2836996 - RNA, 18 nt, Human
uacauuuuguuguaaaaa

SEQ ID NO: 2836997 - RNA, 20 nt, Human
uacaguuaggcaccagaaga

SEQ ID NO: 2836998 - RNA, 23 nt, Human
uacaguuaggcaccagaagaaca

SEQ ID NO: 2836999 - RNA, 16 nt, Human
uacaguucaauaaacu

SEQ ID NO: 2837000 - RNA, 22 nt, Human
uacauaagcggcguaaguuuaa

SEQ ID NO: 2837001 - RNA, 13 nt, Human
uacauccugggua

SEQ ID NO: 2837002 - RNA, 14 nt, Human
uacauccuggguaa

SEQ ID NO: 2837003 - RNA, 19 nt, Human
uacaucuauuuuggauugu

SEQ ID NO: 2837004 - RNA, 18 nt, Human
uacaucuauuuuggauug

SEQ ID NO: 2837005 - RNA, 23 nt, Human
uacaucuauuuuggauuguauau

SEQ ID NO: 2837006 - RNA, 15 nt, Human
uacaucucuccccaa

SEQ ID NO: 2837007 - RNA, 19 nt, Human
uacaucugagguccuguga

SEQ ID NO: 2837008 - RNA, 13 nt, Human
uacaucuggcuua

SEQ ID NO: 2837009 - RNA, 14 nt, Human
uacaucuggcuuau

SEQ ID NO: 2837010 - RNA, 15 nt, Human
uacaucuggcuuauu

SEQ ID NO: 2837011 - RNA, 17 nt, Human
uacaucuggcuuauuuu

SEQ ID NO: 2837012 - RNA, 20 nt, Human
uacaucuggcuuauuuuaau

SEQ ID NO: 2837013 - RNA, 21 nt, Human
uacaucuggcuuauuuuaaug

SEQ ID NO: 2837014 - RNA, 23 nt, Human
uacaucuggcuuauuuuaaugug

SEQ ID NO: 2837015 - RNA, 22 nt, Human
uacaucuauuuuggauuguaua

SEQ ID NO: 2837016 - RNA, 20 nt, Human
uacaucuauuuuggauugua

SEQ ID NO: 2837017 - RNA, 23 nt, Human
uacaugaggaacuguagaugaug

SEQ ID NO: 2837018 - RNA, 20 nt, Human
uacaugaggaacuguagaug

SEQ ID NO: 2837019 - RNA, 19 nt, Human
uacaugaggaacuguagau

SEQ ID NO: 2837020 - RNA, 16 nt, Human
uacaugagaaggaacu

SEQ ID NO: 2837021 - RNA, 18 nt, Human
uacaugagaacaaacaga

SEQ ID NO: 2837022 - RNA, 17 nt, Human
uacaugagaacaaacag

SEQ ID NO: 2837023 - RNA, 14 nt, Human
uacaugaauacaaa

SEQ ID NO: 2837024 - RNA, 20 nt, Human
uacaugaaauuuuuguaaau

SEQ ID NO: 2837025 - RNA, 13 nt, Human
uacaucugucaug

SEQ ID NO: 2837026 - RNA, 14 nt, Human
uacaucuucugccu

SEQ ID NO: 2837027 - RNA, 17 nt, Human
uacaucuucugccuuag

SEQ ID NO: 2837028 - RNA, 16 nt, Human
uacaucuuuaaacagu

SEQ ID NO: 2837029 - RNA, 16 nt, Human
uacaggcacccaccau

SEQ ID NO: 2837030 - RNA, 19 nt, Human
uacaggaaaagcugcugac

SEQ ID NO: 2837031 - RNA, 19 nt, Human
uacagcuuugaucccugac

SEQ ID NO: 2837032 - RNA, 21 nt, Human
uacaggaagcaccccaugcca

SEQ ID NO: 2837033 - RNA, 14 nt, Human
uacaggcagucucu

SEQ ID NO: 2837034 - RNA, 15 nt, Human
uacaggcagucucuc

SEQ ID NO: 2837035 - RNA, 23 nt, Human
uacaggauuugaacucagaucug

SEQ ID NO: 2837036 - RNA, 13 nt, Human
uacaggcaauucc

SEQ ID NO: 2837037 - RNA, 14 nt, Human
uacaggcaauuccg

SEQ ID NO: 2837038 - RNA, 20 nt, Human
uacaggauuugaacucagau

SEQ ID NO: 2837039 - RNA, 21 nt, Human
uacagccaagugccaaaugcu

SEQ ID NO: 2837040 - RNA, 17 nt, Human
uacagcacuacugggug

SEQ ID NO: 2837041 - RNA, 18 nt, Human
uacagcacuacugggugu

SEQ ID NO: 2837042 - RNA, 19 nt, Human
uacagcacuacuggguguc

SEQ ID NO: 2837043 - RNA, 22 nt, Human
uacagcacuacugggugucauu

SEQ ID NO: 2837044 - RNA, 23 nt, Human
uacagcacuacugggugucauuu

SEQ ID NO: 2837045 - RNA, 13 nt, Human
uacagcagcaaga

SEQ ID NO: 2837046 - RNA, 14 nt, Human
uacagcagcaagaa

SEQ ID NO: 2837047 - RNA, 15 nt, Human
uacagcagcaagaaa

SEQ ID NO: 2837048 - RNA, 16 nt, Human
uacagcagcaagaaaa

SEQ ID NO: 2837049 - RNA, 22 nt, Human
uacagcagcaagaaaaaaaaau

SEQ ID NO: 2837050 - RNA, 23 nt, Human
uacagcagcaagaaaaaaaaaug

SEQ ID NO: 2837051 - RNA, 14 nt, Human
uacagcaguagaca

SEQ ID NO: 2837052 - RNA, 16 nt, Human
uacagcaguagacauu

SEQ ID NO: 2837053 - RNA, 17 nt, Human
uacagcaguagacauuu

SEQ ID NO: 2837054 - RNA, 19 nt, Human
uacagcaguagacauuuua

SEQ ID NO: 2837055 - RNA, 20 nt, Human
uacagcaguagacauuuuaa

SEQ ID NO: 2837056 - RNA, 18 nt, Human
uacaggaaaagcugcuga

SEQ ID NO: 2837057 - RNA, 17 nt, Human
uacaggaaaagcugcug

SEQ ID NO: 2837058 - RNA, 20 nt, Human
uacagcuuuacacacacaga

SEQ ID NO: 2837059 - RNA, 21 nt, Human
uacagcuuuacacacacagau

SEQ ID NO: 2837060 - RNA, 12 nt, Human
uacagcuuucug

SEQ ID NO: 2837061 - RNA, 21 nt, Human
uacagcuuucugaccuucagc

SEQ ID NO: 2837062 - RNA, 23 nt, Human
uacagcuuucugaccuucagcuc

SEQ ID NO: 2837063 - RNA, 23 nt, Human
uacagcuuucuugcucccuucag

SEQ ID NO: 2837064 - RNA, 18 nt, Human
uacagaaauuagccgggc

SEQ ID NO: 2837065 - RNA, 14 nt, Human
uacagaaauacuau

SEQ ID NO: 2837066 - RNA, 19 nt, Human
uacagaaauacuauaacau

SEQ ID NO: 2837067 - RNA, 22 nt, Human
uacagaaauacuauaacauaug

SEQ ID NO: 2837068 - RNA, 23 nt, Human
uacagaaauauaauaaaaugugu

SEQ ID NO: 2837069 - RNA, 17 nt, Human
uacagaaauuagccggg

SEQ ID NO: 2837070 - RNA, 15 nt, Human
uacacuugcccugcu

SEQ ID NO: 2837071 - RNA, 16 nt, Human
uacacuugcccugcuc

SEQ ID NO: 2837072 - RNA, 21 nt, Human
uacacuugcccugcucccucu

SEQ ID NO: 2837073 - RNA, 21 nt, Human
uacacuuggggagauuugcca

SEQ ID NO: 2837074 - RNA, 16 nt, Human
uacacuuguauaaaug

SEQ ID NO: 2837075 - RNA, 17 nt, Human
uacacuuguauaaaugu

SEQ ID NO: 2837076 - RNA, 18 nt, Human
uacacuuguauaaaugua

SEQ ID NO: 2837077 - RNA, 19 nt, Human
uacacuuguauaaauguau

SEQ ID NO: 2837078 - RNA, 20 nt, Human
uacacuuguauaaauguaua

SEQ ID NO: 2837079 - RNA, 21 nt, Human
uacacuuguauaaauguauau

SEQ ID NO: 2837080 - RNA, 22 nt, Human
uacacuuguauaaauguauaua

SEQ ID NO: 2837081 - RNA, 15 nt, Human
uacagaaaaagacuu

SEQ ID NO: 2837082 - RNA, 14 nt, Human
uacagaaaaaucuu

SEQ ID NO: 2837083 - RNA, 15 nt, Human
uacagaaaaaucuug

SEQ ID NO: 2837084 - RNA, 15 nt, Human
uacacuuuuaugagc

SEQ ID NO: 2837085 - RNA, 18 nt, Human
uacacuuuuaugagcuuc

SEQ ID NO: 2837086 - RNA, 14 nt, Human
uaauuguuccuuuu

SEQ ID NO: 2837087 - RNA, 17 nt, Human
uaauuuugaaaagaugu

SEQ ID NO: 2837088 - RNA, 13 nt, Human
uacaagauuagaa

SEQ ID NO: 2837089 - RNA, 21 nt, Human
uacaagauuagaagcugaaaa

SEQ ID NO: 2837090 - RNA, 15 nt, Human
uacaagauugaaaau

SEQ ID NO: 2837091 - RNA, 20 nt, Human
uacaagauugaaaaucuugu

SEQ ID NO: 2837092 - RNA, 17 nt, Human
uacaagauuuagaaaaa

SEQ ID NO: 2837093 - RNA, 23 nt, Human
uacacaaaucuauuuaauuagga

SEQ ID NO: 2837094 - RNA, 13 nt, Human
uacacaaagggga

SEQ ID NO: 2837095 - RNA, 14 nt, Human
uacacaaaggggau

SEQ ID NO: 2837096 - RNA, 24 nt, Human
uacacaaaggggaucauaaaguua

SEQ ID NO: 2837097 - RNA, 18 nt, Human
uacacaacuaguuuuguu

SEQ ID NO: 2837098 - RNA, 24 nt, Human
uacaagaugaaggagaggcaacau

SEQ ID NO: 2837099 - RNA, 23 nt, Human
uacaagagcagccuguggcaucu

SEQ ID NO: 2837100 - RNA, 20 nt, Human
uacaagagcagccuguggca

SEQ ID NO: 2837101 - RNA, 19 nt, Human
uacaagagcuuaacagugu

SEQ ID NO: 2837102 - RNA, 19 nt, Human
uacaagagcagccuguggc

SEQ ID NO: 2837103 - RNA, 16 nt, Human
uacaagagcagccugu

SEQ ID NO: 2837104 - RNA, 15 nt, Human
uacaagacacaguga

SEQ ID NO: 2837105 - RNA, 15 nt, Human
uacaagaaguuuauu

SEQ ID NO: 2837106 - RNA, 22 nt, Human
uacaagaaguuuauucucauuu

SEQ ID NO: 2837107 - RNA, 14 nt, Human
uacacaauaagcaa

SEQ ID NO: 2837108 - RNA, 15 nt, Human
uacacaauaagcaaa

SEQ ID NO: 2837109 - RNA, 15 nt, Human
uacacacacauacac

SEQ ID NO: 2837110 - RNA, 21 nt, Human
uacacacacacgcgugcacac

SEQ ID NO: 2837111 - RNA, 14 nt, Human
uacacacacagaug

SEQ ID NO: 2837112 - RNA, 15 nt, Human
uacacacacagaugu

SEQ ID NO: 2837113 - RNA, 16 nt, Human
uacacacacagaugug

SEQ ID NO: 2837114 - RNA, 15 nt, Human
uacacuguaccauau

SEQ ID NO: 2837115 - RNA, 16 nt, Human
uacacuguauuuguau

SEQ ID NO: 2837116 - RNA, 15 nt, Human
uacacagaaacacug

SEQ ID NO: 2837117 - RNA, 14 nt, Human
uacacagaaacacu

SEQ ID NO: 2837118 - RNA, 13 nt, Human
uacacagaaacac

SEQ ID NO: 2837119 - RNA, 11 nt, Human
uacacagaaac

SEQ ID NO: 2837120 - RNA, 20 nt, Human
uacacacugucaugcuucau

SEQ ID NO: 2837121 - RNA, 18 nt, Human
uacacacugguacuuaga

SEQ ID NO: 2837122 - RNA, 18 nt, Human
uacacagaaacacugccu

SEQ ID NO: 2837123 - RNA, 13 nt, Human
uacacugccugua

SEQ ID NO: 2837124 - RNA, 15 nt, Human
uacacugccuguaua

SEQ ID NO: 2837125 - RNA, 16 nt, Human
uacacugccuguauac

SEQ ID NO: 2837126 - RNA, 17 nt, Human
uacacugccuguauacu

SEQ ID NO: 2837127 - RNA, 18 nt, Human
uacacugccuguauacuu

SEQ ID NO: 2837128 - RNA, 19 nt, Human
uacacugccuguauacuuu

SEQ ID NO: 2837129 - RNA, 20 nt, Human
uacacugccuguauacuuua

SEQ ID NO: 2837130 - RNA, 21 nt, Human
uacacugccuguauacuuuag

SEQ ID NO: 2837131 - RNA, 23 nt, Human
uacacugccuguauacuuuagua

SEQ ID NO: 2837132 - RNA, 17 nt, Human
uaaugcauguuaggaaa

SEQ ID NO: 2837133 - RNA, 16 nt, Human
uaaugcauguuaggaa

SEQ ID NO: 2837134 - RNA, 21 nt, Human
uaaugcaaaauuuuuuuaauc

SEQ ID NO: 2837135 - RNA, 14 nt, Human
uaaugcaaagaauc

SEQ ID NO: 2837136 - RNA, 18 nt, Human
uaaugcaauagaagugcu

SEQ ID NO: 2837137 - RNA, 17 nt, Human
uaaugcaguugcuuacu

SEQ ID NO: 2837138 - RNA, 15 nt, Human
uaaugcauacagaaa

SEQ ID NO: 2837139 - RNA, 17 nt, Human
uaaugaugucguuugaa

SEQ ID NO: 2837140 - RNA, 23 nt, Human
uaaugaugucguuugaaucacag

SEQ ID NO: 2837141 - RNA, 19 nt, Human
uaaugauaaguaaaugcua

SEQ ID NO: 2837142 - RNA, 15 nt, Human
uaaucuuauuuagga

SEQ ID NO: 2837143 - RNA, 23 nt, Human
uaaucugucaaaacacuguggaa

SEQ ID NO: 2837144 - RNA, 13 nt, Human
uaaucuguuaugu

SEQ ID NO: 2837145 - RNA, 20 nt, Human
uaaucuguuauguacuagug

SEQ ID NO: 2837146 - RNA, 20 nt, Human
uaaucugauggcuucuccag

SEQ ID NO: 2837147 - RNA, 14 nt, Human
uaaucugaaauucu

SEQ ID NO: 2837148 - RNA, 15 nt, Human
uaaucugaaauucua

SEQ ID NO: 2837149 - RNA, 16 nt, Human
uaaucugaaauucuaa

SEQ ID NO: 2837150 - RNA, 22 nt, Human
uaaucugaaauucuaaagagca

SEQ ID NO: 2837151 - RNA, 17 nt, Human
uaaucucucugcagcug

SEQ ID NO: 2837152 - RNA, 18 nt, Human
uaaucucucugcagcugc

SEQ ID NO: 2837153 - RNA, 19 nt, Human
uaaucucucugcagcugcc

SEQ ID NO: 2837154 - RNA, 20 nt, Human
uaaucucucugcagcugccg

SEQ ID NO: 2837155 - RNA, 12 nt, Human
uaaucucuguua

SEQ ID NO: 2837156 - RNA, 16 nt, Human
uaaucucuguuaugua

SEQ ID NO: 2837157 - RNA, 17 nt, Human
uaaucucuguuauguac

SEQ ID NO: 2837158 - RNA, 18 nt, Human
uaaucucuguuauguacu

SEQ ID NO: 2837159 - RNA, 21 nt, Human
uaaucucuguuauguacugua

SEQ ID NO: 2837160 - RNA, 22 nt, Human
uaaucucuguuauguacuguac

SEQ ID NO: 2837161 - RNA, 24 nt, Human
uaaucucuguuauguacuguacua

SEQ ID NO: 2837162 - RNA, 13 nt, Human
uaaucuccacagu

SEQ ID NO: 2837163 - RNA, 17 nt, Human
uaaucucauaccucuga

SEQ ID NO: 2837164 - RNA, 20 nt, Human
uaaucucauaccucugacca

SEQ ID NO: 2837165 - RNA, 14 nt, Human
uaauauuaaaaaua

SEQ ID NO: 2837166 - RNA, 18 nt, Human
uaauauuaaaaauaugga

SEQ ID NO: 2837167 - RNA, 22 nt, Human
uaauauuaaaaauauggaacuu

SEQ ID NO: 2837168 - RNA, 12 nt, Human
uaauauuaaaag

SEQ ID NO: 2837169 - RNA, 17 nt, Human
uaauauuaaaagucaca

SEQ ID NO: 2837170 - RNA, 18 nt, Human
uaauauuaaaagucacaa

SEQ ID NO: 2837171 - RNA, 16 nt, Human
uaaucguguccccuau

SEQ ID NO: 2837172 - RNA, 22 nt, Human
uaauccuuuguuuucugacuaa

SEQ ID NO: 2837173 - RNA, 16 nt, Human
uaaucgaccugccucg

SEQ ID NO: 2837174 - RNA, 21 nt, Human
uaauauauucugaagcaacau

SEQ ID NO: 2837175 - RNA, 16 nt, Human
uaauccuuuguuuucu

SEQ ID NO: 2837176 - RNA, 17 nt, Human
uaauccuuucugccgac

SEQ ID NO: 2837177 - RNA, 20 nt, Human
uaauccuuucugccgacccc

SEQ ID NO: 2837178 - RNA, 18 nt, Human
uaauccuuuguuuucuga

SEQ ID NO: 2837179 - RNA, 20 nt, Human
uaauccuuuguuuucugacu

SEQ ID NO: 2837180 - RNA, 23 nt, Human
uaauccuuuguuuucugacuaau

SEQ ID NO: 2837181 - RNA, 13 nt, Human
uaaucgaaagaaa

SEQ ID NO: 2837182 - RNA, 14 nt, Human
uaaucgaccugccu

SEQ ID NO: 2837183 - RNA, 13 nt, Human
uaaucgaccugcc

SEQ ID NO: 2837184 - RNA, 20 nt, Human
uaauauauuuguguauuuaa

SEQ ID NO: 2837185 - RNA, 19 nt, Human
uaauauauuuguguauuua

SEQ ID NO: 2837186 - RNA, 20 nt, Human
uaauauauguauuauuuaua

SEQ ID NO: 2837187 - RNA, 17 nt, Human
uaauauaucccagaaau

SEQ ID NO: 2837188 - RNA, 14 nt, Human
uaauauauauauau

SEQ ID NO: 2837189 - RNA, 19 nt, Human
uaauauauauauauaucag

SEQ ID NO: 2837190 - RNA, 20 nt, Human
uaauauauauauauaucagu

SEQ ID NO: 2837191 - RNA, 22 nt, Human
uaauauauauauauaucaguuu

SEQ ID NO: 2837192 - RNA, 14 nt, Human
uaauauauaugaau

SEQ ID NO: 2837193 - RNA, 16 nt, Human
uaauauauaugaauaa

SEQ ID NO: 2837194 - RNA, 18 nt, Human
uaauauauaugaauaaag

SEQ ID NO: 2837195 - RNA, 13 nt, Human
uaauauaauggaa

SEQ ID NO: 2837196 - RNA, 18 nt, Human
uaauauaauggaagagaa

SEQ ID NO: 2837197 - RNA, 19 nt, Human
uaauauaauggaagagaaa

SEQ ID NO: 2837198 - RNA, 20 nt, Human
uaauauaauggaagagaaau

SEQ ID NO: 2837199 - RNA, 21 nt, Human
uaauauaccagcuuguaugca

SEQ ID NO: 2837200 - RNA, 13 nt, Human
uaauaauaccuca

SEQ ID NO: 2837201 - RNA, 14 nt, Human
uaauaauaccucaa

SEQ ID NO: 2837202 - RNA, 20 nt, Human
uaauaauaccucaauguuug

SEQ ID NO: 2837203 - RNA, 17 nt, Human
uaauaauuauuauuaaa

SEQ ID NO: 2837204 - RNA, 20 nt, Human
uaauaauugcucauaagcaa

SEQ ID NO: 2837205 - RNA, 13 nt, Human
uaauaauuucuaa

SEQ ID NO: 2837206 - RNA, 14 nt, Human
uaauaauuucuaau

SEQ ID NO: 2837207 - RNA, 16 nt, Human
uaauaauuucuaaugu

SEQ ID NO: 2837208 - RNA, 21 nt, Human
uaauaguucagguaacaggca

SEQ ID NO: 2837209 - RNA, 13 nt, Human
uaauaguuugucu

SEQ ID NO: 2837210 - RNA, 17 nt, Human
uaauaguuugucuauuu

SEQ ID NO: 2837211 - RNA, 18 nt, Human
uaauaguuugucuauuuu

SEQ ID NO: 2837212 - RNA, 19 nt, Human
uaauaguuugucuauuuua

SEQ ID NO: 2837213 - RNA, 20 nt, Human
uaauaguuugucuauuuuaa

SEQ ID NO: 2837214 - RNA, 22 nt, Human
uaauacaacauguagcugaguu

SEQ ID NO: 2837215 - RNA, 20 nt, Human
uaauaacucggauuccagcc

SEQ ID NO: 2837216 - RNA, 18 nt, Human
uaauacaaaaggcuccau

SEQ ID NO: 2837217 - RNA, 21 nt, Human
uaauauaaaaagcuuccauga

SEQ ID NO: 2837218 - RNA, 16 nt, Human
uaauauaaaagaucuu

SEQ ID NO: 2837219 - RNA, 20 nt, Human
uaauauaaaagaucuugcag

SEQ ID NO: 2837220 - RNA, 15 nt, Human
uaauaacugugaagu

SEQ ID NO: 2837221 - RNA, 21 nt, Human
uaauaacauuaccuuacugug

SEQ ID NO: 2837222 - RNA, 12 nt, Human
uaauaacauuac

SEQ ID NO: 2837223 - RNA, 15 nt, Human
uaauaacauuaccuu

SEQ ID NO: 2837224 - RNA, 20 nt, Human
uaauaacauuaccuuacugu

SEQ ID NO: 2837225 - RNA, 21 nt, Human
uaauaaauuguuuggcuuccu

SEQ ID NO: 2837226 - RNA, 13 nt, Human
uaauaaauugaaa

SEQ ID NO: 2837227 - RNA, 17 nt, Human
uaauaaauugaaauugu

SEQ ID NO: 2837228 - RNA, 19 nt, Human
uaauaaauugaaauuguga

SEQ ID NO: 2837229 - RNA, 20 nt, Human
uaauaaauugaaauugugaa

SEQ ID NO: 2837230 - RNA, 17 nt, Human
uaauaaagaugcucuuu

SEQ ID NO: 2837231 - RNA, 16 nt, Human
uaauaaagaugcucuu

SEQ ID NO: 2837232 - RNA, 14 nt, Human
uaauaaagaugcuc

SEQ ID NO: 2837233 - RNA, 19 nt, Human
uaaguggggcaaaaccuug

SEQ ID NO: 2837234 - RNA, 13 nt, Human
uaauaaagacagg

SEQ ID NO: 2837235 - RNA, 20 nt, Human
uaauaaagaauuaacagaga

SEQ ID NO: 2837236 - RNA, 18 nt, Human
uaaggcaugugugaaaca

SEQ ID NO: 2837237 - RNA, 16 nt, Human
uaaggcguggagcugc

SEQ ID NO: 2837238 - RNA, 17 nt, Human
uaaggcguggagcugcc

SEQ ID NO: 2837239 - RNA, 18 nt, Human
uaaggccuaggauucuaa

SEQ ID NO: 2837240 - RNA, 19 nt, Human
uaaggccuaggauucuaaa

SEQ ID NO: 2837241 - RNA, 20 nt, Human
uaaggccuaggauucuaaaa

SEQ ID NO: 2837242 - RNA, 21 nt, Human
uaaggccuaggauucuaaaau

SEQ ID NO: 2837243 - RNA, 16 nt, Human
uaaggccuaggauucu

SEQ ID NO: 2837244 - RNA, 22 nt, Human
uaaggcccccucucaggagcca

SEQ ID NO: 2837245 - RNA, 23 nt, Human
uaaggcccccucucaggagccau

SEQ ID NO: 2837246 - RNA, 20 nt, Human
uaaggcguggagcugccuga

SEQ ID NO: 2837247 - RNA, 12 nt, Human
uaaggcucuaga

SEQ ID NO: 2837248 - RNA, 22 nt, Human
uaauuuggggaaaccuagagaa

SEQ ID NO: 2837249 - RNA, 14 nt, Human
uaauuguuguuucu

SEQ ID NO: 2837250 - RNA, 15 nt, Human
uaauuuuaaaaaugg

SEQ ID NO: 2837251 - RNA, 17 nt, Human
uaauuuuaaaaauggug

SEQ ID NO: 2837252 - RNA, 14 nt, Human
uaauuuuaaacaaa

SEQ ID NO: 2837253 - RNA, 21 nt, Human
uaauuuguacauauguaaaau

SEQ ID NO: 2837254 - RNA, 13 nt, Human
uaauuuuaagaaa

SEQ ID NO: 2837255 - RNA, 14 nt, Human
uaauuuuacacauu

SEQ ID NO: 2837256 - RNA, 15 nt, Human
uaauuuuacacauua

SEQ ID NO: 2837257 - RNA, 23 nt, Human
uaauuuuaguauucauucugcau

SEQ ID NO: 2837258 - RNA, 16 nt, Human
uaauuuuauucaagaa

SEQ ID NO: 2837259 - RNA, 21 nt, Human
uaauuuucuagauuuucuacu

SEQ ID NO: 2837260 - RNA, 12 nt, Human
uaauuuucucaa

SEQ ID NO: 2837261 - RNA, 13 nt, Human
uaauuuucucaaa

SEQ ID NO: 2837262 - RNA, 18 nt, Human
uaauuuucucaaaagcau

SEQ ID NO: 2837263 - RNA, 19 nt, Human
uaauuuucucaaaagcauu

SEQ ID NO: 2837264 - RNA, 22 nt, Human
uaauuuucucaaaagcauuuau

SEQ ID NO: 2837265 - RNA, 12 nt, Human
uaauuuucugaa

SEQ ID NO: 2837266 - RNA, 14 nt, Human
uaauugcuguugaa

SEQ ID NO: 2837267 - RNA, 17 nt, Human
uaauugcuguugaaagc

SEQ ID NO: 2837268 - RNA, 18 nt, Human
uaauugcuguugaaagca

SEQ ID NO: 2837269 - RNA, 20 nt, Human
uaauugcuguugaaagcaaa

SEQ ID NO: 2837270 - RNA, 21 nt, Human
uaauugcuguugaaagcaaaa

SEQ ID NO: 2837271 - RNA, 12 nt, Human
uaauugcuauuu

SEQ ID NO: 2837272 - RNA, 22 nt, Human
uaauugcagauaacuuugacuu

SEQ ID NO: 2837273 - RNA, 23 nt, Human
uaauugcagauaacuuugacuuu

SEQ ID NO: 2837274 - RNA, 18 nt, Human
uaauugcaucucaaaauu

SEQ ID NO: 2837275 - RNA, 12 nt, Human
uaauugcauuca

SEQ ID NO: 2837276 - RNA, 13 nt, Human
uaauugcauucau

SEQ ID NO: 2837277 - RNA, 22 nt, Human
uaauugcauucaucuuguguuu

SEQ ID NO: 2837278 - RNA, 12 nt, Human
uaauugcugcaa

SEQ ID NO: 2837279 - RNA, 12 nt, Human
uaauugucaugg

SEQ ID NO: 2837280 - RNA, 14 nt, Human
uaauugucaugguu

SEQ ID NO: 2837281 - RNA, 12 nt, Human
uaauuguugaaa

SEQ ID NO: 2837282 - RNA, 14 nt, Human
uaauuguugaaauu

SEQ ID NO: 2837283 - RNA, 18 nt, Human
uaauuguugaaauuuugc

SEQ ID NO: 2837284 - RNA, 22 nt, Human
uaauuguugaaauuuugcaaau

SEQ ID NO: 2837285 - RNA, 20 nt, Human
uaauuguugaacagguguuu

SEQ ID NO: 2837286 - RNA, 16 nt, Human
uaauuguugcuaaucu

SEQ ID NO: 2837287 - RNA, 23 nt, Human
uaauuaaauuuugaguucuacau

SEQ ID NO: 2837288 - RNA, 14 nt, Human
uaauuaaauuaugg

SEQ ID NO: 2837289 - RNA, 19 nt, Human
uaauuaaauuaugguauua

SEQ ID NO: 2837290 - RNA, 22 nt, Human
uaauuaaauaaaucauuaauac

SEQ ID NO: 2837291 - RNA, 21 nt, Human
uaauuaaacauugugaucauu

SEQ ID NO: 2837292 - RNA, 19 nt, Human
uaauuaaaaacuaguaguu

SEQ ID NO: 2837293 - RNA, 20 nt, Human
uaauuaaaaacuaguaguuc

SEQ ID NO: 2837294 - RNA, 22 nt, Human
uaauuaaaaacuaguaguucuc

SEQ ID NO: 2837295 - RNA, 15 nt, Human
uaauuaaaaaguuaa

SEQ ID NO: 2837296 - RNA, 18 nt, Human
uaauuaaaaaguuaaucu

SEQ ID NO: 2837297 - RNA, 23 nt, Human
uaaugcgcaggcuggcccugccc

SEQ ID NO: 2837298 - RNA, 14 nt, Human
uaaugcgauuuuau

SEQ ID NO: 2837299 - RNA, 15 nt, Human
uaaugcgauuuuauu

SEQ ID NO: 2837300 - RNA, 17 nt, Human
uaaugcgauuuuauuac

SEQ ID NO: 2837301 - RNA, 18 nt, Human
uaaugcgauuuuauuacu

SEQ ID NO: 2837302 - RNA, 22 nt, Human
uaaugcgcaggcuggcccugcc

SEQ ID NO: 2837303 - RNA, 19 nt, Human
uaaugcgcaggcuggcccu

SEQ ID NO: 2837304 - RNA, 21 nt, Human
uaaugcauguuaggaaaauuu

SEQ ID NO: 2837305 - RNA, 16 nt, Human
uaaugcauuaaaccug

SEQ ID NO: 2837306 - RNA, 17 nt, Human
uaaugcauuaaaccugu

SEQ ID NO: 2837307 - RNA, 18 nt, Human
uaaugcauuaaaccuguc

SEQ ID NO: 2837308 - RNA, 22 nt, Human
uaaugcauuaaaccugucucca

SEQ ID NO: 2837309 - RNA, 17 nt, Human
uaauugacgguuuuuua

SEQ ID NO: 2837310 - RNA, 23 nt, Human
uaauugacgguuuuuuauuauug

SEQ ID NO: 2837311 - RNA, 19 nt, Human
uaauucuucagcguaaaau

SEQ ID NO: 2837312 - RNA, 22 nt, Human
uaauucuucagcguaaaauggu

SEQ ID NO: 2837313 - RNA, 23 nt, Human
uaauucuucagcguaaaauggug

SEQ ID NO: 2837314 - RNA, 13 nt, Human
uaauucuucaguu

SEQ ID NO: 2837315 - RNA, 17 nt, Human
uaauucuuauuuugugg

SEQ ID NO: 2837316 - RNA, 18 nt, Human
uaauucuuauuuugugga

SEQ ID NO: 2837317 - RNA, 15 nt, Human
uaauucuucuguccu

SEQ ID NO: 2837318 - RNA, 22 nt, Human
uaauucuuacacugccuguaua

SEQ ID NO: 2837319 - RNA, 17 nt, Human
uaauucuggagauacug

SEQ ID NO: 2837320 - RNA, 12 nt, Human
uaauucuguaaa

SEQ ID NO: 2837321 - RNA, 13 nt, Human
uaauucuguaaau

SEQ ID NO: 2837322 - RNA, 15 nt, Human
uaauucuguaaaugu

SEQ ID NO: 2837323 - RNA, 16 nt, Human
uaauucucuuucaaag

SEQ ID NO: 2837324 - RNA, 15 nt, Human
uaauuaaaacacuuu

SEQ ID NO: 2837325 - RNA, 13 nt, Human
uaauuacuuaaaa

SEQ ID NO: 2837326 - RNA, 15 nt, Human
uaauuacgauaagga

SEQ ID NO: 2837327 - RNA, 20 nt, Human
uaauuacgauaaggaagaaa

SEQ ID NO: 2837328 - RNA, 13 nt, Human
uaauuaauuugau

SEQ ID NO: 2837329 - RNA, 16 nt, Human
uaauuaauuugauuaa

SEQ ID NO: 2837330 - RNA, 19 nt, Human
uaauuaauuugauuaacaa

SEQ ID NO: 2837331 - RNA, 21 nt, Human
uaauuaauuugauuaacaaau

SEQ ID NO: 2837332 - RNA, 22 nt, Human
uaauuaauuugauuaacaaaua

SEQ ID NO: 2837333 - RNA, 23 nt, Human
uaauuaauuugauuaacaaauau

SEQ ID NO: 2837334 - RNA, 23 nt, Human
uaaauuguuuggcuuccuccuga

SEQ ID NO: 2837335 - RNA, 14 nt, Human
uaaauuuaaagaua

SEQ ID NO: 2837336 - RNA, 15 nt, Human
uaaauuuaaagauau

SEQ ID NO: 2837337 - RNA, 16 nt, Human
uaaauuuaaagauauu

SEQ ID NO: 2837338 - RNA, 20 nt, Human
uaaauuuaaagauauuguuc

SEQ ID NO: 2837339 - RNA, 21 nt, Human
uaaauuuaaagauauuguuca

SEQ ID NO: 2837340 - RNA, 22 nt, Human
uaaauuuaaagauauuguucaa

SEQ ID NO: 2837341 - RNA, 13 nt, Human
uaaauuuaaauuu

SEQ ID NO: 2837342 - RNA, 15 nt, Human
uaaauuuaaauuuaa

SEQ ID NO: 2837343 - RNA, 18 nt, Human
uaaauuuaaauuuaaaga

SEQ ID NO: 2837344 - RNA, 22 nt, Human
uaaauuuaagcuuaagccauaa

SEQ ID NO: 2837345 - RNA, 23 nt, Human
uaaauuguccguguucauacauu

SEQ ID NO: 2837346 - RNA, 16 nt, Human
uaaauuggguucauga

SEQ ID NO: 2837347 - RNA, 21 nt, Human
uaaauuggguucaugaugcag

SEQ ID NO: 2837348 - RNA, 21 nt, Human
uaaauuggccugguauggcug

SEQ ID NO: 2837349 - RNA, 14 nt, Human
uaaauuuaaugcug

SEQ ID NO: 2837350 - RNA, 15 nt, Human
uaaauuuaaugcugc

SEQ ID NO: 2837351 - RNA, 16 nt, Human
uaaauuuaaugcugcc

SEQ ID NO: 2837352 - RNA, 15 nt, Human
uaaauuuaauucuuc

SEQ ID NO: 2837353 - RNA, 17 nt, Human
uaaauuuacuuuacaca

SEQ ID NO: 2837354 - RNA, 21 nt, Human
uaaauuguuagcuuccuuaag

SEQ ID NO: 2837355 - RNA, 13 nt, Human
uaacaauguuaag

SEQ ID NO: 2837356 - RNA, 12 nt, Human
uaacaauguuaa

SEQ ID NO: 2837357 - RNA, 14 nt, Human
uaacaauguuaagg

SEQ ID NO: 2837358 - RNA, 15 nt, Human
uaacaauguuaagga

SEQ ID NO: 2837359 - RNA, 16 nt, Human
uaacaauguuaaggaa

SEQ ID NO: 2837360 - RNA, 19 nt, Human
uaacaauguuaaggaaacu

SEQ ID NO: 2837361 - RNA, 21 nt, Human
uaacaauguuaaggaaacucu

SEQ ID NO: 2837362 - RNA, 22 nt, Human
uaacaauguuaaggaaacucuu

SEQ ID NO: 2837363 - RNA, 23 nt, Human
uaacaauguuaaggaaacucuua

SEQ ID NO: 2837364 - RNA, 15 nt, Human
uaacaauugugaagu

SEQ ID NO: 2837365 - RNA, 13 nt, Human
uaacaauuuccuu

SEQ ID NO: 2837366 - RNA, 15 nt, Human
uaacaauuuccuuua

SEQ ID NO: 2837367 - RNA, 21 nt, Human
uaacaauuuccuuuauauuua

SEQ ID NO: 2837368 - RNA, 14 nt, Human
uaaauccaguucua

SEQ ID NO: 2837369 - RNA, 16 nt, Human
uaaauugauguugcug

SEQ ID NO: 2837370 - RNA, 16 nt, Human
uaaauugcauaaagca

SEQ ID NO: 2837371 - RNA, 17 nt, Human
uaaauugcauaaagcau

SEQ ID NO: 2837372 - RNA, 18 nt, Human
uaaauugcauaaagcaua

SEQ ID NO: 2837373 - RNA, 15 nt, Human
uaaauugcuccuuga

SEQ ID NO: 2837374 - RNA, 22 nt, Human
uaacagauuuugggguuguguu

SEQ ID NO: 2837375 - RNA, 13 nt, Human
uaacagauacauu

SEQ ID NO: 2837376 - RNA, 18 nt, Human
uaacagaacagcuucagg

SEQ ID NO: 2837377 - RNA, 19 nt, Human
uaacagaacagcuucaggu

SEQ ID NO: 2837378 - RNA, 20 nt, Human
uaacagaacagcuucagguu

SEQ ID NO: 2837379 - RNA, 21 nt, Human
uaacagaacagcuucagguua

SEQ ID NO: 2837380 - RNA, 22 nt, Human
uaacagaacagcuucagguuau

SEQ ID NO: 2837381 - RNA, 23 nt, Human
uaacagcauccccaaaacaaagu

SEQ ID NO: 2837382 - RNA, 18 nt, Human
uaacacacuuuuuauuag

SEQ ID NO: 2837383 - RNA, 17 nt, Human
uaacacaaguccuguga

SEQ ID NO: 2837384 - RNA, 23 nt, Human
uaacacaaguccugugaauuucu

SEQ ID NO: 2837385 - RNA, 15 nt, Human
uaacacacacagaaa

SEQ ID NO: 2837386 - RNA, 20 nt, Human
uaacacacacagaaaagcau

SEQ ID NO: 2837387 - RNA, 21 nt, Human
uaacacacacagaaaagcaua

SEQ ID NO: 2837388 - RNA, 15 nt, Human
uaacacacagcuccc

SEQ ID NO: 2837389 - RNA, 17 nt, Human
uaacacacagcucccau

SEQ ID NO: 2837390 - RNA, 18 nt, Human
uaacacaaguccugugaa

SEQ ID NO: 2837391 - RNA, 12 nt, Human
uaacacacagcu

SEQ ID NO: 2837392 - RNA, 13 nt, Human
uaacacacagcua

SEQ ID NO: 2837393 - RNA, 14 nt, Human
uaacacacagcucc

SEQ ID NO: 2837394 - RNA, 12 nt, Human
uaacagaacagc

SEQ ID NO: 2837395 - RNA, 14 nt, Human
uaacagaacagcuu

SEQ ID NO: 2837396 - RNA, 16 nt, Human
uaacagaacagcuuca

SEQ ID NO: 2837397 - RNA, 17 nt, Human
uaacagaacagcuucag

SEQ ID NO: 2837398 - RNA, 19 nt, Human
uaacaggcagauacaggaa

SEQ ID NO: 2837399 - RNA, 15 nt, Human
uaacaggcauuuguu

SEQ ID NO: 2837400 - RNA, 20 nt, Human
uaacaggcauuuguucacug

SEQ ID NO: 2837401 - RNA, 12 nt, Human
uaacauuaccuu

SEQ ID NO: 2837402 - RNA, 13 nt, Human
uaacauuaccuua

SEQ ID NO: 2837403 - RNA, 17 nt, Human
uaacauuaccuuacugu

SEQ ID NO: 2837404 - RNA, 19 nt, Human
uaacauuaccuuacugugg

SEQ ID NO: 2837405 - RNA, 15 nt, Human
uaacauuauuuauau

SEQ ID NO: 2837406 - RNA, 16 nt, Human
uaacauuauuuauaug

SEQ ID NO: 2837407 - RNA, 12 nt, Human
uaacauuccaag

SEQ ID NO: 2837408 - RNA, 12 nt, Human
uaacauuauuua

SEQ ID NO: 2837409 - RNA, 14 nt, Human
uaacauuauuuaua

SEQ ID NO: 2837410 - RNA, 15 nt, Human
uaaccaaggaaauau

SEQ ID NO: 2837411 - RNA, 20 nt, Human
uaaccaaggaaauauauuuu

SEQ ID NO: 2837412 - RNA, 22 nt, Human
uaacauuccaagacucuagagu

SEQ ID NO: 2837413 - RNA, 13 nt, Human
uaacauuccuaaa

SEQ ID NO: 2837414 - RNA, 16 nt, Human
uaacauuccuaaaaug

SEQ ID NO: 2837415 - RNA, 17 nt, Human
uaacauuccuaaaaugc

SEQ ID NO: 2837416 - RNA, 20 nt, Human
uaacauuccuaaaaugcuuc

SEQ ID NO: 2837417 - RNA, 13 nt, Human
uaacauuccaaga

SEQ ID NO: 2837418 - RNA, 18 nt, Human
uaacauuccaagacucua

SEQ ID NO: 2837419 - RNA, 19 nt, Human
uaaccacaaagcacaguuu

SEQ ID NO: 2837420 - RNA, 23 nt, Human
uaaccacaaagcacaguuugaac

SEQ ID NO: 2837421 - RNA, 20 nt, Human
uaaccagccagauccucuug

SEQ ID NO: 2837422 - RNA, 15 nt, Human
uaaccagcuguaaca

SEQ ID NO: 2837423 - RNA, 23 nt, Human
uaacccuucaacguuucuucacu

SEQ ID NO: 2837424 - RNA, 11 nt, Human
uaacuguaucu

SEQ ID NO: 2837425 - RNA, 12 nt, Human
uaacuguaucuu

SEQ ID NO: 2837426 - RNA, 15 nt, Human
uaacuguaucuugag

SEQ ID NO: 2837427 - RNA, 13 nt, Human
uaacuguacauuu

SEQ ID NO: 2837428 - RNA, 14 nt, Human
uaacuguacauuuc

SEQ ID NO: 2837429 - RNA, 17 nt, Human
uaacuggugcacuuugu

SEQ ID NO: 2837430 - RNA, 20 nt, Human
uaacuggugcacuuuguaaa

SEQ ID NO: 2837431 - RNA, 22 nt, Human
uaacuggugcacuuuguaaauu

SEQ ID NO: 2837432 - RNA, 13 nt, Human
uaacugguauaga

SEQ ID NO: 2837433 - RNA, 21 nt, Human
uaacugauuugcaauaaaaau

SEQ ID NO: 2837434 - RNA, 20 nt, Human
uaacugaguagcucuccuga

SEQ ID NO: 2837435 - RNA, 23 nt, Human
uaacugaguagcucuccugacuu

SEQ ID NO: 2837436 - RNA, 17 nt, Human
uaacugagugccuuuug

SEQ ID NO: 2837437 - RNA, 23 nt, Human
uaacugccaucaagaugagagaa

SEQ ID NO: 2837438 - RNA, 14 nt, Human
uaaccgaugcuuua

SEQ ID NO: 2837439 - RNA, 15 nt, Human
uaaccgaugcuuuac

SEQ ID NO: 2837440 - RNA, 17 nt, Human
uaaccgaugcuuuacca

SEQ ID NO: 2837441 - RNA, 19 nt, Human
uaaccgaugcuuuaccaaa

SEQ ID NO: 2837442 - RNA, 19 nt, Human
uaaccgcacaugcacacac

SEQ ID NO: 2837443 - RNA, 13 nt, Human
uaaccgcuccagg

SEQ ID NO: 2837444 - RNA, 14 nt, Human
uaaccgcuccaggu

SEQ ID NO: 2837445 - RNA, 21 nt, Human
uaaccggcauguuuccagcag

SEQ ID NO: 2837446 - RNA, 20 nt, Human
uaaccuauaugauuuauagu

SEQ ID NO: 2837447 - RNA, 22 nt, Human
uaaccuauaugauuuauaguuu

SEQ ID NO: 2837448 - RNA, 19 nt, Human
uaaccucaagugauccucc

SEQ ID NO: 2837449 - RNA, 22 nt, Human
uaaccucaagugauccucccac

SEQ ID NO: 2837450 - RNA, 14 nt, Human
uaacucagaauuau

SEQ ID NO: 2837451 - RNA, 20 nt, Human
uaacucauuuguuaaaauua

SEQ ID NO: 2837452 - RNA, 12 nt, Human
uaacucauuugu

SEQ ID NO: 2837453 - RNA, 16 nt, Human
uaacucauaguuuguu

SEQ ID NO: 2837454 - RNA, 16 nt, Human
uaacugagugccuuuu

SEQ ID NO: 2837455 - RNA, 14 nt, Human
uaacucaucauaaa

SEQ ID NO: 2837456 - RNA, 16 nt, Human
uaacucaucauaaaau

SEQ ID NO: 2837457 - RNA, 15 nt, Human
uaacucaucauaaaa

SEQ ID NO: 2837458 - RNA, 17 nt, Human
uaacucaucauaaaaua

SEQ ID NO: 2837459 - RNA, 12 nt, Human
uaagaguguaga

SEQ ID NO: 2837460 - RNA, 13 nt, Human
uaagaguguagaa

SEQ ID NO: 2837461 - RNA, 16 nt, Human
uaagaguguagaagca

SEQ ID NO: 2837462 - RNA, 18 nt, Human
uaagaguguagaagcauu

SEQ ID NO: 2837463 - RNA, 19 nt, Human
uaagaguguagaagcauuc

SEQ ID NO: 2837464 - RNA, 22 nt, Human
uaagaguguagaagcauuccuu

SEQ ID NO: 2837465 - RNA, 23 nt, Human
uaagaguguagaagcauuccuuc

SEQ ID NO: 2837466 - RNA, 22 nt, Human
uaagaguaugugccaggaaacu

SEQ ID NO: 2837467 - RNA, 20 nt, Human
uaagagggcacacacugugu

SEQ ID NO: 2837468 - RNA, 18 nt, Human
uaagaguccaagaaucca

SEQ ID NO: 2837469 - RNA, 14 nt, Human
uaagagugcugggc

SEQ ID NO: 2837470 - RNA, 17 nt, Human
uaagagggcacacacug

SEQ ID NO: 2837471 - RNA, 18 nt, Human
uaagagggcacacacugu

SEQ ID NO: 2837472 - RNA, 21 nt, Human
uaagaguuaguuucuuuggga

SEQ ID NO: 2837473 - RNA, 14 nt, Human
uaagauacaaauua

SEQ ID NO: 2837474 - RNA, 22 nt, Human
uaagauacaaauuaauuuuacu

SEQ ID NO: 2837475 - RNA, 20 nt, Human
uaacuuuucaaugacauuuu

SEQ ID NO: 2837476 - RNA, 16 nt, Human
uaagaucacugccaga

SEQ ID NO: 2837477 - RNA, 18 nt, Human
uaagaucacugccagaga

SEQ ID NO: 2837478 - RNA, 21 nt, Human
uaagaucacugccagagauaa

SEQ ID NO: 2837479 - RNA, 23 nt, Human
uaagauccuagauccuaaggguc

SEQ ID NO: 2837480 - RNA, 18 nt, Human
uaagaucguucucugccu

SEQ ID NO: 2837481 - RNA, 14 nt, Human
uaagaagcaaauaa

SEQ ID NO: 2837482 - RNA, 15 nt, Human
uaagaacgaggauuu

SEQ ID NO: 2837483 - RNA, 16 nt, Human
uaagaacuaaagaaga

SEQ ID NO: 2837484 - RNA, 17 nt, Human
uaagaacuaaagaagau

SEQ ID NO: 2837485 - RNA, 22 nt, Human
uaagaggcagggucucacucug

SEQ ID NO: 2837486 - RNA, 22 nt, Human
uaagagccauauaaguuugaag

SEQ ID NO: 2837487 - RNA, 22 nt, Human
uaagagccauuuaggggccacu

SEQ ID NO: 2837488 - RNA, 22 nt, Human
uaagagcaguccauuucuacca

SEQ ID NO: 2837489 - RNA, 13 nt, Human
uaagagauucuga

SEQ ID NO: 2837490 - RNA, 14 nt, Human
uaagagauucugau

SEQ ID NO: 2837491 - RNA, 15 nt, Human
uaagagauucugauu

SEQ ID NO: 2837492 - RNA, 12 nt, Human
uaagaaauaugu

SEQ ID NO: 2837493 - RNA, 16 nt, Human
uaagaaauaugugaga

SEQ ID NO: 2837494 - RNA, 17 nt, Human
uaagaaauaugugagau

SEQ ID NO: 2837495 - RNA, 20 nt, Human
uaagaaauaugugagauuuu

SEQ ID NO: 2837496 - RNA, 22 nt, Human
uaagccacaagaaauuugauuu

SEQ ID NO: 2837497 - RNA, 11 nt, Human
uaagccaaaga

SEQ ID NO: 2837498 - RNA, 12 nt, Human
uaagccaaagaa

SEQ ID NO: 2837499 - RNA, 16 nt, Human
uaagccaaagaaauga

SEQ ID NO: 2837500 - RNA, 20 nt, Human
uaagccaaagaaaugaacau

SEQ ID NO: 2837501 - RNA, 21 nt, Human
uaagccaaagaaaugaacauu

SEQ ID NO: 2837502 - RNA, 23 nt, Human
uaagccaaagaaaugaacauucc

SEQ ID NO: 2837503 - RNA, 20 nt, Human
uaagcauugaaauuauaguu

SEQ ID NO: 2837504 - RNA, 15 nt, Human
uaagcauugugagua

SEQ ID NO: 2837505 - RNA, 14 nt, Human
uaagcauugccugg

SEQ ID NO: 2837506 - RNA, 15 nt, Human
uaagcauugccuggc

SEQ ID NO: 2837507 - RNA, 14 nt, Human
uaagcaucuaaguu

SEQ ID NO: 2837508 - RNA, 18 nt, Human
uaagcauuaccacucagg

SEQ ID NO: 2837509 - RNA, 19 nt, Human
uaagcauuaccacucaggc

SEQ ID NO: 2837510 - RNA, 21 nt, Human
uaagcauuaccacucaggcau

SEQ ID NO: 2837511 - RNA, 14 nt, Human
uaagaucuuagauu

SEQ ID NO: 2837512 - RNA, 16 nt, Human
uaagaucuuagauucu

SEQ ID NO: 2837513 - RNA, 17 nt, Human
uaagaucuuagauucuc

SEQ ID NO: 2837514 - RNA, 20 nt, Human
uaagaucuuagauucucugu

SEQ ID NO: 2837515 - RNA, 20 nt, Human
uaagccucauauuuaaagac

SEQ ID NO: 2837516 - RNA, 19 nt, Human
uaagccaguguugccuaag

SEQ ID NO: 2837517 - RNA, 18 nt, Human
uaagccaguguugccuaa

SEQ ID NO: 2837518 - RNA, 14 nt, Human
uaagccacuugaaa

SEQ ID NO: 2837519 - RNA, 16 nt, Human
uaagccacaagaaauu

SEQ ID NO: 2837520 - RNA, 13 nt, Human
uaagccagccugg

SEQ ID NO: 2837521 - RNA, 14 nt, Human
uaagccagccuggu

SEQ ID NO: 2837522 - RNA, 24 nt, Human
uaagccagccugguccaugcaggg

SEQ ID NO: 2837523 - RNA, 21 nt, Human
uaagccuuuggaaacagcucg

SEQ ID NO: 2837524 - RNA, 12 nt, Human
uaagccuguggc

SEQ ID NO: 2837525 - RNA, 13 nt, Human
uaagccuguggcu

SEQ ID NO: 2837526 - RNA, 14 nt, Human
uaagccuguggcug

SEQ ID NO: 2837527 - RNA, 18 nt, Human
uaagccuguggcugugga

SEQ ID NO: 2837528 - RNA, 20 nt, Human
uaagccuguggcuguggaga

SEQ ID NO: 2837529 - RNA, 17 nt, Human
uaagccuuuggaaacag

SEQ ID NO: 2837530 - RNA, 14 nt, Human
uaagccuuuggaaa

SEQ ID NO: 2837531 - RNA, 20 nt, Human
uaagccuuuuauacugauua

SEQ ID NO: 2837532 - RNA, 23 nt, Human
uaagcgaauguguacaaagugua

SEQ ID NO: 2837533 - RNA, 17 nt, Human
uaaggaugucacagggc

SEQ ID NO: 2837534 - RNA, 19 nt, Human
uaaggaugucacagggcca

SEQ ID NO: 2837535 - RNA, 20 nt, Human
uaaggaugggguuaugaacc

SEQ ID NO: 2837536 - RNA, 13 nt, Human
uaaggauguagcu

SEQ ID NO: 2837537 - RNA, 16 nt, Human
uaaggauguagcuuuu

SEQ ID NO: 2837538 - RNA, 17 nt, Human
uaaggauguagcuuuuc

SEQ ID NO: 2837539 - RNA, 21 nt, Human
uaaggauguagcuuuucaccu

SEQ ID NO: 2837540 - RNA, 22 nt, Human
uaaggauguagcuuuucaccuu

SEQ ID NO: 2837541 - RNA, 14 nt, Human
uaaggcaggcauug

SEQ ID NO: 2837542 - RNA, 20 nt, Human
uaaggaugucacagggccaa

SEQ ID NO: 2837543 - RNA, 18 nt, Human
guuuagauagggcugggc

SEQ ID NO: 2837544 - RNA, 19 nt, Human
guuuagauagggcugggca

SEQ ID NO: 2837545 - RNA, 14 nt, Human
guuuagauuucaag

SEQ ID NO: 2837546 - RNA, 15 nt, Human
guuuaggugaauuaa

SEQ ID NO: 2837547 - RNA, 16 nt, Human
guuuacuuaaagauuu

SEQ ID NO: 2837548 - RNA, 22 nt, Human
guuuacuuaaagauuuaucaaa

SEQ ID NO: 2837549 - RNA, 20 nt, Human
guuuacuuccccuauggaau

SEQ ID NO: 2837550 - RNA, 13 nt, Human
guuuacuuucaaa

SEQ ID NO: 2837551 - RNA, 14 nt, Human
guuuacuuucaaau

SEQ ID NO: 2837552 - RNA, 15 nt, Human
guuuacuuucaaauc

SEQ ID NO: 2837553 - RNA, 14 nt, Human
guuuacuuaaagau

SEQ ID NO: 2837554 - RNA, 21 nt, Human
gguuggccccugcccggcugc

SEQ ID NO: 2837555 - RNA, 15 nt, Human
gguugcacuuuguag

SEQ ID NO: 2837556 - RNA, 13 nt, Human
gguugcagggagc

SEQ ID NO: 2837557 - RNA, 11 nt, Human
gguuggcuggc

SEQ ID NO: 2837558 - RNA, 18 nt, Human
gguucaauucccugaagg

SEQ ID NO: 2837559 - RNA, 10 nt, Human
guuucaggug

SEQ ID NO: 2837560 - RNA, 19 nt, Human
guuucauucuccugccugu

SEQ ID NO: 2837561 - RNA, 21 nt, Human
guuuccaauuauuugacuuua

SEQ ID NO: 2837562 - RNA, 19 nt, Human
guuuccagacuuccuugag

SEQ ID NO: 2837563 - RNA, 16 nt, Human
guuuccaaccuggagu

SEQ ID NO: 2837564 - RNA, 13 nt, Human
guuuccacaugcu

SEQ ID NO: 2837565 - RNA, 14 nt, Human
guuuccacaugcuc

SEQ ID NO: 2837566 - RNA, 23 nt, Human
guuuacuguuuugaaaucaaugc

SEQ ID NO: 2837567 - RNA, 21 nt, Human
guuuccauagcaacaggaaaa

SEQ ID NO: 2837568 - RNA, 20 nt, Human
guuuccagacuuccuugaga

SEQ ID NO: 2837569 - RNA, 17 nt, Human
guuuccagcagaagaca

SEQ ID NO: 2837570 - RNA, 21 nt, Human
guuucagcuaagggaagacau

SEQ ID NO: 2837571 - RNA, 22 nt, Human
guuucagcuaagggaagacauu

SEQ ID NO: 2837572 - RNA, 23 nt, Human
guuucagcuaagggaagacauuu

SEQ ID NO: 2837573 - RNA, 13 nt, Human
guuuaguaaguuu

SEQ ID NO: 2837574 - RNA, 16 nt, Human
guuucagauauauauc

SEQ ID NO: 2837575 - RNA, 17 nt, Human
guuucagauauauauca

SEQ ID NO: 2837576 - RNA, 21 nt, Human
guuucagauauauaucauauu

SEQ ID NO: 2837577 - RNA, 14 nt, Human
guuuccucuuccaa

SEQ ID NO: 2837578 - RNA, 16 nt, Human
guuuccugcaggccag

SEQ ID NO: 2837579 - RNA, 22 nt, Human
guuuccugcccugggaggcagu

SEQ ID NO: 2837580 - RNA, 14 nt, Human
guuuccugcaggcc

SEQ ID NO: 2837581 - RNA, 19 nt, Human
guuucccaaugguguuuuu

SEQ ID NO: 2837582 - RNA, 17 nt, Human
guuuccugcccugggag

SEQ ID NO: 2837583 - RNA, 13 nt, Human
guuuccugcccug

SEQ ID NO: 2837584 - RNA, 23 nt, Human
guuugugauucuuccagauguga

SEQ ID NO: 2837585 - RNA, 11 nt, Human
guuugucuguu

SEQ ID NO: 2837586 - RNA, 16 nt, Human
guuugucuguuuguuu

SEQ ID NO: 2837587 - RNA, 18 nt, Human
guuugucuguuuguuuca

SEQ ID NO: 2837588 - RNA, 21 nt, Human
guuugucuuccauuccauugu

SEQ ID NO: 2837589 - RNA, 14 nt, Human
guuuguggccucag

SEQ ID NO: 2837590 - RNA, 13 nt, Human
guuuguggccuca

SEQ ID NO: 2837591 - RNA, 18 nt, Human
guuuguuccccaagacau

SEQ ID NO: 2837592 - RNA, 12 nt, Human
guuuguggccuc

SEQ ID NO: 2837593 - RNA, 19 nt, Human
guuuguggaaaaugaaaau

SEQ ID NO: 2837594 - RNA, 13 nt, Human
guuuguaaaacua

SEQ ID NO: 2837595 - RNA, 17 nt, Human
guuugucucuccuuuuc

SEQ ID NO: 2837596 - RNA, 18 nt, Human
guuugucucuccuuuucu

SEQ ID NO: 2837597 - RNA, 21 nt, Human
guuugucucuccuuuucuuuu

SEQ ID NO: 2837598 - RNA, 14 nt, Human
guuuguaaauguua

SEQ ID NO: 2837599 - RNA, 19 nt, Human
guuuguaaauguuauuucu

SEQ ID NO: 2837600 - RNA, 20 nt, Human
guuuguaaauguuauuucug

SEQ ID NO: 2837601 - RNA, 22 nt, Human
guuugaugcaggcacuuauugu

SEQ ID NO: 2837602 - RNA, 13 nt, Human
guuugguuuacau

SEQ ID NO: 2837603 - RNA, 14 nt, Human
guuugguuuacauu

SEQ ID NO: 2837604 - RNA, 15 nt, Human
guuugguuuacauuu

SEQ ID NO: 2837605 - RNA, 16 nt, Human
guuugguuuacauuua

SEQ ID NO: 2837606 - RNA, 20 nt, Human
guuugguuuacauuuaaagc

SEQ ID NO: 2837607 - RNA, 14 nt, Human
guuugguuccucuc

SEQ ID NO: 2837608 - RNA, 18 nt, Human
guuugguuccucucuggu

SEQ ID NO: 2837609 - RNA, 15 nt, Human
guuugagaugcugua

SEQ ID NO: 2837610 - RNA, 16 nt, Human
guuugaggcugcagcg

SEQ ID NO: 2837611 - RNA, 22 nt, Human
guuugaggagcauguuuuguau

SEQ ID NO: 2837612 - RNA, 20 nt, Human
guuugaucacacuauuuuag

SEQ ID NO: 2837613 - RNA, 12 nt, Human
guuugaacuuca

SEQ ID NO: 2837614 - RNA, 14 nt, Human
guuugaagccugga

SEQ ID NO: 2837615 - RNA, 15 nt, Human
guuugaaggaaacag

SEQ ID NO: 2837616 - RNA, 16 nt, Human
guuugaaggaaacagu

SEQ ID NO: 2837617 - RNA, 17 nt, Human
guuugaaggaaacaguu

SEQ ID NO: 2837618 - RNA, 13 nt, Human
guuugaauaugga

SEQ ID NO: 2837619 - RNA, 14 nt, Human
guuugaauauggac

SEQ ID NO: 2837620 - RNA, 18 nt, Human
guuugaauauggacaaga

SEQ ID NO: 2837621 - RNA, 21 nt, Human
guuugaacacgaaagaaaugu

SEQ ID NO: 2837622 - RNA, 23 nt, Human
guuucuuucuaguggucuuugua

SEQ ID NO: 2837623 - RNA, 18 nt, Human
guuucuuucuaguggucu

SEQ ID NO: 2837624 - RNA, 15 nt, Human
guuucguuauauuaa

SEQ ID NO: 2837625 - RNA, 14 nt, Human
guuucguuucugua

SEQ ID NO: 2837626 - RNA, 15 nt, Human
guuucguuucuguau

SEQ ID NO: 2837627 - RNA, 16 nt, Human
guuucguuucuguaua

SEQ ID NO: 2837628 - RNA, 16 nt, Human
guuucgcagccugagu

SEQ ID NO: 2837629 - RNA, 18 nt, Human
guuucgcagccugagucc

SEQ ID NO: 2837630 - RNA, 22 nt, Human
guuucggccuucauaauggccu

SEQ ID NO: 2837631 - RNA, 23 nt, Human
guuuccuuguuuaucagauacau

SEQ ID NO: 2837632 - RNA, 14 nt, Human
guuuccuucagugc

SEQ ID NO: 2837633 - RNA, 23 nt, Human
guuuccuuuucugucucucucuu

SEQ ID NO: 2837634 - RNA, 17 nt, Human
uaaaaaaauuuaagugc

SEQ ID NO: 2837635 - RNA, 11 nt, Human
uaaaaaacaac

SEQ ID NO: 2837636 - RNA, 15 nt, Human
uaaaaaauggaaaga

SEQ ID NO: 2837637 - RNA, 15 nt, Human
uaaaaaaugaaaaua

SEQ ID NO: 2837638 - RNA, 13 nt, Human
uaaaaaaugaaau

SEQ ID NO: 2837639 - RNA, 15 nt, Human
uaaaaaaugugugua

SEQ ID NO: 2837640 - RNA, 20 nt, Human
uaaaaaauguguguauucuu

SEQ ID NO: 2837641 - RNA, 22 nt, Human
uaaaaaauguguguauucuuaa

SEQ ID NO: 2837642 - RNA, 23 nt, Human
uaaaaaauguguguauucuuaaa

SEQ ID NO: 2837643 - RNA, 18 nt, Human
uaaaaaauuaugacaaug

SEQ ID NO: 2837644 - RNA, 22 nt, Human
uaaaaacaaaaacaucccaaga

SEQ ID NO: 2837645 - RNA, 23 nt, Human
uaaaaacaaaaacaucccaagau

SEQ ID NO: 2837646 - RNA, 14 nt, Human
uaaaaacuaguagu

SEQ ID NO: 2837647 - RNA, 19 nt, Human
uaaaaacuaguaguucucu

SEQ ID NO: 2837648 - RNA, 20 nt, Human
uaaaaacuaguaguucucuu

SEQ ID NO: 2837649 - RNA, 18 nt, Human
uaaaaaccagacaaggaa

SEQ ID NO: 2837650 - RNA, 16 nt, Human
uaaaaacccacaaaaa

SEQ ID NO: 2837651 - RNA, 17 nt, Human
uaaaaacccacaaaaau

SEQ ID NO: 2837652 - RNA, 23 nt, Human
uaaaaacccacaaaaauguugaa

SEQ ID NO: 2837653 - RNA, 19 nt, Human
uaaaaacauugccuuugaa

SEQ ID NO: 2837654 - RNA, 21 nt, Human
uaaaaacauugccuuugaaug

SEQ ID NO: 2837655 - RNA, 12 nt, Human
uaaaaagaaaaa

SEQ ID NO: 2837656 - RNA, 20 nt, Human
uaaaaagaaaaaccacuccc

SEQ ID NO: 2837657 - RNA, 23 nt, Human
uaaaaagaaaaaccacucccagu

SEQ ID NO: 2837658 - RNA, 11 nt, Human
uaaaaaugcaa

SEQ ID NO: 2837659 - RNA, 19 nt, Human
guuuuuaugauaucccuga

SEQ ID NO: 2837660 - RNA, 20 nt, Human
guuuuuaugauaucccugau

SEQ ID NO: 2837661 - RNA, 15 nt, Human
guuuuuauaauaaaa

SEQ ID NO: 2837662 - RNA, 17 nt, Human
guuuuuauauuaaugua

SEQ ID NO: 2837663 - RNA, 16 nt, Human
guuuuuauuccuugug

SEQ ID NO: 2837664 - RNA, 21 nt, Human
uaaaaaaaaauagaugucuuu

SEQ ID NO: 2837665 - RNA, 23 nt, Human
uaaaaaaaaauagaugucuuuua

SEQ ID NO: 2837666 - RNA, 15 nt, Human
uaaaaaaaaaugccu

SEQ ID NO: 2837667 - RNA, 16 nt, Human
uaaaaaaaaaugccuu

SEQ ID NO: 2837668 - RNA, 19 nt, Human
uaaaaaaaaagaucuguuu

SEQ ID NO: 2837669 - RNA, 20 nt, Human
guuuuucaccacuucacuga

SEQ ID NO: 2837670 - RNA, 14 nt, Human
uaaaaaaauggcag

SEQ ID NO: 2837671 - RNA, 12 nt, Human
uaaaaaaauuua

SEQ ID NO: 2837672 - RNA, 15 nt, Human
uaaaaaaauuuaagu

SEQ ID NO: 2837673 - RNA, 16 nt, Human
uaaaaaaauuuaagug

SEQ ID NO: 2837674 - RNA, 11 nt, Human
uaaaaaaagaa

SEQ ID NO: 2837675 - RNA, 17 nt, Human
guuuuuauuaauuuaua

SEQ ID NO: 2837676 - RNA, 14 nt, Human
uaaaaaaagaaaau

SEQ ID NO: 2837677 - RNA, 12 nt, Human
uaaaaaaagaaa

SEQ ID NO: 2837678 - RNA, 13 nt, Human
uaaaaaaagaaaa

SEQ ID NO: 2837679 - RNA, 15 nt, Human
uaaaaaaagagaauu

SEQ ID NO: 2837680 - RNA, 18 nt, Human
uaaaaaaaggcauuguuu

SEQ ID NO: 2837681 - RNA, 11 nt, Human
uaaaaaaauaa

SEQ ID NO: 2837682 - RNA, 21 nt, Human
uaaaaaaacaaucauuugcuu

SEQ ID NO: 2837683 - RNA, 18 nt, Human
uaaaaaaaaaugccuuug

SEQ ID NO: 2837684 - RNA, 17 nt, Human
uaaaaaaaaaugccuuu

SEQ ID NO: 2837685 - RNA, 14 nt, Human
guuuucaucaagac

SEQ ID NO: 2837686 - RNA, 16 nt, Human
guuuguugugaggauu

SEQ ID NO: 2837687 - RNA, 16 nt, Human
guuuguugcuggcuug

SEQ ID NO: 2837688 - RNA, 20 nt, Human
guuugaugucauuaaugugu

SEQ ID NO: 2837689 - RNA, 20 nt, Human
guuuguuucucccccugggc

SEQ ID NO: 2837690 - RNA, 19 nt, Human
guuuguuucucccccuggg

SEQ ID NO: 2837691 - RNA, 21 nt, Human
guuuguuucucccccugggcu

SEQ ID NO: 2837692 - RNA, 18 nt, Human
guuuguuucucccccugg

SEQ ID NO: 2837693 - RNA, 18 nt, Human
guuuguuuauuagaugaa

SEQ ID NO: 2837694 - RNA, 19 nt, Human
guuuguuuauuagaugaau

SEQ ID NO: 2837695 - RNA, 18 nt, Human
guuuguuucaagaaccug

SEQ ID NO: 2837696 - RNA, 23 nt, Human
guuuguuucauauauacaggcau

SEQ ID NO: 2837697 - RNA, 23 nt, Human
guuuucauggugaaaauguacug

SEQ ID NO: 2837698 - RNA, 21 nt, Human
guuuucauggugaaaauguac

SEQ ID NO: 2837699 - RNA, 22 nt, Human
guuuucauggugaaaauguacu

SEQ ID NO: 2837700 - RNA, 10 nt, Human
guuuucaugg

SEQ ID NO: 2837701 - RNA, 16 nt, Human
guuuuccacccuggaa

SEQ ID NO: 2837702 - RNA, 14 nt, Human
guuuuccacccugg

SEQ ID NO: 2837703 - RNA, 16 nt, Human
guuuucauuugguuca

SEQ ID NO: 2837704 - RNA, 17 nt, Human
guuuucauuugguucau

SEQ ID NO: 2837705 - RNA, 11 nt, Human
guuuuccaaac

SEQ ID NO: 2837706 - RNA, 23 nt, Human
guuuuccacccauaauccuuucu

SEQ ID NO: 2837707 - RNA, 23 nt, Human
guuuucgcaccuaccaucaggga

SEQ ID NO: 2837708 - RNA, 17 nt, Human
guuuucucucggcuccc

SEQ ID NO: 2837709 - RNA, 19 nt, Human
guuuucuccugccugugcu

SEQ ID NO: 2837710 - RNA, 21 nt, Human
guuuucuccucccaggaacug

SEQ ID NO: 2837711 - RNA, 18 nt, Human
guuuucuccucccaggaa

SEQ ID NO: 2837712 - RNA, 16 nt, Human
guuuucuccucccagg

SEQ ID NO: 2837713 - RNA, 13 nt, Human
guuuucuccuccc

SEQ ID NO: 2837714 - RNA, 18 nt, Human
guuuucuauuuaugccuu

SEQ ID NO: 2837715 - RNA, 17 nt, Human
guuuuuaguaaucugua

SEQ ID NO: 2837716 - RNA, 20 nt, Human
guuuuuaguaaucuguacau

SEQ ID NO: 2837717 - RNA, 21 nt, Human
guuuuuaguaaucuguacauu

SEQ ID NO: 2837718 - RNA, 21 nt, Human
guuuuuagacaccuucauuuu

SEQ ID NO: 2837719 - RNA, 18 nt, Human
guuuuuaaaugaggauua

SEQ ID NO: 2837720 - RNA, 15 nt, Human
guuuuuaaauuuugu

SEQ ID NO: 2837721 - RNA, 19 nt, Human
guuuuuaaauuuuguaaug

SEQ ID NO: 2837722 - RNA, 20 nt, Human
guuuuuaaauuuuguaauga

SEQ ID NO: 2837723 - RNA, 18 nt, Human
guuuuuaaauagaguuug

SEQ ID NO: 2837724 - RNA, 23 nt, Human
guuuuuaaauagaguuugcuauu

SEQ ID NO: 2837725 - RNA, 20 nt, Human
guuuuuaccugucacauugc

SEQ ID NO: 2837726 - RNA, 21 nt, Human
guuuuuaccugucacauugca

SEQ ID NO: 2837727 - RNA, 23 nt, Human
guuuuuaccugucacauugcauu

SEQ ID NO: 2837728 - RNA, 13 nt, Human
guuuuuaaaaguu

SEQ ID NO: 2837729 - RNA, 15 nt, Human
guuuuuaaaaguuuc

SEQ ID NO: 2837730 - RNA, 16 nt, Human
guuuuuaaaaguuuca

SEQ ID NO: 2837731 - RNA, 18 nt, Human
guuuuuaaaaguuucaau

SEQ ID NO: 2837732 - RNA, 12 nt, Human
guuuuguauaca

SEQ ID NO: 2837733 - RNA, 21 nt, Human
guuuuguauacaaauauauug

SEQ ID NO: 2837734 - RNA, 22 nt, Human
guuuuguauacaaauauauugu

SEQ ID NO: 2837735 - RNA, 19 nt, Human
guuuuguaucuuaaauuug

SEQ ID NO: 2837736 - RNA, 17 nt, Human
guuuuguaggagacuug

SEQ ID NO: 2837737 - RNA, 19 nt, Human
guuuucucucggcucccca

SEQ ID NO: 2837738 - RNA, 20 nt, Human
guuuucuccugccugugcug

SEQ ID NO: 2837739 - RNA, 17 nt, Human
guuuucucuuugugggg

SEQ ID NO: 2837740 - RNA, 20 nt, Human
guuuucucuuuguggggcuu

SEQ ID NO: 2837741 - RNA, 14 nt, Human
guuuugucuugaau

SEQ ID NO: 2837742 - RNA, 11 nt, Human
guuuuguuugu

SEQ ID NO: 2837743 - RNA, 12 nt, Human
guuuuguuuguc

SEQ ID NO: 2837744 - RNA, 13 nt, Human
guuuuguuugucu

SEQ ID NO: 2837745 - RNA, 15 nt, Human
guuuuguuugucucu

SEQ ID NO: 2837746 - RNA, 22 nt, Human
guuuuguuugucucuccuuuuc

SEQ ID NO: 2837747 - RNA, 12 nt, Human
guuuuguuuugg

SEQ ID NO: 2837748 - RNA, 24 nt, Human
guuuugugacuauauagagauguu

SEQ ID NO: 2837749 - RNA, 15 nt, Human
uaaaagaucuucaaa

SEQ ID NO: 2837750 - RNA, 19 nt, Human
uaaaagaucuucaaaagua

SEQ ID NO: 2837751 - RNA, 23 nt, Human
uaaaagaucuucaaaaguaaugc

SEQ ID NO: 2837752 - RNA, 16 nt, Human
uaaaagaucuugcaga

SEQ ID NO: 2837753 - RNA, 22 nt, Human
uaaaagaugaaguuuuauacac

SEQ ID NO: 2837754 - RNA, 17 nt, Human
uaaaaaugauacugaug

SEQ ID NO: 2837755 - RNA, 18 nt, Human
uaaaaaugagugugaagg

SEQ ID NO: 2837756 - RNA, 12 nt, Human
uaaaaauggugg

SEQ ID NO: 2837757 - RNA, 13 nt, Human
uaaaaaugguggc

SEQ ID NO: 2837758 - RNA, 16 nt, Human
uaaaaaugguggcuuc

SEQ ID NO: 2837759 - RNA, 20 nt, Human
uaaaaaugguggcuucagcu

SEQ ID NO: 2837760 - RNA, 23 nt, Human
uaaaaaugguggcuucagcucca

SEQ ID NO: 2837761 - RNA, 20 nt, Human
uaaaagcguuggauguagca

SEQ ID NO: 2837762 - RNA, 13 nt, Human
uaaaagccacaua

SEQ ID NO: 2837763 - RNA, 15 nt, Human
uaaaagccacauaga

SEQ ID NO: 2837764 - RNA, 15 nt, Human
uaaaaucuauucugu

SEQ ID NO: 2837765 - RNA, 16 nt, Human
uaaaaucuauucugug

SEQ ID NO: 2837766 - RNA, 17 nt, Human
uaaaaucuauucugugu

SEQ ID NO: 2837767 - RNA, 19 nt, Human
uaaaauccccaugccugug

SEQ ID NO: 2837768 - RNA, 23 nt, Human
uaaaauccccaugccuguggcug

SEQ ID NO: 2837769 - RNA, 17 nt, Human
uaaaauccuaagacaca

SEQ ID NO: 2837770 - RNA, 22 nt, Human
uaaaauccuaagacacaaaugc

SEQ ID NO: 2837771 - RNA, 18 nt, Human
uaaaaggcuugaagcugu

SEQ ID NO: 2837772 - RNA, 13 nt, Human
uaaaauauuuauu

SEQ ID NO: 2837773 - RNA, 17 nt, Human
uaaaauauuuuugaaag

SEQ ID NO: 2837774 - RNA, 17 nt, Human
uaaaaucaaaacaagug

SEQ ID NO: 2837775 - RNA, 18 nt, Human
uaaaaucaacuuaacaug

SEQ ID NO: 2837776 - RNA, 17 nt, Human
uaaaaucaaguuuuaag

SEQ ID NO: 2837777 - RNA, 19 nt, Human
uaaaaucaauuuuuaggaa

SEQ ID NO: 2837778 - RNA, 14 nt, Human
uaaaaugauuguaa

SEQ ID NO: 2837779 - RNA, 15 nt, Human
uaaaaugauuguaaa

SEQ ID NO: 2837780 - RNA, 16 nt, Human
uaaaaugauuguaaaa

SEQ ID NO: 2837781 - RNA, 17 nt, Human
uaaaaugauuguaaaau

SEQ ID NO: 2837782 - RNA, 18 nt, Human
uaaaaugauuguaaaaua

SEQ ID NO: 2837783 - RNA, 20 nt, Human
uaaaaugauuguaaaauagc

SEQ ID NO: 2837784 - RNA, 15 nt, Human
uaaaaugacuacuua

SEQ ID NO: 2837785 - RNA, 16 nt, Human
uaaaaugacuacuuag

SEQ ID NO: 2837786 - RNA, 19 nt, Human
uaaaaugacuacuuagcau

SEQ ID NO: 2837787 - RNA, 20 nt, Human
uaaaaugacuacuuagcauc

SEQ ID NO: 2837788 - RNA, 17 nt, Human
uaaaaugaggacauguu

SEQ ID NO: 2837789 - RNA, 24 nt, Human
uaaacaacauugagauuaugauga

SEQ ID NO: 2837790 - RNA, 21 nt, Human
uaaacaaauucauauucuguc

SEQ ID NO: 2837791 - RNA, 22 nt, Human
uaaacaaauucauauucugucu

SEQ ID NO: 2837792 - RNA, 17 nt, Human
uaaacaaauucauauuc

SEQ ID NO: 2837793 - RNA, 19 nt, Human
uaaacaaauucauauucug

SEQ ID NO: 2837794 - RNA, 12 nt, Human
uaaaauggaauu

SEQ ID NO: 2837795 - RNA, 13 nt, Human
uaaaauggaauug

SEQ ID NO: 2837796 - RNA, 15 nt, Human
uaaaauggaauugaa

SEQ ID NO: 2837797 - RNA, 23 nt, Human
uaaaauggaauugaaaaacucuu

SEQ ID NO: 2837798 - RNA, 18 nt, Human
uaaaauggaugccuugaa

SEQ ID NO: 2837799 - RNA, 22 nt, Human
uaaaauggaugccuugaauaau

SEQ ID NO: 2837800 - RNA, 21 nt, Human
uaaaaugcuucacuguacgua

SEQ ID NO: 2837801 - RNA, 12 nt, Human
uaaaaugcaaua

SEQ ID NO: 2837802 - RNA, 16 nt, Human
uaaaaugcaauauuug

SEQ ID NO: 2837803 - RNA, 18 nt, Human
uaaaaugcaauauuugua

SEQ ID NO: 2837804 - RNA, 22 nt, Human
uaaaaugauuguaaaauagcuu

SEQ ID NO: 2837805 - RNA, 17 nt, Human
uaaaaugauuuguagug

SEQ ID NO: 2837806 - RNA, 23 nt, Human
uaaaaugauuuguaguggaaaca

SEQ ID NO: 2837807 - RNA, 21 nt, Human
uaaacaaugcugauuugguga

SEQ ID NO: 2837808 - RNA, 16 nt, Human
uaaacaauucaaguga

SEQ ID NO: 2837809 - RNA, 23 nt, Human
uaaacaaugaaauauugcuguau

SEQ ID NO: 2837810 - RNA, 22 nt, Human
uaaacaaugaugcccugcucca

SEQ ID NO: 2837811 - RNA, 23 nt, Human
uaaacaaugaugcccugcuccag

SEQ ID NO: 2837812 - RNA, 14 nt, Human
uaaacacugcgcuu

SEQ ID NO: 2837813 - RNA, 16 nt, Human
uaaacacagucaaaau

SEQ ID NO: 2837814 - RNA, 18 nt, Human
uaaacacagucaaaauaa

SEQ ID NO: 2837815 - RNA, 21 nt, Human
uaaacacagucaaaauaauuc

SEQ ID NO: 2837816 - RNA, 13 nt, Human
uaaacagacaaua

SEQ ID NO: 2837817 - RNA, 16 nt, Human
uaaacagacuguuaau

SEQ ID NO: 2837818 - RNA, 16 nt, Human
uaaacagaugaauaaa

SEQ ID NO: 2837819 - RNA, 17 nt, Human
uaaacagaugaugagaa

SEQ ID NO: 2837820 - RNA, 18 nt, Human
uaaacagaugaugagaau

SEQ ID NO: 2837821 - RNA, 19 nt, Human
uaaacagaugaugagaauu

SEQ ID NO: 2837822 - RNA, 20 nt, Human
uaaacagaugaugagaauuu

SEQ ID NO: 2837823 - RNA, 12 nt, Human
uaaacacacaga

SEQ ID NO: 2837824 - RNA, 14 nt, Human
uaaacacacagaua

SEQ ID NO: 2837825 - RNA, 18 nt, Human
uaaacacacagauacaca

SEQ ID NO: 2837826 - RNA, 21 nt, Human
uaaacacacagauacacacac

SEQ ID NO: 2837827 - RNA, 22 nt, Human
uaaacacacagauacacacaca

SEQ ID NO: 2837828 - RNA, 20 nt, Human
uaaacuuuacccaaaaacua

SEQ ID NO: 2837829 - RNA, 15 nt, Human
uaaacaguauuucau

SEQ ID NO: 2837830 - RNA, 23 nt, Human
uaaacagugagccugaauuuugu

SEQ ID NO: 2837831 - RNA, 20 nt, Human
uaaacagugagccugaauuu

SEQ ID NO: 2837832 - RNA, 17 nt, Human
uaaacagguggugagaa

SEQ ID NO: 2837833 - RNA, 23 nt, Human
uaaacagguggugagaaauuucu

SEQ ID NO: 2837834 - RNA, 18 nt, Human
uaaacaggagacaggaag

SEQ ID NO: 2837835 - RNA, 13 nt, Human
uaaacagcagugu

SEQ ID NO: 2837836 - RNA, 17 nt, Human
uaaacagcaguguuccc

SEQ ID NO: 2837837 - RNA, 22 nt, Human
uaaacagcaguguuccccaucu

SEQ ID NO: 2837838 - RNA, 22 nt, Human
uaaacuggaauuaaaaggauag

SEQ ID NO: 2837839 - RNA, 15 nt, Human
uaaacauaugauuuc

SEQ ID NO: 2837840 - RNA, 16 nt, Human
uaaacauaugauuuca

SEQ ID NO: 2837841 - RNA, 18 nt, Human
uaaacauaugauuucacu

SEQ ID NO: 2837842 - RNA, 23 nt, Human
uaaacugcccccucugcccugcg

SEQ ID NO: 2837843 - RNA, 22 nt, Human
uaaacugcccccucugcccugc

SEQ ID NO: 2837844 - RNA, 15 nt, Human
uaaacauaaguguac

SEQ ID NO: 2837845 - RNA, 23 nt, Human
uaaacauaaguguacgauucuua

SEQ ID NO: 2837846 - RNA, 15 nt, Human
uaaacauaaugaaaa

SEQ ID NO: 2837847 - RNA, 16 nt, Human
uaaacauaaugaaaau

SEQ ID NO: 2837848 - RNA, 14 nt, Human
uaaacauaaaacaa

SEQ ID NO: 2837849 - RNA, 21 nt, Human
uaaacugcccccucugcccug

SEQ ID NO: 2837850 - RNA, 20 nt, Human
uaaacugcccccucugcccu

SEQ ID NO: 2837851 - RNA, 22 nt, Human
uaaaggagaaggcaugaaauug

SEQ ID NO: 2837852 - RNA, 17 nt, Human
uaaaggagaaggcauga

SEQ ID NO: 2837853 - RNA, 14 nt, Human
uaaaggacuguaau

SEQ ID NO: 2837854 - RNA, 14 nt, Human
uaaagcucugacau

SEQ ID NO: 2837855 - RNA, 12 nt, Human
uaaaggacugua

SEQ ID NO: 2837856 - RNA, 17 nt, Human
uaaagcgauauacagau

SEQ ID NO: 2837857 - RNA, 18 nt, Human
uaaagcgauauacagaug

SEQ ID NO: 2837858 - RNA, 23 nt, Human
uaaagcgauauacagaugaaaau

SEQ ID NO: 2837859 - RNA, 16 nt, Human
uaaagccugcuuuuua

SEQ ID NO: 2837860 - RNA, 21 nt, Human
uaaagccugcuuuuuaagugu

SEQ ID NO: 2837861 - RNA, 21 nt, Human
uaaagccuuuaguaucagugu

SEQ ID NO: 2837862 - RNA, 12 nt, Human
uaaagcauugcu

SEQ ID NO: 2837863 - RNA, 15 nt, Human
uaaagcauugcuguu

SEQ ID NO: 2837864 - RNA, 19 nt, Human
uaaagcauugcuguuaugu

SEQ ID NO: 2837865 - RNA, 20 nt, Human
uaaagcauugcuguuauguc

SEQ ID NO: 2837866 - RNA, 21 nt, Human
uaaagcauugcuguuaugucu

SEQ ID NO: 2837867 - RNA, 23 nt, Human
uaaagcauugcuguuaugucugu

SEQ ID NO: 2837868 - RNA, 13 nt, Human
uaaagcauugcuu

SEQ ID NO: 2837869 - RNA, 21 nt, Human
uaaagcauugcuuuuauuuug

SEQ ID NO: 2837870 - RNA, 14 nt, Human
uaaacuuuuuuuca

SEQ ID NO: 2837871 - RNA, 15 nt, Human
uaaacuuuuuuucaa

SEQ ID NO: 2837872 - RNA, 16 nt, Human
uaaacuuuuuuucaau

SEQ ID NO: 2837873 - RNA, 17 nt, Human
uaaacuuuuuuucaaug

SEQ ID NO: 2837874 - RNA, 18 nt, Human
uaaacuuuuuuucaaugu

SEQ ID NO: 2837875 - RNA, 19 nt, Human
uaaacuuuuuuucaaugug

SEQ ID NO: 2837876 - RNA, 16 nt, Human
uaaagcauaaguauac

SEQ ID NO: 2837877 - RNA, 17 nt, Human
uaaagcauaaguauaca

SEQ ID NO: 2837878 - RNA, 21 nt, Human
uaaagcauaaguauacaguuc

SEQ ID NO: 2837879 - RNA, 12 nt, Human
uaaagcauauag

SEQ ID NO: 2837880 - RNA, 22 nt, Human
uaaagcaugaaugguauggaac

SEQ ID NO: 2837881 - RNA, 21 nt, Human
uaaauaaaacuuaaaucucac

SEQ ID NO: 2837882 - RNA, 13 nt, Human
uaaauaaaagaaa

SEQ ID NO: 2837883 - RNA, 13 nt, Human
uaaaguuucucag

SEQ ID NO: 2837884 - RNA, 14 nt, Human
uaaaguuucucaga

SEQ ID NO: 2837885 - RNA, 14 nt, Human
uaaaguuugcuuag

SEQ ID NO: 2837886 - RNA, 17 nt, Human
uaaaguuugcuuagaaa

SEQ ID NO: 2837887 - RNA, 18 nt, Human
uaaaguuugcuuguuucu

SEQ ID NO: 2837888 - RNA, 21 nt, Human
uaaaguuugcuuguuucuugg

SEQ ID NO: 2837889 - RNA, 17 nt, Human
uaaaggauguugguguu

SEQ ID NO: 2837890 - RNA, 22 nt, Human
uaaaggaugugauuguggaaug

SEQ ID NO: 2837891 - RNA, 16 nt, Human
uaaaggaugugauugu

SEQ ID NO: 2837892 - RNA, 21 nt, Human
uaaauaucugaacauuuacua

SEQ ID NO: 2837893 - RNA, 22 nt, Human
uaaauaucaaucaagccaugua

SEQ ID NO: 2837894 - RNA, 14 nt, Human
uaaauaucuuuuau

SEQ ID NO: 2837895 - RNA, 15 nt, Human
uaaauaucuuuuaug

SEQ ID NO: 2837896 - RNA, 17 nt, Human
uaaauaucuuuuauguu

SEQ ID NO: 2837897 - RNA, 18 nt, Human
uaaauaucuuuuauguuu

SEQ ID NO: 2837898 - RNA, 20 nt, Human
uaaauaucuuuuauguuuga

SEQ ID NO: 2837899 - RNA, 21 nt, Human
uaaauaucuuuuauguuugaa

SEQ ID NO: 2837900 - RNA, 22 nt, Human
uaaauaucuuuuauguuugaau

SEQ ID NO: 2837901 - RNA, 23 nt, Human
uaaauaucuuuuauguuugaaua

SEQ ID NO: 2837902 - RNA, 18 nt, Human
uaaauaugaacccuuugu

SEQ ID NO: 2837903 - RNA, 22 nt, Human
uaaauaugaacccuuuguuucu

SEQ ID NO: 2837904 - RNA, 23 nt, Human
uaaauaugaacccuuuguuucuu

SEQ ID NO: 2837905 - RNA, 13 nt, Human
uaaauaugcagug

SEQ ID NO: 2837906 - RNA, 22 nt, Human
uaaauaugaaucugcucacuuu

SEQ ID NO: 2837907 - RNA, 23 nt, Human
uaaauaugaaucugcucacuuua

SEQ ID NO: 2837908 - RNA, 14 nt, Human
uaaauauauauaaa

SEQ ID NO: 2837909 - RNA, 15 nt, Human
uaaauauauauaaag

SEQ ID NO: 2837910 - RNA, 20 nt, Human
uaaauauauauaaagaauau

SEQ ID NO: 2837911 - RNA, 11 nt, Human
uaaauauauau

SEQ ID NO: 2837912 - RNA, 13 nt, Human
uaaauauauauaa

SEQ ID NO: 2837913 - RNA, 16 nt, Human
uaaauauagauuagaa

SEQ ID NO: 2837914 - RNA, 17 nt, Human
uaaauauagauuagaaa

SEQ ID NO: 2837915 - RNA, 20 nt, Human
uaaauauagauuagaaaaau

SEQ ID NO: 2837916 - RNA, 15 nt, Human
uaaauauaguuccua

SEQ ID NO: 2837917 - RNA, 16 nt, Human
uaaauauaguuccuaa

SEQ ID NO: 2837918 - RNA, 19 nt, Human
uaaauauaguuccuaagaa

SEQ ID NO: 2837919 - RNA, 20 nt, Human
uaaauauaguuccuaagaag

SEQ ID NO: 2837920 - RNA, 23 nt, Human
uaaauauaguuccuaagaagcuu

SEQ ID NO: 2837921 - RNA, 20 nt, Human
uaaauaaacuguugcucguu

SEQ ID NO: 2837922 - RNA, 11 nt, Human
uaaauaaacuu

SEQ ID NO: 2837923 - RNA, 12 nt, Human
uaaauaaacuuu

SEQ ID NO: 2837924 - RNA, 13 nt, Human
uaaauaaacuuuu

SEQ ID NO: 2837925 - RNA, 14 nt, Human
uaaauaaacuuuuu

SEQ ID NO: 2837926 - RNA, 15 nt, Human
uaaauaaacuuuuuu

SEQ ID NO: 2837927 - RNA, 18 nt, Human
uaaauaaacuuuuuuuca

SEQ ID NO: 2837928 - RNA, 19 nt, Human
uaaauaaacuuuuuuucaa

SEQ ID NO: 2837929 - RNA, 20 nt, Human
uaaauaaacuuuuuuucaau

SEQ ID NO: 2837930 - RNA, 22 nt, Human
uaaauaaaccucaaaaugucua

SEQ ID NO: 2837931 - RNA, 13 nt, Human
uaaauaaacccuu

SEQ ID NO: 2837932 - RNA, 18 nt, Human
uaaauaaaaguuuuacaa

SEQ ID NO: 2837933 - RNA, 22 nt, Human
uaaauaaaaguuuuacaaaggg

SEQ ID NO: 2837934 - RNA, 21 nt, Human
uaaauaaaagaaaaaauaucu

SEQ ID NO: 2837935 - RNA, 12 nt, Human
uaaauaaaauca

SEQ ID NO: 2837936 - RNA, 14 nt, Human
uaaauaaaaucaau

SEQ ID NO: 2837937 - RNA, 15 nt, Human
uaaauaaaaucaauu

SEQ ID NO: 2837938 - RNA, 14 nt, Human
uaaaucauuaauac

SEQ ID NO: 2837939 - RNA, 16 nt, Human
uaaaucagauguugaa

SEQ ID NO: 2837940 - RNA, 22 nt, Human
uaaaucagauguuuuggucaag

SEQ ID NO: 2837941 - RNA, 14 nt, Human
uaaaucauauugau

SEQ ID NO: 2837942 - RNA, 19 nt, Human
uaaaucauauugaugaaaa

SEQ ID NO: 2837943 - RNA, 20 nt, Human
uaaaucauauugaugaaaag

SEQ ID NO: 2837944 - RNA, 16 nt, Human
uaaaucaugaugcuag

SEQ ID NO: 2837945 - RNA, 22 nt, Human
uaaaucaugaugcuagccagca

SEQ ID NO: 2837946 - RNA, 12 nt, Human
uaaaucauuuua

SEQ ID NO: 2837947 - RNA, 17 nt, Human
uaaaucauuuuaggaaa

SEQ ID NO: 2837948 - RNA, 19 nt, Human
uaaaucauuuuaggaaagg

SEQ ID NO: 2837949 - RNA, 20 nt, Human
uaaaucauuuuaggaaagga

SEQ ID NO: 2837950 - RNA, 21 nt, Human
uaaaucauuuuaggaaaggau

SEQ ID NO: 2837951 - RNA, 14 nt, Human
uaaaucacauccuu

SEQ ID NO: 2837952 - RNA, 19 nt, Human
uaaaucaaguuggcuucua

SEQ ID NO: 2837953 - RNA, 20 nt, Human
uaaauauguacaauuguggg

SEQ ID NO: 2837954 - RNA, 14 nt, Human
uaaauaugcaguga

SEQ ID NO: 2837955 - RNA, 16 nt, Human
uaaauaugcagugaua

SEQ ID NO: 2837956 - RNA, 17 nt, Human
uaaauaugcagugauau

SEQ ID NO: 2837957 - RNA, 13 nt, Human
uaaauauucuaua

SEQ ID NO: 2837958 - RNA, 18 nt, Human
uaaauauuaguuaaugga

SEQ ID NO: 2837959 - RNA, 19 nt, Human
uaaauauuaguuaauggau

SEQ ID NO: 2837960 - RNA, 20 nt, Human
uaaauauuaguuaauggauu

SEQ ID NO: 2837961 - RNA, 21 nt, Human
uaaauauuaguuaauggauua

SEQ ID NO: 2837962 - RNA, 12 nt, Human
uaaauauugagg

SEQ ID NO: 2837963 - RNA, 18 nt, Human
uaaauauugaggcuuugu

SEQ ID NO: 2837964 - RNA, 20 nt, Human
uaaauauugaggcuuugugu

SEQ ID NO: 2837965 - RNA, 21 nt, Human
uaaauauugaggcuuuguguu

SEQ ID NO: 2837966 - RNA, 15 nt, Human
uaaauauucuauaug

SEQ ID NO: 2837967 - RNA, 19 nt, Human
uaaauauucuauaugaauu

SEQ ID NO: 2837968 - RNA, 18 nt, Human
uaaauauuugacuugcau

SEQ ID NO: 2837969 - RNA, 19 nt, Human
uaaauauuuggucucuauu

SEQ ID NO: 2837970 - RNA, 22 nt, Human
uaaauauuuggucucuauuuca

SEQ ID NO: 2837971 - RNA, 15 nt, Human
uauuuauuuaaaaga

SEQ ID NO: 2837972 - RNA, 16 nt, Human
uauuuauuuaaaagau

SEQ ID NO: 2837973 - RNA, 13 nt, Human
uauuuauuuaaaa

SEQ ID NO: 2837974 - RNA, 12 nt, Human
uauuuauuuaaa

SEQ ID NO: 2837975 - RNA, 19 nt, Human
uauuuauuaauauuuaaca

SEQ ID NO: 2837976 - RNA, 13 nt, Human
uauuuauuaauau

SEQ ID NO: 2837977 - RNA, 17 nt, Human
uauuuauuaauauuuaa

SEQ ID NO: 2837978 - RNA, 21 nt, Human
uauuuauucagcuucauuugu

SEQ ID NO: 2837979 - RNA, 13 nt, Human
uauuuauuaacag

SEQ ID NO: 2837980 - RNA, 21 nt, Human
uauuuauugaagaaacagaua

SEQ ID NO: 2837981 - RNA, 18 nt, Human
uauuuauuaauauuuaac

SEQ ID NO: 2837982 - RNA, 14 nt, Human
uauuuauuacuaug

SEQ ID NO: 2837983 - RNA, 24 nt, Human
uauuuauucagcuucauuuguguc

SEQ ID NO: 2837984 - RNA, 16 nt, Human
uaucugagcugagcca

SEQ ID NO: 2837985 - RNA, 12 nt, Human
uaucugaaaacu

SEQ ID NO: 2837986 - RNA, 13 nt, Human
uaucugaaaacug

SEQ ID NO: 2837987 - RNA, 14 nt, Human
uaucugaaaacugg

SEQ ID NO: 2837988 - RNA, 15 nt, Human
uaucugaaaacugga

SEQ ID NO: 2837989 - RNA, 16 nt, Human
uaucugaaaacuggaa

SEQ ID NO: 2837990 - RNA, 14 nt, Human
uaucugaacauuua

SEQ ID NO: 2837991 - RNA, 15 nt, Human
uaucugaacauuuac

SEQ ID NO: 2837992 - RNA, 17 nt, Human
uaucugaacauuuacua

SEQ ID NO: 2837993 - RNA, 19 nt, Human
uaucugaacauuuacuaca

SEQ ID NO: 2837994 - RNA, 15 nt, Human
uauuugcuuuuugcu

SEQ ID NO: 2837995 - RNA, 15 nt, Human
uauuugcuucauugu

SEQ ID NO: 2837996 - RNA, 14 nt, Human
uauuuggcaguuug

SEQ ID NO: 2837997 - RNA, 17 nt, Human
uauuuggcaguuuggua

SEQ ID NO: 2837998 - RNA, 21 nt, Human
uauuuggcaguuugguauuug

SEQ ID NO: 2837999 - RNA, 14 nt, Human
uauuuggcuuaaau

SEQ ID NO: 2838000 - RNA, 15 nt, Human
uauuuggcuuaaaua

SEQ ID NO: 2838001 - RNA, 16 nt, Human
uauuuggcuuaaauau

SEQ ID NO: 2838002 - RNA, 19 nt, Human
uauuuggcuuaaauauagu

SEQ ID NO: 2838003 - RNA, 16 nt, Human
uauuugggaaacuugu

SEQ ID NO: 2838004 - RNA, 21 nt, Human
uauuugggaaacuugucacuu

SEQ ID NO: 2838005 - RNA, 14 nt, Human
uauuugggaaguga

SEQ ID NO: 2838006 - RNA, 15 nt, Human
uauuugggaagugaa

SEQ ID NO: 2838007 - RNA, 22 nt, Human
uauuugggagggaaaagggaag

SEQ ID NO: 2838008 - RNA, 23 nt, Human
uauuugggagggaaaagggaagu

SEQ ID NO: 2838009 - RNA, 21 nt, Human
uauuuggaagaaaaaaaucuu

SEQ ID NO: 2838010 - RNA, 16 nt, Human
uauuuuagaauaaauu

SEQ ID NO: 2838011 - RNA, 16 nt, Human
uauuugagaguucuaa

SEQ ID NO: 2838012 - RNA, 15 nt, Human
uauuugagaguucua

SEQ ID NO: 2838013 - RNA, 18 nt, Human
uauuucuuauacgcuuuu

SEQ ID NO: 2838014 - RNA, 19 nt, Human
uauuugagaguucuaaauu

SEQ ID NO: 2838015 - RNA, 18 nt, Human
uauuugagaguucuaaau

SEQ ID NO: 2838016 - RNA, 15 nt, Human
uauuugauucaaaau

SEQ ID NO: 2838017 - RNA, 16 nt, Human
uauuugauucaaaaua

SEQ ID NO: 2838018 - RNA, 16 nt, Human
uauuugagacuaguuu

SEQ ID NO: 2838019 - RNA, 19 nt, Human
uauuugagggguuucagaa

SEQ ID NO: 2838020 - RNA, 20 nt, Human
uauuucugucauucaaaugg

SEQ ID NO: 2838021 - RNA, 16 nt, Human
uauuucuguuucucau

SEQ ID NO: 2838022 - RNA, 17 nt, Human
uauuucuguuucucaua

SEQ ID NO: 2838023 - RNA, 15 nt, Human
uauuucugcuuucuu

SEQ ID NO: 2838024 - RNA, 17 nt, Human
uauuucugggucuuuug

SEQ ID NO: 2838025 - RNA, 18 nt, Human
uauuucugggucuuuugc

SEQ ID NO: 2838026 - RNA, 22 nt, Human
uauuucugggucuuuugcuacu

SEQ ID NO: 2838027 - RNA, 17 nt, Human
uauuucugcauauguug

SEQ ID NO: 2838028 - RNA, 14 nt, Human
uauuucugcaaaca

SEQ ID NO: 2838029 - RNA, 21 nt, Human
uauuucucaacaaagcacagu

SEQ ID NO: 2838030 - RNA, 19 nt, Human
uauuucucaacaaagcaca

SEQ ID NO: 2838031 - RNA, 15 nt, Human
uauuucucuaguagu

SEQ ID NO: 2838032 - RNA, 16 nt, Human
uauuucucuaguaguu

SEQ ID NO: 2838033 - RNA, 18 nt, Human
ucaaaacucacaagugcu

SEQ ID NO: 2838034 - RNA, 23 nt, Human
ucaaacggccucacuaggcuucu

SEQ ID NO: 2838035 - RNA, 18 nt, Human
ucaaaacggggcagccaa

SEQ ID NO: 2838036 - RNA, 16 nt, Human
ucaaaacuacaaauca

SEQ ID NO: 2838037 - RNA, 21 nt, Human
ucaaacuccaagguucccuug

SEQ ID NO: 2838038 - RNA, 22 nt, Human
ucaaacuccaagguucccuugu

SEQ ID NO: 2838039 - RNA, 17 nt, Human
ucaaacuaucuggccau

SEQ ID NO: 2838040 - RNA, 15 nt, Human
ucaaacgugaaaaug

SEQ ID NO: 2838041 - RNA, 16 nt, Human
ucaaacgugaaaaugc

SEQ ID NO: 2838042 - RNA, 13 nt, Human
ucaaacuaaaaga

SEQ ID NO: 2838043 - RNA, 14 nt, Human
ucaaacuaaaagac

SEQ ID NO: 2838044 - RNA, 17 nt, Human
ucaaacuaaaagacauu

SEQ ID NO: 2838045 - RNA, 21 nt, Human
ucaaacuaaaagacauuuguu

SEQ ID NO: 2838046 - RNA, 12 nt, Human
ucaaaaaguguu

SEQ ID NO: 2838047 - RNA, 14 nt, Human
ucaaaaaguguuua

SEQ ID NO: 2838048 - RNA, 15 nt, Human
ucaaaaaguguuuau

SEQ ID NO: 2838049 - RNA, 23 nt, Human
ucaaaaagucuacgcucuccuuu

SEQ ID NO: 2838050 - RNA, 19 nt, Human
ucaaaacccaucugggcuc

SEQ ID NO: 2838051 - RNA, 23 nt, Human
ucaaaaaguguuuauuuuucaua

SEQ ID NO: 2838052 - RNA, 14 nt, Human
ucaaaaauacaaaa

SEQ ID NO: 2838053 - RNA, 15 nt, Human
ucaaaaauacaaaau

SEQ ID NO: 2838054 - RNA, 21 nt, Human
ucaaaaauacaaaauaaaaac

SEQ ID NO: 2838055 - RNA, 19 nt, Human
ucaaaaaguguuuauuuuu

SEQ ID NO: 2838056 - RNA, 13 nt, Human
ucaaaaauauaac

SEQ ID NO: 2838057 - RNA, 22 nt, Human
ucaaaaacuuuggaguccccuc

SEQ ID NO: 2838058 - RNA, 13 nt, Human
ucaaaaacuguuu

SEQ ID NO: 2838059 - RNA, 17 nt, Human
ucaaaaacuuuggaguc

SEQ ID NO: 2838060 - RNA, 15 nt, Human
ucaaaaacauucuua

SEQ ID NO: 2838061 - RNA, 12 nt, Human
uauuuuaugaga

SEQ ID NO: 2838062 - RNA, 14 nt, Human
uauuuuaugagaaa

SEQ ID NO: 2838063 - RNA, 15 nt, Human
uauuuuaugagaaau

SEQ ID NO: 2838064 - RNA, 16 nt, Human
uauuuuaugagaaaug

SEQ ID NO: 2838065 - RNA, 17 nt, Human
uauuuuaugagaaaugu

SEQ ID NO: 2838066 - RNA, 18 nt, Human
uauuuuaugagaaaugua

SEQ ID NO: 2838067 - RNA, 17 nt, Human
uauuuucaguauuuugg

SEQ ID NO: 2838068 - RNA, 18 nt, Human
uauuuucaguaauguuau

SEQ ID NO: 2838069 - RNA, 16 nt, Human
uauuuucaagaaacug

SEQ ID NO: 2838070 - RNA, 13 nt, Human
uauuuucaagaaa

SEQ ID NO: 2838071 - RNA, 11 nt, Human
uauuuucacaa

SEQ ID NO: 2838072 - RNA, 12 nt, Human
uauuuucacaau

SEQ ID NO: 2838073 - RNA, 14 nt, Human
uauuuucacaaugu

SEQ ID NO: 2838074 - RNA, 16 nt, Human
uauuuucacaauguca

SEQ ID NO: 2838075 - RNA, 19 nt, Human
uauuuucaacgcagcccug

SEQ ID NO: 2838076 - RNA, 21 nt, Human
uauuuucaacgcagcccugcu

SEQ ID NO: 2838077 - RNA, 14 nt, Human
uauuuugaaguuua

SEQ ID NO: 2838078 - RNA, 15 nt, Human
uauuuugaaguuuac

SEQ ID NO: 2838079 - RNA, 17 nt, Human
uauuuugaaguuuacau

SEQ ID NO: 2838080 - RNA, 18 nt, Human
uauuuugaaguuuacauu

SEQ ID NO: 2838081 - RNA, 19 nt, Human
uauuuugaaguuuacauuu

SEQ ID NO: 2838082 - RNA, 22 nt, Human
uauuuugaaguuuacauuuuua

SEQ ID NO: 2838083 - RNA, 11 nt, Human
uauuuugaagu

SEQ ID NO: 2838084 - RNA, 16 nt, Human
uauuuucuuuuguaaa

SEQ ID NO: 2838085 - RNA, 14 nt, Human
uauuuugaaaagcu

SEQ ID NO: 2838086 - RNA, 16 nt, Human
uauuuugaaaagcuuc

SEQ ID NO: 2838087 - RNA, 17 nt, Human
uauuuugaaaagcuucu

SEQ ID NO: 2838088 - RNA, 20 nt, Human
uauuuugaaaagcuucuuaa

SEQ ID NO: 2838089 - RNA, 16 nt, Human
uauuuucuuuugaauu

SEQ ID NO: 2838090 - RNA, 19 nt, Human
uauuuucuuuugaauuguu

SEQ ID NO: 2838091 - RNA, 13 nt, Human
uauuuucauuaca

SEQ ID NO: 2838092 - RNA, 17 nt, Human
uauuuucauuacaaugg

SEQ ID NO: 2838093 - RNA, 21 nt, Human
uauuuucauuacaauggaaac

SEQ ID NO: 2838094 - RNA, 21 nt, Human
uauuuucuuacccaauuuccc

SEQ ID NO: 2838095 - RNA, 12 nt, Human
uauuuucuucau

SEQ ID NO: 2838096 - RNA, 19 nt, Human
uauuuucuucauccaacuu

SEQ ID NO: 2838097 - RNA, 15 nt, Human
uauuuucuucuaagu

SEQ ID NO: 2838098 - RNA, 13 nt, Human
uauuuuuuaagua

SEQ ID NO: 2838099 - RNA, 14 nt, Human
uauuuuuguaguga

SEQ ID NO: 2838100 - RNA, 23 nt, Human
uauuuuuguagugaccuguuuau

SEQ ID NO: 2838101 - RNA, 13 nt, Human
uauuuuuuauugu

SEQ ID NO: 2838102 - RNA, 17 nt, Human
uauuuuuuauuguuuuc

SEQ ID NO: 2838103 - RNA, 16 nt, Human
uauuuuuuauauauac

SEQ ID NO: 2838104 - RNA, 19 nt, Human
uauuuuuuauaucuggaau

SEQ ID NO: 2838105 - RNA, 21 nt, Human
uauuuuuuaaguauuuauaua

SEQ ID NO: 2838106 - RNA, 15 nt, Human
uauuuuuuaaguauu

SEQ ID NO: 2838107 - RNA, 12 nt, Human
ucaacuauuuua

SEQ ID NO: 2838108 - RNA, 23 nt, Human
ucaacuaccucgcaucauugcag

SEQ ID NO: 2838109 - RNA, 17 nt, Human
ucaacuacuauucaaaa

SEQ ID NO: 2838110 - RNA, 22 nt, Human
ucaagcagcgaccgcccccucc

SEQ ID NO: 2838111 - RNA, 23 nt, Human
ucaagcagcgaccgcccccuccu

SEQ ID NO: 2838112 - RNA, 16 nt, Human
ucaagcagguuagaga

SEQ ID NO: 2838113 - RNA, 17 nt, Human
ucaagcagguuagagaa

SEQ ID NO: 2838114 - RNA, 23 nt, Human
ucaagcagguuagagaaaauaga

SEQ ID NO: 2838115 - RNA, 14 nt, Human
ucaaccuccugggc

SEQ ID NO: 2838116 - RNA, 13 nt, Human
ucaaccuccuggg

SEQ ID NO: 2838117 - RNA, 15 nt, Human
ucaacguauuguuuc

SEQ ID NO: 2838118 - RNA, 14 nt, Human
ucaacguuguacug

SEQ ID NO: 2838119 - RNA, 20 nt, Human
ucaacguuguacuguaugug

SEQ ID NO: 2838120 - RNA, 17 nt, Human
ucaacguuucuucacuu

SEQ ID NO: 2838121 - RNA, 21 nt, Human
ucaaagaaagaaaguuuagaa

SEQ ID NO: 2838122 - RNA, 22 nt, Human
ucaaagaaagaaaguuuagaag

SEQ ID NO: 2838123 - RNA, 22 nt, Human
ucaaacucuugaccucagguga

SEQ ID NO: 2838124 - RNA, 22 nt, Human
ucaagugauucuccugccucag

SEQ ID NO: 2838125 - RNA, 16 nt, Human
ucaagcgauucuucug

SEQ ID NO: 2838126 - RNA, 15 nt, Human
ucaagccugugcaaa

SEQ ID NO: 2838127 - RNA, 18 nt, Human
ucaagccugugcaaaaaa

SEQ ID NO: 2838128 - RNA, 19 nt, Human
ucaagccugugcaaaaaaa

SEQ ID NO: 2838129 - RNA, 15 nt, Human
ucaagcgauucuccu

SEQ ID NO: 2838130 - RNA, 16 nt, Human
ucaagcgauucuccug

SEQ ID NO: 2838131 - RNA, 17 nt, Human
ucaagcgauucuccugc

SEQ ID NO: 2838132 - RNA, 16 nt, Human
ucaagcccgcggggac

SEQ ID NO: 2838133 - RNA, 11 nt, Human
ucacaggcagg

SEQ ID NO: 2838134 - RNA, 23 nt, Human
ucacacagugagucgaggacagg

SEQ ID NO: 2838135 - RNA, 22 nt, Human
ucacacagugagucgaggacag

SEQ ID NO: 2838136 - RNA, 14 nt, Human
ucacacauccagac

SEQ ID NO: 2838137 - RNA, 19 nt, Human
ucacacauccagacaucau

SEQ ID NO: 2838138 - RNA, 22 nt, Human
ucacacauccagacaucaugaa

SEQ ID NO: 2838139 - RNA, 14 nt, Human
ucacaauaaaagcu

SEQ ID NO: 2838140 - RNA, 13 nt, Human
ucacaauacagau

SEQ ID NO: 2838141 - RNA, 14 nt, Human
ucacaauacagaua

SEQ ID NO: 2838142 - RNA, 15 nt, Human
ucacaauacagauaa

SEQ ID NO: 2838143 - RNA, 20 nt, Human
ucacaauacagauaacauua

SEQ ID NO: 2838144 - RNA, 17 nt, Human
ucaaugcgcaaaaugca

SEQ ID NO: 2838145 - RNA, 22 nt, Human
ucacaaugaaaugcucuccuuu

SEQ ID NO: 2838146 - RNA, 17 nt, Human
ucacaaugucaguauuu

SEQ ID NO: 2838147 - RNA, 19 nt, Human
ucacaaugucaguauuuca

SEQ ID NO: 2838148 - RNA, 14 nt, Human
ucacaauguucuuu

SEQ ID NO: 2838149 - RNA, 15 nt, Human
ucacaauguucuuua

SEQ ID NO: 2838150 - RNA, 16 nt, Human
ucacaauguucuuuau

SEQ ID NO: 2838151 - RNA, 17 nt, Human
ucacaauguucuuuaua

SEQ ID NO: 2838152 - RNA, 13 nt, Human
ucacaauuuuuaa

SEQ ID NO: 2838153 - RNA, 15 nt, Human
ucacaauuuuuaaug

SEQ ID NO: 2838154 - RNA, 13 nt, Human
ucacacagugagu

SEQ ID NO: 2838155 - RNA, 22 nt, Human
ucacacaguauuacuucugcua

SEQ ID NO: 2838156 - RNA, 21 nt, Human
ucacacaguauuacuucugcu

SEQ ID NO: 2838157 - RNA, 10 nt, Human
ucacacacac

SEQ ID NO: 2838158 - RNA, 23 nt, Human
ucacaaugaaaugcucuccuuuc

SEQ ID NO: 2838159 - RNA, 17 nt, Human
ucaaugggcaaugacag

SEQ ID NO: 2838160 - RNA, 17 nt, Human
ucaaugggcucuuccaa

SEQ ID NO: 2838161 - RNA, 11 nt, Human
ucaauuaauaa

SEQ ID NO: 2838162 - RNA, 14 nt, Human
ucaaugggcaauga

SEQ ID NO: 2838163 - RNA, 17 nt, Human
ucaaugcuauaacuaug

SEQ ID NO: 2838164 - RNA, 18 nt, Human
ucaaugcacugacauugu

SEQ ID NO: 2838165 - RNA, 21 nt, Human
ucaauggaguaugucugaugg

SEQ ID NO: 2838166 - RNA, 20 nt, Human
ucaauggauuugaugcuguu

SEQ ID NO: 2838167 - RNA, 21 nt, Human
ucaauggccuaaaacuggccu

SEQ ID NO: 2838168 - RNA, 23 nt, Human
ucaauggccuaaaacuggccuga

SEQ ID NO: 2838169 - RNA, 12 nt, Human
ucaaugcuauuu

SEQ ID NO: 2838170 - RNA, 15 nt, Human
ucaaugcuauuuuug

SEQ ID NO: 2838171 - RNA, 14 nt, Human
ucaaugcacugaca

SEQ ID NO: 2838172 - RNA, 16 nt, Human
ucaaugauuauuuuca

SEQ ID NO: 2838173 - RNA, 20 nt, Human
ucaaugcaagagugauugca

SEQ ID NO: 2838174 - RNA, 22 nt, Human
ucaaugcaagagugauugcagc

SEQ ID NO: 2838175 - RNA, 15 nt, Human
ucaaguuagcucagg

SEQ ID NO: 2838176 - RNA, 18 nt, Human
ucaagugggaucugucac

SEQ ID NO: 2838177 - RNA, 14 nt, Human
ucagaggaccugua

SEQ ID NO: 2838178 - RNA, 17 nt, Human
ucagaggaccuguauuu

SEQ ID NO: 2838179 - RNA, 18 nt, Human
ucagaggaccuguauuua

SEQ ID NO: 2838180 - RNA, 21 nt, Human
ucagaggaccuguauuuaagc

SEQ ID NO: 2838181 - RNA, 22 nt, Human
ucagaggaccuguauuuaagca

SEQ ID NO: 2838182 - RNA, 23 nt, Human
ucagaggaccuguauuuaagcaa

SEQ ID NO: 2838183 - RNA, 21 nt, Human
ucagaggagagauagccugug

SEQ ID NO: 2838184 - RNA, 22 nt, Human
ucagaggagagauagccugugg

SEQ ID NO: 2838185 - RNA, 23 nt, Human
ucagaggagagauagccuguggc

SEQ ID NO: 2838186 - RNA, 17 nt, Human
ucagacugcugggacug

SEQ ID NO: 2838187 - RNA, 16 nt, Human
ucagacugcugggacu

SEQ ID NO: 2838188 - RNA, 15 nt, Human
ucagacugcugggac

SEQ ID NO: 2838189 - RNA, 14 nt, Human
ucagacugcuggga

SEQ ID NO: 2838190 - RNA, 13 nt, Human
ucagacugcuggg

SEQ ID NO: 2838191 - RNA, 14 nt, Human
ucagacugcaugua

SEQ ID NO: 2838192 - RNA, 14 nt, Human
ucagacugcaccca

SEQ ID NO: 2838193 - RNA, 15 nt, Human
ucagacugcacccag

SEQ ID NO: 2838194 - RNA, 16 nt, Human
ucagacugcacccagg

SEQ ID NO: 2838195 - RNA, 17 nt, Human
ucagacugcacccagga

SEQ ID NO: 2838196 - RNA, 18 nt, Human
ucagacugcacccaggag

SEQ ID NO: 2838197 - RNA, 19 nt, Human
ucagacugcacccaggagg

SEQ ID NO: 2838198 - RNA, 20 nt, Human
ucagacugcacccaggaggg

SEQ ID NO: 2838199 - RNA, 16 nt, Human
ucagacucucagccca

SEQ ID NO: 2838200 - RNA, 17 nt, Human
ucagacucucagcccag

SEQ ID NO: 2838201 - RNA, 18 nt, Human
ucagacucucagcccaga

SEQ ID NO: 2838202 - RNA, 19 nt, Human
ucagacucucagcccagaa

SEQ ID NO: 2838203 - RNA, 20 nt, Human
ucagacucucagcccagaag

SEQ ID NO: 2838204 - RNA, 21 nt, Human
ucagacucucagcccagaaga

SEQ ID NO: 2838205 - RNA, 22 nt, Human
ucagacauccauguuuguaaaa

SEQ ID NO: 2838206 - RNA, 21 nt, Human
ucagacauccauguuuguaaa

SEQ ID NO: 2838207 - RNA, 14 nt, Human
ucagacauguuuuc

SEQ ID NO: 2838208 - RNA, 15 nt, Human
ucagacauguuuucc

SEQ ID NO: 2838209 - RNA, 20 nt, Human
ucagacauguuuuccgugaa

SEQ ID NO: 2838210 - RNA, 14 nt, Human
ucagaccagcucuu

SEQ ID NO: 2838211 - RNA, 13 nt, Human
ucagaccagagaa

SEQ ID NO: 2838212 - RNA, 12 nt, Human
ucagacauaaag

SEQ ID NO: 2838213 - RNA, 13 nt, Human
ucagacauaaagc

SEQ ID NO: 2838214 - RNA, 14 nt, Human
ucagacauaaagcc

SEQ ID NO: 2838215 - RNA, 15 nt, Human
ucagacauaaagcca

SEQ ID NO: 2838216 - RNA, 16 nt, Human
ucagacauaaagccau

SEQ ID NO: 2838217 - RNA, 11 nt, Human
ucagcacugaa

SEQ ID NO: 2838218 - RNA, 12 nt, Human
ucagcacugaaa

SEQ ID NO: 2838219 - RNA, 13 nt, Human
ucagcacugaaaa

SEQ ID NO: 2838220 - RNA, 14 nt, Human
ucagcacugaaaau

SEQ ID NO: 2838221 - RNA, 15 nt, Human
ucagcacugaaaaua

SEQ ID NO: 2838222 - RNA, 21 nt, Human
ucagcacugaaaauaccauca

SEQ ID NO: 2838223 - RNA, 14 nt, Human
ucagcacuugucuc

SEQ ID NO: 2838224 - RNA, 15 nt, Human
ucagcacuugucuca

SEQ ID NO: 2838225 - RNA, 17 nt, Human
ucagcacuugucucauu

SEQ ID NO: 2838226 - RNA, 18 nt, Human
ucagcacuugucucauuu

SEQ ID NO: 2838227 - RNA, 21 nt, Human
ucagcacuugucucauuuuaa

SEQ ID NO: 2838228 - RNA, 23 nt, Human
ucagcacuugucucauuuuaaug

SEQ ID NO: 2838229 - RNA, 19 nt, Human
ucagcaauuuaacuagaca

SEQ ID NO: 2838230 - RNA, 12 nt, Human
ucagcaagagaa

SEQ ID NO: 2838231 - RNA, 14 nt, Human
ucagcaagagagaa

SEQ ID NO: 2838232 - RNA, 15 nt, Human
ucagcaagagagaac

SEQ ID NO: 2838233 - RNA, 16 nt, Human
ucagcaagagagaacc

SEQ ID NO: 2838234 - RNA, 21 nt, Human
ucagcaaccuuucaccuuugu

SEQ ID NO: 2838235 - RNA, 21 nt, Human
ucagcaagcccuacagagcug

SEQ ID NO: 2838236 - RNA, 23 nt, Human
ucagagugcaagccccugcucca

SEQ ID NO: 2838237 - RNA, 20 nt, Human
ucagaguucuauacuguaaa

SEQ ID NO: 2838238 - RNA, 22 nt, Human
ucagaguucuauacuguaaagc

SEQ ID NO: 2838239 - RNA, 21 nt, Human
ucagcaaacaggaucaguuaa

SEQ ID NO: 2838240 - RNA, 13 nt, Human
ucagcaaaccauu

SEQ ID NO: 2838241 - RNA, 20 nt, Human
ucagcaaaccauuuuuaaag

SEQ ID NO: 2838242 - RNA, 22 nt, Human
ucagcaaaccauuuuuaaagua

SEQ ID NO: 2838243 - RNA, 14 nt, Human
ucagaguuuucugg

SEQ ID NO: 2838244 - RNA, 15 nt, Human
ucagaguuuucuggg

SEQ ID NO: 2838245 - RNA, 15 nt, Human
ucagcaaacaggauc

SEQ ID NO: 2838246 - RNA, 17 nt, Human
ucagaguccuuaaaaug

SEQ ID NO: 2838247 - RNA, 18 nt, Human
ucagaguccuuaaaaugu

SEQ ID NO: 2838248 - RNA, 22 nt, Human
ucagaggccuuaugaggguccu

SEQ ID NO: 2838249 - RNA, 17 nt, Human
ucacuuguacaaaauaa

SEQ ID NO: 2838250 - RNA, 16 nt, Human
ucacuuguacaaaaua

SEQ ID NO: 2838251 - RNA, 13 nt, Human
ucacuuguacaaa

SEQ ID NO: 2838252 - RNA, 12 nt, Human
ucacuugcaugu

SEQ ID NO: 2838253 - RNA, 13 nt, Human
ucacuugcauguc

SEQ ID NO: 2838254 - RNA, 15 nt, Human
ucacuugcauguccc

SEQ ID NO: 2838255 - RNA, 21 nt, Human
ucacuuggucugccaggcccc

SEQ ID NO: 2838256 - RNA, 15 nt, Human
ucacuuguacaaaau

SEQ ID NO: 2838257 - RNA, 14 nt, Human
ucacuuguacaaaa

SEQ ID NO: 2838258 - RNA, 14 nt, Human
ucacuugauucaua

SEQ ID NO: 2838259 - RNA, 15 nt, Human
ucacuugauucauaa

SEQ ID NO: 2838260 - RNA, 16 nt, Human
ucacuugauucauaaa

SEQ ID NO: 2838261 - RNA, 22 nt, Human
ucacuugauucauaaagauuca

SEQ ID NO: 2838262 - RNA, 16 nt, Human
ucacucugucaucuuu

SEQ ID NO: 2838263 - RNA, 17 nt, Human
ucacuggagcccaggag

SEQ ID NO: 2838264 - RNA, 14 nt, Human
ucacucuggccuca

SEQ ID NO: 2838265 - RNA, 21 nt, Human
ucacucugggcacacucugcc

SEQ ID NO: 2838266 - RNA, 22 nt, Human
ucacucugggcacacucugcca

SEQ ID NO: 2838267 - RNA, 15 nt, Human
ucacuggccaucccu

SEQ ID NO: 2838268 - RNA, 16 nt, Human
ucacucugucgcccag

SEQ ID NO: 2838269 - RNA, 12 nt, Human
ucacucugucgc

SEQ ID NO: 2838270 - RNA, 19 nt, Human
ucacucugucgcccagucu

SEQ ID NO: 2838271 - RNA, 13 nt, Human
ucacucugcugcu

SEQ ID NO: 2838272 - RNA, 14 nt, Human
ucacucugcugcuu

SEQ ID NO: 2838273 - RNA, 13 nt, Human
ucacucuggccuc

SEQ ID NO: 2838274 - RNA, 13 nt, Human
ucacuuuugcaag

SEQ ID NO: 2838275 - RNA, 18 nt, Human
ucacuuuugcaagguucc

SEQ ID NO: 2838276 - RNA, 21 nt, Human
ucacuuuugcaagguuccaca

SEQ ID NO: 2838277 - RNA, 21 nt, Human
ucacuuuugcuccgaagcuac

SEQ ID NO: 2838278 - RNA, 18 nt, Human
ucacuuuuccucccucag

SEQ ID NO: 2838279 - RNA, 13 nt, Human
ucacuuuuccucc

SEQ ID NO: 2838280 - RNA, 15 nt, Human
ucacuuuuugaacua

SEQ ID NO: 2838281 - RNA, 17 nt, Human
ucacuuuuugaacuaag

SEQ ID NO: 2838282 - RNA, 18 nt, Human
ucacuuuuugaacuaaga

SEQ ID NO: 2838283 - RNA, 19 nt, Human
ucacuuuuugaacuaagaa

SEQ ID NO: 2838284 - RNA, 20 nt, Human
ucacuuuuugaacuaagaaa

SEQ ID NO: 2838285 - RNA, 21 nt, Human
ucacuuuuugaacuaagaaac

SEQ ID NO: 2838286 - RNA, 22 nt, Human
ucacuuuuugaacuaagaaacu

SEQ ID NO: 2838287 - RNA, 13 nt, Human
ucacuuugucuaa

SEQ ID NO: 2838288 - RNA, 19 nt, Human
ucacuuugucuaacucaga

SEQ ID NO: 2838289 - RNA, 22 nt, Human
ucacuuuuauuuagcaccaggg

SEQ ID NO: 2838290 - RNA, 12 nt, Human
ucacuuuuauuu

SEQ ID NO: 2838291 - RNA, 12 nt, Human
ucacuuuuccuc

SEQ ID NO: 2838292 - RNA, 13 nt, Human
ucacuuuucagug

SEQ ID NO: 2838293 - RNA, 14 nt, Human
ucacuuuucaguga

SEQ ID NO: 2838294 - RNA, 16 nt, Human
ucacuuuucagugaug

SEQ ID NO: 2838295 - RNA, 17 nt, Human
ucagaaaauauuaugug

SEQ ID NO: 2838296 - RNA, 17 nt, Human
ucagaaaaauggagcaa

SEQ ID NO: 2838297 - RNA, 18 nt, Human
ucacuuuuuuuuuuuguu

SEQ ID NO: 2838298 - RNA, 22 nt, Human
ucacuuuuuuuuuuuguuugau

SEQ ID NO: 2838299 - RNA, 20 nt, Human
ucagaaaauauuauguguuu

SEQ ID NO: 2838300 - RNA, 19 nt, Human
ucagaaaauauuauguguu

SEQ ID NO: 2838301 - RNA, 14 nt, Human
ucagaaaagggaag

SEQ ID NO: 2838302 - RNA, 18 nt, Human
ucagaaaacuuuaaaaaa

SEQ ID NO: 2838303 - RNA, 22 nt, Human
ucagaaaacuuuaaaaaauauu

SEQ ID NO: 2838304 - RNA, 15 nt, Human
ucagaaaguguaaau

SEQ ID NO: 2838305 - RNA, 18 nt, Human
ucagaaaguguaaauguu

SEQ ID NO: 2838306 - RNA, 19 nt, Human
ucacucuacuuagcauguc

SEQ ID NO: 2838307 - RNA, 20 nt, Human
ucacucuacuuagcaugucc

SEQ ID NO: 2838308 - RNA, 17 nt, Human
ucacucuccuaugccuu

SEQ ID NO: 2838309 - RNA, 11 nt, Human
ucacucugcca

SEQ ID NO: 2838310 - RNA, 12 nt, Human
ucacucugccag

SEQ ID NO: 2838311 - RNA, 13 nt, Human
ucacucugccagg

SEQ ID NO: 2838312 - RNA, 14 nt, Human
ucacucugccaggg

SEQ ID NO: 2838313 - RNA, 20 nt, Human
ucacucugccagggcagugc

SEQ ID NO: 2838314 - RNA, 21 nt, Human
ucacucugccagggcagugcu

SEQ ID NO: 2838315 - RNA, 14 nt, Human
ucacucggcacccu

SEQ ID NO: 2838316 - RNA, 17 nt, Human
ucacucggcacccugca

SEQ ID NO: 2838317 - RNA, 19 nt, Human
ucacgggcaugggcacucc

SEQ ID NO: 2838318 - RNA, 18 nt, Human
ucacuccuaccugguaau

SEQ ID NO: 2838319 - RNA, 20 nt, Human
ucacgggcaugggcacuccc

SEQ ID NO: 2838320 - RNA, 20 nt, Human
ucacggcucacugcagccuc

SEQ ID NO: 2838321 - RNA, 15 nt, Human
ucacggcucacugca

SEQ ID NO: 2838322 - RNA, 13 nt, Human
ucacggcucacug

SEQ ID NO: 2838323 - RNA, 18 nt, Human
ucacggagauaugaagag

SEQ ID NO: 2838324 - RNA, 14 nt, Human
ucacgcuucacagu

SEQ ID NO: 2838325 - RNA, 15 nt, Human
ucacgcuucacagug

SEQ ID NO: 2838326 - RNA, 15 nt, Human
ucacaggcaggucca

SEQ ID NO: 2838327 - RNA, 12 nt, Human
ucacaggcaggu

SEQ ID NO: 2838328 - RNA, 19 nt, Human
ucacaggcagguccagggu

SEQ ID NO: 2838329 - RNA, 15 nt, Human
ucaccuagaaauuga

SEQ ID NO: 2838330 - RNA, 13 nt, Human
ucaccuagagcca

SEQ ID NO: 2838331 - RNA, 14 nt, Human
ucaccuagagccag

SEQ ID NO: 2838332 - RNA, 15 nt, Human
ucaccuagagccaga

SEQ ID NO: 2838333 - RNA, 18 nt, Human
ucaccuagagccagacca

SEQ ID NO: 2838334 - RNA, 14 nt, Human
ucacagggccaacu

SEQ ID NO: 2838335 - RNA, 22 nt, Human
ucacagggccaacuugagggcc

SEQ ID NO: 2838336 - RNA, 20 nt, Human
ucacagggcaugccccggcc

SEQ ID NO: 2838337 - RNA, 12 nt, Human
ucacagggccaa

SEQ ID NO: 2838338 - RNA, 23 nt, Human
ucacagggacugaaaaccucucc

SEQ ID NO: 2838339 - RNA, 15 nt, Human
ucacagggcagagcc

SEQ ID NO: 2838340 - RNA, 12 nt, Human
ucacaggcuaau

SEQ ID NO: 2838341 - RNA, 19 nt, Human
ucacagggcagagccggga

SEQ ID NO: 2838342 - RNA, 18 nt, Human
ucacagggcagagccggg

SEQ ID NO: 2838343 - RNA, 13 nt, Human
ucaccuuuauucu

SEQ ID NO: 2838344 - RNA, 22 nt, Human
ucaccuucguuuacuaugccug

SEQ ID NO: 2838345 - RNA, 18 nt, Human
ucaccucaggccaggugc

SEQ ID NO: 2838346 - RNA, 12 nt, Human
ucaccucagccu

SEQ ID NO: 2838347 - RNA, 13 nt, Human
ucaccucagccuc

SEQ ID NO: 2838348 - RNA, 20 nt, Human
ucaccuauuuccauucaaca

SEQ ID NO: 2838349 - RNA, 12 nt, Human
ucaccuuuguag

SEQ ID NO: 2838350 - RNA, 15 nt, Human
ucaccuuuguagcac

SEQ ID NO: 2838351 - RNA, 19 nt, Human
ucaccuuuguagcacucag

SEQ ID NO: 2838352 - RNA, 20 nt, Human
ucaccuuguguguuccaagu

SEQ ID NO: 2838353 - RNA, 18 nt, Human
ucaccuuguuucucaacu

SEQ ID NO: 2838354 - RNA, 15 nt, Human
ucaccuuuacuuuag

SEQ ID NO: 2838355 - RNA, 17 nt, Human
ucaccuuuacuuuagaa

SEQ ID NO: 2838356 - RNA, 14 nt, Human
ucacgcaccugggu

SEQ ID NO: 2838357 - RNA, 18 nt, Human
ucacgauugucaucagga

SEQ ID NO: 2838358 - RNA, 21 nt, Human
ucacgauugucaucaggagaa

SEQ ID NO: 2838359 - RNA, 15 nt, Human
ucacgcaacuugaaa

SEQ ID NO: 2838360 - RNA, 16 nt, Human
ucacgcaacuugaaau

SEQ ID NO: 2838361 - RNA, 13 nt, Human
ucacgacgcugca

SEQ ID NO: 2838362 - RNA, 16 nt, Human
ucacgacgcugcagag

SEQ ID NO: 2838363 - RNA, 14 nt, Human
ucaccuuuguguau

SEQ ID NO: 2838364 - RNA, 16 nt, Human
ucaccuuuguguauuu

SEQ ID NO: 2838365 - RNA, 17 nt, Human
ucaccuuuguguauuuu

SEQ ID NO: 2838366 - RNA, 14 nt, Human
ucaccuuuucuugc

SEQ ID NO: 2838367 - RNA, 17 nt, Human
ucaccuuuucuugccug

SEQ ID NO: 2838368 - RNA, 14 nt, Human
ucacgccacugcac

SEQ ID NO: 2838369 - RNA, 13 nt, Human
ucacgccacugca

SEQ ID NO: 2838370 - RNA, 16 nt, Human
ucacgccacugcacua

SEQ ID NO: 2838371 - RNA, 22 nt, Human
ucacgccacugcacuccagccu

SEQ ID NO: 2838372 - RNA, 21 nt, Human
ucacgccuaugaucccagcac

SEQ ID NO: 2838373 - RNA, 19 nt, Human
ucacgccuaugaucccagc

SEQ ID NO: 2838374 - RNA, 16 nt, Human
ucccaaauccuuccca

SEQ ID NO: 2838375 - RNA, 19 nt, Human
ucccaaauccuucccaagu

SEQ ID NO: 2838376 - RNA, 19 nt, Human
ucccaaauuugauugauuu

SEQ ID NO: 2838377 - RNA, 17 nt, Human
ucccaaauuugauugau

SEQ ID NO: 2838378 - RNA, 22 nt, Human
uccauccauaaauccaguucua

SEQ ID NO: 2838379 - RNA, 19 nt, Human
ucccaacaacauccauguc

SEQ ID NO: 2838380 - RNA, 22 nt, Human
ucccaaauuugauugauuugaa

SEQ ID NO: 2838381 - RNA, 20 nt, Human
ucccaaauuugauugauuug

SEQ ID NO: 2838382 - RNA, 15 nt, Human
ucccaagcucugcuc

SEQ ID NO: 2838383 - RNA, 14 nt, Human
ucccaagcucugcu

SEQ ID NO: 2838384 - RNA, 13 nt, Human
ucccaagcucugc

SEQ ID NO: 2838385 - RNA, 12 nt, Human
ucccaagcucug

SEQ ID NO: 2838386 - RNA, 17 nt, Human
ucccaagcucugcuccu

SEQ ID NO: 2838387 - RNA, 20 nt, Human
ucccaagcuaucuaaaguuu

SEQ ID NO: 2838388 - RNA, 13 nt, Human
ucccaagcuggcu

SEQ ID NO: 2838389 - RNA, 15 nt, Human
ucccaagcuggcugg

SEQ ID NO: 2838390 - RNA, 16 nt, Human
ucccaagcuggcuggg

SEQ ID NO: 2838391 - RNA, 17 nt, Human
ucccaagcuggcugggg

SEQ ID NO: 2838392 - RNA, 13 nt, Human
ucccaaggaaagc

SEQ ID NO: 2838393 - RNA, 12 nt, Human
ucccaaggaaag

SEQ ID NO: 2838394 - RNA, 22 nt, Human
ucccaaggaaagccccagcacu

SEQ ID NO: 2838395 - RNA, 16 nt, Human
ucccaaggagaacaaa

SEQ ID NO: 2838396 - RNA, 17 nt, Human
ucccaaggagaacaaau

SEQ ID NO: 2838397 - RNA, 18 nt, Human
ucccaaggagaacaaaua

SEQ ID NO: 2838398 - RNA, 19 nt, Human
ucccaaggagaacaaauau

SEQ ID NO: 2838399 - RNA, 18 nt, Human
ucccaaggcucugagcaa

SEQ ID NO: 2838400 - RNA, 21 nt, Human
ucccaaagugcugggauuaca

SEQ ID NO: 2838401 - RNA, 14 nt, Human
uccauguacuuguu

SEQ ID NO: 2838402 - RNA, 17 nt, Human
uccauguacuuguuugc

SEQ ID NO: 2838403 - RNA, 18 nt, Human
uccauguacuuguuugca

SEQ ID NO: 2838404 - RNA, 23 nt, Human
uccagcucaccagccccagugcc

SEQ ID NO: 2838405 - RNA, 15 nt, Human
uccagcucagaaccc

SEQ ID NO: 2838406 - RNA, 16 nt, Human
uccagcucagaaccca

SEQ ID NO: 2838407 - RNA, 17 nt, Human
uccagcucagaacccag

SEQ ID NO: 2838408 - RNA, 18 nt, Human
uccagcucagaacccagg

SEQ ID NO: 2838409 - RNA, 19 nt, Human
uccagcucagaacccaggg

SEQ ID NO: 2838410 - RNA, 20 nt, Human
uccagcucagaacccagggc

SEQ ID NO: 2838411 - RNA, 21 nt, Human
uccagcucagaacccagggcu

SEQ ID NO: 2838412 - RNA, 16 nt, Human
uccagcucauucauuu

SEQ ID NO: 2838413 - RNA, 18 nt, Human
uccagcucauucauuuua

SEQ ID NO: 2838414 - RNA, 19 nt, Human
uccagcucauucauuuuau

SEQ ID NO: 2838415 - RNA, 20 nt, Human
uccagcucauucauuuuaua

SEQ ID NO: 2838416 - RNA, 18 nt, Human
uccagcuccucauccagg

SEQ ID NO: 2838417 - RNA, 11 nt, Human
uccauccaauc

SEQ ID NO: 2838418 - RNA, 16 nt, Human
uccauccaggccauuc

SEQ ID NO: 2838419 - RNA, 16 nt, Human
uccauccagcuugcca

SEQ ID NO: 2838420 - RNA, 18 nt, Human
uccauccagcuugccaga

SEQ ID NO: 2838421 - RNA, 14 nt, Human
uccaucccuacccc

SEQ ID NO: 2838422 - RNA, 15 nt, Human
uccaucccaggacac

SEQ ID NO: 2838423 - RNA, 21 nt, Human
uccaucccaggacaccacacc

SEQ ID NO: 2838424 - RNA, 22 nt, Human
uccaucccaggacaccacaccc

SEQ ID NO: 2838425 - RNA, 17 nt, Human
uccaucccaacagccau

SEQ ID NO: 2838426 - RNA, 19 nt, Human
uccaucccaacagccaugc

SEQ ID NO: 2838427 - RNA, 18 nt, Human
uccaucccaaccagugcc

SEQ ID NO: 2838428 - RNA, 19 nt, Human
uccaucccaaccagugcca

SEQ ID NO: 2838429 - RNA, 21 nt, Human
uccaucccaaccagugccaag

SEQ ID NO: 2838430 - RNA, 22 nt, Human
uccaucccaaccagugccaagg

SEQ ID NO: 2838431 - RNA, 23 nt, Human
uccaucccaaccagugccaagga

SEQ ID NO: 2838432 - RNA, 19 nt, Human
uccccacuuguccgcuggg

SEQ ID NO: 2838433 - RNA, 19 nt, Human
uccccacuugcagcccugu

SEQ ID NO: 2838434 - RNA, 22 nt, Human
ucccauugcaucaccucuguaa

SEQ ID NO: 2838435 - RNA, 17 nt, Human
uccccagaaaggagacu

SEQ ID NO: 2838436 - RNA, 21 nt, Human
uccccacuuguccgcugggug

SEQ ID NO: 2838437 - RNA, 13 nt, Human
ucccauguagccc

SEQ ID NO: 2838438 - RNA, 15 nt, Human
ucccauguagccccc

SEQ ID NO: 2838439 - RNA, 21 nt, Human
ucccauguagcccccuggccu

SEQ ID NO: 2838440 - RNA, 13 nt, Human
ucccauucuaugu

SEQ ID NO: 2838441 - RNA, 14 nt, Human
ucccauucuaugug

SEQ ID NO: 2838442 - RNA, 15 nt, Human
ucccauucuaugugu

SEQ ID NO: 2838443 - RNA, 18 nt, Human
ucccauucuaugugucau

SEQ ID NO: 2838444 - RNA, 16 nt, Human
ucccaggcugagccuc

SEQ ID NO: 2838445 - RNA, 21 nt, Human
ucccaggcucucaacagggga

SEQ ID NO: 2838446 - RNA, 22 nt, Human
ucccaggaugagcaucccagga

SEQ ID NO: 2838447 - RNA, 16 nt, Human
ucccaucuccacuguu

SEQ ID NO: 2838448 - RNA, 21 nt, Human
ucccauggacacuccagugcc

SEQ ID NO: 2838449 - RNA, 22 nt, Human
ucccauggacacuccagugcca

SEQ ID NO: 2838450 - RNA, 12 nt, Human
ucccaugcccug

SEQ ID NO: 2838451 - RNA, 14 nt, Human
ucccauggacacuc

SEQ ID NO: 2838452 - RNA, 15 nt, Human
ucccauggacacucc

SEQ ID NO: 2838453 - RNA, 20 nt, Human
ucccauggacacuccagugc

SEQ ID NO: 2838454 - RNA, 24 nt, Human
ucccaggaugagcaucccaggauc

SEQ ID NO: 2838455 - RNA, 15 nt, Human
ucccaggaugcuggg

SEQ ID NO: 2838456 - RNA, 18 nt, Human
ucccaggaugcugggugg

SEQ ID NO: 2838457 - RNA, 20 nt, Human
ucccaggcgccccuuccccc

SEQ ID NO: 2838458 - RNA, 18 nt, Human
ucccaggcgccccuuccc

SEQ ID NO: 2838459 - RNA, 21 nt, Human
ucccaggcgccccuucccccu

SEQ ID NO: 2838460 - RNA, 15 nt, Human
ucccaggcugagccu

SEQ ID NO: 2838461 - RNA, 22 nt, Human
ucccaggagacaguucaagaaa

SEQ ID NO: 2838462 - RNA, 16 nt, Human
ucccaggagacaguuc

SEQ ID NO: 2838463 - RNA, 16 nt, Human
ucccaggaugagcauc

SEQ ID NO: 2838464 - RNA, 15 nt, Human
ucccaccucagccuc

SEQ ID NO: 2838465 - RNA, 14 nt, Human
ucccaccucagccu

SEQ ID NO: 2838466 - RNA, 15 nt, Human
ucccaggagacaguu

SEQ ID NO: 2838467 - RNA, 13 nt, Human
ucccaccucagcc

SEQ ID NO: 2838468 - RNA, 18 nt, Human
ucccaaguaagaggcugg

SEQ ID NO: 2838469 - RNA, 23 nt, Human
ucccaaguaagaggcuggaguug

SEQ ID NO: 2838470 - RNA, 18 nt, Human
ucccaaggaaagccccag

SEQ ID NO: 2838471 - RNA, 22 nt, Human
ucccaaggcucugagcaaaugu

SEQ ID NO: 2838472 - RNA, 18 nt, Human
ucccaagggauggugccc

SEQ ID NO: 2838473 - RNA, 21 nt, Human
ucccaagggauggugcccugu

SEQ ID NO: 2838474 - RNA, 15 nt, Human
ucccuacuuccugug

SEQ ID NO: 2838475 - RNA, 16 nt, Human
ucccuacuuccuguga

SEQ ID NO: 2838476 - RNA, 17 nt, Human
ucccuaccucaggcagg

SEQ ID NO: 2838477 - RNA, 15 nt, Human
ucccuaccucaggca

SEQ ID NO: 2838478 - RNA, 13 nt, Human
ucccuaccucagg

SEQ ID NO: 2838479 - RNA, 13 nt, Human
uccccuguuucaa

SEQ ID NO: 2838480 - RNA, 22 nt, Human
uccccuuccuaauuccacagcu

SEQ ID NO: 2838481 - RNA, 21 nt, Human
uccccuuccuaauuccacagc

SEQ ID NO: 2838482 - RNA, 22 nt, Human
ucccuaaggcaugugugaaaca

SEQ ID NO: 2838483 - RNA, 16 nt, Human
ucccuaagccagccug

SEQ ID NO: 2838484 - RNA, 17 nt, Human
ucccuaagccagccugg

SEQ ID NO: 2838485 - RNA, 18 nt, Human
ucccuaaagaaaaaaaau

SEQ ID NO: 2838486 - RNA, 15 nt, Human
ucccuaacacuuacc

SEQ ID NO: 2838487 - RNA, 16 nt, Human
ucccuaacacuuaccc

SEQ ID NO: 2838488 - RNA, 16 nt, Human
uccccuuccucacugc

SEQ ID NO: 2838489 - RNA, 13 nt, Human
ucccuaaacugua

SEQ ID NO: 2838490 - RNA, 19 nt, Human
ucccuaaaauacauuuaaa

SEQ ID NO: 2838491 - RNA, 24 nt, Human
uccccugcccugguccagggaagc

SEQ ID NO: 2838492 - RNA, 17 nt, Human
uccccugcccuggucca

SEQ ID NO: 2838493 - RNA, 15 nt, Human
uccccugcugcaggg

SEQ ID NO: 2838494 - RNA, 12 nt, Human
uccccugccuug

SEQ ID NO: 2838495 - RNA, 15 nt, Human
uccccugccuugcug

SEQ ID NO: 2838496 - RNA, 13 nt, Human
uccccugcuaccc

SEQ ID NO: 2838497 - RNA, 14 nt, Human
uccccugcuacccu

SEQ ID NO: 2838498 - RNA, 17 nt, Human
uccccugcugcaggggc

SEQ ID NO: 2838499 - RNA, 18 nt, Human
uccccugcugcaggggcu

SEQ ID NO: 2838500 - RNA, 21 nt, Human
uccccugcugcaggggcucug

SEQ ID NO: 2838501 - RNA, 23 nt, Human
uccccugcugcaggggcucugga

SEQ ID NO: 2838502 - RNA, 22 nt, Human
uccccugccccuuuacggacac

SEQ ID NO: 2838503 - RNA, 19 nt, Human
uccccugccccuuccuuua

SEQ ID NO: 2838504 - RNA, 15 nt, Human
uccccugcccugcug

SEQ ID NO: 2838505 - RNA, 12 nt, Human
uccccugcccug

SEQ ID NO: 2838506 - RNA, 15 nt, Human
uccccugcccugguc

SEQ ID NO: 2838507 - RNA, 13 nt, Human
uccccugcccugg

SEQ ID NO: 2838508 - RNA, 23 nt, Human
uccccugcccugcugccgccucc

SEQ ID NO: 2838509 - RNA, 16 nt, Human
uccccugcccugcugc

SEQ ID NO: 2838510 - RNA, 15 nt, Human
uccccuguucacucu

SEQ ID NO: 2838511 - RNA, 17 nt, Human
uccccuggacugggagg

SEQ ID NO: 2838512 - RNA, 19 nt, Human
uccccuggggacagcaagg

SEQ ID NO: 2838513 - RNA, 14 nt, Human
uccccuggggaccc

SEQ ID NO: 2838514 - RNA, 15 nt, Human
uccccuggggaccca

SEQ ID NO: 2838515 - RNA, 11 nt, Human
uccccugcuuc

SEQ ID NO: 2838516 - RNA, 14 nt, Human
uccccugcuucaga

SEQ ID NO: 2838517 - RNA, 15 nt, Human
uccccuggacuggga

SEQ ID NO: 2838518 - RNA, 16 nt, Human
uccccuggacugggag

SEQ ID NO: 2838519 - RNA, 14 nt, Human
ucccccuuuuuugu

SEQ ID NO: 2838520 - RNA, 19 nt, Human
ucccccuuuuuuguccccc

SEQ ID NO: 2838521 - RNA, 21 nt, Human
ucccccuuuuuugucccccaa

SEQ ID NO: 2838522 - RNA, 17 nt, Human
ucccccuugccacccca

SEQ ID NO: 2838523 - RNA, 23 nt, Human
ucccccuugccaccccacccucc

SEQ ID NO: 2838524 - RNA, 12 nt, Human
ucccccuugcca

SEQ ID NO: 2838525 - RNA, 13 nt, Human
ucccccuugccac

SEQ ID NO: 2838526 - RNA, 14 nt, Human
ucccccuugccacc

SEQ ID NO: 2838527 - RNA, 16 nt, Human
ucccccuugccacccc

SEQ ID NO: 2838528 - RNA, 18 nt, Human
uccccgacgcccacccaa

SEQ ID NO: 2838529 - RNA, 19 nt, Human
uccccgaaggugcuggagg

SEQ ID NO: 2838530 - RNA, 18 nt, Human
uccccgcagcccuggcag

SEQ ID NO: 2838531 - RNA, 21 nt, Human
uccccgcaccccccaagcugu

SEQ ID NO: 2838532 - RNA, 14 nt, Human
uccccgcacccccc

SEQ ID NO: 2838533 - RNA, 22 nt, Human
uccccgccuuccgccccuuccc

SEQ ID NO: 2838534 - RNA, 15 nt, Human
uccccgcuaaggaag

SEQ ID NO: 2838535 - RNA, 13 nt, Human
uccccugccauuu

SEQ ID NO: 2838536 - RNA, 23 nt, Human
uccccugcccccagaccuuuuau

SEQ ID NO: 2838537 - RNA, 13 nt, Human
ucccccaucuccc

SEQ ID NO: 2838538 - RNA, 15 nt, Human
ucccccaucucccac

SEQ ID NO: 2838539 - RNA, 17 nt, Human
ucccccaucucccaccc

SEQ ID NO: 2838540 - RNA, 15 nt, Human
ucccccauagccacc

SEQ ID NO: 2838541 - RNA, 14 nt, Human
ucccccauagccac

SEQ ID NO: 2838542 - RNA, 12 nt, Human
ucccccauagcc

SEQ ID NO: 2838543 - RNA, 22 nt, Human
uccccagcgucccagucucugg

SEQ ID NO: 2838544 - RNA, 13 nt, Human
ucccccucuggcu

SEQ ID NO: 2838545 - RNA, 12 nt, Human
ucccccugcagc

SEQ ID NO: 2838546 - RNA, 13 nt, Human
ucccccugcagcu

SEQ ID NO: 2838547 - RNA, 14 nt, Human
ucccccugcagcua

SEQ ID NO: 2838548 - RNA, 13 nt, Human
ucccccugcccca

SEQ ID NO: 2838549 - RNA, 17 nt, Human
ucccccucccagggcca

SEQ ID NO: 2838550 - RNA, 15 nt, Human
ucccccuauccuugg

SEQ ID NO: 2838551 - RNA, 17 nt, Human
ucccccuauccuuggca

SEQ ID NO: 2838552 - RNA, 16 nt, Human
ucccccucagcaagcc

SEQ ID NO: 2838553 - RNA, 19 nt, Human
ucccccucccagggccagg

SEQ ID NO: 2838554 - RNA, 18 nt, Human
ucccccucccagggccag

SEQ ID NO: 2838555 - RNA, 20 nt, Human
uccccccuuuuuuuccuuuu

SEQ ID NO: 2838556 - RNA, 13 nt, Human
uccccccucccac

SEQ ID NO: 2838557 - RNA, 14 nt, Human
ucccccgccacucc

SEQ ID NO: 2838558 - RNA, 23 nt, Human
ucccccaucucgcucccucccag

SEQ ID NO: 2838559 - RNA, 17 nt, Human
ucccccaucucuucugg

SEQ ID NO: 2838560 - RNA, 13 nt, Human
uccaagauuccgg

SEQ ID NO: 2838561 - RNA, 15 nt, Human
uccaagauuccggau

SEQ ID NO: 2838562 - RNA, 12 nt, Human
uccaagauucua

SEQ ID NO: 2838563 - RNA, 13 nt, Human
uccaagauucuag

SEQ ID NO: 2838564 - RNA, 14 nt, Human
uccaagauucuaga

SEQ ID NO: 2838565 - RNA, 15 nt, Human
uccaagauucuagau

SEQ ID NO: 2838566 - RNA, 16 nt, Human
uccaagauucuagaug

SEQ ID NO: 2838567 - RNA, 17 nt, Human
uccaagauucuagauga

SEQ ID NO: 2838568 - RNA, 16 nt, Human
uccaagagucuaaaga

SEQ ID NO: 2838569 - RNA, 17 nt, Human
uccaagagucuaaagau

SEQ ID NO: 2838570 - RNA, 16 nt, Human
uccaagagucugauga

SEQ ID NO: 2838571 - RNA, 18 nt, Human
uccaagagucuaaagaug

SEQ ID NO: 2838572 - RNA, 17 nt, Human
uccaagagucugaugau

SEQ ID NO: 2838573 - RNA, 14 nt, Human
uccaagaccagacu

SEQ ID NO: 2838574 - RNA, 22 nt, Human
uccaagaauccacauuucuaaa

SEQ ID NO: 2838575 - RNA, 23 nt, Human
uccaagaauccacauuucuaaaa

SEQ ID NO: 2838576 - RNA, 16 nt, Human
uccaagaauccacauu

SEQ ID NO: 2838577 - RNA, 19 nt, Human
uccaagaauccacauuucu

SEQ ID NO: 2838578 - RNA, 20 nt, Human
uccaagaauccacauuucua

SEQ ID NO: 2838579 - RNA, 21 nt, Human
uccaagaauccacauuucuaa

SEQ ID NO: 2838580 - RNA, 14 nt, Human
uccaagaauccaca

SEQ ID NO: 2838581 - RNA, 18 nt, Human
uccaagaauagcaucugu

SEQ ID NO: 2838582 - RNA, 19 nt, Human
uccaagaauagcaucugua

SEQ ID NO: 2838583 - RNA, 23 nt, Human
uccaagaauagcaucuguacaaa

SEQ ID NO: 2838584 - RNA, 19 nt, Human
uccaaaggaggcuggcagg

SEQ ID NO: 2838585 - RNA, 15 nt, Human
uccaaaggaggcugg

SEQ ID NO: 2838586 - RNA, 13 nt, Human
uccaaaggaggcu

SEQ ID NO: 2838587 - RNA, 13 nt, Human
uccaaagcuuuau

SEQ ID NO: 2838588 - RNA, 20 nt, Human
uccaaagcuuuauuaccagu

SEQ ID NO: 2838589 - RNA, 21 nt, Human
uccaaagcuuuauuaccagug

SEQ ID NO: 2838590 - RNA, 13 nt, Human
uccaaagcagggu

SEQ ID NO: 2838591 - RNA, 19 nt, Human
ucauuucuccagauuaucu

SEQ ID NO: 2838592 - RNA, 16 nt, Human
ucauucacuagcuuug

SEQ ID NO: 2838593 - RNA, 16 nt, Human
ucauucacuucucuua

SEQ ID NO: 2838594 - RNA, 19 nt, Human
ucauucauggaccacuguu

SEQ ID NO: 2838595 - RNA, 20 nt, Human
ucauucauggaccacuguuu

SEQ ID NO: 2838596 - RNA, 14 nt, Human
ucauucauuuuaua

SEQ ID NO: 2838597 - RNA, 19 nt, Human
ucauucauuuuauauugaa

SEQ ID NO: 2838598 - RNA, 23 nt, Human
ucauuucucacuguguacauaau

SEQ ID NO: 2838599 - RNA, 24 nt, Human
ucauuucucacuguguacauaaug

SEQ ID NO: 2838600 - RNA, 23 nt, Human
uccaaagaguagaauugcauuga

SEQ ID NO: 2838601 - RNA, 22 nt, Human
uccaaagaguagaauugcauug

SEQ ID NO: 2838602 - RNA, 20 nt, Human
uccaaaagcaaccacaaacc

SEQ ID NO: 2838603 - RNA, 19 nt, Human
uccaaacuaccuuccaguu

SEQ ID NO: 2838604 - RNA, 20 nt, Human
uccacccuuggccugucuca

SEQ ID NO: 2838605 - RNA, 14 nt, Human
uccaccgcugcucc

SEQ ID NO: 2838606 - RNA, 15 nt, Human
uccaccgcugcucca

SEQ ID NO: 2838607 - RNA, 18 nt, Human
uccaccucgacguuuaca

SEQ ID NO: 2838608 - RNA, 18 nt, Human
uccaauuuucuggaauac

SEQ ID NO: 2838609 - RNA, 18 nt, Human
uccaagauucuagaugau

SEQ ID NO: 2838610 - RNA, 20 nt, Human
uccaagauucuagaugauua

SEQ ID NO: 2838611 - RNA, 14 nt, Human
uccacaacacacag

SEQ ID NO: 2838612 - RNA, 22 nt, Human
uccaauuuucuggaauacauga

SEQ ID NO: 2838613 - RNA, 19 nt, Human
uccacccuuggccugucuc

SEQ ID NO: 2838614 - RNA, 17 nt, Human
uccacccuuggccuguc

SEQ ID NO: 2838615 - RNA, 16 nt, Human
uccacccuuggccugu

SEQ ID NO: 2838616 - RNA, 15 nt, Human
uccacccuuggccug

SEQ ID NO: 2838617 - RNA, 14 nt, Human
uccacccuuggccu

SEQ ID NO: 2838618 - RNA, 13 nt, Human
uccacccuuggcc

SEQ ID NO: 2838619 - RNA, 19 nt, Human
uccagaagccucuggcuag

SEQ ID NO: 2838620 - RNA, 18 nt, Human
uccagaagccucuggcua

SEQ ID NO: 2838621 - RNA, 17 nt, Human
uccagaagccucuggcu

SEQ ID NO: 2838622 - RNA, 14 nt, Human
uccagcagucacuu

SEQ ID NO: 2838623 - RNA, 20 nt, Human
uccagcagucacuucggcca

SEQ ID NO: 2838624 - RNA, 17 nt, Human
uccagcagucucugccu

SEQ ID NO: 2838625 - RNA, 18 nt, Human
uccagcagucucugccuu

SEQ ID NO: 2838626 - RNA, 19 nt, Human
uccagcagucucugccuug

SEQ ID NO: 2838627 - RNA, 20 nt, Human
uccagcagucucugccuugc

SEQ ID NO: 2838628 - RNA, 23 nt, Human
uccagcagucucugccuugccuu

SEQ ID NO: 2838629 - RNA, 18 nt, Human
uccaccucuucacccccc

SEQ ID NO: 2838630 - RNA, 14 nt, Human
uccacuucuuccuu

SEQ ID NO: 2838631 - RNA, 17 nt, Human
uccacuucuuccuuucu

SEQ ID NO: 2838632 - RNA, 18 nt, Human
uccacuucuuccuuucuc

SEQ ID NO: 2838633 - RNA, 20 nt, Human
uccacuucuuccuuucucuu

SEQ ID NO: 2838634 - RNA, 22 nt, Human
uccagaacucacuggggccuac

SEQ ID NO: 2838635 - RNA, 15 nt, Human
uccagaagaagagaa

SEQ ID NO: 2838636 - RNA, 17 nt, Human
uccagaagaagagaagc

SEQ ID NO: 2838637 - RNA, 18 nt, Human
uccagaagaagagaagcu

SEQ ID NO: 2838638 - RNA, 19 nt, Human
uccagaagaagagaagcug

SEQ ID NO: 2838639 - RNA, 20 nt, Human
uccagaagaagagaagcugc

SEQ ID NO: 2838640 - RNA, 21 nt, Human
uccagaagaagagaagcugcu

SEQ ID NO: 2838641 - RNA, 22 nt, Human
uccagaagaagagaagcugcug

SEQ ID NO: 2838642 - RNA, 23 nt, Human
uccagaagaagagaagcugcuga

SEQ ID NO: 2838643 - RNA, 16 nt, Human
uccagaagccucuggc

SEQ ID NO: 2838644 - RNA, 11 nt, Human
uccagaaaugg

SEQ ID NO: 2838645 - RNA, 23 nt, Human
uccagaaaugucuaaaugcugaa

SEQ ID NO: 2838646 - RNA, 20 nt, Human
uccagaacacggcucacgcu

SEQ ID NO: 2838647 - RNA, 18 nt, Human
ucauguaaauacuguugg

SEQ ID NO: 2838648 - RNA, 20 nt, Human
ucauguaaauacuguuggug

SEQ ID NO: 2838649 - RNA, 14 nt, Human
ucauguaaacauac

SEQ ID NO: 2838650 - RNA, 22 nt, Human
ucauguaaacauaccaacaugu

SEQ ID NO: 2838651 - RNA, 22 nt, Human
ucaugguguaauaagacauaac

SEQ ID NO: 2838652 - RNA, 16 nt, Human
ucaugguguguuacac

SEQ ID NO: 2838653 - RNA, 16 nt, Human
ucauguaaagaaaugu

SEQ ID NO: 2838654 - RNA, 19 nt, Human
ucauguaaagaaaugucuu

SEQ ID NO: 2838655 - RNA, 22 nt, Human
ucauguaaagaaaugucuuaau

SEQ ID NO: 2838656 - RNA, 18 nt, Human
ucaugccuggcuucgcaa

SEQ ID NO: 2838657 - RNA, 13 nt, Human
ucaugccuggcuu

SEQ ID NO: 2838658 - RNA, 23 nt, Human
ucaugccuggaagcuuugucccc

SEQ ID NO: 2838659 - RNA, 15 nt, Human
ucaugccuggcuucg

SEQ ID NO: 2838660 - RNA, 17 nt, Human
ucaugccuggcuucgca

SEQ ID NO: 2838661 - RNA, 20 nt, Human
ucaugguguaauaagacaua

SEQ ID NO: 2838662 - RNA, 21 nt, Human
ucaugguguaauaagacauaa

SEQ ID NO: 2838663 - RNA, 18 nt, Human
ucaugcuacccagccauu

SEQ ID NO: 2838664 - RNA, 15 nt, Human
ucaugcuaucucugu

SEQ ID NO: 2838665 - RNA, 17 nt, Human
ucaugcccggucccacc

SEQ ID NO: 2838666 - RNA, 21 nt, Human
ucauaguaacuucuuauggaa

SEQ ID NO: 2838667 - RNA, 18 nt, Human
ucauaguaacuucuuaug

SEQ ID NO: 2838668 - RNA, 16 nt, Human
ucauaguaacuucuua

SEQ ID NO: 2838669 - RNA, 15 nt, Human
ucauaguaacuucuu

SEQ ID NO: 2838670 - RNA, 14 nt, Human
ucauaguaacuucu

SEQ ID NO: 2838671 - RNA, 16 nt, Human
ucauagguauuucaaa

SEQ ID NO: 2838672 - RNA, 16 nt, Human
ucauagguugccaaua

SEQ ID NO: 2838673 - RNA, 20 nt, Human
ucauagguugccaauaauac

SEQ ID NO: 2838674 - RNA, 17 nt, Human
ucaucuguuuuucuuuu

SEQ ID NO: 2838675 - RNA, 19 nt, Human
ucaucugugugaaaauggg

SEQ ID NO: 2838676 - RNA, 12 nt, Human
ucaucuguguga

SEQ ID NO: 2838677 - RNA, 14 nt, Human
ucaucugugugaaa

SEQ ID NO: 2838678 - RNA, 17 nt, Human
ucaucugugugaaaaug

SEQ ID NO: 2838679 - RNA, 15 nt, Human
ucaucugucaagugg

SEQ ID NO: 2838680 - RNA, 13 nt, Human
ucaucugaagggg

SEQ ID NO: 2838681 - RNA, 23 nt, Human
ucaucugaaggggcaaauucuuu

SEQ ID NO: 2838682 - RNA, 20 nt, Human
ucaucugaauuugcccuggg

SEQ ID NO: 2838683 - RNA, 21 nt, Human
ucaucugaauuugcccuggga

SEQ ID NO: 2838684 - RNA, 14 nt, Human
ucaucucuguccca

SEQ ID NO: 2838685 - RNA, 21 nt, Human
ucagugguccacaucccggga

SEQ ID NO: 2838686 - RNA, 16 nt, Human
ucaguguccaaagcag

SEQ ID NO: 2838687 - RNA, 24 nt, Human
ucagucugauucccaagcucugcu

SEQ ID NO: 2838688 - RNA, 21 nt, Human
ucagcagccgccuuaagcuga

SEQ ID NO: 2838689 - RNA, 22 nt, Human
ucagcagccgccuuaagcugau

SEQ ID NO: 2838690 - RNA, 23 nt, Human
ucagcagccgccuuaagcugauc

SEQ ID NO: 2838691 - RNA, 14 nt, Human
ucagcagcuagaaa

SEQ ID NO: 2838692 - RNA, 17 nt, Human
ucagcagcuagaaaaca

SEQ ID NO: 2838693 - RNA, 19 nt, Human
ucagucuggugggaggacg

SEQ ID NO: 2838694 - RNA, 16 nt, Human
ucaguggggcucucug

SEQ ID NO: 2838695 - RNA, 17 nt, Human
ucaguggggcucucuga

SEQ ID NO: 2838696 - RNA, 18 nt, Human
ucaguggggcucucugag

SEQ ID NO: 2838697 - RNA, 19 nt, Human
ucaguggggcucucugagu

SEQ ID NO: 2838698 - RNA, 20 nt, Human
ucaguggggcccauggaugu

SEQ ID NO: 2838699 - RNA, 13 nt, Human
ucagucugguggg

SEQ ID NO: 2838700 - RNA, 16 nt, Human
ucagucuggugggagg

SEQ ID NO: 2838701 - RNA, 17 nt, Human
ucagucuggugggagga

SEQ ID NO: 2838702 - RNA, 12 nt, Human
ucagucuugccu

SEQ ID NO: 2838703 - RNA, 13 nt, Human
ucagucuugccuu

SEQ ID NO: 2838704 - RNA, 20 nt, Human
ucagucuugccuuacacaaa

SEQ ID NO: 2838705 - RNA, 18 nt, Human
ucauaauuccuacagcac

SEQ ID NO: 2838706 - RNA, 20 nt, Human
ucauaauuccuacagcacua

SEQ ID NO: 2838707 - RNA, 23 nt, Human
ucauaauuccuacagcacuacug

SEQ ID NO: 2838708 - RNA, 12 nt, Human
ucauaauggccu

SEQ ID NO: 2838709 - RNA, 13 nt, Human
ucauaauggccug

SEQ ID NO: 2838710 - RNA, 19 nt, Human
ucauacacuaaccaaaucu

SEQ ID NO: 2838711 - RNA, 16 nt, Human
ucaguugguugugucu

SEQ ID NO: 2838712 - RNA, 17 nt, Human
ucaguugguugugucuu

SEQ ID NO: 2838713 - RNA, 18 nt, Human
ucaguugguugugucuuu

SEQ ID NO: 2838714 - RNA, 19 nt, Human
ucaguugguugugucuuuu

SEQ ID NO: 2838715 - RNA, 15 nt, Human
ucaguugugacuaac

SEQ ID NO: 2838716 - RNA, 13 nt, Human
ucaguugugcagc

SEQ ID NO: 2838717 - RNA, 14 nt, Human
ucaguuggcugacu

SEQ ID NO: 2838718 - RNA, 16 nt, Human
ucaguugcuaaacacu

SEQ ID NO: 2838719 - RNA, 17 nt, Human
ucaguugcuaaacacug

SEQ ID NO: 2838720 - RNA, 18 nt, Human
ucaguugcuaaacacugc

SEQ ID NO: 2838721 - RNA, 22 nt, Human
ucaguugcuaaacacugcgcuu

SEQ ID NO: 2838722 - RNA, 12 nt, Human
ucaguuccaaga

SEQ ID NO: 2838723 - RNA, 20 nt, Human
ucaguucagaaucacuucug

SEQ ID NO: 2838724 - RNA, 15 nt, Human
ucaguuacucuucag

SEQ ID NO: 2838725 - RNA, 18 nt, Human
ucaguuagagcugacaca

SEQ ID NO: 2838726 - RNA, 22 nt, Human
ucaguuagagcugacacaaacc

SEQ ID NO: 2838727 - RNA, 13 nt, Human
ucaguuauucauu

SEQ ID NO: 2838728 - RNA, 16 nt, Human
ucaguuauucauucug

SEQ ID NO: 2838729 - RNA, 15 nt, Human
ucaguuauuggugga

SEQ ID NO: 2838730 - RNA, 17 nt, Human
ucaguuauugguggaau

SEQ ID NO: 2838731 - RNA, 17 nt, Human
ucucuucagacucucag

SEQ ID NO: 2838732 - RNA, 19 nt, Human
ucucuucagacucucagcc

SEQ ID NO: 2838733 - RNA, 22 nt, Human
ucucuucagacucucagcccag

SEQ ID NO: 2838734 - RNA, 14 nt, Human
ucucuucauacuuu

SEQ ID NO: 2838735 - RNA, 17 nt, Human
ucucuucccugcgccug

SEQ ID NO: 2838736 - RNA, 12 nt, Human
ucucuucccuuu

SEQ ID NO: 2838737 - RNA, 19 nt, Human
ucucuucccuuuccccagc

SEQ ID NO: 2838738 - RNA, 23 nt, Human
ucucuucccuuuccccagcauca

SEQ ID NO: 2838739 - RNA, 18 nt, Human
ucucugcaccguacugug

SEQ ID NO: 2838740 - RNA, 11 nt, Human
ucucugcaccc

SEQ ID NO: 2838741 - RNA, 12 nt, Human
ucucugcagcug

SEQ ID NO: 2838742 - RNA, 13 nt, Human
ucucugcagcugc

SEQ ID NO: 2838743 - RNA, 14 nt, Human
ucucugcagcugcc

SEQ ID NO: 2838744 - RNA, 15 nt, Human
ucucugcagcugccg

SEQ ID NO: 2838745 - RNA, 16 nt, Human
ucucugcagcugccgg

SEQ ID NO: 2838746 - RNA, 13 nt, Human
ucucuucucccag

SEQ ID NO: 2838747 - RNA, 14 nt, Human
ucucuucucccaga

SEQ ID NO: 2838748 - RNA, 16 nt, Human
ucucuucucccagaau

SEQ ID NO: 2838749 - RNA, 21 nt, Human
ucucuucucccagaaucccag

SEQ ID NO: 2838750 - RNA, 11 nt, Human
ucucuucucca

SEQ ID NO: 2838751 - RNA, 11 nt, Human
ucucuuccugu

SEQ ID NO: 2838752 - RNA, 11 nt, Human
ucucuuccugc

SEQ ID NO: 2838753 - RNA, 13 nt, Human
ucucuuccugccc

SEQ ID NO: 2838754 - RNA, 14 nt, Human
ucucuuccugcccc

SEQ ID NO: 2838755 - RNA, 15 nt, Human
ucucuuccugccccu

SEQ ID NO: 2838756 - RNA, 16 nt, Human
ucucuuccugccccuc

SEQ ID NO: 2838757 - RNA, 18 nt, Human
ucucuuccugccccucuu

SEQ ID NO: 2838758 - RNA, 22 nt, Human
ucucuuccugccccucuuucuc

SEQ ID NO: 2838759 - RNA, 13 nt, Human
ucucuucuccacu

SEQ ID NO: 2838760 - RNA, 14 nt, Human
ucucuucuccacug

SEQ ID NO: 2838761 - RNA, 15 nt, Human
ucucuucuccacugg

SEQ ID NO: 2838762 - RNA, 16 nt, Human
ucucuucuccacugga

SEQ ID NO: 2838763 - RNA, 19 nt, Human
ucugaaaguuacccacuga

SEQ ID NO: 2838764 - RNA, 15 nt, Human
ucugaaaguuguaca

SEQ ID NO: 2838765 - RNA, 17 nt, Human
ucugaaaguuguacaug

SEQ ID NO: 2838766 - RNA, 21 nt, Human
ucugaaaguuguacaugaaau

SEQ ID NO: 2838767 - RNA, 22 nt, Human
ucugaaaauguuguuaugcuau

SEQ ID NO: 2838768 - RNA, 14 nt, Human
ucugaaaugugaua

SEQ ID NO: 2838769 - RNA, 18 nt, Human
ucugaaauaggaaacaag

SEQ ID NO: 2838770 - RNA, 17 nt, Human
ucugaaauaggaaacaa

SEQ ID NO: 2838771 - RNA, 20 nt, Human
ucugaaauaggaaacaagug

SEQ ID NO: 2838772 - RNA, 14 nt, Human
ucugaaaugaaaca

SEQ ID NO: 2838773 - RNA, 14 nt, Human
ucugaaaucuccuu

SEQ ID NO: 2838774 - RNA, 12 nt, Human
ucugaaauucua

SEQ ID NO: 2838775 - RNA, 14 nt, Human
ucugaaauucuaaa

SEQ ID NO: 2838776 - RNA, 21 nt, Human
ucugaaaugugauaaguucuu

SEQ ID NO: 2838777 - RNA, 14 nt, Human
ucugaacuggagcc

SEQ ID NO: 2838778 - RNA, 15 nt, Human
ucugaacuggagcca

SEQ ID NO: 2838779 - RNA, 16 nt, Human
ucucuuuucaaaacau

SEQ ID NO: 2838780 - RNA, 20 nt, Human
ucucuuuuauauuuguagga

SEQ ID NO: 2838781 - RNA, 19 nt, Human
ucucuuuuaucuguuuaaa

SEQ ID NO: 2838782 - RNA, 15 nt, Human
ucucuuuucaaaaca

SEQ ID NO: 2838783 - RNA, 17 nt, Human
ucucuuuguucuaaaga

SEQ ID NO: 2838784 - RNA, 16 nt, Human
ucucuuuguggggcuu

SEQ ID NO: 2838785 - RNA, 20 nt, Human
ucucuuuguggggcuuggcg

SEQ ID NO: 2838786 - RNA, 21 nt, Human
ucucuuuguggggcuuggcgu

SEQ ID NO: 2838787 - RNA, 13 nt, Human
ucucuuuuucagu

SEQ ID NO: 2838788 - RNA, 17 nt, Human
ucucuuuucucuuuuua

SEQ ID NO: 2838789 - RNA, 17 nt, Human
ucucuuuucuguacuuc

SEQ ID NO: 2838790 - RNA, 13 nt, Human
ucucuuuucucuu

SEQ ID NO: 2838791 - RNA, 21 nt, Human
ucucuuuuccuguuguauuga

SEQ ID NO: 2838792 - RNA, 11 nt, Human
ucucuuuucua

SEQ ID NO: 2838793 - RNA, 14 nt, Human
ucucuuuucuaguu

SEQ ID NO: 2838794 - RNA, 23 nt, Human
ucugaggacacuaaccacgcugg

SEQ ID NO: 2838795 - RNA, 20 nt, Human
ucugaggacacuaaccacgc

SEQ ID NO: 2838796 - RNA, 17 nt, Human
ucugaggaauccagacc

SEQ ID NO: 2838797 - RNA, 16 nt, Human
ucugaggaauccagac

SEQ ID NO: 2838798 - RNA, 15 nt, Human
ucugagcugagccag

SEQ ID NO: 2838799 - RNA, 16 nt, Human
ucugagcugagccagg

SEQ ID NO: 2838800 - RNA, 17 nt, Human
ucugagcugagccaggc

SEQ ID NO: 2838801 - RNA, 18 nt, Human
ucugagcugagccaggcu

SEQ ID NO: 2838802 - RNA, 15 nt, Human
ucugagccacagcag

SEQ ID NO: 2838803 - RNA, 19 nt, Human
ucugagccacagcagcauu

SEQ ID NO: 2838804 - RNA, 20 nt, Human
ucugagccacagcagcauuu

SEQ ID NO: 2838805 - RNA, 21 nt, Human
ucugagccacagcagcauuuu

SEQ ID NO: 2838806 - RNA, 22 nt, Human
ucugagcauuagauuucucauu

SEQ ID NO: 2838807 - RNA, 23 nt, Human
ucugauucccaagcucugcuccu

SEQ ID NO: 2838808 - RNA, 13 nt, Human
ucugauuggcuug

SEQ ID NO: 2838809 - RNA, 17 nt, Human
ucugauuggcuuguaga

SEQ ID NO: 2838810 - RNA, 21 nt, Human
ucugauuggcuuguagaauug

SEQ ID NO: 2838811 - RNA, 22 nt, Human
ucugauuggcuuguagaauugu

SEQ ID NO: 2838812 - RNA, 23 nt, Human
ucugauuggcuuguagaauuguu

SEQ ID NO: 2838813 - RNA, 16 nt, Human
ucugcaauuccccucu

SEQ ID NO: 2838814 - RNA, 23 nt, Human
ucugcaauucaaaaguuccaaga

SEQ ID NO: 2838815 - RNA, 18 nt, Human
ucugcaauuccccucugc

SEQ ID NO: 2838816 - RNA, 20 nt, Human
ucugcaauuccccucugcug

SEQ ID NO: 2838817 - RNA, 20 nt, Human
ucugcacaugucuuguacau

SEQ ID NO: 2838818 - RNA, 19 nt, Human
ucugcacaugucuuguaca

SEQ ID NO: 2838819 - RNA, 21 nt, Human
ucugcaauuccccucugcugc

SEQ ID NO: 2838820 - RNA, 22 nt, Human
ucugcaauuccccucugcugcu

SEQ ID NO: 2838821 - RNA, 21 nt, Human
ucugacccagugagauuacag

SEQ ID NO: 2838822 - RNA, 15 nt, Human
ucugagcacacuuua

SEQ ID NO: 2838823 - RNA, 12 nt, Human
ucugagcacaga

SEQ ID NO: 2838824 - RNA, 20 nt, Human
ucugagcauuagauuucuca

SEQ ID NO: 2838825 - RNA, 20 nt, Human
ucugaacuggagccaugggc

SEQ ID NO: 2838826 - RNA, 22 nt, Human
ucugacauuaugugguuuuaga

SEQ ID NO: 2838827 - RNA, 23 nt, Human
ucugacauuaugugguuuuagau

SEQ ID NO: 2838828 - RNA, 14 nt, Human
ucugacccagugag

SEQ ID NO: 2838829 - RNA, 15 nt, Human
ucugacccagugaga

SEQ ID NO: 2838830 - RNA, 13 nt, Human
ucucuagcacaau

SEQ ID NO: 2838831 - RNA, 19 nt, Human
ucuccuguaagccaaagaa

SEQ ID NO: 2838832 - RNA, 23 nt, Human
ucuccuguaagccaaagaaauga

SEQ ID NO: 2838833 - RNA, 15 nt, Human
ucucuaauucuauua

SEQ ID NO: 2838834 - RNA, 22 nt, Human
ucucuacuuuucccuguacuuu

SEQ ID NO: 2838835 - RNA, 21 nt, Human
ucucuacuccuaccucagccu

SEQ ID NO: 2838836 - RNA, 20 nt, Human
ucucuacuccuaccucagcc

SEQ ID NO: 2838837 - RNA, 19 nt, Human
ucucuacuccuaccucagc

SEQ ID NO: 2838838 - RNA, 19 nt, Human
ucucuaauuccauccauaa

SEQ ID NO: 2838839 - RNA, 13 nt, Human
ucucuaccagaua

SEQ ID NO: 2838840 - RNA, 14 nt, Human
ucucuacagugcca

SEQ ID NO: 2838841 - RNA, 14 nt, Human
ucucucuuaaaguu

SEQ ID NO: 2838842 - RNA, 16 nt, Human
ucucucuuaaaguugg

SEQ ID NO: 2838843 - RNA, 14 nt, Human
ucucucuucugcuc

SEQ ID NO: 2838844 - RNA, 11 nt, Human
ucucucuucug

SEQ ID NO: 2838845 - RNA, 20 nt, Human
ucucucuucugcuccacccu

SEQ ID NO: 2838846 - RNA, 19 nt, Human
ucucucuucugcuccaccc

SEQ ID NO: 2838847 - RNA, 17 nt, Human
ucucucuucugcuccac

SEQ ID NO: 2838848 - RNA, 16 nt, Human
ucucucuucugcucca

SEQ ID NO: 2838849 - RNA, 14 nt, Human
ucucucuucugccu

SEQ ID NO: 2838850 - RNA, 15 nt, Human
ucucugaacacaggc

SEQ ID NO: 2838851 - RNA, 16 nt, Human
ucucugaacacaggca

SEQ ID NO: 2838852 - RNA, 17 nt, Human
ucucugaacacaggcag

SEQ ID NO: 2838853 - RNA, 18 nt, Human
ucucugaacacaggcagc

SEQ ID NO: 2838854 - RNA, 19 nt, Human
ucucugaacacaggcagcu

SEQ ID NO: 2838855 - RNA, 20 nt, Human
ucucugaacacaggcagcuu

SEQ ID NO: 2838856 - RNA, 21 nt, Human
ucucugaacacaggcagcuuu

SEQ ID NO: 2838857 - RNA, 13 nt, Human
ucucugaggacac

SEQ ID NO: 2838858 - RNA, 20 nt, Human
ucucugauuuucaaagcuuu

SEQ ID NO: 2838859 - RNA, 19 nt, Human
ucucugauuuucaaagcuu

SEQ ID NO: 2838860 - RNA, 21 nt, Human
ucucucaaaagagaaaaacaa

SEQ ID NO: 2838861 - RNA, 13 nt, Human
ucucucaaaucug

SEQ ID NO: 2838862 - RNA, 14 nt, Human
ucucucaaauuguc

SEQ ID NO: 2838863 - RNA, 15 nt, Human
ucucucaaauuguca

SEQ ID NO: 2838864 - RNA, 17 nt, Human
ucucuauuuaauauuua

SEQ ID NO: 2838865 - RNA, 14 nt, Human
ucucuccuuugcug

SEQ ID NO: 2838866 - RNA, 11 nt, Human
ucucuccuuuu

SEQ ID NO: 2838867 - RNA, 12 nt, Human
ucucuccuuuuc

SEQ ID NO: 2838868 - RNA, 13 nt, Human
ucucuccuuuucu

SEQ ID NO: 2838869 - RNA, 17 nt, Human
ucucuccuuuucuuuug

SEQ ID NO: 2838870 - RNA, 23 nt, Human
ucucucggcuccccauguguccu

SEQ ID NO: 2838871 - RNA, 15 nt, Human
ucucucggcucccca

SEQ ID NO: 2838872 - RNA, 20 nt, Human
ucucucggcuccccaugugu

SEQ ID NO: 2838873 - RNA, 14 nt, Human
ucucuauuuaauau

SEQ ID NO: 2838874 - RNA, 15 nt, Human
ucucuauuuaauauu

SEQ ID NO: 2838875 - RNA, 20 nt, Human
ucucucuacuccuaccucag

SEQ ID NO: 2838876 - RNA, 19 nt, Human
ucucucuacuccuaccuca

SEQ ID NO: 2838877 - RNA, 15 nt, Human
ucucucuacagugcc

SEQ ID NO: 2838878 - RNA, 16 nt, Human
ucucucuucagacucu

SEQ ID NO: 2838879 - RNA, 18 nt, Human
ucucucuucagacucuca

SEQ ID NO: 2838880 - RNA, 20 nt, Human
ucucucuucagacucucagc

SEQ ID NO: 2838881 - RNA, 14 nt, Human
ucucucuucccuca

SEQ ID NO: 2838882 - RNA, 17 nt, Human
ucucucugugcugugga

SEQ ID NO: 2838883 - RNA, 21 nt, Human
ucucucugugcuguggaagca

SEQ ID NO: 2838884 - RNA, 22 nt, Human
ucucucuacuccuaccucagcc

SEQ ID NO: 2838885 - RNA, 19 nt, Human
ucucagugccaacuguggc

SEQ ID NO: 2838886 - RNA, 20 nt, Human
ucucagugccaacuguggcu

SEQ ID NO: 2838887 - RNA, 21 nt, Human
ucucagugccaacuguggcug

SEQ ID NO: 2838888 - RNA, 23 nt, Human
ucucagugccaacuguggcuggu

SEQ ID NO: 2838889 - RNA, 14 nt, Human
ucucagucaugcau

SEQ ID NO: 2838890 - RNA, 19 nt, Human
ucucagggucucugcugcc

SEQ ID NO: 2838891 - RNA, 22 nt, Human
ucucagguagaagguugacaca

SEQ ID NO: 2838892 - RNA, 15 nt, Human
ucucaggucccugca

SEQ ID NO: 2838893 - RNA, 12 nt, Human
ucucaguguuuu

SEQ ID NO: 2838894 - RNA, 15 nt, Human
ucucaguguuuugga

SEQ ID NO: 2838895 - RNA, 19 nt, Human
ucucaguguuuuggacucc

SEQ ID NO: 2838896 - RNA, 23 nt, Human
ucucaguguuuuggacuccaucu

SEQ ID NO: 2838897 - RNA, 21 nt, Human
ucucaguuaaaaugugaggaa

SEQ ID NO: 2838898 - RNA, 20 nt, Human
ucucaguggcuucaucuguc

SEQ ID NO: 2838899 - RNA, 18 nt, Human
ucucaguguugagccuuu

SEQ ID NO: 2838900 - RNA, 22 nt, Human
ucucaguguugagccuuuuccc

SEQ ID NO: 2838901 - RNA, 14 nt, Human
ucucccccugggcu

SEQ ID NO: 2838902 - RNA, 13 nt, Human
ucucccccugggc

SEQ ID NO: 2838903 - RNA, 12 nt, Human
ucucccccuggg

SEQ ID NO: 2838904 - RNA, 17 nt, Human
ucuccccugcccugcug

SEQ ID NO: 2838905 - RNA, 15 nt, Human
ucuccccugcccugc

SEQ ID NO: 2838906 - RNA, 14 nt, Human
ucuccccugcccug

SEQ ID NO: 2838907 - RNA, 13 nt, Human
ucucccgcugcug

SEQ ID NO: 2838908 - RNA, 14 nt, Human
ucucccgcugcugc

SEQ ID NO: 2838909 - RNA, 20 nt, Human
ucucccggagguuggguggg

SEQ ID NO: 2838910 - RNA, 15 nt, Human
ucucccgcugcugcu

SEQ ID NO: 2838911 - RNA, 16 nt, Human
ucucccgcugcugcug

SEQ ID NO: 2838912 - RNA, 20 nt, Human
ucuccugccugugcugugac

SEQ ID NO: 2838913 - RNA, 12 nt, Human
ucuccugccuuu

SEQ ID NO: 2838914 - RNA, 13 nt, Human
ucuccugccuuug

SEQ ID NO: 2838915 - RNA, 15 nt, Human
ucuccugccuuugcc

SEQ ID NO: 2838916 - RNA, 16 nt, Human
ucuccugccuuugccu

SEQ ID NO: 2838917 - RNA, 17 nt, Human
ucuccugccuuugccuc

SEQ ID NO: 2838918 - RNA, 19 nt, Human
ucuccugccucagccuccc

SEQ ID NO: 2838919 - RNA, 13 nt, Human
ucuccugccugua

SEQ ID NO: 2838920 - RNA, 20 nt, Human
ucuccugccuguagcaguga

SEQ ID NO: 2838921 - RNA, 22 nt, Human
ucuccugccuguagcagugaga

SEQ ID NO: 2838922 - RNA, 22 nt, Human
ucuccugccucagccucccaaa

SEQ ID NO: 2838923 - RNA, 14 nt, Human
ucuccugacuuuua

SEQ ID NO: 2838924 - RNA, 17 nt, Human
ucuccugaagauacuua

SEQ ID NO: 2838925 - RNA, 18 nt, Human
ucucccucuaggcucugc

SEQ ID NO: 2838926 - RNA, 21 nt, Human
ucucccucuaggcucugccuu

SEQ ID NO: 2838927 - RNA, 22 nt, Human
ucucccucuaggcucugccuuc

SEQ ID NO: 2838928 - RNA, 15 nt, Human
ucuccugacagaagg

SEQ ID NO: 2838929 - RNA, 12 nt, Human
ucuccugccaca

SEQ ID NO: 2838930 - RNA, 19 nt, Human
ucuccugccacauuagaac

SEQ ID NO: 2838931 - RNA, 22 nt, Human
ucuccugccacauuagaacuuc

SEQ ID NO: 2838932 - RNA, 13 nt, Human
ucuccucuuuaaa

SEQ ID NO: 2838933 - RNA, 14 nt, Human
ucuccucuuuaaaa

SEQ ID NO: 2838934 - RNA, 17 nt, Human
ucuccucuuuaaaacaa

SEQ ID NO: 2838935 - RNA, 19 nt, Human
ucuccucuuuaaaacaaaa

SEQ ID NO: 2838936 - RNA, 20 nt, Human
ucuccucuuuaaaacaaaac

SEQ ID NO: 2838937 - RNA, 22 nt, Human
ucuccucuugccacugccucuu

SEQ ID NO: 2838938 - RNA, 24 nt, Human
uccuugcaccccucacucuggccu

SEQ ID NO: 2838939 - RNA, 21 nt, Human
uccuugcaccccucacucugg

SEQ ID NO: 2838940 - RNA, 22 nt, Human
uccuugcaccccucacucuggc

SEQ ID NO: 2838941 - RNA, 14 nt, Human
uccuugcaccccuc

SEQ ID NO: 2838942 - RNA, 15 nt, Human
uccuugcaccccuca

SEQ ID NO: 2838943 - RNA, 20 nt, Human
uccuugcaccccucacucug

SEQ ID NO: 2838944 - RNA, 22 nt, Human
uccuugaucuguauauacaaua

SEQ ID NO: 2838945 - RNA, 16 nt, Human
uccuugaucuguauau

SEQ ID NO: 2838946 - RNA, 14 nt, Human
uccuugaucauuuu

SEQ ID NO: 2838947 - RNA, 21 nt, Human
uccuugcaagguuaagcaagg

SEQ ID NO: 2838948 - RNA, 20 nt, Human
uccuucugugaaaguacauu

SEQ ID NO: 2838949 - RNA, 14 nt, Human
uccuggucugaaaa

SEQ ID NO: 2838950 - RNA, 15 nt, Human
uccuucaagccagca

SEQ ID NO: 2838951 - RNA, 20 nt, Human
uccuucuggcagauucaaau

SEQ ID NO: 2838952 - RNA, 21 nt, Human
uccuucuggcagauucaaauc

SEQ ID NO: 2838953 - RNA, 12 nt, Human
uccuucuggccu

SEQ ID NO: 2838954 - RNA, 13 nt, Human
uccuucuggccuu

SEQ ID NO: 2838955 - RNA, 20 nt, Human
uccuucuggccuuuccucuc

SEQ ID NO: 2838956 - RNA, 19 nt, Human
uccuucuguccuacucugu

SEQ ID NO: 2838957 - RNA, 12 nt, Human
uccuucuguccu

SEQ ID NO: 2838958 - RNA, 23 nt, Human
uccuucaaguuagcucaggaggc

SEQ ID NO: 2838959 - RNA, 15 nt, Human
uccuucaauuccaua

SEQ ID NO: 2838960 - RNA, 23 nt, Human
uccuucaauuccauauauccuuu

SEQ ID NO: 2838961 - RNA, 20 nt, Human
uccuucaaguuagcucagga

SEQ ID NO: 2838962 - RNA, 19 nt, Human
uccuucaaguuagcucagg

SEQ ID NO: 2838963 - RNA, 18 nt, Human
uccuucaaguuagcucag

SEQ ID NO: 2838964 - RNA, 15 nt, Human
uccuucaaaauccuu

SEQ ID NO: 2838965 - RNA, 19 nt, Human
uccuucaaaauccuuccaa

SEQ ID NO: 2838966 - RNA, 20 nt, Human
uccuucaaaauccuuccaaa

SEQ ID NO: 2838967 - RNA, 23 nt, Human
uccuucaagaacucugggcugcu

SEQ ID NO: 2838968 - RNA, 21 nt, Human
uccuucaagaacucugggcug

SEQ ID NO: 2838969 - RNA, 20 nt, Human
uccuucaagaacucugggcu

SEQ ID NO: 2838970 - RNA, 19 nt, Human
uccuucaagaacucugggc

SEQ ID NO: 2838971 - RNA, 20 nt, Human
uccuuauuugcuucauugua

SEQ ID NO: 2838972 - RNA, 16 nt, Human
uccuucaaagcaaaug

SEQ ID NO: 2838973 - RNA, 11 nt, Human
uccuuaaguau

SEQ ID NO: 2838974 - RNA, 21 nt, Human
uccuuaaguauaucauguaaa

SEQ ID NO: 2838975 - RNA, 17 nt, Human
uccuggcagcccagaga

SEQ ID NO: 2838976 - RNA, 16 nt, Human
uccuggcagcccagag

SEQ ID NO: 2838977 - RNA, 19 nt, Human
uccuggcagcccagagacu

SEQ ID NO: 2838978 - RNA, 20 nt, Human
uccuggccagauggcccgga

SEQ ID NO: 2838979 - RNA, 15 nt, Human
uccuggugucacccc

SEQ ID NO: 2838980 - RNA, 17 nt, Human
uccuggugucaccccag

SEQ ID NO: 2838981 - RNA, 18 nt, Human
uccuggugucaccccaga

SEQ ID NO: 2838982 - RNA, 19 nt, Human
uccuggugucaccccagag

SEQ ID NO: 2838983 - RNA, 20 nt, Human
uccuggugucaccccagagc

SEQ ID NO: 2838984 - RNA, 22 nt, Human
uccuggugucaccccagagcca

SEQ ID NO: 2838985 - RNA, 24 nt, Human
uccuggugucaccccagagccaca

SEQ ID NO: 2838986 - RNA, 16 nt, Human
uccuguagcucucccu

SEQ ID NO: 2838987 - RNA, 15 nt, Human
uccugguucccguuu

SEQ ID NO: 2838988 - RNA, 21 nt, Human
uccugguucccguuucuccac

SEQ ID NO: 2838989 - RNA, 23 nt, Human
uccugguucccguuucuccaccu

SEQ ID NO: 2838990 - RNA, 22 nt, Human
uccugguuucauaacuuccugu

SEQ ID NO: 2838991 - RNA, 23 nt, Human
uccugguuucauaacuuccugua

SEQ ID NO: 2838992 - RNA, 21 nt, Human
uccuguaguugcguggacucu

SEQ ID NO: 2838993 - RNA, 22 nt, Human
uccuguaguugcguggacucug

SEQ ID NO: 2838994 - RNA, 23 nt, Human
uccuguaguugcguggacucugc

SEQ ID NO: 2838995 - RNA, 15 nt, Human
uccuguaguuuuauu

SEQ ID NO: 2838996 - RNA, 17 nt, Human
uccuguaguuuuauuuu

SEQ ID NO: 2838997 - RNA, 21 nt, Human
uccuguaguuuuauuuuaugu

SEQ ID NO: 2838998 - RNA, 14 nt, Human
uccuguauaagcac

SEQ ID NO: 2838999 - RNA, 22 nt, Human
uccuguauaagcacugaaaaac

SEQ ID NO: 2839000 - RNA, 13 nt, Human
uccuguauguugu

SEQ ID NO: 2839001 - RNA, 19 nt, Human
uccuguaugaaagauugug

SEQ ID NO: 2839002 - RNA, 14 nt, Human
uccuguaugucugu

SEQ ID NO: 2839003 - RNA, 15 nt, Human
uccuguaugucuguc

SEQ ID NO: 2839004 - RNA, 16 nt, Human
uccuguaugucuguca

SEQ ID NO: 2839005 - RNA, 17 nt, Human
ucgauucauauugaaua

SEQ ID NO: 2839006 - RNA, 18 nt, Human
ucgaguucggcucugggu

SEQ ID NO: 2839007 - RNA, 21 nt, Human
ucgauacccaggaccaagcca

SEQ ID NO: 2839008 - RNA, 14 nt, Human
uccuuuuucugauu

SEQ ID NO: 2839009 - RNA, 15 nt, Human
uccuuuuucugauua

SEQ ID NO: 2839010 - RNA, 20 nt, Human
uccuuuuucugauuagcuuu

SEQ ID NO: 2839011 - RNA, 22 nt, Human
uccuuuuucugauuagcuuugu

SEQ ID NO: 2839012 - RNA, 23 nt, Human
uccuuuuucugauuagcuuugug

SEQ ID NO: 2839013 - RNA, 15 nt, Human
ucgaaaauucauuuc

SEQ ID NO: 2839014 - RNA, 19 nt, Human
ucgaaaauucauuucacau

SEQ ID NO: 2839015 - RNA, 21 nt, Human
ucgaaaauucauuucacauua

SEQ ID NO: 2839016 - RNA, 24 nt, Human
ucgaaaauucauuucacauuaaug

SEQ ID NO: 2839017 - RNA, 21 nt, Human
uccuuuuuuuccaucuuuaca

SEQ ID NO: 2839018 - RNA, 12 nt, Human
uccuuuuuauga

SEQ ID NO: 2839019 - RNA, 21 nt, Human
uccuuuuuaugaggcaaccug

SEQ ID NO: 2839020 - RNA, 14 nt, Human
uccuuuugaccuuc

SEQ ID NO: 2839021 - RNA, 18 nt, Human
uccuuuugaccuucauuu

SEQ ID NO: 2839022 - RNA, 20 nt, Human
uccuuuugaccuucauuuca

SEQ ID NO: 2839023 - RNA, 23 nt, Human
uccuuuugaccuucauuucaugu

SEQ ID NO: 2839024 - RNA, 14 nt, Human
uccuuuuggaguca

SEQ ID NO: 2839025 - RNA, 23 nt, Human
uccuuuuggagucagacagaugu

SEQ ID NO: 2839026 - RNA, 15 nt, Human
uccuuuugguguguu

SEQ ID NO: 2839027 - RNA, 12 nt, Human
uccuuuuguaaa

SEQ ID NO: 2839028 - RNA, 13 nt, Human
uccuuuuguaaag

SEQ ID NO: 2839029 - RNA, 14 nt, Human
uccuuuuguaaagu

SEQ ID NO: 2839030 - RNA, 15 nt, Human
uccuuuuguaaagug

SEQ ID NO: 2839031 - RNA, 20 nt, Human
uccuuuuguaaagugaagaa

SEQ ID NO: 2839032 - RNA, 21 nt, Human
uccuuuuguaaagugaagaau

SEQ ID NO: 2839033 - RNA, 11 nt, Human
uccuuuuguag

SEQ ID NO: 2839034 - RNA, 12 nt, Human
uccuuuuguaga

SEQ ID NO: 2839035 - RNA, 17 nt, Human
uccuuuuguagaaugaa

SEQ ID NO: 2839036 - RNA, 14 nt, Human
uccuuuugucuucu

SEQ ID NO: 2839037 - RNA, 22 nt, Human
uccuuuugucuucucugucuca

SEQ ID NO: 2839038 - RNA, 23 nt, Human
uccuugcacgcgcccuuucuacc

SEQ ID NO: 2839039 - RNA, 10 nt, Human
uccuuggccu

SEQ ID NO: 2839040 - RNA, 13 nt, Human
uccuuggccuagc

SEQ ID NO: 2839041 - RNA, 22 nt, Human
uccuuggccuagcccacccugc

SEQ ID NO: 2839042 - RNA, 23 nt, Human
uccuuggccuagcccacccugcu

SEQ ID NO: 2839043 - RNA, 22 nt, Human
uccuugcaucaaggggucacuu

SEQ ID NO: 2839044 - RNA, 23 nt, Human
uccuugcaucaaggggucacuua

SEQ ID NO: 2839045 - RNA, 15 nt, Human
uccuuggcuggugca

SEQ ID NO: 2839046 - RNA, 20 nt, Human
uccuuggcuuaccugaccuc

SEQ ID NO: 2839047 - RNA, 15 nt, Human
ucgcaccccccuguu

SEQ ID NO: 2839048 - RNA, 17 nt, Human
ucgcaccccccuguucu

SEQ ID NO: 2839049 - RNA, 19 nt, Human
ucgcaccccccuguucuaa

SEQ ID NO: 2839050 - RNA, 22 nt, Human
ucgcaccccccuguucuaaggg

SEQ ID NO: 2839051 - RNA, 12 nt, Human
ucgcaccuacca

SEQ ID NO: 2839052 - RNA, 18 nt, Human
ucgcaccuaccaucaggg

SEQ ID NO: 2839053 - RNA, 17 nt, Human
ucgcaauguaagacucg

SEQ ID NO: 2839054 - RNA, 19 nt, Human
ucgcccaggcuggagugca

SEQ ID NO: 2839055 - RNA, 12 nt, Human
ucgcccaggaga

SEQ ID NO: 2839056 - RNA, 11 nt, Human
ucgcccaggag

SEQ ID NO: 2839057 - RNA, 14 nt, Human
ucgcccaggcugga

SEQ ID NO: 2839058 - RNA, 12 nt, Human
ucgcccaggcug

SEQ ID NO: 2839059 - RNA, 22 nt, Human
ucgcuucuguguaucucuuuca

SEQ ID NO: 2839060 - RNA, 19 nt, Human
ucgcuucccccauagccac

SEQ ID NO: 2839061 - RNA, 17 nt, Human
ucgcuucccccauagcc

SEQ ID NO: 2839062 - RNA, 16 nt, Human
ucgcuucccccauagc

SEQ ID NO: 2839063 - RNA, 15 nt, Human
ucgcuucccccauag

SEQ ID NO: 2839064 - RNA, 14 nt, Human
ucgcuucccccaua

SEQ ID NO: 2839065 - RNA, 21 nt, Human
ucgcuguuaccgccugucucu

SEQ ID NO: 2839066 - RNA, 19 nt, Human
ucggaacccaagcuuagaa

SEQ ID NO: 2839067 - RNA, 20 nt, Human
ucggaacccaagcuuagaac

SEQ ID NO: 2839068 - RNA, 16 nt, Human
ucggaaccgcucaccu

SEQ ID NO: 2839069 - RNA, 17 nt, Human
ucggaaccgcucaccua

SEQ ID NO: 2839070 - RNA, 19 nt, Human
ucggaaccgcucaccuaga

SEQ ID NO: 2839071 - RNA, 20 nt, Human
ucggaaccgcucaccuagag

SEQ ID NO: 2839072 - RNA, 22 nt, Human
ucggaaccgcucaccuagagcc

SEQ ID NO: 2839073 - RNA, 14 nt, Human
ucggaacagcagau

SEQ ID NO: 2839074 - RNA, 19 nt, Human
ucggaaggcuggcugggca

SEQ ID NO: 2839075 - RNA, 23 nt, Human
ucggaccgcuuguggggacccag

SEQ ID NO: 2839076 - RNA, 19 nt, Human
ucggacuaagccuaccugc

SEQ ID NO: 2839077 - RNA, 22 nt, Human
ucggacuaagccuaccugcucu

SEQ ID NO: 2839078 - RNA, 23 nt, Human
ucggacuaagccuaccugcucuc

SEQ ID NO: 2839079 - RNA, 21 nt, Human
ucgaaaagagucuuccaauua

SEQ ID NO: 2839080 - RNA, 12 nt, Human
ucuaaccuugaa

SEQ ID NO: 2839081 - RNA, 17 nt, Human
ucuaaccuugaaugcug

SEQ ID NO: 2839082 - RNA, 18 nt, Human
ucuaaccuugaaugcugc

SEQ ID NO: 2839083 - RNA, 19 nt, Human
ucuaaccuugaaugcugcc

SEQ ID NO: 2839084 - RNA, 20 nt, Human
ucuaaccuugaaugcugcca

SEQ ID NO: 2839085 - RNA, 21 nt, Human
ucuaaccuugaaugcugccag

SEQ ID NO: 2839086 - RNA, 22 nt, Human
ucuaaccuugaaugcugccagu

SEQ ID NO: 2839087 - RNA, 15 nt, Human
ucuaaccugauggca

SEQ ID NO: 2839088 - RNA, 19 nt, Human
ucuaacuagaaaucugcca

SEQ ID NO: 2839089 - RNA, 14 nt, Human
ucuaacucagaauu

SEQ ID NO: 2839090 - RNA, 16 nt, Human
ucuaacucagaauuau

SEQ ID NO: 2839091 - RNA, 18 nt, Human
ucuaacucagaauuauuu

SEQ ID NO: 2839092 - RNA, 17 nt, Human
ucuaacggucuguucug

SEQ ID NO: 2839093 - RNA, 22 nt, Human
ucuaacggucuguucuguuuca

SEQ ID NO: 2839094 - RNA, 23 nt, Human
ucuaaauuugaauguuaagcaga

SEQ ID NO: 2839095 - RNA, 22 nt, Human
ucuaaauuugaauguuaagcag

SEQ ID NO: 2839096 - RNA, 19 nt, Human
ucuaacaaaaaaauauauu

SEQ ID NO: 2839097 - RNA, 19 nt, Human
ucuaacccuauacuguagu

SEQ ID NO: 2839098 - RNA, 17 nt, Human
ucuaaauuugaauguua

SEQ ID NO: 2839099 - RNA, 13 nt, Human
ucuaaauuugaau

SEQ ID NO: 2839100 - RNA, 18 nt, Human
ucuaaauuaaagccuuua

SEQ ID NO: 2839101 - RNA, 20 nt, Human
ucuaaauuaaagccuuuagu

SEQ ID NO: 2839102 - RNA, 17 nt, Human
ucuaaauucuuuauuuc

SEQ ID NO: 2839103 - RNA, 20 nt, Human
ucuaaauucuuuauuucugu

SEQ ID NO: 2839104 - RNA, 13 nt, Human
ucuaaaugaagug

SEQ ID NO: 2839105 - RNA, 21 nt, Human
ucuaacuuaagaaauaaauca

SEQ ID NO: 2839106 - RNA, 16 nt, Human
ucuacacugcaaucau

SEQ ID NO: 2839107 - RNA, 19 nt, Human
ucuacacugcaaucauaug

SEQ ID NO: 2839108 - RNA, 20 nt, Human
ucuacacugcaaucauaugu

SEQ ID NO: 2839109 - RNA, 21 nt, Human
ucuacacugggugcugauccu

SEQ ID NO: 2839110 - RNA, 16 nt, Human
ucuagaaguuguuugu

SEQ ID NO: 2839111 - RNA, 20 nt, Human
ucuagaaguuguuugucauc

SEQ ID NO: 2839112 - RNA, 18 nt, Human
ucuagaaguuucccuucc

SEQ ID NO: 2839113 - RNA, 20 nt, Human
ucuagaaguuucccuuccuc

SEQ ID NO: 2839114 - RNA, 17 nt, Human
ucuagaauuauaaguca

SEQ ID NO: 2839115 - RNA, 23 nt, Human
ucuagaauuauaagucacaaaga

SEQ ID NO: 2839116 - RNA, 22 nt, Human
ucuagaaucugcaauucaaaag

SEQ ID NO: 2839117 - RNA, 23 nt, Human
ucuagaaucugcaauucaaaagu

SEQ ID NO: 2839118 - RNA, 19 nt, Human
ucuagaauuuaucacacuu

SEQ ID NO: 2839119 - RNA, 17 nt, Human
ucuagaacacaggcaaa

SEQ ID NO: 2839120 - RNA, 18 nt, Human
ucuagaacuugacccccu

SEQ ID NO: 2839121 - RNA, 16 nt, Human
ucuaguacacuuuuau

SEQ ID NO: 2839122 - RNA, 13 nt, Human
ucuagggcuggga

SEQ ID NO: 2839123 - RNA, 19 nt, Human
ucuagggcugggaaacacu

SEQ ID NO: 2839124 - RNA, 17 nt, Human
ucuaggguugcuggagc

SEQ ID NO: 2839125 - RNA, 20 nt, Human
ucuagguuucaaagaugcug

SEQ ID NO: 2839126 - RNA, 15 nt, Human
ucuagguuucaaaga

SEQ ID NO: 2839127 - RNA, 17 nt, Human
ucuagguuucaaagaug

SEQ ID NO: 2839128 - RNA, 19 nt, Human
ucuagguuucaaagaugcu

SEQ ID NO: 2839129 - RNA, 14 nt, Human
ucucaaacuccuga

SEQ ID NO: 2839130 - RNA, 17 nt, Human
ucucaaacuaaaagaca

SEQ ID NO: 2839131 - RNA, 19 nt, Human
ucucaaacuaaaagacauu

SEQ ID NO: 2839132 - RNA, 15 nt, Human
ucuaguaguuaaaaa

SEQ ID NO: 2839133 - RNA, 21 nt, Human
ucucaaaacuggacagucacu

SEQ ID NO: 2839134 - RNA, 13 nt, Human
ucucaaaagaacu

SEQ ID NO: 2839135 - RNA, 14 nt, Human
ucucaaaagaacuu

SEQ ID NO: 2839136 - RNA, 18 nt, Human
ucucaaaagaacuuaccc

SEQ ID NO: 2839137 - RNA, 19 nt, Human
ucucaaaagaacuuacccc

SEQ ID NO: 2839138 - RNA, 13 nt, Human
ucucaaaagcauu

SEQ ID NO: 2839139 - RNA, 14 nt, Human
ucucaaaagcauuu

SEQ ID NO: 2839140 - RNA, 18 nt, Human
ucucaaaagcauuuauca

SEQ ID NO: 2839141 - RNA, 21 nt, Human
ucucaaaagcauuuaucauuc

SEQ ID NO: 2839142 - RNA, 23 nt, Human
ucucaaaagcauuuaucauucuu

SEQ ID NO: 2839143 - RNA, 20 nt, Human
ucucaaacaaggggcuguua

SEQ ID NO: 2839144 - RNA, 21 nt, Human
ucucaaacucuugaccucagg

SEQ ID NO: 2839145 - RNA, 13 nt, Human
ucucaaacucuug

SEQ ID NO: 2839146 - RNA, 22 nt, Human
ucucaaacucuugaccucaggu

SEQ ID NO: 2839147 - RNA, 17 nt, Human
ucuaguacuugaaaaag

SEQ ID NO: 2839148 - RNA, 23 nt, Human
ucucaaacucccgaccucaggug

SEQ ID NO: 2839149 - RNA, 21 nt, Human
ucucaaauuuggauugcuaau

SEQ ID NO: 2839150 - RNA, 21 nt, Human
ucucaacaaagcacaguguua

SEQ ID NO: 2839151 - RNA, 19 nt, Human
ucucaacaaagcacagugu

SEQ ID NO: 2839152 - RNA, 17 nt, Human
ucucacucugucgccca

SEQ ID NO: 2839153 - RNA, 16 nt, Human
ucucacucugucgccc

SEQ ID NO: 2839154 - RNA, 22 nt, Human
ucucacucugucgcccagucug

SEQ ID NO: 2839155 - RNA, 18 nt, Human
ucucacucugucgcccag

SEQ ID NO: 2839156 - RNA, 21 nt, Human
ucucacuguugcccaggcugg

SEQ ID NO: 2839157 - RNA, 20 nt, Human
ucucacuguugcccaggcug

SEQ ID NO: 2839158 - RNA, 19 nt, Human
ucucacuguugcccaggcu

SEQ ID NO: 2839159 - RNA, 18 nt, Human
ucucacuguugcccaggc

SEQ ID NO: 2839160 - RNA, 17 nt, Human
ucucaggggccagagga

SEQ ID NO: 2839161 - RNA, 20 nt, Human
ucucaggggccagaggaacu

SEQ ID NO: 2839162 - RNA, 15 nt, Human
ucucagggucucugc

SEQ ID NO: 2839163 - RNA, 16 nt, Human
ucucagggucucugcu

SEQ ID NO: 2839164 - RNA, 17 nt, Human
ucucagggucucugcug

SEQ ID NO: 2839165 - RNA, 18 nt, Human
ucucagggucucugcugc

SEQ ID NO: 2839166 - RNA, 20 nt, Human
ucucagggucucugcugccg

SEQ ID NO: 2839167 - RNA, 17 nt, Human
ucucacuguugcccagg

SEQ ID NO: 2839168 - RNA, 13 nt, Human
ucucacuugugcc

SEQ ID NO: 2839169 - RNA, 19 nt, Human
ugaacacaaacuguaaaua

SEQ ID NO: 2839170 - RNA, 22 nt, Human
ugaacacgaaagaaauguaccu

SEQ ID NO: 2839171 - RNA, 13 nt, Human
ugaacacaggcag

SEQ ID NO: 2839172 - RNA, 14 nt, Human
ugaacacaggcagc

SEQ ID NO: 2839173 - RNA, 15 nt, Human
ugaacacaggcagcu

SEQ ID NO: 2839174 - RNA, 16 nt, Human
ugaacacaggcagcuu

SEQ ID NO: 2839175 - RNA, 17 nt, Human
ugaacacaggcagcuuu

SEQ ID NO: 2839176 - RNA, 20 nt, Human
ugaacacaggcagcuuucua

SEQ ID NO: 2839177 - RNA, 23 nt, Human
ugaacacaggcagcuuucuagaa

SEQ ID NO: 2839178 - RNA, 20 nt, Human
ugaaaugcaucagguccuuu

SEQ ID NO: 2839179 - RNA, 16 nt, Human
ugaaaugcucuccuuu

SEQ ID NO: 2839180 - RNA, 17 nt, Human
ugaaaugcucuccuuuc

SEQ ID NO: 2839181 - RNA, 16 nt, Human
ugaaaugcuggcauuu

SEQ ID NO: 2839182 - RNA, 13 nt, Human
ugaacacuuauaa

SEQ ID NO: 2839183 - RNA, 20 nt, Human
ugaacagaaaacauucugau

SEQ ID NO: 2839184 - RNA, 15 nt, Human
ugaacacuuggugcu

SEQ ID NO: 2839185 - RNA, 16 nt, Human
ugaacacuuggugcug

SEQ ID NO: 2839186 - RNA, 18 nt, Human
ugaacacuuggugcuggg

SEQ ID NO: 2839187 - RNA, 19 nt, Human
ugaacacuuggugcuggga

SEQ ID NO: 2839188 - RNA, 11 nt, Human
ugaacauucca

SEQ ID NO: 2839189 - RNA, 12 nt, Human
ugaacauuccaa

SEQ ID NO: 2839190 - RNA, 17 nt, Human
ugaacauccccucccau

SEQ ID NO: 2839191 - RNA, 19 nt, Human
ugaaccacaucuugcucug

SEQ ID NO: 2839192 - RNA, 19 nt, Human
ugaacugaacucugacaac

SEQ ID NO: 2839193 - RNA, 17 nt, Human
ugaacugaacucugaca

SEQ ID NO: 2839194 - RNA, 22 nt, Human
ugaaccacaucuugcucugcug

SEQ ID NO: 2839195 - RNA, 21 nt, Human
ugaaccacaucuugcucugcu

SEQ ID NO: 2839196 - RNA, 20 nt, Human
ugaaccacaucuugcucugc

SEQ ID NO: 2839197 - RNA, 12 nt, Human
ugaacucuuaga

SEQ ID NO: 2839198 - RNA, 19 nt, Human
ugaacucuuagaaaugaag

SEQ ID NO: 2839199 - RNA, 14 nt, Human
ugaacugaacucug

SEQ ID NO: 2839200 - RNA, 19 nt, Human
ugaacucuucugcaaaaau

SEQ ID NO: 2839201 - RNA, 18 nt, Human
ugaacugaaauuaaaacu

SEQ ID NO: 2839202 - RNA, 19 nt, Human
ugaacuggguacuugugga

SEQ ID NO: 2839203 - RNA, 17 nt, Human
ugaacuggcaauugucu

SEQ ID NO: 2839204 - RNA, 21 nt, Human
ugaacuggcaauugucuauuu

SEQ ID NO: 2839205 - RNA, 13 nt, Human
ugaagaggaaggg

SEQ ID NO: 2839206 - RNA, 23 nt, Human
ugaagagaaccgagcaaagauca

SEQ ID NO: 2839207 - RNA, 13 nt, Human
ugaagacuugccc

SEQ ID NO: 2839208 - RNA, 17 nt, Human
ugaagacuggaagcuaa

SEQ ID NO: 2839209 - RNA, 18 nt, Human
ugaagacuggaagcuaau

SEQ ID NO: 2839210 - RNA, 14 nt, Human
ugaagacaggacag

SEQ ID NO: 2839211 - RNA, 14 nt, Human
ugaagacaggaugg

SEQ ID NO: 2839212 - RNA, 17 nt, Human
ugaaggcaaaauugcaa

SEQ ID NO: 2839213 - RNA, 16 nt, Human
ugaaggcaaaauugca

SEQ ID NO: 2839214 - RNA, 18 nt, Human
ugaaggaggugagagaag

SEQ ID NO: 2839215 - RNA, 14 nt, Human
ugaaggcaaaauug

SEQ ID NO: 2839216 - RNA, 20 nt, Human
ugaacugaaggcagcaugua

SEQ ID NO: 2839217 - RNA, 20 nt, Human
ugaaggagagcccuucauuu

SEQ ID NO: 2839218 - RNA, 22 nt, Human
ugaaggagaggcaacauccaaa

SEQ ID NO: 2839219 - RNA, 16 nt, Human
ugaagaugggaacgca

SEQ ID NO: 2839220 - RNA, 12 nt, Human
ugaagaugaaca

SEQ ID NO: 2839221 - RNA, 15 nt, Human
ugaagaugcagcuca

SEQ ID NO: 2839222 - RNA, 19 nt, Human
ugaagaugcauuguaguuu

SEQ ID NO: 2839223 - RNA, 23 nt, Human
ugaagauauaacuauugcccagg

SEQ ID NO: 2839224 - RNA, 17 nt, Human
ugaagagggagaaggga

SEQ ID NO: 2839225 - RNA, 21 nt, Human
ugaaagauucagguauguugc

SEQ ID NO: 2839226 - RNA, 14 nt, Human
ugaaagauuguggg

SEQ ID NO: 2839227 - RNA, 22 nt, Human
ugaaagauugugggggaaaaau

SEQ ID NO: 2839228 - RNA, 12 nt, Human
ugaaagcaaaaa

SEQ ID NO: 2839229 - RNA, 15 nt, Human
ugaaagcaaaaaugc

SEQ ID NO: 2839230 - RNA, 16 nt, Human
ugaaagcaaaaaugcu

SEQ ID NO: 2839231 - RNA, 17 nt, Human
ugaaagcaaaaaugcua

SEQ ID NO: 2839232 - RNA, 19 nt, Human
ugaaagcaaaaaugcuaau

SEQ ID NO: 2839233 - RNA, 20 nt, Human
ugaaagcaaaaaugcuaaua

SEQ ID NO: 2839234 - RNA, 11 nt, Human
ugaaagcacag

SEQ ID NO: 2839235 - RNA, 21 nt, Human
ugaaagcacaggagacacugu

SEQ ID NO: 2839236 - RNA, 19 nt, Human
ugaaagcagggaauuucua

SEQ ID NO: 2839237 - RNA, 20 nt, Human
ugaaagcagggaauuucuau

SEQ ID NO: 2839238 - RNA, 22 nt, Human
ugaaagcagggaauuucuaucu

SEQ ID NO: 2839239 - RNA, 18 nt, Human
ugaaaggaagcuccacug

SEQ ID NO: 2839240 - RNA, 13 nt, Human
ugaaaggaaagug

SEQ ID NO: 2839241 - RNA, 14 nt, Human
ugaaaggaaagugc

SEQ ID NO: 2839242 - RNA, 12 nt, Human
ugaaagauuaaa

SEQ ID NO: 2839243 - RNA, 13 nt, Human
ugaaagauuaaac

SEQ ID NO: 2839244 - RNA, 15 nt, Human
ugaaagauuaaacag

SEQ ID NO: 2839245 - RNA, 12 nt, Human
ugaaaagaugua

SEQ ID NO: 2839246 - RNA, 16 nt, Human
ugaaaccuacacacug

SEQ ID NO: 2839247 - RNA, 20 nt, Human
ugaaaccuacacacugucau

SEQ ID NO: 2839248 - RNA, 22 nt, Human
ugaaagauggcugugccucugc

SEQ ID NO: 2839249 - RNA, 23 nt, Human
ugaaagauggcugugccucugcc

SEQ ID NO: 2839250 - RNA, 21 nt, Human
ugaaagauggcugugccucug

SEQ ID NO: 2839251 - RNA, 21 nt, Human
ugaaaccuuuuuuaagauuuu

SEQ ID NO: 2839252 - RNA, 23 nt, Human
ugaaaccuuuuuuaagauuuuuc

SEQ ID NO: 2839253 - RNA, 19 nt, Human
ugaaagauggcugugccuc

SEQ ID NO: 2839254 - RNA, 19 nt, Human
ugaaaccuaguacugcccc

SEQ ID NO: 2839255 - RNA, 13 nt, Human
ugaaaccuguaua

SEQ ID NO: 2839256 - RNA, 22 nt, Human
ugaaaccuguauaacccuguua

SEQ ID NO: 2839257 - RNA, 18 nt, Human
ugaaaccuaguacugccc

SEQ ID NO: 2839258 - RNA, 18 nt, Human
ugaaaagagagcagagaa

SEQ ID NO: 2839259 - RNA, 19 nt, Human
ugaaaagagagcagagaau

SEQ ID NO: 2839260 - RNA, 19 nt, Human
ugaaaccuuuuuccuagua

SEQ ID NO: 2839261 - RNA, 16 nt, Human
ugaaaccuuuuuuaag

SEQ ID NO: 2839262 - RNA, 17 nt, Human
ugaaaccuuuuuuaaga

SEQ ID NO: 2839263 - RNA, 18 nt, Human
ugaaaccuuuuuuaagau

SEQ ID NO: 2839264 - RNA, 19 nt, Human
ugaaaccuuuuuuaagauu

SEQ ID NO: 2839265 - RNA, 20 nt, Human
ugaaaccuuuuuuaagauuu

SEQ ID NO: 2839266 - RNA, 22 nt, Human
ugaaaugaggucagagccugca

SEQ ID NO: 2839267 - RNA, 21 nt, Human
ugaaaugaggucagagccugc

SEQ ID NO: 2839268 - RNA, 23 nt, Human
ugaaaugaggucagagccugcag

SEQ ID NO: 2839269 - RNA, 19 nt, Human
ugaaaugcagagucaauga

SEQ ID NO: 2839270 - RNA, 17 nt, Human
ugaaaugaggucuguuu

SEQ ID NO: 2839271 - RNA, 18 nt, Human
ugaaaugaggucuguuua

SEQ ID NO: 2839272 - RNA, 19 nt, Human
ugaaaugaggucuguuuaa

SEQ ID NO: 2839273 - RNA, 23 nt, Human
ugaaaugaggucuguuuaaagug

SEQ ID NO: 2839274 - RNA, 14 nt, Human
ugaaaugauagauu

SEQ ID NO: 2839275 - RNA, 17 nt, Human
ugaaaugauagauuuga

SEQ ID NO: 2839276 - RNA, 21 nt, Human
ugaaaugauagauuugaccuc

SEQ ID NO: 2839277 - RNA, 22 nt, Human
ugaaaugauagauuugaccucc

SEQ ID NO: 2839278 - RNA, 20 nt, Human
ugaaaugaggucagagccug

SEQ ID NO: 2839279 - RNA, 19 nt, Human
ugaaaugaggucagagccu

SEQ ID NO: 2839280 - RNA, 21 nt, Human
ugaaaugaaacaaauaaucac

SEQ ID NO: 2839281 - RNA, 13 nt, Human
ugaaaugaaauuu

SEQ ID NO: 2839282 - RNA, 14 nt, Human
ugaaaugaaauuua

SEQ ID NO: 2839283 - RNA, 15 nt, Human
ugaaaugaaauuuaa

SEQ ID NO: 2839284 - RNA, 16 nt, Human
ugaaaugaaauuuaaa

SEQ ID NO: 2839285 - RNA, 17 nt, Human
ugaaaugaaauuuaaac

SEQ ID NO: 2839286 - RNA, 23 nt, Human
ugaaaugaaauuuaaacauuaaa

SEQ ID NO: 2839287 - RNA, 17 nt, Human
ugaaaugaccucugucc

SEQ ID NO: 2839288 - RNA, 17 nt, Human
ugaaaugagcaccucca

SEQ ID NO: 2839289 - RNA, 21 nt, Human
ugaaaugagcaccuccauuaa

SEQ ID NO: 2839290 - RNA, 18 nt, Human
ugaaagggcccagagagg

SEQ ID NO: 2839291 - RNA, 17 nt, Human
ugaaagggcccagagag

SEQ ID NO: 2839292 - RNA, 16 nt, Human
ugaaagggcccagaga

SEQ ID NO: 2839293 - RNA, 15 nt, Human
ugaaagggcccagag

SEQ ID NO: 2839294 - RNA, 19 nt, Human
ugaaaucuuacagcugggu

SEQ ID NO: 2839295 - RNA, 15 nt, Human
ugaaaucugucaaga

SEQ ID NO: 2839296 - RNA, 21 nt, Human
ugaaaucugucaagaguaguu

SEQ ID NO: 2839297 - RNA, 14 nt, Human
ugaaaggagcccuu

SEQ ID NO: 2839298 - RNA, 14 nt, Human
ugaaauccugcuuc

SEQ ID NO: 2839299 - RNA, 17 nt, Human
ugaaauccuugacugga

SEQ ID NO: 2839300 - RNA, 18 nt, Human
ugaaauccuugacuggac

SEQ ID NO: 2839301 - RNA, 20 nt, Human
ugaaauccuugacuggaccu

SEQ ID NO: 2839302 - RNA, 19 nt, Human
ugaaaacucauuacuuuuc

SEQ ID NO: 2839303 - RNA, 12 nt, Human
ugaaaacuggaa

SEQ ID NO: 2839304 - RNA, 13 nt, Human
ugaaaacuggaau

SEQ ID NO: 2839305 - RNA, 14 nt, Human
ugaaaacuggaaua

SEQ ID NO: 2839306 - RNA, 21 nt, Human
ugaaaacuggaauaagaagca

SEQ ID NO: 2839307 - RNA, 23 nt, Human
ugaaaacuggaauaagaagcaaa

SEQ ID NO: 2839308 - RNA, 17 nt, Human
ugaaaacuuuucucaga

SEQ ID NO: 2839309 - RNA, 13 nt, Human
ugaaaagaaauaa

SEQ ID NO: 2839310 - RNA, 14 nt, Human
ugaaaagaaauaau

SEQ ID NO: 2839311 - RNA, 16 nt, Human
ugaaaagaaauaauaa

SEQ ID NO: 2839312 - RNA, 16 nt, Human
ugaaaagacaagaaaa

SEQ ID NO: 2839313 - RNA, 19 nt, Human
ugaaaagacaagaaaauca

SEQ ID NO: 2839314 - RNA, 14 nt, Human
ucuuuuuaugcauu

SEQ ID NO: 2839315 - RNA, 19 nt, Human
ucuuuuguaauaaacuauu

SEQ ID NO: 2839316 - RNA, 13 nt, Human
ucuuuuuauugaa

SEQ ID NO: 2839317 - RNA, 14 nt, Human
ucuuuuuauugaau

SEQ ID NO: 2839318 - RNA, 15 nt, Human
ucuuuuuauugaauc

SEQ ID NO: 2839319 - RNA, 12 nt, Human
ucuuuuucaguu

SEQ ID NO: 2839320 - RNA, 11 nt, Human
ucuuuuucuga

SEQ ID NO: 2839321 - RNA, 14 nt, Human
ucuuuuucuguugu

SEQ ID NO: 2839322 - RNA, 15 nt, Human
ucuuuuucuguugua

SEQ ID NO: 2839323 - RNA, 16 nt, Human
ucuuuuucuguuguaa

SEQ ID NO: 2839324 - RNA, 17 nt, Human
ucuuuuucuguuguaac

SEQ ID NO: 2839325 - RNA, 13 nt, Human
ucuuuuuucaaaa

SEQ ID NO: 2839326 - RNA, 13 nt, Human
ugaaaacuauaca

SEQ ID NO: 2839327 - RNA, 14 nt, Human
ugaaaacuauacaa

SEQ ID NO: 2839328 - RNA, 14 nt, Human
ucuuuuuuacucau

SEQ ID NO: 2839329 - RNA, 15 nt, Human
ucuuuuuuacucauu

SEQ ID NO: 2839330 - RNA, 19 nt, Human
ucuuuuuuacucauugaaa

SEQ ID NO: 2839331 - RNA, 20 nt, Human
ucuuuuuuacucauugaaau

SEQ ID NO: 2839332 - RNA, 21 nt, Human
ucuuuuuuacucauugaaaug

SEQ ID NO: 2839333 - RNA, 22 nt, Human
ucuuuuuuacucauugaaaugu

SEQ ID NO: 2839334 - RNA, 15 nt, Human
ucuuuuuuaaaauca

SEQ ID NO: 2839335 - RNA, 17 nt, Human
ucuuuuuuaauaaacua

SEQ ID NO: 2839336 - RNA, 19 nt, Human
ucuuuuuuaauaaacuacu

SEQ ID NO: 2839337 - RNA, 13 nt, Human
ucuuuucuuugua

SEQ ID NO: 2839338 - RNA, 14 nt, Human
ucuuuucuuuguau

SEQ ID NO: 2839339 - RNA, 17 nt, Human
ucuuuucuuuguaucau

SEQ ID NO: 2839340 - RNA, 20 nt, Human
ucuuuucuuuguaucauuca

SEQ ID NO: 2839341 - RNA, 13 nt, Human
ucuuuucuuuuua

SEQ ID NO: 2839342 - RNA, 14 nt, Human
ucuuuucuuuuuac

SEQ ID NO: 2839343 - RNA, 16 nt, Human
ucuuuucuuuuuacau

SEQ ID NO: 2839344 - RNA, 17 nt, Human
ucuuuucuuuuuacaua

SEQ ID NO: 2839345 - RNA, 14 nt, Human
ucuuuugaauuguu

SEQ ID NO: 2839346 - RNA, 17 nt, Human
ucuuuugaauuguuaca

SEQ ID NO: 2839347 - RNA, 18 nt, Human
ucuuuugaauuguuacau

SEQ ID NO: 2839348 - RNA, 15 nt, Human
ucuuuugaauuguuu

SEQ ID NO: 2839349 - RNA, 23 nt, Human
ucuuuugaauauucccaagccca

SEQ ID NO: 2839350 - RNA, 13 nt, Human
ucuuuuggcuucc

SEQ ID NO: 2839351 - RNA, 16 nt, Human
ucuuuugauuauguuu

SEQ ID NO: 2839352 - RNA, 22 nt, Human
ucuuuugacuuaaucucauuug

SEQ ID NO: 2839353 - RNA, 17 nt, Human
ucuuuugcuacuaaguu

SEQ ID NO: 2839354 - RNA, 19 nt, Human
ucuuuugcuacuaaguuca

SEQ ID NO: 2839355 - RNA, 17 nt, Human
ucuuuugggggaaacuu

SEQ ID NO: 2839356 - RNA, 16 nt, Human
ucuuuuuauacuauua

SEQ ID NO: 2839357 - RNA, 10 nt, Human
ucuuuuguaa

SEQ ID NO: 2839358 - RNA, 14 nt, Human
ucuuuuguaaauua

SEQ ID NO: 2839359 - RNA, 11 nt, Human
ucuuuuguaag

SEQ ID NO: 2839360 - RNA, 13 nt, Human
ucuuuuguaagug

SEQ ID NO: 2839361 - RNA, 18 nt, Human
ucuuuuguaagugcuaca

SEQ ID NO: 2839362 - RNA, 13 nt, Human
ucuuuucuuuaga

SEQ ID NO: 2839363 - RNA, 15 nt, Human
ucuuuucuuuagaga

SEQ ID NO: 2839364 - RNA, 17 nt, Human
ucuuuucuuuagagaac

SEQ ID NO: 2839365 - RNA, 21 nt, Human
ucuuuucuuuagagaacugaa

SEQ ID NO: 2839366 - RNA, 22 nt, Human
ucuuuucuuuagagaacugaaa

SEQ ID NO: 2839367 - RNA, 15 nt, Human
ucuuuucuuggcaaa

SEQ ID NO: 2839368 - RNA, 22 nt, Human
ucuuuucuuggcaaaagccuug

SEQ ID NO: 2839369 - RNA, 15 nt, Human
ucuuuucuuccuggc

SEQ ID NO: 2839370 - RNA, 22 nt, Human
ucuuucacauuguuugcugcua

SEQ ID NO: 2839371 - RNA, 23 nt, Human
ucuuucacauuguuugcugcuau

SEQ ID NO: 2839372 - RNA, 17 nt, Human
ucuuuucucugugcuuc

SEQ ID NO: 2839373 - RNA, 16 nt, Human
ucuuuucucuuuuuag

SEQ ID NO: 2839374 - RNA, 13 nt, Human
ucuuuucucugug

SEQ ID NO: 2839375 - RNA, 16 nt, Human
ucuuuucuguacuucc

SEQ ID NO: 2839376 - RNA, 18 nt, Human
ucuuuucuguacuuccug

SEQ ID NO: 2839377 - RNA, 17 nt, Human
ucuuuucuuacuccucc

SEQ ID NO: 2839378 - RNA, 18 nt, Human
ucuuuucuuacuccuccu

SEQ ID NO: 2839379 - RNA, 19 nt, Human
ucuuuucuuacuccuccuc

SEQ ID NO: 2839380 - RNA, 14 nt, Human
ucuuucaauucugu

SEQ ID NO: 2839381 - RNA, 14 nt, Human
ucuuucacagcucc

SEQ ID NO: 2839382 - RNA, 15 nt, Human
ucuuucacagcuccu

SEQ ID NO: 2839383 - RNA, 14 nt, Human
ucuuuucucaugug

SEQ ID NO: 2839384 - RNA, 15 nt, Human
ucuuuucucaugugu

SEQ ID NO: 2839385 - RNA, 20 nt, Human
ucuuucacagcuccucccac

SEQ ID NO: 2839386 - RNA, 18 nt, Human
ucuuucacagcuccuccc

SEQ ID NO: 2839387 - RNA, 19 nt, Human
ucuuucacagcuccuccca

SEQ ID NO: 2839388 - RNA, 13 nt, Human
ucuguucaccuuc

SEQ ID NO: 2839389 - RNA, 19 nt, Human
ucuguucacuuuuccuccc

SEQ ID NO: 2839390 - RNA, 22 nt, Human
ucuguucacuuuuccucccuca

SEQ ID NO: 2839391 - RNA, 21 nt, Human
ucuguucacuuuuccucccuc

SEQ ID NO: 2839392 - RNA, 14 nt, Human
ucuguuauguacug

SEQ ID NO: 2839393 - RNA, 15 nt, Human
ucuguuauguacugu

SEQ ID NO: 2839394 - RNA, 16 nt, Human
ucuguuauguacugua

SEQ ID NO: 2839395 - RNA, 17 nt, Human
ucuguuauguacuguac

SEQ ID NO: 2839396 - RNA, 18 nt, Human
ucuguuauguacuguacu

SEQ ID NO: 2839397 - RNA, 19 nt, Human
ucuguuauguacuguacua

SEQ ID NO: 2839398 - RNA, 22 nt, Human
ucuguuauguacuguacuaauu

SEQ ID NO: 2839399 - RNA, 15 nt, Human
ucuguuauuaacaaa

SEQ ID NO: 2839400 - RNA, 18 nt, Human
ucuguuauuuagacucau

SEQ ID NO: 2839401 - RNA, 19 nt, Human
ucuguuauauccccugcua

SEQ ID NO: 2839402 - RNA, 17 nt, Human
ucuguggugucugccug

SEQ ID NO: 2839403 - RNA, 20 nt, Human
ucuguuagcuggguuuacau

SEQ ID NO: 2839404 - RNA, 11 nt, Human
ucugugucuuu

SEQ ID NO: 2839405 - RNA, 21 nt, Human
ucuguguugcauuauucauuu

SEQ ID NO: 2839406 - RNA, 22 nt, Human
ucuguguugcauuauucauuua

SEQ ID NO: 2839407 - RNA, 17 nt, Human
ucuguguuuaauuucuu

SEQ ID NO: 2839408 - RNA, 18 nt, Human
ucuguguuuaauuucuuc

SEQ ID NO: 2839409 - RNA, 19 nt, Human
ucuguguuuaauuucuuca

SEQ ID NO: 2839410 - RNA, 22 nt, Human
ucuguguuuaauuucuucaaaa

SEQ ID NO: 2839411 - RNA, 23 nt, Human
ucuguguuuaauuucuucaaaau

SEQ ID NO: 2839412 - RNA, 13 nt, Human
ucuguguuuauaa

SEQ ID NO: 2839413 - RNA, 15 nt, Human
ucuguuaaaaucuau

SEQ ID NO: 2839414 - RNA, 20 nt, Human
ucuguuaaaaucuauucugu

SEQ ID NO: 2839415 - RNA, 13 nt, Human
ucuguuacccagg

SEQ ID NO: 2839416 - RNA, 16 nt, Human
ucuguaccauuuauuu

SEQ ID NO: 2839417 - RNA, 13 nt, Human
ucuguaccccaug

SEQ ID NO: 2839418 - RNA, 18 nt, Human
ucuguaccccaugaccuu

SEQ ID NO: 2839419 - RNA, 23 nt, Human
ucuguaccccaugaccuuauccu

SEQ ID NO: 2839420 - RNA, 20 nt, Human
ucugucccuucugucccuca

SEQ ID NO: 2839421 - RNA, 19 nt, Human
ucugucccuucugucccuc

SEQ ID NO: 2839422 - RNA, 15 nt, Human
ucugucccucacagc

SEQ ID NO: 2839423 - RNA, 23 nt, Human
ucugucccugagagugucucuga

SEQ ID NO: 2839424 - RNA, 14 nt, Human
ucugucccucacag

SEQ ID NO: 2839425 - RNA, 13 nt, Human
ucuguacauuuug

SEQ ID NO: 2839426 - RNA, 19 nt, Human
ucuguacauuuuguuguaa

SEQ ID NO: 2839427 - RNA, 21 nt, Human
ucuguacauuuuguuguaaaa

SEQ ID NO: 2839428 - RNA, 22 nt, Human
ucuguacauuuuguuguaaaaa

SEQ ID NO: 2839429 - RNA, 17 nt, Human
ucuguacgucugacagg

SEQ ID NO: 2839430 - RNA, 23 nt, Human
ucugucccuucugucccucacag

SEQ ID NO: 2839431 - RNA, 22 nt, Human
ucugucccuucugucccucaca

SEQ ID NO: 2839432 - RNA, 14 nt, Human
ucugucccuugcug

SEQ ID NO: 2839433 - RNA, 15 nt, Human
ucugucccuugcugu

SEQ ID NO: 2839434 - RNA, 16 nt, Human
ucugucccuugcugua

SEQ ID NO: 2839435 - RNA, 17 nt, Human
ucugucccuugcuguau

SEQ ID NO: 2839436 - RNA, 22 nt, Human
ucugugucagguggggcagcuu

SEQ ID NO: 2839437 - RNA, 19 nt, Human
ucuguguaaccauuuuaua

SEQ ID NO: 2839438 - RNA, 18 nt, Human
ucuguguccuucccugca

SEQ ID NO: 2839439 - RNA, 14 nt, Human
ucugugucuaagau

SEQ ID NO: 2839440 - RNA, 16 nt, Human
ucugugucuaagauuc

SEQ ID NO: 2839441 - RNA, 17 nt, Human
ucugugucuaagauucu

SEQ ID NO: 2839442 - RNA, 11 nt, Human
ucuguguccuu

SEQ ID NO: 2839443 - RNA, 15 nt, Human
ucuguguccuucccu

SEQ ID NO: 2839444 - RNA, 17 nt, Human
ucuguguccuucccugc

SEQ ID NO: 2839445 - RNA, 18 nt, Human
ucugugucuaagauucua

SEQ ID NO: 2839446 - RNA, 20 nt, Human
ucugugucuaagauucuaga

SEQ ID NO: 2839447 - RNA, 22 nt, Human
ucugugucuaagauucuagauc

SEQ ID NO: 2839448 - RNA, 23 nt, Human
ucugugucuaagauucuagauca

SEQ ID NO: 2839449 - RNA, 23 nt, Human
ucuggagcccuaaccccuuccag

SEQ ID NO: 2839450 - RNA, 21 nt, Human
ucuggagcccuaaccccuucc

SEQ ID NO: 2839451 - RNA, 16 nt, Human
ucuggagcccuaaccc

SEQ ID NO: 2839452 - RNA, 13 nt, Human
ucuggagcccuug

SEQ ID NO: 2839453 - RNA, 12 nt, Human
ucuggagcccuu

SEQ ID NO: 2839454 - RNA, 16 nt, Human
ucuggagcccuugggu

SEQ ID NO: 2839455 - RNA, 14 nt, Human
ucuggagcuguccg

SEQ ID NO: 2839456 - RNA, 16 nt, Human
ucuggaggccuuccag

SEQ ID NO: 2839457 - RNA, 17 nt, Human
ucuggaggccuuccagc

SEQ ID NO: 2839458 - RNA, 19 nt, Human
ucuggaggccuuccagcug

SEQ ID NO: 2839459 - RNA, 20 nt, Human
ucuggaggccuuccagcugc

SEQ ID NO: 2839460 - RNA, 21 nt, Human
ucuggaggccuuccagcugcu

SEQ ID NO: 2839461 - RNA, 22 nt, Human
ucuggaggccuuccagcugcug

SEQ ID NO: 2839462 - RNA, 23 nt, Human
ucuggaggccuuccagcugcugu

SEQ ID NO: 2839463 - RNA, 22 nt, Human
ucuggcuagaggccagccccac

SEQ ID NO: 2839464 - RNA, 21 nt, Human
ucuggcuagaggccagcccca

SEQ ID NO: 2839465 - RNA, 17 nt, Human
ucuggcuagaggccagc

SEQ ID NO: 2839466 - RNA, 16 nt, Human
ucuggcuagaggccag

SEQ ID NO: 2839467 - RNA, 13 nt, Human
ucuggccuuuccu

SEQ ID NO: 2839468 - RNA, 21 nt, Human
ucuggccuuuccucucuccug

SEQ ID NO: 2839469 - RNA, 15 nt, Human
ucuggagaccaggga

SEQ ID NO: 2839470 - RNA, 19 nt, Human
ucuggagaccagggagccu

SEQ ID NO: 2839471 - RNA, 20 nt, Human
ucuggagaccagggagccuu

SEQ ID NO: 2839472 - RNA, 15 nt, Human
ucuggagacagcccc

SEQ ID NO: 2839473 - RNA, 16 nt, Human
ucuggagacagcccca

SEQ ID NO: 2839474 - RNA, 17 nt, Human
ucuggagacagccccag

SEQ ID NO: 2839475 - RNA, 18 nt, Human
ucuggagacagccccaga

SEQ ID NO: 2839476 - RNA, 20 nt, Human
ucuggagacagccccagagc

SEQ ID NO: 2839477 - RNA, 22 nt, Human
ucuggagacagccccagagcag

SEQ ID NO: 2839478 - RNA, 24 nt, Human
ucuggagacagccccagagcaggg

SEQ ID NO: 2839479 - RNA, 21 nt, Human
ucuggagaccagggagccuuu

SEQ ID NO: 2839480 - RNA, 12 nt, Human
ucuggagagaaa

SEQ ID NO: 2839481 - RNA, 15 nt, Human
ucuggagagaaacaa

SEQ ID NO: 2839482 - RNA, 21 nt, Human
ucugcacaugucuuguacaug

SEQ ID NO: 2839483 - RNA, 22 nt, Human
ucugcacaugucuuguacaugu

SEQ ID NO: 2839484 - RNA, 13 nt, Human
ucugcaccccucu

SEQ ID NO: 2839485 - RNA, 21 nt, Human
ucugcaccccucugcccucau

SEQ ID NO: 2839486 - RNA, 12 nt, Human
ucuggagacagc

SEQ ID NO: 2839487 - RNA, 14 nt, Human
ucuguaaucccagc

SEQ ID NO: 2839488 - RNA, 15 nt, Human
ucugguuucaccgag

SEQ ID NO: 2839489 - RNA, 14 nt, Human
ucugguuucucauu

SEQ ID NO: 2839490 - RNA, 16 nt, Human
ucugguuucucauucu

SEQ ID NO: 2839491 - RNA, 13 nt, Human
ucugguuuuaaca

SEQ ID NO: 2839492 - RNA, 15 nt, Human
ucugguuuuaacaau

SEQ ID NO: 2839493 - RNA, 16 nt, Human
ucuguaaaaacacuga

SEQ ID NO: 2839494 - RNA, 19 nt, Human
ucuguaaaaacacugaaaa

SEQ ID NO: 2839495 - RNA, 12 nt, Human
ucugggacacag

SEQ ID NO: 2839496 - RNA, 15 nt, Human
ucugggaaccuccca

SEQ ID NO: 2839497 - RNA, 16 nt, Human
ucugggaaccucccag

SEQ ID NO: 2839498 - RNA, 17 nt, Human
ucugggaaccucccaga

SEQ ID NO: 2839499 - RNA, 18 nt, Human
ucugggaaccucccagag

SEQ ID NO: 2839500 - RNA, 19 nt, Human
ucugggaaccucccagagg

SEQ ID NO: 2839501 - RNA, 20 nt, Human
ucugggaaccucccagaggu

SEQ ID NO: 2839502 - RNA, 22 nt, Human
ucugggaaccucccagaggucc

SEQ ID NO: 2839503 - RNA, 14 nt, Human
ucugggaagggaag

SEQ ID NO: 2839504 - RNA, 13 nt, Human
ucugggacacagu

SEQ ID NO: 2839505 - RNA, 22 nt, Human
ucugggaaaugagaaggcagcc

SEQ ID NO: 2839506 - RNA, 13 nt, Human
ucugguucugaug

SEQ ID NO: 2839507 - RNA, 14 nt, Human
ucugguucugaugc

SEQ ID NO: 2839508 - RNA, 13 nt, Human
ucuggcuuggccu

SEQ ID NO: 2839509 - RNA, 14 nt, Human
ucuggcuuggccua

SEQ ID NO: 2839510 - RNA, 22 nt, Human
ucuggcuugggcagggucuguu

SEQ ID NO: 2839511 - RNA, 21 nt, Human
ucuuguuuuuuuuuuccacuu

SEQ ID NO: 2839512 - RNA, 18 nt, Human
ucuuguuuuuuuuuucca

SEQ ID NO: 2839513 - RNA, 12 nt, Human
ucuuuaaaacaa

SEQ ID NO: 2839514 - RNA, 13 nt, Human
ucuuuaaaacaaa

SEQ ID NO: 2839515 - RNA, 14 nt, Human
ucuuuaaaacaaaa

SEQ ID NO: 2839516 - RNA, 15 nt, Human
ucuuuaaaacaaaac

SEQ ID NO: 2839517 - RNA, 16 nt, Human
ucuuuaaaacaaaaca

SEQ ID NO: 2839518 - RNA, 14 nt, Human
ucuuuaaaagagag

SEQ ID NO: 2839519 - RNA, 15 nt, Human
ucuuuaaaagagaga

SEQ ID NO: 2839520 - RNA, 16 nt, Human
ucuuuaaaagagagag

SEQ ID NO: 2839521 - RNA, 17 nt, Human
ucuuuaaaagagagaga

SEQ ID NO: 2839522 - RNA, 23 nt, Human
ucuuuaaaagagagagagagaaa

SEQ ID NO: 2839523 - RNA, 15 nt, Human
ucuugugaaggcagg

SEQ ID NO: 2839524 - RNA, 16 nt, Human
ucuugugaaggccaug

SEQ ID NO: 2839525 - RNA, 14 nt, Human
ucuugugaaauggc

SEQ ID NO: 2839526 - RNA, 10 nt, Human
ucuugugaag

SEQ ID NO: 2839527 - RNA, 11 nt, Human
ucuugugaagg

SEQ ID NO: 2839528 - RNA, 11 nt, Human
ucuugcucugc

SEQ ID NO: 2839529 - RNA, 14 nt, Human
ucuugcucccuuca

SEQ ID NO: 2839530 - RNA, 17 nt, Human
ucuugcucccuucagcc

SEQ ID NO: 2839531 - RNA, 18 nt, Human
ucuugcucccuucagccc

SEQ ID NO: 2839532 - RNA, 19 nt, Human
ucuugcucccuucagcccc

SEQ ID NO: 2839533 - RNA, 22 nt, Human
ucuugcucccuucagcccccag

SEQ ID NO: 2839534 - RNA, 16 nt, Human
ucuugccuuacacaaa

SEQ ID NO: 2839535 - RNA, 13 nt, Human
ucuugcucugcug

SEQ ID NO: 2839536 - RNA, 12 nt, Human
ucuugcucugcu

SEQ ID NO: 2839537 - RNA, 17 nt, Human
ucuugcucuaucucuca

SEQ ID NO: 2839538 - RNA, 18 nt, Human
ucuugcucuaucucucaa

SEQ ID NO: 2839539 - RNA, 22 nt, Human
ucuuguccaugugguucuucaa

SEQ ID NO: 2839540 - RNA, 23 nt, Human
ucuuguccaugugguucuucaaa

SEQ ID NO: 2839541 - RNA, 20 nt, Human
ucuugucccacgugucuucc

SEQ ID NO: 2839542 - RNA, 23 nt, Human
ucuugucccacgugucuuccacu

SEQ ID NO: 2839543 - RNA, 13 nt, Human
ucuugucagacau

SEQ ID NO: 2839544 - RNA, 14 nt, Human
ucuugucagacaua

SEQ ID NO: 2839545 - RNA, 18 nt, Human
ucuugucagacauaaagc

SEQ ID NO: 2839546 - RNA, 19 nt, Human
ucuugucagacauaaagcc

SEQ ID NO: 2839547 - RNA, 20 nt, Human
ucuugucagacauaaagcca

SEQ ID NO: 2839548 - RNA, 21 nt, Human
ucuugucagacauaaagccau

SEQ ID NO: 2839549 - RNA, 23 nt, Human
ucuugucagacauaaagccaugu

SEQ ID NO: 2839550 - RNA, 12 nt, Human
ucuucuccaggc

SEQ ID NO: 2839551 - RNA, 16 nt, Human
ucuucuccacuggaug

SEQ ID NO: 2839552 - RNA, 14 nt, Human
ucuucuccagauuu

SEQ ID NO: 2839553 - RNA, 15 nt, Human
ucuucuccagauuuu

SEQ ID NO: 2839554 - RNA, 17 nt, Human
ucuucuccagauuuuuc

SEQ ID NO: 2839555 - RNA, 23 nt, Human
ucuucuccagauuuuucggaggc

SEQ ID NO: 2839556 - RNA, 14 nt, Human
ucuucuccaggcug

SEQ ID NO: 2839557 - RNA, 13 nt, Human
ucuucuccaggcu

SEQ ID NO: 2839558 - RNA, 18 nt, Human
ucuugaacuccuggccuc

SEQ ID NO: 2839559 - RNA, 17 nt, Human
ucuugaacuccuggccu

SEQ ID NO: 2839560 - RNA, 16 nt, Human
ucuugaacuccuggcc

SEQ ID NO: 2839561 - RNA, 15 nt, Human
ucuucuccaggcugu

SEQ ID NO: 2839562 - RNA, 18 nt, Human
ucuugaauuucuaaaaaa

SEQ ID NO: 2839563 - RNA, 13 nt, Human
ucuugacaaaacc

SEQ ID NO: 2839564 - RNA, 14 nt, Human
ucuuaaaaugcaau

SEQ ID NO: 2839565 - RNA, 15 nt, Human
ucuuaaaaugcaaua

SEQ ID NO: 2839566 - RNA, 16 nt, Human
ucuuaaaaugcaauau

SEQ ID NO: 2839567 - RNA, 21 nt, Human
ucuuaaaaugcaauauuugua

SEQ ID NO: 2839568 - RNA, 23 nt, Human
ucuuaguuuggauucuuauguag

SEQ ID NO: 2839569 - RNA, 16 nt, Human
ucuuaguuuggauucu

SEQ ID NO: 2839570 - RNA, 21 nt, Human
ucuuaguuuggauucuuaugu

SEQ ID NO: 2839571 - RNA, 16 nt, Human
ucuuaaaaaguuguuc

SEQ ID NO: 2839572 - RNA, 19 nt, Human
ucuuaaaaaguuguucaac

SEQ ID NO: 2839573 - RNA, 21 nt, Human
ucuuaaaaaguuguucaacua

SEQ ID NO: 2839574 - RNA, 20 nt, Human
ucuuaaaaauguuuuuucau

SEQ ID NO: 2839575 - RNA, 23 nt, Human
ucuuaaaaguugugauuccagau

SEQ ID NO: 2839576 - RNA, 13 nt, Human
ucuucagggccug

SEQ ID NO: 2839577 - RNA, 15 nt, Human
ucuucagggccuggu

SEQ ID NO: 2839578 - RNA, 22 nt, Human
ucuucagggccugguugaagaa

SEQ ID NO: 2839579 - RNA, 23 nt, Human
ucuucagggccugguugaagaag

SEQ ID NO: 2839580 - RNA, 22 nt, Human
ucuuauggaauugauuugcauu

SEQ ID NO: 2839581 - RNA, 21 nt, Human
ucuuauggaauugauuugcau

SEQ ID NO: 2839582 - RNA, 15 nt, Human
ucuuauggauucauu

SEQ ID NO: 2839583 - RNA, 17 nt, Human
ucuuauggauucauuua

SEQ ID NO: 2839584 - RNA, 18 nt, Human
ucuuauggaauugauuug

SEQ ID NO: 2839585 - RNA, 17 nt, Human
ucuuauggaauugauuu

SEQ ID NO: 2839586 - RNA, 15 nt, Human
ucuuauggaauugau

SEQ ID NO: 2839587 - RNA, 14 nt, Human
ucuuauggaauuga

SEQ ID NO: 2839588 - RNA, 14 nt, Human
ucuuaugcaauuuc

SEQ ID NO: 2839589 - RNA, 17 nt, Human
ucuuaugcuuauaauau

SEQ ID NO: 2839590 - RNA, 13 nt, Human
ucuuauaguucua

SEQ ID NO: 2839591 - RNA, 22 nt, Human
ucuuauagucaauguuucuuuu

SEQ ID NO: 2839592 - RNA, 16 nt, Human
ucuuauaguucuaggc

SEQ ID NO: 2839593 - RNA, 17 nt, Human
ucuuauaguucuaggca

SEQ ID NO: 2839594 - RNA, 12 nt, Human
ucuuauauagca

SEQ ID NO: 2839595 - RNA, 22 nt, Human
ucuuauauagcagcaaaaauau

SEQ ID NO: 2839596 - RNA, 13 nt, Human
ucuuauagaaagu

SEQ ID NO: 2839597 - RNA, 16 nt, Human
ucuuauagcacuuuga

SEQ ID NO: 2839598 - RNA, 17 nt, Human
ucuuauagcacuuugaa

SEQ ID NO: 2839599 - RNA, 18 nt, Human
ucuuauagcacuuugaaa

SEQ ID NO: 2839600 - RNA, 19 nt, Human
ucuuauagcacuuugaaau

SEQ ID NO: 2839601 - RNA, 23 nt, Human
ucuuauagcacuuugaaauaccu

SEQ ID NO: 2839602 - RNA, 17 nt, Human
ucuuauaauacucuguu

SEQ ID NO: 2839603 - RNA, 19 nt, Human
ucuuauaauacucuguugu

SEQ ID NO: 2839604 - RNA, 20 nt, Human
ucuuauaauacucuguugua

SEQ ID NO: 2839605 - RNA, 16 nt, Human
ucuuauacgcuuuucu

SEQ ID NO: 2839606 - RNA, 19 nt, Human
ucuuauacgcuuuucuuug

SEQ ID NO: 2839607 - RNA, 20 nt, Human
ucuuauacgcuuuucuuugu

SEQ ID NO: 2839608 - RNA, 14 nt, Human
ucuuauacuguaca

SEQ ID NO: 2839609 - RNA, 15 nt, Human
ucuuauacuguacaa

SEQ ID NO: 2839610 - RNA, 16 nt, Human
ucuuauacuguacaau

SEQ ID NO: 2839611 - RNA, 18 nt, Human
ucuuauacuguacaauaa

SEQ ID NO: 2839612 - RNA, 21 nt, Human
ucuuauacuguacaauaaaaa

SEQ ID NO: 2839613 - RNA, 16 nt, Human
ucuucagucagaaaac

SEQ ID NO: 2839614 - RNA, 22 nt, Human
ucuucagucagaaaacuuuaaa

SEQ ID NO: 2839615 - RNA, 13 nt, Human
ucuuccacuuugc

SEQ ID NO: 2839616 - RNA, 16 nt, Human
ucuuccagaugugaug

SEQ ID NO: 2839617 - RNA, 15 nt, Human
ucuucuaauuucaaa

SEQ ID NO: 2839618 - RNA, 20 nt, Human
ucuucuaauuucaaaaauau

SEQ ID NO: 2839619 - RNA, 22 nt, Human
ucuucuaaacuuccccaucuuc

SEQ ID NO: 2839620 - RNA, 13 nt, Human
ucuucuaaacuuc

SEQ ID NO: 2839621 - RNA, 17 nt, Human
ucuucaggcuuccugca

SEQ ID NO: 2839622 - RNA, 19 nt, Human
ucuucguucuuuuuaaguu

SEQ ID NO: 2839623 - RNA, 14 nt, Human
ucuucgucuucacu

SEQ ID NO: 2839624 - RNA, 18 nt, Human
ucuucgucuucacucuua

SEQ ID NO: 2839625 - RNA, 13 nt, Human
ucuucuccacugg

SEQ ID NO: 2839626 - RNA, 23 nt, Human
ucuucucaaguucuaagauucua

SEQ ID NO: 2839627 - RNA, 19 nt, Human
ucuucucaaguucuaagau

SEQ ID NO: 2839628 - RNA, 21 nt, Human
ucuucucaaguucuaagauuc

SEQ ID NO: 2839629 - RNA, 14 nt, Human
ucuucucaaguucu

SEQ ID NO: 2839630 - RNA, 15 nt, Human
ucuucucaaguucua

SEQ ID NO: 2839631 - RNA, 17 nt, Human
ucuucucaaguucuaag

SEQ ID NO: 2839632 - RNA, 18 nt, Human
ucuucucaaguucuaaga

SEQ ID NO: 2839633 - RNA, 12 nt, Human
ucuucuagaguu

SEQ ID NO: 2839634 - RNA, 17 nt, Human
ucuucuagaguucagag

SEQ ID NO: 2839635 - RNA, 14 nt, Human
ucuucuagaguuca

SEQ ID NO: 2839636 - RNA, 16 nt, Human
ucuucuauuuuauucc

SEQ ID NO: 2839637 - RNA, 15 nt, Human
ucuucuauuuuauuc

SEQ ID NO: 2839638 - RNA, 14 nt, Human
ucuucuaugaccca

SEQ ID NO: 2839639 - RNA, 19 nt, Human
ucuucuauguaggaaaaaa

SEQ ID NO: 2839640 - RNA, 13 nt, Human
ucuucuauuuugu

SEQ ID NO: 2839641 - RNA, 15 nt, Human
ucuucucaaaagaac

SEQ ID NO: 2839642 - RNA, 11 nt, Human
ucuucucaagu

SEQ ID NO: 2839643 - RNA, 21 nt, Human
ugccuaauaaacauccuucaa

SEQ ID NO: 2839644 - RNA, 18 nt, Human
ugccuaauaaacauccuu

SEQ ID NO: 2839645 - RNA, 16 nt, Human
ugccuagcaagcuggc

SEQ ID NO: 2839646 - RNA, 17 nt, Human
ugccuagcaagcuggcc

SEQ ID NO: 2839647 - RNA, 18 nt, Human
ugccuagcaagcuggccu

SEQ ID NO: 2839648 - RNA, 19 nt, Human
ugccuagcaagcuggccuc

SEQ ID NO: 2839649 - RNA, 20 nt, Human
ugccuagcaagcuggccucu

SEQ ID NO: 2839650 - RNA, 13 nt, Human
ugccuaaguauua

SEQ ID NO: 2839651 - RNA, 15 nt, Human
ugccuaaguauuaaa

SEQ ID NO: 2839652 - RNA, 19 nt, Human
ugccuaaggcugaacuugu

SEQ ID NO: 2839653 - RNA, 22 nt, Human
ugccuaaguauuaaaacauugg

SEQ ID NO: 2839654 - RNA, 23 nt, Human
ugccuaaguauuaaaacauugga

SEQ ID NO: 2839655 - RNA, 17 nt, Human
ugccuaaguauuaaaac

SEQ ID NO: 2839656 - RNA, 19 nt, Human
ugccuaaguauuaaaacau

SEQ ID NO: 2839657 - RNA, 20 nt, Human
ugccuaaguauuaaaacauu

SEQ ID NO: 2839658 - RNA, 21 nt, Human
ugccuaaguauuaaaacauug

SEQ ID NO: 2839659 - RNA, 23 nt, Human
ugcccaggcuggcgugcaguggu

SEQ ID NO: 2839660 - RNA, 13 nt, Human
ugcccaggcuggu

SEQ ID NO: 2839661 - RNA, 15 nt, Human
ugcccaggcuggucu

SEQ ID NO: 2839662 - RNA, 17 nt, Human
ugcccaggcuggucuca

SEQ ID NO: 2839663 - RNA, 16 nt, Human
ugcccaggcuggucuu

SEQ ID NO: 2839664 - RNA, 14 nt, Human
ugcccaggcugugc

SEQ ID NO: 2839665 - RNA, 17 nt, Human
ugccugaagucacacag

SEQ ID NO: 2839666 - RNA, 18 nt, Human
ugccugaagucacacagu

SEQ ID NO: 2839667 - RNA, 22 nt, Human
ugccugaagucacacagugagu

SEQ ID NO: 2839668 - RNA, 18 nt, Human
ugccugauccuccaacag

SEQ ID NO: 2839669 - RNA, 22 nt, Human
ugccugauauuucccuccccug

SEQ ID NO: 2839670 - RNA, 15 nt, Human
ugccugauggaccug

SEQ ID NO: 2839671 - RNA, 15 nt, Human
ugccugauugccaag

SEQ ID NO: 2839672 - RNA, 20 nt, Human
ugccugauugccaagcucag

SEQ ID NO: 2839673 - RNA, 17 nt, Human
ugccugcacaaacucac

SEQ ID NO: 2839674 - RNA, 19 nt, Human
ugccugagucacccaugaa

SEQ ID NO: 2839675 - RNA, 16 nt, Human
ugccugagugccuggc

SEQ ID NO: 2839676 - RNA, 17 nt, Human
ugccuccuguguacugu

SEQ ID NO: 2839677 - RNA, 18 nt, Human
ugccuccuguguacugug

SEQ ID NO: 2839678 - RNA, 20 nt, Human
ugccuccuguguacuguguc

SEQ ID NO: 2839679 - RNA, 21 nt, Human
ugccuccuguguacuguguca

SEQ ID NO: 2839680 - RNA, 17 nt, Human
ugccucugucuagcaug

SEQ ID NO: 2839681 - RNA, 21 nt, Human
ugccucugucuagcaugccaa

SEQ ID NO: 2839682 - RNA, 17 nt, Human
ugccuucugacggcccu

SEQ ID NO: 2839683 - RNA, 18 nt, Human
ugccuucugacggcccug

SEQ ID NO: 2839684 - RNA, 19 nt, Human
ugccuucugacggcccugc

SEQ ID NO: 2839685 - RNA, 20 nt, Human
ugccuucugacggcccugca

SEQ ID NO: 2839686 - RNA, 22 nt, Human
ugccuucugacggcccugcaau

SEQ ID NO: 2839687 - RNA, 16 nt, Human
ugcgcagaaaacaaga

SEQ ID NO: 2839688 - RNA, 15 nt, Human
ugcgcagccccaucu

SEQ ID NO: 2839689 - RNA, 16 nt, Human
ugcgcagccccaucug

SEQ ID NO: 2839690 - RNA, 17 nt, Human
ugcgcagccccaucugu

SEQ ID NO: 2839691 - RNA, 20 nt, Human
ugcgcagccccaucugugca

SEQ ID NO: 2839692 - RNA, 21 nt, Human
ugcgcagccccaucugugcau

SEQ ID NO: 2839693 - RNA, 15 nt, Human
ugcgauuuuauuacu

SEQ ID NO: 2839694 - RNA, 16 nt, Human
ugcgauuuuauuacug

SEQ ID NO: 2839695 - RNA, 16 nt, Human
ugccuuccuuucucca

SEQ ID NO: 2839696 - RNA, 18 nt, Human
ugccuuccuuucuccagg

SEQ ID NO: 2839697 - RNA, 19 nt, Human
ugccuuccuuucuccagga

SEQ ID NO: 2839698 - RNA, 20 nt, Human
ugccuuccuuucuccaggac

SEQ ID NO: 2839699 - RNA, 21 nt, Human
ugccuuccuuucuccaggacc

SEQ ID NO: 2839700 - RNA, 22 nt, Human
ugccuuccuuucuccaggacca

SEQ ID NO: 2839701 - RNA, 23 nt, Human
ugccuuccuuucuccaggaccaa

SEQ ID NO: 2839702 - RNA, 13 nt, Human
ugcgccuacagga

SEQ ID NO: 2839703 - RNA, 15 nt, Human
ugcgcccuuaccuuc

SEQ ID NO: 2839704 - RNA, 16 nt, Human
ugcgcccuuaccuucc

SEQ ID NO: 2839705 - RNA, 18 nt, Human
ugcgcccaguccuuccac

SEQ ID NO: 2839706 - RNA, 17 nt, Human
ugcgcccaguccuucca

SEQ ID NO: 2839707 - RNA, 19 nt, Human
ugcgauuuugccugugucu

SEQ ID NO: 2839708 - RNA, 16 nt, Human
ugcgcaaaaugcagcu

SEQ ID NO: 2839709 - RNA, 17 nt, Human
ugcgcaggcuggcccug

SEQ ID NO: 2839710 - RNA, 16 nt, Human
ugcgcaggcuggcccu

SEQ ID NO: 2839711 - RNA, 13 nt, Human
ugcgcaggcuggc

SEQ ID NO: 2839712 - RNA, 20 nt, Human
ugccuggccaggcagaucug

SEQ ID NO: 2839713 - RNA, 16 nt, Human
ugccuggccaggcaga

SEQ ID NO: 2839714 - RNA, 14 nt, Human
ugccuggccaggca

SEQ ID NO: 2839715 - RNA, 12 nt, Human
ugccuggccagg

SEQ ID NO: 2839716 - RNA, 15 nt, Human
ugccuggccacugcu

SEQ ID NO: 2839717 - RNA, 18 nt, Human
ugccuggccacugcuccc

SEQ ID NO: 2839718 - RNA, 23 nt, Human
ugccuggccacugcucccuaagc

SEQ ID NO: 2839719 - RNA, 19 nt, Human
ugccugcacaaacucacca

SEQ ID NO: 2839720 - RNA, 16 nt, Human
ugccuggccuggcaca

SEQ ID NO: 2839721 - RNA, 21 nt, Human
ugccuggccccucgccugugg

SEQ ID NO: 2839722 - RNA, 13 nt, Human
ugccuggccggcc

SEQ ID NO: 2839723 - RNA, 14 nt, Human
ugccuggccggcca

SEQ ID NO: 2839724 - RNA, 15 nt, Human
ugccuggccggccag

SEQ ID NO: 2839725 - RNA, 16 nt, Human
ugccuggccggccagc

SEQ ID NO: 2839726 - RNA, 17 nt, Human
ugccuggccggccagcc

SEQ ID NO: 2839727 - RNA, 18 nt, Human
ugccuggccggccagcca

SEQ ID NO: 2839728 - RNA, 23 nt, Human
ugccuggccggccagccagccac

SEQ ID NO: 2839729 - RNA, 17 nt, Human
ugccuggccuggcacac

SEQ ID NO: 2839730 - RNA, 20 nt, Human
ugccuggccuggcacacauc

SEQ ID NO: 2839731 - RNA, 16 nt, Human
ugccuuauuaaaguuc

SEQ ID NO: 2839732 - RNA, 22 nt, Human
ugccuggccuggcacacaucag

SEQ ID NO: 2839733 - RNA, 18 nt, Human
ugccuggccuuccugucu

SEQ ID NO: 2839734 - RNA, 13 nt, Human
ugccuucagcucu

SEQ ID NO: 2839735 - RNA, 19 nt, Human
ugccuucauuaccuuuuuu

SEQ ID NO: 2839736 - RNA, 17 nt, Human
ugccuucauuaccuuuu

SEQ ID NO: 2839737 - RNA, 24 nt, Human
ugccuucauggaacucagcugucu

SEQ ID NO: 2839738 - RNA, 17 nt, Human
ugccuucagcucuacag

SEQ ID NO: 2839739 - RNA, 18 nt, Human
ugccuucagcucuacagc

SEQ ID NO: 2839740 - RNA, 14 nt, Human
ugccuuccuaagcc

SEQ ID NO: 2839741 - RNA, 16 nt, Human
ugccuuccuaagccug

SEQ ID NO: 2839742 - RNA, 19 nt, Human
ugccuuccuaagccugugg

SEQ ID NO: 2839743 - RNA, 20 nt, Human
ugccuuccuaagccuguggc

SEQ ID NO: 2839744 - RNA, 21 nt, Human
ugccuuccuaagccuguggcu

SEQ ID NO: 2839745 - RNA, 23 nt, Human
ugccuuccuaagccuguggcugu

SEQ ID NO: 2839746 - RNA, 13 nt, Human
ugcgugggucaga

SEQ ID NO: 2839747 - RNA, 16 nt, Human
ugcgugggucagaaga

SEQ ID NO: 2839748 - RNA, 18 nt, Human
ugcguggacucugcacau

SEQ ID NO: 2839749 - RNA, 22 nt, Human
ugcguggacucugcacaugucu

SEQ ID NO: 2839750 - RNA, 13 nt, Human
ugcgugucguggg

SEQ ID NO: 2839751 - RNA, 16 nt, Human
ugcguggacucugcac

SEQ ID NO: 2839752 - RNA, 17 nt, Human
ugcguggacucugcaca

SEQ ID NO: 2839753 - RNA, 17 nt, Human
ugcgugccccugcugcu

SEQ ID NO: 2839754 - RNA, 15 nt, Human
ugcgugccgugugag

SEQ ID NO: 2839755 - RNA, 17 nt, Human
ugcgugccgugugagug

SEQ ID NO: 2839756 - RNA, 18 nt, Human
ugcgugccgugugagugu

SEQ ID NO: 2839757 - RNA, 19 nt, Human
ugcgugccgugugagugug

SEQ ID NO: 2839758 - RNA, 23 nt, Human
ugcgugccgugugagugugacag

SEQ ID NO: 2839759 - RNA, 23 nt, Human
ugcguacguuuccugagaagugu

SEQ ID NO: 2839760 - RNA, 20 nt, Human
ugcguacguuuccugagaag

SEQ ID NO: 2839761 - RNA, 15 nt, Human
ugcguacguuuccug

SEQ ID NO: 2839762 - RNA, 20 nt, Human
ugcuagcaaauggcagaacc

SEQ ID NO: 2839763 - RNA, 13 nt, Human
ugcuagauaaaag

SEQ ID NO: 2839764 - RNA, 14 nt, Human
ugcuagauaaaagc

SEQ ID NO: 2839765 - RNA, 13 nt, Human
ugcuagaauacuu

SEQ ID NO: 2839766 - RNA, 16 nt, Human
ugcuagaauacuuuuu

SEQ ID NO: 2839767 - RNA, 19 nt, Human
ugcuagacucuagacaaga

SEQ ID NO: 2839768 - RNA, 11 nt, Human
ugcuagaacuu

SEQ ID NO: 2839769 - RNA, 12 nt, Human
ugcuagaacuuu

SEQ ID NO: 2839770 - RNA, 13 nt, Human
ugcuagaacuuuu

SEQ ID NO: 2839771 - RNA, 14 nt, Human
ugcuagaacuuuuu

SEQ ID NO: 2839772 - RNA, 16 nt, Human
ugcuagaacuuuuuua

SEQ ID NO: 2839773 - RNA, 17 nt, Human
ugcuagaacuuuuuuaa

SEQ ID NO: 2839774 - RNA, 19 nt, Human
ugcuagaacuuuuuuaaau

SEQ ID NO: 2839775 - RNA, 20 nt, Human
ugcuagaacuuuuuuaaaua

SEQ ID NO: 2839776 - RNA, 21 nt, Human
ugcuagaacuuuuuuaaauaa

SEQ ID NO: 2839777 - RNA, 22 nt, Human
ugcuagaacuuuuuuaaauaaa

SEQ ID NO: 2839778 - RNA, 23 nt, Human
ugcuagaacuuuuuuaaauaaac

SEQ ID NO: 2839779 - RNA, 14 nt, Human
ugcuagaagaaaac

SEQ ID NO: 2839780 - RNA, 15 nt, Human
ugcuagaagaaaaca

SEQ ID NO: 2839781 - RNA, 18 nt, Human
ugcuagcgcguugccugu

SEQ ID NO: 2839782 - RNA, 19 nt, Human
ugcuagcgcguugccuguc

SEQ ID NO: 2839783 - RNA, 18 nt, Human
ugcuagcaguaaaagaug

SEQ ID NO: 2839784 - RNA, 22 nt, Human
ugcuagcaguaaaagaugaagu

SEQ ID NO: 2839785 - RNA, 18 nt, Human
ugcuagcuaugugaccuu

SEQ ID NO: 2839786 - RNA, 17 nt, Human
ugcuagcuaugugaccu

SEQ ID NO: 2839787 - RNA, 23 nt, Human
ugcuagguuaauuccaauuauau

SEQ ID NO: 2839788 - RNA, 16 nt, Human
ugcuagguuaauucca

SEQ ID NO: 2839789 - RNA, 22 nt, Human
ugcuaggucucggacuaagccu

SEQ ID NO: 2839790 - RNA, 14 nt, Human
ugcuaggucucgga

SEQ ID NO: 2839791 - RNA, 23 nt, Human
ugcucaggacucagaagccucug

SEQ ID NO: 2839792 - RNA, 17 nt, Human
ugcucaggacucagaag

SEQ ID NO: 2839793 - RNA, 14 nt, Human
ugcucaggacucag

SEQ ID NO: 2839794 - RNA, 19 nt, Human
ugcuccucuccccagcaag

SEQ ID NO: 2839795 - RNA, 18 nt, Human
ugcuccucuccccagcaa

SEQ ID NO: 2839796 - RNA, 16 nt, Human
ugcucaucuguuguag

SEQ ID NO: 2839797 - RNA, 13 nt, Human
ugcuccugcagca

SEQ ID NO: 2839798 - RNA, 15 nt, Human
ugcuccugcagcaug

SEQ ID NO: 2839799 - RNA, 22 nt, Human
ugcuccugccaggccuucagaa

SEQ ID NO: 2839800 - RNA, 22 nt, Human
ugcucaucauuccuugagaaaa

SEQ ID NO: 2839801 - RNA, 19 nt, Human
ugcugaucaucgccagagg

SEQ ID NO: 2839802 - RNA, 21 nt, Human
ugcugaucaucgccagaggug

SEQ ID NO: 2839803 - RNA, 23 nt, Human
ugcugaucaucgccagaggugcu

SEQ ID NO: 2839804 - RNA, 14 nt, Human
ugcugauccuugca

SEQ ID NO: 2839805 - RNA, 14 nt, Human
ugcugaugaaucac

SEQ ID NO: 2839806 - RNA, 19 nt, Human
ugcugaugaaucacuguuu

SEQ ID NO: 2839807 - RNA, 20 nt, Human
ugcugaugaaucacuguuuu

SEQ ID NO: 2839808 - RNA, 19 nt, Human
ugcugacagacacaggccc

SEQ ID NO: 2839809 - RNA, 16 nt, Human
ugcugacagacacagg

SEQ ID NO: 2839810 - RNA, 15 nt, Human
ugcugacagacacag

SEQ ID NO: 2839811 - RNA, 18 nt, Human
ugcugaauauacagcagg

SEQ ID NO: 2839812 - RNA, 17 nt, Human
ugcugauguccucacca

SEQ ID NO: 2839813 - RNA, 13 nt, Human
ugcugcaggggcu

SEQ ID NO: 2839814 - RNA, 17 nt, Human
ugcugcaggggcucugg

SEQ ID NO: 2839815 - RNA, 18 nt, Human
ugcugcaggggcucugga

SEQ ID NO: 2839816 - RNA, 19 nt, Human
ugcugcaggggcucuggag

SEQ ID NO: 2839817 - RNA, 21 nt, Human
ugcugcaggacuugagaagac

SEQ ID NO: 2839818 - RNA, 17 nt, Human
ugcugauucucccguuc

SEQ ID NO: 2839819 - RNA, 14 nt, Human
ugcugcacuaauug

SEQ ID NO: 2839820 - RNA, 15 nt, Human
ugcugcacuuccugu

SEQ ID NO: 2839821 - RNA, 17 nt, Human
ugcugcacuuccuguuu

SEQ ID NO: 2839822 - RNA, 15 nt, Human
ugcucuuuuuuacuc

SEQ ID NO: 2839823 - RNA, 17 nt, Human
ugcucuuuuuuacucau

SEQ ID NO: 2839824 - RNA, 18 nt, Human
ugcucuuuuuuacucauu

SEQ ID NO: 2839825 - RNA, 22 nt, Human
ugcucuuuuuuacucauugaaa

SEQ ID NO: 2839826 - RNA, 17 nt, Human
ugcuccuggccuugcug

SEQ ID NO: 2839827 - RNA, 19 nt, Human
ugcuccuggccuugcugac

SEQ ID NO: 2839828 - RNA, 12 nt, Human
ugcuccuuggcu

SEQ ID NO: 2839829 - RNA, 15 nt, Human
ugcuccuuggcuuac

SEQ ID NO: 2839830 - RNA, 17 nt, Human
ugcuccuuggcuuaccu

SEQ ID NO: 2839831 - RNA, 19 nt, Human
ugcuccuuggcuuaccuga

SEQ ID NO: 2839832 - RNA, 22 nt, Human
ugcuccuuggcuuaccugaccu

SEQ ID NO: 2839833 - RNA, 13 nt, Human
ugcugaagggcau

SEQ ID NO: 2839834 - RNA, 18 nt, Human
ugcugaagggcauucuuu

SEQ ID NO: 2839835 - RNA, 21 nt, Human
ugcugaagggcauucuuuccc

SEQ ID NO: 2839836 - RNA, 20 nt, Human
ugcugaaaaccaucuggccu

SEQ ID NO: 2839837 - RNA, 21 nt, Human
ugcugaaaaccaucuggccug

SEQ ID NO: 2839838 - RNA, 22 nt, Human
ugcugaaaaccaucuggccugg

SEQ ID NO: 2839839 - RNA, 23 nt, Human
ugcugaaaaccaucuggccuggc

SEQ ID NO: 2839840 - RNA, 17 nt, Human
ugcagauuugggcugga

SEQ ID NO: 2839841 - RNA, 23 nt, Human
ugcagagugccccaucggucacc

SEQ ID NO: 2839842 - RNA, 18 nt, Human
ugcagcaaggcccugcug

SEQ ID NO: 2839843 - RNA, 19 nt, Human
ugcagcaaggcccugcugc

SEQ ID NO: 2839844 - RNA, 20 nt, Human
ugcagcaaggcccugcugcc

SEQ ID NO: 2839845 - RNA, 16 nt, Human
ugcacguacacacaca

SEQ ID NO: 2839846 - RNA, 16 nt, Human
ugcacuugcagacucu

SEQ ID NO: 2839847 - RNA, 21 nt, Human
ugcacuugcagacucuacaga

SEQ ID NO: 2839848 - RNA, 20 nt, Human
ugcacuugugauuauuuauu

SEQ ID NO: 2839849 - RNA, 17 nt, Human
ugcacuugugauuauuu

SEQ ID NO: 2839850 - RNA, 18 nt, Human
ugcagcauuugauaauga

SEQ ID NO: 2839851 - RNA, 22 nt, Human
ugcagcauuugauaaugauaaa

SEQ ID NO: 2839852 - RNA, 11 nt, Human
ugcagccagcu

SEQ ID NO: 2839853 - RNA, 12 nt, Human
ugcagcccaugc

SEQ ID NO: 2839854 - RNA, 13 nt, Human
ugcagcuuuaaaa

SEQ ID NO: 2839855 - RNA, 14 nt, Human
ugcagcuuuugguc

SEQ ID NO: 2839856 - RNA, 15 nt, Human
ugcagcuuuacaugc

SEQ ID NO: 2839857 - RNA, 16 nt, Human
ugcagcuuuacaugca

SEQ ID NO: 2839858 - RNA, 13 nt, Human
ugcagcuuuaugu

SEQ ID NO: 2839859 - RNA, 15 nt, Human
ugcagcuuuauguuc

SEQ ID NO: 2839860 - RNA, 22 nt, Human
ugcagcuuuauguucauuuguu

SEQ ID NO: 2839861 - RNA, 23 nt, Human
ugcagcuugugugcaaaagcagu

SEQ ID NO: 2839862 - RNA, 22 nt, Human
ugcagcuuuaaaaaauuaaucu

SEQ ID NO: 2839863 - RNA, 12 nt, Human
ugcaggaaucaa

SEQ ID NO: 2839864 - RNA, 14 nt, Human
ugcaggaaucaaaa

SEQ ID NO: 2839865 - RNA, 15 nt, Human
ugcaggaaucaaaaa

SEQ ID NO: 2839866 - RNA, 19 nt, Human
ugcaggaaucaaaaauuga

SEQ ID NO: 2839867 - RNA, 20 nt, Human
ugcaggaaucaaaaauugaa

SEQ ID NO: 2839868 - RNA, 21 nt, Human
ugcaggaaucaaaaauugaag

SEQ ID NO: 2839869 - RNA, 15 nt, Human
ugcaggaccugccug

SEQ ID NO: 2839870 - RNA, 14 nt, Human
ugcacauauggacu

SEQ ID NO: 2839871 - RNA, 15 nt, Human
ugcacauauggacuc

SEQ ID NO: 2839872 - RNA, 17 nt, Human
ugcacauauggacucug

SEQ ID NO: 2839873 - RNA, 18 nt, Human
ugcacauauggacucugc

SEQ ID NO: 2839874 - RNA, 19 nt, Human
ugcacauauggacucugca

SEQ ID NO: 2839875 - RNA, 13 nt, Human
ugcacauccauuc

SEQ ID NO: 2839876 - RNA, 16 nt, Human
ugcacauccauuccca

SEQ ID NO: 2839877 - RNA, 18 nt, Human
ugcacauccauucccaag

SEQ ID NO: 2839878 - RNA, 20 nt, Human
ugcaccugccagccuggcuu

SEQ ID NO: 2839879 - RNA, 19 nt, Human
ugcaccugccagccuggcu

SEQ ID NO: 2839880 - RNA, 18 nt, Human
ugcaccugccagccuggc

SEQ ID NO: 2839881 - RNA, 17 nt, Human
ugcaccugccagccugg

SEQ ID NO: 2839882 - RNA, 16 nt, Human
ugcaccugccagccug

SEQ ID NO: 2839883 - RNA, 15 nt, Human
ugcaccugccagccu

SEQ ID NO: 2839884 - RNA, 23 nt, Human
ugcaccuacccauacacccccuc

SEQ ID NO: 2839885 - RNA, 17 nt, Human
ugcaccuagcugugcaa

SEQ ID NO: 2839886 - RNA, 19 nt, Human
ugcaccuagcugugcaaga

SEQ ID NO: 2839887 - RNA, 20 nt, Human
ugcaccuagcugugcaagac

SEQ ID NO: 2839888 - RNA, 18 nt, Human
ugcacagcggccccugca

SEQ ID NO: 2839889 - RNA, 10 nt, Human
ugcacagcug

SEQ ID NO: 2839890 - RNA, 11 nt, Human
ugcacagcugu

SEQ ID NO: 2839891 - RNA, 12 nt, Human
ugcacagcuguc

SEQ ID NO: 2839892 - RNA, 13 nt, Human
ugcacagcugucc

SEQ ID NO: 2839893 - RNA, 14 nt, Human
ugcacagcugucca

SEQ ID NO: 2839894 - RNA, 22 nt, Human
ugcacaguuagcaaacuuugua

SEQ ID NO: 2839895 - RNA, 19 nt, Human
ugcacagugcaucucagcc

SEQ ID NO: 2839896 - RNA, 20 nt, Human
ugcacagugcaucucagccc

SEQ ID NO: 2839897 - RNA, 18 nt, Human
ugcacagugcaucucagc

SEQ ID NO: 2839898 - RNA, 18 nt, Human
ugcacaggaugcuggccu

SEQ ID NO: 2839899 - RNA, 21 nt, Human
ugaagucgucuuaacucacca

SEQ ID NO: 2839900 - RNA, 14 nt, Human
ugaaguccuggcuu

SEQ ID NO: 2839901 - RNA, 16 nt, Human
ugaaguccuggcuuca

SEQ ID NO: 2839902 - RNA, 10 nt, Human
ugaagucuug

SEQ ID NO: 2839903 - RNA, 12 nt, Human
ugaagucuugua

SEQ ID NO: 2839904 - RNA, 13 nt, Human
ugaagucuuguau

SEQ ID NO: 2839905 - RNA, 14 nt, Human
ugaagucuuguaua

SEQ ID NO: 2839906 - RNA, 14 nt, Human
ugcacagaagcaca

SEQ ID NO: 2839907 - RNA, 14 nt, Human
ugcacagaaguccu

SEQ ID NO: 2839908 - RNA, 15 nt, Human
ugcacagaaguccug

SEQ ID NO: 2839909 - RNA, 16 nt, Human
ugcacagaaguccugu

SEQ ID NO: 2839910 - RNA, 21 nt, Human
ugcacagaaguccuguauguc

SEQ ID NO: 2839911 - RNA, 22 nt, Human
ugcacagaaguccuguaugucu

SEQ ID NO: 2839912 - RNA, 12 nt, Human
ugcacagagaag

SEQ ID NO: 2839913 - RNA, 13 nt, Human
ugcacagagaagc

SEQ ID NO: 2839914 - RNA, 15 nt, Human
ugcacagagaagcug

SEQ ID NO: 2839915 - RNA, 17 nt, Human
ugcacagagaagcuggg

SEQ ID NO: 2839916 - RNA, 18 nt, Human
ugcacagagaagcugggg

SEQ ID NO: 2839917 - RNA, 19 nt, Human
ugcacagagaagcugggga

SEQ ID NO: 2839918 - RNA, 16 nt, Human
ugcacagauauacuuu

SEQ ID NO: 2839919 - RNA, 18 nt, Human
ugcacagauauacuuugu

SEQ ID NO: 2839920 - RNA, 19 nt, Human
ugcacagauauacuuugug

SEQ ID NO: 2839921 - RNA, 16 nt, Human
ugcacagcggccccug

SEQ ID NO: 2839922 - RNA, 11 nt, Human
ugccauccuca

SEQ ID NO: 2839923 - RNA, 19 nt, Human
ugccauccucaaacacugc

SEQ ID NO: 2839924 - RNA, 17 nt, Human
ugccagucaagaagaaa

SEQ ID NO: 2839925 - RNA, 21 nt, Human
ugccauccuaaaagccacccc

SEQ ID NO: 2839926 - RNA, 23 nt, Human
ugccauccucaaacacugcaggc

SEQ ID NO: 2839927 - RNA, 13 nt, Human
ugccauccucuuu

SEQ ID NO: 2839928 - RNA, 15 nt, Human
ugccauccucuuucu

SEQ ID NO: 2839929 - RNA, 17 nt, Human
ugccauccucuuucucu

SEQ ID NO: 2839930 - RNA, 24 nt, Human
ugccagguuuuuggucugacccac

SEQ ID NO: 2839931 - RNA, 12 nt, Human
ugccagggagcu

SEQ ID NO: 2839932 - RNA, 11 nt, Human
ugccagggagc

SEQ ID NO: 2839933 - RNA, 22 nt, Human
ugccagggcaaugaugaaugag

SEQ ID NO: 2839934 - RNA, 17 nt, Human
ugccagggcaaugauga

SEQ ID NO: 2839935 - RNA, 20 nt, Human
ugccaagcaaggaaaacuua

SEQ ID NO: 2839936 - RNA, 23 nt, Human
ugccaagcaaggaaaacuuauuu

SEQ ID NO: 2839937 - RNA, 21 nt, Human
ugccacccaggugauguuagu

SEQ ID NO: 2839938 - RNA, 23 nt, Human
ugccaccccacccucccuggagu

SEQ ID NO: 2839939 - RNA, 14 nt, Human
ugccaccccacccu

SEQ ID NO: 2839940 - RNA, 15 nt, Human
ugccaccccacccuc

SEQ ID NO: 2839941 - RNA, 16 nt, Human
ugccaccccacccucc

SEQ ID NO: 2839942 - RNA, 17 nt, Human
ugccaccccacccuccc

SEQ ID NO: 2839943 - RNA, 19 nt, Human
ugccaccccacccucccug

SEQ ID NO: 2839944 - RNA, 20 nt, Human
ugccaccccacccucccugg

SEQ ID NO: 2839945 - RNA, 21 nt, Human
ugccaccccacccucccugga

SEQ ID NO: 2839946 - RNA, 22 nt, Human
ugccaccccacccucccuggag

SEQ ID NO: 2839947 - RNA, 19 nt, Human
ugcccagagggcccaggca

SEQ ID NO: 2839948 - RNA, 23 nt, Human
ugcccagagggcccaggcaggcc

SEQ ID NO: 2839949 - RNA, 21 nt, Human
ugcccagagggcccaggcagg

SEQ ID NO: 2839950 - RNA, 20 nt, Human
ugcccagagggcccaggcag

SEQ ID NO: 2839951 - RNA, 14 nt, Human
ugccaucgcuguga

SEQ ID NO: 2839952 - RNA, 20 nt, Human
ugccaucuguguccugguua

SEQ ID NO: 2839953 - RNA, 16 nt, Human
ugccaucuguguccug

SEQ ID NO: 2839954 - RNA, 16 nt, Human
ugccaugcagggccuc

SEQ ID NO: 2839955 - RNA, 17 nt, Human
ugccauggcgugucccu

SEQ ID NO: 2839956 - RNA, 18 nt, Human
ugccaugggcuucacugu

SEQ ID NO: 2839957 - RNA, 19 nt, Human
ugccaugggcuucacugua

SEQ ID NO: 2839958 - RNA, 20 nt, Human
ugccaugggcuucacuguau

SEQ ID NO: 2839959 - RNA, 16 nt, Human
ugcccacauuuagucu

SEQ ID NO: 2839960 - RNA, 18 nt, Human
ugcccacauuuagucucu

SEQ ID NO: 2839961 - RNA, 22 nt, Human
ugccaugggcuucacuguauaa

SEQ ID NO: 2839962 - RNA, 23 nt, Human
ugccaugggcuucacuguauaaa

SEQ ID NO: 2839963 - RNA, 13 nt, Human
ugcaggacuugag

SEQ ID NO: 2839964 - RNA, 15 nt, Human
ugcaggacuugagaa

SEQ ID NO: 2839965 - RNA, 18 nt, Human
ugcaggacuugagaagac

SEQ ID NO: 2839966 - RNA, 19 nt, Human
ugcaggaccugccuguagc

SEQ ID NO: 2839967 - RNA, 18 nt, Human
ugcaggaccugccuguag

SEQ ID NO: 2839968 - RNA, 17 nt, Human
ugcaggaccugccugua

SEQ ID NO: 2839969 - RNA, 16 nt, Human
ugcaggaccugccugu

SEQ ID NO: 2839970 - RNA, 16 nt, Human
ugcauguaugucuugg

SEQ ID NO: 2839971 - RNA, 14 nt, Human
ugcaucguccccuc

SEQ ID NO: 2839972 - RNA, 18 nt, Human
ugcaucguccccuccccc

SEQ ID NO: 2839973 - RNA, 20 nt, Human
ugcaugucaaacaugagaug

SEQ ID NO: 2839974 - RNA, 23 nt, Human
ugcauguccuuugcgccugugac

SEQ ID NO: 2839975 - RNA, 15 nt, Human
ugcauguggcuuuuu

SEQ ID NO: 2839976 - RNA, 21 nt, Human
ugcaugugguuugguuccucu

SEQ ID NO: 2839977 - RNA, 22 nt, Human
ugcaugugguuugguuccucuc

SEQ ID NO: 2839978 - RNA, 24 nt, Human
ugcaugugguuugguuccucucug

SEQ ID NO: 2839979 - RNA, 14 nt, Human
ugcauccagaggca

SEQ ID NO: 2839980 - RNA, 21 nt, Human
ugcauccagcaguacaauaaa

SEQ ID NO: 2839981 - RNA, 13 nt, Human
ugcauccaacucc

SEQ ID NO: 2839982 - RNA, 16 nt, Human
ugcauccaacuccagg

SEQ ID NO: 2839983 - RNA, 17 nt, Human
ugcauccaacuccagga

SEQ ID NO: 2839984 - RNA, 13 nt, Human
ugcaucagguccu

SEQ ID NO: 2839985 - RNA, 14 nt, Human
ugcaucaguauuaa

SEQ ID NO: 2839986 - RNA, 20 nt, Human
ugcaucaguauuaauacuaa

SEQ ID NO: 2839987 - RNA, 18 nt, Human
ugcauccuccgccucccg

SEQ ID NO: 2839988 - RNA, 15 nt, Human
ugcauccuccgccuc

SEQ ID NO: 2839989 - RNA, 13 nt, Human
ugcauccuuccua

SEQ ID NO: 2839990 - RNA, 14 nt, Human
ugcauccuuccuau

SEQ ID NO: 2839991 - RNA, 15 nt, Human
ugcauccuuccuaua

SEQ ID NO: 2839992 - RNA, 18 nt, Human
ugcauccuuccuauaacu

SEQ ID NO: 2839993 - RNA, 21 nt, Human
ugcauccuccgccucccgggu

SEQ ID NO: 2839994 - RNA, 21 nt, Human
ugcauuaaauucacaaacuuu

SEQ ID NO: 2839995 - RNA, 20 nt, Human
ugcauuaaauucacaaacuu

SEQ ID NO: 2839996 - RNA, 14 nt, Human
ugcaugugugugug

SEQ ID NO: 2839997 - RNA, 11 nt, Human
ugcaugugugu

SEQ ID NO: 2839998 - RNA, 13 nt, Human
ugcauguguguau

SEQ ID NO: 2839999 - RNA, 14 nt, Human
ugcauguguguaua

SEQ ID NO: 2840000 - RNA, 15 nt, Human
ugcauguguguauaa

SEQ ID NO: 2840001 - RNA, 19 nt, Human
ugcauguguguauaagugc

SEQ ID NO: 2840002 - RNA, 19 nt, Human
ugcauuaaauucacaaacu

SEQ ID NO: 2840003 - RNA, 17 nt, Human
ugcauuaaauucacaaa

SEQ ID NO: 2840004 - RNA, 16 nt, Human
ugcauuaaauucacaa

SEQ ID NO: 2840005 - RNA, 15 nt, Human
ugcauuaaauucaca

SEQ ID NO: 2840006 - RNA, 13 nt, Human
ugcauuaaaccug

SEQ ID NO: 2840007 - RNA, 14 nt, Human
ugcauuaaaccugu

SEQ ID NO: 2840008 - RNA, 15 nt, Human
ugcauuaaaccuguc

SEQ ID NO: 2840009 - RNA, 16 nt, Human
ugcauuaaaccugucu

SEQ ID NO: 2840010 - RNA, 21 nt, Human
ugcauuaaaccugucuccacu

SEQ ID NO: 2840011 - RNA, 14 nt, Human
ugcauuaaauucac

SEQ ID NO: 2840012 - RNA, 13 nt, Human
ugcauuaaauuca

SEQ ID NO: 2840013 - RNA, 13 nt, Human
ugcauuuuucugc

SEQ ID NO: 2840014 - RNA, 14 nt, Human
ugcauuuuucugca

SEQ ID NO: 2840015 - RNA, 15 nt, Human
ugcauuuuucugcag

SEQ ID NO: 2840016 - RNA, 17 nt, Human
ugcauuuuucugcagaa

SEQ ID NO: 2840017 - RNA, 20 nt, Human
ugccaaaaaaagacagggcu

SEQ ID NO: 2840018 - RNA, 19 nt, Human
ugccaaaaaggauacauaa

SEQ ID NO: 2840019 - RNA, 20 nt, Human
ugccaaaaaggauacauaau

SEQ ID NO: 2840020 - RNA, 21 nt, Human
ugccaaaaaggauacauaaug

SEQ ID NO: 2840021 - RNA, 13 nt, Human
ugccaacuccuca

SEQ ID NO: 2840022 - RNA, 21 nt, Human
ugccaacuucuucagagcuga

SEQ ID NO: 2840023 - RNA, 21 nt, Human
ugccaagaaaagggcugacau

SEQ ID NO: 2840024 - RNA, 14 nt, Human
ugccaacuguggcu

SEQ ID NO: 2840025 - RNA, 15 nt, Human
ugccaacuguggcug

SEQ ID NO: 2840026 - RNA, 16 nt, Human
ugccaacuguggcugg

SEQ ID NO: 2840027 - RNA, 17 nt, Human
ugccaacuguggcuggu

SEQ ID NO: 2840028 - RNA, 22 nt, Human
ugccaacuguucagcuguccuc

SEQ ID NO: 2840029 - RNA, 12 nt, Human
ugccaagacaaa

SEQ ID NO: 2840030 - RNA, 13 nt, Human
ugccaagacaaau

SEQ ID NO: 2840031 - RNA, 14 nt, Human
ugccaagacaaauc

SEQ ID NO: 2840032 - RNA, 16 nt, Human
ugccaagacaaaucaa

SEQ ID NO: 2840033 - RNA, 17 nt, Human
ugccaagacaaaucaac

SEQ ID NO: 2840034 - RNA, 19 nt, Human
ugccaagacaaaucaacag

SEQ ID NO: 2840035 - RNA, 22 nt, Human
ugccaagacaaaucaacagaag

SEQ ID NO: 2840036 - RNA, 23 nt, Human
ugccaagacaaaucaacagaagc

SEQ ID NO: 2840037 - RNA, 23 nt, Human
ugccaacuguuguaacuaggcuc

SEQ ID NO: 2840038 - RNA, 12 nt, Human
ugccaagagagg

SEQ ID NO: 2840039 - RNA, 18 nt, Human
uggaaccguugccaaccg

SEQ ID NO: 2840040 - RNA, 11 nt, Human
uggaacucuug

SEQ ID NO: 2840041 - RNA, 21 nt, Human
uggaacucuaucugggccugg

SEQ ID NO: 2840042 - RNA, 22 nt, Human
uggaacucuaucugggccuggg

SEQ ID NO: 2840043 - RNA, 23 nt, Human
uggaacucuaucugggccugggc

SEQ ID NO: 2840044 - RNA, 13 nt, Human
uggaagacagaga

SEQ ID NO: 2840045 - RNA, 15 nt, Human
uggaagacacauuga

SEQ ID NO: 2840046 - RNA, 22 nt, Human
uggaaaaaaugauguucauuua

SEQ ID NO: 2840047 - RNA, 11 nt, Human
uggaaaauaaa

SEQ ID NO: 2840048 - RNA, 15 nt, Human
uggaaaauaaaucaa

SEQ ID NO: 2840049 - RNA, 20 nt, Human
uggaaaaaccacccccaaau

SEQ ID NO: 2840050 - RNA, 17 nt, Human
ugcuuuuuuuuuuccag

SEQ ID NO: 2840051 - RNA, 19 nt, Human
ugcuuuuuuuuuuccagca

SEQ ID NO: 2840052 - RNA, 22 nt, Human
ugcuuuuuuuuuuccagcaagu

SEQ ID NO: 2840053 - RNA, 13 nt, Human
uggaaaaaaaaaa

SEQ ID NO: 2840054 - RNA, 16 nt, Human
uggaaaaaaaaaaaag

SEQ ID NO: 2840055 - RNA, 17 nt, Human
uggaaaaaaaaaaaaga

SEQ ID NO: 2840056 - RNA, 20 nt, Human
uggaaaaaaaaaaaagagga

SEQ ID NO: 2840057 - RNA, 21 nt, Human
uggaaaaaaaaaaaagaggaa

SEQ ID NO: 2840058 - RNA, 23 nt, Human
uggaaaaaaaaaaaagaggaaaa

SEQ ID NO: 2840059 - RNA, 21 nt, Human
uggaacccagcaguucuguua

SEQ ID NO: 2840060 - RNA, 21 nt, Human
uggaagugugugaucuguggg

SEQ ID NO: 2840061 - RNA, 20 nt, Human
uggaagacagagaccuccug

SEQ ID NO: 2840062 - RNA, 23 nt, Human
uggaagacagagaccuccugccu

SEQ ID NO: 2840063 - RNA, 18 nt, Human
uggaaguucauaccuaag

SEQ ID NO: 2840064 - RNA, 23 nt, Human
uggaaguucauaccuaaguacug

SEQ ID NO: 2840065 - RNA, 11 nt, Human
uggaaguugca

SEQ ID NO: 2840066 - RNA, 18 nt, Human
uggaaguguguguggcag

SEQ ID NO: 2840067 - RNA, 20 nt, Human
uggaaguguguguggcagca

SEQ ID NO: 2840068 - RNA, 16 nt, Human
uggaaguugcauggca

SEQ ID NO: 2840069 - RNA, 18 nt, Human
uggaaguugcauggcauc

SEQ ID NO: 2840070 - RNA, 22 nt, Human
uggaauacuaaaaaucaugaga

SEQ ID NO: 2840071 - RNA, 20 nt, Human
uggaauacuaaaaaucauga

SEQ ID NO: 2840072 - RNA, 18 nt, Human
uggaauacuuuuuguuau

SEQ ID NO: 2840073 - RNA, 14 nt, Human
uggaauaggaauaa

SEQ ID NO: 2840074 - RNA, 17 nt, Human
uggaauaggaauaagcu

SEQ ID NO: 2840075 - RNA, 13 nt, Human
uggaauacuuuuu

SEQ ID NO: 2840076 - RNA, 12 nt, Human
uggaauacuuuu

SEQ ID NO: 2840077 - RNA, 14 nt, Human
uggaauaauguaaa

SEQ ID NO: 2840078 - RNA, 14 nt, Human
uggaauacaugaaa

SEQ ID NO: 2840079 - RNA, 15 nt, Human
uggaauacaugaaau

SEQ ID NO: 2840080 - RNA, 21 nt, Human
uggaaucagauuuuaacagcu

SEQ ID NO: 2840081 - RNA, 18 nt, Human
uggaaucccacuguauga

SEQ ID NO: 2840082 - RNA, 17 nt, Human
uggaaucuggagaccag

SEQ ID NO: 2840083 - RNA, 18 nt, Human
uggaaucuggagaccagg

SEQ ID NO: 2840084 - RNA, 21 nt, Human
uggaauguggccccugaacaa

SEQ ID NO: 2840085 - RNA, 17 nt, Human
uggaauuaaaaggauag

SEQ ID NO: 2840086 - RNA, 21 nt, Human
uggaauuaaaaggauaguauu

SEQ ID NO: 2840087 - RNA, 16 nt, Human
uggaaugguuugggaa

SEQ ID NO: 2840088 - RNA, 23 nt, Human
uggaauguggccccugaacaaga

SEQ ID NO: 2840089 - RNA, 20 nt, Human
uggaauuagcuuggggccag

SEQ ID NO: 2840090 - RNA, 22 nt, Human
uggaauuagcuuggggccaggg

SEQ ID NO: 2840091 - RNA, 21 nt, Human
uggaauuaugcuggcuucuga

SEQ ID NO: 2840092 - RNA, 18 nt, Human
ugcuucugaaugugcuga

SEQ ID NO: 2840093 - RNA, 14 nt, Human
ugcugccuccagaa

SEQ ID NO: 2840094 - RNA, 13 nt, Human
ugcugccucaugc

SEQ ID NO: 2840095 - RNA, 19 nt, Human
ugcugccgccucccagccu

SEQ ID NO: 2840096 - RNA, 17 nt, Human
ugcugccgccucccagc

SEQ ID NO: 2840097 - RNA, 16 nt, Human
ugcugccgccucccag

SEQ ID NO: 2840098 - RNA, 21 nt, Human
ugcugccgccccacccagaug

SEQ ID NO: 2840099 - RNA, 23 nt, Human
ugcugccgccccacccagauggg

SEQ ID NO: 2840100 - RNA, 21 nt, Human
ugcugccgccucccagccugg

SEQ ID NO: 2840101 - RNA, 20 nt, Human
ugcugccgccucccagccug

SEQ ID NO: 2840102 - RNA, 17 nt, Human
ugcuuuauuccagaaug

SEQ ID NO: 2840103 - RNA, 16 nt, Human
ugcuuuauugcuuuuu

SEQ ID NO: 2840104 - RNA, 15 nt, Human
ugcuuuauuccagaa

SEQ ID NO: 2840105 - RNA, 14 nt, Human
ugcuuuauuccaga

SEQ ID NO: 2840106 - RNA, 14 nt, Human
ugcuuuuuuaaaua

SEQ ID NO: 2840107 - RNA, 17 nt, Human
ugcuuuuuuaaauauua

SEQ ID NO: 2840108 - RNA, 12 nt, Human
ugcuuucacucu

SEQ ID NO: 2840109 - RNA, 13 nt, Human
ugcuuuuuuguau

SEQ ID NO: 2840110 - RNA, 20 nt, Human
ugcuuuccagaauaauauga

SEQ ID NO: 2840111 - RNA, 12 nt, Human
ugcuucuuguga

SEQ ID NO: 2840112 - RNA, 14 nt, Human
ugcuucuugugaag

SEQ ID NO: 2840113 - RNA, 15 nt, Human
ugcuucuugugaagg

SEQ ID NO: 2840114 - RNA, 20 nt, Human
ugcuucuugugaaggccaug

SEQ ID NO: 2840115 - RNA, 12 nt, Human
ugcuuguuacau

SEQ ID NO: 2840116 - RNA, 19 nt, Human
ugcuuguucccucucccug

SEQ ID NO: 2840117 - RNA, 16 nt, Human
ugcuuguucccucucc

SEQ ID NO: 2840118 - RNA, 18 nt, Human
ugcuuguuaacugagugc

SEQ ID NO: 2840119 - RNA, 15 nt, Human
ugcuuuaugccuucu

SEQ ID NO: 2840120 - RNA, 13 nt, Human
ugcuuuaaagaua

SEQ ID NO: 2840121 - RNA, 16 nt, Human
ugcuuuaaagauaaaa

SEQ ID NO: 2840122 - RNA, 19 nt, Human
ugcuuuaaagggccugccu

SEQ ID NO: 2840123 - RNA, 20 nt, Human
ugcuuuaaagggccugccug

SEQ ID NO: 2840124 - RNA, 21 nt, Human
ugcuuuaaagggccugccugg

SEQ ID NO: 2840125 - RNA, 12 nt, Human
ugcuuguuuuau

SEQ ID NO: 2840126 - RNA, 13 nt, Human
ugcuuguuucuug

SEQ ID NO: 2840127 - RNA, 15 nt, Human
ugcuuguuucuuggu

SEQ ID NO: 2840128 - RNA, 17 nt, Human
uggaggccuuccagcug

SEQ ID NO: 2840129 - RNA, 18 nt, Human
uggaggccuuccagcugc

SEQ ID NO: 2840130 - RNA, 19 nt, Human
uggaggccuuccagcugcu

SEQ ID NO: 2840131 - RNA, 20 nt, Human
uggaggccuuccagcugcug

SEQ ID NO: 2840132 - RNA, 21 nt, Human
uggaggccuuccagcugcugu

SEQ ID NO: 2840133 - RNA, 16 nt, Human
uggaggcccuccugug

SEQ ID NO: 2840134 - RNA, 21 nt, Human
uggaggcccuccugugcuggg

SEQ ID NO: 2840135 - RNA, 15 nt, Human
uggaggcagugucau

SEQ ID NO: 2840136 - RNA, 16 nt, Human
uggaggcagugucauu

SEQ ID NO: 2840137 - RNA, 17 nt, Human
uggaggcagccagggcu

SEQ ID NO: 2840138 - RNA, 18 nt, Human
uggaggcagccagggcuu

SEQ ID NO: 2840139 - RNA, 14 nt, Human
uggauacuacaucu

SEQ ID NO: 2840140 - RNA, 15 nt, Human
uggauacuacaucuu

SEQ ID NO: 2840141 - RNA, 15 nt, Human
uggauacagcaguag

SEQ ID NO: 2840142 - RNA, 18 nt, Human
uggauacagcaguagaca

SEQ ID NO: 2840143 - RNA, 19 nt, Human
uggauacagcaguagacau

SEQ ID NO: 2840144 - RNA, 16 nt, Human
uggauaggagccugcu

SEQ ID NO: 2840145 - RNA, 15 nt, Human
uggauauaaaaugug

SEQ ID NO: 2840146 - RNA, 13 nt, Human
uggauagcuaaua

SEQ ID NO: 2840147 - RNA, 17 nt, Human
uggauagcuaauaauga

SEQ ID NO: 2840148 - RNA, 14 nt, Human
uggaucuugaaugu

SEQ ID NO: 2840149 - RNA, 15 nt, Human
uggaucuugaaugug

SEQ ID NO: 2840150 - RNA, 16 nt, Human
uggaucuugaaugugg

SEQ ID NO: 2840151 - RNA, 19 nt, Human
uggaucuugaauguggucu

SEQ ID NO: 2840152 - RNA, 21 nt, Human
uggaugauggucuucagccuc

SEQ ID NO: 2840153 - RNA, 20 nt, Human
uggaugauggucuucagccu

SEQ ID NO: 2840154 - RNA, 17 nt, Human
uggaugagcccucagaa

SEQ ID NO: 2840155 - RNA, 15 nt, Human
uggaugaucaauccu

SEQ ID NO: 2840156 - RNA, 19 nt, Human
uggaggcugacgugugagg

SEQ ID NO: 2840157 - RNA, 15 nt, Human
uggaugagcccucag

SEQ ID NO: 2840158 - RNA, 14 nt, Human
uggaugaaauuuuc

SEQ ID NO: 2840159 - RNA, 16 nt, Human
uggaucuuuucauucu

SEQ ID NO: 2840160 - RNA, 15 nt, Human
uggaugaaauuuucu

SEQ ID NO: 2840161 - RNA, 17 nt, Human
uggaugaaauuuucuag

SEQ ID NO: 2840162 - RNA, 18 nt, Human
uggaugaaauuuucuaga

SEQ ID NO: 2840163 - RNA, 16 nt, Human
uggacaggcauguucu

SEQ ID NO: 2840164 - RNA, 12 nt, Human
uggacaggcaug

SEQ ID NO: 2840165 - RNA, 17 nt, Human
uggagacugucucaaga

SEQ ID NO: 2840166 - RNA, 18 nt, Human
uggagacuuucuuuaaau

SEQ ID NO: 2840167 - RNA, 21 nt, Human
uggagagaaacaauaaagaga

SEQ ID NO: 2840168 - RNA, 22 nt, Human
uggagagaaacaauaaagagau

SEQ ID NO: 2840169 - RNA, 14 nt, Human
uggagagaggauuu

SEQ ID NO: 2840170 - RNA, 15 nt, Human
uggagagaaggccuc

SEQ ID NO: 2840171 - RNA, 21 nt, Human
uggagagaaggccucccuagc

SEQ ID NO: 2840172 - RNA, 18 nt, Human
uggagaugcugagggugu

SEQ ID NO: 2840173 - RNA, 16 nt, Human
uggagagucagaucuu

SEQ ID NO: 2840174 - RNA, 16 nt, Human
uggagagugagcuaca

SEQ ID NO: 2840175 - RNA, 19 nt, Human
uggagagggcucugugcug

SEQ ID NO: 2840176 - RNA, 23 nt, Human
uggagaggagggaugcugccuga

SEQ ID NO: 2840177 - RNA, 21 nt, Human
uggagaggagggaugcugccu

SEQ ID NO: 2840178 - RNA, 20 nt, Human
uggagaggcccggccucuca

SEQ ID NO: 2840179 - RNA, 22 nt, Human
uggagaggagggaugcugccug

SEQ ID NO: 2840180 - RNA, 20 nt, Human
uggccacuccagaccccugg

SEQ ID NO: 2840181 - RNA, 22 nt, Human
uggccacuccagaccccuggcu

SEQ ID NO: 2840182 - RNA, 20 nt, Human
uggcagugggagcugccugu

SEQ ID NO: 2840183 - RNA, 16 nt, Human
uggcaguguuuugaga

SEQ ID NO: 2840184 - RNA, 17 nt, Human
uggcaguguuuugagaa

SEQ ID NO: 2840185 - RNA, 18 nt, Human
uggcaguguuuugagaac

SEQ ID NO: 2840186 - RNA, 16 nt, Human
uggcaguuugguauuu

SEQ ID NO: 2840187 - RNA, 18 nt, Human
uggcaguuuugacaucag

SEQ ID NO: 2840188 - RNA, 21 nt, Human
uggcaguuuugacaucagcca

SEQ ID NO: 2840189 - RNA, 16 nt, Human
uggccacuuuaagaga

SEQ ID NO: 2840190 - RNA, 22 nt, Human
uggccacuuuaagagagaaauc

SEQ ID NO: 2840191 - RNA, 14 nt, Human
uggccacugcuccc

SEQ ID NO: 2840192 - RNA, 16 nt, Human
uggccacugcucccua

SEQ ID NO: 2840193 - RNA, 19 nt, Human
uggccacugcucccuaagc

SEQ ID NO: 2840194 - RNA, 20 nt, Human
uggccacugcucccuaagcc

SEQ ID NO: 2840195 - RNA, 17 nt, Human
uggccacuucuguccau

SEQ ID NO: 2840196 - RNA, 12 nt, Human
uggccagacucg

SEQ ID NO: 2840197 - RNA, 15 nt, Human
uggccagacucgaug

SEQ ID NO: 2840198 - RNA, 19 nt, Human
uggcagugggagcugccug

SEQ ID NO: 2840199 - RNA, 16 nt, Human
uggcagugggagcugc

SEQ ID NO: 2840200 - RNA, 15 nt, Human
uggcagugggagcug

SEQ ID NO: 2840201 - RNA, 14 nt, Human
uggcagugggagcu

SEQ ID NO: 2840202 - RNA, 13 nt, Human
uggcagugggagc

SEQ ID NO: 2840203 - RNA, 19 nt, Human
uggcagggaggucaggccc

SEQ ID NO: 2840204 - RNA, 20 nt, Human
uggcagggaggucaggcccu

SEQ ID NO: 2840205 - RNA, 21 nt, Human
uggcagggaggucaggcccug

SEQ ID NO: 2840206 - RNA, 22 nt, Human
uggcagggaggucaggcccugg

SEQ ID NO: 2840207 - RNA, 22 nt, Human
uggcagcugcgguccacccagg

SEQ ID NO: 2840208 - RNA, 21 nt, Human
uggcagcugcgguccacccag

SEQ ID NO: 2840209 - RNA, 23 nt, Human
uggcagcugcgguccacccagga

SEQ ID NO: 2840210 - RNA, 19 nt, Human
uggcaggauggccuggcca

SEQ ID NO: 2840211 - RNA, 21 nt, Human
uggcagaagacaccagagcag

SEQ ID NO: 2840212 - RNA, 20 nt, Human
uggcaggauggccuggccag

SEQ ID NO: 2840213 - RNA, 21 nt, Human
uggcagaaaaaaugucuguaa

SEQ ID NO: 2840214 - RNA, 13 nt, Human
uggcagaagacac

SEQ ID NO: 2840215 - RNA, 14 nt, Human
uggcagaagacacc

SEQ ID NO: 2840216 - RNA, 18 nt, Human
uggcagaagacaccagag

SEQ ID NO: 2840217 - RNA, 20 nt, Human
uggcagaagacaccagagca

SEQ ID NO: 2840218 - RNA, 19 nt, Human
uggcagcugcgguccaccc

SEQ ID NO: 2840219 - RNA, 20 nt, Human
uggcagaaaaaaugucugua

SEQ ID NO: 2840220 - RNA, 18 nt, Human
uggcacuugccuggguca

SEQ ID NO: 2840221 - RNA, 11 nt, Human
uggcacuuuga

SEQ ID NO: 2840222 - RNA, 16 nt, Human
uggcacuuugaagggg

SEQ ID NO: 2840223 - RNA, 17 nt, Human
uggcacuugccuggguc

SEQ ID NO: 2840224 - RNA, 16 nt, Human
uggcacuugccugggu

SEQ ID NO: 2840225 - RNA, 15 nt, Human
uggcacuugccuggg

SEQ ID NO: 2840226 - RNA, 14 nt, Human
uggcacuugccugg

SEQ ID NO: 2840227 - RNA, 10 nt, Human
uggcacugau

SEQ ID NO: 2840228 - RNA, 13 nt, Human
uggcacugccaug

SEQ ID NO: 2840229 - RNA, 21 nt, Human
uggcacuuagcuaucagaaga

SEQ ID NO: 2840230 - RNA, 15 nt, Human
uggcacuuaucauua

SEQ ID NO: 2840231 - RNA, 14 nt, Human
uggaugccuggugg

SEQ ID NO: 2840232 - RNA, 22 nt, Human
uggaugccagggccgaccagag

SEQ ID NO: 2840233 - RNA, 13 nt, Human
uggaugccugauu

SEQ ID NO: 2840234 - RNA, 20 nt, Human
uggaugccaauauuaaaucu

SEQ ID NO: 2840235 - RNA, 20 nt, Human
uggaugcauguuuuccagcu

SEQ ID NO: 2840236 - RNA, 22 nt, Human
uggaugcauguuuuccagcucc

SEQ ID NO: 2840237 - RNA, 20 nt, Human
uggaugccacagcccagcuu

SEQ ID NO: 2840238 - RNA, 21 nt, Human
uggaugccaauauuaaaucug

SEQ ID NO: 2840239 - RNA, 18 nt, Human
ugggucaccccuccagga

SEQ ID NO: 2840240 - RNA, 22 nt, Human
uggguagcugccacuugaacaa

SEQ ID NO: 2840241 - RNA, 21 nt, Human
uggguagugagcagugagcag

SEQ ID NO: 2840242 - RNA, 12 nt, Human
ugggucagucug

SEQ ID NO: 2840243 - RNA, 23 nt, Human
ugggucaguguccaaagcagggu

SEQ ID NO: 2840244 - RNA, 14 nt, Human
ugggucaggccacc

SEQ ID NO: 2840245 - RNA, 20 nt, Human
uggggcaggcugggccaugu

SEQ ID NO: 2840246 - RNA, 18 nt, Human
uggggcaggcugggccau

SEQ ID NO: 2840247 - RNA, 17 nt, Human
uggggcaggcugggcca

SEQ ID NO: 2840248 - RNA, 16 nt, Human
uggggcaggcugggcc

SEQ ID NO: 2840249 - RNA, 15 nt, Human
uggggcaggcugggc

SEQ ID NO: 2840250 - RNA, 14 nt, Human
uggggcaggcuggg

SEQ ID NO: 2840251 - RNA, 23 nt, Human
ugggugucaagagggucugagga

SEQ ID NO: 2840252 - RNA, 21 nt, Human
ugggugucaagagggucugag

SEQ ID NO: 2840253 - RNA, 16 nt, Human
uggguucacugcaacc

SEQ ID NO: 2840254 - RNA, 24 nt, Human
uggguucaggggacucagcccuga

SEQ ID NO: 2840255 - RNA, 15 nt, Human
uggguuauucuggag

SEQ ID NO: 2840256 - RNA, 16 nt, Human
uggguuauucuggagu

SEQ ID NO: 2840257 - RNA, 17 nt, Human
uggguuauucuggaguu

SEQ ID NO: 2840258 - RNA, 23 nt, Human
uggguucaagcgauucuucugcu

SEQ ID NO: 2840259 - RNA, 14 nt, Human
ugggugucauuuca

SEQ ID NO: 2840260 - RNA, 19 nt, Human
ugggugucauuucauucca

SEQ ID NO: 2840261 - RNA, 20 nt, Human
ugggugucauuucauuccau

SEQ ID NO: 2840262 - RNA, 20 nt, Human
uggguucccuuuccuuccau

SEQ ID NO: 2840263 - RNA, 21 nt, Human
uggguuccucuuccccacucc

SEQ ID NO: 2840264 - RNA, 13 nt, Human
uggguuccucuuc

SEQ ID NO: 2840265 - RNA, 22 nt, Human
uggguuccuuccucugagccuu

SEQ ID NO: 2840266 - RNA, 21 nt, Human
uggguuccuuccucugagccu

SEQ ID NO: 2840267 - RNA, 16 nt, Human
uggguucaugaugcag

SEQ ID NO: 2840268 - RNA, 17 nt, Human
uggguucaugaugcagu

SEQ ID NO: 2840269 - RNA, 19 nt, Human
uggguucaugaugcagucu

SEQ ID NO: 2840270 - RNA, 21 nt, Human
uggguuccagcaauucuccug

SEQ ID NO: 2840271 - RNA, 18 nt, Human
uggguuccaauccuggcu

SEQ ID NO: 2840272 - RNA, 16 nt, Human
uggguuggugcuucua

SEQ ID NO: 2840273 - RNA, 14 nt, Human
uggguugacuuuca

SEQ ID NO: 2840274 - RNA, 15 nt, Human
uggguugcuaacuga

SEQ ID NO: 2840275 - RNA, 17 nt, Human
uggguugcuaacugaac

SEQ ID NO: 2840276 - RNA, 17 nt, Human
uggguuggaaaacagua

SEQ ID NO: 2840277 - RNA, 18 nt, Human
ugggaggagcagauuuuu

SEQ ID NO: 2840278 - RNA, 13 nt, Human
ugggaggagcaga

SEQ ID NO: 2840279 - RNA, 20 nt, Human
ugggaggacggugcaaccca

SEQ ID NO: 2840280 - RNA, 13 nt, Human
ugggaggaagcag

SEQ ID NO: 2840281 - RNA, 24 nt, Human
ugggaggaagcagguugaggggcu

SEQ ID NO: 2840282 - RNA, 19 nt, Human
ugggaggacggugcaaccc

SEQ ID NO: 2840283 - RNA, 24 nt, Human
ugggagcugccuguucagcuccag

SEQ ID NO: 2840284 - RNA, 18 nt, Human
ugggagcugguuagaaau

SEQ ID NO: 2840285 - RNA, 20 nt, Human
ugggagcugguuagaaaugc

SEQ ID NO: 2840286 - RNA, 16 nt, Human
ugggagcuugggaaug

SEQ ID NO: 2840287 - RNA, 19 nt, Human
ugggagcugguuagaaaug

SEQ ID NO: 2840288 - RNA, 11 nt, Human
ugggaggaagc

SEQ ID NO: 2840289 - RNA, 16 nt, Human
ugggaggaaagagagc

SEQ ID NO: 2840290 - RNA, 18 nt, Human
ugggaggaaagagagcag

SEQ ID NO: 2840291 - RNA, 18 nt, Human
ugggccuucagggaguga

SEQ ID NO: 2840292 - RNA, 15 nt, Human
ugggccuucagggag

SEQ ID NO: 2840293 - RNA, 22 nt, Human
ugggccuccugugugugcgccu

SEQ ID NO: 2840294 - RNA, 16 nt, Human
ugggccuccugugugu

SEQ ID NO: 2840295 - RNA, 14 nt, Human
ugggccuccugugu

SEQ ID NO: 2840296 - RNA, 20 nt, Human
ugggcaugguaccagcccug

SEQ ID NO: 2840297 - RNA, 21 nt, Human
ugggcaugguaccagcccugg

SEQ ID NO: 2840298 - RNA, 22 nt, Human
ugggcaugguaccagcccuggg

SEQ ID NO: 2840299 - RNA, 12 nt, Human
ugggcauggugc

SEQ ID NO: 2840300 - RNA, 14 nt, Human
ugggcaugugggcu

SEQ ID NO: 2840301 - RNA, 15 nt, Human
ugggcaugugggcuu

SEQ ID NO: 2840302 - RNA, 16 nt, Human
ugggcaugugggcuuc

SEQ ID NO: 2840303 - RNA, 17 nt, Human
ugggcaugugggcuuca

SEQ ID NO: 2840304 - RNA, 20 nt, Human
ugggccuccucacaacaugg

SEQ ID NO: 2840305 - RNA, 16 nt, Human
ugggcauagaugcagg

SEQ ID NO: 2840306 - RNA, 22 nt, Human
ugggcauagaugcaggugagcc

SEQ ID NO: 2840307 - RNA, 19 nt, Human
ugggcuucaguggcagcug

SEQ ID NO: 2840308 - RNA, 18 nt, Human
ugggcuucaguggcagcu

SEQ ID NO: 2840309 - RNA, 16 nt, Human
ugggcgggcccagcac

SEQ ID NO: 2840310 - RNA, 17 nt, Human
ugggcgugagaccugcc

SEQ ID NO: 2840311 - RNA, 19 nt, Human
ugggcgugagaccugcccc

SEQ ID NO: 2840312 - RNA, 18 nt, Human
ugggcgugagaccugccc

SEQ ID NO: 2840313 - RNA, 15 nt, Human
ugggcauaaacuguu

SEQ ID NO: 2840314 - RNA, 16 nt, Human
ugggcggcucugaagc

SEQ ID NO: 2840315 - RNA, 16 nt, Human
uggggcagcuugaggg

SEQ ID NO: 2840316 - RNA, 20 nt, Human
ugggcuucaguggcagcugc

SEQ ID NO: 2840317 - RNA, 17 nt, Human
ugggcguacgcuggugc

SEQ ID NO: 2840318 - RNA, 18 nt, Human
ugggcguacgcuggugcu

SEQ ID NO: 2840319 - RNA, 19 nt, Human
ugggcguacgcuggugcug

SEQ ID NO: 2840320 - RNA, 21 nt, Human
ugggcguacgcuggugcugag

SEQ ID NO: 2840321 - RNA, 15 nt, Human
ugggaaugagacaua

SEQ ID NO: 2840322 - RNA, 14 nt, Human
uggcuuuucacugc

SEQ ID NO: 2840323 - RNA, 21 nt, Human
uggcuguaaggcucuagauca

SEQ ID NO: 2840324 - RNA, 19 nt, Human
uggcuguaaggcucuagau

SEQ ID NO: 2840325 - RNA, 20 nt, Human
uggcuguaaggcucuagauc

SEQ ID NO: 2840326 - RNA, 15 nt, Human
uggcuguaaggcucu

SEQ ID NO: 2840327 - RNA, 16 nt, Human
uggcuguaaggcucua

SEQ ID NO: 2840328 - RNA, 14 nt, Human
uggcugggggccuc

SEQ ID NO: 2840329 - RNA, 17 nt, Human
uggcuguagaucccaag

SEQ ID NO: 2840330 - RNA, 18 nt, Human
uggcuguagaucccaaga

SEQ ID NO: 2840331 - RNA, 16 nt, Human
ugggacagggcauggc

SEQ ID NO: 2840332 - RNA, 20 nt, Human
ugggacaguuuaucaugaag

SEQ ID NO: 2840333 - RNA, 22 nt, Human
ugggacaguuuaucaugaagcc

SEQ ID NO: 2840334 - RNA, 23 nt, Human
ugggacaguuuaucaugaagccu

SEQ ID NO: 2840335 - RNA, 19 nt, Human
ugggaccacgugagaucau

SEQ ID NO: 2840336 - RNA, 13 nt, Human
ugggacccugcuu

SEQ ID NO: 2840337 - RNA, 19 nt, Human
ugggacccugcuuuagagc

SEQ ID NO: 2840338 - RNA, 23 nt, Human
ugggacccugcuuuagagcuagg

SEQ ID NO: 2840339 - RNA, 20 nt, Human
ugggacccauagaucuucug

SEQ ID NO: 2840340 - RNA, 21 nt, Human
ugggacccauagaucuucuga

SEQ ID NO: 2840341 - RNA, 13 nt, Human
ugggaccccaggc

SEQ ID NO: 2840342 - RNA, 15 nt, Human
ugggaccccaggccc

SEQ ID NO: 2840343 - RNA, 16 nt, Human
ugggaccccaggccca

SEQ ID NO: 2840344 - RNA, 22 nt, Human
ugggaccccaggcccacucagg

SEQ ID NO: 2840345 - RNA, 23 nt, Human
ugggagcugccuguucagcucca

SEQ ID NO: 2840346 - RNA, 22 nt, Human
ugggagcuccucuccuggagga

SEQ ID NO: 2840347 - RNA, 23 nt, Human
ugggagcuccucuccuggaggau

SEQ ID NO: 2840348 - RNA, 18 nt, Human
ugggagcuccucuccugg

SEQ ID NO: 2840349 - RNA, 19 nt, Human
ugggagcuccucuccugga

SEQ ID NO: 2840350 - RNA, 20 nt, Human
ugggagcuccucuccuggag

SEQ ID NO: 2840351 - RNA, 21 nt, Human
ugggagcuccucuccuggagg

SEQ ID NO: 2840352 - RNA, 13 nt, Human
ugggagcuccucu

SEQ ID NO: 2840353 - RNA, 14 nt, Human
ugggagcuccucuc

SEQ ID NO: 2840354 - RNA, 15 nt, Human
ugggagcuccucucc

SEQ ID NO: 2840355 - RNA, 16 nt, Human
ugggagcuccucuccu

SEQ ID NO: 2840356 - RNA, 17 nt, Human
ugggagcuccucuccug

SEQ ID NO: 2840357 - RNA, 15 nt, Human
ugggagccucugggg

SEQ ID NO: 2840358 - RNA, 22 nt, Human
ugggagcgucaggguuggugug

SEQ ID NO: 2840359 - RNA, 13 nt, Human
ugggagccccagg

SEQ ID NO: 2840360 - RNA, 16 nt, Human
ugggagccccaggguc

SEQ ID NO: 2840361 - RNA, 14 nt, Human
ugggagccccaggg

SEQ ID NO: 2840362 - RNA, 11 nt, Human
ugggagcagga

SEQ ID NO: 2840363 - RNA, 13 nt, Human
ugggagcaggaga

SEQ ID NO: 2840364 - RNA, 14 nt, Human
ugggagcaggagau

SEQ ID NO: 2840365 - RNA, 22 nt, Human
ugggagcaggagauugagaagg

SEQ ID NO: 2840366 - RNA, 23 nt, Human
ugggagcaggagauugagaagga

SEQ ID NO: 2840367 - RNA, 15 nt, Human
ugggagcaggauuuu

SEQ ID NO: 2840368 - RNA, 14 nt, Human
ugggagcaguccau

SEQ ID NO: 2840369 - RNA, 17 nt, Human
ugggagcaguccaugca

SEQ ID NO: 2840370 - RNA, 19 nt, Human
ugggagcaguccaugcaug

SEQ ID NO: 2840371 - RNA, 23 nt, Human
ugggagccccagggucuucccua

SEQ ID NO: 2840372 - RNA, 22 nt, Human
ugggagccccagggucuucccu

SEQ ID NO: 2840373 - RNA, 18 nt, Human
uggccuugaaaccaccuu

SEQ ID NO: 2840374 - RNA, 24 nt, Human
uggccagagcugggaggcauggcc

SEQ ID NO: 2840375 - RNA, 12 nt, Human
uggccuugcuga

SEQ ID NO: 2840376 - RNA, 21 nt, Human
uggccuuggcuuuucuagccu

SEQ ID NO: 2840377 - RNA, 14 nt, Human
uggccuuuccucuc

SEQ ID NO: 2840378 - RNA, 15 nt, Human
uggccagaugcacca

SEQ ID NO: 2840379 - RNA, 20 nt, Human
uggccagagcugggaggcau

SEQ ID NO: 2840380 - RNA, 23 nt, Human
uggccagagcugggaggcauggc

SEQ ID NO: 2840381 - RNA, 14 nt, Human
uggccagagcuggg

SEQ ID NO: 2840382 - RNA, 15 nt, Human
uggccagagcuggga

SEQ ID NO: 2840383 - RNA, 17 nt, Human
uggccagagcugggagg

SEQ ID NO: 2840384 - RNA, 18 nt, Human
uggccagagcugggaggc

SEQ ID NO: 2840385 - RNA, 17 nt, Human
uggcgccaccagcucug

SEQ ID NO: 2840386 - RNA, 17 nt, Human
uggcgcuauuacaaaua

SEQ ID NO: 2840387 - RNA, 22 nt, Human
uggcgugcaguggugcgaucug

SEQ ID NO: 2840388 - RNA, 15 nt, Human
uggcucgccaggcca

SEQ ID NO: 2840389 - RNA, 21 nt, Human
uggcucucaguuaaaauguga

SEQ ID NO: 2840390 - RNA, 14 nt, Human
uggcucuggagaca

SEQ ID NO: 2840391 - RNA, 19 nt, Human
uggcucucauugacuuccu

SEQ ID NO: 2840392 - RNA, 21 nt, Human
uggcucuggagacagccccag

SEQ ID NO: 2840393 - RNA, 12 nt, Human
uggcugggggcc

SEQ ID NO: 2840394 - RNA, 17 nt, Human
uggcugggggcaggagg

SEQ ID NO: 2840395 - RNA, 16 nt, Human
uggcugggggcaggag

SEQ ID NO: 2840396 - RNA, 22 nt, Human
uggcucuggagacagccccaga

SEQ ID NO: 2840397 - RNA, 18 nt, Human
uggcucuguggcuugcua

SEQ ID NO: 2840398 - RNA, 14 nt, Human
uggcguggagcagg

SEQ ID NO: 2840399 - RNA, 15 nt, Human
uggcguggagcaggc

SEQ ID NO: 2840400 - RNA, 13 nt, Human
uggcguggauuaa

SEQ ID NO: 2840401 - RNA, 16 nt, Human
uggcguggauuaaacu

SEQ ID NO: 2840402 - RNA, 18 nt, Human
uggcguggauuaaacuua

SEQ ID NO: 2840403 - RNA, 18 nt, Human
uggcgugucccucucgga

SEQ ID NO: 2840404 - RNA, 14 nt, Human
uggcguuguugcau

SEQ ID NO: 2840405 - RNA, 12 nt, Human
uggcuaaagaua

SEQ ID NO: 2840406 - RNA, 18 nt, Human
uggcuaaagauaauugcu

SEQ ID NO: 2840407 - RNA, 22 nt, Human
uggcuaaagauaauugcuauuu

SEQ ID NO: 2840408 - RNA, 20 nt, Human
uggcuaaaugccuaauaaac

SEQ ID NO: 2840409 - RNA, 24 nt, Human
uggcucagcucggggagccuuagc

SEQ ID NO: 2840410 - RNA, 14 nt, Human
uggcuccuuuacaa

SEQ ID NO: 2840411 - RNA, 15 nt, Human
uggcuccuuuacaaa

SEQ ID NO: 2840412 - RNA, 16 nt, Human
uggcuccuuuacaaaa

SEQ ID NO: 2840413 - RNA, 18 nt, Human
uggcuccuuuacaaaaga

SEQ ID NO: 2840414 - RNA, 20 nt, Human
uggcuccugaggggcaucug

SEQ ID NO: 2840415 - RNA, 17 nt, Human
uggcuccuucccaucgc

SEQ ID NO: 2840416 - RNA, 19 nt, Human
uggcuccuucccaucgcug

SEQ ID NO: 2840417 - RNA, 23 nt, Human
uggcuccugaggggcaucugccc

SEQ ID NO: 2840418 - RNA, 21 nt, Human
uggcuccugaggggcaucugc

SEQ ID NO: 2840419 - RNA, 14 nt, Human
uuaaaacauguaau

SEQ ID NO: 2840420 - RNA, 13 nt, Human
uuaaaacauguaa

SEQ ID NO: 2840421 - RNA, 12 nt, Human
uuaaaacagcug

SEQ ID NO: 2840422 - RNA, 21 nt, Human
uuaaaacagcugcauuagaaa

SEQ ID NO: 2840423 - RNA, 13 nt, Human
uuaaaacaguauu

SEQ ID NO: 2840424 - RNA, 20 nt, Human
uuaaaacaguauuuauuuug

SEQ ID NO: 2840425 - RNA, 22 nt, Human
uuaaaacaguauuuauuuugua

SEQ ID NO: 2840426 - RNA, 23 nt, Human
uuaaaacaguauuuauuuuguaa

SEQ ID NO: 2840427 - RNA, 11 nt, Human
uuaaaagagag

SEQ ID NO: 2840428 - RNA, 23 nt, Human
uuaaaagagagagagagaaaaaa

SEQ ID NO: 2840429 - RNA, 18 nt, Human
uuaaagcugccuguaguu

SEQ ID NO: 2840430 - RNA, 17 nt, Human
uuaaagcugccuguagu

SEQ ID NO: 2840431 - RNA, 15 nt, Human
uuaaagcugccugua

SEQ ID NO: 2840432 - RNA, 14 nt, Human
uuaaagcugccugu

SEQ ID NO: 2840433 - RNA, 21 nt, Human
uuaaagauuuaucaaaucagu

SEQ ID NO: 2840434 - RNA, 16 nt, Human
uuaaagcaaaaaauga

SEQ ID NO: 2840435 - RNA, 17 nt, Human
uuaaagcaaaaaaugaa

SEQ ID NO: 2840436 - RNA, 14 nt, Human
uuaaagccuccuca

SEQ ID NO: 2840437 - RNA, 18 nt, Human
uuaaagccuuuaguauca

SEQ ID NO: 2840438 - RNA, 22 nt, Human
uuaaagccuuuaguaucagugu

SEQ ID NO: 2840439 - RNA, 14 nt, Human
uuaaagauuuauca

SEQ ID NO: 2840440 - RNA, 17 nt, Human
uuaaagauuuaucaaau

SEQ ID NO: 2840441 - RNA, 19 nt, Human
uuaaagagucuagauucaa

SEQ ID NO: 2840442 - RNA, 16 nt, Human
uuaaacuguuagcacu

SEQ ID NO: 2840443 - RNA, 18 nt, Human
uuaaacuguuagcacugu

SEQ ID NO: 2840444 - RNA, 19 nt, Human
uuaaacuguuagcacuguu

SEQ ID NO: 2840445 - RNA, 20 nt, Human
uuaaacuguuagcacuguug

SEQ ID NO: 2840446 - RNA, 21 nt, Human
uuaaacuguuagcacuguuga

SEQ ID NO: 2840447 - RNA, 22 nt, Human
uuaaacuguuagcacuguugau

SEQ ID NO: 2840448 - RNA, 12 nt, Human
uuaaagagucua

SEQ ID NO: 2840449 - RNA, 14 nt, Human
uuaaagagucuaga

SEQ ID NO: 2840450 - RNA, 15 nt, Human
uuaaagagucuagau

SEQ ID NO: 2840451 - RNA, 16 nt, Human
uuaaagagucuagauu

SEQ ID NO: 2840452 - RNA, 17 nt, Human
uuaaagagucuagauuc

SEQ ID NO: 2840453 - RNA, 18 nt, Human
uuaaagagucuagauuca

SEQ ID NO: 2840454 - RNA, 23 nt, Human
uuaaagagucuagauucaaaggu

SEQ ID NO: 2840455 - RNA, 14 nt, Human
uuaaagauauuguu

SEQ ID NO: 2840456 - RNA, 17 nt, Human
uuaaagauauuguucaa

SEQ ID NO: 2840457 - RNA, 19 nt, Human
uuaaagauauuguucaaac

SEQ ID NO: 2840458 - RNA, 18 nt, Human
uuaaagaucaugacauau

SEQ ID NO: 2840459 - RNA, 22 nt, Human
uuaaagaucuguaaguaacuuc

SEQ ID NO: 2840460 - RNA, 17 nt, Human
uuaaagaugaacucuga

SEQ ID NO: 2840461 - RNA, 18 nt, Human
uuaaagaugaacucugaa

SEQ ID NO: 2840462 - RNA, 13 nt, Human
uuaacauuauuua

SEQ ID NO: 2840463 - RNA, 13 nt, Human
uuaacauuccaag

SEQ ID NO: 2840464 - RNA, 22 nt, Human
uuaacauuccuaaaaugcuuca

SEQ ID NO: 2840465 - RNA, 14 nt, Human
uuaacauuccaaga

SEQ ID NO: 2840466 - RNA, 17 nt, Human
uuaacauuccaagacuc

SEQ ID NO: 2840467 - RNA, 14 nt, Human
uuaacaucaugaau

SEQ ID NO: 2840468 - RNA, 22 nt, Human
uuaacaugaacacccuuagaaa

SEQ ID NO: 2840469 - RNA, 21 nt, Human
uuaacaugacauuuaccagca

SEQ ID NO: 2840470 - RNA, 19 nt, Human
uuaacaugggcucuucacu

SEQ ID NO: 2840471 - RNA, 20 nt, Human
uuaacaugggcucuucacua

SEQ ID NO: 2840472 - RNA, 22 nt, Human
uuaacaugggcucuucacuagu

SEQ ID NO: 2840473 - RNA, 17 nt, Human
uuaacauauuuacuaag

SEQ ID NO: 2840474 - RNA, 23 nt, Human
uuaacauaguaaguucagcacuu

SEQ ID NO: 2840475 - RNA, 16 nt, Human
uuaaauguaaauaauc

SEQ ID NO: 2840476 - RNA, 16 nt, Human
uuaaauguacagacau

SEQ ID NO: 2840477 - RNA, 19 nt, Human
uuaaauguacagacauauu

SEQ ID NO: 2840478 - RNA, 21 nt, Human
uuaaauguacagacauauuua

SEQ ID NO: 2840479 - RNA, 21 nt, Human
uuaaaugggaauauuuauaaa

SEQ ID NO: 2840480 - RNA, 20 nt, Human
uuaaauggaaaaaaugaugu

SEQ ID NO: 2840481 - RNA, 14 nt, Human
uuaaauauagauua

SEQ ID NO: 2840482 - RNA, 17 nt, Human
uuaaauauagauuagaa

SEQ ID NO: 2840483 - RNA, 18 nt, Human
uuaaauauagauuagaaa

SEQ ID NO: 2840484 - RNA, 12 nt, Human
uuaaauauaguu

SEQ ID NO: 2840485 - RNA, 23 nt, Human
uuaaauauaguuccuaagaagcu

SEQ ID NO: 2840486 - RNA, 16 nt, Human
uuaaagcaagcaacac

SEQ ID NO: 2840487 - RNA, 18 nt, Human
uuaaauaguuauauaauu

SEQ ID NO: 2840488 - RNA, 18 nt, Human
uuaaauaggauauuaaca

SEQ ID NO: 2840489 - RNA, 18 nt, Human
uuaaauaguaaaaauaaa

SEQ ID NO: 2840490 - RNA, 12 nt, Human
uuaaauauaauu

SEQ ID NO: 2840491 - RNA, 13 nt, Human
uuaaauauaauuc

SEQ ID NO: 2840492 - RNA, 14 nt, Human
uuaaauauaauucu

SEQ ID NO: 2840493 - RNA, 16 nt, Human
uuaaauauaauucugu

SEQ ID NO: 2840494 - RNA, 17 nt, Human
uuaaauauaauucugua

SEQ ID NO: 2840495 - RNA, 18 nt, Human
uuaaauauaauucuguaa

SEQ ID NO: 2840496 - RNA, 19 nt, Human
uuaaauauaauucuguaaa

SEQ ID NO: 2840497 - RNA, 20 nt, Human
uuaaauauaauucuguaaau

SEQ ID NO: 2840498 - RNA, 13 nt, Human
uguuuguuuauua

SEQ ID NO: 2840499 - RNA, 18 nt, Human
uguuuguuuauuagauga

SEQ ID NO: 2840500 - RNA, 15 nt, Human
uguuuguuucaagaa

SEQ ID NO: 2840501 - RNA, 19 nt, Human
uguuuguuucaagaaccug

SEQ ID NO: 2840502 - RNA, 12 nt, Human
uguuuuaaaaaa

SEQ ID NO: 2840503 - RNA, 22 nt, Human
uguuuguuucucccccugggcu

SEQ ID NO: 2840504 - RNA, 13 nt, Human
uguuuguuucuuu

SEQ ID NO: 2840505 - RNA, 15 nt, Human
uguuuguuucuuugu

SEQ ID NO: 2840506 - RNA, 13 nt, Human
uguuuguuugucu

SEQ ID NO: 2840507 - RNA, 16 nt, Human
uguuuguuugucuguu

SEQ ID NO: 2840508 - RNA, 22 nt, Human
uguuucucuguuguaagaauag

SEQ ID NO: 2840509 - RNA, 20 nt, Human
uguuuuaaaaagaaacaaga

SEQ ID NO: 2840510 - RNA, 18 nt, Human
uguuuuaaaaaggaacug

SEQ ID NO: 2840511 - RNA, 21 nt, Human
uguuuuaaaaaggaacugcag

SEQ ID NO: 2840512 - RNA, 23 nt, Human
uguuuuaaaaaggaacugcagca

SEQ ID NO: 2840513 - RNA, 12 nt, Human
uguuuuaaaaag

SEQ ID NO: 2840514 - RNA, 17 nt, Human
uguuuguuuccuuuguu

SEQ ID NO: 2840515 - RNA, 14 nt, Human
uguuucugaaaaga

SEQ ID NO: 2840516 - RNA, 20 nt, Human
uguuucucuugagcuggccu

SEQ ID NO: 2840517 - RNA, 12 nt, Human
uguuucugaaaa

SEQ ID NO: 2840518 - RNA, 18 nt, Human
uguuucucuugagcuggc

SEQ ID NO: 2840519 - RNA, 17 nt, Human
uguuucuccuucugaaa

SEQ ID NO: 2840520 - RNA, 23 nt, Human
uguuucucccccugggcucugcc

SEQ ID NO: 2840521 - RNA, 17 nt, Human
uguuucucccccugggc

SEQ ID NO: 2840522 - RNA, 15 nt, Human
uguuucucaaaucuu

SEQ ID NO: 2840523 - RNA, 16 nt, Human
uguuucucccccuggg

SEQ ID NO: 2840524 - RNA, 15 nt, Human
uguuucucccccugg

SEQ ID NO: 2840525 - RNA, 19 nt, Human
uguuucuauugacuucaau

SEQ ID NO: 2840526 - RNA, 16 nt, Human
uguuucuauacaaaua

SEQ ID NO: 2840527 - RNA, 16 nt, Human
uguuucuaucugauuu

SEQ ID NO: 2840528 - RNA, 14 nt, Human
uguuuuucauucau

SEQ ID NO: 2840529 - RNA, 14 nt, Human
uguuuuuguugugu

SEQ ID NO: 2840530 - RNA, 15 nt, Human
uguuuuuguugugug

SEQ ID NO: 2840531 - RNA, 17 nt, Human
uguuuuuauuguuuucu

SEQ ID NO: 2840532 - RNA, 12 nt, Human
uguuuuucucac

SEQ ID NO: 2840533 - RNA, 13 nt, Human
uguuuuuuccuuu

SEQ ID NO: 2840534 - RNA, 15 nt, Human
uguuuuuuaugaagu

SEQ ID NO: 2840535 - RNA, 17 nt, Human
uguuuuuuaugaagugc

SEQ ID NO: 2840536 - RNA, 13 nt, Human
uguuuuuucaaaa

SEQ ID NO: 2840537 - RNA, 14 nt, Human
uguuuuuucaaaau

SEQ ID NO: 2840538 - RNA, 16 nt, Human
uguuuuuucaaaauag

SEQ ID NO: 2840539 - RNA, 23 nt, Human
uguuuuuucaaaauagaaaaguu

SEQ ID NO: 2840540 - RNA, 13 nt, Human
uguuuuuucaugu

SEQ ID NO: 2840541 - RNA, 14 nt, Human
uguuuuuucaugug

SEQ ID NO: 2840542 - RNA, 14 nt, Human
uuaaaacacuucug

SEQ ID NO: 2840543 - RNA, 17 nt, Human
uuaaaacacuucugucc

SEQ ID NO: 2840544 - RNA, 20 nt, Human
uuaaaacacuucuguccugu

SEQ ID NO: 2840545 - RNA, 12 nt, Human
uuaaaacacuuu

SEQ ID NO: 2840546 - RNA, 18 nt, Human
uuaaaacacuuucaaaac

SEQ ID NO: 2840547 - RNA, 20 nt, Human
uuaaaacacauguuuuuaua

SEQ ID NO: 2840548 - RNA, 19 nt, Human
uguuuuggacuccaucucu

SEQ ID NO: 2840549 - RNA, 21 nt, Human
uguuuuaaacucuccuaguca

SEQ ID NO: 2840550 - RNA, 21 nt, Human
uguuuuuauacaaaauaagaa

SEQ ID NO: 2840551 - RNA, 19 nt, Human
uguuuuggguagcugccac

SEQ ID NO: 2840552 - RNA, 16 nt, Human
uguuuugguagauuaa

SEQ ID NO: 2840553 - RNA, 19 nt, Human
uguuuugguagauuaaaua

SEQ ID NO: 2840554 - RNA, 21 nt, Human
uguuuugguagauuaaauaua

SEQ ID NO: 2840555 - RNA, 18 nt, Human
uguuuuuauuaauuuaua

SEQ ID NO: 2840556 - RNA, 16 nt, Human
uuaaggcuaaaaagua

SEQ ID NO: 2840557 - RNA, 18 nt, Human
uuaauagcuuuuauugua

SEQ ID NO: 2840558 - RNA, 18 nt, Human
uuaaggaugggguuauga

SEQ ID NO: 2840559 - RNA, 23 nt, Human
uuaaggaugggguuaugaacccu

SEQ ID NO: 2840560 - RNA, 19 nt, Human
uuaacaugcuuaugacaau

SEQ ID NO: 2840561 - RNA, 19 nt, Human
uuaacauuccaagacucua

SEQ ID NO: 2840562 - RNA, 22 nt, Human
uuaagcuuuggacccaaggaaa

SEQ ID NO: 2840563 - RNA, 20 nt, Human
uuaaggaaacucuuaucuca

SEQ ID NO: 2840564 - RNA, 12 nt, Human
uuaaggaaacaa

SEQ ID NO: 2840565 - RNA, 14 nt, Human
uuaaggaaacaaua

SEQ ID NO: 2840566 - RNA, 14 nt, Human
uuaaggaaacucuu

SEQ ID NO: 2840567 - RNA, 16 nt, Human
uuaaggaaacucuuau

SEQ ID NO: 2840568 - RNA, 17 nt, Human
uuaaugucacaggcagg

SEQ ID NO: 2840569 - RNA, 20 nt, Human
uuaauggacacuuuucaccu

SEQ ID NO: 2840570 - RNA, 14 nt, Human
uuaauggaaauguu

SEQ ID NO: 2840571 - RNA, 18 nt, Human
uuaauggacuuauuucuu

SEQ ID NO: 2840572 - RNA, 20 nt, Human
uuaauggacuuauuucuuca

SEQ ID NO: 2840573 - RNA, 21 nt, Human
uuaauggacuuauuucuucaa

SEQ ID NO: 2840574 - RNA, 14 nt, Human
uuaauggcacugau

SEQ ID NO: 2840575 - RNA, 14 nt, Human
uuaauggauuguua

SEQ ID NO: 2840576 - RNA, 16 nt, Human
uuaauggauuguuaau

SEQ ID NO: 2840577 - RNA, 20 nt, Human
uuaauggauuguuaauuuca

SEQ ID NO: 2840578 - RNA, 21 nt, Human
uuaauggauuguuaauuucag

SEQ ID NO: 2840579 - RNA, 18 nt, Human
uuaaugucacaggcaggu

SEQ ID NO: 2840580 - RNA, 14 nt, Human
uuaauuauuauuug

SEQ ID NO: 2840581 - RNA, 23 nt, Human
uuaauuauaggagccuuaauuuu

SEQ ID NO: 2840582 - RNA, 16 nt, Human
uuaauuauuaacuaca

SEQ ID NO: 2840583 - RNA, 17 nt, Human
uuaauuauuaacuacau

SEQ ID NO: 2840584 - RNA, 18 nt, Human
uuaauuauuaacuacauu

SEQ ID NO: 2840585 - RNA, 15 nt, Human
uuaauagucauucca

SEQ ID NO: 2840586 - RNA, 19 nt, Human
uuaauagucauuccaaaua

SEQ ID NO: 2840587 - RNA, 20 nt, Human
uuaauagcuuuuauuguaua

SEQ ID NO: 2840588 - RNA, 22 nt, Human
uuaauagcuuuuauuguauaaa

SEQ ID NO: 2840589 - RNA, 15 nt, Human
uuaauaguuugucua

SEQ ID NO: 2840590 - RNA, 16 nt, Human
uuaauaguuugucuau

SEQ ID NO: 2840591 - RNA, 18 nt, Human
uuaauaguuugucuauuu

SEQ ID NO: 2840592 - RNA, 19 nt, Human
uuaauaguuugucuauuuu

SEQ ID NO: 2840593 - RNA, 16 nt, Human
uuaaugcugccuuuuc

SEQ ID NO: 2840594 - RNA, 17 nt, Human
uuaaugcugccuuuucu

SEQ ID NO: 2840595 - RNA, 13 nt, Human
uuaaugcuucauu

SEQ ID NO: 2840596 - RNA, 14 nt, Human
uuaaugcuucauuc

SEQ ID NO: 2840597 - RNA, 15 nt, Human
uuaaugcuucauuca

SEQ ID NO: 2840598 - RNA, 23 nt, Human
uuaaugccgauauacucuagaug

SEQ ID NO: 2840599 - RNA, 12 nt, Human
uuaauauggauu

SEQ ID NO: 2840600 - RNA, 17 nt, Human
uuaauauggauuuguua

SEQ ID NO: 2840601 - RNA, 23 nt, Human
uuacaaucccaccuuuccucaaa

SEQ ID NO: 2840602 - RNA, 14 nt, Human
uuacaauggaaaca

SEQ ID NO: 2840603 - RNA, 16 nt, Human
uuacagaggaaguuau

SEQ ID NO: 2840604 - RNA, 23 nt, Human
uuacaauaaaaucuugaaaaugc

SEQ ID NO: 2840605 - RNA, 13 nt, Human
uuaaugugaacuu

SEQ ID NO: 2840606 - RNA, 21 nt, Human
uuaauuauuauuuguguuuua

SEQ ID NO: 2840607 - RNA, 14 nt, Human
uuacaaguguauau

SEQ ID NO: 2840608 - RNA, 21 nt, Human
uuacaauaaaacuuugcugcc

SEQ ID NO: 2840609 - RNA, 16 nt, Human
uuacaaguguauauca

SEQ ID NO: 2840610 - RNA, 22 nt, Human
uuacaugguuaagguaaaguaa

SEQ ID NO: 2840611 - RNA, 17 nt, Human
uuacauguauuauuuca

SEQ ID NO: 2840612 - RNA, 12 nt, Human
uuacaugugaug

SEQ ID NO: 2840613 - RNA, 18 nt, Human
uuacauguguagccuaug

SEQ ID NO: 2840614 - RNA, 20 nt, Human
uuacagaugaauguauuuau

SEQ ID NO: 2840615 - RNA, 16 nt, Human
uuacagauuuaauaca

SEQ ID NO: 2840616 - RNA, 20 nt, Human
uuacagcaaguagauaaaua

SEQ ID NO: 2840617 - RNA, 15 nt, Human
uuacagcacaaaaug

SEQ ID NO: 2840618 - RNA, 22 nt, Human
uuacagccaagugccaaaugcu

SEQ ID NO: 2840619 - RNA, 17 nt, Human
uuacauggacagaauuu

SEQ ID NO: 2840620 - RNA, 23 nt, Human
uuacauggagaaaaccaaaauga

SEQ ID NO: 2840621 - RNA, 17 nt, Human
uuaccagaagcuuccau

SEQ ID NO: 2840622 - RNA, 14 nt, Human
uuaccacucaggca

SEQ ID NO: 2840623 - RNA, 12 nt, Human
uuaccacucagg

SEQ ID NO: 2840624 - RNA, 12 nt, Human
uuaccagcaaga

SEQ ID NO: 2840625 - RNA, 19 nt, Human
uuaccagcaagaauaaaaa

SEQ ID NO: 2840626 - RNA, 22 nt, Human
uuaccagcaagaauaaaaaaga

SEQ ID NO: 2840627 - RNA, 23 nt, Human
uuaccuuuuuugauaaaguuucu

SEQ ID NO: 2840628 - RNA, 15 nt, Human
uuaccuuuuuugaua

SEQ ID NO: 2840629 - RNA, 17 nt, Human
uuaccuuuuuugauaaa

SEQ ID NO: 2840630 - RNA, 20 nt, Human
uuaccuuuuaccagcuuuua

SEQ ID NO: 2840631 - RNA, 16 nt, Human
uuacgguaguuaggau

SEQ ID NO: 2840632 - RNA, 16 nt, Human
uuacggacacccccuc

SEQ ID NO: 2840633 - RNA, 16 nt, Human
uuacgcuuugauucau

SEQ ID NO: 2840634 - RNA, 15 nt, Human
uuacgcuuugauuca

SEQ ID NO: 2840635 - RNA, 16 nt, Human
uuacgaauauuuucag

SEQ ID NO: 2840636 - RNA, 17 nt, Human
uuacgaauauuuucagu

SEQ ID NO: 2840637 - RNA, 16 nt, Human
uuacgauaaggaagaa

SEQ ID NO: 2840638 - RNA, 18 nt, Human
uuacgauaaggaagaaac

SEQ ID NO: 2840639 - RNA, 15 nt, Human
uuacgaucaggcaca

SEQ ID NO: 2840640 - RNA, 22 nt, Human
uuacgaucaggcacaggucagg

SEQ ID NO: 2840641 - RNA, 13 nt, Human
uuacgcuuugauu

SEQ ID NO: 2840642 - RNA, 16 nt, Human
ugugugaaugaacacu

SEQ ID NO: 2840643 - RNA, 12 nt, Human
ugugugaaugaa

SEQ ID NO: 2840644 - RNA, 13 nt, Human
ugugugaaggcag

SEQ ID NO: 2840645 - RNA, 15 nt, Human
ugugugaaggcagag

SEQ ID NO: 2840646 - RNA, 14 nt, Human
ugugucacuugugc

SEQ ID NO: 2840647 - RNA, 15 nt, Human
ugugucacuugugcu

SEQ ID NO: 2840648 - RNA, 16 nt, Human
ugugucacuugugcuu

SEQ ID NO: 2840649 - RNA, 17 nt, Human
ugugucacuugugcuuu

SEQ ID NO: 2840650 - RNA, 21 nt, Human
ugugucacuugugcuuugcuc

SEQ ID NO: 2840651 - RNA, 22 nt, Human
ugugucacuugugcuuugcucu

SEQ ID NO: 2840652 - RNA, 12 nt, Human
ugugugaccaac

SEQ ID NO: 2840653 - RNA, 16 nt, Human
ugugugaccaacugug

SEQ ID NO: 2840654 - RNA, 17 nt, Human
ugugugaccaacugugu

SEQ ID NO: 2840655 - RNA, 19 nt, Human
ugugugaccaacuguguug

SEQ ID NO: 2840656 - RNA, 20 nt, Human
ugugugaccaacuguguugu

SEQ ID NO: 2840657 - RNA, 18 nt, Human
ugugugaccccuccuggg

SEQ ID NO: 2840658 - RNA, 19 nt, Human
ugugugaccccuccugggg

SEQ ID NO: 2840659 - RNA, 22 nt, Human
ugugugaccccuccuggggcca

SEQ ID NO: 2840660 - RNA, 23 nt, Human
ugugugaccccuccuggggccag

SEQ ID NO: 2840661 - RNA, 18 nt, Human
ugugugacucuuuagcaa

SEQ ID NO: 2840662 - RNA, 16 nt, Human
ugugugagacuacuaa

SEQ ID NO: 2840663 - RNA, 17 nt, Human
ugugugaggagcugcug

SEQ ID NO: 2840664 - RNA, 22 nt, Human
ugugugaaugaacacucuuuug

SEQ ID NO: 2840665 - RNA, 12 nt, Human
ugugugaaugug

SEQ ID NO: 2840666 - RNA, 13 nt, Human
ugugugaaugugg

SEQ ID NO: 2840667 - RNA, 18 nt, Human
ugugugaaugaacacucu

SEQ ID NO: 2840668 - RNA, 17 nt, Human
ugugugaaugaacacuc

SEQ ID NO: 2840669 - RNA, 13 nt, Human
uguguauuuaaca

SEQ ID NO: 2840670 - RNA, 18 nt, Human
uguguauuuaacagggag

SEQ ID NO: 2840671 - RNA, 20 nt, Human
uguguauuuaacagggaggg

SEQ ID NO: 2840672 - RNA, 22 nt, Human
uguguauuuaacagggagggga

SEQ ID NO: 2840673 - RNA, 14 nt, Human
ugugucaauccaga

SEQ ID NO: 2840674 - RNA, 16 nt, Human
ugugucaaugggcaau

SEQ ID NO: 2840675 - RNA, 16 nt, Human
ugugucacaaagaauu

SEQ ID NO: 2840676 - RNA, 16 nt, Human
uguguauuucuuauac

SEQ ID NO: 2840677 - RNA, 15 nt, Human
uguguauuuacgcuu

SEQ ID NO: 2840678 - RNA, 16 nt, Human
uguguagggcgggagg

SEQ ID NO: 2840679 - RNA, 13 nt, Human
uguguagccuaug

SEQ ID NO: 2840680 - RNA, 14 nt, Human
uguguagccuaugu

SEQ ID NO: 2840681 - RNA, 21 nt, Human
uguguagaguuaagaagcugu

SEQ ID NO: 2840682 - RNA, 13 nt, Human
uguguagaguuaa

SEQ ID NO: 2840683 - RNA, 17 nt, Human
uguguagaaaaaaaaac

SEQ ID NO: 2840684 - RNA, 16 nt, Human
uguguagacaaauauu

SEQ ID NO: 2840685 - RNA, 21 nt, Human
uguguagacaaauauuuggag

SEQ ID NO: 2840686 - RNA, 16 nt, Human
uguguagaguuaagaa

SEQ ID NO: 2840687 - RNA, 18 nt, Human
uguguagaguuaagaagc

SEQ ID NO: 2840688 - RNA, 19 nt, Human
uguguagaguuaagaagcu

SEQ ID NO: 2840689 - RNA, 20 nt, Human
uguguauauauaugugagga

SEQ ID NO: 2840690 - RNA, 18 nt, Human
uguguauauauguguaua

SEQ ID NO: 2840691 - RNA, 23 nt, Human
uguguauauauguguauauauac

SEQ ID NO: 2840692 - RNA, 15 nt, Human
uguguauauaguuuu

SEQ ID NO: 2840693 - RNA, 13 nt, Human
uguguauauauac

SEQ ID NO: 2840694 - RNA, 14 nt, Human
uguguauauauaca

SEQ ID NO: 2840695 - RNA, 15 nt, Human
uguguauauauacau

SEQ ID NO: 2840696 - RNA, 16 nt, Human
uguguauauauacaua

SEQ ID NO: 2840697 - RNA, 17 nt, Human
uguguauaagugcacac

SEQ ID NO: 2840698 - RNA, 16 nt, Human
uguguauacagcccug

SEQ ID NO: 2840699 - RNA, 22 nt, Human
uguguauacagcccugacgcaa

SEQ ID NO: 2840700 - RNA, 22 nt, Human
uguguaguugucucucuucaga

SEQ ID NO: 2840701 - RNA, 15 nt, Human
uguguauauuauuug

SEQ ID NO: 2840702 - RNA, 16 nt, Human
uguguauauuauuugg

SEQ ID NO: 2840703 - RNA, 17 nt, Human
uguguauauuauuuggc

SEQ ID NO: 2840704 - RNA, 18 nt, Human
uguguauauuauuuggca

SEQ ID NO: 2840705 - RNA, 16 nt, Human
uguguauguguauuua

SEQ ID NO: 2840706 - RNA, 12 nt, Human
uguguauucuua

SEQ ID NO: 2840707 - RNA, 14 nt, Human
uguguauucuuaaa

SEQ ID NO: 2840708 - RNA, 20 nt, Human
uguguauucuuaaaaugcaa

SEQ ID NO: 2840709 - RNA, 23 nt, Human
uguguauucuuaaaaugcaauau

SEQ ID NO: 2840710 - RNA, 24 nt, Human
ugugugccauagaguuuaacacaa

SEQ ID NO: 2840711 - RNA, 20 nt, Human
ugugugaggagcugcuggcu

SEQ ID NO: 2840712 - RNA, 13 nt, Human
ugugugcagugaa

SEQ ID NO: 2840713 - RNA, 21 nt, Human
ugugugccauagaguuuaaca

SEQ ID NO: 2840714 - RNA, 23 nt, Human
ugugugccauagaguuuaacaca

SEQ ID NO: 2840715 - RNA, 14 nt, Human
ugugugcaugugug

SEQ ID NO: 2840716 - RNA, 19 nt, Human
ugugugcauguguguauaa

SEQ ID NO: 2840717 - RNA, 18 nt, Human
ugugugucaugccaguga

SEQ ID NO: 2840718 - RNA, 12 nt, Human
uguguaugugua

SEQ ID NO: 2840719 - RNA, 11 nt, Human
uguguguacuc

SEQ ID NO: 2840720 - RNA, 21 nt, Human
uguguguacucacugaagccu

SEQ ID NO: 2840721 - RNA, 14 nt, Human
uguguguauauaug

SEQ ID NO: 2840722 - RNA, 15 nt, Human
uguguguauauaugu

SEQ ID NO: 2840723 - RNA, 22 nt, Human
uguguguauauauguguauaua

SEQ ID NO: 2840724 - RNA, 14 nt, Human
ugugugguggccuc

SEQ ID NO: 2840725 - RNA, 16 nt, Human
ugugugguggccucag

SEQ ID NO: 2840726 - RNA, 14 nt, Human
uguguuuauaaaau

SEQ ID NO: 2840727 - RNA, 13 nt, Human
uguguugugauag

SEQ ID NO: 2840728 - RNA, 16 nt, Human
uguguuuaauuucuuc

SEQ ID NO: 2840729 - RNA, 21 nt, Human
uguguuguugcuucuugugaa

SEQ ID NO: 2840730 - RNA, 23 nt, Human
uguguuguugcuucuugugaagg

SEQ ID NO: 2840731 - RNA, 16 nt, Human
uguucaauguuuaaug

SEQ ID NO: 2840732 - RNA, 21 nt, Human
uguucaaugguucugaaauaa

SEQ ID NO: 2840733 - RNA, 14 nt, Human
uguucagcuccagc

SEQ ID NO: 2840734 - RNA, 17 nt, Human
uguucaacaucacugaa

SEQ ID NO: 2840735 - RNA, 14 nt, Human
uguucacaaccugg

SEQ ID NO: 2840736 - RNA, 16 nt, Human
uguucagcuccagcuc

SEQ ID NO: 2840737 - RNA, 15 nt, Human
uguucagcuccagcu

SEQ ID NO: 2840738 - RNA, 21 nt, Human
uguuagauagaauuuccaaua

SEQ ID NO: 2840739 - RNA, 19 nt, Human
uguuagauagcugcaugug

SEQ ID NO: 2840740 - RNA, 13 nt, Human
uguuagagacuuu

SEQ ID NO: 2840741 - RNA, 18 nt, Human
uguuagagacuuuuuucu

SEQ ID NO: 2840742 - RNA, 21 nt, Human
uguuagagacuuuuuucuagu

SEQ ID NO: 2840743 - RNA, 11 nt, Human
uguuagagcac

SEQ ID NO: 2840744 - RNA, 22 nt, Human
uguuagaggaucccucucugga

SEQ ID NO: 2840745 - RNA, 19 nt, Human
uguuagaaaauggacacug

SEQ ID NO: 2840746 - RNA, 15 nt, Human
uguuagacucauggu

SEQ ID NO: 2840747 - RNA, 15 nt, Human
uguucaacuauuuua

SEQ ID NO: 2840748 - RNA, 21 nt, Human
uguuaguguuuuaagaaaugu

SEQ ID NO: 2840749 - RNA, 22 nt, Human
uguuaguguuuuaagaaaugua

SEQ ID NO: 2840750 - RNA, 12 nt, Human
uguuagcacugu

SEQ ID NO: 2840751 - RNA, 13 nt, Human
uguuagcacuguu

SEQ ID NO: 2840752 - RNA, 14 nt, Human
uguuagcacuguug

SEQ ID NO: 2840753 - RNA, 15 nt, Human
uguuagcacuguuga

SEQ ID NO: 2840754 - RNA, 16 nt, Human
uguuagcacuguugau

SEQ ID NO: 2840755 - RNA, 17 nt, Human
uguuagcacuguugaug

SEQ ID NO: 2840756 - RNA, 14 nt, Human
uguuaguuccugua

SEQ ID NO: 2840757 - RNA, 20 nt, Human
uguuaguuccuguaugaaag

SEQ ID NO: 2840758 - RNA, 22 nt, Human
uguuaguuccuguaugaaagau

SEQ ID NO: 2840759 - RNA, 14 nt, Human
uguuaguuucuugg

SEQ ID NO: 2840760 - RNA, 17 nt, Human
uguuaguuauagauguc

SEQ ID NO: 2840761 - RNA, 11 nt, Human
uguuaaacugu

SEQ ID NO: 2840762 - RNA, 12 nt, Human
uguuaaacuguu

SEQ ID NO: 2840763 - RNA, 13 nt, Human
uguuaaacuguua

SEQ ID NO: 2840764 - RNA, 14 nt, Human
uguuaaacuguuag

SEQ ID NO: 2840765 - RNA, 19 nt, Human
uguuaaacuguuagcacug

SEQ ID NO: 2840766 - RNA, 20 nt, Human
uguuaaacuguuagcacugu

SEQ ID NO: 2840767 - RNA, 21 nt, Human
uguuaaacuguuagcacuguu

SEQ ID NO: 2840768 - RNA, 22 nt, Human
uguuaaacuguuagcacuguug

SEQ ID NO: 2840769 - RNA, 12 nt, Human
uguguuuuauaa

SEQ ID NO: 2840770 - RNA, 20 nt, Human
uguguuuguucuuuuuauug

SEQ ID NO: 2840771 - RNA, 14 nt, Human
uguguuuuagagua

SEQ ID NO: 2840772 - RNA, 20 nt, Human
uguguuuuagaguaagaaau

SEQ ID NO: 2840773 - RNA, 17 nt, Human
uguguuuucucuggaau

SEQ ID NO: 2840774 - RNA, 10 nt, Human
uguguuuguu

SEQ ID NO: 2840775 - RNA, 15 nt, Human
uguguuuguguauuu

SEQ ID NO: 2840776 - RNA, 16 nt, Human
uguguuugguuuacau

SEQ ID NO: 2840777 - RNA, 17 nt, Human
uguguuugguuuacauu

SEQ ID NO: 2840778 - RNA, 18 nt, Human
uguguuugguuuacauuu

SEQ ID NO: 2840779 - RNA, 23 nt, Human
uguguuugguuuacauuuaaagc

SEQ ID NO: 2840780 - RNA, 14 nt, Human
uguuaccauucaca

SEQ ID NO: 2840781 - RNA, 15 nt, Human
uguuaccauucacaa

SEQ ID NO: 2840782 - RNA, 17 nt, Human
uguuagaaaacaaaauu

SEQ ID NO: 2840783 - RNA, 15 nt, Human
uguuacuguaauucc

SEQ ID NO: 2840784 - RNA, 10 nt, Human
uguuacuguu

SEQ ID NO: 2840785 - RNA, 17 nt, Human
uguuacuguuaaccauu

SEQ ID NO: 2840786 - RNA, 18 nt, Human
uguuacuguuaaccauuu

SEQ ID NO: 2840787 - RNA, 11 nt, Human
uguuacuguuc

SEQ ID NO: 2840788 - RNA, 12 nt, Human
uguuacuguucu

SEQ ID NO: 2840789 - RNA, 13 nt, Human
uguuacuguucuu

SEQ ID NO: 2840790 - RNA, 14 nt, Human
uguuacuguucuug

SEQ ID NO: 2840791 - RNA, 15 nt, Human
uguuacuguucuugc

SEQ ID NO: 2840792 - RNA, 16 nt, Human
uguuacuguucuugcu

SEQ ID NO: 2840793 - RNA, 17 nt, Human
uguuacuguucuugcug

SEQ ID NO: 2840794 - RNA, 18 nt, Human
uguuacuguucuugcugc

SEQ ID NO: 2840795 - RNA, 19 nt, Human
uguuacuguucuugcugcu

SEQ ID NO: 2840796 - RNA, 20 nt, Human
uguuacuguucuugcugcua

SEQ ID NO: 2840797 - RNA, 21 nt, Human
uguuacuguucuugcugcuag

SEQ ID NO: 2840798 - RNA, 22 nt, Human
uguuacuguucuugcugcuaga

SEQ ID NO: 2840799 - RNA, 23 nt, Human
uguuacuguucuugcugcuagaa

SEQ ID NO: 2840800 - RNA, 24 nt, Human
uguuacuguucuugcugcuagaac

SEQ ID NO: 2840801 - RNA, 14 nt, Human
uguuuaaaaggauu

SEQ ID NO: 2840802 - RNA, 19 nt, Human
uguuguuuguuuuuuugcc

SEQ ID NO: 2840803 - RNA, 14 nt, Human
uguuuaauauuuaa

SEQ ID NO: 2840804 - RNA, 15 nt, Human
uguuuaauauuuaaa

SEQ ID NO: 2840805 - RNA, 17 nt, Human
uguuuaauauuuaaaca

SEQ ID NO: 2840806 - RNA, 13 nt, Human
uguuuaaugugaa

SEQ ID NO: 2840807 - RNA, 14 nt, Human
uguuuaaugugaac

SEQ ID NO: 2840808 - RNA, 15 nt, Human
uguuuaaugugaacu

SEQ ID NO: 2840809 - RNA, 16 nt, Human
uguuuaaugugaacuu

SEQ ID NO: 2840810 - RNA, 17 nt, Human
uguuuaaugugaacuug

SEQ ID NO: 2840811 - RNA, 18 nt, Human
uguuuaaugugaacuugu

SEQ ID NO: 2840812 - RNA, 19 nt, Human
uguuuaaugugaacuugua

SEQ ID NO: 2840813 - RNA, 22 nt, Human
uguuuaaugugaacuuguagcu

SEQ ID NO: 2840814 - RNA, 23 nt, Human
uguuuaaugugaacuuguagcug

SEQ ID NO: 2840815 - RNA, 16 nt, Human
uguuuaauguucugug

SEQ ID NO: 2840816 - RNA, 19 nt, Human
uguuuaauguucugugaua

SEQ ID NO: 2840817 - RNA, 14 nt, Human
uguuuaauuucuuc

SEQ ID NO: 2840818 - RNA, 15 nt, Human
uguuuaauuucuuca

SEQ ID NO: 2840819 - RNA, 17 nt, Human
uguuuaauuucuucaaa

SEQ ID NO: 2840820 - RNA, 20 nt, Human
uguuuaauuucuucaaaaug

SEQ ID NO: 2840821 - RNA, 21 nt, Human
uguuuaauuucuucaaaaugu

SEQ ID NO: 2840822 - RNA, 23 nt, Human
uguuuaauuucuucaaaauguau

SEQ ID NO: 2840823 - RNA, 14 nt, Human
uguuuaaucuguua

SEQ ID NO: 2840824 - RNA, 20 nt, Human
uguuuaaucuguuauguacu

SEQ ID NO: 2840825 - RNA, 17 nt, Human
uguuuacagauccccaa

SEQ ID NO: 2840826 - RNA, 15 nt, Human
uguuguuucuuucua

SEQ ID NO: 2840827 - RNA, 12 nt, Human
uguuguuugcca

SEQ ID NO: 2840828 - RNA, 13 nt, Human
uguuguuucuuuc

SEQ ID NO: 2840829 - RNA, 14 nt, Human
uguuguuucuuucu

SEQ ID NO: 2840830 - RNA, 20 nt, Human
uguuguuuuguuuuaaauac

SEQ ID NO: 2840831 - RNA, 11 nt, Human
uguuguuuugu

SEQ ID NO: 2840832 - RNA, 14 nt, Human
uguuggccaggcug

SEQ ID NO: 2840833 - RNA, 13 nt, Human
uguuggccaggcu

SEQ ID NO: 2840834 - RNA, 13 nt, Human
uguuguuucagug

SEQ ID NO: 2840835 - RNA, 14 nt, Human
uguuguuucaguga

SEQ ID NO: 2840836 - RNA, 21 nt, Human
uguuguuucagugaauaugcc

SEQ ID NO: 2840837 - RNA, 21 nt, Human
uguuguuuccuaauaucaaau

SEQ ID NO: 2840838 - RNA, 12 nt, Human
uguuguuucuuu

SEQ ID NO: 2840839 - RNA, 20 nt, Human
uguuguugcuucuugugaag

SEQ ID NO: 2840840 - RNA, 13 nt, Human
uguuguugguugu

SEQ ID NO: 2840841 - RNA, 15 nt, Human
uguugcuucuuguga

SEQ ID NO: 2840842 - RNA, 17 nt, Human
uguugcuucuugugaag

SEQ ID NO: 2840843 - RNA, 23 nt, Human
uguugcuugaauagcaauagcau

SEQ ID NO: 2840844 - RNA, 14 nt, Human
uguugcugccucau

SEQ ID NO: 2840845 - RNA, 14 nt, Human
uguugcuuggacua

SEQ ID NO: 2840846 - RNA, 12 nt, Human
uguugcuuuguu

SEQ ID NO: 2840847 - RNA, 16 nt, Human
uguugcuuuguugcac

SEQ ID NO: 2840848 - RNA, 11 nt, Human
uguuggccagg

SEQ ID NO: 2840849 - RNA, 15 nt, Human
uguuggccaaagcca

SEQ ID NO: 2840850 - RNA, 20 nt, Human
uguuggauuuguuuaaaagg

SEQ ID NO: 2840851 - RNA, 17 nt, Human
uguuggauuccaugcua

SEQ ID NO: 2840852 - RNA, 22 nt, Human
uguugaagaaauuauaaagaua

SEQ ID NO: 2840853 - RNA, 18 nt, Human
uguugaagaauacaguua

SEQ ID NO: 2840854 - RNA, 20 nt, Human
uguugaacagguguuuuucc

SEQ ID NO: 2840855 - RNA, 23 nt, Human
uguugaaccaaaccucccugcua

SEQ ID NO: 2840856 - RNA, 16 nt, Human
uguugaaauuuugcaa

SEQ ID NO: 2840857 - RNA, 18 nt, Human
uguugaaauuuugcaaau

SEQ ID NO: 2840858 - RNA, 21 nt, Human
uguugaaauuuugcaaauaua

SEQ ID NO: 2840859 - RNA, 23 nt, Human
uguugaaauuuugcaaauauaaa

SEQ ID NO: 2840860 - RNA, 23 nt, Human
uguugagaaucccaaauuugauu

SEQ ID NO: 2840861 - RNA, 14 nt, Human
uguugagcaagcag

SEQ ID NO: 2840862 - RNA, 23 nt, Human
uguugagcaagcaguagcauuug

SEQ ID NO: 2840863 - RNA, 22 nt, Human
uguugauaaauuccacuggacu

SEQ ID NO: 2840864 - RNA, 15 nt, Human
uguugauaauucuua

SEQ ID NO: 2840865 - RNA, 19 nt, Human
uguugauaaauuccacugg

SEQ ID NO: 2840866 - RNA, 16 nt, Human
uguugagccuuuuccc

SEQ ID NO: 2840867 - RNA, 18 nt, Human
uguugagccuuuucccuc

SEQ ID NO: 2840868 - RNA, 13 nt, Human
uguugcugccuca

SEQ ID NO: 2840869 - RNA, 16 nt, Human
uguucuuucuggaguc

SEQ ID NO: 2840870 - RNA, 21 nt, Human
uguugaaaauuauuuuaaaca

SEQ ID NO: 2840871 - RNA, 12 nt, Human
uguugaaagcaa

SEQ ID NO: 2840872 - RNA, 17 nt, Human
uguugaaagcaaaaaug

SEQ ID NO: 2840873 - RNA, 18 nt, Human
uguugaaagcaaaaaugc

SEQ ID NO: 2840874 - RNA, 19 nt, Human
uguugaaagcaaaaaugcu

SEQ ID NO: 2840875 - RNA, 23 nt, Human
uguugaaagcaaaaaugcuaaua

SEQ ID NO: 2840876 - RNA, 22 nt, Human
uguugaaaauuauuuuaaacaa

SEQ ID NO: 2840877 - RNA, 17 nt, Human
uguugaaaauguucaga

SEQ ID NO: 2840878 - RNA, 14 nt, Human
uguugaaaauguuc

SEQ ID NO: 2840879 - RNA, 14 nt, Human
uguucugcccccag

SEQ ID NO: 2840880 - RNA, 16 nt, Human
uguucugcccccagcc

SEQ ID NO: 2840881 - RNA, 23 nt, Human
uguucucuugggaacugaacuca

SEQ ID NO: 2840882 - RNA, 14 nt, Human
uguucucuucuuca

SEQ ID NO: 2840883 - RNA, 15 nt, Human
uguucucuucuucau

SEQ ID NO: 2840884 - RNA, 20 nt, Human
uguucucuucuucauucuau

SEQ ID NO: 2840885 - RNA, 12 nt, Human
uguucugcacug

SEQ ID NO: 2840886 - RNA, 13 nt, Human
uguucugcacuga

SEQ ID NO: 2840887 - RNA, 14 nt, Human
uguucugcacugaa

SEQ ID NO: 2840888 - RNA, 15 nt, Human
uguucugcacugaaa

SEQ ID NO: 2840889 - RNA, 16 nt, Human
uguucugcacugaaaa

SEQ ID NO: 2840890 - RNA, 17 nt, Human
uguucugcacugaaaag

SEQ ID NO: 2840891 - RNA, 17 nt, Human
uguucugcacacagcac

SEQ ID NO: 2840892 - RNA, 22 nt, Human
uguucauuaaagcaugaauggu

SEQ ID NO: 2840893 - RNA, 12 nt, Human
uguucauguuug

SEQ ID NO: 2840894 - RNA, 13 nt, Human
uguucauguuugg

SEQ ID NO: 2840895 - RNA, 17 nt, Human
uguucauguuuggugca

SEQ ID NO: 2840896 - RNA, 22 nt, Human
uguucauuuagauugaaaacuu

SEQ ID NO: 2840897 - RNA, 15 nt, Human
uguucacugaagacg

SEQ ID NO: 2840898 - RNA, 17 nt, Human
uguucacugaagacgcc

SEQ ID NO: 2840899 - RNA, 18 nt, Human
uguucacugaaggugauu

SEQ ID NO: 2840900 - RNA, 17 nt, Human
uguucacgcaacuugaa

SEQ ID NO: 2840901 - RNA, 18 nt, Human
uguucacgcaacuugaaa

SEQ ID NO: 2840902 - RNA, 21 nt, Human
uguucagcuguccucccucca

SEQ ID NO: 2840903 - RNA, 18 nt, Human
uguucucugaggacacua

SEQ ID NO: 2840904 - RNA, 16 nt, Human
uguucucugaggacac

SEQ ID NO: 2840905 - RNA, 13 nt, Human
uguucucugagga

SEQ ID NO: 2840906 - RNA, 17 nt, Human
uguucucccuucggugg

SEQ ID NO: 2840907 - RNA, 16 nt, Human
uguucuauucaucuca

SEQ ID NO: 2840908 - RNA, 13 nt, Human
uguucuauccaaa

SEQ ID NO: 2840909 - RNA, 14 nt, Human
uguucuauccaaac

SEQ ID NO: 2840910 - RNA, 18 nt, Human
uguucuauccaaacaugu

SEQ ID NO: 2840911 - RNA, 19 nt, Human
uguucuauccaaacaugua

SEQ ID NO: 2840912 - RNA, 14 nt, Human
uguucuaugaacaa

SEQ ID NO: 2840913 - RNA, 15 nt, Human
uguucuaugaacaac

SEQ ID NO: 2840914 - RNA, 17 nt, Human
uguucuaugguuaugaa

SEQ ID NO: 2840915 - RNA, 18 nt, Human
uguucuaugguuaugaaa

SEQ ID NO: 2840916 - RNA, 20 nt, Human
uguaucuacaucuuuuuuca

SEQ ID NO: 2840917 - RNA, 20 nt, Human
uguaucgggaagauuucuaa

SEQ ID NO: 2840918 - RNA, 19 nt, Human
uguaucguaaccagccaga

SEQ ID NO: 2840919 - RNA, 15 nt, Human
uguaucggaugcuuu

SEQ ID NO: 2840920 - RNA, 19 nt, Human
uguaucgauguuuuauuau

SEQ ID NO: 2840921 - RNA, 22 nt, Human
uguauugaacuuggaaagaaau

SEQ ID NO: 2840922 - RNA, 14 nt, Human
uguaugcacuuugu

SEQ ID NO: 2840923 - RNA, 19 nt, Human
uguauuguaaacauguguu

SEQ ID NO: 2840924 - RNA, 15 nt, Human
uguauuguaaacaug

SEQ ID NO: 2840925 - RNA, 16 nt, Human
uguauugguuaaaacu

SEQ ID NO: 2840926 - RNA, 18 nt, Human
uguauugguuaaaacugu

SEQ ID NO: 2840927 - RNA, 15 nt, Human
uguaugauuuauaaa

SEQ ID NO: 2840928 - RNA, 19 nt, Human
uguauuggauauauaagag

SEQ ID NO: 2840929 - RNA, 12 nt, Human
uguauugcuguc

SEQ ID NO: 2840930 - RNA, 14 nt, Human
uguauugcuguccu

SEQ ID NO: 2840931 - RNA, 15 nt, Human
uguauugagauuucu

SEQ ID NO: 2840932 - RNA, 20 nt, Human
uguauugagauuucuuaaau

SEQ ID NO: 2840933 - RNA, 16 nt, Human
uguauuuaugugugag

SEQ ID NO: 2840934 - RNA, 13 nt, Human
uguauuuauguaa

SEQ ID NO: 2840935 - RNA, 22 nt, Human
uguauuuauguaaugaaguaaa

SEQ ID NO: 2840936 - RNA, 23 nt, Human
uguauuuacgcuuugauucauag

SEQ ID NO: 2840937 - RNA, 21 nt, Human
uguauuuacgcuuugauucau

SEQ ID NO: 2840938 - RNA, 20 nt, Human
uguauuuacgcuuugauuca

SEQ ID NO: 2840939 - RNA, 18 nt, Human
uguauuuaacagggaggg

SEQ ID NO: 2840940 - RNA, 12 nt, Human
uguauuuaagca

SEQ ID NO: 2840941 - RNA, 13 nt, Human
uguauuuaagcaa

SEQ ID NO: 2840942 - RNA, 14 nt, Human
uguauuuaagcaaa

SEQ ID NO: 2840943 - RNA, 16 nt, Human
uguauuuaagcaaaua

SEQ ID NO: 2840944 - RNA, 19 nt, Human
uguauuuaagcaaauacuu

SEQ ID NO: 2840945 - RNA, 20 nt, Human
uguauuuaagcaaauacuua

SEQ ID NO: 2840946 - RNA, 17 nt, Human
uguauacuauaguacca

SEQ ID NO: 2840947 - RNA, 15 nt, Human
uguauacuauaguac

SEQ ID NO: 2840948 - RNA, 11 nt, Human
uguauacuuua

SEQ ID NO: 2840949 - RNA, 13 nt, Human
uguauacuuuaaa

SEQ ID NO: 2840950 - RNA, 14 nt, Human
uguauacuuuaaau

SEQ ID NO: 2840951 - RNA, 15 nt, Human
uguauacuuuaaaua

SEQ ID NO: 2840952 - RNA, 16 nt, Human
uguauacuuuaaauaa

SEQ ID NO: 2840953 - RNA, 17 nt, Human
uguauacuuuaaauaau

SEQ ID NO: 2840954 - RNA, 21 nt, Human
uguauacuuuaaauaauuuaa

SEQ ID NO: 2840955 - RNA, 12 nt, Human
uguauacuuuag

SEQ ID NO: 2840956 - RNA, 13 nt, Human
uguauacuuuagu

SEQ ID NO: 2840957 - RNA, 14 nt, Human
uguauacuuuagua

SEQ ID NO: 2840958 - RNA, 15 nt, Human
uguauacuuuaguau

SEQ ID NO: 2840959 - RNA, 17 nt, Human
uguauacuuuaguauga

SEQ ID NO: 2840960 - RNA, 19 nt, Human
uguauacuuuaguaugacg

SEQ ID NO: 2840961 - RNA, 15 nt, Human
uguauacauccuggg

SEQ ID NO: 2840962 - RNA, 17 nt, Human
uguauacauccugggua

SEQ ID NO: 2840963 - RNA, 16 nt, Human
uguauacaacccuggc

SEQ ID NO: 2840964 - RNA, 12 nt, Human
uguauaauuucg

SEQ ID NO: 2840965 - RNA, 13 nt, Human
uguauaauuucga

SEQ ID NO: 2840966 - RNA, 12 nt, Human
uguauacaaaua

SEQ ID NO: 2840967 - RNA, 13 nt, Human
uguauacaaauau

SEQ ID NO: 2840968 - RNA, 15 nt, Human
uguauacaaauauau

SEQ ID NO: 2840969 - RNA, 16 nt, Human
uguauacaaauauauu

SEQ ID NO: 2840970 - RNA, 18 nt, Human
uguauacaaauauauugu

SEQ ID NO: 2840971 - RNA, 22 nt, Human
uguauacaaauauauuguuaau

SEQ ID NO: 2840972 - RNA, 14 nt, Human
uguauacuauagua

SEQ ID NO: 2840973 - RNA, 23 nt, Human
uguaucccaugagccucagcauc

SEQ ID NO: 2840974 - RNA, 19 nt, Human
uguaucccaugagccucag

SEQ ID NO: 2840975 - RNA, 16 nt, Human
uguaucccaugagccu

SEQ ID NO: 2840976 - RNA, 20 nt, Human
uguauccccccccuguauag

SEQ ID NO: 2840977 - RNA, 21 nt, Human
uguauccccccccuguauagu

SEQ ID NO: 2840978 - RNA, 19 nt, Human
uguauacuauaguaccagu

SEQ ID NO: 2840979 - RNA, 22 nt, Human
uguauccccccccuguauaguu

SEQ ID NO: 2840980 - RNA, 20 nt, Human
uguaucccuucucacagcac

SEQ ID NO: 2840981 - RNA, 16 nt, Human
uguauaagugcacaca

SEQ ID NO: 2840982 - RNA, 18 nt, Human
uguauaagugcacacaga

SEQ ID NO: 2840983 - RNA, 20 nt, Human
uguauaagugcacacagaaa

SEQ ID NO: 2840984 - RNA, 21 nt, Human
uguauaagugcacacagaaau

SEQ ID NO: 2840985 - RNA, 22 nt, Human
uguauaagugcacacagaaaua

SEQ ID NO: 2840986 - RNA, 23 nt, Human
uguauaagugcacacagaaauau

SEQ ID NO: 2840987 - RNA, 14 nt, Human
uguauuuguucaug

SEQ ID NO: 2840988 - RNA, 16 nt, Human
uguauuuguucauguu

SEQ ID NO: 2840989 - RNA, 17 nt, Human
uguauuuguucauguuu

SEQ ID NO: 2840990 - RNA, 18 nt, Human
uguauuuguucauguuug

SEQ ID NO: 2840991 - RNA, 19 nt, Human
uguauuuguucauguuugg

SEQ ID NO: 2840992 - RNA, 13 nt, Human
ugucacguacugu

SEQ ID NO: 2840993 - RNA, 15 nt, Human
ugucacguacugucu

SEQ ID NO: 2840994 - RNA, 18 nt, Human
ugucacguacugucugau

SEQ ID NO: 2840995 - RNA, 19 nt, Human
ugucacguacugucugauu

SEQ ID NO: 2840996 - RNA, 21 nt, Human
ugucacucauugcugagccuc

SEQ ID NO: 2840997 - RNA, 22 nt, Human
ugucacucauugcugagccucu

SEQ ID NO: 2840998 - RNA, 23 nt, Human
ugucacucauugcugagccucug

SEQ ID NO: 2840999 - RNA, 18 nt, Human
ugucacugacacaaagga

SEQ ID NO: 2841000 - RNA, 19 nt, Human
ugucacugacacaaaggaa

SEQ ID NO: 2841001 - RNA, 20 nt, Human
ugucacugacacaaaggaag

SEQ ID NO: 2841002 - RNA, 13 nt, Human
ugucacugcuuuu

SEQ ID NO: 2841003 - RNA, 23 nt, Human
ugucaguauuucaguguaguuaa

SEQ ID NO: 2841004 - RNA, 15 nt, Human
ugucacucauugcug

SEQ ID NO: 2841005 - RNA, 16 nt, Human
ugucacucauugcuga

SEQ ID NO: 2841006 - RNA, 12 nt, Human
ugucacucaggc

SEQ ID NO: 2841007 - RNA, 15 nt, Human
ugucacucaggcugg

SEQ ID NO: 2841008 - RNA, 15 nt, Human
ugucacuagaaugga

SEQ ID NO: 2841009 - RNA, 20 nt, Human
ugucacuagaauggauaaaa

SEQ ID NO: 2841010 - RNA, 18 nt, Human
ugucauaaacagaugaau

SEQ ID NO: 2841011 - RNA, 21 nt, Human
ugucauaaacagaugaauaaa

SEQ ID NO: 2841012 - RNA, 18 nt, Human
ugucaguggggcucucug

SEQ ID NO: 2841013 - RNA, 19 nt, Human
ugucaguggggcucucuga

SEQ ID NO: 2841014 - RNA, 20 nt, Human
ugucaguggggcucucugag

SEQ ID NO: 2841015 - RNA, 19 nt, Human
ugucaguuucagauccuga

SEQ ID NO: 2841016 - RNA, 22 nt, Human
ugucccacgugucuuccacuuu

SEQ ID NO: 2841017 - RNA, 20 nt, Human
uguccauuuauccacaggaa

SEQ ID NO: 2841018 - RNA, 21 nt, Human
uguccauuuauccacaggaaa

SEQ ID NO: 2841019 - RNA, 13 nt, Human
uguccauuuguaa

SEQ ID NO: 2841020 - RNA, 15 nt, Human
uguccauuuugugaa

SEQ ID NO: 2841021 - RNA, 16 nt, Human
uguccauuuugugaag

SEQ ID NO: 2841022 - RNA, 18 nt, Human
uguccauuuugugaagcc

SEQ ID NO: 2841023 - RNA, 19 nt, Human
uguccauuuugugaagccc

SEQ ID NO: 2841024 - RNA, 21 nt, Human
uguccauuuugugaagcccug

SEQ ID NO: 2841025 - RNA, 22 nt, Human
uguccauuuugugaagcccugu

SEQ ID NO: 2841026 - RNA, 20 nt, Human
uguccaugugguucuucaaa

SEQ ID NO: 2841027 - RNA, 17 nt, Human
ugucccagguccucacu

SEQ ID NO: 2841028 - RNA, 16 nt, Human
ugucccagguccucac

SEQ ID NO: 2841029 - RNA, 14 nt, Human
ugucccagguccuc

SEQ ID NO: 2841030 - RNA, 22 nt, Human
ugucccauggacacuccagugc

SEQ ID NO: 2841031 - RNA, 18 nt, Human
ugucccauggacacucca

SEQ ID NO: 2841032 - RNA, 19 nt, Human
ugucccauggacacuccag

SEQ ID NO: 2841033 - RNA, 17 nt, Human
ugucccaugcaggcccu

SEQ ID NO: 2841034 - RNA, 17 nt, Human
ugucccauggacacucc

SEQ ID NO: 2841035 - RNA, 16 nt, Human
ugucauucaaaugggu

SEQ ID NO: 2841036 - RNA, 21 nt, Human
ugucauucaaaugggugauau

SEQ ID NO: 2841037 - RNA, 15 nt, Human
uguccaugcuucuca

SEQ ID NO: 2841038 - RNA, 17 nt, Human
uguccaugcuucucauc

SEQ ID NO: 2841039 - RNA, 14 nt, Human
ugucauuguaaaca

SEQ ID NO: 2841040 - RNA, 18 nt, Human
ugucauuguaaacaaacu

SEQ ID NO: 2841041 - RNA, 16 nt, Human
ugucauauacugccau

SEQ ID NO: 2841042 - RNA, 17 nt, Human
ugucauauacugccaug

SEQ ID NO: 2841043 - RNA, 16 nt, Human
ugucauagaaauuaca

SEQ ID NO: 2841044 - RNA, 15 nt, Human
ugucauagaaauuac

SEQ ID NO: 2841045 - RNA, 13 nt, Human
ugucauaucagca

SEQ ID NO: 2841046 - RNA, 17 nt, Human
ugucauaucagcacaua

SEQ ID NO: 2841047 - RNA, 23 nt, Human
ugucauaucagcacauauuuucu

SEQ ID NO: 2841048 - RNA, 23 nt, Human
ugucaucaauaguguccuaugca

SEQ ID NO: 2841049 - RNA, 23 nt, Human
ugucauuaaauggggcucacaaa

SEQ ID NO: 2841050 - RNA, 14 nt, Human
ugucauuaaugugu

SEQ ID NO: 2841051 - RNA, 15 nt, Human
ugucauuaauguguu

SEQ ID NO: 2841052 - RNA, 16 nt, Human
uguaacuuauauugaa

SEQ ID NO: 2841053 - RNA, 17 nt, Human
uguaacuuauauugaag

SEQ ID NO: 2841054 - RNA, 18 nt, Human
uguaacuuauauugaaga

SEQ ID NO: 2841055 - RNA, 20 nt, Human
uguaacuuauauugaagaca

SEQ ID NO: 2841056 - RNA, 23 nt, Human
uguaacuuauauugaagacaauu

SEQ ID NO: 2841057 - RNA, 15 nt, Human
uguaaucccagcacu

SEQ ID NO: 2841058 - RNA, 17 nt, Human
uguaaucccagcacacu

SEQ ID NO: 2841059 - RNA, 15 nt, Human
uguaaugaaguaaag

SEQ ID NO: 2841060 - RNA, 22 nt, Human
uguaacguuuucuuucacacac

SEQ ID NO: 2841061 - RNA, 18 nt, Human
uguaacuaggcucagaga

SEQ ID NO: 2841062 - RNA, 21 nt, Human
uguaacuaggcucagagaugu

SEQ ID NO: 2841063 - RNA, 20 nt, Human
uguaacuauagacuggaaaa

SEQ ID NO: 2841064 - RNA, 23 nt, Human
uguaacuauagacuggaaaaaau

SEQ ID NO: 2841065 - RNA, 19 nt, Human
uguaaccuguugcuguguu

SEQ ID NO: 2841066 - RNA, 23 nt, Human
uguaaccuguugcuguguuuaau

SEQ ID NO: 2841067 - RNA, 15 nt, Human
uguaacgaaacacuu

SEQ ID NO: 2841068 - RNA, 18 nt, Human
uguaacgguuaacuguaa

SEQ ID NO: 2841069 - RNA, 13 nt, Human
uguaaauuauauu

SEQ ID NO: 2841070 - RNA, 15 nt, Human
uguaaauuauauuug

SEQ ID NO: 2841071 - RNA, 22 nt, Human
uguaaauuauauuugugcuaua

SEQ ID NO: 2841072 - RNA, 23 nt, Human
uguaaauuaggaggcucaacaau

SEQ ID NO: 2841073 - RNA, 16 nt, Human
uguaaauuauguaaug

SEQ ID NO: 2841074 - RNA, 20 nt, Human
uguaaauuauguaaugcaaa

SEQ ID NO: 2841075 - RNA, 20 nt, Human
uguaaaaugugaagugaaug

SEQ ID NO: 2841076 - RNA, 17 nt, Human
uguaaaauguugaauaa

SEQ ID NO: 2841077 - RNA, 14 nt, Human
uguaaacaaacucu

SEQ ID NO: 2841078 - RNA, 15 nt, Human
uguaaacaaacucuu

SEQ ID NO: 2841079 - RNA, 18 nt, Human
uguaaacacagucaaaau

SEQ ID NO: 2841080 - RNA, 14 nt, Human
uguaaacauguguu

SEQ ID NO: 2841081 - RNA, 22 nt, Human
uguaaacauguguuuuaauucc

SEQ ID NO: 2841082 - RNA, 14 nt, Human
uguaaaccaauuuu

SEQ ID NO: 2841083 - RNA, 19 nt, Human
uguaaacauaccaacaugu

SEQ ID NO: 2841084 - RNA, 20 nt, Human
uguaaacaggagacaggaag

SEQ ID NO: 2841085 - RNA, 14 nt, Human
ugguaguaaaacac

SEQ ID NO: 2841086 - RNA, 15 nt, Human
ugguaguaaaacaca

SEQ ID NO: 2841087 - RNA, 18 nt, Human
ugguaguaaaacacagag

SEQ ID NO: 2841088 - RNA, 19 nt, Human
ugguaguaaaacacagagg

SEQ ID NO: 2841089 - RNA, 22 nt, Human
ugguaguaaucacaguuggccu

SEQ ID NO: 2841090 - RNA, 14 nt, Human
ugguagguacuuuu

SEQ ID NO: 2841091 - RNA, 20 nt, Human
ugguagguacuuuuugugaa

SEQ ID NO: 2841092 - RNA, 22 nt, Human
ugguagguacuuuuugugaaga

SEQ ID NO: 2841093 - RNA, 16 nt, Human
ugguaggcauuuccua

SEQ ID NO: 2841094 - RNA, 18 nt, Human
ugguaggccuuuuaacau

SEQ ID NO: 2841095 - RNA, 21 nt, Human
ugguaggccuuuuaacauuuu

SEQ ID NO: 2841096 - RNA, 12 nt, Human
uguaaauguguu

SEQ ID NO: 2841097 - RNA, 15 nt, Human
uguaaauguguugga

SEQ ID NO: 2841098 - RNA, 22 nt, Human
uguaaauguguuggacaaaugu

SEQ ID NO: 2841099 - RNA, 11 nt, Human
uguaaauguua

SEQ ID NO: 2841100 - RNA, 14 nt, Human
uguaaauguuaguu

SEQ ID NO: 2841101 - RNA, 17 nt, Human
uguaaauguuaguuucu

SEQ ID NO: 2841102 - RNA, 19 nt, Human
uguaaauguuaguuucuug

SEQ ID NO: 2841103 - RNA, 22 nt, Human
uguaaauguuaguuucuuggua

SEQ ID NO: 2841104 - RNA, 16 nt, Human
uguaaauguuauuucu

SEQ ID NO: 2841105 - RNA, 17 nt, Human
uguaaauguuauuucug

SEQ ID NO: 2841106 - RNA, 19 nt, Human
uguaaauguuauuucugca

SEQ ID NO: 2841107 - RNA, 21 nt, Human
uguaaauguuauuucugcaaa

SEQ ID NO: 2841108 - RNA, 22 nt, Human
uguaaauguuauuucugcaaac

SEQ ID NO: 2841109 - RNA, 22 nt, Human
uguaaauguuuguuaaaaauaa

SEQ ID NO: 2841110 - RNA, 21 nt, Human
uguagaguuaagaagcuguug

SEQ ID NO: 2841111 - RNA, 12 nt, Human
uguagaguuaag

SEQ ID NO: 2841112 - RNA, 13 nt, Human
uguagaguuaaga

SEQ ID NO: 2841113 - RNA, 14 nt, Human
uguagaguuaagaa

SEQ ID NO: 2841114 - RNA, 15 nt, Human
uguagaguuaagaag

SEQ ID NO: 2841115 - RNA, 16 nt, Human
uguagaguuaagaagc

SEQ ID NO: 2841116 - RNA, 17 nt, Human
uguagaguuaagaagcu

SEQ ID NO: 2841117 - RNA, 18 nt, Human
uguagaguuaagaagcug

SEQ ID NO: 2841118 - RNA, 19 nt, Human
uguagaguuaagaagcugu

SEQ ID NO: 2841119 - RNA, 21 nt, Human
uguaauguagcguguuuacau

SEQ ID NO: 2841120 - RNA, 15 nt, Human
uguacugacuugagg

SEQ ID NO: 2841121 - RNA, 20 nt, Human
uguacugaaaaaugguaauu

SEQ ID NO: 2841122 - RNA, 19 nt, Human
uguacucuggggugcugcc

SEQ ID NO: 2841123 - RNA, 12 nt, Human
uguacugaaaaa

SEQ ID NO: 2841124 - RNA, 15 nt, Human
uguacucuaacuuaa

SEQ ID NO: 2841125 - RNA, 18 nt, Human
uguacucaggaggcugag

SEQ ID NO: 2841126 - RNA, 12 nt, Human
uguacuccuccc

SEQ ID NO: 2841127 - RNA, 13 nt, Human
uguacuccuccca

SEQ ID NO: 2841128 - RNA, 16 nt, Human
uguacuaauucuuaca

SEQ ID NO: 2841129 - RNA, 14 nt, Human
uguacuaccugugu

SEQ ID NO: 2841130 - RNA, 17 nt, Human
uguacuaccuguguaua

SEQ ID NO: 2841131 - RNA, 16 nt, Human
uguacuaguacugugu

SEQ ID NO: 2841132 - RNA, 17 nt, Human
uguacuaguacugugua

SEQ ID NO: 2841133 - RNA, 18 nt, Human
uguacuaguacuguguac

SEQ ID NO: 2841134 - RNA, 19 nt, Human
uguacuaguacuguguacu

SEQ ID NO: 2841135 - RNA, 21 nt, Human
uguacuaguacuguguacugu

SEQ ID NO: 2841136 - RNA, 13 nt, Human
uguacuaguuuua

SEQ ID NO: 2841137 - RNA, 19 nt, Human
uguacuauggaaaaucagc

SEQ ID NO: 2841138 - RNA, 21 nt, Human
uguacuauggaaaaucagcug

SEQ ID NO: 2841139 - RNA, 16 nt, Human
uguacgucugacaggc

SEQ ID NO: 2841140 - RNA, 17 nt, Human
uguacgucugacaggca

SEQ ID NO: 2841141 - RNA, 20 nt, Human
uguacguuuguaugugugua

SEQ ID NO: 2841142 - RNA, 19 nt, Human
uguacguuuguaugugugu

SEQ ID NO: 2841143 - RNA, 16 nt, Human
uguacguuuguaugug

SEQ ID NO: 2841144 - RNA, 17 nt, Human
uguaccuguuccuuaga

SEQ ID NO: 2841145 - RNA, 18 nt, Human
uguaccuucuuucacucu

SEQ ID NO: 2841146 - RNA, 12 nt, Human
uguacccuuaag

SEQ ID NO: 2841147 - RNA, 22 nt, Human
uguacccuuaagucacccuagc

SEQ ID NO: 2841148 - RNA, 16 nt, Human
uguaccuguguacaua

SEQ ID NO: 2841149 - RNA, 19 nt, Human
uguaccuguguacauaacu

SEQ ID NO: 2841150 - RNA, 14 nt, Human
uguaccauuugccu

SEQ ID NO: 2841151 - RNA, 12 nt, Human
uguacagucugu

SEQ ID NO: 2841152 - RNA, 13 nt, Human
uguacagucuguc

SEQ ID NO: 2841153 - RNA, 14 nt, Human
uguacagucugucu

SEQ ID NO: 2841154 - RNA, 15 nt, Human
uguacagucugucuu

SEQ ID NO: 2841155 - RNA, 19 nt, Human
uguacagucugucuucugu

SEQ ID NO: 2841156 - RNA, 20 nt, Human
uguacagucugucuucugua

SEQ ID NO: 2841157 - RNA, 19 nt, Human
uguaaugaauuccuagaau

SEQ ID NO: 2841158 - RNA, 12 nt, Human
uguaaugcaaaa

SEQ ID NO: 2841159 - RNA, 17 nt, Human
uguaaugcgauuuuauu

SEQ ID NO: 2841160 - RNA, 22 nt, Human
uguaaugcgauuuuauuacugg

SEQ ID NO: 2841161 - RNA, 12 nt, Human
uguaaugcugca

SEQ ID NO: 2841162 - RNA, 13 nt, Human
uguaaugcugcac

SEQ ID NO: 2841163 - RNA, 14 nt, Human
uguaaugcugcacu

SEQ ID NO: 2841164 - RNA, 18 nt, Human
uguaaugcugcacuuccu

SEQ ID NO: 2841165 - RNA, 19 nt, Human
uguaaugcugcacuuccug

SEQ ID NO: 2841166 - RNA, 20 nt, Human
uguaaugcugcacuuccugu

SEQ ID NO: 2841167 - RNA, 15 nt, Human
ugugcgcucugugga

SEQ ID NO: 2841168 - RNA, 20 nt, Human
ugugccuggguggacauggc

SEQ ID NO: 2841169 - RNA, 15 nt, Human
ugugccucuuugucu

SEQ ID NO: 2841170 - RNA, 22 nt, Human
ugugccuggcuucuuucucuca

SEQ ID NO: 2841171 - RNA, 23 nt, Human
ugugccuggcuucuuucucucag

SEQ ID NO: 2841172 - RNA, 13 nt, Human
ugugccuggggga

SEQ ID NO: 2841173 - RNA, 21 nt, Human
ugugccugggggaguuuuccu

SEQ ID NO: 2841174 - RNA, 22 nt, Human
ugugccugggggaguuuuccuc

SEQ ID NO: 2841175 - RNA, 13 nt, Human
ugugccugcagcc

SEQ ID NO: 2841176 - RNA, 15 nt, Human
ugugccugacccuac

SEQ ID NO: 2841177 - RNA, 18 nt, Human
ugugccugacugcccagc

SEQ ID NO: 2841178 - RNA, 12 nt, Human
ugugccugcagc

SEQ ID NO: 2841179 - RNA, 15 nt, Human
ugugccucugccugu

SEQ ID NO: 2841180 - RNA, 23 nt, Human
ugugcuucacaguagagccagcu

SEQ ID NO: 2841181 - RNA, 12 nt, Human
ugugcuucuccc

SEQ ID NO: 2841182 - RNA, 15 nt, Human
ugugcuucuccccag

SEQ ID NO: 2841183 - RNA, 16 nt, Human
ugugcuucuccccaga

SEQ ID NO: 2841184 - RNA, 18 nt, Human
ugugcuucuccccagaau

SEQ ID NO: 2841185 - RNA, 20 nt, Human
ugugcuucuccccagaauuc

SEQ ID NO: 2841186 - RNA, 22 nt, Human
ugugcuuugcucuugucccacg

SEQ ID NO: 2841187 - RNA, 23 nt, Human
ugugcuuugcucuugucccacgu

SEQ ID NO: 2841188 - RNA, 16 nt, Human
ugugcuuuuaaaugca

SEQ ID NO: 2841189 - RNA, 16 nt, Human
ugugcuuuuccuauuu

SEQ ID NO: 2841190 - RNA, 14 nt, Human
ugugcuuuuccuga

SEQ ID NO: 2841191 - RNA, 21 nt, Human
ugugcuuuuccugauaaagca

SEQ ID NO: 2841192 - RNA, 14 nt, Human
ugugcuuuuccuau

SEQ ID NO: 2841193 - RNA, 22 nt, Human
ugugcuucacaguagagccagc

SEQ ID NO: 2841194 - RNA, 15 nt, Human
ugugcuucacaguag

SEQ ID NO: 2841195 - RNA, 22 nt, Human
ugugcuuauguaugagguacaa

SEQ ID NO: 2841196 - RNA, 23 nt, Human
ugugcuaaccacgucugucuuca

SEQ ID NO: 2841197 - RNA, 14 nt, Human
ugugcuacagauga

SEQ ID NO: 2841198 - RNA, 14 nt, Human
ugugcuaaauauca

SEQ ID NO: 2841199 - RNA, 21 nt, Human
ugugcuacugucuuuggaaaa

SEQ ID NO: 2841200 - RNA, 13 nt, Human
ugugccucugccu

SEQ ID NO: 2841201 - RNA, 15 nt, Human
ugugcauguguguau

SEQ ID NO: 2841202 - RNA, 16 nt, Human
ugugcauguguguaua

SEQ ID NO: 2841203 - RNA, 17 nt, Human
ugugcauguguguauaa

SEQ ID NO: 2841204 - RNA, 18 nt, Human
ugugcauguguguauaag

SEQ ID NO: 2841205 - RNA, 14 nt, Human
ugugccucugccug

SEQ ID NO: 2841206 - RNA, 20 nt, Human
ugugcagugaagguugcuga

SEQ ID NO: 2841207 - RNA, 13 nt, Human
ugugcaguucuag

SEQ ID NO: 2841208 - RNA, 19 nt, Human
ugugcaguucuaguuugca

SEQ ID NO: 2841209 - RNA, 22 nt, Human
ugugcaguucuaguuugcauuc

SEQ ID NO: 2841210 - RNA, 15 nt, Human
ugugcauagugcugg

SEQ ID NO: 2841211 - RNA, 17 nt, Human
ugugcauagugcuggga

SEQ ID NO: 2841212 - RNA, 18 nt, Human
ugugcauagugcugggau

SEQ ID NO: 2841213 - RNA, 16 nt, Human
ugugcauggaggcccu

SEQ ID NO: 2841214 - RNA, 19 nt, Human
ugugcauggaggcccuccu

SEQ ID NO: 2841215 - RNA, 22 nt, Human
ugugcauggaggcccuccugug

SEQ ID NO: 2841216 - RNA, 14 nt, Human
ugugcaugugugua

SEQ ID NO: 2841217 - RNA, 23 nt, Human
ugugcauguaugucuuggacacu

SEQ ID NO: 2841218 - RNA, 20 nt, Human
ugugcauguaugucuuggac

SEQ ID NO: 2841219 - RNA, 22 nt, Human
ugugcacaugcacgugugugca

SEQ ID NO: 2841220 - RNA, 16 nt, Human
ugugcacaugcacgug

SEQ ID NO: 2841221 - RNA, 19 nt, Human
ugugcaccaccacacccgg

SEQ ID NO: 2841222 - RNA, 21 nt, Human
ugugcaccaccacacccggcu

SEQ ID NO: 2841223 - RNA, 14 nt, Human
ugugcacccauggg

SEQ ID NO: 2841224 - RNA, 23 nt, Human
ugugcaagcgacgacagaugcua

SEQ ID NO: 2841225 - RNA, 19 nt, Human
ugugcaguaauagcacugc

SEQ ID NO: 2841226 - RNA, 15 nt, Human
ugugcagcgcagcug

SEQ ID NO: 2841227 - RNA, 20 nt, Human
ugugcagcgcagcuggacuc

SEQ ID NO: 2841228 - RNA, 12 nt, Human
ugugcagcuuuu

SEQ ID NO: 2841229 - RNA, 16 nt, Human
ugugcagcuuuugguc

SEQ ID NO: 2841230 - RNA, 17 nt, Human
ugugcagcuuuugguca

SEQ ID NO: 2841231 - RNA, 15 nt, Human
ugugcagggagggca

SEQ ID NO: 2841232 - RNA, 17 nt, Human
ugugcagggagggcagu

SEQ ID NO: 2841233 - RNA, 18 nt, Human
ugugcaggugcuauuguu

SEQ ID NO: 2841234 - RNA, 19 nt, Human
ugugcaggugcuauuguua

SEQ ID NO: 2841235 - RNA, 21 nt, Human
ugugcaggugcuauuguuacu

SEQ ID NO: 2841236 - RNA, 21 nt, Human
ugugcaccuuaccaacuuucu

SEQ ID NO: 2841237 - RNA, 22 nt, Human
ugugcaccuuaccaacuuucug

SEQ ID NO: 2841238 - RNA, 23 nt, Human
ugugcacgcagauuagcaggcca

SEQ ID NO: 2841239 - RNA, 13 nt, Human
ugugcagcagauu

SEQ ID NO: 2841240 - RNA, 15 nt, Human
ugugcagcagauugg

SEQ ID NO: 2841241 - RNA, 17 nt, Human
ugugcagcagauuggaa

SEQ ID NO: 2841242 - RNA, 22 nt, Human
uguggcugaggaggccuccauc

SEQ ID NO: 2841243 - RNA, 18 nt, Human
uguggcugggggcaggag

SEQ ID NO: 2841244 - RNA, 15 nt, Human
uguggcugggggcag

SEQ ID NO: 2841245 - RNA, 14 nt, Human
uguggcuccuuccc

SEQ ID NO: 2841246 - RNA, 15 nt, Human
uguggcuccuuccca

SEQ ID NO: 2841247 - RNA, 13 nt, Human
uguggcugaggag

SEQ ID NO: 2841248 - RNA, 16 nt, Human
uguggcugaggaggcc

SEQ ID NO: 2841249 - RNA, 21 nt, Human
uguggcugaggaggccuccau

SEQ ID NO: 2841250 - RNA, 18 nt, Human
uguggcuuuuuuaaaaaa

SEQ ID NO: 2841251 - RNA, 15 nt, Human
ugugggaaaaaaaug

SEQ ID NO: 2841252 - RNA, 21 nt, Human
ugugggaaaaaaaugaaugag

SEQ ID NO: 2841253 - RNA, 19 nt, Human
uguggcuugcuagcuaugu

SEQ ID NO: 2841254 - RNA, 21 nt, Human
uguggcugggggcaggagggc

SEQ ID NO: 2841255 - RNA, 20 nt, Human
uguggcuguagaucccaaga

SEQ ID NO: 2841256 - RNA, 15 nt, Human
ugugggaauuuaaga

SEQ ID NO: 2841257 - RNA, 12 nt, Human
ugugggacccca

SEQ ID NO: 2841258 - RNA, 18 nt, Human
ugugggaccccaggccca

SEQ ID NO: 2841259 - RNA, 13 nt, Human
uguggggaaaggg

SEQ ID NO: 2841260 - RNA, 17 nt, Human
uguggggacccaggcuc

SEQ ID NO: 2841261 - RNA, 14 nt, Human
ugugggggguccuu

SEQ ID NO: 2841262 - RNA, 12 nt, Human
uguggggccuug

SEQ ID NO: 2841263 - RNA, 18 nt, Human
uguggggcuuggcgugga

SEQ ID NO: 2841264 - RNA, 10 nt, Human
uguguacugu

SEQ ID NO: 2841265 - RNA, 19 nt, Human
uguguacauggcagaguuu

SEQ ID NO: 2841266 - RNA, 22 nt, Human
uguguacucacugaagccugcg

SEQ ID NO: 2841267 - RNA, 17 nt, Human
uguguacuguauagaca

SEQ ID NO: 2841268 - RNA, 19 nt, Human
uguguacuguauagacagu

SEQ ID NO: 2841269 - RNA, 20 nt, Human
uguguacuguauagacaguu

SEQ ID NO: 2841270 - RNA, 21 nt, Human
uguguacuguauagacaguuu

SEQ ID NO: 2841271 - RNA, 14 nt, Human
uguguacuguguca

SEQ ID NO: 2841272 - RNA, 15 nt, Human
uguggguaccuguau

SEQ ID NO: 2841273 - RNA, 13 nt, Human
uguggacacagcu

SEQ ID NO: 2841274 - RNA, 14 nt, Human
uguggacacagcuc

SEQ ID NO: 2841275 - RNA, 20 nt, Human
uguggaaagccucugcugcc

SEQ ID NO: 2841276 - RNA, 19 nt, Human
uguggaaagccucugcugc

SEQ ID NO: 2841277 - RNA, 17 nt, Human
uguggaaagccucugcu

SEQ ID NO: 2841278 - RNA, 15 nt, Human
uguggaaagccucug

SEQ ID NO: 2841279 - RNA, 14 nt, Human
uguggaaagccucu

SEQ ID NO: 2841280 - RNA, 18 nt, Human
uguggaaaccuccacagg

SEQ ID NO: 2841281 - RNA, 12 nt, Human
uguggaaagccu

SEQ ID NO: 2841282 - RNA, 17 nt, Human
uguggaaaaugaaaauu

SEQ ID NO: 2841283 - RNA, 15 nt, Human
uguggaaaagaaaca

SEQ ID NO: 2841284 - RNA, 20 nt, Human
uguggaaaagaaacacgcac

SEQ ID NO: 2841285 - RNA, 13 nt, Human
uguggaaaacaga

SEQ ID NO: 2841286 - RNA, 21 nt, Human
uguggcuccuggggguucuuu

SEQ ID NO: 2841287 - RNA, 16 nt, Human
uguggacacagcucuu

SEQ ID NO: 2841288 - RNA, 15 nt, Human
uguggacacagcucu

SEQ ID NO: 2841289 - RNA, 23 nt, Human
uguggacuguggcacuugccugg

SEQ ID NO: 2841290 - RNA, 12 nt, Human
uguggacucugg

SEQ ID NO: 2841291 - RNA, 22 nt, Human
uguggacucuggugccuccaga

SEQ ID NO: 2841292 - RNA, 23 nt, Human
uguggacucuggugccuccagag

SEQ ID NO: 2841293 - RNA, 15 nt, Human
ugucugcagccuuga

SEQ ID NO: 2841294 - RNA, 16 nt, Human
ugucugccaauuuuug

SEQ ID NO: 2841295 - RNA, 11 nt, Human
ugucugcccuu

SEQ ID NO: 2841296 - RNA, 16 nt, Human
ugucugcccuucaccc

SEQ ID NO: 2841297 - RNA, 15 nt, Human
ugucugcgaaguccu

SEQ ID NO: 2841298 - RNA, 23 nt, Human
ugucugcgaaguccuauggaaac

SEQ ID NO: 2841299 - RNA, 17 nt, Human
ugucugcgugggucaga

SEQ ID NO: 2841300 - RNA, 21 nt, Human
ugucugcgugguuccuuucuc

SEQ ID NO: 2841301 - RNA, 19 nt, Human
ugucucaagagggcacugg

SEQ ID NO: 2841302 - RNA, 23 nt, Human
ugucucaagagggcacugguggc

SEQ ID NO: 2841303 - RNA, 20 nt, Human
ugucucaagagggcacuggu

SEQ ID NO: 2841304 - RNA, 21 nt, Human
ugucucaagagggcacuggug

SEQ ID NO: 2841305 - RNA, 16 nt, Human
ugucucaggucccugc

SEQ ID NO: 2841306 - RNA, 17 nt, Human
ugucucaggucccugca

SEQ ID NO: 2841307 - RNA, 16 nt, Human
ugucuuuuuucacuac

SEQ ID NO: 2841308 - RNA, 14 nt, Human
ugugaaguuuacau

SEQ ID NO: 2841309 - RNA, 20 nt, Human
ugugaaguuuacauuguaaa

SEQ ID NO: 2841310 - RNA, 20 nt, Human
ugugaaaccuuuuuuaagau

SEQ ID NO: 2841311 - RNA, 14 nt, Human
ugugaaaccuguga

SEQ ID NO: 2841312 - RNA, 22 nt, Human
ugugaaaaagaugccaauuauu

SEQ ID NO: 2841313 - RNA, 22 nt, Human
ugugaaaccuuuuuuaagauuu

SEQ ID NO: 2841314 - RNA, 19 nt, Human
ugugaaacuggcacugaau

SEQ ID NO: 2841315 - RNA, 14 nt, Human
ugugaaaauguguu

SEQ ID NO: 2841316 - RNA, 15 nt, Human
ugugaaacacagcug

SEQ ID NO: 2841317 - RNA, 16 nt, Human
ugugaaacacagcugu

SEQ ID NO: 2841318 - RNA, 17 nt, Human
ugugaaacacagcuguu

SEQ ID NO: 2841319 - RNA, 19 nt, Human
ugugaaacacuuugccucc

SEQ ID NO: 2841320 - RNA, 14 nt, Human
ugugaaaaaaauaa

SEQ ID NO: 2841321 - RNA, 21 nt, Human
ugucuggugguggcaccaucu

SEQ ID NO: 2841322 - RNA, 14 nt, Human
ugugacccacuucu

SEQ ID NO: 2841323 - RNA, 21 nt, Human
ugugacccacuucucaucaca

SEQ ID NO: 2841324 - RNA, 13 nt, Human
ugugaccaccacc

SEQ ID NO: 2841325 - RNA, 20 nt, Human
ugugacaauaauauuguugu

SEQ ID NO: 2841326 - RNA, 22 nt, Human
ugugacaauaauauuguuguau

SEQ ID NO: 2841327 - RNA, 12 nt, Human
ugugacaaaauu

SEQ ID NO: 2841328 - RNA, 19 nt, Human
ugugacaacugucuaacuu

SEQ ID NO: 2841329 - RNA, 21 nt, Human
ugugacaacugucuaacuuua

SEQ ID NO: 2841330 - RNA, 15 nt, Human
ugugacacacuacac

SEQ ID NO: 2841331 - RNA, 16 nt, Human
ugugacacacuacacc

SEQ ID NO: 2841332 - RNA, 19 nt, Human
ugugacacacuacaccaca

SEQ ID NO: 2841333 - RNA, 21 nt, Human
ugugacacacuacaccacaca

SEQ ID NO: 2841334 - RNA, 22 nt, Human
ugugacacacuacaccacacac

SEQ ID NO: 2841335 - RNA, 23 nt, Human
ugugacacacuacaccacacaca

SEQ ID NO: 2841336 - RNA, 17 nt, Human
ugugacacauaugcacc

SEQ ID NO: 2841337 - RNA, 22 nt, Human
ugugacacauaugcaccuugug

SEQ ID NO: 2841338 - RNA, 23 nt, Human
ugugacagcucuuuuugugaagu

SEQ ID NO: 2841339 - RNA, 12 nt, Human
ugugacagggcc

SEQ ID NO: 2841340 - RNA, 13 nt, Human
ugugacagggcca

SEQ ID NO: 2841341 - RNA, 14 nt, Human
ugugacagggccag

SEQ ID NO: 2841342 - RNA, 15 nt, Human
ugugacagggccagu

SEQ ID NO: 2841343 - RNA, 22 nt, Human
ugugacagggccaguggggccu

SEQ ID NO: 2841344 - RNA, 23 nt, Human
ugugacagggccaguggggccug

SEQ ID NO: 2841345 - RNA, 21 nt, Human
ugugacaaggauugcuacugu

SEQ ID NO: 2841346 - RNA, 13 nt, Human
ugugaauggauug

SEQ ID NO: 2841347 - RNA, 15 nt, Human
ugugaauggauugga

SEQ ID NO: 2841348 - RNA, 23 nt, Human
ugugaauuucuucacuguugaaa

SEQ ID NO: 2841349 - RNA, 14 nt, Human
ugugaaugcuucuc

SEQ ID NO: 2841350 - RNA, 15 nt, Human
ugugaaugcuucuca

SEQ ID NO: 2841351 - RNA, 17 nt, Human
ugugaaugcuucucacu

SEQ ID NO: 2841352 - RNA, 17 nt, Human
ugugaaugaacacucuu

SEQ ID NO: 2841353 - RNA, 14 nt, Human
ugugaaugaacacu

SEQ ID NO: 2841354 - RNA, 23 nt, Human
ugugaaugaacacucuuuugcuu

SEQ ID NO: 2841355 - RNA, 19 nt, Human
ugugaaugauucauguuau

SEQ ID NO: 2841356 - RNA, 20 nt, Human
ugugaaugauucauguuaua

SEQ ID NO: 2841357 - RNA, 22 nt, Human
ugugaaugauucauguuauauu

SEQ ID NO: 2841358 - RNA, 20 nt, Human
ugugaauauggacucaguuu

SEQ ID NO: 2841359 - RNA, 13 nt, Human
ugugauaauuuaa

SEQ ID NO: 2841360 - RNA, 19 nt, Human
ugugaguuuggucuggacu

SEQ ID NO: 2841361 - RNA, 20 nt, Human
ugugaguuuggucuggacug

SEQ ID NO: 2841362 - RNA, 21 nt, Human
ugugaguuuggucuggacuga

SEQ ID NO: 2841363 - RNA, 16 nt, Human
ugugaguaucagaauu

SEQ ID NO: 2841364 - RNA, 17 nt, Human
ugugaguaucagaauug

SEQ ID NO: 2841365 - RNA, 18 nt, Human
ugugaguaucagaauuga

SEQ ID NO: 2841366 - RNA, 16 nt, Human
ugugagguuucccaau

SEQ ID NO: 2841367 - RNA, 20 nt, Human
ugugagguuucccaauggug

SEQ ID NO: 2841368 - RNA, 21 nt, Human
ugugagguuucccaauggugu

SEQ ID NO: 2841369 - RNA, 22 nt, Human
ugugagguuucccaaugguguu

SEQ ID NO: 2841370 - RNA, 12 nt, Human
ugugaguaaaua

SEQ ID NO: 2841371 - RNA, 14 nt, Human
ugugaguaaauauu

SEQ ID NO: 2841372 - RNA, 15 nt, Human
ugugaguaaauauug

SEQ ID NO: 2841373 - RNA, 19 nt, Human
ugugaguaaaucagauguu

SEQ ID NO: 2841374 - RNA, 22 nt, Human
ugugaguaaaucagauguugaa

SEQ ID NO: 2841375 - RNA, 12 nt, Human
ugugaccccucc

SEQ ID NO: 2841376 - RNA, 14 nt, Human
ugugaccccuccug

SEQ ID NO: 2841377 - RNA, 15 nt, Human
ugugaccccuccugg

SEQ ID NO: 2841378 - RNA, 16 nt, Human
ugugaccccuccuggg

SEQ ID NO: 2841379 - RNA, 16 nt, Human
uuggcuuuguuuggau

SEQ ID NO: 2841380 - RNA, 14 nt, Human
uugggaggccgagg

SEQ ID NO: 2841381 - RNA, 18 nt, Human
uugggaggccgaggcagg

SEQ ID NO: 2841382 - RNA, 18 nt, Human
uugggaacugaacucacu

SEQ ID NO: 2841383 - RNA, 19 nt, Human
uugggagcuugggaaugga

SEQ ID NO: 2841384 - RNA, 16 nt, Human
uuggcuuaccugaccu

SEQ ID NO: 2841385 - RNA, 17 nt, Human
uugggaaacuugucacu

SEQ ID NO: 2841386 - RNA, 19 nt, Human
uugggaaacuugucacuug

SEQ ID NO: 2841387 - RNA, 21 nt, Human
uugggaaacuugucacuugca

SEQ ID NO: 2841388 - RNA, 22 nt, Human
uugggaaccaagcuauuccuuu

SEQ ID NO: 2841389 - RNA, 14 nt, Human
uuggcuuaaauaua

SEQ ID NO: 2841390 - RNA, 15 nt, Human
uuggcuuaaauauag

SEQ ID NO: 2841391 - RNA, 16 nt, Human
uuggguggaugccugg

SEQ ID NO: 2841392 - RNA, 15 nt, Human
uugguaaaguccuuu

SEQ ID NO: 2841393 - RNA, 20 nt, Human
uugguaaaguccuuuucuug

SEQ ID NO: 2841394 - RNA, 20 nt, Human
uuggccaccaggugccuuuc

SEQ ID NO: 2841395 - RNA, 18 nt, Human
uuggcugggggccucagu

SEQ ID NO: 2841396 - RNA, 23 nt, Human
uuggcuggaugaaauuuucuaga

SEQ ID NO: 2841397 - RNA, 21 nt, Human
uuggcuggaugaaauuuucua

SEQ ID NO: 2841398 - RNA, 20 nt, Human
uuggcuggaugaaauuuucu

SEQ ID NO: 2841399 - RNA, 22 nt, Human
uuggcugggggccucagugcca

SEQ ID NO: 2841400 - RNA, 21 nt, Human
uuggcugggggccucagugcc

SEQ ID NO: 2841401 - RNA, 17 nt, Human
uuggcugugaggccccu

SEQ ID NO: 2841402 - RNA, 24 nt, Human
uuggccaaagccaaagcuaggccu

SEQ ID NO: 2841403 - RNA, 14 nt, Human
uuggccaggcuggu

SEQ ID NO: 2841404 - RNA, 23 nt, Human
uuggauuuuuaauuaaaaacuag

SEQ ID NO: 2841405 - RNA, 19 nt, Human
uuggcauggauuucugucu

SEQ ID NO: 2841406 - RNA, 14 nt, Human
uuggcauggcuuua

SEQ ID NO: 2841407 - RNA, 21 nt, Human
uuggcaucacagggcagagcc

SEQ ID NO: 2841408 - RNA, 15 nt, Human
uuggcaacagaagca

SEQ ID NO: 2841409 - RNA, 13 nt, Human
uuggcaaggaaag

SEQ ID NO: 2841410 - RNA, 15 nt, Human
uuggcaucagcuggc

SEQ ID NO: 2841411 - RNA, 15 nt, Human
uuggcaaaagccuug

SEQ ID NO: 2841412 - RNA, 17 nt, Human
uuggcaaaagccuugug

SEQ ID NO: 2841413 - RNA, 20 nt, Human
uuggcaaaagccuuguguau

SEQ ID NO: 2841414 - RNA, 16 nt, Human
uuggcaaauuccuagu

SEQ ID NO: 2841415 - RNA, 14 nt, Human
uuggcaacagaagc

SEQ ID NO: 2841416 - RNA, 15 nt, Human
uuguagauuuagugu

SEQ ID NO: 2841417 - RNA, 20 nt, Human
uuguaucucugaagcauguu

SEQ ID NO: 2841418 - RNA, 21 nt, Human
uuguaucucugaagcauguuu

SEQ ID NO: 2841419 - RNA, 13 nt, Human
uuguauuacagau

SEQ ID NO: 2841420 - RNA, 14 nt, Human
uuguauuacagaug

SEQ ID NO: 2841421 - RNA, 14 nt, Human
uuguauuauugcug

SEQ ID NO: 2841422 - RNA, 19 nt, Human
uuguauuauugcuguugcu

SEQ ID NO: 2841423 - RNA, 22 nt, Human
uuguauuauugcuguugcuuga

SEQ ID NO: 2841424 - RNA, 22 nt, Human
uuguauucaaaaauuaucuaua

SEQ ID NO: 2841425 - RNA, 23 nt, Human
uuguagagaacacgcguauuuac

SEQ ID NO: 2841426 - RNA, 13 nt, Human
uuguagaauuguu

SEQ ID NO: 2841427 - RNA, 14 nt, Human
uuguagaauuguua

SEQ ID NO: 2841428 - RNA, 16 nt, Human
uuguagaauuguuaua

SEQ ID NO: 2841429 - RNA, 15 nt, Human
uuguagagccagggu

SEQ ID NO: 2841430 - RNA, 14 nt, Human
uuguagagccaggg

SEQ ID NO: 2841431 - RNA, 11 nt, Human
uuguacauaaa

SEQ ID NO: 2841432 - RNA, 16 nt, Human
uuguacagcuguuuaa

SEQ ID NO: 2841433 - RNA, 13 nt, Human
uuguacagcccag

SEQ ID NO: 2841434 - RNA, 15 nt, Human
uuguacagcccagag

SEQ ID NO: 2841435 - RNA, 21 nt, Human
uuguacagcguuuuaaaagaa

SEQ ID NO: 2841436 - RNA, 16 nt, Human
uuguacaguuuaaaau

SEQ ID NO: 2841437 - RNA, 14 nt, Human
uuguaaaucacauc

SEQ ID NO: 2841438 - RNA, 18 nt, Human
uuguacagaauuuuggaa

SEQ ID NO: 2841439 - RNA, 18 nt, Human
uuguaaagaaauuuacua

SEQ ID NO: 2841440 - RNA, 20 nt, Human
uuguaaagaaauuuacuaua

SEQ ID NO: 2841441 - RNA, 21 nt, Human
uuguaaagaaauuuacuauau

SEQ ID NO: 2841442 - RNA, 16 nt, Human
uuguaaagugaagaau

SEQ ID NO: 2841443 - RNA, 19 nt, Human
uuggaaauccuaguuuccu

SEQ ID NO: 2841444 - RNA, 22 nt, Human
uuggaaauccuaguuuccucuc

SEQ ID NO: 2841445 - RNA, 24 nt, Human
uuggaaauccuaguuuccucuccu

SEQ ID NO: 2841446 - RNA, 21 nt, Human
uuggaaauggaugcaaaguac

SEQ ID NO: 2841447 - RNA, 13 nt, Human
uuggaaauauuca

SEQ ID NO: 2841448 - RNA, 13 nt, Human
uuggaacagaaug

SEQ ID NO: 2841449 - RNA, 14 nt, Human
uuggaacagaaugu

SEQ ID NO: 2841450 - RNA, 22 nt, Human
uuggaaccacggagaucuccuu

SEQ ID NO: 2841451 - RNA, 22 nt, Human
uuggaaagcaucaccucaggcc

SEQ ID NO: 2841452 - RNA, 12 nt, Human
uugcuuaguaaa

SEQ ID NO: 2841453 - RNA, 17 nt, Human
uugcuuaccuugacugu

SEQ ID NO: 2841454 - RNA, 20 nt, Human
uuggaaagcaucaccucagg

SEQ ID NO: 2841455 - RNA, 13 nt, Human
uugcuguuuugau

SEQ ID NO: 2841456 - RNA, 18 nt, Human
uugcuguaugcugaucau

SEQ ID NO: 2841457 - RNA, 21 nt, Human
uugcuguaugcugaucaucgc

SEQ ID NO: 2841458 - RNA, 16 nt, Human
uugcugccucagagca

SEQ ID NO: 2841459 - RNA, 20 nt, Human
uugcugccacuuuuuaacua

SEQ ID NO: 2841460 - RNA, 16 nt, Human
uugcuguaggaucuaa

SEQ ID NO: 2841461 - RNA, 19 nt, Human
uugcuguaggaucuaaggc

SEQ ID NO: 2841462 - RNA, 16 nt, Human
uugcuguaagaugucu

SEQ ID NO: 2841463 - RNA, 18 nt, Human
uugcuguaagaugucugu

SEQ ID NO: 2841464 - RNA, 19 nt, Human
uugcuguaagaugucuguu

SEQ ID NO: 2841465 - RNA, 15 nt, Human
uuggacccaaggaaa

SEQ ID NO: 2841466 - RNA, 19 nt, Human
uuggacccaaggaaaacug

SEQ ID NO: 2841467 - RNA, 14 nt, Human
uuggaccccagaga

SEQ ID NO: 2841468 - RNA, 13 nt, Human
uuggaaguuucau

SEQ ID NO: 2841469 - RNA, 16 nt, Human
uuggaaguugcauggc

SEQ ID NO: 2841470 - RNA, 16 nt, Human
uuggaacaaagugaag

SEQ ID NO: 2841471 - RNA, 15 nt, Human
uuggaaguacaugaa

SEQ ID NO: 2841472 - RNA, 20 nt, Human
uuggaacuaacacgugaugu

SEQ ID NO: 2841473 - RNA, 22 nt, Human
uuggaacuaacacgugauguga

SEQ ID NO: 2841474 - RNA, 13 nt, Human
uuggaaggagaca

SEQ ID NO: 2841475 - RNA, 18 nt, Human
uuggaaggagacacagau

SEQ ID NO: 2841476 - RNA, 19 nt, Human
uuggaaggagacacagaug

SEQ ID NO: 2841477 - RNA, 21 nt, Human
uuggaaggagacacagauguu

SEQ ID NO: 2841478 - RNA, 19 nt, Human
uuggaagaaaaaaaucuuc

SEQ ID NO: 2841479 - RNA, 22 nt, Human
uuggaagaaaaaaaucuucucc

SEQ ID NO: 2841480 - RNA, 18 nt, Human
uuggauuguauauugugu

SEQ ID NO: 2841481 - RNA, 14 nt, Human
uuggauuguauauu

SEQ ID NO: 2841482 - RNA, 20 nt, Human
uuggauuauuuaauaacauu

SEQ ID NO: 2841483 - RNA, 15 nt, Human
uuggauucuuaugua

SEQ ID NO: 2841484 - RNA, 18 nt, Human
uuggauuauuuaauaaca

SEQ ID NO: 2841485 - RNA, 19 nt, Human
uuggauuauuuaauaacau

SEQ ID NO: 2841486 - RNA, 21 nt, Human
uuggauuauuuaauaacauua

SEQ ID NO: 2841487 - RNA, 23 nt, Human
uuggauuccaugcuaagcaagcu

SEQ ID NO: 2841488 - RNA, 22 nt, Human
uuggauucccuuaaacaaaagu

SEQ ID NO: 2841489 - RNA, 15 nt, Human
uugcugccucaugcu

SEQ ID NO: 2841490 - RNA, 12 nt, Human
uugcugccucau

SEQ ID NO: 2841491 - RNA, 11 nt, Human
uugcugccuca

SEQ ID NO: 2841492 - RNA, 17 nt, Human
uugcugauuuccccucu

SEQ ID NO: 2841493 - RNA, 14 nt, Human
uugcugauuuuaau

SEQ ID NO: 2841494 - RNA, 16 nt, Human
uugcugauuuuaaugg

SEQ ID NO: 2841495 - RNA, 18 nt, Human
uugcugauuuuaauggau

SEQ ID NO: 2841496 - RNA, 19 nt, Human
uugcugauuuuaauggauu

SEQ ID NO: 2841497 - RNA, 16 nt, Human
uugccugguuuugucu

SEQ ID NO: 2841498 - RNA, 23 nt, Human
uugcggcgucagucuuuuucugu

SEQ ID NO: 2841499 - RNA, 14 nt, Human
uugcgugacacucu

SEQ ID NO: 2841500 - RNA, 20 nt, Human
uugcgugacacucuccuugc

SEQ ID NO: 2841501 - RNA, 15 nt, Human
uugcguggacucugc

SEQ ID NO: 2841502 - RNA, 18 nt, Human
uugcguggacucugcaca

SEQ ID NO: 2841503 - RNA, 16 nt, Human
uugcguuacacccuuu

SEQ ID NO: 2841504 - RNA, 22 nt, Human
uugcguuccaugaugcugggau

SEQ ID NO: 2841505 - RNA, 20 nt, Human
uugcguuggucucugcauuu

SEQ ID NO: 2841506 - RNA, 13 nt, Human
uugcuaaacacug

SEQ ID NO: 2841507 - RNA, 14 nt, Human
uugcuaaacacugc

SEQ ID NO: 2841508 - RNA, 17 nt, Human
uugcuaaacacugcgcu

SEQ ID NO: 2841509 - RNA, 22 nt, Human
uugccugcguuuuggaagcucu

SEQ ID NO: 2841510 - RNA, 12 nt, Human
uugccuggccuu

SEQ ID NO: 2841511 - RNA, 12 nt, Human
uugccugcaggc

SEQ ID NO: 2841512 - RNA, 18 nt, Human
uugccucugccucugaca

SEQ ID NO: 2841513 - RNA, 16 nt, Human
uugccucugccucuga

SEQ ID NO: 2841514 - RNA, 12 nt, Human
uugccucuacuu

SEQ ID NO: 2841515 - RNA, 19 nt, Human
uugccucucgguugaaacc

SEQ ID NO: 2841516 - RNA, 20 nt, Human
uugccucucgguugaaaccu

SEQ ID NO: 2841517 - RNA, 14 nt, Human
uugccucugccucu

SEQ ID NO: 2841518 - RNA, 11 nt, Human
uugccucugcc

SEQ ID NO: 2841519 - RNA, 14 nt, Human
uugccuccguguca

SEQ ID NO: 2841520 - RNA, 19 nt, Human
uugccuccuguguacugug

SEQ ID NO: 2841521 - RNA, 21 nt, Human
uugccuccuguguacuguguc

SEQ ID NO: 2841522 - RNA, 18 nt, Human
uugccacugccucuuccu

SEQ ID NO: 2841523 - RNA, 22 nt, Human
uugccauacuuugucugaaaaa

SEQ ID NO: 2841524 - RNA, 18 nt, Human
uugccauacuuugucuga

SEQ ID NO: 2841525 - RNA, 15 nt, Human
uugccacuuugcacg

SEQ ID NO: 2841526 - RNA, 16 nt, Human
uugccacuuugcacga

SEQ ID NO: 2841527 - RNA, 11 nt, Human
uugcccaggca

SEQ ID NO: 2841528 - RNA, 22 nt, Human
uugcccagcauuuuacugauuc

SEQ ID NO: 2841529 - RNA, 23 nt, Human
uugcccacgcuggagugcaguga

SEQ ID NO: 2841530 - RNA, 12 nt, Human
uucugagaaaac

SEQ ID NO: 2841531 - RNA, 13 nt, Human
uucugagaaaaca

SEQ ID NO: 2841532 - RNA, 13 nt, Human
uucugacugcuga

SEQ ID NO: 2841533 - RNA, 21 nt, Human
uucugagaaaacaagcaaguu

SEQ ID NO: 2841534 - RNA, 12 nt, Human
uucugagaaaag

SEQ ID NO: 2841535 - RNA, 14 nt, Human
uucugagaaaacaa

SEQ ID NO: 2841536 - RNA, 12 nt, Human
uucuguggcuca

SEQ ID NO: 2841537 - RNA, 16 nt, Human
uucuguggcucacaga

SEQ ID NO: 2841538 - RNA, 17 nt, Human
uucuguccuacucugug

SEQ ID NO: 2841539 - RNA, 13 nt, Human
uucuguuaaaauc

SEQ ID NO: 2841540 - RNA, 14 nt, Human
uucuguuaaaaucu

SEQ ID NO: 2841541 - RNA, 15 nt, Human
uucuguuaaaaucua

SEQ ID NO: 2841542 - RNA, 17 nt, Human
uucuguuaaaaucuauu

SEQ ID NO: 2841543 - RNA, 21 nt, Human
uucuguuaaaaucuauucugu

SEQ ID NO: 2841544 - RNA, 22 nt, Human
uucuguggguccgauaauaucu

SEQ ID NO: 2841545 - RNA, 19 nt, Human
uucuguuauauccccugcu

SEQ ID NO: 2841546 - RNA, 21 nt, Human
uucuguuauauccccugcuac

SEQ ID NO: 2841547 - RNA, 14 nt, Human
uucuucaacucccu

SEQ ID NO: 2841548 - RNA, 13 nt, Human
uucuuauuuugug

SEQ ID NO: 2841549 - RNA, 22 nt, Human
uucuuauuuuuccuaacaaaag

SEQ ID NO: 2841550 - RNA, 14 nt, Human
uucuucaaaaugua

SEQ ID NO: 2841551 - RNA, 15 nt, Human
uucuucaaaauguau

SEQ ID NO: 2841552 - RNA, 19 nt, Human
uucuucaaaauguauauau

SEQ ID NO: 2841553 - RNA, 20 nt, Human
uucuucaaaauguauauauu

SEQ ID NO: 2841554 - RNA, 21 nt, Human
uucuucaaaauguauauauuu

SEQ ID NO: 2841555 - RNA, 23 nt, Human
uucuucaaaauguauauauuuag

SEQ ID NO: 2841556 - RNA, 15 nt, Human
uucuuauugcuuuua

SEQ ID NO: 2841557 - RNA, 23 nt, Human
uucuguuccucucuuuuccuguu

SEQ ID NO: 2841558 - RNA, 16 nt, Human
uucuugguuggcuggc

SEQ ID NO: 2841559 - RNA, 15 nt, Human
uucuuguaaaugugu

SEQ ID NO: 2841560 - RNA, 16 nt, Human
uucuuguaaauguguu

SEQ ID NO: 2841561 - RNA, 18 nt, Human
uucuuguaaauguguugg

SEQ ID NO: 2841562 - RNA, 22 nt, Human
uucuuguaaauguguuggacaa

SEQ ID NO: 2841563 - RNA, 19 nt, Human
uucuuguaaggcuuugauu

SEQ ID NO: 2841564 - RNA, 20 nt, Human
uucuugguuggcuggccuuc

SEQ ID NO: 2841565 - RNA, 21 nt, Human
uucuucaccuaagucucugug

SEQ ID NO: 2841566 - RNA, 22 nt, Human
uucuucaccuaagucucuguga

SEQ ID NO: 2841567 - RNA, 22 nt, Human
uucuucacuguccuccaagcca

SEQ ID NO: 2841568 - RNA, 14 nt, Human
uucuucacuuuugc

SEQ ID NO: 2841569 - RNA, 18 nt, Human
uucuucacuuuugcaagg

SEQ ID NO: 2841570 - RNA, 19 nt, Human
uucuucaaauccuuccaaa

SEQ ID NO: 2841571 - RNA, 18 nt, Human
uugaaacuacuacaauga

SEQ ID NO: 2841572 - RNA, 15 nt, Human
uucuuuauacuguaa

SEQ ID NO: 2841573 - RNA, 16 nt, Human
uucuuuauacuguaau

SEQ ID NO: 2841574 - RNA, 18 nt, Human
uucuuuauauacaauaau

SEQ ID NO: 2841575 - RNA, 21 nt, Human
uucuuuauauacaauaaugga

SEQ ID NO: 2841576 - RNA, 23 nt, Human
uucuuuauauacaauaauggaaa

SEQ ID NO: 2841577 - RNA, 20 nt, Human
uucuuuauauuuauccacua

SEQ ID NO: 2841578 - RNA, 12 nt, Human
uucuuguacagu

SEQ ID NO: 2841579 - RNA, 12 nt, Human
uugaagacaauu

SEQ ID NO: 2841580 - RNA, 13 nt, Human
uugaagacaauuu

SEQ ID NO: 2841581 - RNA, 15 nt, Human
uugaagacaauuuga

SEQ ID NO: 2841582 - RNA, 16 nt, Human
uugaagacaauuugau

SEQ ID NO: 2841583 - RNA, 19 nt, Human
uugaagacaauuugauaca

SEQ ID NO: 2841584 - RNA, 22 nt, Human
uugaagacaauuugauacauaa

SEQ ID NO: 2841585 - RNA, 23 nt, Human
uugaagacaauuugauacauaau

SEQ ID NO: 2841586 - RNA, 20 nt, Human
uugaagacccgcuacaaaac

SEQ ID NO: 2841587 - RNA, 18 nt, Human
uugaagagagauauaucu

SEQ ID NO: 2841588 - RNA, 20 nt, Human
uugaagagagauauaucuga

SEQ ID NO: 2841589 - RNA, 21 nt, Human
uugaagagagauauaucugaa

SEQ ID NO: 2841590 - RNA, 20 nt, Human
uugaaucuauuuaaguaaaa

SEQ ID NO: 2841591 - RNA, 14 nt, Human
uugaaucuauuuca

SEQ ID NO: 2841592 - RNA, 18 nt, Human
uugaaucuauuucacuua

SEQ ID NO: 2841593 - RNA, 14 nt, Human
uugaagaaggugga

SEQ ID NO: 2841594 - RNA, 18 nt, Human
uugaagaagguggaccuu

SEQ ID NO: 2841595 - RNA, 19 nt, Human
uugaagaagguggaccuuu

SEQ ID NO: 2841596 - RNA, 22 nt, Human
uugaagaagguggaccuuuuaa

SEQ ID NO: 2841597 - RNA, 22 nt, Human
uugaacuuuuuuccacugaagu

SEQ ID NO: 2841598 - RNA, 14 nt, Human
uugaagaaacagau

SEQ ID NO: 2841599 - RNA, 19 nt, Human
uugaagaaacagauaccau

SEQ ID NO: 2841600 - RNA, 20 nt, Human
uugaagaaauuauaaagaua

SEQ ID NO: 2841601 - RNA, 22 nt, Human
uugaagaaauuauaaagauaaa

SEQ ID NO: 2841602 - RNA, 16 nt, Human
uugaacuuuuuuccac

SEQ ID NO: 2841603 - RNA, 13 nt, Human
uugaggcuuugug

SEQ ID NO: 2841604 - RNA, 14 nt, Human
uugaggcuuugugu

SEQ ID NO: 2841605 - RNA, 15 nt, Human
uugaggcuuuguguu

SEQ ID NO: 2841606 - RNA, 17 nt, Human
uugaggcuuuguguugu

SEQ ID NO: 2841607 - RNA, 20 nt, Human
uugagggacgcuuugucugu

SEQ ID NO: 2841608 - RNA, 21 nt, Human
uugagggacgcuuugucuguc

SEQ ID NO: 2841609 - RNA, 17 nt, Human
uugagggacugccucug

SEQ ID NO: 2841610 - RNA, 18 nt, Human
uugagggacugccucugc

SEQ ID NO: 2841611 - RNA, 20 nt, Human
uugagggacugccucugcca

SEQ ID NO: 2841612 - RNA, 14 nt, Human
uugagggcccagag

SEQ ID NO: 2841613 - RNA, 15 nt, Human
uugagggcccagagc

SEQ ID NO: 2841614 - RNA, 16 nt, Human
uugagggcccagagca

SEQ ID NO: 2841615 - RNA, 19 nt, Human
uugagggcccagagcagga

SEQ ID NO: 2841616 - RNA, 21 nt, Human
uugagggcccagagcaggaag

SEQ ID NO: 2841617 - RNA, 23 nt, Human
uugagggcccagagcaggaagca

SEQ ID NO: 2841618 - RNA, 15 nt, Human
uugaggggcuccugg

SEQ ID NO: 2841619 - RNA, 16 nt, Human
uugaggggcuccugga

SEQ ID NO: 2841620 - RNA, 21 nt, Human
uugacuagggauucaggcugc

SEQ ID NO: 2841621 - RNA, 19 nt, Human
uugacuagggauucaggcu

SEQ ID NO: 2841622 - RNA, 15 nt, Human
uugacgauuccuucu

SEQ ID NO: 2841623 - RNA, 17 nt, Human
uugacgauuccuucucu

SEQ ID NO: 2841624 - RNA, 18 nt, Human
uugacgagucaccuucca

SEQ ID NO: 2841625 - RNA, 23 nt, Human
uugacgguuuuuuauuauugugg

SEQ ID NO: 2841626 - RNA, 23 nt, Human
uugacuagaugauggaugccaau

SEQ ID NO: 2841627 - RNA, 11 nt, Human
uugagcuggcc

SEQ ID NO: 2841628 - RNA, 13 nt, Human
uugagcuggccuc

SEQ ID NO: 2841629 - RNA, 12 nt, Human
uugagcuggccu

SEQ ID NO: 2841630 - RNA, 18 nt, Human
uugaggaaacaacagcuu

SEQ ID NO: 2841631 - RNA, 14 nt, Human
uugaggaacuguac

SEQ ID NO: 2841632 - RNA, 15 nt, Human
uugaggaacuguaca

SEQ ID NO: 2841633 - RNA, 19 nt, Human
uugaggaacuguacagaaa

SEQ ID NO: 2841634 - RNA, 15 nt, Human
uugaccucaggugau

SEQ ID NO: 2841635 - RNA, 12 nt, Human
uugaaugucuuu

SEQ ID NO: 2841636 - RNA, 16 nt, Human
uugaaugucuuuugaa

SEQ ID NO: 2841637 - RNA, 23 nt, Human
uugaaugccauagucaaagagag

SEQ ID NO: 2841638 - RNA, 13 nt, Human
uugaaugcugcca

SEQ ID NO: 2841639 - RNA, 14 nt, Human
uugaaugcugccag

SEQ ID NO: 2841640 - RNA, 15 nt, Human
uugaaugcugccagu

SEQ ID NO: 2841641 - RNA, 23 nt, Human
uugaaugcugccaguguggagug

SEQ ID NO: 2841642 - RNA, 18 nt, Human
uugaauggccugccuuga

SEQ ID NO: 2841643 - RNA, 15 nt, Human
uugaaugcuuuuuga

SEQ ID NO: 2841644 - RNA, 17 nt, Human
uugaaugcuuuuugaau

SEQ ID NO: 2841645 - RNA, 20 nt, Human
uugaaugcuuuuugaauguu

SEQ ID NO: 2841646 - RNA, 23 nt, Human
uugaaugcuuuuugaauguuauu

SEQ ID NO: 2841647 - RNA, 20 nt, Human
uugaccuucauuucauguau

SEQ ID NO: 2841648 - RNA, 13 nt, Human
uugaccuuuguac

SEQ ID NO: 2841649 - RNA, 14 nt, Human
uugaccuuuguaca

SEQ ID NO: 2841650 - RNA, 15 nt, Human
uugaccuuuguacag

SEQ ID NO: 2841651 - RNA, 16 nt, Human
uugaccugcuccgcug

SEQ ID NO: 2841652 - RNA, 21 nt, Human
uugaccugcuccgcugcuccu

SEQ ID NO: 2841653 - RNA, 21 nt, Human
uugaccuuuuauguaguaauu

SEQ ID NO: 2841654 - RNA, 22 nt, Human
uugaccucacagugacccuucc

SEQ ID NO: 2841655 - RNA, 23 nt, Human
uugaccucacagugacccuuccc

SEQ ID NO: 2841656 - RNA, 19 nt, Human
uugccaccccacccucccu

SEQ ID NO: 2841657 - RNA, 21 nt, Human
uugccaccccacccucccugg

SEQ ID NO: 2841658 - RNA, 22 nt, Human
uugccaccccacccucccugga

SEQ ID NO: 2841659 - RNA, 23 nt, Human
uugccaccccacccucccuggag

SEQ ID NO: 2841660 - RNA, 14 nt, Human
uugccacugauauu

SEQ ID NO: 2841661 - RNA, 18 nt, Human
uugccacugauauucaga

SEQ ID NO: 2841662 - RNA, 19 nt, Human
uugccacugauauucagaa

SEQ ID NO: 2841663 - RNA, 20 nt, Human
uugccacugauauucagaau

SEQ ID NO: 2841664 - RNA, 12 nt, Human
uugccacuaauu

SEQ ID NO: 2841665 - RNA, 16 nt, Human
uugccacuaauuuuag

SEQ ID NO: 2841666 - RNA, 21 nt, Human
uugccacuaauuuuaguauuc

SEQ ID NO: 2841667 - RNA, 14 nt, Human
uugccacugccucu

SEQ ID NO: 2841668 - RNA, 15 nt, Human
uugccacugccucuu

SEQ ID NO: 2841669 - RNA, 23 nt, Human
uugcaguccuuuuacuacagcua

SEQ ID NO: 2841670 - RNA, 14 nt, Human
uugcagucauagaa

SEQ ID NO: 2841671 - RNA, 17 nt, Human
uugcagucaucagaagu

SEQ ID NO: 2841672 - RNA, 16 nt, Human
uugcauacugagccaa

SEQ ID NO: 2841673 - RNA, 22 nt, Human
uugcagacaggcaagcaccucc

SEQ ID NO: 2841674 - RNA, 14 nt, Human
uugcagcuuuaugu

SEQ ID NO: 2841675 - RNA, 18 nt, Human
uugcagcuuuauguucau

SEQ ID NO: 2841676 - RNA, 21 nt, Human
uugcagcuuuauguucauuug

SEQ ID NO: 2841677 - RNA, 18 nt, Human
uugcagguggaacucagu

SEQ ID NO: 2841678 - RNA, 12 nt, Human
uugcagggcagc

SEQ ID NO: 2841679 - RNA, 13 nt, Human
uugcagggcagcc

SEQ ID NO: 2841680 - RNA, 14 nt, Human
uugcagggcagccc

SEQ ID NO: 2841681 - RNA, 21 nt, Human
uugcagggcagccccacaacu

SEQ ID NO: 2841682 - RNA, 19 nt, Human
uugcagguggaacucaguc

SEQ ID NO: 2841683 - RNA, 20 nt, Human
uugcagguggaacucaguca

SEQ ID NO: 2841684 - RNA, 16 nt, Human
uugcagacaggcaagc

SEQ ID NO: 2841685 - RNA, 13 nt, Human
uugcagaaguucu

SEQ ID NO: 2841686 - RNA, 19 nt, Human
uugcagaaguucuuagugu

SEQ ID NO: 2841687 - RNA, 13 nt, Human
uugcagaagaggg

SEQ ID NO: 2841688 - RNA, 15 nt, Human
uugcagaagagggug

SEQ ID NO: 2841689 - RNA, 16 nt, Human
uugcagaagagggugu

SEQ ID NO: 2841690 - RNA, 20 nt, Human
uugcagaagaggguguguuu

SEQ ID NO: 2841691 - RNA, 21 nt, Human
uugcagaagaggguguguuug

SEQ ID NO: 2841692 - RNA, 11 nt, Human
uugcagaacug

SEQ ID NO: 2841693 - RNA, 14 nt, Human
uugcagaacugcca

SEQ ID NO: 2841694 - RNA, 16 nt, Human
uugcagaacugccauu

SEQ ID NO: 2841695 - RNA, 14 nt, Human
uugcaacguuuaca

SEQ ID NO: 2841696 - RNA, 11 nt, Human
uugaugaaaag

SEQ ID NO: 2841697 - RNA, 19 nt, Human
uugaugaaaagauuuaagc

SEQ ID NO: 2841698 - RNA, 20 nt, Human
uugaugaaaagauuuaagca

SEQ ID NO: 2841699 - RNA, 19 nt, Human
uugauuuaugcauggaaac

SEQ ID NO: 2841700 - RNA, 12 nt, Human
uugauuuaugca

SEQ ID NO: 2841701 - RNA, 11 nt, Human
uugauuuacag

SEQ ID NO: 2841702 - RNA, 22 nt, Human
uugauuuacagcaaguagauaa

SEQ ID NO: 2841703 - RNA, 17 nt, Human
uugauuuaaacacacag

SEQ ID NO: 2841704 - RNA, 18 nt, Human
uugauuuaaacacacaga

SEQ ID NO: 2841705 - RNA, 16 nt, Human
uugauuuccuguguca

SEQ ID NO: 2841706 - RNA, 21 nt, Human
uugauuggggaauuaaaaguc

SEQ ID NO: 2841707 - RNA, 17 nt, Human
uugauuuuuacuguguu

SEQ ID NO: 2841708 - RNA, 17 nt, Human
uugcaaaagacuaauuu

SEQ ID NO: 2841709 - RNA, 16 nt, Human
uugauuuuuacugugu

SEQ ID NO: 2841710 - RNA, 15 nt, Human
uugauuuuugucuca

SEQ ID NO: 2841711 - RNA, 17 nt, Human
uugcaacaggcugggcu

SEQ ID NO: 2841712 - RNA, 14 nt, Human
uugcaacaggcugg

SEQ ID NO: 2841713 - RNA, 19 nt, Human
uugcaaaauagcauuuguu

SEQ ID NO: 2841714 - RNA, 23 nt, Human
uucagacuugccaugugacucug

SEQ ID NO: 2841715 - RNA, 14 nt, Human
uucagacuugucaa

SEQ ID NO: 2841716 - RNA, 15 nt, Human
uucagacuugucaag

SEQ ID NO: 2841717 - RNA, 22 nt, Human
uucagcuccagcucaccagccc

SEQ ID NO: 2841718 - RNA, 19 nt, Human
uucacugaaguucuccuga

SEQ ID NO: 2841719 - RNA, 13 nt, Human
uucacugaagacg

SEQ ID NO: 2841720 - RNA, 14 nt, Human
uucagagaaaggca

SEQ ID NO: 2841721 - RNA, 13 nt, Human
uucagagaauauc

SEQ ID NO: 2841722 - RNA, 21 nt, Human
uucagagacagcugauacuuc

SEQ ID NO: 2841723 - RNA, 22 nt, Human
uucaccccccacucaccagugu

SEQ ID NO: 2841724 - RNA, 21 nt, Human
uucacucugggcacacucugc

SEQ ID NO: 2841725 - RNA, 13 nt, Human
uucacucuuaggc

SEQ ID NO: 2841726 - RNA, 23 nt, Human
uucacucuuaggcacuuuggggg

SEQ ID NO: 2841727 - RNA, 16 nt, Human
uucacccccuuuccug

SEQ ID NO: 2841728 - RNA, 17 nt, Human
uucaccccaaucccagc

SEQ ID NO: 2841729 - RNA, 18 nt, Human
uucacccaggccuauguu

SEQ ID NO: 2841730 - RNA, 21 nt, Human
uucacccaggccuauguugau

SEQ ID NO: 2841731 - RNA, 16 nt, Human
uucacccaucuuauca

SEQ ID NO: 2841732 - RNA, 18 nt, Human
uucacccaucuuaucaag

SEQ ID NO: 2841733 - RNA, 14 nt, Human
uucaccccacccuu

SEQ ID NO: 2841734 - RNA, 13 nt, Human
uucaccccacccu

SEQ ID NO: 2841735 - RNA, 13 nt, Human
uucaauucucaaa

SEQ ID NO: 2841736 - RNA, 16 nt, Human
uucaauuccugggccc

SEQ ID NO: 2841737 - RNA, 14 nt, Human
uucaauuccugggc

SEQ ID NO: 2841738 - RNA, 22 nt, Human
uucaccccagggccugagccug

SEQ ID NO: 2841739 - RNA, 22 nt, Human
uucaccccaguggccacucagc

SEQ ID NO: 2841740 - RNA, 20 nt, Human
uucaccccagggccugagcc

SEQ ID NO: 2841741 - RNA, 17 nt, Human
uucaccccagggccuga

SEQ ID NO: 2841742 - RNA, 19 nt, Human
uucacccccuuuccuggac

SEQ ID NO: 2841743 - RNA, 18 nt, Human
uucaccccggcaggcccu

SEQ ID NO: 2841744 - RNA, 20 nt, Human
uucaccccggcaggcccugc

SEQ ID NO: 2841745 - RNA, 21 nt, Human
uucaccccggcaggcccugca

SEQ ID NO: 2841746 - RNA, 22 nt, Human
uucaccccggcaggcccugcag

SEQ ID NO: 2841747 - RNA, 21 nt, Human
uucaccccaguggccacucag

SEQ ID NO: 2841748 - RNA, 17 nt, Human
uucaccccccacucacc

SEQ ID NO: 2841749 - RNA, 23 nt, Human
uucaccccccacucaccaguguc

SEQ ID NO: 2841750 - RNA, 21 nt, Human
uucacccccugagauccccug

SEQ ID NO: 2841751 - RNA, 19 nt, Human
uucaggaauguguggccug

SEQ ID NO: 2841752 - RNA, 16 nt, Human
uucaggagcagccuca

SEQ ID NO: 2841753 - RNA, 20 nt, Human
uucaggagcagccucagaac

SEQ ID NO: 2841754 - RNA, 22 nt, Human
uucaggagcagccucagaacaa

SEQ ID NO: 2841755 - RNA, 14 nt, Human
uucaggagcgcaag

SEQ ID NO: 2841756 - RNA, 17 nt, Human
uucaggagcgcaagaua

SEQ ID NO: 2841757 - RNA, 18 nt, Human
uucaggagcgcaagauag

SEQ ID NO: 2841758 - RNA, 19 nt, Human
uucaggagcgcaagauaga

SEQ ID NO: 2841759 - RNA, 17 nt, Human
uucaggagucccaagga

SEQ ID NO: 2841760 - RNA, 15 nt, Human
uucaggcucuucucc

SEQ ID NO: 2841761 - RNA, 22 nt, Human
uucaggcuccccagaucauguu

SEQ ID NO: 2841762 - RNA, 17 nt, Human
uucaggcaauucuccug

SEQ ID NO: 2841763 - RNA, 13 nt, Human
uucagcucuuuuu

SEQ ID NO: 2841764 - RNA, 23 nt, Human
uucagcuccagcucaccagcccc

SEQ ID NO: 2841765 - RNA, 15 nt, Human
uucagcucucuguau

SEQ ID NO: 2841766 - RNA, 16 nt, Human
uucagcucucuguaua

SEQ ID NO: 2841767 - RNA, 17 nt, Human
uucagcucucuguauaa

SEQ ID NO: 2841768 - RNA, 18 nt, Human
uucagcucucuguauaaa

SEQ ID NO: 2841769 - RNA, 21 nt, Human
uucagcucucuguauaaacau

SEQ ID NO: 2841770 - RNA, 14 nt, Human
uuacuaaaauauau

SEQ ID NO: 2841771 - RNA, 17 nt, Human
uuacuaaaauauauaua

SEQ ID NO: 2841772 - RNA, 17 nt, Human
uuacguguuuaaaaaaa

SEQ ID NO: 2841773 - RNA, 18 nt, Human
uuacuaaacauaugauuu

SEQ ID NO: 2841774 - RNA, 22 nt, Human
uuacuaaacauaugauuucacu

SEQ ID NO: 2841775 - RNA, 18 nt, Human
uuauuuuccccuaucauu

SEQ ID NO: 2841776 - RNA, 22 nt, Human
uuauuuuccccuaucauuuauu

SEQ ID NO: 2841777 - RNA, 12 nt, Human
uuauuuucacug

SEQ ID NO: 2841778 - RNA, 18 nt, Human
uuacuaaagaaaauaucu

SEQ ID NO: 2841779 - RNA, 12 nt, Human
uuauuuucagua

SEQ ID NO: 2841780 - RNA, 14 nt, Human
uuauuuucaguauu

SEQ ID NO: 2841781 - RNA, 14 nt, Human
uuauuuucagugau

SEQ ID NO: 2841782 - RNA, 15 nt, Human
uuauuuucagugaua

SEQ ID NO: 2841783 - RNA, 12 nt, Human
uuauuuucauua

SEQ ID NO: 2841784 - RNA, 14 nt, Human
uuauuuucauuaca

SEQ ID NO: 2841785 - RNA, 15 nt, Human
uucaaagcaaauguc

SEQ ID NO: 2841786 - RNA, 12 nt, Human
uucaaagaugcu

SEQ ID NO: 2841787 - RNA, 18 nt, Human
uuauuuucuuuugaauug

SEQ ID NO: 2841788 - RNA, 20 nt, Human
uuauuuucuuuugaauuguu

SEQ ID NO: 2841789 - RNA, 21 nt, Human
uuauuuugaaaagcuucuuaa

SEQ ID NO: 2841790 - RNA, 22 nt, Human
uuauuuugaaaagcuucuuaau

SEQ ID NO: 2841791 - RNA, 13 nt, Human
uuauuuucuguca

SEQ ID NO: 2841792 - RNA, 14 nt, Human
uuauuuucugucag

SEQ ID NO: 2841793 - RNA, 15 nt, Human
uuauuuucugucaga

SEQ ID NO: 2841794 - RNA, 13 nt, Human
uucaaauuucaca

SEQ ID NO: 2841795 - RNA, 21 nt, Human
uucaaauuuuuuaaaagagac

SEQ ID NO: 2841796 - RNA, 13 nt, Human
uucaaagccacau

SEQ ID NO: 2841797 - RNA, 16 nt, Human
uucaaauugucuuuug

SEQ ID NO: 2841798 - RNA, 11 nt, Human
uucaaauuuag

SEQ ID NO: 2841799 - RNA, 13 nt, Human
uucaaagaugcug

SEQ ID NO: 2841800 - RNA, 18 nt, Human
uucaaagaugcugugagu

SEQ ID NO: 2841801 - RNA, 16 nt, Human
uucaaugauaguaaga

SEQ ID NO: 2841802 - RNA, 21 nt, Human
uucaaugugauucuaaugucu

SEQ ID NO: 2841803 - RNA, 17 nt, Human
uucaaugggcucuucca

SEQ ID NO: 2841804 - RNA, 16 nt, Human
uucaaugguucugaaa

SEQ ID NO: 2841805 - RNA, 18 nt, Human
uucaauucucauuuguca

SEQ ID NO: 2841806 - RNA, 19 nt, Human
uucaauucagugcuguacu

SEQ ID NO: 2841807 - RNA, 13 nt, Human
uucaauuccuggg

SEQ ID NO: 2841808 - RNA, 13 nt, Human
uucaauucagugc

SEQ ID NO: 2841809 - RNA, 17 nt, Human
uucaauucaacacuccc

SEQ ID NO: 2841810 - RNA, 21 nt, Human
uucaauuaauauuaauuuucu

SEQ ID NO: 2841811 - RNA, 15 nt, Human
uucaaccauucccca

SEQ ID NO: 2841812 - RNA, 19 nt, Human
uucaacaaauaucuugugu

SEQ ID NO: 2841813 - RNA, 20 nt, Human
uucaacaaauaucuuguguu

SEQ ID NO: 2841814 - RNA, 17 nt, Human
uucaaccauuccccaug

SEQ ID NO: 2841815 - RNA, 20 nt, Human
uucaaccauuccccauggga

SEQ ID NO: 2841816 - RNA, 13 nt, Human
uucaacgcagccc

SEQ ID NO: 2841817 - RNA, 17 nt, Human
uucaacccacagcuacu

SEQ ID NO: 2841818 - RNA, 14 nt, Human
uucaaccccacccu

SEQ ID NO: 2841819 - RNA, 20 nt, Human
uucaaccccacccuguuugg

SEQ ID NO: 2841820 - RNA, 21 nt, Human
uucaaccccacccuguuugga

SEQ ID NO: 2841821 - RNA, 14 nt, Human
uucaacgcagcccu

SEQ ID NO: 2841822 - RNA, 16 nt, Human
uucaaucccaggaugu

SEQ ID NO: 2841823 - RNA, 20 nt, Human
uucaaucucccgcugcugcu

SEQ ID NO: 2841824 - RNA, 12 nt, Human
uucaaucacugu

SEQ ID NO: 2841825 - RNA, 14 nt, Human
uuccacuucuuccu

SEQ ID NO: 2841826 - RNA, 15 nt, Human
uuccacuucuuccuu

SEQ ID NO: 2841827 - RNA, 18 nt, Human
uuccacuucuuccuuucu

SEQ ID NO: 2841828 - RNA, 19 nt, Human
uuccacuucuuccuuucuc

SEQ ID NO: 2841829 - RNA, 20 nt, Human
uuccacuucuuccuuucucu

SEQ ID NO: 2841830 - RNA, 21 nt, Human
uuccacuucuuccuuucucuu

SEQ ID NO: 2841831 - RNA, 22 nt, Human
uuccacuggacuugagcuuggc

SEQ ID NO: 2841832 - RNA, 12 nt, Human
uuccacuggacu

SEQ ID NO: 2841833 - RNA, 20 nt, Human
uuccacugucaagaaagagc

SEQ ID NO: 2841834 - RNA, 21 nt, Human
uuccacuuagaaauugcauuu

SEQ ID NO: 2841835 - RNA, 11 nt, Human
uucauuuucca

SEQ ID NO: 2841836 - RNA, 13 nt, Human
uucauuuuccaau

SEQ ID NO: 2841837 - RNA, 14 nt, Human
uucauuuuccaaua

SEQ ID NO: 2841838 - RNA, 18 nt, Human
uucauuuuauauugaaaa

SEQ ID NO: 2841839 - RNA, 19 nt, Human
uucauuuuauauugaaaaa

SEQ ID NO: 2841840 - RNA, 22 nt, Human
uucauuuuauauugaaaaaaau

SEQ ID NO: 2841841 - RNA, 13 nt, Human
uuccacugcaaaa

SEQ ID NO: 2841842 - RNA, 13 nt, Human
uuccacugccucu

SEQ ID NO: 2841843 - RNA, 14 nt, Human
uuccacugccucug

SEQ ID NO: 2841844 - RNA, 15 nt, Human
uuccacugccucugc

SEQ ID NO: 2841845 - RNA, 16 nt, Human
uuccacugccucugcc

SEQ ID NO: 2841846 - RNA, 17 nt, Human
uuccacugccucugccu

SEQ ID NO: 2841847 - RNA, 14 nt, Human
uuccaucucugacu

SEQ ID NO: 2841848 - RNA, 12 nt, Human
uuccaucugaaa

SEQ ID NO: 2841849 - RNA, 21 nt, Human
uuccaucccuacccccuaaga

SEQ ID NO: 2841850 - RNA, 15 nt, Human
uuccaucccuacccc

SEQ ID NO: 2841851 - RNA, 15 nt, Human
uuccagccagggcug

SEQ ID NO: 2841852 - RNA, 16 nt, Human
uuccagccagggcugc

SEQ ID NO: 2841853 - RNA, 12 nt, Human
uuccagccaggg

SEQ ID NO: 2841854 - RNA, 23 nt, Human
uuccagcaauucuccugccucag

SEQ ID NO: 2841855 - RNA, 16 nt, Human
uuccagcagaagacaa

SEQ ID NO: 2841856 - RNA, 22 nt, Human
uuccagcagaagacaaaaagac

SEQ ID NO: 2841857 - RNA, 16 nt, Human
uuccagaagaagagaa

SEQ ID NO: 2841858 - RNA, 18 nt, Human
uuccagaagaagagaagc

SEQ ID NO: 2841859 - RNA, 20 nt, Human
uuccagaagaagagaagcug

SEQ ID NO: 2841860 - RNA, 21 nt, Human
uuccagaagaagagaagcugc

SEQ ID NO: 2841861 - RNA, 22 nt, Human
uuccagaagaagagaagcugcu

SEQ ID NO: 2841862 - RNA, 21 nt, Human
uuccagaaaaccccagcaucc

SEQ ID NO: 2841863 - RNA, 18 nt, Human
uuccagaaaaccccagca

SEQ ID NO: 2841864 - RNA, 20 nt, Human
uuccacuuuuuuuuguaugu

SEQ ID NO: 2841865 - RNA, 17 nt, Human
uuccagaaaaccccagc

SEQ ID NO: 2841866 - RNA, 12 nt, Human
uuccacuuggcu

SEQ ID NO: 2841867 - RNA, 19 nt, Human
uuccacuuggcuacacagg

SEQ ID NO: 2841868 - RNA, 18 nt, Human
uuccaugauucuauuuau

SEQ ID NO: 2841869 - RNA, 18 nt, Human
uuccaugaugcugggauu

SEQ ID NO: 2841870 - RNA, 17 nt, Human
uuccaugauucuauuua

SEQ ID NO: 2841871 - RNA, 13 nt, Human
uuccaugaugcug

SEQ ID NO: 2841872 - RNA, 17 nt, Human
uuccaugucgccucugc

SEQ ID NO: 2841873 - RNA, 16 nt, Human
uuccaugucgccucug

SEQ ID NO: 2841874 - RNA, 18 nt, Human
uuccaugucgccucugca

SEQ ID NO: 2841875 - RNA, 19 nt, Human
uuccaugucgccucugcau

SEQ ID NO: 2841876 - RNA, 20 nt, Human
uuccaugaaguuugaacuuc

SEQ ID NO: 2841877 - RNA, 18 nt, Human
uuccauccuuuacguguu

SEQ ID NO: 2841878 - RNA, 22 nt, Human
uuccaucuccuauaaucuguca

SEQ ID NO: 2841879 - RNA, 23 nt, Human
uuccaucuccuauaaucugucaa

SEQ ID NO: 2841880 - RNA, 18 nt, Human
uuccaucuuuacaaaacu

SEQ ID NO: 2841881 - RNA, 13 nt, Human
uuccaucuuuaca

SEQ ID NO: 2841882 - RNA, 16 nt, Human
uucccaaacgccuccc

SEQ ID NO: 2841883 - RNA, 17 nt, Human
uucccauuuguaauuug

SEQ ID NO: 2841884 - RNA, 20 nt, Human
uucccauuugugccagagga

SEQ ID NO: 2841885 - RNA, 17 nt, Human
uucccauuugugccaga

SEQ ID NO: 2841886 - RNA, 13 nt, Human
uuccccaauuaau

SEQ ID NO: 2841887 - RNA, 14 nt, Human
uuccccaagacauu

SEQ ID NO: 2841888 - RNA, 23 nt, Human
uuccauuuuggcgcuauuacaaa

SEQ ID NO: 2841889 - RNA, 22 nt, Human
uuccauuugaggauuuagaagu

SEQ ID NO: 2841890 - RNA, 12 nt, Human
uuccauuuccaa

SEQ ID NO: 2841891 - RNA, 20 nt, Human
uuccauugguccaagauucc

SEQ ID NO: 2841892 - RNA, 20 nt, Human
uuccaugucgccucugcauu

SEQ ID NO: 2841893 - RNA, 21 nt, Human
uuccaugucgccucugcauuc

SEQ ID NO: 2841894 - RNA, 14 nt, Human
uucauuucauguau

SEQ ID NO: 2841895 - RNA, 12 nt, Human
uucauuucauug

SEQ ID NO: 2841896 - RNA, 13 nt, Human
uucauuucauugu

SEQ ID NO: 2841897 - RNA, 15 nt, Human
uucauuucauuguau

SEQ ID NO: 2841898 - RNA, 13 nt, Human
uucauuuccacuc

SEQ ID NO: 2841899 - RNA, 13 nt, Human
uucauuuguguca

SEQ ID NO: 2841900 - RNA, 15 nt, Human
uucauuugugucaau

SEQ ID NO: 2841901 - RNA, 22 nt, Human
uucauuuguuuguuuguuuguc

SEQ ID NO: 2841902 - RNA, 22 nt, Human
uucauuuguggugauauagaau

SEQ ID NO: 2841903 - RNA, 23 nt, Human
uucauuuguggugauauagaauu

SEQ ID NO: 2841904 - RNA, 22 nt, Human
uucauuugguucauuaauucua

SEQ ID NO: 2841905 - RNA, 18 nt, Human
uucauuuagugaguuauu

SEQ ID NO: 2841906 - RNA, 12 nt, Human
uucaugaugcag

SEQ ID NO: 2841907 - RNA, 13 nt, Human
uucaugaugcagu

SEQ ID NO: 2841908 - RNA, 14 nt, Human
uucaugaugcaguc

SEQ ID NO: 2841909 - RNA, 16 nt, Human
uucaugaugcagucuc

SEQ ID NO: 2841910 - RNA, 17 nt, Human
uucaugaugcagucucc

SEQ ID NO: 2841911 - RNA, 23 nt, Human
uucaucgaaucuacuaauuccac

SEQ ID NO: 2841912 - RNA, 17 nt, Human
uucaguuucuucugcgc

SEQ ID NO: 2841913 - RNA, 11 nt, Human
uucauaauggc

SEQ ID NO: 2841914 - RNA, 21 nt, Human
uucaguuuucauuugguucau

SEQ ID NO: 2841915 - RNA, 19 nt, Human
uucaguuucaauucagugc

SEQ ID NO: 2841916 - RNA, 16 nt, Human
uucaggcugcuuggga

SEQ ID NO: 2841917 - RNA, 19 nt, Human
uucaggcuuccugcaauuu

SEQ ID NO: 2841918 - RNA, 21 nt, Human
uucaggcuuccugcaauuuuc

SEQ ID NO: 2841919 - RNA, 22 nt, Human
uucaggcuuccugcaauuuucu

SEQ ID NO: 2841920 - RNA, 13 nt, Human
uucaggcugcuug

SEQ ID NO: 2841921 - RNA, 16 nt, Human
uucaggcucuucuccu

SEQ ID NO: 2841922 - RNA, 18 nt, Human
uucaguugguugugucuu

SEQ ID NO: 2841923 - RNA, 19 nt, Human
uucaguugguugugucuuu

SEQ ID NO: 2841924 - RNA, 17 nt, Human
uucaguuguguuuguug

SEQ ID NO: 2841925 - RNA, 20 nt, Human
uucaguuguguuuguugcug

SEQ ID NO: 2841926 - RNA, 22 nt, Human
uucaguuguguuuguugcuggc

SEQ ID NO: 2841927 - RNA, 23 nt, Human
uucaguuguuuguuuuugcuugu

SEQ ID NO: 2841928 - RNA, 19 nt, Human
uucaguuggcugacuucca

SEQ ID NO: 2841929 - RNA, 12 nt, Human
uucaguggagaa

SEQ ID NO: 2841930 - RNA, 13 nt, Human
uucagugcugugg

SEQ ID NO: 2841931 - RNA, 18 nt, Human
uucagggaauuucaggaa

SEQ ID NO: 2841932 - RNA, 21 nt, Human
uucagugcuguggccugggca

SEQ ID NO: 2841933 - RNA, 19 nt, Human
uucagugcuguggccuggg

SEQ ID NO: 2841934 - RNA, 20 nt, Human
uucuaaaaucuuauaguucu

SEQ ID NO: 2841935 - RNA, 21 nt, Human
uucuaaaaucuuauaguucua

SEQ ID NO: 2841936 - RNA, 22 nt, Human
uucuaaaaucuuauaguucuag

SEQ ID NO: 2841937 - RNA, 15 nt, Human
uuccuuugcucuuuc

SEQ ID NO: 2841938 - RNA, 13 nt, Human
uuccuuugaagau

SEQ ID NO: 2841939 - RNA, 14 nt, Human
uuccuuugaagaua

SEQ ID NO: 2841940 - RNA, 12 nt, Human
uuccuuucucag

SEQ ID NO: 2841941 - RNA, 14 nt, Human
uuccuuucuccagg

SEQ ID NO: 2841942 - RNA, 19 nt, Human
uuccuuucuccaggaccaa

SEQ ID NO: 2841943 - RNA, 13 nt, Human
uuccuuucucuuu

SEQ ID NO: 2841944 - RNA, 15 nt, Human
uuccuuucucuuucu

SEQ ID NO: 2841945 - RNA, 17 nt, Human
uuccuuucucuuucucu

SEQ ID NO: 2841946 - RNA, 22 nt, Human
uuccuuucucuuucucucuucc

SEQ ID NO: 2841947 - RNA, 14 nt, Human
uuccuuucccaagc

SEQ ID NO: 2841948 - RNA, 14 nt, Human
uuccuuuccccagc

SEQ ID NO: 2841949 - RNA, 17 nt, Human
uuccuuuccccagccca

SEQ ID NO: 2841950 - RNA, 12 nt, Human
uuccuuucccuu

SEQ ID NO: 2841951 - RNA, 13 nt, Human
uuccuuucccuuc

SEQ ID NO: 2841952 - RNA, 14 nt, Human
uuccuuucccuucc

SEQ ID NO: 2841953 - RNA, 15 nt, Human
uuccuuucccuuccu

SEQ ID NO: 2841954 - RNA, 17 nt, Human
uuccuuucccuuccucu

SEQ ID NO: 2841955 - RNA, 18 nt, Human
uuccuuucccuuccucuu

SEQ ID NO: 2841956 - RNA, 14 nt, Human
uuccuuuccuuuuc

SEQ ID NO: 2841957 - RNA, 15 nt, Human
uuccuuuccccagcc

SEQ ID NO: 2841958 - RNA, 16 nt, Human
uuccuuuccccagccc

SEQ ID NO: 2841959 - RNA, 20 nt, Human
uucuaaagagcacuuacugu

SEQ ID NO: 2841960 - RNA, 13 nt, Human
uucuaaagauaau

SEQ ID NO: 2841961 - RNA, 23 nt, Human
uucuaaagauaauauuacuguuu

SEQ ID NO: 2841962 - RNA, 23 nt, Human
uucuaaacccaauccaaauggcg

SEQ ID NO: 2841963 - RNA, 21 nt, Human
uucuaaacguaagcacuguuu

SEQ ID NO: 2841964 - RNA, 19 nt, Human
uucuaaacccaauccaaau

SEQ ID NO: 2841965 - RNA, 18 nt, Human
uucuaaacccaauccaaa

SEQ ID NO: 2841966 - RNA, 15 nt, Human
uucuaaaaugugaug

SEQ ID NO: 2841967 - RNA, 19 nt, Human
uucuaaaaugugauguucu

SEQ ID NO: 2841968 - RNA, 20 nt, Human
uucuaaaaugugauguucua

SEQ ID NO: 2841969 - RNA, 23 nt, Human
uucuaaaaugugauguucuaagg

SEQ ID NO: 2841970 - RNA, 21 nt, Human
uucuaaguuucuaagauucua

SEQ ID NO: 2841971 - RNA, 15 nt, Human
uucuaauaauuucua

SEQ ID NO: 2841972 - RNA, 16 nt, Human
uucuaauaauuucuaa

SEQ ID NO: 2841973 - RNA, 18 nt, Human
uucuaauaauuucuaaug

SEQ ID NO: 2841974 - RNA, 13 nt, Human
uucuaauaaauua

SEQ ID NO: 2841975 - RNA, 16 nt, Human
uucuaauaaauuauac

SEQ ID NO: 2841976 - RNA, 18 nt, Human
uucuaauaaauuauacaa

SEQ ID NO: 2841977 - RNA, 20 nt, Human
uucuaaguuucuaagauucu

SEQ ID NO: 2841978 - RNA, 20 nt, Human
uuccuucugugaaaguacau

SEQ ID NO: 2841979 - RNA, 22 nt, Human
uuccuuuccaacguuuggaaga

SEQ ID NO: 2841980 - RNA, 23 nt, Human
uuccuuuccaacguuuggaagau

SEQ ID NO: 2841981 - RNA, 13 nt, Human
uuccuucuggccu

SEQ ID NO: 2841982 - RNA, 14 nt, Human
uuccuucuggccuu

SEQ ID NO: 2841983 - RNA, 13 nt, Human
uuccuucuguaaa

SEQ ID NO: 2841984 - RNA, 17 nt, Human
uuccuucugugaaagua

SEQ ID NO: 2841985 - RNA, 15 nt, Human
uuccuucucugaaca

SEQ ID NO: 2841986 - RNA, 16 nt, Human
uuccuucucugaacac

SEQ ID NO: 2841987 - RNA, 17 nt, Human
uuccuucucugaacaca

SEQ ID NO: 2841988 - RNA, 22 nt, Human
uuccuucucugaacacaggcag

SEQ ID NO: 2841989 - RNA, 11 nt, Human
uuccuuccuaa

SEQ ID NO: 2841990 - RNA, 12 nt, Human
uuccuuccuaaa

SEQ ID NO: 2841991 - RNA, 17 nt, Human
uuccuuccuaaaauaau

SEQ ID NO: 2841992 - RNA, 17 nt, Human
uuccuuccucugagccu

SEQ ID NO: 2841993 - RNA, 13 nt, Human
uuccuuccucuga

SEQ ID NO: 2841994 - RNA, 15 nt, Human
uuccuuccacuaacu

SEQ ID NO: 2841995 - RNA, 20 nt, Human
uuccuuccaucccuaccccc

SEQ ID NO: 2841996 - RNA, 22 nt, Human
uuccuucccgccagagggcuug

SEQ ID NO: 2841997 - RNA, 11 nt, Human
uuccuccugga

SEQ ID NO: 2841998 - RNA, 11 nt, Human
uuccugcccug

SEQ ID NO: 2841999 - RNA, 13 nt, Human
uuccugccccucu

SEQ ID NO: 2842000 - RNA, 14 nt, Human
uuccugccccucuu

SEQ ID NO: 2842001 - RNA, 15 nt, Human
uuccugccccucuuu

SEQ ID NO: 2842002 - RNA, 17 nt, Human
uuccugccccucuuucu

SEQ ID NO: 2842003 - RNA, 18 nt, Human
uuccugccccucuuucuc

SEQ ID NO: 2842004 - RNA, 20 nt, Human
uuccugccccucuuucucuu

SEQ ID NO: 2842005 - RNA, 21 nt, Human
uuccugccccucuuucucuuu

SEQ ID NO: 2842006 - RNA, 22 nt, Human
uuccugccccucuuucucuuuc

SEQ ID NO: 2842007 - RNA, 22 nt, Human
uuccugcccugggaggcaguga

SEQ ID NO: 2842008 - RNA, 16 nt, Human
uuccugcccugggagg

SEQ ID NO: 2842009 - RNA, 13 nt, Human
uuccugcccuggg

SEQ ID NO: 2842010 - RNA, 18 nt, Human
uuccuagcccucucacau

SEQ ID NO: 2842011 - RNA, 13 nt, Human
uuccuagccuguu

SEQ ID NO: 2842012 - RNA, 16 nt, Human
uuccuagccuguuucu

SEQ ID NO: 2842013 - RNA, 14 nt, Human
uuccuagcccucuc

SEQ ID NO: 2842014 - RNA, 23 nt, Human
uuccucauaguaugguggcuggg

SEQ ID NO: 2842015 - RNA, 12 nt, Human
uuccucagcuua

SEQ ID NO: 2842016 - RNA, 16 nt, Human
uuccucagcuuaucuc

SEQ ID NO: 2842017 - RNA, 19 nt, Human
uuccucagcuuaucucuuu

SEQ ID NO: 2842018 - RNA, 18 nt, Human
uuccuaguuuucuccucc

SEQ ID NO: 2842019 - RNA, 15 nt, Human
uuccuaguuuucucc

SEQ ID NO: 2842020 - RNA, 17 nt, Human
uuccuauaacuugaugc

SEQ ID NO: 2842021 - RNA, 19 nt, Human
uuccuauaacuugaugcau

SEQ ID NO: 2842022 - RNA, 14 nt, Human
uuccuagggguuug

SEQ ID NO: 2842023 - RNA, 13 nt, Human
uuccuaguuggug

SEQ ID NO: 2842024 - RNA, 21 nt, Human
uuccuaguuggugagaaaccu

SEQ ID NO: 2842025 - RNA, 22 nt, Human
uuccuaguuggugagaaaccug

SEQ ID NO: 2842026 - RNA, 23 nt, Human
uuccuccccauuagagucagccu

SEQ ID NO: 2842027 - RNA, 16 nt, Human
uuccuccuccccacuu

SEQ ID NO: 2842028 - RNA, 14 nt, Human
uuccuccuccccac

SEQ ID NO: 2842029 - RNA, 14 nt, Human
uuccuccuccacca

SEQ ID NO: 2842030 - RNA, 15 nt, Human
uuccuccuccaccac

SEQ ID NO: 2842031 - RNA, 18 nt, Human
uuccuccuccaccaccgc

SEQ ID NO: 2842032 - RNA, 19 nt, Human
uuccuccuccaccaccgcc

SEQ ID NO: 2842033 - RNA, 18 nt, Human
uuccucauccaccccauc

SEQ ID NO: 2842034 - RNA, 19 nt, Human
uuccucauccaccccaucc

SEQ ID NO: 2842035 - RNA, 14 nt, Human
uuccucauccucag

SEQ ID NO: 2842036 - RNA, 16 nt, Human
uuccucauccucagau

SEQ ID NO: 2842037 - RNA, 19 nt, Human
uuccucauccucagaugcu

SEQ ID NO: 2842038 - RNA, 22 nt, Human
uuccucauccucagaugcucaa

SEQ ID NO: 2842039 - RNA, 19 nt, Human
uucccuugccacuuugcac

SEQ ID NO: 2842040 - RNA, 17 nt, Human
uucccuugcuuuucccu

SEQ ID NO: 2842041 - RNA, 18 nt, Human
uucccuugcuuuucccuc

SEQ ID NO: 2842042 - RNA, 19 nt, Human
uucccuugcuuuucccucu

SEQ ID NO: 2842043 - RNA, 20 nt, Human
uucccuugcuuuucccucuu

SEQ ID NO: 2842044 - RNA, 13 nt, Human
uucccuuccacug

SEQ ID NO: 2842045 - RNA, 15 nt, Human
uucccuuccacugcc

SEQ ID NO: 2842046 - RNA, 19 nt, Human
uucccuuccacugccucug

SEQ ID NO: 2842047 - RNA, 15 nt, Human
uucccuuggccucag

SEQ ID NO: 2842048 - RNA, 14 nt, Human
uucccuuggccuca

SEQ ID NO: 2842049 - RNA, 12 nt, Human
uucccuuggccu

SEQ ID NO: 2842050 - RNA, 11 nt, Human
uucccuuggcc

SEQ ID NO: 2842051 - RNA, 16 nt, Human
uucccuuggccucaga

SEQ ID NO: 2842052 - RNA, 18 nt, Human
uucccuucccuaaaguga

SEQ ID NO: 2842053 - RNA, 15 nt, Human
uucccuuuccccagc

SEQ ID NO: 2842054 - RNA, 15 nt, Human
uucccuuuccuucca

SEQ ID NO: 2842055 - RNA, 17 nt, Human
uuccccacugacagccu

SEQ ID NO: 2842056 - RNA, 23 nt, Human
uuccccacugacagccucccacc

SEQ ID NO: 2842057 - RNA, 21 nt, Human
uuccccacugacagccuccca

SEQ ID NO: 2842058 - RNA, 19 nt, Human
uucccuucaguacccucuc

SEQ ID NO: 2842059 - RNA, 22 nt, Human
uucccuucaguacccucucagc

SEQ ID NO: 2842060 - RNA, 23 nt, Human
uucccuucaguacccucucagcu

SEQ ID NO: 2842061 - RNA, 20 nt, Human
uucccugucucuugaaaaau

SEQ ID NO: 2842062 - RNA, 12 nt, Human
uucccuguucuu

SEQ ID NO: 2842063 - RNA, 15 nt, Human
uucccuguucuuccu

SEQ ID NO: 2842064 - RNA, 16 nt, Human
uucccuguucuuccuc

SEQ ID NO: 2842065 - RNA, 17 nt, Human
uucccuguucuuccucc

SEQ ID NO: 2842066 - RNA, 18 nt, Human
uucccuguucuuccucca

SEQ ID NO: 2842067 - RNA, 19 nt, Human
uucccuguucuuccuccag

SEQ ID NO: 2842068 - RNA, 12 nt, Human
uuccccagccca

SEQ ID NO: 2842069 - RNA, 12 nt, Human
uuccccagcauc

SEQ ID NO: 2842070 - RNA, 18 nt, Human
uuccccagcaucacuccc

SEQ ID NO: 2842071 - RNA, 20 nt, Human
uuccccagcaucacucccca

SEQ ID NO: 2842072 - RNA, 13 nt, Human
uuccccagcccag

SEQ ID NO: 2842073 - RNA, 14 nt, Human
uuccccagcccagg

SEQ ID NO: 2842074 - RNA, 20 nt, Human
uucuauaugaauuuaaauau

SEQ ID NO: 2842075 - RNA, 23 nt, Human
uucuauaugaauuuaaauauaau

SEQ ID NO: 2842076 - RNA, 20 nt, Human
uucuauaugcgaguuagcca

SEQ ID NO: 2842077 - RNA, 13 nt, Human
uucuaaugaugau

SEQ ID NO: 2842078 - RNA, 16 nt, Human
uucuaaugcugauaug

SEQ ID NO: 2842079 - RNA, 16 nt, Human
uucuaauggaaugguu

SEQ ID NO: 2842080 - RNA, 17 nt, Human
uucuaauggaaugguuu

SEQ ID NO: 2842081 - RNA, 13 nt, Human
uucuaaucaaaag

SEQ ID NO: 2842082 - RNA, 21 nt, Human
uucuaaugaggagagaaaaua

SEQ ID NO: 2842083 - RNA, 23 nt, Human
uucuaaugaggagagaaaauaua

SEQ ID NO: 2842084 - RNA, 19 nt, Human
uucuaauaauuucuaaugu

SEQ ID NO: 2842085 - RNA, 22 nt, Human
uucuaauauauuuuuauauuua

SEQ ID NO: 2842086 - RNA, 13 nt, Human
uucuaauaucauu

SEQ ID NO: 2842087 - RNA, 14 nt, Human
uucuaugcaguggc

SEQ ID NO: 2842088 - RNA, 15 nt, Human
uucuaugcugcuuuu

SEQ ID NO: 2842089 - RNA, 16 nt, Human
uucuaugcugcuuuua

SEQ ID NO: 2842090 - RNA, 18 nt, Human
uucuaugcugcuuuuaua

SEQ ID NO: 2842091 - RNA, 21 nt, Human
uucuaugcugcuuuuauaucu

SEQ ID NO: 2842092 - RNA, 23 nt, Human
uucuaugcugcuuuuauaucugu

SEQ ID NO: 2842093 - RNA, 14 nt, Human
uucuaucaagccca

SEQ ID NO: 2842094 - RNA, 19 nt, Human
uucuaugaguggaaaaagc

SEQ ID NO: 2842095 - RNA, 13 nt, Human
uucuauguuuacu

SEQ ID NO: 2842096 - RNA, 14 nt, Human
uucuauguuuacuu

SEQ ID NO: 2842097 - RNA, 16 nt, Human
uucuaugguuaugaaa

SEQ ID NO: 2842098 - RNA, 19 nt, Human
uucuaugguuaugaaagaa

SEQ ID NO: 2842099 - RNA, 23 nt, Human
uucuaugguuaugaaagaauaua

SEQ ID NO: 2842100 - RNA, 13 nt, Human
uucuauguacuag

SEQ ID NO: 2842101 - RNA, 15 nt, Human
uucuauguacuagua

SEQ ID NO: 2842102 - RNA, 18 nt, Human
uucuauguacuaguacug

SEQ ID NO: 2842103 - RNA, 21 nt, Human
uucuauguacuaguacugugu

SEQ ID NO: 2842104 - RNA, 24 nt, Human
uucuauguacuaguacuguguacu

SEQ ID NO: 2842105 - RNA, 22 nt, Human
uucuauucaagguggccaaauu

SEQ ID NO: 2842106 - RNA, 14 nt, Human
uucuauuccuucug

SEQ ID NO: 2842107 - RNA, 18 nt, Human
uucuauuccuucuggccu

SEQ ID NO: 2842108 - RNA, 17 nt, Human
uucuauuaacuuuaauu

SEQ ID NO: 2842109 - RNA, 15 nt, Human
uucuauuaaagugcu

SEQ ID NO: 2842110 - RNA, 21 nt, Human
uucuauuaaagugcuaagguu

SEQ ID NO: 2842111 - RNA, 15 nt, Human
uucuauuaaauaguu

SEQ ID NO: 2842112 - RNA, 12 nt, Human
uucuauuaaagu

SEQ ID NO: 2842113 - RNA, 17 nt, Human
uucuauugacuucaaug

SEQ ID NO: 2842114 - RNA, 23 nt, Human
uucuauugacuucaaugauagua

SEQ ID NO: 2842115 - RNA, 12 nt, Human
uucuauugccuu

SEQ ID NO: 2842116 - RNA, 17 nt, Human
uucuauugccuucuuug

SEQ ID NO: 2842117 - RNA, 18 nt, Human
uucuauugccuucuuuga

SEQ ID NO: 2842118 - RNA, 19 nt, Human
uucuauugccuucuuugaa

SEQ ID NO: 2842119 - RNA, 20 nt, Human
uucuauugccuucuuugaag

SEQ ID NO: 2842120 - RNA, 21 nt, Human
uucuauugccuucuuugaaga

SEQ ID NO: 2842121 - RNA, 23 nt, Human
uucuauugccuucuuugaagaag

SEQ ID NO: 2842122 - RNA, 19 nt, Human
uucuauuuauauguacaug

SEQ ID NO: 2842123 - RNA, 17 nt, Human
uucuauuuauuaugcuu

SEQ ID NO: 2842124 - RNA, 18 nt, Human
uucuauuuauauguacau

SEQ ID NO: 2842125 - RNA, 16 nt, Human
uucucaaaagaacuua

SEQ ID NO: 2842126 - RNA, 15 nt, Human
uucucaaaagcauuu

SEQ ID NO: 2842127 - RNA, 16 nt, Human
uucucaaaagcauuua

SEQ ID NO: 2842128 - RNA, 18 nt, Human
uucucaaaagcauuuauc

SEQ ID NO: 2842129 - RNA, 20 nt, Human
uucucaaaagcauuuaucau

SEQ ID NO: 2842130 - RNA, 21 nt, Human
uucucaaaagcauuuaucauu

SEQ ID NO: 2842131 - RNA, 16 nt, Human
uucuauuuuguaaacu

SEQ ID NO: 2842132 - RNA, 13 nt, Human
uucuauuuuguaa

SEQ ID NO: 2842133 - RNA, 15 nt, Human
uucucaaaguuuuga

SEQ ID NO: 2842134 - RNA, 17 nt, Human
uucucaaaguuuugaaa

SEQ ID NO: 2842135 - RNA, 18 nt, Human
uucucaaaguuuugaaaa

SEQ ID NO: 2842136 - RNA, 15 nt, Human
uucucauccugcagg

SEQ ID NO: 2842137 - RNA, 14 nt, Human
uucucaucugcacc

SEQ ID NO: 2842138 - RNA, 17 nt, Human
uucucaucugcacccuu

SEQ ID NO: 2842139 - RNA, 19 nt, Human
uucucaucugcacccuucu

SEQ ID NO: 2842140 - RNA, 20 nt, Human
uucucaucugcacccuucuu

SEQ ID NO: 2842141 - RNA, 21 nt, Human
uucucaaaguuuugaaaagcu

SEQ ID NO: 2842142 - RNA, 22 nt, Human
uucucaaaguuuugaaaagcua

SEQ ID NO: 2842143 - RNA, 12 nt, Human
uucucaaaucuu

SEQ ID NO: 2842144 - RNA, 14 nt, Human
uucucaugccucag

SEQ ID NO: 2842145 - RNA, 12 nt, Human
uucucaugccuc

SEQ ID NO: 2842146 - RNA, 11 nt, Human
uucucaugccu

SEQ ID NO: 2842147 - RNA, 15 nt, Human
uucucaucuugugaa

SEQ ID NO: 2842148 - RNA, 18 nt, Human
uucucaucuugugaaaug

SEQ ID NO: 2842149 - RNA, 14 nt, Human
uucucuccccaacc

SEQ ID NO: 2842150 - RNA, 15 nt, Human
uucucuccccaaccc

SEQ ID NO: 2842151 - RNA, 22 nt, Human
uucucuccccaacccccauucu

SEQ ID NO: 2842152 - RNA, 23 nt, Human
uucucuccccaacccccauucuc

SEQ ID NO: 2842153 - RNA, 18 nt, Human
uucucucccugccagagg

SEQ ID NO: 2842154 - RNA, 15 nt, Human
uucuccaaggaaacc

SEQ ID NO: 2842155 - RNA, 17 nt, Human
uucucucggcuccccau

SEQ ID NO: 2842156 - RNA, 17 nt, Human
uucucucuacagugcca

SEQ ID NO: 2842157 - RNA, 20 nt, Human
uucuccccaaugagacuugc

SEQ ID NO: 2842158 - RNA, 22 nt, Human
uucuccccaaugagacuugccu

SEQ ID NO: 2842159 - RNA, 12 nt, Human
uucuccccagaa

SEQ ID NO: 2842160 - RNA, 13 nt, Human
uucuccccagaau

SEQ ID NO: 2842161 - RNA, 18 nt, Human
uucucccccugggcucug

SEQ ID NO: 2842162 - RNA, 19 nt, Human
uucuccccgcuaaggaaga

SEQ ID NO: 2842163 - RNA, 17 nt, Human
uucucccccugggcucu

SEQ ID NO: 2842164 - RNA, 14 nt, Human
uucucccccugggc

SEQ ID NO: 2842165 - RNA, 13 nt, Human
uucuccacccugc

SEQ ID NO: 2842166 - RNA, 11 nt, Human
uucuccaggcu

SEQ ID NO: 2842167 - RNA, 14 nt, Human
uucuccaccccagc

SEQ ID NO: 2842168 - RNA, 12 nt, Human
uucuccaucccu

SEQ ID NO: 2842169 - RNA, 20 nt, Human
uucuccaggucucacgggca

SEQ ID NO: 2842170 - RNA, 17 nt, Human
uucucccagaaucccag

SEQ ID NO: 2842171 - RNA, 20 nt, Human
uucucccagaaucccagccg

SEQ ID NO: 2842172 - RNA, 18 nt, Human
uucucugaacacaggcag

SEQ ID NO: 2842173 - RNA, 19 nt, Human
uucucugaacacaggcagc

SEQ ID NO: 2842174 - RNA, 20 nt, Human
uucucugaacacaggcagcu

SEQ ID NO: 2842175 - RNA, 24 nt, Human
uucucugaacacaggcagcuuucu

SEQ ID NO: 2842176 - RNA, 16 nt, Human
uucucucuucccucag

SEQ ID NO: 2842177 - RNA, 20 nt, Human
uucucuggcuguaaggcucu

SEQ ID NO: 2842178 - RNA, 15 nt, Human
uucucugcuccacca

SEQ ID NO: 2842179 - RNA, 14 nt, Human
uucucugcuccacc

SEQ ID NO: 2842180 - RNA, 13 nt, Human
uucucugcuccac

SEQ ID NO: 2842181 - RNA, 11 nt, Human
uucucugcucc

SEQ ID NO: 2842182 - RNA, 21 nt, Human
uucucugccgcuaccucccuc

SEQ ID NO: 2842183 - RNA, 22 nt, Human
uucucugccgcuaccucccucc

SEQ ID NO: 2842184 - RNA, 23 nt, Human
uucucugccgcuaccucccuccc

SEQ ID NO: 2842185 - RNA, 19 nt, Human
uucucugccuuugacauuu

SEQ ID NO: 2842186 - RNA, 20 nt, Human
uucucugccuuugacauuua

SEQ ID NO: 2842187 - RNA, 21 nt, Human
uucucugccuuugacauuuaa

SEQ ID NO: 2842188 - RNA, 14 nt, Human
uucucuguauagua

SEQ ID NO: 2842189 - RNA, 11 nt, Human
uucucugucca

SEQ ID NO: 2842190 - RNA, 17 nt, Human
uucucugucucagacuu

SEQ ID NO: 2842191 - RNA, 22 nt, Human
uucucugucucagacuuuugua

SEQ ID NO: 2842192 - RNA, 16 nt, Human
uucugaccuucagcuc

SEQ ID NO: 2842193 - RNA, 18 nt, Human
uucugaccuucagcucac

SEQ ID NO: 2842194 - RNA, 13 nt, Human
uucugacggcccu

SEQ ID NO: 2842195 - RNA, 14 nt, Human
uucugacggcccug

SEQ ID NO: 2842196 - RNA, 15 nt, Human
uucugacggcccugc

SEQ ID NO: 2842197 - RNA, 17 nt, Human
uucugacggcccugcaa

SEQ ID NO: 2842198 - RNA, 12 nt, Human
uuucagagauuu

SEQ ID NO: 2842199 - RNA, 15 nt, Human
uuucagacuugucaa

SEQ ID NO: 2842200 - RNA, 23 nt, Human
uuucagagacagcugauacuuca

SEQ ID NO: 2842201 - RNA, 14 nt, Human
uuucaaucacuguc

SEQ ID NO: 2842202 - RNA, 21 nt, Human
uuucaaucacuguccuccaca

SEQ ID NO: 2842203 - RNA, 23 nt, Human
uuucaaucacuguccuccacaca

SEQ ID NO: 2842204 - RNA, 14 nt, Human
uuucaaugacauuu

SEQ ID NO: 2842205 - RNA, 14 nt, Human
uuuauuuguuuuuc

SEQ ID NO: 2842206 - RNA, 16 nt, Human
uuuauuugcaacauuu

SEQ ID NO: 2842207 - RNA, 16 nt, Human
uuuauuucugcauaug

SEQ ID NO: 2842208 - RNA, 13 nt, Human
uuuauuuccagug

SEQ ID NO: 2842209 - RNA, 14 nt, Human
uuuauuuauuuaca

SEQ ID NO: 2842210 - RNA, 14 nt, Human
uuuauuuauguacu

SEQ ID NO: 2842211 - RNA, 15 nt, Human
uuuauuuauguacuu

SEQ ID NO: 2842212 - RNA, 11 nt, Human
uuuauuucacu

SEQ ID NO: 2842213 - RNA, 15 nt, Human
uuuauuucagauuuu

SEQ ID NO: 2842214 - RNA, 13 nt, Human
uuuauuuauuuau

SEQ ID NO: 2842215 - RNA, 11 nt, Human
uuuauuucauu

SEQ ID NO: 2842216 - RNA, 17 nt, Human
uuuauuucauugguuaa

SEQ ID NO: 2842217 - RNA, 15 nt, Human
uuucauucuccugcc

SEQ ID NO: 2842218 - RNA, 13 nt, Human
uuucauucucauu

SEQ ID NO: 2842219 - RNA, 16 nt, Human
uuucaggguuuucuga

SEQ ID NO: 2842220 - RNA, 22 nt, Human
uuucaggguuuucugagggaaa

SEQ ID NO: 2842221 - RNA, 15 nt, Human
uuucauucaucccau

SEQ ID NO: 2842222 - RNA, 14 nt, Human
uuucauuccaaagg

SEQ ID NO: 2842223 - RNA, 17 nt, Human
uuucauuccaaagggga

SEQ ID NO: 2842224 - RNA, 11 nt, Human
uuucauuccau

SEQ ID NO: 2842225 - RNA, 12 nt, Human
uuucauuccauu

SEQ ID NO: 2842226 - RNA, 16 nt, Human
uuucauuccauugccu

SEQ ID NO: 2842227 - RNA, 17 nt, Human
uuucauuccauugccua

SEQ ID NO: 2842228 - RNA, 22 nt, Human
uuucaggcaggcaccuagcaau

SEQ ID NO: 2842229 - RNA, 13 nt, Human
uuucagcuuaaaa

SEQ ID NO: 2842230 - RNA, 14 nt, Human
uuucagcuuacaca

SEQ ID NO: 2842231 - RNA, 16 nt, Human
uuucaggaccuuuuga

SEQ ID NO: 2842232 - RNA, 17 nt, Human
uuucaggagcagccuca

SEQ ID NO: 2842233 - RNA, 14 nt, Human
uuuccaaaauaauu

SEQ ID NO: 2842234 - RNA, 17 nt, Human
uuucauuguaugaugug

SEQ ID NO: 2842235 - RNA, 19 nt, Human
uuuccaaaauaaaacaaag

SEQ ID NO: 2842236 - RNA, 17 nt, Human
uuucauugguuaauuuu

SEQ ID NO: 2842237 - RNA, 15 nt, Human
uuucauuguaugaug

SEQ ID NO: 2842238 - RNA, 16 nt, Human
uuucauuguaugaugu

SEQ ID NO: 2842239 - RNA, 17 nt, Human
uuucauugccuguguau

SEQ ID NO: 2842240 - RNA, 23 nt, Human
uuucauugccuguguauggaaaa

SEQ ID NO: 2842241 - RNA, 19 nt, Human
uuuccagaggcuauuauuu

SEQ ID NO: 2842242 - RNA, 16 nt, Human
uuuccagcagaagaca

SEQ ID NO: 2842243 - RNA, 21 nt, Human
uuuccagcagaagacaaaaag

SEQ ID NO: 2842244 - RNA, 23 nt, Human
uuuccagcagaagacaaaaagac

SEQ ID NO: 2842245 - RNA, 16 nt, Human
uuuccagcuuucuccc

SEQ ID NO: 2842246 - RNA, 18 nt, Human
uuuccagacuuccuugag

SEQ ID NO: 2842247 - RNA, 19 nt, Human
uuuccagacuuccuugaga

SEQ ID NO: 2842248 - RNA, 16 nt, Human
uuuccaaacugacuca

SEQ ID NO: 2842249 - RNA, 15 nt, Human
uuuccaaaauuuuuc

SEQ ID NO: 2842250 - RNA, 16 nt, Human
uuuccaaaauuuuuca

SEQ ID NO: 2842251 - RNA, 18 nt, Human
uuuccaaaauuuuucaac

SEQ ID NO: 2842252 - RNA, 16 nt, Human
uuuccaaacaacagaa

SEQ ID NO: 2842253 - RNA, 15 nt, Human
uuuccaaauaaaaug

SEQ ID NO: 2842254 - RNA, 12 nt, Human
uuucucuuucuu

SEQ ID NO: 2842255 - RNA, 15 nt, Human
uuucucuuucuuccu

SEQ ID NO: 2842256 - RNA, 20 nt, Human
uuucucuuucuuccuuuacu

SEQ ID NO: 2842257 - RNA, 13 nt, Human
uuucucuuucucu

SEQ ID NO: 2842258 - RNA, 16 nt, Human
uuucugagcacacuuu

SEQ ID NO: 2842259 - RNA, 15 nt, Human
uuucucuugagcugg

SEQ ID NO: 2842260 - RNA, 16 nt, Human
uuucucuucauacuuu

SEQ ID NO: 2842261 - RNA, 17 nt, Human
uuucucuugagcuggcc

SEQ ID NO: 2842262 - RNA, 16 nt, Human
uuucucuugagcuggc

SEQ ID NO: 2842263 - RNA, 18 nt, Human
uuucucuugagcuggccu

SEQ ID NO: 2842264 - RNA, 17 nt, Human
uuucucuguauaguacu

SEQ ID NO: 2842265 - RNA, 14 nt, Human
uuucucuguuguaa

SEQ ID NO: 2842266 - RNA, 21 nt, Human
uuucuccuguuuauucccauc

SEQ ID NO: 2842267 - RNA, 23 nt, Human
uuucuccuugaauaucuuucgau

SEQ ID NO: 2842268 - RNA, 15 nt, Human
uuucuccucccagga

SEQ ID NO: 2842269 - RNA, 17 nt, Human
uuucucccuaaacugua

SEQ ID NO: 2842270 - RNA, 19 nt, Human
uuucuaaugaggagagaaa

SEQ ID NO: 2842271 - RNA, 23 nt, Human
uuucuaaugaggagagaaaauau

SEQ ID NO: 2842272 - RNA, 20 nt, Human
uuucuaauggaaugguuugg

SEQ ID NO: 2842273 - RNA, 13 nt, Human
uuucuaaucaaaa

SEQ ID NO: 2842274 - RNA, 15 nt, Human
uuuccucuuccaaag

SEQ ID NO: 2842275 - RNA, 20 nt, Human
uuuccugagaccacagagag

SEQ ID NO: 2842276 - RNA, 14 nt, Human
uuucuaagagagcu

SEQ ID NO: 2842277 - RNA, 13 nt, Human
uuucuaagauucu

SEQ ID NO: 2842278 - RNA, 14 nt, Human
uuucuaagauucua

SEQ ID NO: 2842279 - RNA, 15 nt, Human
uuucuaagauucuaa

SEQ ID NO: 2842280 - RNA, 17 nt, Human
uuucuaagauucuaaag

SEQ ID NO: 2842281 - RNA, 18 nt, Human
uuucuaagauucuaaagg

SEQ ID NO: 2842282 - RNA, 13 nt, Human
uuucuaaccuuga

SEQ ID NO: 2842283 - RNA, 14 nt, Human
uuucuaaccuugaa

SEQ ID NO: 2842284 - RNA, 15 nt, Human
uuucuaaccuugaau

SEQ ID NO: 2842285 - RNA, 17 nt, Human
uuucuaaccuugaaugc

SEQ ID NO: 2842286 - RNA, 19 nt, Human
uuucuaaccuugaaugcug

SEQ ID NO: 2842287 - RNA, 20 nt, Human
uuucuaaccuugaaugcugc

SEQ ID NO: 2842288 - RNA, 22 nt, Human
uuucuaaccuugaaugcugcca

SEQ ID NO: 2842289 - RNA, 23 nt, Human
uuucuaaccuugaaugcugccag

SEQ ID NO: 2842290 - RNA, 15 nt, Human
uuuccugaaaucaag

SEQ ID NO: 2842291 - RNA, 23 nt, Human
uuuccugacagaaggacucaggu

SEQ ID NO: 2842292 - RNA, 22 nt, Human
uuuccucuucuauuuuguaaac

SEQ ID NO: 2842293 - RNA, 21 nt, Human
uuuccucuucuauuuuguaaa

SEQ ID NO: 2842294 - RNA, 23 nt, Human
uuuccuagcccucucacauuuau

SEQ ID NO: 2842295 - RNA, 15 nt, Human
uuuccuagccuguuu

SEQ ID NO: 2842296 - RNA, 17 nt, Human
uuuccuagcccucucac

SEQ ID NO: 2842297 - RNA, 15 nt, Human
uuuacaaugucauau

SEQ ID NO: 2842298 - RNA, 23 nt, Human
uuuagaaaaaaguuuacaacaua

SEQ ID NO: 2842299 - RNA, 12 nt, Human
uuuacuuuggcc

SEQ ID NO: 2842300 - RNA, 15 nt, Human
uuuacuuuuaaacag

SEQ ID NO: 2842301 - RNA, 18 nt, Human
uuuacuuuuaaacaguga

SEQ ID NO: 2842302 - RNA, 13 nt, Human
uuuacauuguaaa

SEQ ID NO: 2842303 - RNA, 21 nt, Human
uuuacaugugauguuuuagug

SEQ ID NO: 2842304 - RNA, 19 nt, Human
uuuacauguguagccuaug

SEQ ID NO: 2842305 - RNA, 20 nt, Human
uuuacauguguagccuaugu

SEQ ID NO: 2842306 - RNA, 21 nt, Human
uuuacauguguagccuauguu

SEQ ID NO: 2842307 - RNA, 15 nt, Human
uuuacuuuguguuca

SEQ ID NO: 2842308 - RNA, 15 nt, Human
uuuacauuguaaaua

SEQ ID NO: 2842309 - RNA, 11 nt, Human
uuuacuuucaa

SEQ ID NO: 2842310 - RNA, 16 nt, Human
uuuacuuucccuugcu

SEQ ID NO: 2842311 - RNA, 17 nt, Human
uuuacuuucccuugcuu

SEQ ID NO: 2842312 - RNA, 20 nt, Human
uuuacuuucccuugcuuuuc

SEQ ID NO: 2842313 - RNA, 17 nt, Human
uuuagaacaauuuucuu

SEQ ID NO: 2842314 - RNA, 19 nt, Human
uuuagaacaauuuucuugu

SEQ ID NO: 2842315 - RNA, 15 nt, Human
uuuagaagugcauuu

SEQ ID NO: 2842316 - RNA, 19 nt, Human
uuuagaagugcauuucuga

SEQ ID NO: 2842317 - RNA, 14 nt, Human
uuuagaagugucau

SEQ ID NO: 2842318 - RNA, 15 nt, Human
uuuagaagugucaug

SEQ ID NO: 2842319 - RNA, 18 nt, Human
uuuagaagugucauguuu

SEQ ID NO: 2842320 - RNA, 23 nt, Human
uuuagaauaaauucccaacuucu

SEQ ID NO: 2842321 - RNA, 20 nt, Human
uuuagacuuaauagaaacau

SEQ ID NO: 2842322 - RNA, 18 nt, Human
uuuagagaacuguggccg

SEQ ID NO: 2842323 - RNA, 14 nt, Human
uuuagagaacugaa

SEQ ID NO: 2842324 - RNA, 15 nt, Human
uuuagagaacugaaa

SEQ ID NO: 2842325 - RNA, 18 nt, Human
uuuagagaacugaaaaga

SEQ ID NO: 2842326 - RNA, 20 nt, Human
uuuagagaacugaaaagaga

SEQ ID NO: 2842327 - RNA, 21 nt, Human
uuuacaaucagccacauucua

SEQ ID NO: 2842328 - RNA, 21 nt, Human
uuuacaaguguauaucagaaa

SEQ ID NO: 2842329 - RNA, 15 nt, Human
uuuacaaguguauau

SEQ ID NO: 2842330 - RNA, 15 nt, Human
uuuacaagccccccc

SEQ ID NO: 2842331 - RNA, 21 nt, Human
uuuacaagcccccccuuccac

SEQ ID NO: 2842332 - RNA, 13 nt, Human
uuuaaucaugaaa

SEQ ID NO: 2842333 - RNA, 14 nt, Human
uuuaaucaugaaau

SEQ ID NO: 2842334 - RNA, 19 nt, Human
uuuaaucaugaaauuacuu

SEQ ID NO: 2842335 - RNA, 24 nt, Human
uuuaaucaugaaauuacuuaucau

SEQ ID NO: 2842336 - RNA, 16 nt, Human
uuuacaagaaguuuau

SEQ ID NO: 2842337 - RNA, 19 nt, Human
uuuacaagaaguuuauucu

SEQ ID NO: 2842338 - RNA, 21 nt, Human
uuuacaagaaguuuauucuca

SEQ ID NO: 2842339 - RNA, 17 nt, Human
uuuaaucugaaauucua

SEQ ID NO: 2842340 - RNA, 18 nt, Human
uuuaaucuguuauguacu

SEQ ID NO: 2842341 - RNA, 13 nt, Human
uuguauuguuuuc

SEQ ID NO: 2842342 - RNA, 14 nt, Human
uuguauuguuuucu

SEQ ID NO: 2842343 - RNA, 15 nt, Human
uuguauuuauuuagu

SEQ ID NO: 2842344 - RNA, 12 nt, Human
uuuaaucaugaa

SEQ ID NO: 2842345 - RNA, 14 nt, Human
uuguauugugguau

SEQ ID NO: 2842346 - RNA, 19 nt, Human
uuguauugugguauugaau

SEQ ID NO: 2842347 - RNA, 15 nt, Human
uuguauugcuguccu

SEQ ID NO: 2842348 - RNA, 14 nt, Human
uuuaugaucagugu

SEQ ID NO: 2842349 - RNA, 15 nt, Human
uuuaugaucaguguu

SEQ ID NO: 2842350 - RNA, 21 nt, Human
uuuaugaucaguguuguugcu

SEQ ID NO: 2842351 - RNA, 22 nt, Human
uuuaucuacccaagggcagaaa

SEQ ID NO: 2842352 - RNA, 16 nt, Human
uuuaugauaucccuga

SEQ ID NO: 2842353 - RNA, 14 nt, Human
uuuaugaugaugaa

SEQ ID NO: 2842354 - RNA, 17 nt, Human
uuuaugaugaugaaaau

SEQ ID NO: 2842355 - RNA, 14 nt, Human
uuuaugauuuucau

SEQ ID NO: 2842356 - RNA, 17 nt, Human
uuuaugauuuucauaac

SEQ ID NO: 2842357 - RNA, 19 nt, Human
uuuaugauuuucauaacuu

SEQ ID NO: 2842358 - RNA, 22 nt, Human
uuuaugauuuucauaacuuauu

SEQ ID NO: 2842359 - RNA, 12 nt, Human
uuuaugauuuaa

SEQ ID NO: 2842360 - RNA, 14 nt, Human
uuuaugauuuaaua

SEQ ID NO: 2842361 - RNA, 18 nt, Human
uuuaugauuuaauaaaau

SEQ ID NO: 2842362 - RNA, 12 nt, Human
uuuaugaaguuu

SEQ ID NO: 2842363 - RNA, 15 nt, Human
uuuaugaaguuuaaa

SEQ ID NO: 2842364 - RNA, 23 nt, Human
uuuaugaaguuuaaaacaguauu

SEQ ID NO: 2842365 - RNA, 12 nt, Human
uuuaugaaauga

SEQ ID NO: 2842366 - RNA, 20 nt, Human
uuuaucuauucugagaaaac

SEQ ID NO: 2842367 - RNA, 11 nt, Human
uuuaugaaaau

SEQ ID NO: 2842368 - RNA, 16 nt, Human
uuuaugaaaauaaaua

SEQ ID NO: 2842369 - RNA, 18 nt, Human
uuuaugaaaauaaauagc

SEQ ID NO: 2842370 - RNA, 19 nt, Human
uuuaugaaaauaaauagcu

SEQ ID NO: 2842371 - RNA, 18 nt, Human
uuuaugaaagguuuacau

SEQ ID NO: 2842372 - RNA, 19 nt, Human
uuuaugaaagguuuacauu

SEQ ID NO: 2842373 - RNA, 18 nt, Human
uuuauaaacagacaauau

SEQ ID NO: 2842374 - RNA, 22 nt, Human
uuuauaaacagacaauauguga

SEQ ID NO: 2842375 - RNA, 23 nt, Human
uuuauaaacagacaauaugugag

SEQ ID NO: 2842376 - RNA, 17 nt, Human
uuuauaaaauauaaaca

SEQ ID NO: 2842377 - RNA, 14 nt, Human
uuuauaaaauuaga

SEQ ID NO: 2842378 - RNA, 16 nt, Human
uuuauaaaauuagaaa

SEQ ID NO: 2842379 - RNA, 22 nt, Human
uuuauaaaauuagaaagcaacu

SEQ ID NO: 2842380 - RNA, 17 nt, Human
uuuauaaaauuuugcuu

SEQ ID NO: 2842381 - RNA, 12 nt, Human
uuuauaaacaga

SEQ ID NO: 2842382 - RNA, 21 nt, Human
uuuauaaaauagaguguaguu

SEQ ID NO: 2842383 - RNA, 19 nt, Human
uuuagaguaagaaauuuca

SEQ ID NO: 2842384 - RNA, 22 nt, Human
uuuagaguaagaaauuucaggu

SEQ ID NO: 2842385 - RNA, 12 nt, Human
uuuaucuaaauu

SEQ ID NO: 2842386 - RNA, 15 nt, Human
uuuaucuaaauuaaa

SEQ ID NO: 2842387 - RNA, 20 nt, Human
uuuaucuaauaccucugugu

SEQ ID NO: 2842388 - RNA, 13 nt, Human
uuuauuguauaaa

SEQ ID NO: 2842389 - RNA, 13 nt, Human
uuuauuuaugaag

SEQ ID NO: 2842390 - RNA, 14 nt, Human
uuuauuuaugaagu

SEQ ID NO: 2842391 - RNA, 19 nt, Human
uuuauuuauauguacuguu

SEQ ID NO: 2842392 - RNA, 15 nt, Human
uuuauuuauacuauu

SEQ ID NO: 2842393 - RNA, 20 nt, Human
uuuauuguuaacucuugucu

SEQ ID NO: 2842394 - RNA, 17 nt, Human
uuuauucaaguuauugu

SEQ ID NO: 2842395 - RNA, 16 nt, Human
uuuauuauuuauuuau

SEQ ID NO: 2842396 - RNA, 17 nt, Human
uuuauucagcuucauuu

SEQ ID NO: 2842397 - RNA, 19 nt, Human
uuuauucagcuucauuugu

SEQ ID NO: 2842398 - RNA, 21 nt, Human
uuuauucagcuucauuugugu

SEQ ID NO: 2842399 - RNA, 22 nt, Human
uuuauucagcuucauuuguguc

SEQ ID NO: 2842400 - RNA, 18 nt, Human
uuuaugcaaggaaggaaa

SEQ ID NO: 2842401 - RNA, 19 nt, Human
uuuaugcacuuauaaggug

SEQ ID NO: 2842402 - RNA, 14 nt, Human
uuuaugcagauaga

SEQ ID NO: 2842403 - RNA, 17 nt, Human
uuuaugcaaggaaggaa

SEQ ID NO: 2842404 - RNA, 15 nt, Human
uuuaugcaaggaagg

SEQ ID NO: 2842405 - RNA, 17 nt, Human
uuuauugcuaguauuug

SEQ ID NO: 2842406 - RNA, 19 nt, Human
uuuauugcuaguauuugaa

SEQ ID NO: 2842407 - RNA, 20 nt, Human
uuuauugcuaguauuugaau

SEQ ID NO: 2842408 - RNA, 23 nt, Human
uuuauugcuaguauuugaauuaa

SEQ ID NO: 2842409 - RNA, 13 nt, Human
uuuauuauuucua

SEQ ID NO: 2842410 - RNA, 23 nt, Human
uuuauuccagaaugcuguacauc

SEQ ID NO: 2842411 - RNA, 22 nt, Human
uuuauuccagaaugcuguacau

SEQ ID NO: 2842412 - RNA, 19 nt, Human
uuuauuccagaaugcugua

SEQ ID NO: 2842413 - RNA, 18 nt, Human
uuuauuccagaaugcugu

SEQ ID NO: 2842414 - RNA, 16 nt, Human
uuuauucauuagcugu

SEQ ID NO: 2842415 - RNA, 18 nt, Human
uuuauucauuagcuguga

SEQ ID NO: 2842416 - RNA, 22 nt, Human
uuuauucauuggucuaauuuau

SEQ ID NO: 2842417 - RNA, 14 nt, Human
uuuguauacaaaua

SEQ ID NO: 2842418 - RNA, 19 nt, Human
uuuguauacaaauauauug

SEQ ID NO: 2842419 - RNA, 22 nt, Human
uuuguauacaaauauauuguua

SEQ ID NO: 2842420 - RNA, 19 nt, Human
uuuguauaacuucuuaaaa

SEQ ID NO: 2842421 - RNA, 18 nt, Human
uuuguauaacuucuuaaa

SEQ ID NO: 2842422 - RNA, 17 nt, Human
uuuguauacauccuggg

SEQ ID NO: 2842423 - RNA, 19 nt, Human
uuuguauacauccugggua

SEQ ID NO: 2842424 - RNA, 20 nt, Human
uuuguauacauccuggguaa

SEQ ID NO: 2842425 - RNA, 14 nt, Human
uuuguauacuuuaa

SEQ ID NO: 2842426 - RNA, 20 nt, Human
uuuguauacuuuaaauaauu

SEQ ID NO: 2842427 - RNA, 22 nt, Human
uuuguauacuuuaaauaauuua

SEQ ID NO: 2842428 - RNA, 16 nt, Human
uuugucaacauuguga

SEQ ID NO: 2842429 - RNA, 17 nt, Human
uuugucaccagaacaca

SEQ ID NO: 2842430 - RNA, 17 nt, Human
uuuggaauacuuuuugu

SEQ ID NO: 2842431 - RNA, 15 nt, Human
uuuggaauacuuuuu

SEQ ID NO: 2842432 - RNA, 13 nt, Human
uuuggaauaaagu

SEQ ID NO: 2842433 - RNA, 13 nt, Human
uuuggaauacuuu

SEQ ID NO: 2842434 - RNA, 15 nt, Human
uuugguguacagacu

SEQ ID NO: 2842435 - RNA, 21 nt, Human
uuuggugucaacaugaaacac

SEQ ID NO: 2842436 - RNA, 12 nt, Human
uuuguucauguu

SEQ ID NO: 2842437 - RNA, 14 nt, Human
uuuguucauguuug

SEQ ID NO: 2842438 - RNA, 15 nt, Human
uuuguucauguuugg

SEQ ID NO: 2842439 - RNA, 19 nt, Human
uuuguucauccuauuguug

SEQ ID NO: 2842440 - RNA, 17 nt, Human
uuuguucaaguuuuggg

SEQ ID NO: 2842441 - RNA, 23 nt, Human
uuuguucaaguuuuggguauguu

SEQ ID NO: 2842442 - RNA, 17 nt, Human
uuuguucacugaaggug

SEQ ID NO: 2842443 - RNA, 19 nt, Human
uuuguucacugaaggugau

SEQ ID NO: 2842444 - RNA, 22 nt, Human
uuuguuaaaauuaucaauaucu

SEQ ID NO: 2842445 - RNA, 13 nt, Human
uuuguuaaauaau

SEQ ID NO: 2842446 - RNA, 24 nt, Human
uuuguuaaaauacaguucugucau

SEQ ID NO: 2842447 - RNA, 18 nt, Human
uuuguuaagguccugaaa

SEQ ID NO: 2842448 - RNA, 19 nt, Human
uuuguguguugucuugaaa

SEQ ID NO: 2842449 - RNA, 12 nt, Human
uuugucccaggu

SEQ ID NO: 2842450 - RNA, 12 nt, Human
uuuguccucaaa

SEQ ID NO: 2842451 - RNA, 14 nt, Human
uuugucccccaacu

SEQ ID NO: 2842452 - RNA, 15 nt, Human
uuugucccccaacuu

SEQ ID NO: 2842453 - RNA, 16 nt, Human
uuugucccccaacuug

SEQ ID NO: 2842454 - RNA, 17 nt, Human
uuugucccccaacuuga

SEQ ID NO: 2842455 - RNA, 18 nt, Human
uuugucccccaacuugag

SEQ ID NO: 2842456 - RNA, 21 nt, Human
uuugucccccaacuugagaug

SEQ ID NO: 2842457 - RNA, 14 nt, Human
uuuguccccugcuu

SEQ ID NO: 2842458 - RNA, 20 nt, Human
uuuguguuguuggaaaaagu

SEQ ID NO: 2842459 - RNA, 21 nt, Human
uuuguguuguuggaaaaaguc

SEQ ID NO: 2842460 - RNA, 13 nt, Human
uuuguguuguaau

SEQ ID NO: 2842461 - RNA, 14 nt, Human
uuuguguuguaauu

SEQ ID NO: 2842462 - RNA, 17 nt, Human
uuuguguuguaauucuu

SEQ ID NO: 2842463 - RNA, 22 nt, Human
uuuguguuguaauucuucaguu

SEQ ID NO: 2842464 - RNA, 23 nt, Human
uuuguguuguaauucuucaguug

SEQ ID NO: 2842465 - RNA, 14 nt, Human
uuuguguucuucuu

SEQ ID NO: 2842466 - RNA, 17 nt, Human
uuuguguuugguuuaca

SEQ ID NO: 2842467 - RNA, 18 nt, Human
uuuguguuugguuuacau

SEQ ID NO: 2842468 - RNA, 21 nt, Human
uuuguguuugguuuacauuua

SEQ ID NO: 2842469 - RNA, 14 nt, Human
uuuguuaaaaauaa

SEQ ID NO: 2842470 - RNA, 19 nt, Human
uuugucaucagauggaaau

SEQ ID NO: 2842471 - RNA, 22 nt, Human
uuugucaucagauggaaauauu

SEQ ID NO: 2842472 - RNA, 17 nt, Human
uuugucaucagccacca

SEQ ID NO: 2842473 - RNA, 21 nt, Human
uuugucaugaauucuuaugcu

SEQ ID NO: 2842474 - RNA, 13 nt, Human
uuuguccauuugu

SEQ ID NO: 2842475 - RNA, 15 nt, Human
uuuguccauuuguaa

SEQ ID NO: 2842476 - RNA, 16 nt, Human
uuuguccauuuguaaa

SEQ ID NO: 2842477 - RNA, 20 nt, Human
uuugccaugggcuucacugu

SEQ ID NO: 2842478 - RNA, 14 nt, Human
uuugccaugggcuu

SEQ ID NO: 2842479 - RNA, 15 nt, Human
uuugccagugggaac

SEQ ID NO: 2842480 - RNA, 16 nt, Human
uuugccagugggaacu

SEQ ID NO: 2842481 - RNA, 18 nt, Human
uuugccauguuggccagg

SEQ ID NO: 2842482 - RNA, 13 nt, Human
uuugccauacauc

SEQ ID NO: 2842483 - RNA, 20 nt, Human
uuuggaagauccugugagga

SEQ ID NO: 2842484 - RNA, 13 nt, Human
uuuggaagcaggg

SEQ ID NO: 2842485 - RNA, 20 nt, Human
uuuggaagaaaaaaaucuuc

SEQ ID NO: 2842486 - RNA, 22 nt, Human
uuuggaagaaaaaaaucuucuc

SEQ ID NO: 2842487 - RNA, 14 nt, Human
uuugcagacaggca

SEQ ID NO: 2842488 - RNA, 21 nt, Human
uuugcacuugugauuauuuau

SEQ ID NO: 2842489 - RNA, 17 nt, Human
uuugcacuguaugcugg

SEQ ID NO: 2842490 - RNA, 12 nt, Human
uuugauacuuau

SEQ ID NO: 2842491 - RNA, 13 nt, Human
uuugauacuuaua

SEQ ID NO: 2842492 - RNA, 14 nt, Human
uuugauacuuauau

SEQ ID NO: 2842493 - RNA, 15 nt, Human
uuugauacuuauauu

SEQ ID NO: 2842494 - RNA, 17 nt, Human
uuugauacuuauauuuu

SEQ ID NO: 2842495 - RNA, 18 nt, Human
uuugauacuuauauuuuc

SEQ ID NO: 2842496 - RNA, 17 nt, Human
uuugcagaagagggugu

SEQ ID NO: 2842497 - RNA, 16 nt, Human
uuucuuaaggugaggc

SEQ ID NO: 2842498 - RNA, 23 nt, Human
uuucuuaaggugaggccugucug

SEQ ID NO: 2842499 - RNA, 17 nt, Human
uuucuuacauaauuuuu

SEQ ID NO: 2842500 - RNA, 18 nt, Human
uuucuuacccaauuuccc

SEQ ID NO: 2842501 - RNA, 15 nt, Human
uuucuuacuccuccu

SEQ ID NO: 2842502 - RNA, 17 nt, Human
uuucuuacuccuccucu

SEQ ID NO: 2842503 - RNA, 17 nt, Human
uuucugaggcuuuauga

SEQ ID NO: 2842504 - RNA, 18 nt, Human
uuucugaggagaaacaaa

SEQ ID NO: 2842505 - RNA, 16 nt, Human
uuucugaggagaaaca

SEQ ID NO: 2842506 - RNA, 15 nt, Human
uuugagcagggcuca

SEQ ID NO: 2842507 - RNA, 15 nt, Human
uuugagcaauuuucg

SEQ ID NO: 2842508 - RNA, 12 nt, Human
uuucuuagcuuu

SEQ ID NO: 2842509 - RNA, 13 nt, Human
uuucuuagcuuuu

SEQ ID NO: 2842510 - RNA, 23 nt, Human
uuugagauuaagaaugccaggaa

SEQ ID NO: 2842511 - RNA, 20 nt, Human
uuugagauugccccaggucu

SEQ ID NO: 2842512 - RNA, 14 nt, Human
uuugagcucagccc

SEQ ID NO: 2842513 - RNA, 13 nt, Human
uuugauacauaau

SEQ ID NO: 2842514 - RNA, 14 nt, Human
uuugauacauaaua

SEQ ID NO: 2842515 - RNA, 15 nt, Human
uuugauacauaauaa

SEQ ID NO: 2842516 - RNA, 17 nt, Human
uuugauacauaauaaaa

SEQ ID NO: 2842517 - RNA, 23 nt, Human
uuugauacauaauaaaaaauuau

SEQ ID NO: 2842518 - RNA, 16 nt, Human
uuugauacauauguga

SEQ ID NO: 2842519 - RNA, 23 nt, Human
uuugauaauguuaaauuuguaag

SEQ ID NO: 2842520 - RNA, 22 nt, Human
uuugauacagucaacaagccug

SEQ ID NO: 2842521 - RNA, 15 nt, Human
uuugauaccccuggg

SEQ ID NO: 2842522 - RNA, 16 nt, Human
uuugauaccccugggg

SEQ ID NO: 2842523 - RNA, 17 nt, Human
uuugauaccccugggga

SEQ ID NO: 2842524 - RNA, 19 nt, Human
uuugauacauaugugaaua

SEQ ID NO: 2842525 - RNA, 19 nt, Human
uuugauaauguuaaauuug

SEQ ID NO: 2842526 - RNA, 17 nt, Human
uuugauaauguuaaauu

SEQ ID NO: 2842527 - RNA, 21 nt, Human
uuucucuuagaacauuguauu

SEQ ID NO: 2842528 - RNA, 19 nt, Human
uuugaguagauauuacuuu

SEQ ID NO: 2842529 - RNA, 20 nt, Human
uuugaguagauauuacuuua

SEQ ID NO: 2842530 - RNA, 21 nt, Human
uuugaguagauauuacuuuau

SEQ ID NO: 2842531 - RNA, 17 nt, Human
uuuuauauuaauguacu

SEQ ID NO: 2842532 - RNA, 13 nt, Human
uuuuauauugaaa

SEQ ID NO: 2842533 - RNA, 14 nt, Human
uuuuauauugaaaa

SEQ ID NO: 2842534 - RNA, 15 nt, Human
uuuuaucaugacaug

SEQ ID NO: 2842535 - RNA, 17 nt, Human
uuuuaucaugacauguu

SEQ ID NO: 2842536 - RNA, 19 nt, Human
uuuuaucaugacauguuau

SEQ ID NO: 2842537 - RNA, 12 nt, Human
uuuuauauuugu

SEQ ID NO: 2842538 - RNA, 13 nt, Human
uuuuauauuugua

SEQ ID NO: 2842539 - RNA, 14 nt, Human
uuuuauauuuguag

SEQ ID NO: 2842540 - RNA, 16 nt, Human
uuuuauauuuguaucg

SEQ ID NO: 2842541 - RNA, 17 nt, Human
uuuuauauuuguaucga

SEQ ID NO: 2842542 - RNA, 21 nt, Human
uuuuaugagauggaucacaua

SEQ ID NO: 2842543 - RNA, 21 nt, Human
uuuuauaucuggaaugagccu

SEQ ID NO: 2842544 - RNA, 14 nt, Human
uuuuauaucuguau

SEQ ID NO: 2842545 - RNA, 15 nt, Human
uuuuauaucuguaug

SEQ ID NO: 2842546 - RNA, 16 nt, Human
uuuuauaucuguaugu

SEQ ID NO: 2842547 - RNA, 17 nt, Human
uuuuauaucuguaugua

SEQ ID NO: 2842548 - RNA, 18 nt, Human
uuuuauaucuguauguau

SEQ ID NO: 2842549 - RNA, 15 nt, Human
uuuuacuguguuuua

SEQ ID NO: 2842550 - RNA, 15 nt, Human
uuuuauauauacagu

SEQ ID NO: 2842551 - RNA, 15 nt, Human
uuuguugugugugca

SEQ ID NO: 2842552 - RNA, 14 nt, Human
uuuguuuaaaagga

SEQ ID NO: 2842553 - RNA, 19 nt, Human
uuuguuuaauggacacuuu

SEQ ID NO: 2842554 - RNA, 17 nt, Human
uuuguuuaaugugaacu

SEQ ID NO: 2842555 - RNA, 21 nt, Human
uuuuaaaauggugcuuaaguu

SEQ ID NO: 2842556 - RNA, 12 nt, Human
uuuuaauuuagu

SEQ ID NO: 2842557 - RNA, 14 nt, Human
uuuuaauuuaguaa

SEQ ID NO: 2842558 - RNA, 18 nt, Human
uuuuaauuuaguaaaugu

SEQ ID NO: 2842559 - RNA, 20 nt, Human
uuuuaauuuaguaaauguua

SEQ ID NO: 2842560 - RNA, 21 nt, Human
uuuuaauuuauuuauacuauu

SEQ ID NO: 2842561 - RNA, 23 nt, Human
uuuuaauuuaugaguuuuugaua

SEQ ID NO: 2842562 - RNA, 16 nt, Human
uuuuaaacaaaauaga

SEQ ID NO: 2842563 - RNA, 13 nt, Human
uuuuacauaacug

SEQ ID NO: 2842564 - RNA, 18 nt, Human
uuuuacauaacugccuug

SEQ ID NO: 2842565 - RNA, 16 nt, Human
uuuuacagcugccugc

SEQ ID NO: 2842566 - RNA, 19 nt, Human
uuuuacagcuuuacacaca

SEQ ID NO: 2842567 - RNA, 13 nt, Human
uuuuacauuaaau

SEQ ID NO: 2842568 - RNA, 15 nt, Human
uuuuacauggagaaa

SEQ ID NO: 2842569 - RNA, 22 nt, Human
uuuuacucuaugccccaaauau

SEQ ID NO: 2842570 - RNA, 16 nt, Human
uuuuacucauugaaau

SEQ ID NO: 2842571 - RNA, 17 nt, Human
uuuuacucauugaaaug

SEQ ID NO: 2842572 - RNA, 20 nt, Human
uuuuacucauugaaauguca

SEQ ID NO: 2842573 - RNA, 13 nt, Human
uuuuaccagcuuu

SEQ ID NO: 2842574 - RNA, 15 nt, Human
uuuuaccagcuuuua

SEQ ID NO: 2842575 - RNA, 16 nt, Human
uuuuaccagcuuuuaa

SEQ ID NO: 2842576 - RNA, 16 nt, Human
uuuuaugagcuuccaa

SEQ ID NO: 2842577 - RNA, 18 nt, Human
uuuuaugagcuuccaagg

SEQ ID NO: 2842578 - RNA, 15 nt, Human
uuuuaugaugaugaa

SEQ ID NO: 2842579 - RNA, 16 nt, Human
uuuuaugaugaugaaa

SEQ ID NO: 2842580 - RNA, 15 nt, Human
uuuuaugauaucccu

SEQ ID NO: 2842581 - RNA, 13 nt, Human
uuuuaugaucagu

SEQ ID NO: 2842582 - RNA, 17 nt, Human
uuuucaacgcagcccug

SEQ ID NO: 2842583 - RNA, 13 nt, Human
uuuuaugcagaua

SEQ ID NO: 2842584 - RNA, 21 nt, Human
uuuucaacgcagcccugcuuu

SEQ ID NO: 2842585 - RNA, 22 nt, Human
uuuucaacgcagcccugcuuug

SEQ ID NO: 2842586 - RNA, 15 nt, Human
uuuucaagcagcauc

SEQ ID NO: 2842587 - RNA, 22 nt, Human
uuuucaagcagcaucuucuggu

SEQ ID NO: 2842588 - RNA, 13 nt, Human
uuuucaaggaagg

SEQ ID NO: 2842589 - RNA, 18 nt, Human
uuuucaaggcuuauauuc

SEQ ID NO: 2842590 - RNA, 15 nt, Human
uuuucaagaaacuga

SEQ ID NO: 2842591 - RNA, 14 nt, Human
uuuucaagaaacug

SEQ ID NO: 2842592 - RNA, 11 nt, Human
uuuucaaugug

SEQ ID NO: 2842593 - RNA, 15 nt, Human
uuuucacauaaaugc

SEQ ID NO: 2842594 - RNA, 22 nt, Human
uuuucacauaaaugcagcccau

SEQ ID NO: 2842595 - RNA, 19 nt, Human
uuuucacugcuggcugccu

SEQ ID NO: 2842596 - RNA, 23 nt, Human
uuuucacaggugugguguaauuu

SEQ ID NO: 2842597 - RNA, 17 nt, Human
uuuucacaaugucagua

SEQ ID NO: 2842598 - RNA, 20 nt, Human
uuuucacaaugucaguauuu

SEQ ID NO: 2842599 - RNA, 15 nt, Human
uuuucagaaaauauu

SEQ ID NO: 2842600 - RNA, 16 nt, Human
uuuucacuguagaaug

SEQ ID NO: 2842601 - RNA, 20 nt, Human
uuuucacugcuggcugccuu

SEQ ID NO: 2842602 - RNA, 17 nt, Human
uuuuccuagcccucuca

SEQ ID NO: 2842603 - RNA, 13 nt, Human
uuuuccucccuca

SEQ ID NO: 2842604 - RNA, 13 nt, Human
uuuuccuauuugu

SEQ ID NO: 2842605 - RNA, 16 nt, Human
uuuucagaaaauauua

SEQ ID NO: 2842606 - RNA, 21 nt, Human
uuuucggaggccccacugaug

SEQ ID NO: 2842607 - RNA, 19 nt, Human
uuuucguaugaaaaugagu

SEQ ID NO: 2842608 - RNA, 18 nt, Human
uuuucuaaacguaagcac

SEQ ID NO: 2842609 - RNA, 20 nt, Human
uuuucuaaacguaagcacug

SEQ ID NO: 2842610 - RNA, 21 nt, Human
uuuucuaaacguaagcacugu

SEQ ID NO: 2842611 - RNA, 14 nt, Human
uuuucuugauuuga

SEQ ID NO: 2842612 - RNA, 14 nt, Human
uuuucuugcauuga

SEQ ID NO: 2842613 - RNA, 18 nt, Human
uuuuccucuucuauuuug

SEQ ID NO: 2842614 - RNA, 12 nt, Human
uuuuccuuuaaa

SEQ ID NO: 2842615 - RNA, 13 nt, Human
uuuuccuuugugg

SEQ ID NO: 2842616 - RNA, 21 nt, Human
uuuuccuuuaaaaaaauuuaa

SEQ ID NO: 2842617 - RNA, 23 nt, Human
uuuucgaacauucuuugccuggu

SEQ ID NO: 2842618 - RNA, 13 nt, Human
uuuuucugcagaa

SEQ ID NO: 2842619 - RNA, 11 nt, Human
uuuugaaauga

SEQ ID NO: 2842620 - RNA, 12 nt, Human
uuuugaaaugaa

SEQ ID NO: 2842621 - RNA, 16 nt, Human
uuuugaaaugaaauuu

SEQ ID NO: 2842622 - RNA, 17 nt, Human
uuuugaaaugaaauuua

SEQ ID NO: 2842623 - RNA, 21 nt, Human
uuuugaaaugaaauuuaaaca

SEQ ID NO: 2842624 - RNA, 22 nt, Human
uuuugaaaugaaauuuaaacau

SEQ ID NO: 2842625 - RNA, 11 nt, Human
uuuuucugauu

SEQ ID NO: 2842626 - RNA, 16 nt, Human
uuuuucugauuagcuu

SEQ ID NO: 2842627 - RNA, 15 nt, Human
uuuugaaaagcuauu

SEQ ID NO: 2842628 - RNA, 16 nt, Human
uuuugaaaagcuauua

SEQ ID NO: 2842629 - RNA, 23 nt, Human
uuuugaaaagcuauuagccagga

SEQ ID NO: 2842630 - RNA, 17 nt, Human
uuuugaaaagcuucuua

SEQ ID NO: 2842631 - RNA, 21 nt, Human
uuuugaaaagcuucuuaauua

SEQ ID NO: 2842632 - RNA, 23 nt, Human
uuuugaaaucaaugcaagaguga

SEQ ID NO: 2842633 - RNA, 13 nt, Human
uuuucuugccuga

SEQ ID NO: 2842634 - RNA, 20 nt, Human
uuuucuugcuuaccuugacu

SEQ ID NO: 2842635 - RNA, 19 nt, Human
uuuucuuggcaaaagccuu

SEQ ID NO: 2842636 - RNA, 21 nt, Human
uuuucuuggcaaaagccuugu

SEQ ID NO: 2842637 - RNA, 24 nt, Human
uuuucuuggcaaaagccuugugua

SEQ ID NO: 2842638 - RNA, 17 nt, Human
uuuuucuguuguaacuu

SEQ ID NO: 2842639 - RNA, 18 nt, Human
uuuuucuguuguaacuua

SEQ ID NO: 2842640 - RNA, 23 nt, Human
uuuuucuuguaaauguguuggac

SEQ ID NO: 2842641 - RNA, 21 nt, Human
uuuuuuaguauuuauuuaugu

SEQ ID NO: 2842642 - RNA, 10 nt, Human
uuuuuugaag

SEQ ID NO: 2842643 - RNA, 22 nt, Human
uuuuuuacucauugaaauguca

SEQ ID NO: 2842644 - RNA, 12 nt, Human
uuuuuucuucua

SEQ ID NO: 2842645 - RNA, 20 nt, Human
caaggagggugagugcaagg

SEQ ID NO: 2842646 - RNA, 19 nt, Human
caaggagggugagugcaag

SEQ ID NO: 2842647 - RNA, 14 nt, Human
caaggagccaaaca

SEQ ID NO: 2842648 - RNA, 22 nt, Human
caaggacugcagggacugccag

SEQ ID NO: 2842649 - RNA, 22 nt, Human
caaggacacgcgccccccuccc

SEQ ID NO: 2842650 - RNA, 15 nt, Human
caaggacugcaggga

SEQ ID NO: 2842651 - RNA, 22 nt, Human
caaggacugagggacucugaag

SEQ ID NO: 2842652 - RNA, 23 nt, Human
caaggaaggaaagaaagaaggaa

SEQ ID NO: 2842653 - RNA, 18 nt, Human
caaggaaggaaagaaaga

SEQ ID NO: 2842654 - RNA, 19 nt, Human
caagcuggucccacucagu

SEQ ID NO: 2842655 - RNA, 17 nt, Human
caaggaaggaaagaaag

SEQ ID NO: 2842656 - RNA, 16 nt, Human
caaggaaggaaagaaa

SEQ ID NO: 2842657 - RNA, 13 nt, Human
caaggaaggaaag

SEQ ID NO: 2842658 - RNA, 12 nt, Human
caaggaaggaaa

SEQ ID NO: 2842659 - RNA, 17 nt, Human
caagcuggucccacuca

SEQ ID NO: 2842660 - RNA, 22 nt, Human
caagccagcgggaauggcagcu

SEQ ID NO: 2842661 - RNA, 22 nt, Human
caagccagcaacacagagcacu

SEQ ID NO: 2842662 - RNA, 17 nt, Human
caagccguggcuucccg

SEQ ID NO: 2842663 - RNA, 15 nt, Human
caagcagguuagaga

SEQ ID NO: 2842664 - RNA, 16 nt, Human
caagcagguuagagaa

SEQ ID NO: 2842665 - RNA, 19 nt, Human
caagcaggcgcugugcuau

SEQ ID NO: 2842666 - RNA, 16 nt, Human
caagcaggaaguucaa

SEQ ID NO: 2842667 - RNA, 13 nt, Human
caagcaggagacg

SEQ ID NO: 2842668 - RNA, 14 nt, Human
caagcaggagacga

SEQ ID NO: 2842669 - RNA, 19 nt, Human
caagcaggagacgacaggc

SEQ ID NO: 2842670 - RNA, 19 nt, Human
caagcgauucuucugcuuc

SEQ ID NO: 2842671 - RNA, 13 nt, Human
caagccuccacag

SEQ ID NO: 2842672 - RNA, 14 nt, Human
caagccuccacagc

SEQ ID NO: 2842673 - RNA, 18 nt, Human
caagccguggcuucccgc

SEQ ID NO: 2842674 - RNA, 17 nt, Human
caagccuccacagcgag

SEQ ID NO: 2842675 - RNA, 19 nt, Human
caagccucgaggugccuuc

SEQ ID NO: 2842676 - RNA, 16 nt, Human
caagccuccacagcga

SEQ ID NO: 2842677 - RNA, 15 nt, Human
caagccuccacagcg

SEQ ID NO: 2842678 - RNA, 22 nt, Human
caagcgauucuucugcuucagc

SEQ ID NO: 2842679 - RNA, 20 nt, Human
caagcgauucuucugcuuca

SEQ ID NO: 2842680 - RNA, 11 nt, Human
caagcuggccu

SEQ ID NO: 2842681 - RNA, 12 nt, Human
caagcuggccuc

SEQ ID NO: 2842682 - RNA, 13 nt, Human
caagcuggccucu

SEQ ID NO: 2842683 - RNA, 12 nt, Human
caagcuggcugg

SEQ ID NO: 2842684 - RNA, 14 nt, Human
caagcuggcugggg

SEQ ID NO: 2842685 - RNA, 22 nt, Human
caagcuggcugggguggccugu

SEQ ID NO: 2842686 - RNA, 23 nt, Human
caagcuggcugggguggccugug

SEQ ID NO: 2842687 - RNA, 14 nt, Human
caagccuggcaagg

SEQ ID NO: 2842688 - RNA, 20 nt, Human
caagcgauuuuccugcuuca

SEQ ID NO: 2842689 - RNA, 16 nt, Human
caagcgcauccaaucu

SEQ ID NO: 2842690 - RNA, 23 nt, Human
caagcgcauccaaucucaaggaa

SEQ ID NO: 2842691 - RNA, 16 nt, Human
caagcaguagacaagc

SEQ ID NO: 2842692 - RNA, 18 nt, Human
caaggcugugcucccugg

SEQ ID NO: 2842693 - RNA, 17 nt, Human
caaggcugugcucccug

SEQ ID NO: 2842694 - RNA, 23 nt, Human
caaggaagguucauguagagaaa

SEQ ID NO: 2842695 - RNA, 19 nt, Human
caaggcugaugcaggauuu

SEQ ID NO: 2842696 - RNA, 14 nt, Human
caaguccucuuuuc

SEQ ID NO: 2842697 - RNA, 19 nt, Human
caaguccgcagaagcccug

SEQ ID NO: 2842698 - RNA, 16 nt, Human
caaguccgcagaagcc

SEQ ID NO: 2842699 - RNA, 23 nt, Human
caagucccugacucucugugacc

SEQ ID NO: 2842700 - RNA, 16 nt, Human
caaggucgguaaguug

SEQ ID NO: 2842701 - RNA, 15 nt, Human
caaggucugagccac

SEQ ID NO: 2842702 - RNA, 20 nt, Human
caaggucugagccacagcag

SEQ ID NO: 2842703 - RNA, 21 nt, Human
caaggucugagccacagcagc

SEQ ID NO: 2842704 - RNA, 18 nt, Human
caaggguagggugggccu

SEQ ID NO: 2842705 - RNA, 17 nt, Human
caagugagagcugggug

SEQ ID NO: 2842706 - RNA, 15 nt, Human
caagugagagcuggg

SEQ ID NO: 2842707 - RNA, 14 nt, Human
caagugagagcugg

SEQ ID NO: 2842708 - RNA, 21 nt, Human
caaguccucuuuucugagagg

SEQ ID NO: 2842709 - RNA, 18 nt, Human
caagugagagcugggugu

SEQ ID NO: 2842710 - RNA, 21 nt, Human
caagugauucucaugccucag

SEQ ID NO: 2842711 - RNA, 20 nt, Human
caagugauucucaugccuca

SEQ ID NO: 2842712 - RNA, 18 nt, Human
caagugauucucaugccu

SEQ ID NO: 2842713 - RNA, 17 nt, Human
caagugauucucaugcc

SEQ ID NO: 2842714 - RNA, 19 nt, Human
caagugugaacaaaagaug

SEQ ID NO: 2842715 - RNA, 14 nt, Human
caagugugaacaaa

SEQ ID NO: 2842716 - RNA, 14 nt, Human
caaguguauaucag

SEQ ID NO: 2842717 - RNA, 18 nt, Human
caaguguauaucagaaaa

SEQ ID NO: 2842718 - RNA, 16 nt, Human
caaguguauaucagaa

SEQ ID NO: 2842719 - RNA, 12 nt, Human
caaguggaccuu

SEQ ID NO: 2842720 - RNA, 19 nt, Human
caagugaucugcccaccuc

SEQ ID NO: 2842721 - RNA, 21 nt, Human
caaguggaccuuaggccuucc

SEQ ID NO: 2842722 - RNA, 22 nt, Human
caaguggaccuuaggccuuccu

SEQ ID NO: 2842723 - RNA, 23 nt, Human
caaguggaccuuaggccuuccuc

SEQ ID NO: 2842724 - RNA, 19 nt, Human
caaguggcucccacacccu

SEQ ID NO: 2842725 - RNA, 18 nt, Human
caaguggcagagcuugga

SEQ ID NO: 2842726 - RNA, 23 nt, Human
caaguggcagagcuuggacugga

SEQ ID NO: 2842727 - RNA, 22 nt, Human
caacacuggugugaccugaggg

SEQ ID NO: 2842728 - RNA, 23 nt, Human
caacacuggugugaccugagggc

SEQ ID NO: 2842729 - RNA, 19 nt, Human
caacccuaucuccugacag

SEQ ID NO: 2842730 - RNA, 16 nt, Human
caacccuaucuccuga

SEQ ID NO: 2842731 - RNA, 18 nt, Human
caacccuagguucccugu

SEQ ID NO: 2842732 - RNA, 19 nt, Human
caacccuagguucccuguu

SEQ ID NO: 2842733 - RNA, 21 nt, Human
caacccuagguucccuguucu

SEQ ID NO: 2842734 - RNA, 22 nt, Human
caacccuagguucccuguucuu

SEQ ID NO: 2842735 - RNA, 22 nt, Human
caacccuaucuccugacagaag

SEQ ID NO: 2842736 - RNA, 20 nt, Human
caacccuaucuccugacaga

SEQ ID NO: 2842737 - RNA, 13 nt, Human
caacccucagagc

SEQ ID NO: 2842738 - RNA, 17 nt, Human
caacccuggcacccagg

SEQ ID NO: 2842739 - RNA, 22 nt, Human
caaccgagagaaugcugaccug

SEQ ID NO: 2842740 - RNA, 23 nt, Human
caaccgagagaaugcugaccuga

SEQ ID NO: 2842741 - RNA, 19 nt, Human
caacccuggcauuaugucc

SEQ ID NO: 2842742 - RNA, 22 nt, Human
caacacucacauuuauucugcu

SEQ ID NO: 2842743 - RNA, 22 nt, Human
caaccccuucgcuccugugucu

SEQ ID NO: 2842744 - RNA, 20 nt, Human
caacacugggaaacagaggc

SEQ ID NO: 2842745 - RNA, 13 nt, Human
caacacuggugug

SEQ ID NO: 2842746 - RNA, 18 nt, Human
caacacuggugugaccug

SEQ ID NO: 2842747 - RNA, 11 nt, Human
caaauuucaca

SEQ ID NO: 2842748 - RNA, 15 nt, Human
caaauuucacuuaua

SEQ ID NO: 2842749 - RNA, 14 nt, Human
caaccuccugggcu

SEQ ID NO: 2842750 - RNA, 21 nt, Human
caaccgguggauccucaaaca

SEQ ID NO: 2842751 - RNA, 17 nt, Human
caaccgccucaaaaugu

SEQ ID NO: 2842752 - RNA, 21 nt, Human
caaccgcuucccuauuuauuu

SEQ ID NO: 2842753 - RNA, 15 nt, Human
caaccuccugggcua

SEQ ID NO: 2842754 - RNA, 12 nt, Human
caaccuccugug

SEQ ID NO: 2842755 - RNA, 16 nt, Human
caaccuccuguggaac

SEQ ID NO: 2842756 - RNA, 23 nt, Human
caaccuccuguggaacccagcag

SEQ ID NO: 2842757 - RNA, 20 nt, Human
caaccucugccuccuggguu

SEQ ID NO: 2842758 - RNA, 16 nt, Human
caaccucugcuuccca

SEQ ID NO: 2842759 - RNA, 17 nt, Human
caaccucugcuucccag

SEQ ID NO: 2842760 - RNA, 20 nt, Human
caaccucugcuucccagguu

SEQ ID NO: 2842761 - RNA, 13 nt, Human
caaccucucacuc

SEQ ID NO: 2842762 - RNA, 14 nt, Human
caaccucucacucc

SEQ ID NO: 2842763 - RNA, 17 nt, Human
caaccucucacucccca

SEQ ID NO: 2842764 - RNA, 15 nt, Human
caacguagcuucuac

SEQ ID NO: 2842765 - RNA, 22 nt, Human
caacugacacucccacccaguc

SEQ ID NO: 2842766 - RNA, 15 nt, Human
caacugaccagccuc

SEQ ID NO: 2842767 - RNA, 17 nt, Human
caacugaccagccucca

SEQ ID NO: 2842768 - RNA, 18 nt, Human
caacggcccugcagccag

SEQ ID NO: 2842769 - RNA, 19 nt, Human
caacggcccugcagccagc

SEQ ID NO: 2842770 - RNA, 20 nt, Human
caacggcccugcagccagcu

SEQ ID NO: 2842771 - RNA, 17 nt, Human
caacgggaagcaaccuc

SEQ ID NO: 2842772 - RNA, 19 nt, Human
caaccuucgccaccugggu

SEQ ID NO: 2842773 - RNA, 20 nt, Human
caaccuguucugcuuuccuc

SEQ ID NO: 2842774 - RNA, 19 nt, Human
caacugaccagccuccaug

SEQ ID NO: 2842775 - RNA, 13 nt, Human
caacgugcaacug

SEQ ID NO: 2842776 - RNA, 14 nt, Human
caacuuuuguguaa

SEQ ID NO: 2842777 - RNA, 20 nt, Human
caacuuuuguguaaugaaaa

SEQ ID NO: 2842778 - RNA, 21 nt, Human
caacuuuuaaccaaacaauua

SEQ ID NO: 2842779 - RNA, 21 nt, Human
caacuuuuguguaaugaaaau

SEQ ID NO: 2842780 - RNA, 15 nt, Human
caagaaaacaacuuc

SEQ ID NO: 2842781 - RNA, 15 nt, Human
caagaaaaaaaaaug

SEQ ID NO: 2842782 - RNA, 16 nt, Human
caagaaaaaaaaaugc

SEQ ID NO: 2842783 - RNA, 17 nt, Human
caagaaaaaaaaaugcc

SEQ ID NO: 2842784 - RNA, 18 nt, Human
caagaaaaaaaaaugcca

SEQ ID NO: 2842785 - RNA, 19 nt, Human
caagaaaaaaaaaugccau

SEQ ID NO: 2842786 - RNA, 15 nt, Human
caagaaaaaauaaau

SEQ ID NO: 2842787 - RNA, 17 nt, Human
caagaaaaaauaaaugg

SEQ ID NO: 2842788 - RNA, 13 nt, Human
caagaaauuugau

SEQ ID NO: 2842789 - RNA, 10 nt, Human
caagaaccug

SEQ ID NO: 2842790 - RNA, 15 nt, Human
caagaaccuggaaaa

SEQ ID NO: 2842791 - RNA, 16 nt, Human
caagaacucaucacug

SEQ ID NO: 2842792 - RNA, 19 nt, Human
caagaacucaucacugugg

SEQ ID NO: 2842793 - RNA, 20 nt, Human
caagaacucaucacuguggc

SEQ ID NO: 2842794 - RNA, 21 nt, Human
caagaacucaucacuguggcu

SEQ ID NO: 2842795 - RNA, 13 nt, Human
caagaagaaaaag

SEQ ID NO: 2842796 - RNA, 14 nt, Human
caagaacucugggc

SEQ ID NO: 2842797 - RNA, 16 nt, Human
caagaaauuugauuuc

SEQ ID NO: 2842798 - RNA, 17 nt, Human
caagcaccuccugccuc

SEQ ID NO: 2842799 - RNA, 16 nt, Human
caagcaccuccugccu

SEQ ID NO: 2842800 - RNA, 15 nt, Human
caagcaccuccugcc

SEQ ID NO: 2842801 - RNA, 14 nt, Human
caagagggcacugg

SEQ ID NO: 2842802 - RNA, 15 nt, Human
caagagggcacuggu

SEQ ID NO: 2842803 - RNA, 16 nt, Human
caagagggaauccccg

SEQ ID NO: 2842804 - RNA, 13 nt, Human
caagagggcacug

SEQ ID NO: 2842805 - RNA, 21 nt, Human
caagacucuagaguccaaggu

SEQ ID NO: 2842806 - RNA, 14 nt, Human
caagacucuagagu

SEQ ID NO: 2842807 - RNA, 17 nt, Human
caagacucuagagucca

SEQ ID NO: 2842808 - RNA, 19 nt, Human
caagaagaagggcacccua

SEQ ID NO: 2842809 - RNA, 14 nt, Human
caaugucaggaaca

SEQ ID NO: 2842810 - RNA, 18 nt, Human
caauguauuuauuuaaaa

SEQ ID NO: 2842811 - RNA, 20 nt, Human
caauguauuuauuuaaaaga

SEQ ID NO: 2842812 - RNA, 22 nt, Human
caauguauuuauuuaaaagauu

SEQ ID NO: 2842813 - RNA, 23 nt, Human
caauguauuuauuuaaaagauuc

SEQ ID NO: 2842814 - RNA, 20 nt, Human
caauguauugauaagagggc

SEQ ID NO: 2842815 - RNA, 15 nt, Human
caauguauuuauuua

SEQ ID NO: 2842816 - RNA, 17 nt, Human
caauguaucccuucuca

SEQ ID NO: 2842817 - RNA, 23 nt, Human
caauguaucccuucucacagcac

SEQ ID NO: 2842818 - RNA, 22 nt, Human
caauggggauguuguguuucug

SEQ ID NO: 2842819 - RNA, 18 nt, Human
caaugggcacugggauga

SEQ ID NO: 2842820 - RNA, 15 nt, Human
caaugggcaaugaca

SEQ ID NO: 2842821 - RNA, 15 nt, Human
caaugggcacuggga

SEQ ID NO: 2842822 - RNA, 17 nt, Human
caaugggcacugggaug

SEQ ID NO: 2842823 - RNA, 19 nt, Human
caaugggcacugggaugag

SEQ ID NO: 2842824 - RNA, 16 nt, Human
caaugggcucuuccaa

SEQ ID NO: 2842825 - RNA, 16 nt, Human
caaugguccugacuuu

SEQ ID NO: 2842826 - RNA, 21 nt, Human
caauggugucaguauccaggc

SEQ ID NO: 2842827 - RNA, 20 nt, Human
caaugguguuauuugaaacu

SEQ ID NO: 2842828 - RNA, 21 nt, Human
caaugguguuauuugaaacuu

SEQ ID NO: 2842829 - RNA, 20 nt, Human
caaugggauguaugaauaca

SEQ ID NO: 2842830 - RNA, 21 nt, Human
caaugggauguaugaauacag

SEQ ID NO: 2842831 - RNA, 23 nt, Human
caaugggauguaugaauacagca

SEQ ID NO: 2842832 - RNA, 11 nt, Human
caaugacuacu

SEQ ID NO: 2842833 - RNA, 17 nt, Human
caaugacugugcuacug

SEQ ID NO: 2842834 - RNA, 20 nt, Human
caaugacugugcuacugucu

SEQ ID NO: 2842835 - RNA, 21 nt, Human
caaugacugugcuacugucuu

SEQ ID NO: 2842836 - RNA, 21 nt, Human
caaugagacucuaggguccag

SEQ ID NO: 2842837 - RNA, 17 nt, Human
caaugagacuugccuuc

SEQ ID NO: 2842838 - RNA, 19 nt, Human
caaugagacuugccuuccu

SEQ ID NO: 2842839 - RNA, 15 nt, Human
caauuaauaaaaaau

SEQ ID NO: 2842840 - RNA, 23 nt, Human
caauucucauuugucacacacuu

SEQ ID NO: 2842841 - RNA, 16 nt, Human
caauuccugggcccca

SEQ ID NO: 2842842 - RNA, 13 nt, Human
caauucuccugcc

SEQ ID NO: 2842843 - RNA, 14 nt, Human
caauuugauacaua

SEQ ID NO: 2842844 - RNA, 15 nt, Human
caauuugauacauaa

SEQ ID NO: 2842845 - RNA, 16 nt, Human
caauuugauacauaau

SEQ ID NO: 2842846 - RNA, 19 nt, Human
caauuugauacauaauaaa

SEQ ID NO: 2842847 - RNA, 20 nt, Human
caauuugauacauaauaaaa

SEQ ID NO: 2842848 - RNA, 22 nt, Human
caauuugauacauaauaaaaaa

SEQ ID NO: 2842849 - RNA, 15 nt, Human
caauucuccugccuc

SEQ ID NO: 2842850 - RNA, 14 nt, Human
caauucuccugccu

SEQ ID NO: 2842851 - RNA, 20 nt, Human
caauuugcacuaaaucagag

SEQ ID NO: 2842852 - RNA, 21 nt, Human
caauuugcacuaaaucagaga

SEQ ID NO: 2842853 - RNA, 23 nt, Human
caauuugcacaucuuggcuaugu

SEQ ID NO: 2842854 - RNA, 16 nt, Human
caaugucaggaacaga

SEQ ID NO: 2842855 - RNA, 15 nt, Human
caaugugaucuaugu

SEQ ID NO: 2842856 - RNA, 16 nt, Human
caaugugaucuauguu

SEQ ID NO: 2842857 - RNA, 22 nt, Human
caaugugaucuauguuucaucu

SEQ ID NO: 2842858 - RNA, 11 nt, Human
caauguuaagg

SEQ ID NO: 2842859 - RNA, 15 nt, Human
caaugugauucuaau

SEQ ID NO: 2842860 - RNA, 14 nt, Human
caauguuaaggaaa

SEQ ID NO: 2842861 - RNA, 16 nt, Human
caauguuaaggaaacu

SEQ ID NO: 2842862 - RNA, 18 nt, Human
caauguuaaggaaacucu

SEQ ID NO: 2842863 - RNA, 18 nt, Human
caauuaauaaaaaaugga

SEQ ID NO: 2842864 - RNA, 15 nt, Human
caauuaauaguuugu

SEQ ID NO: 2842865 - RNA, 18 nt, Human
caauuaauaguuugucua

SEQ ID NO: 2842866 - RNA, 19 nt, Human
caauuaauaguuugucuau

SEQ ID NO: 2842867 - RNA, 22 nt, Human
caauuaauaguuugucuauuuu

SEQ ID NO: 2842868 - RNA, 20 nt, Human
caauuaauauuaauuuucua

SEQ ID NO: 2842869 - RNA, 13 nt, Human
caauuaaugcuuu

SEQ ID NO: 2842870 - RNA, 19 nt, Human
caauuaauugcuauugugu

SEQ ID NO: 2842871 - RNA, 22 nt, Human
caauuaauugcuauuguguuau

SEQ ID NO: 2842872 - RNA, 23 nt, Human
caauuaauugcuauuguguuauu

SEQ ID NO: 2842873 - RNA, 16 nt, Human
caauguuagagacuuu

SEQ ID NO: 2842874 - RNA, 17 nt, Human
caauguuagagacuuuu

SEQ ID NO: 2842875 - RNA, 19 nt, Human
caauguuaaggaaacucuu

SEQ ID NO: 2842876 - RNA, 20 nt, Human
caauguuaaggaaacucuua

SEQ ID NO: 2842877 - RNA, 24 nt, Human
caauguuaaggaaacucuuaucuc

SEQ ID NO: 2842878 - RNA, 23 nt, Human
caauacaucugagguccugugau

SEQ ID NO: 2842879 - RNA, 18 nt, Human
caauacagauaacauuag

SEQ ID NO: 2842880 - RNA, 19 nt, Human
caauacaaacaaucucuua

SEQ ID NO: 2842881 - RNA, 12 nt, Human
caauagcugccc

SEQ ID NO: 2842882 - RNA, 18 nt, Human
caauagcugcccauuucg

SEQ ID NO: 2842883 - RNA, 22 nt, Human
caauauaaaaggcaaaugugua

SEQ ID NO: 2842884 - RNA, 21 nt, Human
caauaauauuguuguauaauu

SEQ ID NO: 2842885 - RNA, 22 nt, Human
caauaauauuguuguauaauuu

SEQ ID NO: 2842886 - RNA, 23 nt, Human
caauaauauuguuguauaauuuc

SEQ ID NO: 2842887 - RNA, 15 nt, Human
caauaauggaaaaaa

SEQ ID NO: 2842888 - RNA, 16 nt, Human
caauaauggaaaaaaa

SEQ ID NO: 2842889 - RNA, 23 nt, Human
caauaauggaaaaaaaaaaaaga

SEQ ID NO: 2842890 - RNA, 14 nt, Human
caauaauuucaggu

SEQ ID NO: 2842891 - RNA, 16 nt, Human
caauaauucauauucu

SEQ ID NO: 2842892 - RNA, 19 nt, Human
caauaauucauauucuuca

SEQ ID NO: 2842893 - RNA, 22 nt, Human
caauaauuucagguuuuguaaa

SEQ ID NO: 2842894 - RNA, 13 nt, Human
caaguuagcucag

SEQ ID NO: 2842895 - RNA, 13 nt, Human
caaguuaagagaa

SEQ ID NO: 2842896 - RNA, 14 nt, Human
caaguuaagagaaa

SEQ ID NO: 2842897 - RNA, 17 nt, Human
caaguuaagagaaacuu

SEQ ID NO: 2842898 - RNA, 18 nt, Human
caaguuaagagaaacuuu

SEQ ID NO: 2842899 - RNA, 21 nt, Human
caaguuaagagaaacuuuaua

SEQ ID NO: 2842900 - RNA, 22 nt, Human
caaguuaagagaaacuuuauac

SEQ ID NO: 2842901 - RNA, 21 nt, Human
caagugugggccacuguggug

SEQ ID NO: 2842902 - RNA, 19 nt, Human
caaguuagcucaggaggcu

SEQ ID NO: 2842903 - RNA, 17 nt, Human
caaguuagcucaggagg

SEQ ID NO: 2842904 - RNA, 16 nt, Human
caaguuagcucaggag

SEQ ID NO: 2842905 - RNA, 14 nt, Human
caaguuagcucagg

SEQ ID NO: 2842906 - RNA, 18 nt, Human
caauaauaauaccucccu

SEQ ID NO: 2842907 - RNA, 16 nt, Human
caaucuggaagaaaaa

SEQ ID NO: 2842908 - RNA, 17 nt, Human
caaucuggaagaaaaaa

SEQ ID NO: 2842909 - RNA, 16 nt, Human
caauauauuaccagca

SEQ ID NO: 2842910 - RNA, 18 nt, Human
caauauauuaccagcaag

SEQ ID NO: 2842911 - RNA, 23 nt, Human
caauauaaaaggcaaauguguac

SEQ ID NO: 2842912 - RNA, 12 nt, Human
caauauagcaag

SEQ ID NO: 2842913 - RNA, 13 nt, Human
caauauagcaaga

SEQ ID NO: 2842914 - RNA, 16 nt, Human
caauauauaaaaauau

SEQ ID NO: 2842915 - RNA, 17 nt, Human
caauauauaaaaauaua

SEQ ID NO: 2842916 - RNA, 18 nt, Human
caauauauaaaaauauau

SEQ ID NO: 2842917 - RNA, 20 nt, Human
caauauauaaaaauauauau

SEQ ID NO: 2842918 - RNA, 21 nt, Human
caauauauaaaaauauauaua

SEQ ID NO: 2842919 - RNA, 20 nt, Human
caauauauagcuggcaagaa

SEQ ID NO: 2842920 - RNA, 18 nt, Human
caaucucuuaaauugggu

SEQ ID NO: 2842921 - RNA, 21 nt, Human
caaucucuuaaauuggguuca

SEQ ID NO: 2842922 - RNA, 16 nt, Human
caauauugacauuugu

SEQ ID NO: 2842923 - RNA, 17 nt, Human
caauauugacauuugua

SEQ ID NO: 2842924 - RNA, 15 nt, Human
caauauugaacuuuu

SEQ ID NO: 2842925 - RNA, 13 nt, Human
caauauuccuuag

SEQ ID NO: 2842926 - RNA, 14 nt, Human
caauauuccuuagu

SEQ ID NO: 2842927 - RNA, 21 nt, Human
caaaagaaaaaaaaaagcacc

SEQ ID NO: 2842928 - RNA, 13 nt, Human
caaaacuuaacau

SEQ ID NO: 2842929 - RNA, 14 nt, Human
caaaacuuuuaaac

SEQ ID NO: 2842930 - RNA, 15 nt, Human
caaaacuuuuaaacu

SEQ ID NO: 2842931 - RNA, 11 nt, Human
caaaacuucuu

SEQ ID NO: 2842932 - RNA, 15 nt, Human
caaaacuucuuguca

SEQ ID NO: 2842933 - RNA, 17 nt, Human
caaaacuucuugucaga

SEQ ID NO: 2842934 - RNA, 19 nt, Human
caaaacuucuugucagaca

SEQ ID NO: 2842935 - RNA, 20 nt, Human
caaaacuucuugucagacau

SEQ ID NO: 2842936 - RNA, 21 nt, Human
caaaacuucuugucagacaua

SEQ ID NO: 2842937 - RNA, 20 nt, Human
caaaacuugguauuuuucag

SEQ ID NO: 2842938 - RNA, 19 nt, Human
caaaagaacaagaauuucu

SEQ ID NO: 2842939 - RNA, 12 nt, Human
caaaagaacuua

SEQ ID NO: 2842940 - RNA, 16 nt, Human
caaaagaacuuacccc

SEQ ID NO: 2842941 - RNA, 19 nt, Human
caaaauaaaaagugacaca

SEQ ID NO: 2842942 - RNA, 21 nt, Human
caaaauaaaaagugacacagc

SEQ ID NO: 2842943 - RNA, 15 nt, Human
caaaauaaaaacuau

SEQ ID NO: 2842944 - RNA, 14 nt, Human
caaaacugugcaga

SEQ ID NO: 2842945 - RNA, 20 nt, Human
caaaacaaguuuuucuguca

SEQ ID NO: 2842946 - RNA, 15 nt, Human
caaaacaacauuuug

SEQ ID NO: 2842947 - RNA, 16 nt, Human
caaaacaagccuggua

SEQ ID NO: 2842948 - RNA, 15 nt, Human
caaaacaaagucuuu

SEQ ID NO: 2842949 - RNA, 16 nt, Human
caaaacaaagucuuug

SEQ ID NO: 2842950 - RNA, 19 nt, Human
caaaacacucggcauuuca

SEQ ID NO: 2842951 - RNA, 12 nt, Human
caaaacacugug

SEQ ID NO: 2842952 - RNA, 13 nt, Human
caaaacacugugg

SEQ ID NO: 2842953 - RNA, 14 nt, Human
caaaacacugugga

SEQ ID NO: 2842954 - RNA, 15 nt, Human
caaaacacuguggaa

SEQ ID NO: 2842955 - RNA, 16 nt, Human
caaaacacuguggaac

SEQ ID NO: 2842956 - RNA, 23 nt, Human
caaaacacacgcgcgcacacaca

SEQ ID NO: 2842957 - RNA, 22 nt, Human
caaaacacacgcgcgcacacac

SEQ ID NO: 2842958 - RNA, 15 nt, Human
caaaaccuguccuau

SEQ ID NO: 2842959 - RNA, 14 nt, Human
caaaaccuaacuug

SEQ ID NO: 2842960 - RNA, 16 nt, Human
caaaacccaugcauuu

SEQ ID NO: 2842961 - RNA, 14 nt, Human
caaaacccaugugg

SEQ ID NO: 2842962 - RNA, 23 nt, Human
caaaaccccuaagagacugcguu

SEQ ID NO: 2842963 - RNA, 17 nt, Human
caaaaaggauacauaau

SEQ ID NO: 2842964 - RNA, 13 nt, Human
caaaaagcuuccc

SEQ ID NO: 2842965 - RNA, 14 nt, Human
caaaaagcuucccc

SEQ ID NO: 2842966 - RNA, 13 nt, Human
caaaaagguugcu

SEQ ID NO: 2842967 - RNA, 21 nt, Human
caaaaaguggggcagagccuc

SEQ ID NO: 2842968 - RNA, 11 nt, Human
caaaaaguguu

SEQ ID NO: 2842969 - RNA, 12 nt, Human
caaaaaguguuu

SEQ ID NO: 2842970 - RNA, 15 nt, Human
caaaaaguuuccaua

SEQ ID NO: 2842971 - RNA, 10 nt, Human
caaaaauaaa

SEQ ID NO: 2842972 - RNA, 13 nt, Human
caaaaauacaaaa

SEQ ID NO: 2842973 - RNA, 17 nt, Human
caaaaaguguuuauuuu

SEQ ID NO: 2842974 - RNA, 12 nt, Human
caaaaauaaauu

SEQ ID NO: 2842975 - RNA, 14 nt, Human
caaaaauaaauuua

SEQ ID NO: 2842976 - RNA, 11 nt, Human
caaaaauauaa

SEQ ID NO: 2842977 - RNA, 15 nt, Human
caaaaauauaacuua

SEQ ID NO: 2842978 - RNA, 17 nt, Human
caaaaauaucccuuccg

SEQ ID NO: 2842979 - RNA, 15 nt, Human
caaaaauauaaaaua

SEQ ID NO: 2842980 - RNA, 15 nt, Human
caaaaauuagccggg

SEQ ID NO: 2842981 - RNA, 17 nt, Human
caaaaauuagccgggcg

SEQ ID NO: 2842982 - RNA, 20 nt, Human
caaaaauuagccgggcgugg

SEQ ID NO: 2842983 - RNA, 11 nt, Human
caaaaauguug

SEQ ID NO: 2842984 - RNA, 13 nt, Human
caaaaauguugaa

SEQ ID NO: 2842985 - RNA, 14 nt, Human
caaaaauguugaac

SEQ ID NO: 2842986 - RNA, 12 nt, Human
caaaaauuauua

SEQ ID NO: 2842987 - RNA, 19 nt, Human
caaaaauuaucuauagcua

SEQ ID NO: 2842988 - RNA, 13 nt, Human
caaaaaugcuaau

SEQ ID NO: 2842989 - RNA, 14 nt, Human
caaaaaugcuaaua

SEQ ID NO: 2842990 - RNA, 15 nt, Human
caaaaaugcuaauau

SEQ ID NO: 2842991 - RNA, 21 nt, Human
caaaaaugcuaauauuaaaag

SEQ ID NO: 2842992 - RNA, 14 nt, Human
caaaaaucagccag

SEQ ID NO: 2842993 - RNA, 15 nt, Human
caaaaaucagccaga

SEQ ID NO: 2842994 - RNA, 16 nt, Human
caaaaaucagccagac

SEQ ID NO: 2842995 - RNA, 17 nt, Human
caaaaaucagccagaca

SEQ ID NO: 2842996 - RNA, 17 nt, Human
caaaaauuaucuauagc

SEQ ID NO: 2842997 - RNA, 10 nt, Human
caaaacaaaa

SEQ ID NO: 2842998 - RNA, 11 nt, Human
caaaacaaaac

SEQ ID NO: 2842999 - RNA, 13 nt, Human
caaaacaaaacaa

SEQ ID NO: 2843000 - RNA, 14 nt, Human
caaaacaaaacaaa

SEQ ID NO: 2843001 - RNA, 15 nt, Human
caaaacaaaacaaaa

SEQ ID NO: 2843002 - RNA, 16 nt, Human
caaaacaaaacaaaac

SEQ ID NO: 2843003 - RNA, 17 nt, Human
caaaacaaaacaaaacu

SEQ ID NO: 2843004 - RNA, 16 nt, Human
caaaacaaaacaacau

SEQ ID NO: 2843005 - RNA, 14 nt, Human
caaaacaaaacuau

SEQ ID NO: 2843006 - RNA, 15 nt, Human
auuuucguaugaaaa

SEQ ID NO: 2843007 - RNA, 16 nt, Human
auuuucguaugaaaau

SEQ ID NO: 2843008 - RNA, 17 nt, Human
auuuucguaugaaaaug

SEQ ID NO: 2843009 - RNA, 18 nt, Human
auuuucguaugaaaauga

SEQ ID NO: 2843010 - RNA, 16 nt, Human
auuuucguucauuacu

SEQ ID NO: 2843011 - RNA, 21 nt, Human
auuuugggguacccacugcuc

SEQ ID NO: 2843012 - RNA, 16 nt, Human
auuuucuagacuuucu

SEQ ID NO: 2843013 - RNA, 18 nt, Human
auuuucuagacuuucugu

SEQ ID NO: 2843014 - RNA, 15 nt, Human
auuuucuacaauuaa

SEQ ID NO: 2843015 - RNA, 18 nt, Human
auuuucuaagcaauuucu

SEQ ID NO: 2843016 - RNA, 22 nt, Human
auuuucuaagcaauuucuugcu

SEQ ID NO: 2843017 - RNA, 19 nt, Human
auuuucuacaaauaauuuu

SEQ ID NO: 2843018 - RNA, 21 nt, Human
auuuuggagaaauuauuuaau

SEQ ID NO: 2843019 - RNA, 14 nt, Human
auuuuggagaaauu

SEQ ID NO: 2843020 - RNA, 16 nt, Human
auuuugguucuucuca

SEQ ID NO: 2843021 - RNA, 17 nt, Human
auuuugguucuucucaa

SEQ ID NO: 2843022 - RNA, 23 nt, Human
auuuugggguacccacugcucug

SEQ ID NO: 2843023 - RNA, 22 nt, Human
auuuugggguacccacugcucu

SEQ ID NO: 2843024 - RNA, 19 nt, Human
auuuuggguuuugggucuu

SEQ ID NO: 2843025 - RNA, 21 nt, Human
auuuugguaagagacagaaug

SEQ ID NO: 2843026 - RNA, 20 nt, Human
auuuugguauuacacuguau

SEQ ID NO: 2843027 - RNA, 21 nt, Human
auuuugguauuacacuguauu

SEQ ID NO: 2843028 - RNA, 21 nt, Human
auuuuggucauagcauucacu

SEQ ID NO: 2843029 - RNA, 21 nt, Human
auuuugggacaauuguuuuaa

SEQ ID NO: 2843030 - RNA, 22 nt, Human
auuuugggacaauuguuuuaau

SEQ ID NO: 2843031 - RNA, 14 nt, Human
auuuugggcaugug

SEQ ID NO: 2843032 - RNA, 23 nt, Human
auuuuggggaaggguuugaauug

SEQ ID NO: 2843033 - RNA, 19 nt, Human
auuuuggcgcuauuacaaa

SEQ ID NO: 2843034 - RNA, 20 nt, Human
auuuuggcgcuauuacaaau

SEQ ID NO: 2843035 - RNA, 21 nt, Human
auuuuggcgcuauuacaaaua

SEQ ID NO: 2843036 - RNA, 20 nt, Human
auuuugggguuguguuguca

SEQ ID NO: 2843037 - RNA, 11 nt, Human
auuuugggguc

SEQ ID NO: 2843038 - RNA, 13 nt, Human
auuuuggggucuc

SEQ ID NO: 2843039 - RNA, 14 nt, Human
auuuuggggucucu

SEQ ID NO: 2843040 - RNA, 16 nt, Human
auuuuggggucucuuu

SEQ ID NO: 2843041 - RNA, 17 nt, Human
auuuuggggucucuuuu

SEQ ID NO: 2843042 - RNA, 14 nt, Human
caaaaacaaaaaga

SEQ ID NO: 2843043 - RNA, 17 nt, Human
auuuuguaaacucaaaa

SEQ ID NO: 2843044 - RNA, 10 nt, Human
auuuuguaaa

SEQ ID NO: 2843045 - RNA, 18 nt, Human
caaaaaauuagccgggcg

SEQ ID NO: 2843046 - RNA, 16 nt, Human
caaaaaauuagccggg

SEQ ID NO: 2843047 - RNA, 23 nt, Human
caaaaacuuuggaguccccucac

SEQ ID NO: 2843048 - RNA, 20 nt, Human
caaaaagaaaagaaaauuuu

SEQ ID NO: 2843049 - RNA, 22 nt, Human
caaaaacugucuuuaaaagaga

SEQ ID NO: 2843050 - RNA, 13 nt, Human
caaaaacuguuuu

SEQ ID NO: 2843051 - RNA, 13 nt, Human
caaaaacuuguua

SEQ ID NO: 2843052 - RNA, 22 nt, Human
caaaaagcucuuacacuacauu

SEQ ID NO: 2843053 - RNA, 13 nt, Human
caaaaagaaauga

SEQ ID NO: 2843054 - RNA, 14 nt, Human
caaaaagaaaugac

SEQ ID NO: 2843055 - RNA, 16 nt, Human
caaaaagaaaugacua

SEQ ID NO: 2843056 - RNA, 15 nt, Human
caaaaagaaaugaug

SEQ ID NO: 2843057 - RNA, 14 nt, Human
caaaaagacaaaca

SEQ ID NO: 2843058 - RNA, 18 nt, Human
caaacuccaagguucccu

SEQ ID NO: 2843059 - RNA, 17 nt, Human
caaauaugcuaauuugg

SEQ ID NO: 2843060 - RNA, 18 nt, Human
caaaugggugauauccug

SEQ ID NO: 2843061 - RNA, 22 nt, Human
caaaugggugauauccugaaaa

SEQ ID NO: 2843062 - RNA, 18 nt, Human
caaauggguuuuccacgc

SEQ ID NO: 2843063 - RNA, 20 nt, Human
caaaugguaggcauuuccua

SEQ ID NO: 2843064 - RNA, 23 nt, Human
caaaugguuaccuuguuauuuaa

SEQ ID NO: 2843065 - RNA, 15 nt, Human
caaaugguaggcauu

SEQ ID NO: 2843066 - RNA, 13 nt, Human
caaaugguaggca

SEQ ID NO: 2843067 - RNA, 19 nt, Human
caaaggguaucaggugcug

SEQ ID NO: 2843068 - RNA, 19 nt, Human
caaagugcugggauuacag

SEQ ID NO: 2843069 - RNA, 23 nt, Human
caaagugcugggauuacaggugu

SEQ ID NO: 2843070 - RNA, 12 nt, Human
caaaggcuggga

SEQ ID NO: 2843071 - RNA, 23 nt, Human
caaaggggaucauaaaguuagaa

SEQ ID NO: 2843072 - RNA, 20 nt, Human
caaagugcugggauuacagg

SEQ ID NO: 2843073 - RNA, 14 nt, Human
caaauugugcuucu

SEQ ID NO: 2843074 - RNA, 18 nt, Human
caaauugugcuucucccc

SEQ ID NO: 2843075 - RNA, 19 nt, Human
caaauugugcuucucccca

SEQ ID NO: 2843076 - RNA, 21 nt, Human
caaauugugcuucuccccaga

SEQ ID NO: 2843077 - RNA, 22 nt, Human
caaauugugcuucuccccagaa

SEQ ID NO: 2843078 - RNA, 23 nt, Human
caaauugugcuucuccccagaau

SEQ ID NO: 2843079 - RNA, 14 nt, Human
caaauuguggagcc

SEQ ID NO: 2843080 - RNA, 13 nt, Human
caaauuuaucaaa

SEQ ID NO: 2843081 - RNA, 16 nt, Human
caaauuuaucaaagca

SEQ ID NO: 2843082 - RNA, 17 nt, Human
caaauuuaucaaagcau

SEQ ID NO: 2843083 - RNA, 19 nt, Human
caaauuuaucaaagcauag

SEQ ID NO: 2843084 - RNA, 16 nt, Human
caaauuucaaaagaca

SEQ ID NO: 2843085 - RNA, 17 nt, Human
caaauuucaaaagacau

SEQ ID NO: 2843086 - RNA, 14 nt, Human
caaauugucagcaa

SEQ ID NO: 2843087 - RNA, 22 nt, Human
caaauugucuuuugucaugugg

SEQ ID NO: 2843088 - RNA, 18 nt, Human
caaauguccuccagaagc

SEQ ID NO: 2843089 - RNA, 19 nt, Human
caaauguccuccagaagcc

SEQ ID NO: 2843090 - RNA, 19 nt, Human
caaauuauaaaaagccacu

SEQ ID NO: 2843091 - RNA, 16 nt, Human
caaaugucagauacaa

SEQ ID NO: 2843092 - RNA, 19 nt, Human
caaaugucagauacaaugu

SEQ ID NO: 2843093 - RNA, 20 nt, Human
caaaugucagauacaaugua

SEQ ID NO: 2843094 - RNA, 14 nt, Human
caaauguaaacauu

SEQ ID NO: 2843095 - RNA, 17 nt, Human
caaauguaaacauuuuc

SEQ ID NO: 2843096 - RNA, 12 nt, Human
caaauuauuugu

SEQ ID NO: 2843097 - RNA, 14 nt, Human
caaauuauuugugu

SEQ ID NO: 2843098 - RNA, 15 nt, Human
caaauuauuugugua

SEQ ID NO: 2843099 - RNA, 16 nt, Human
caaauuauuuguguaa

SEQ ID NO: 2843100 - RNA, 20 nt, Human
caaauuauuuguguaauaga

SEQ ID NO: 2843101 - RNA, 17 nt, Human
caaauuauuuguguaau

SEQ ID NO: 2843102 - RNA, 18 nt, Human
caaauuauuuguguaaua

SEQ ID NO: 2843103 - RNA, 22 nt, Human
caaaauugcaaaucuugaaauu

SEQ ID NO: 2843104 - RNA, 14 nt, Human
caaacacauuguua

SEQ ID NO: 2843105 - RNA, 16 nt, Human
caaacacauuguuauu

SEQ ID NO: 2843106 - RNA, 17 nt, Human
caaacacauuguuauuu

SEQ ID NO: 2843107 - RNA, 24 nt, Human
caaacaauaguaauucucaggcca

SEQ ID NO: 2843108 - RNA, 20 nt, Human
caaacaaucucuuaaauugg

SEQ ID NO: 2843109 - RNA, 21 nt, Human
caaacaaucucuuaaauuggg

SEQ ID NO: 2843110 - RNA, 14 nt, Human
caaacacaaaugca

SEQ ID NO: 2843111 - RNA, 14 nt, Human
caaacaauuuaaaa

SEQ ID NO: 2843112 - RNA, 16 nt, Human
caaacaauuuaaaaau

SEQ ID NO: 2843113 - RNA, 15 nt, Human
caaacacaaaugcag

SEQ ID NO: 2843114 - RNA, 14 nt, Human
caaacacaagguca

SEQ ID NO: 2843115 - RNA, 20 nt, Human
caaacacaaggucauggcca

SEQ ID NO: 2843116 - RNA, 23 nt, Human
caaacacaaggucauggccacac

SEQ ID NO: 2843117 - RNA, 17 nt, Human
caaaccuaccaaaaugg

SEQ ID NO: 2843118 - RNA, 15 nt, Human
caaaccuaccaaaau

SEQ ID NO: 2843119 - RNA, 14 nt, Human
caaacgccuccccu

SEQ ID NO: 2843120 - RNA, 17 nt, Human
caaacgccuccccugcc

SEQ ID NO: 2843121 - RNA, 22 nt, Human
caaaauuacagacugucugaaa

SEQ ID NO: 2843122 - RNA, 17 nt, Human
caaacgccuagauugcu

SEQ ID NO: 2843123 - RNA, 17 nt, Human
caaacgcugccugccca

SEQ ID NO: 2843124 - RNA, 16 nt, Human
caaacgcugccugccc

SEQ ID NO: 2843125 - RNA, 16 nt, Human
caaacuaaaagacauu

SEQ ID NO: 2843126 - RNA, 20 nt, Human
caaacuaaaagacauuuguu

SEQ ID NO: 2843127 - RNA, 16 nt, Human
caaacuaaaggugcac

SEQ ID NO: 2843128 - RNA, 15 nt, Human
caaacgcugccugcc

SEQ ID NO: 2843129 - RNA, 14 nt, Human
caaacgcugccugc

SEQ ID NO: 2843130 - RNA, 13 nt, Human
caaacgcugccug

SEQ ID NO: 2843131 - RNA, 12 nt, Human
caaacgcugccu

SEQ ID NO: 2843132 - RNA, 12 nt, Human
caaaauguauau

SEQ ID NO: 2843133 - RNA, 15 nt, Human
caaaauguauauauu

SEQ ID NO: 2843134 - RNA, 16 nt, Human
caaaauguauauauuu

SEQ ID NO: 2843135 - RNA, 17 nt, Human
caaaauguauauauuua

SEQ ID NO: 2843136 - RNA, 18 nt, Human
caaaauguauauauuuag

SEQ ID NO: 2843137 - RNA, 14 nt, Human
caaaauguguauuu

SEQ ID NO: 2843138 - RNA, 16 nt, Human
caaaauguguauuucu

SEQ ID NO: 2843139 - RNA, 20 nt, Human
caaaauguguauuucuuaua

SEQ ID NO: 2843140 - RNA, 15 nt, Human
caaaagaaauaccuu

SEQ ID NO: 2843141 - RNA, 13 nt, Human
caaaauaaaacaa

SEQ ID NO: 2843142 - RNA, 14 nt, Human
caaaauaaaacaaa

SEQ ID NO: 2843143 - RNA, 15 nt, Human
caaaauaaaacaaag

SEQ ID NO: 2843144 - RNA, 17 nt, Human
caaaauaaaacaaaggg

SEQ ID NO: 2843145 - RNA, 22 nt, Human
caaaauaaaaagugacacagca

SEQ ID NO: 2843146 - RNA, 23 nt, Human
caaaauaaaaagugacacagcag

SEQ ID NO: 2843147 - RNA, 18 nt, Human
caaaaugcuuuuuauuuc

SEQ ID NO: 2843148 - RNA, 17 nt, Human
caaaauggaauaaaagg

SEQ ID NO: 2843149 - RNA, 16 nt, Human
caaaauggaauaaaag

SEQ ID NO: 2843150 - RNA, 16 nt, Human
caaaauggacauggug

SEQ ID NO: 2843151 - RNA, 23 nt, Human
caaaaugcuuuuuauuucugcau

SEQ ID NO: 2843152 - RNA, 14 nt, Human
caaaauggaacgcu

SEQ ID NO: 2843153 - RNA, 20 nt, Human
caaaaugcuuuuuauuucug

SEQ ID NO: 2843154 - RNA, 16 nt, Human
caaaauugauguguuu

SEQ ID NO: 2843155 - RNA, 15 nt, Human
caaaauugauguguu

SEQ ID NO: 2843156 - RNA, 20 nt, Human
caaaauucuuauuuuuccua

SEQ ID NO: 2843157 - RNA, 22 nt, Human
caaaauugauguguuuauuuau

SEQ ID NO: 2843158 - RNA, 17 nt, Human
caaaauugcaaaucuug

SEQ ID NO: 2843159 - RNA, 16 nt, Human
caaaauugcaaaucuu

SEQ ID NO: 2843160 - RNA, 15 nt, Human
caaaauuaaaucugu

SEQ ID NO: 2843161 - RNA, 19 nt, Human
caaaauguuaucuucucaa

SEQ ID NO: 2843162 - RNA, 20 nt, Human
caaaauguuaucuucucaag

SEQ ID NO: 2843163 - RNA, 21 nt, Human
caaaauguuaucuucucaagu

SEQ ID NO: 2843164 - RNA, 22 nt, Human
caaaauguuaucuucucaaguu

SEQ ID NO: 2843165 - RNA, 18 nt, Human
caaaggguaucaggugcu

SEQ ID NO: 2843166 - RNA, 16 nt, Human
caaaggguaucaggug

SEQ ID NO: 2843167 - RNA, 13 nt, Human
caaaggccaugga

SEQ ID NO: 2843168 - RNA, 19 nt, Human
caaaggccauggagagcug

SEQ ID NO: 2843169 - RNA, 20 nt, Human
caaaggccauggagagcugg

SEQ ID NO: 2843170 - RNA, 21 nt, Human
caaaggccauggagagcugga

SEQ ID NO: 2843171 - RNA, 23 nt, Human
caaaggccauggagagcuggagc

SEQ ID NO: 2843172 - RNA, 14 nt, Human
caaaggcugagaac

SEQ ID NO: 2843173 - RNA, 23 nt, Human
caaaggcugagaacacugugaaa

SEQ ID NO: 2843174 - RNA, 11 nt, Human
caaaggcuggg

SEQ ID NO: 2843175 - RNA, 13 nt, Human
caaaggcccccua

SEQ ID NO: 2843176 - RNA, 15 nt, Human
caaagcugcccacug

SEQ ID NO: 2843177 - RNA, 14 nt, Human
caaagcugcccacu

SEQ ID NO: 2843178 - RNA, 20 nt, Human
caaagcugcccacuguuucu

SEQ ID NO: 2843179 - RNA, 19 nt, Human
caaaggaagucuaaauauu

SEQ ID NO: 2843180 - RNA, 13 nt, Human
caaaggccaaacu

SEQ ID NO: 2843181 - RNA, 14 nt, Human
caaaggccaaacug

SEQ ID NO: 2843182 - RNA, 15 nt, Human
caaaggccaaacugc

SEQ ID NO: 2843183 - RNA, 16 nt, Human
caaaggccaaacugcu

SEQ ID NO: 2843184 - RNA, 19 nt, Human
caaaggccaaacugcugga

SEQ ID NO: 2843185 - RNA, 19 nt, Human
caaaggaagugcccccucc

SEQ ID NO: 2843186 - RNA, 20 nt, Human
caaaggaagugcccccuccc

SEQ ID NO: 2843187 - RNA, 20 nt, Human
caaaggcaaguuaagagaaa

SEQ ID NO: 2843188 - RNA, 23 nt, Human
caaaggcaaguuaagagaaacuu

SEQ ID NO: 2843189 - RNA, 19 nt, Human
caaagcuaggccuggccag

SEQ ID NO: 2843190 - RNA, 14 nt, Human
caaagcuaggccug

SEQ ID NO: 2843191 - RNA, 13 nt, Human
caaagcuaggccu

SEQ ID NO: 2843192 - RNA, 19 nt, Human
caaagcugaugacaacuuc

SEQ ID NO: 2843193 - RNA, 19 nt, Human
caaagcucuguggccacau

SEQ ID NO: 2843194 - RNA, 22 nt, Human
caaagcuaggguggcccuugca

SEQ ID NO: 2843195 - RNA, 18 nt, Human
caaagcucaaauaaaaau

SEQ ID NO: 2843196 - RNA, 20 nt, Human
caaagcucaaauaaaaauaa

SEQ ID NO: 2843197 - RNA, 21 nt, Human
caaagcuaggguggcccuugc

SEQ ID NO: 2843198 - RNA, 18 nt, Human
caaacgcugccugcccac

SEQ ID NO: 2843199 - RNA, 14 nt, Human
caaacuacuugauu

SEQ ID NO: 2843200 - RNA, 16 nt, Human
caaacuacuugauuuu

SEQ ID NO: 2843201 - RNA, 18 nt, Human
caaacuaaggugcuaaau

SEQ ID NO: 2843202 - RNA, 20 nt, Human
caaacuaaggugcuaaaucu

SEQ ID NO: 2843203 - RNA, 20 nt, Human
caaacuacagaccugcuuuu

SEQ ID NO: 2843204 - RNA, 22 nt, Human
caaacuacagaccugcuuuuug

SEQ ID NO: 2843205 - RNA, 15 nt, Human
caaacuggggccucc

SEQ ID NO: 2843206 - RNA, 16 nt, Human
caaacuggggccucca

SEQ ID NO: 2843207 - RNA, 19 nt, Human
caaacuggggccuccagaa

SEQ ID NO: 2843208 - RNA, 21 nt, Human
caaacuggggccuccagaacu

SEQ ID NO: 2843209 - RNA, 12 nt, Human
caaacuguaaau

SEQ ID NO: 2843210 - RNA, 21 nt, Human
caaacuuaauguucuuaugca

SEQ ID NO: 2843211 - RNA, 13 nt, Human
caaacuuacuauu

SEQ ID NO: 2843212 - RNA, 14 nt, Human
caaacuuacuauuu

SEQ ID NO: 2843213 - RNA, 16 nt, Human
caaacuguucaagaaa

SEQ ID NO: 2843214 - RNA, 20 nt, Human
caaacuguucaagaaauaau

SEQ ID NO: 2843215 - RNA, 14 nt, Human
caaacugugaagca

SEQ ID NO: 2843216 - RNA, 22 nt, Human
caaacugugaagcauuuacaga

SEQ ID NO: 2843217 - RNA, 20 nt, Human
caaacuguaaauaaaaagaa

SEQ ID NO: 2843218 - RNA, 14 nt, Human
caaacuguaaauaa

SEQ ID NO: 2843219 - RNA, 21 nt, Human
caaacuguaaauaaaaagaaa

SEQ ID NO: 2843220 - RNA, 12 nt, Human
caaacuguaaaa

SEQ ID NO: 2843221 - RNA, 21 nt, Human
caaacuguaaaaaaugugugu

SEQ ID NO: 2843222 - RNA, 22 nt, Human
caaagccaaagcuaggccuggc

SEQ ID NO: 2843223 - RNA, 20 nt, Human
caaagccaccucugucauuu

SEQ ID NO: 2843224 - RNA, 23 nt, Human
caaagccaccucugucauuuguu

SEQ ID NO: 2843225 - RNA, 18 nt, Human
caaagcccuuccaugucg

SEQ ID NO: 2843226 - RNA, 14 nt, Human
caaagccagggucu

SEQ ID NO: 2843227 - RNA, 15 nt, Human
caaagccagggucuc

SEQ ID NO: 2843228 - RNA, 22 nt, Human
caaagccagggucucucccuca

SEQ ID NO: 2843229 - RNA, 23 nt, Human
caaagccagggucucucccucag

SEQ ID NO: 2843230 - RNA, 16 nt, Human
cacauacaguuuuaug

SEQ ID NO: 2843231 - RNA, 17 nt, Human
cacauacaguuuuaugc

SEQ ID NO: 2843232 - RNA, 23 nt, Human
cacauacaguuuuaugcucuuuu

SEQ ID NO: 2843233 - RNA, 14 nt, Human
cacauaucugucau

SEQ ID NO: 2843234 - RNA, 13 nt, Human
cacauagauuaau

SEQ ID NO: 2843235 - RNA, 18 nt, Human
cacauagauuaauggcac

SEQ ID NO: 2843236 - RNA, 20 nt, Human
cacauagauuaauggcacug

SEQ ID NO: 2843237 - RNA, 21 nt, Human
cacauagauuaauggcacuga

SEQ ID NO: 2843238 - RNA, 22 nt, Human
cacauagauuaauggcacugau

SEQ ID NO: 2843239 - RNA, 16 nt, Human
cacauagcugucuaga

SEQ ID NO: 2843240 - RNA, 18 nt, Human
cacauaugcaccuugugu

SEQ ID NO: 2843241 - RNA, 13 nt, Human
cacauagcugucu

SEQ ID NO: 2843242 - RNA, 22 nt, Human
cacauagcuacccaaaagagaa

SEQ ID NO: 2843243 - RNA, 23 nt, Human
cacauagcuacccaaaagagaaa

SEQ ID NO: 2843244 - RNA, 19 nt, Human
cacauaugcaccuuguguc

SEQ ID NO: 2843245 - RNA, 20 nt, Human
cacauaugcaccuugugucu

SEQ ID NO: 2843246 - RNA, 21 nt, Human
cacauaugcaccuugugucug

SEQ ID NO: 2843247 - RNA, 22 nt, Human
cacauaugcaccuugugucugu

SEQ ID NO: 2843248 - RNA, 21 nt, Human
cacagugagucgaggacaggg

SEQ ID NO: 2843249 - RNA, 22 nt, Human
cacagugagucgaggacaggga

SEQ ID NO: 2843250 - RNA, 14 nt, Human
cacagugcaucuca

SEQ ID NO: 2843251 - RNA, 13 nt, Human
cacagugggaacu

SEQ ID NO: 2843252 - RNA, 14 nt, Human
cacagugggaacuc

SEQ ID NO: 2843253 - RNA, 19 nt, Human
cacagugggaacucugaca

SEQ ID NO: 2843254 - RNA, 22 nt, Human
cacagcuucauuuccugugucu

SEQ ID NO: 2843255 - RNA, 21 nt, Human
cacagcuucauuuccuguguc

SEQ ID NO: 2843256 - RNA, 17 nt, Human
cacagcuguucuucugu

SEQ ID NO: 2843257 - RNA, 22 nt, Human
cacagcuguucuucuguucugc

SEQ ID NO: 2843258 - RNA, 14 nt, Human
cacagcuguagugg

SEQ ID NO: 2843259 - RNA, 20 nt, Human
cacagcugcuggagacuccu

SEQ ID NO: 2843260 - RNA, 21 nt, Human
cacagcuggagcucucaaacu

SEQ ID NO: 2843261 - RNA, 12 nt, Human
cacagcugcugg

SEQ ID NO: 2843262 - RNA, 14 nt, Human
cacagcugcuggag

SEQ ID NO: 2843263 - RNA, 15 nt, Human
cacagcugcuggaga

SEQ ID NO: 2843264 - RNA, 17 nt, Human
caauuugggcuuccugu

SEQ ID NO: 2843265 - RNA, 18 nt, Human
caauuugggcuuccuguu

SEQ ID NO: 2843266 - RNA, 21 nt, Human
caauuugggcuuccuguuugu

SEQ ID NO: 2843267 - RNA, 22 nt, Human
caauuuguucauccuauuguug

SEQ ID NO: 2843268 - RNA, 15 nt, Human
cacaggcagguccag

SEQ ID NO: 2843269 - RNA, 14 nt, Human
cacaggcaggucca

SEQ ID NO: 2843270 - RNA, 11 nt, Human
cacaggcaggu

SEQ ID NO: 2843271 - RNA, 18 nt, Human
cacaggagugggaaaaca

SEQ ID NO: 2843272 - RNA, 15 nt, Human
cacaggaggcaagca

SEQ ID NO: 2843273 - RNA, 19 nt, Human
cacaggaggcaagcaagcu

SEQ ID NO: 2843274 - RNA, 20 nt, Human
cacaggaggcaagcaagcuc

SEQ ID NO: 2843275 - RNA, 14 nt, Human
cacaggagggaggg

SEQ ID NO: 2843276 - RNA, 21 nt, Human
cacaggagggagggggaaggc

SEQ ID NO: 2843277 - RNA, 19 nt, Human
cacaggagggagggggaag

SEQ ID NO: 2843278 - RNA, 21 nt, Human
cacaggacugauucugggaug

SEQ ID NO: 2843279 - RNA, 15 nt, Human
cacaggagacacugu

SEQ ID NO: 2843280 - RNA, 21 nt, Human
cacaggagacacugugcuaua

SEQ ID NO: 2843281 - RNA, 13 nt, Human
cucuuauugccca

SEQ ID NO: 2843282 - RNA, 20 nt, Human
cucuuauugcccacgcugga

SEQ ID NO: 2843283 - RNA, 19 nt, Human
cucuuauugcccacgcugg

SEQ ID NO: 2843284 - RNA, 15 nt, Human
cucuuauugcccacg

SEQ ID NO: 2843285 - RNA, 14 nt, Human
cucuuauugcccac

SEQ ID NO: 2843286 - RNA, 16 nt, Human
cucuucaccccccacu

SEQ ID NO: 2843287 - RNA, 17 nt, Human
cucuucaccccccacuc

SEQ ID NO: 2843288 - RNA, 18 nt, Human
cucuucaccccccacuca

SEQ ID NO: 2843289 - RNA, 16 nt, Human
cucuucaccccggcag

SEQ ID NO: 2843290 - RNA, 18 nt, Human
cucuucaccccggcaggc

SEQ ID NO: 2843291 - RNA, 19 nt, Human
cucuucaccccggcaggcc

SEQ ID NO: 2843292 - RNA, 21 nt, Human
cucuucaccccggcaggcccu

SEQ ID NO: 2843293 - RNA, 22 nt, Human
cucuucaccccggcaggcccug

SEQ ID NO: 2843294 - RNA, 23 nt, Human
cucuucaccccggcaggcccugc

SEQ ID NO: 2843295 - RNA, 15 nt, Human
cucuuauuuuacaau

SEQ ID NO: 2843296 - RNA, 16 nt, Human
cucuucaaaaacuguu

SEQ ID NO: 2843297 - RNA, 17 nt, Human
cucuucaaaaacuguuu

SEQ ID NO: 2843298 - RNA, 20 nt, Human
cucuucaacugaccagccuc

SEQ ID NO: 2843299 - RNA, 16 nt, Human
cucuucaacugaccag

SEQ ID NO: 2843300 - RNA, 17 nt, Human
cucuucaacugaccagc

SEQ ID NO: 2843301 - RNA, 15 nt, Human
cucuucagacucuca

SEQ ID NO: 2843302 - RNA, 17 nt, Human
cucuucagacucucagc

SEQ ID NO: 2843303 - RNA, 20 nt, Human
cucuucagacucucagccca

SEQ ID NO: 2843304 - RNA, 23 nt, Human
cucuucagacucucagcccagaa

SEQ ID NO: 2843305 - RNA, 16 nt, Human
cucuucaggccucccu

SEQ ID NO: 2843306 - RNA, 15 nt, Human
cucuucaggccuccc

SEQ ID NO: 2843307 - RNA, 14 nt, Human
cucuucaggccucc

SEQ ID NO: 2843308 - RNA, 13 nt, Human
cucuucaggccuc

SEQ ID NO: 2843309 - RNA, 18 nt, Human
cucuccccugcccugcug

SEQ ID NO: 2843310 - RNA, 17 nt, Human
cucuccccugcccugcu

SEQ ID NO: 2843311 - RNA, 16 nt, Human
cucuccccugcccugc

SEQ ID NO: 2843312 - RNA, 15 nt, Human
cucuccccugcccug

SEQ ID NO: 2843313 - RNA, 21 nt, Human
cucuccccucagagugcaagc

SEQ ID NO: 2843314 - RNA, 13 nt, Human
cucuccccuccag

SEQ ID NO: 2843315 - RNA, 14 nt, Human
cucuccccuccagc

SEQ ID NO: 2843316 - RNA, 15 nt, Human
cucuccccuccagcc

SEQ ID NO: 2843317 - RNA, 16 nt, Human
cucuccccuccagccu

SEQ ID NO: 2843318 - RNA, 17 nt, Human
cucuccccuccagccuu

SEQ ID NO: 2843319 - RNA, 18 nt, Human
cucuccccuccagccuuu

SEQ ID NO: 2843320 - RNA, 23 nt, Human
cucucccggagguugggugggcc

SEQ ID NO: 2843321 - RNA, 20 nt, Human
cucugcuccucuccccagca

SEQ ID NO: 2843322 - RNA, 18 nt, Human
cucugcuccucuccccag

SEQ ID NO: 2843323 - RNA, 13 nt, Human
cucugcuccucuc

SEQ ID NO: 2843324 - RNA, 19 nt, Human
cucugcuccaccacauccu

SEQ ID NO: 2843325 - RNA, 13 nt, Human
cucugcuccaccu

SEQ ID NO: 2843326 - RNA, 14 nt, Human
cucugcuccaccuu

SEQ ID NO: 2843327 - RNA, 18 nt, Human
cucugcuccaccuuucag

SEQ ID NO: 2843328 - RNA, 19 nt, Human
cucugcuccaccuuucagc

SEQ ID NO: 2843329 - RNA, 16 nt, Human
cucugcagacugcuag

SEQ ID NO: 2843330 - RNA, 18 nt, Human
cucugcagacugcuagug

SEQ ID NO: 2843331 - RNA, 12 nt, Human
cucuguccaggc

SEQ ID NO: 2843332 - RNA, 16 nt, Human
cucuggucuuggaauu

SEQ ID NO: 2843333 - RNA, 13 nt, Human
cucuggugccucc

SEQ ID NO: 2843334 - RNA, 16 nt, Human
cucuggugauaaggac

SEQ ID NO: 2843335 - RNA, 17 nt, Human
cucuggugauaaggaca

SEQ ID NO: 2843336 - RNA, 19 nt, Human
cucuggugauaaggacaug

SEQ ID NO: 2843337 - RNA, 18 nt, Human
cucuggugccuccagagg

SEQ ID NO: 2843338 - RNA, 14 nt, Human
cucuggugccucca

SEQ ID NO: 2843339 - RNA, 16 nt, Human
cucuggugccuccaga

SEQ ID NO: 2843340 - RNA, 22 nt, Human
cucugguccggacacuccuaga

SEQ ID NO: 2843341 - RNA, 17 nt, Human
cucugggucaguggucc

SEQ ID NO: 2843342 - RNA, 20 nt, Human
cucugggucagugguccaca

SEQ ID NO: 2843343 - RNA, 12 nt, Human
cucugcugaaga

SEQ ID NO: 2843344 - RNA, 13 nt, Human
cucugcugaagac

SEQ ID NO: 2843345 - RNA, 16 nt, Human
cucugcugaagacuug

SEQ ID NO: 2843346 - RNA, 18 nt, Human
cucuggggugcugccuga

SEQ ID NO: 2843347 - RNA, 16 nt, Human
cucugcugacagacac

SEQ ID NO: 2843348 - RNA, 14 nt, Human
cucugcugacagac

SEQ ID NO: 2843349 - RNA, 13 nt, Human
cucugcugacaga

SEQ ID NO: 2843350 - RNA, 13 nt, Human
cucugcuccccag

SEQ ID NO: 2843351 - RNA, 19 nt, Human
cucuuuuugguuguccuca

SEQ ID NO: 2843352 - RNA, 13 nt, Human
cugaaacuucccu

SEQ ID NO: 2843353 - RNA, 21 nt, Human
cugaaacuugcugagcuguuu

SEQ ID NO: 2843354 - RNA, 16 nt, Human
cugaaacccuggacca

SEQ ID NO: 2843355 - RNA, 20 nt, Human
cugaaaccuaguacugcccc

SEQ ID NO: 2843356 - RNA, 17 nt, Human
cugaaaccuuuaagaaa

SEQ ID NO: 2843357 - RNA, 18 nt, Human
cugaaaccuuuaagaaaa

SEQ ID NO: 2843358 - RNA, 18 nt, Human
cugaaacacgaaacuugu

SEQ ID NO: 2843359 - RNA, 19 nt, Human
cugaaacacgaaacuuguu

SEQ ID NO: 2843360 - RNA, 20 nt, Human
cugaaacacgaaacuuguua

SEQ ID NO: 2843361 - RNA, 21 nt, Human
cugaaacacgaaacuuguuau

SEQ ID NO: 2843362 - RNA, 13 nt, Human
cugaaacagauuu

SEQ ID NO: 2843363 - RNA, 17 nt, Human
cugaaacagauuucaua

SEQ ID NO: 2843364 - RNA, 14 nt, Human
cucuuuucucugug

SEQ ID NO: 2843365 - RNA, 17 nt, Human
cucuuuucuaaaagacu

SEQ ID NO: 2843366 - RNA, 15 nt, Human
cucuuuucuguacuu

SEQ ID NO: 2843367 - RNA, 10 nt, Human
cucuuuucuu

SEQ ID NO: 2843368 - RNA, 16 nt, Human
cucuuuucuuacuccu

SEQ ID NO: 2843369 - RNA, 18 nt, Human
cucuuuucuuacuccucc

SEQ ID NO: 2843370 - RNA, 20 nt, Human
cucuuuucuuacuccuccuc

SEQ ID NO: 2843371 - RNA, 21 nt, Human
cucuuuucuuacuccuccucu

SEQ ID NO: 2843372 - RNA, 22 nt, Human
cucuuuucuuacuccuccucuu

SEQ ID NO: 2843373 - RNA, 21 nt, Human
cucuugauuauccauauugag

SEQ ID NO: 2843374 - RNA, 23 nt, Human
cucuugauaccccccucugucuu

SEQ ID NO: 2843375 - RNA, 20 nt, Human
cucuuuuuagggccaggcag

SEQ ID NO: 2843376 - RNA, 22 nt, Human
cucuuuuuagggccaggcaggu

SEQ ID NO: 2843377 - RNA, 11 nt, Human
cucuuuuuaag

SEQ ID NO: 2843378 - RNA, 18 nt, Human
cucuuuuuagggccaggc

SEQ ID NO: 2843379 - RNA, 21 nt, Human
cucuuuugcuuuauuccagaa

SEQ ID NO: 2843380 - RNA, 10 nt, Human
cucuuuugua

SEQ ID NO: 2843381 - RNA, 14 nt, Human
cucuuuuguaaauu

SEQ ID NO: 2843382 - RNA, 15 nt, Human
cucuuuuguaaauua

SEQ ID NO: 2843383 - RNA, 18 nt, Human
cucuuuuguuaaauaaua

SEQ ID NO: 2843384 - RNA, 19 nt, Human
cucuuuuguuaaauaauau

SEQ ID NO: 2843385 - RNA, 23 nt, Human
cugaaggacauugcggacagcca

SEQ ID NO: 2843386 - RNA, 13 nt, Human
cugaagccucugg

SEQ ID NO: 2843387 - RNA, 14 nt, Human
cugaagccucuggg

SEQ ID NO: 2843388 - RNA, 15 nt, Human
cugaagccucuggga

SEQ ID NO: 2843389 - RNA, 12 nt, Human
cugaagccucug

SEQ ID NO: 2843390 - RNA, 21 nt, Human
cugaagcccucccagguguua

SEQ ID NO: 2843391 - RNA, 18 nt, Human
cugacaaaaaguuuccau

SEQ ID NO: 2843392 - RNA, 20 nt, Human
cugagucaaugcgcaaaaug

SEQ ID NO: 2843393 - RNA, 18 nt, Human
cugaguauguggaaggca

SEQ ID NO: 2843394 - RNA, 13 nt, Human
cugaguaugugga

SEQ ID NO: 2843395 - RNA, 20 nt, Human
cugaguagcuggauuacagg

SEQ ID NO: 2843396 - RNA, 14 nt, Human
cugaguagcuggga

SEQ ID NO: 2843397 - RNA, 20 nt, Human
cugaguagcugggauuacag

SEQ ID NO: 2843398 - RNA, 15 nt, Human
cugaguagcugggau

SEQ ID NO: 2843399 - RNA, 19 nt, Human
cugaguagcuggauuacag

SEQ ID NO: 2843400 - RNA, 18 nt, Human
cugaguagaugcgcagcc

SEQ ID NO: 2843401 - RNA, 22 nt, Human
cugaguagaugcgcagccccau

SEQ ID NO: 2843402 - RNA, 17 nt, Human
cugaguagcucuccuga

SEQ ID NO: 2843403 - RNA, 19 nt, Human
cugaguagcucuccugacu

SEQ ID NO: 2843404 - RNA, 11 nt, Human
cugaggagaaa

SEQ ID NO: 2843405 - RNA, 13 nt, Human
cugaggaggccuc

SEQ ID NO: 2843406 - RNA, 14 nt, Human
cugaggaggccucc

SEQ ID NO: 2843407 - RNA, 15 nt, Human
cugaggaggccucca

SEQ ID NO: 2843408 - RNA, 16 nt, Human
cugaggaggccuccau

SEQ ID NO: 2843409 - RNA, 19 nt, Human
cugaggaggccuccaucuc

SEQ ID NO: 2843410 - RNA, 13 nt, Human
cugaggaggggag

SEQ ID NO: 2843411 - RNA, 22 nt, Human
cugaggacuuaaaauauuccug

SEQ ID NO: 2843412 - RNA, 14 nt, Human
cugaggaccagcca

SEQ ID NO: 2843413 - RNA, 17 nt, Human
cugaggugaaagggagc

SEQ ID NO: 2843414 - RNA, 19 nt, Human
cugaggugaaagggagcua

SEQ ID NO: 2843415 - RNA, 17 nt, Human
cugaggugccuguccca

SEQ ID NO: 2843416 - RNA, 19 nt, Human
cugaggugccugucccacc

SEQ ID NO: 2843417 - RNA, 22 nt, Human
cugaggugccugucccaccccc

SEQ ID NO: 2843418 - RNA, 14 nt, Human
cugaggaauccaga

SEQ ID NO: 2843419 - RNA, 20 nt, Human
cugaggaauccagacccggc

SEQ ID NO: 2843420 - RNA, 17 nt, Human
cugaggaauccagaccc

SEQ ID NO: 2843421 - RNA, 20 nt, Human
cugaggacacuaaccacgcu

SEQ ID NO: 2843422 - RNA, 21 nt, Human
cugaggaauccagacccggcu

SEQ ID NO: 2843423 - RNA, 23 nt, Human
cugaggacacuaaccacgcugga

SEQ ID NO: 2843424 - RNA, 16 nt, Human
cugaggaauuuucuuu

SEQ ID NO: 2843425 - RNA, 14 nt, Human
cugaggacaaagug

SEQ ID NO: 2843426 - RNA, 15 nt, Human
cugaggacaaagugg

SEQ ID NO: 2843427 - RNA, 20 nt, Human
cugaggacaaaguggaggag

SEQ ID NO: 2843428 - RNA, 23 nt, Human
cugaggacaaaguggaggagggc

SEQ ID NO: 2843429 - RNA, 11 nt, Human
cugagcuuuau

SEQ ID NO: 2843430 - RNA, 14 nt, Human
cugagauccccuga

SEQ ID NO: 2843431 - RNA, 17 nt, Human
cugagauccccugagcc

SEQ ID NO: 2843432 - RNA, 18 nt, Human
cugagauccccugagccc

SEQ ID NO: 2843433 - RNA, 21 nt, Human
cugagauccccugagccccag

SEQ ID NO: 2843434 - RNA, 14 nt, Human
cugagaucgugcca

SEQ ID NO: 2843435 - RNA, 19 nt, Human
cugagaucgugccacugca

SEQ ID NO: 2843436 - RNA, 12 nt, Human
cugagacucaca

SEQ ID NO: 2843437 - RNA, 19 nt, Human
cugagacucacaggaagga

SEQ ID NO: 2843438 - RNA, 16 nt, Human
cugagaccauuuaaca

SEQ ID NO: 2843439 - RNA, 22 nt, Human
cugagaccauuuaacaugcaac

SEQ ID NO: 2843440 - RNA, 13 nt, Human
cugagacccagga

SEQ ID NO: 2843441 - RNA, 14 nt, Human
cugagacccaggac

SEQ ID NO: 2843442 - RNA, 17 nt, Human
cugagacccaggacucc

SEQ ID NO: 2843443 - RNA, 21 nt, Human
cugagacccaggacuccuccc

SEQ ID NO: 2843444 - RNA, 20 nt, Human
cugaccccaaacaccuucca

SEQ ID NO: 2843445 - RNA, 21 nt, Human
cugaccccaaacaccuuccag

SEQ ID NO: 2843446 - RNA, 22 nt, Human
cugaccccaaacaccuuccagc

SEQ ID NO: 2843447 - RNA, 19 nt, Human
cugaccucuugcugucucu

SEQ ID NO: 2843448 - RNA, 20 nt, Human
cugaccucuugcugucucug

SEQ ID NO: 2843449 - RNA, 21 nt, Human
cugaccucuugcugucucugc

SEQ ID NO: 2843450 - RNA, 22 nt, Human
cugaccucuugcugucucugcu

SEQ ID NO: 2843451 - RNA, 23 nt, Human
cugaccucuugcugucucugcuc

SEQ ID NO: 2843452 - RNA, 13 nt, Human
cugaccugcaggc

SEQ ID NO: 2843453 - RNA, 14 nt, Human
cugaccugccucuc

SEQ ID NO: 2843454 - RNA, 18 nt, Human
cugaccugccucucacac

SEQ ID NO: 2843455 - RNA, 22 nt, Human
cugaccugccucucacacacau

SEQ ID NO: 2843456 - RNA, 12 nt, Human
cugaccugcagg

SEQ ID NO: 2843457 - RNA, 14 nt, Human
cugaccugcacugg

SEQ ID NO: 2843458 - RNA, 19 nt, Human
cugagacuuucuuucugua

SEQ ID NO: 2843459 - RNA, 14 nt, Human
cugagacugcggga

SEQ ID NO: 2843460 - RNA, 18 nt, Human
cugagagaauuggcucaa

SEQ ID NO: 2843461 - RNA, 20 nt, Human
cugagagaauuggcucaaua

SEQ ID NO: 2843462 - RNA, 16 nt, Human
cugagagacauggcuu

SEQ ID NO: 2843463 - RNA, 13 nt, Human
cugagagacuuuu

SEQ ID NO: 2843464 - RNA, 16 nt, Human
cugagagacuuuuaau

SEQ ID NO: 2843465 - RNA, 18 nt, Human
cugagagacuuuuaauca

SEQ ID NO: 2843466 - RNA, 12 nt, Human
cugagagccagg

SEQ ID NO: 2843467 - RNA, 17 nt, Human
cugagagcaaagugacc

SEQ ID NO: 2843468 - RNA, 14 nt, Human
cugagagucuagau

SEQ ID NO: 2843469 - RNA, 14 nt, Human
cugagaggggaagc

SEQ ID NO: 2843470 - RNA, 15 nt, Human
cugagagugucucug

SEQ ID NO: 2843471 - RNA, 22 nt, Human
cugagagucuagauucucuggc

SEQ ID NO: 2843472 - RNA, 15 nt, Human
cugagagucuagauu

SEQ ID NO: 2843473 - RNA, 17 nt, Human
cugagagucuagauucu

SEQ ID NO: 2843474 - RNA, 22 nt, Human
cugagaggacuuuucuuugugg

SEQ ID NO: 2843475 - RNA, 21 nt, Human
cugagaggacuuuucuuugug

SEQ ID NO: 2843476 - RNA, 12 nt, Human
cugacaagggcu

SEQ ID NO: 2843477 - RNA, 13 nt, Human
cugacaagggcug

SEQ ID NO: 2843478 - RNA, 14 nt, Human
cugacaagggcuga

SEQ ID NO: 2843479 - RNA, 19 nt, Human
cugacaagggcugaccugc

SEQ ID NO: 2843480 - RNA, 20 nt, Human
cugacaagggcugaccugcc

SEQ ID NO: 2843481 - RNA, 22 nt, Human
cugacaagggcugaccugccuc

SEQ ID NO: 2843482 - RNA, 19 nt, Human
cugacaacagacuucugaa

SEQ ID NO: 2843483 - RNA, 18 nt, Human
cugacaacagacuucuga

SEQ ID NO: 2843484 - RNA, 15 nt, Human
cugacaacagacuuc

SEQ ID NO: 2843485 - RNA, 14 nt, Human
cucguuccuuucuc

SEQ ID NO: 2843486 - RNA, 15 nt, Human
cucguuccuuucucc

SEQ ID NO: 2843487 - RNA, 17 nt, Human
cucguuccuuucuccug

SEQ ID NO: 2843488 - RNA, 16 nt, Human
cucgugguccccaaca

SEQ ID NO: 2843489 - RNA, 22 nt, Human
cucucacacugguucucaauga

SEQ ID NO: 2843490 - RNA, 20 nt, Human
cucucacacugguucucaau

SEQ ID NO: 2843491 - RNA, 19 nt, Human
cucucacacugguucucaa

SEQ ID NO: 2843492 - RNA, 12 nt, Human
cucucacacaca

SEQ ID NO: 2843493 - RNA, 14 nt, Human
cucucacacacaua

SEQ ID NO: 2843494 - RNA, 21 nt, Human
cucucacacacauagauuaau

SEQ ID NO: 2843495 - RNA, 15 nt, Human
cucucaccucagccu

SEQ ID NO: 2843496 - RNA, 13 nt, Human
cucucaggagcca

SEQ ID NO: 2843497 - RNA, 14 nt, Human
cucucaggagccau

SEQ ID NO: 2843498 - RNA, 21 nt, Human
cucucaggagccaucaucggc

SEQ ID NO: 2843499 - RNA, 16 nt, Human
cucucaggauccaagc

SEQ ID NO: 2843500 - RNA, 13 nt, Human
cucucaggaucca

SEQ ID NO: 2843501 - RNA, 14 nt, Human
cucucaggauccaa

SEQ ID NO: 2843502 - RNA, 17 nt, Human
cucucagcucagcgcca

SEQ ID NO: 2843503 - RNA, 13 nt, Human
cucucagcuccag

SEQ ID NO: 2843504 - RNA, 15 nt, Human
cucucagcuccaggu

SEQ ID NO: 2843505 - RNA, 15 nt, Human
cucucacuaaacuuu

SEQ ID NO: 2843506 - RNA, 12 nt, Human
cucucagcucca

SEQ ID NO: 2843507 - RNA, 19 nt, Human
cucucagccuuacauuugu

SEQ ID NO: 2843508 - RNA, 16 nt, Human
cucucagcucagcgcc

SEQ ID NO: 2843509 - RNA, 21 nt, Human
cucuaaagaguuuauuuuaag

SEQ ID NO: 2843510 - RNA, 14 nt, Human
cucuaaagaccaaa

SEQ ID NO: 2843511 - RNA, 15 nt, Human
cucuaaagaccaaac

SEQ ID NO: 2843512 - RNA, 17 nt, Human
cucuaaagaccaaacuu

SEQ ID NO: 2843513 - RNA, 19 nt, Human
cucuaaagaccaaacuuca

SEQ ID NO: 2843514 - RNA, 20 nt, Human
cucuaaagaccaaacuucac

SEQ ID NO: 2843515 - RNA, 18 nt, Human
cucguuggaagaggaaca

SEQ ID NO: 2843516 - RNA, 21 nt, Human
cucguuuuucuucuuaagacu

SEQ ID NO: 2843517 - RNA, 12 nt, Human
cucguuugugau

SEQ ID NO: 2843518 - RNA, 13 nt, Human
cucguuugugauu

SEQ ID NO: 2843519 - RNA, 13 nt, Human
cucuaaaagcacc

SEQ ID NO: 2843520 - RNA, 23 nt, Human
cucuaaaagcguuggauguagca

SEQ ID NO: 2843521 - RNA, 22 nt, Human
cucuauauuuagauuguuaaaa

SEQ ID NO: 2843522 - RNA, 11 nt, Human
cucuauauuua

SEQ ID NO: 2843523 - RNA, 17 nt, Human
cucuauauaaaaacaaa

SEQ ID NO: 2843524 - RNA, 18 nt, Human
cucuauacugcccugagu

SEQ ID NO: 2843525 - RNA, 21 nt, Human
cucuauacugcccugaguugg

SEQ ID NO: 2843526 - RNA, 15 nt, Human
cucuaucaccaagga

SEQ ID NO: 2843527 - RNA, 14 nt, Human
cucuaucucucaaa

SEQ ID NO: 2843528 - RNA, 14 nt, Human
cucuaucugggccu

SEQ ID NO: 2843529 - RNA, 15 nt, Human
cucuaucugggccug

SEQ ID NO: 2843530 - RNA, 16 nt, Human
cucuaucugggccugg

SEQ ID NO: 2843531 - RNA, 17 nt, Human
cucuaucugggccuggg

SEQ ID NO: 2843532 - RNA, 20 nt, Human
cucuaucugggccugggcua

SEQ ID NO: 2843533 - RNA, 14 nt, Human
cucgaacuggcugc

SEQ ID NO: 2843534 - RNA, 13 nt, Human
cucgaacuggcug

SEQ ID NO: 2843535 - RNA, 15 nt, Human
cucgaacuggcugca

SEQ ID NO: 2843536 - RNA, 23 nt, Human
cuccuggggguucuuucuuccuc

SEQ ID NO: 2843537 - RNA, 14 nt, Human
cuccuggggguucu

SEQ ID NO: 2843538 - RNA, 19 nt, Human
cuccuggguucaagcgauu

SEQ ID NO: 2843539 - RNA, 18 nt, Human
cuccuggggguucuuucu

SEQ ID NO: 2843540 - RNA, 20 nt, Human
cuccuggggguucuuucuuc

SEQ ID NO: 2843541 - RNA, 22 nt, Human
cuccuggggguucuuucuuccu

SEQ ID NO: 2843542 - RNA, 19 nt, Human
cuccucucugcccuaaugc

SEQ ID NO: 2843543 - RNA, 19 nt, Human
cuccuaaccucaagugauc

SEQ ID NO: 2843544 - RNA, 20 nt, Human
cuccuacaagauuuagaaaa

SEQ ID NO: 2843545 - RNA, 15 nt, Human
cuccucucugcccua

SEQ ID NO: 2843546 - RNA, 14 nt, Human
cuccucucugcccu

SEQ ID NO: 2843547 - RNA, 13 nt, Human
cuccucucugccc

SEQ ID NO: 2843548 - RNA, 13 nt, Human
cuccucuccugga

SEQ ID NO: 2843549 - RNA, 14 nt, Human
cuccucuccuggag

SEQ ID NO: 2843550 - RNA, 15 nt, Human
cuccucuccuggagg

SEQ ID NO: 2843551 - RNA, 16 nt, Human
cuccucuccuggagga

SEQ ID NO: 2843552 - RNA, 22 nt, Human
cuccguuuauuauaaacuguau

SEQ ID NO: 2843553 - RNA, 18 nt, Human
cuccucuguccugcuucu

SEQ ID NO: 2843554 - RNA, 20 nt, Human
cuccucuguccugcuucuga

SEQ ID NO: 2843555 - RNA, 20 nt, Human
cuccucuccuggaggauugc

SEQ ID NO: 2843556 - RNA, 16 nt, Human
cuccucugucugcccu

SEQ ID NO: 2843557 - RNA, 18 nt, Human
cuccucuucaccccggca

SEQ ID NO: 2843558 - RNA, 19 nt, Human
cuccucuucaccccggcag

SEQ ID NO: 2843559 - RNA, 20 nt, Human
cuccucuucaccccggcagg

SEQ ID NO: 2843560 - RNA, 22 nt, Human
cuccucuucaccccggcaggcc

SEQ ID NO: 2843561 - RNA, 15 nt, Human
cuccuggacuccugc

SEQ ID NO: 2843562 - RNA, 12 nt, Human
cuccuggacucc

SEQ ID NO: 2843563 - RNA, 10 nt, Human
cuccuggagg

SEQ ID NO: 2843564 - RNA, 15 nt, Human
cuccuggaguugcau

SEQ ID NO: 2843565 - RNA, 13 nt, Human
cuccucuguggug

SEQ ID NO: 2843566 - RNA, 18 nt, Human
cuccucuguggugucugc

SEQ ID NO: 2843567 - RNA, 19 nt, Human
cuccucuguggugucugcc

SEQ ID NO: 2843568 - RNA, 18 nt, Human
cuccucuucaacugacca

SEQ ID NO: 2843569 - RNA, 23 nt, Human
cuccucuucaacugaccagccuc

SEQ ID NO: 2843570 - RNA, 20 nt, Human
cuccuggcagaagggagcag

SEQ ID NO: 2843571 - RNA, 16 nt, Human
cucccccaccccugcu

SEQ ID NO: 2843572 - RNA, 23 nt, Human
cucccccaacccccaccccacac

SEQ ID NO: 2843573 - RNA, 21 nt, Human
cucccccaacccccaccccac

SEQ ID NO: 2843574 - RNA, 16 nt, Human
cucccccaucucccac

SEQ ID NO: 2843575 - RNA, 19 nt, Human
cucccccaucucccacccu

SEQ ID NO: 2843576 - RNA, 13 nt, Human
cucccccaucucu

SEQ ID NO: 2843577 - RNA, 17 nt, Human
cuccacugugccuuugc

SEQ ID NO: 2843578 - RNA, 22 nt, Human
cuccacugugccuuugcaaauc

SEQ ID NO: 2843579 - RNA, 23 nt, Human
cuccacugugccuuugcaaauca

SEQ ID NO: 2843580 - RNA, 13 nt, Human
cuccacugucacc

SEQ ID NO: 2843581 - RNA, 18 nt, Human
cuccacugucacccucca

SEQ ID NO: 2843582 - RNA, 21 nt, Human
cuccacuucuuguuccccacu

SEQ ID NO: 2843583 - RNA, 15 nt, Human
cuccccaugccacgu

SEQ ID NO: 2843584 - RNA, 14 nt, Human
cucccacgugggag

SEQ ID NO: 2843585 - RNA, 15 nt, Human
cucccacgugggaga

SEQ ID NO: 2843586 - RNA, 12 nt, Human
cuccccauggag

SEQ ID NO: 2843587 - RNA, 17 nt, Human
cuccccauggagccagc

SEQ ID NO: 2843588 - RNA, 14 nt, Human
cuccccaugugucc

SEQ ID NO: 2843589 - RNA, 21 nt, Human
cuccccauuagagucagccuu

SEQ ID NO: 2843590 - RNA, 21 nt, Human
cuccccauguguccugguucc

SEQ ID NO: 2843591 - RNA, 18 nt, Human
cuccccauguguccuggu

SEQ ID NO: 2843592 - RNA, 20 nt, Human
cuccccauguguccugguuc

SEQ ID NO: 2843593 - RNA, 13 nt, Human
cucccacgggacc

SEQ ID NO: 2843594 - RNA, 22 nt, Human
cucccacgggaccuggggcuuu

SEQ ID NO: 2843595 - RNA, 20 nt, Human
cucccaccucugugaccuca

SEQ ID NO: 2843596 - RNA, 21 nt, Human
cucccaccucugugaccucag

SEQ ID NO: 2843597 - RNA, 23 nt, Human
cucccacccccuucucugcucca

SEQ ID NO: 2843598 - RNA, 13 nt, Human
cucccaccuccag

SEQ ID NO: 2843599 - RNA, 15 nt, Human
cucccaccuccaguc

SEQ ID NO: 2843600 - RNA, 12 nt, Human
cucccaccucug

SEQ ID NO: 2843601 - RNA, 13 nt, Human
cucccaccucugu

SEQ ID NO: 2843602 - RNA, 14 nt, Human
cucccaccucugug

SEQ ID NO: 2843603 - RNA, 15 nt, Human
cucccaccucuguga

SEQ ID NO: 2843604 - RNA, 17 nt, Human
cucccaccucugugacc

SEQ ID NO: 2843605 - RNA, 18 nt, Human
cucccaccucugugaccu

SEQ ID NO: 2843606 - RNA, 19 nt, Human
cucccaccucugugaccuc

SEQ ID NO: 2843607 - RNA, 12 nt, Human
cucccacccagu

SEQ ID NO: 2843608 - RNA, 18 nt, Human
cucccacccagucucugc

SEQ ID NO: 2843609 - RNA, 21 nt, Human
cucccacccagucucugcucc

SEQ ID NO: 2843610 - RNA, 22 nt, Human
cucccacccagucucugcucca

SEQ ID NO: 2843611 - RNA, 18 nt, Human
cucccaccccaugcauua

SEQ ID NO: 2843612 - RNA, 19 nt, Human
cucccacccccaucucucc

SEQ ID NO: 2843613 - RNA, 15 nt, Human
cucccacccccaucu

SEQ ID NO: 2843614 - RNA, 22 nt, Human
cucccacccccuucucugcucc

SEQ ID NO: 2843615 - RNA, 18 nt, Human
cucccacccccuucucug

SEQ ID NO: 2843616 - RNA, 22 nt, Human
cucccacccccaucucucccuc

SEQ ID NO: 2843617 - RNA, 20 nt, Human
cucccacccccaucucuccc

SEQ ID NO: 2843618 - RNA, 16 nt, Human
cuccacuggauggagg

SEQ ID NO: 2843619 - RNA, 9 nt, Human
cuccacugu

SEQ ID NO: 2843620 - RNA, 11 nt, Human
cuccacuguca

SEQ ID NO: 2843621 - RNA, 12 nt, Human
cuccacugucac

SEQ ID NO: 2843622 - RNA, 13 nt, Human
cuccacugucaca

SEQ ID NO: 2843623 - RNA, 16 nt, Human
cuccacugucacauug

SEQ ID NO: 2843624 - RNA, 14 nt, Human
cuccaagcuccauc

SEQ ID NO: 2843625 - RNA, 18 nt, Human
cuccaagcuccaucucca

SEQ ID NO: 2843626 - RNA, 19 nt, Human
cuccaagcuccaucuccac

SEQ ID NO: 2843627 - RNA, 13 nt, Human
cuccaagccagcg

SEQ ID NO: 2843628 - RNA, 18 nt, Human
cuccaagauucuagauga

SEQ ID NO: 2843629 - RNA, 12 nt, Human
cuccaagauucu

SEQ ID NO: 2843630 - RNA, 13 nt, Human
cuccaagauucua

SEQ ID NO: 2843631 - RNA, 14 nt, Human
cuccaagauucuag

SEQ ID NO: 2843632 - RNA, 15 nt, Human
cuccaagauucuaga

SEQ ID NO: 2843633 - RNA, 16 nt, Human
cuccaagauucuagau

SEQ ID NO: 2843634 - RNA, 17 nt, Human
cuccaagauucuagaug

SEQ ID NO: 2843635 - RNA, 14 nt, Human
cuccaagaccuagg

SEQ ID NO: 2843636 - RNA, 16 nt, Human
cuccaagaccuaggcu

SEQ ID NO: 2843637 - RNA, 15 nt, Human
cucauguguuugcau

SEQ ID NO: 2843638 - RNA, 15 nt, Human
cucauguucugcuuu

SEQ ID NO: 2843639 - RNA, 16 nt, Human
cucauguucugcuuuc

SEQ ID NO: 2843640 - RNA, 16 nt, Human
cucaugccucagccuc

SEQ ID NO: 2843641 - RNA, 12 nt, Human
cucaugccucag

SEQ ID NO: 2843642 - RNA, 21 nt, Human
cucaguaagacgacaaggaaa

SEQ ID NO: 2843643 - RNA, 21 nt, Human
cucaguccuccccucacagcc

SEQ ID NO: 2843644 - RNA, 13 nt, Human
cucagucucagga

SEQ ID NO: 2843645 - RNA, 22 nt, Human
cucaguccuccccucacagccu

SEQ ID NO: 2843646 - RNA, 23 nt, Human
cucaguccuccccucacagccuc

SEQ ID NO: 2843647 - RNA, 15 nt, Human
cucagucucaggagc

SEQ ID NO: 2843648 - RNA, 14 nt, Human
cucagucucaggag

SEQ ID NO: 2843649 - RNA, 13 nt, Human
cucagucucccuc

SEQ ID NO: 2843650 - RNA, 20 nt, Human
cucaguaaauguacaacugc

SEQ ID NO: 2843651 - RNA, 19 nt, Human
cucaguaagacgacaagga

SEQ ID NO: 2843652 - RNA, 22 nt, Human
cucagguugucugaagucacug

SEQ ID NO: 2843653 - RNA, 16 nt, Human
cucagucucaggagca

SEQ ID NO: 2843654 - RNA, 17 nt, Human
cucagucucccucccuu

SEQ ID NO: 2843655 - RNA, 16 nt, Human
cucagucucccucccu

SEQ ID NO: 2843656 - RNA, 15 nt, Human
cucagucucccuccc

SEQ ID NO: 2843657 - RNA, 13 nt, Human
cucaucuuacugu

SEQ ID NO: 2843658 - RNA, 20 nt, Human
cgccuguaaucccagcuacu

SEQ ID NO: 2843659 - RNA, 20 nt, Human
cgccuguaaucccagcacuu

SEQ ID NO: 2843660 - RNA, 17 nt, Human
cgccuggguccagggga

SEQ ID NO: 2843661 - RNA, 18 nt, Human
cgcugauacauaacuaaa

SEQ ID NO: 2843662 - RNA, 20 nt, Human
cgcugauacauaacuaaauu

SEQ ID NO: 2843663 - RNA, 16 nt, Human
cgcugauucucagggu

SEQ ID NO: 2843664 - RNA, 23 nt, Human
cgcugauucucagggucucugcu

SEQ ID NO: 2843665 - RNA, 14 nt, Human
cgcugauucucagg

SEQ ID NO: 2843666 - RNA, 16 nt, Human
cggagucccaccuugg

SEQ ID NO: 2843667 - RNA, 22 nt, Human
cggaggcauccuacccuuuucu

SEQ ID NO: 2843668 - RNA, 19 nt, Human
cggaggcaaagcuggcuca

SEQ ID NO: 2843669 - RNA, 16 nt, Human
cggaggcaaagcuggc

SEQ ID NO: 2843670 - RNA, 17 nt, Human
cggaggauaguaugagc

SEQ ID NO: 2843671 - RNA, 18 nt, Human
cggaggauaguaugagcc

SEQ ID NO: 2843672 - RNA, 13 nt, Human
cggagcuggcccc

SEQ ID NO: 2843673 - RNA, 16 nt, Human
cggagcuggccccgcc

SEQ ID NO: 2843674 - RNA, 21 nt, Human
cggagcuggccccgccgccug

SEQ ID NO: 2843675 - RNA, 18 nt, Human
cggaggaaagacaacaca

SEQ ID NO: 2843676 - RNA, 19 nt, Human
cggaggaaagacaacacaa

SEQ ID NO: 2843677 - RNA, 12 nt, Human
cggaggaaaucu

SEQ ID NO: 2843678 - RNA, 17 nt, Human
cggagcugccccucucu

SEQ ID NO: 2843679 - RNA, 19 nt, Human
cggagcugccccucucugg

SEQ ID NO: 2843680 - RNA, 20 nt, Human
cggagcugccccucucuggg

SEQ ID NO: 2843681 - RNA, 22 nt, Human
cggagcugccccucucugggcc

SEQ ID NO: 2843682 - RNA, 23 nt, Human
cggagcugccccucucugggccu

SEQ ID NO: 2843683 - RNA, 17 nt, Human
cgggccacagagaaagu

SEQ ID NO: 2843684 - RNA, 20 nt, Human
cgggcgcgaucccacacagg

SEQ ID NO: 2843685 - RNA, 16 nt, Human
cgggcgcggccagccc

SEQ ID NO: 2843686 - RNA, 14 nt, Human
cgggcugcccugcc

SEQ ID NO: 2843687 - RNA, 14 nt, Human
cggggacagcuccu

SEQ ID NO: 2843688 - RNA, 14 nt, Human
cggggaagccagac

SEQ ID NO: 2843689 - RNA, 14 nt, Human
cggggacagaggcc

SEQ ID NO: 2843690 - RNA, 16 nt, Human
cggggacagaggccug

SEQ ID NO: 2843691 - RNA, 17 nt, Human
cggggacagaggccugc

SEQ ID NO: 2843692 - RNA, 18 nt, Human
cggggacagaggccugcc

SEQ ID NO: 2843693 - RNA, 16 nt, Human
cggugugggcuguguc

SEQ ID NO: 2843694 - RNA, 21 nt, Human
cggggacagaggccugcccgg

SEQ ID NO: 2843695 - RNA, 15 nt, Human
cggggacagcuccuu

SEQ ID NO: 2843696 - RNA, 14 nt, Human
cggcucacugcagc

SEQ ID NO: 2843697 - RNA, 15 nt, Human
cggcucacugcagcc

SEQ ID NO: 2843698 - RNA, 20 nt, Human
cggagucccaccuuggcugc

SEQ ID NO: 2843699 - RNA, 18 nt, Human
cggagucccaccuuggcu

SEQ ID NO: 2843700 - RNA, 17 nt, Human
cggcucacugcagccuc

SEQ ID NO: 2843701 - RNA, 21 nt, Human
cggcucacugcauccuccgcc

SEQ ID NO: 2843702 - RNA, 16 nt, Human
cggcucacugcagccu

SEQ ID NO: 2843703 - RNA, 12 nt, Human
cggcuccaggcu

SEQ ID NO: 2843704 - RNA, 16 nt, Human
cggcuccaggcuccuu

SEQ ID NO: 2843705 - RNA, 15 nt, Human
cggcuccaggcuccu

SEQ ID NO: 2843706 - RNA, 14 nt, Human
cggcuccaggcucc

SEQ ID NO: 2843707 - RNA, 13 nt, Human
cggcuccaggcuc

SEQ ID NO: 2843708 - RNA, 14 nt, Human
cgggccacagagaa

SEQ ID NO: 2843709 - RNA, 12 nt, Human
cgggccacagag

SEQ ID NO: 2843710 - RNA, 19 nt, Human
cggcucagugcaaccucug

SEQ ID NO: 2843711 - RNA, 20 nt, Human
cggcucagugcaaccucugc

SEQ ID NO: 2843712 - RNA, 21 nt, Human
cggcucagugcaaccucugcu

SEQ ID NO: 2843713 - RNA, 17 nt, Human
cgggcaugggcacuccc

SEQ ID NO: 2843714 - RNA, 20 nt, Human
cggcuccccauguguccugg

SEQ ID NO: 2843715 - RNA, 15 nt, Human
cggcuccccaugugu

SEQ ID NO: 2843716 - RNA, 17 nt, Human
cggcuccccaugugucc

SEQ ID NO: 2843717 - RNA, 10 nt, Human
cguguacaua

SEQ ID NO: 2843718 - RNA, 20 nt, Human
cguguacauagugcauuguu

SEQ ID NO: 2843719 - RNA, 18 nt, Human
cguguacuggcuccucug

SEQ ID NO: 2843720 - RNA, 22 nt, Human
cguguagcuauggaaguugcau

SEQ ID NO: 2843721 - RNA, 14 nt, Human
cgugcacacaccag

SEQ ID NO: 2843722 - RNA, 13 nt, Human
cgugcaacugaca

SEQ ID NO: 2843723 - RNA, 16 nt, Human
cgugcaacugacacuc

SEQ ID NO: 2843724 - RNA, 22 nt, Human
cgugaucaaagccacacucugg

SEQ ID NO: 2843725 - RNA, 18 nt, Human
cgugauccacccaccucg

SEQ ID NO: 2843726 - RNA, 13 nt, Human
cgugaucuuggcu

SEQ ID NO: 2843727 - RNA, 21 nt, Human
cgugaucaaagccacacucug

SEQ ID NO: 2843728 - RNA, 15 nt, Human
cgugaggucccagga

SEQ ID NO: 2843729 - RNA, 16 nt, Human
cgugaggucccaggaa

SEQ ID NO: 2843730 - RNA, 16 nt, Human
cgugagucauuuaaau

SEQ ID NO: 2843731 - RNA, 18 nt, Human
cgguuuuuuauuauugug

SEQ ID NO: 2843732 - RNA, 15 nt, Human
cgguuuuuuuccugu

SEQ ID NO: 2843733 - RNA, 15 nt, Human
cgguuugaagccugg

SEQ ID NO: 2843734 - RNA, 20 nt, Human
cgguuugccauguugccaga

SEQ ID NO: 2843735 - RNA, 13 nt, Human
cgguuucuuuuua

SEQ ID NO: 2843736 - RNA, 16 nt, Human
cgguuucuuuuuaagu

SEQ ID NO: 2843737 - RNA, 19 nt, Human
cgguuucuuuuuaaguaau

SEQ ID NO: 2843738 - RNA, 23 nt, Human
cgguguuuaagacauuuuuggaa

SEQ ID NO: 2843739 - RNA, 13 nt, Human
cgguguucuaaga

SEQ ID NO: 2843740 - RNA, 12 nt, Human
cguaaaauggug

SEQ ID NO: 2843741 - RNA, 17 nt, Human
cgaucaggcacagguca

SEQ ID NO: 2843742 - RNA, 18 nt, Human
cgaucaggcacaggucag

SEQ ID NO: 2843743 - RNA, 17 nt, Human
cgcaggauucagccgga

SEQ ID NO: 2843744 - RNA, 15 nt, Human
cgauccaccugucuc

SEQ ID NO: 2843745 - RNA, 19 nt, Human
cgcauggucacacacugau

SEQ ID NO: 2843746 - RNA, 16 nt, Human
cgcauggucacacacu

SEQ ID NO: 2843747 - RNA, 13 nt, Human
cgcaggcuggccc

SEQ ID NO: 2843748 - RNA, 15 nt, Human
cgauauacucuagau

SEQ ID NO: 2843749 - RNA, 16 nt, Human
cgauauuuuuaaagau

SEQ ID NO: 2843750 - RNA, 22 nt, Human
cgauauuuuuaaagaucuguaa

SEQ ID NO: 2843751 - RNA, 13 nt, Human
cgauauacagaug

SEQ ID NO: 2843752 - RNA, 15 nt, Human
cgauauacagaugaa

SEQ ID NO: 2843753 - RNA, 18 nt, Human
cgauauacagaugaaaau

SEQ ID NO: 2843754 - RNA, 12 nt, Human
cgauagagucuc

SEQ ID NO: 2843755 - RNA, 14 nt, Human
cgagucaccuucca

SEQ ID NO: 2843756 - RNA, 15 nt, Human
cgagucaccuuccag

SEQ ID NO: 2843757 - RNA, 16 nt, Human
cgagucaccuuccagg

SEQ ID NO: 2843758 - RNA, 18 nt, Human
cgagucaccuuccaggac

SEQ ID NO: 2843759 - RNA, 16 nt, Human
cgccugagcucacucg

SEQ ID NO: 2843760 - RNA, 18 nt, Human
cgccugcaaacgcugccu

SEQ ID NO: 2843761 - RNA, 12 nt, Human
cgccuggagccc

SEQ ID NO: 2843762 - RNA, 13 nt, Human
cgccuggagcccu

SEQ ID NO: 2843763 - RNA, 14 nt, Human
cgccuggagcccuc

SEQ ID NO: 2843764 - RNA, 15 nt, Human
cgccuggauuucugg

SEQ ID NO: 2843765 - RNA, 16 nt, Human
cgccuggauuucuggu

SEQ ID NO: 2843766 - RNA, 20 nt, Human
cgccuggauuucugguucug

SEQ ID NO: 2843767 - RNA, 23 nt, Human
cgccuggauuucugguucugaug

SEQ ID NO: 2843768 - RNA, 11 nt, Human
cgccuggccuc

SEQ ID NO: 2843769 - RNA, 12 nt, Human
cgccuggccucc

SEQ ID NO: 2843770 - RNA, 13 nt, Human
cgccuggccucca

SEQ ID NO: 2843771 - RNA, 14 nt, Human
cgccuggccuccag

SEQ ID NO: 2843772 - RNA, 15 nt, Human
cgccuggccuccagg

SEQ ID NO: 2843773 - RNA, 16 nt, Human
cgccuggccuccaggc

SEQ ID NO: 2843774 - RNA, 17 nt, Human
cgccuggccuccaggcc

SEQ ID NO: 2843775 - RNA, 20 nt, Human
cgccuggccuccaggcccgu

SEQ ID NO: 2843776 - RNA, 16 nt, Human
cgccugacagaaacca

SEQ ID NO: 2843777 - RNA, 13 nt, Human
cgccucccacugg

SEQ ID NO: 2843778 - RNA, 14 nt, Human
cgccucccacuggg

SEQ ID NO: 2843779 - RNA, 13 nt, Human
cgccucugcauuc

SEQ ID NO: 2843780 - RNA, 23 nt, Human
cgccacugcacuccagccugggc

SEQ ID NO: 2843781 - RNA, 22 nt, Human
cgccacugcacuccagccuggg

SEQ ID NO: 2843782 - RNA, 21 nt, Human
cgccacugcacuccagccugg

SEQ ID NO: 2843783 - RNA, 23 nt, Human
cgccacucgcuucccccauagcc

SEQ ID NO: 2843784 - RNA, 22 nt, Human
cgccacuacacuccagccugag

SEQ ID NO: 2843785 - RNA, 15 nt, Human
cgccacucgcuuccc

SEQ ID NO: 2843786 - RNA, 15 nt, Human
cgccacuccugaacc

SEQ ID NO: 2843787 - RNA, 21 nt, Human
cgccacuacacuccagccuga

SEQ ID NO: 2843788 - RNA, 14 nt, Human
cgccagagggcuug

SEQ ID NO: 2843789 - RNA, 17 nt, Human
cgccagaggugcuucac

SEQ ID NO: 2843790 - RNA, 16 nt, Human
cgccuaugaucccagc

SEQ ID NO: 2843791 - RNA, 13 nt, Human
cgccucaaaaugu

SEQ ID NO: 2843792 - RNA, 21 nt, Human
cgccucacugcaaccuucacc

SEQ ID NO: 2843793 - RNA, 15 nt, Human
cgccucaguaagacg

SEQ ID NO: 2843794 - RNA, 13 nt, Human
ccuuuuuuaagau

SEQ ID NO: 2843795 - RNA, 14 nt, Human
ccuuuuuuaagauu

SEQ ID NO: 2843796 - RNA, 18 nt, Human
ccuuuuuuaagauuuuuc

SEQ ID NO: 2843797 - RNA, 19 nt, Human
ccuuuuuuaagauuuuucu

SEQ ID NO: 2843798 - RNA, 20 nt, Human
ccuuuuuuaagauuuuucuc

SEQ ID NO: 2843799 - RNA, 22 nt, Human
cgaauuaauagcuuuuauugua

SEQ ID NO: 2843800 - RNA, 14 nt, Human
cgaauugagcacaa

SEQ ID NO: 2843801 - RNA, 21 nt, Human
ccuuuuuuaagauuuuucuca

SEQ ID NO: 2843802 - RNA, 13 nt, Human
ccuuuuuauuuau

SEQ ID NO: 2843803 - RNA, 18 nt, Human
cgacacucaccaugaagc

SEQ ID NO: 2843804 - RNA, 17 nt, Human
cgacacucucuggaagc

SEQ ID NO: 2843805 - RNA, 18 nt, Human
cgaccccccgugggcucc

SEQ ID NO: 2843806 - RNA, 16 nt, Human
cgaccccccgugggcu

SEQ ID NO: 2843807 - RNA, 19 nt, Human
cgaccccuaguucccucug

SEQ ID NO: 2843808 - RNA, 14 nt, Human
cgacccucugggaa

SEQ ID NO: 2843809 - RNA, 15 nt, Human
cgacccucugggaac

SEQ ID NO: 2843810 - RNA, 16 nt, Human
cgacccucugggaacc

SEQ ID NO: 2843811 - RNA, 17 nt, Human
cgacccucugggaaccu

SEQ ID NO: 2843812 - RNA, 18 nt, Human
cgacccucugggaaccuc

SEQ ID NO: 2843813 - RNA, 21 nt, Human
cgacccucugggaaccuccca

SEQ ID NO: 2843814 - RNA, 22 nt, Human
cgacccucugggaaccucccag

SEQ ID NO: 2843815 - RNA, 23 nt, Human
cgacccucugggaaccucccaga

SEQ ID NO: 2843816 - RNA, 16 nt, Human
ccuuuuuaugaggcaa

SEQ ID NO: 2843817 - RNA, 16 nt, Human
cgacaggaguauuuuu

SEQ ID NO: 2843818 - RNA, 14 nt, Human
cgacaggcccuggc

SEQ ID NO: 2843819 - RNA, 17 nt, Human
cgacaggcgagagagga

SEQ ID NO: 2843820 - RNA, 21 nt, Human
cgacaggcgagagaggagcca

SEQ ID NO: 2843821 - RNA, 14 nt, Human
cgacagccuggcac

SEQ ID NO: 2843822 - RNA, 14 nt, Human
cgacacuguucucc

SEQ ID NO: 2843823 - RNA, 12 nt, Human
cgacagccuggc

SEQ ID NO: 2843824 - RNA, 13 nt, Human
cgacagccuggca

SEQ ID NO: 2843825 - RNA, 12 nt, Human
cgacgcccaccc

SEQ ID NO: 2843826 - RNA, 15 nt, Human
cgacgcgucuccugu

SEQ ID NO: 2843827 - RNA, 13 nt, Human
cgacgcugcagag

SEQ ID NO: 2843828 - RNA, 19 nt, Human
cgaccccccgugggcuccc

SEQ ID NO: 2843829 - RNA, 14 nt, Human
cgacgcccacccaa

SEQ ID NO: 2843830 - RNA, 14 nt, Human
cgacuaauuucaaa

SEQ ID NO: 2843831 - RNA, 13 nt, Human
cgacuagccagga

SEQ ID NO: 2843832 - RNA, 16 nt, Human
cgacugcacagcggcc

SEQ ID NO: 2843833 - RNA, 20 nt, Human
cgacugcacagcggccccug

SEQ ID NO: 2843834 - RNA, 19 nt, Human
ccuugcccggauucuggga

SEQ ID NO: 2843835 - RNA, 18 nt, Human
ccuugcccggauucuggg

SEQ ID NO: 2843836 - RNA, 16 nt, Human
ccuugcuguccuaggc

SEQ ID NO: 2843837 - RNA, 13 nt, Human
ccuugcuguccug

SEQ ID NO: 2843838 - RNA, 14 nt, Human
ccuugcuguccuga

SEQ ID NO: 2843839 - RNA, 16 nt, Human
ccuugcuguccugauc

SEQ ID NO: 2843840 - RNA, 17 nt, Human
ccuugcuguccugaucu

SEQ ID NO: 2843841 - RNA, 17 nt, Human
ccuugcuggaaaaccca

SEQ ID NO: 2843842 - RNA, 20 nt, Human
ccuugcuguaugcugaucau

SEQ ID NO: 2843843 - RNA, 21 nt, Human
ccuugcuguaugcugaucauc

SEQ ID NO: 2843844 - RNA, 22 nt, Human
ccuugcuggacggggacugggg

SEQ ID NO: 2843845 - RNA, 20 nt, Human
ccuugcuguuggucaugugg

SEQ ID NO: 2843846 - RNA, 18 nt, Human
ccuugcuuaugacaucac

SEQ ID NO: 2843847 - RNA, 20 nt, Human
ccuugcuucuuacugauaau

SEQ ID NO: 2843848 - RNA, 22 nt, Human
ccuugcucuccccugcccugcu

SEQ ID NO: 2843849 - RNA, 20 nt, Human
ccuugcucuccccugcccug

SEQ ID NO: 2843850 - RNA, 16 nt, Human
ccuuuccaaggcuucu

SEQ ID NO: 2843851 - RNA, 15 nt, Human
ccuuuccaaaauuuu

SEQ ID NO: 2843852 - RNA, 20 nt, Human
ccuuucagggaauuucagga

SEQ ID NO: 2843853 - RNA, 12 nt, Human
ccuuucagggaa

SEQ ID NO: 2843854 - RNA, 12 nt, Human
ccuuucagccca

SEQ ID NO: 2843855 - RNA, 15 nt, Human
ccuuucagcccacgu

SEQ ID NO: 2843856 - RNA, 16 nt, Human
ccuuucagcccacguc

SEQ ID NO: 2843857 - RNA, 22 nt, Human
ccuuucagcccacgucacgugu

SEQ ID NO: 2843858 - RNA, 16 nt, Human
ccuuuugaggagcccc

SEQ ID NO: 2843859 - RNA, 21 nt, Human
ccuuuugaggagccccagcua

SEQ ID NO: 2843860 - RNA, 23 nt, Human
ccuuuugaggagccccagcuacc

SEQ ID NO: 2843861 - RNA, 17 nt, Human
ccuuuuuaaaacacaug

SEQ ID NO: 2843862 - RNA, 16 nt, Human
ccuuuacugacccugg

SEQ ID NO: 2843863 - RNA, 17 nt, Human
ccuuuacugacccuggg

SEQ ID NO: 2843864 - RNA, 20 nt, Human
ccuuuacugacccuggggcu

SEQ ID NO: 2843865 - RNA, 13 nt, Human
ccuuuacuuuccc

SEQ ID NO: 2843866 - RNA, 14 nt, Human
ccuuuacuuucccu

SEQ ID NO: 2843867 - RNA, 20 nt, Human
ccuuuacuuucccuugcuuu

SEQ ID NO: 2843868 - RNA, 23 nt, Human
ccuuuacuuucccuugcuuuucc

SEQ ID NO: 2843869 - RNA, 16 nt, Human
ccuuuacaaaagaaau

SEQ ID NO: 2843870 - RNA, 22 nt, Human
ccuuuacaaaagaaauaccuug

SEQ ID NO: 2843871 - RNA, 19 nt, Human
ccuuuaauuaagacugaaa

SEQ ID NO: 2843872 - RNA, 14 nt, Human
ccuuuacggacacc

SEQ ID NO: 2843873 - RNA, 19 nt, Human
ccuuuacggacacccccuc

SEQ ID NO: 2843874 - RNA, 15 nt, Human
ccuuuacguguuuaa

SEQ ID NO: 2843875 - RNA, 19 nt, Human
ccuuuacguguuuaaaaaa

SEQ ID NO: 2843876 - RNA, 18 nt, Human
ccuuuacauggacagaau

SEQ ID NO: 2843877 - RNA, 19 nt, Human
ccuuuacauggacagaauu

SEQ ID NO: 2843878 - RNA, 14 nt, Human
ccuuuaccccaucc

SEQ ID NO: 2843879 - RNA, 15 nt, Human
ccuuuaccccauccc

SEQ ID NO: 2843880 - RNA, 20 nt, Human
ccuuuagaaacucaaaaacu

SEQ ID NO: 2843881 - RNA, 22 nt, Human
ccuuucacaaaauuuuauuccu

SEQ ID NO: 2843882 - RNA, 21 nt, Human
ccuuucacaaaauuuuauucc

SEQ ID NO: 2843883 - RNA, 17 nt, Human
ccuuucaccccagggcc

SEQ ID NO: 2843884 - RNA, 19 nt, Human
ccuuuaaguagauaagcag

SEQ ID NO: 2843885 - RNA, 15 nt, Human
ccuuucacaaccuuc

SEQ ID NO: 2843886 - RNA, 21 nt, Human
ccuuucaccccagggccugag

SEQ ID NO: 2843887 - RNA, 22 nt, Human
ccuuucaccuuuguguauuuuu

SEQ ID NO: 2843888 - RNA, 19 nt, Human
ccuuucaccccagggccug

SEQ ID NO: 2843889 - RNA, 23 nt, Human
cucaaaaaaaaaauuuuuuuccu

SEQ ID NO: 2843890 - RNA, 20 nt, Human
cucaaaacuggacagucacu

SEQ ID NO: 2843891 - RNA, 16 nt, Human
cucaaacaacacuggu

SEQ ID NO: 2843892 - RNA, 17 nt, Human
cucaaacaacacuggug

SEQ ID NO: 2843893 - RNA, 12 nt, Human
cucaaaaugugu

SEQ ID NO: 2843894 - RNA, 14 nt, Human
cucaaaauguguaa

SEQ ID NO: 2843895 - RNA, 18 nt, Human
cucaaaauauuuguacau

SEQ ID NO: 2843896 - RNA, 12 nt, Human
cucaaaagcauu

SEQ ID NO: 2843897 - RNA, 14 nt, Human
cucaaaagcauuua

SEQ ID NO: 2843898 - RNA, 21 nt, Human
cucaaaagcauuuaucauucu

SEQ ID NO: 2843899 - RNA, 22 nt, Human
cucaaaagcauuuaucauucuu

SEQ ID NO: 2843900 - RNA, 13 nt, Human
cucaaaauauuug

SEQ ID NO: 2843901 - RNA, 16 nt, Human
cucaaaacuuaacaua

SEQ ID NO: 2843902 - RNA, 20 nt, Human
cucaaaacuuaacauauuua

SEQ ID NO: 2843903 - RNA, 12 nt, Human
cucaaaagaacu

SEQ ID NO: 2843904 - RNA, 19 nt, Human
cucaaaagaacuuaccccc

SEQ ID NO: 2843905 - RNA, 20 nt, Human
cucaaaagagaaaaacaaaa

SEQ ID NO: 2843906 - RNA, 12 nt, Human
cucaaacacugc

SEQ ID NO: 2843907 - RNA, 13 nt, Human
cucaaacacugca

SEQ ID NO: 2843908 - RNA, 14 nt, Human
cucaaacacugcag

SEQ ID NO: 2843909 - RNA, 16 nt, Human
cucaaacacugcaggc

SEQ ID NO: 2843910 - RNA, 19 nt, Human
cuauuaaagugcuaagguu

SEQ ID NO: 2843911 - RNA, 23 nt, Human
cuauuaaagugcuaagguucuaa

SEQ ID NO: 2843912 - RNA, 22 nt, Human
cuauuaaaguggagaagcacac

SEQ ID NO: 2843913 - RNA, 23 nt, Human
cuauuaaaguggagaagcacacu

SEQ ID NO: 2843914 - RNA, 22 nt, Human
cuauuaaauaguuauauaauuc

SEQ ID NO: 2843915 - RNA, 21 nt, Human
cuauuaauauauguauuauuu

SEQ ID NO: 2843916 - RNA, 15 nt, Human
cuauuuuuguaaacu

SEQ ID NO: 2843917 - RNA, 21 nt, Human
cuauuuuuguaaacuggaauu

SEQ ID NO: 2843918 - RNA, 17 nt, Human
cuauuaauauauguauu

SEQ ID NO: 2843919 - RNA, 12 nt, Human
cuauuuuuguac

SEQ ID NO: 2843920 - RNA, 22 nt, Human
cuauuuuugucuuauauauauu

SEQ ID NO: 2843921 - RNA, 15 nt, Human
cuauuuuuguuuuua

SEQ ID NO: 2843922 - RNA, 12 nt, Human
cuauuaauauau

SEQ ID NO: 2843923 - RNA, 14 nt, Human
cuauuaauauaugu

SEQ ID NO: 2843924 - RNA, 15 nt, Human
cuauuaauauaugua

SEQ ID NO: 2843925 - RNA, 11 nt, Human
cuauuaauaua

SEQ ID NO: 2843926 - RNA, 19 nt, Human
cuauuaaggauguagcuuu

SEQ ID NO: 2843927 - RNA, 22 nt, Human
cuauuaaggauguagcuuuuca

SEQ ID NO: 2843928 - RNA, 23 nt, Human
cuauuaagaggcagaaaauugca

SEQ ID NO: 2843929 - RNA, 22 nt, Human
cuauuaaagugcuaagguucua

SEQ ID NO: 2843930 - RNA, 20 nt, Human
cuauuaaagugcuaagguuc

SEQ ID NO: 2843931 - RNA, 21 nt, Human
cuauuaaagugcuaagguucu

SEQ ID NO: 2843932 - RNA, 20 nt, Human
cucaaacucuugaccucagg

SEQ ID NO: 2843933 - RNA, 14 nt, Human
cucaaacuccugac

SEQ ID NO: 2843934 - RNA, 13 nt, Human
cucaaacuccuga

SEQ ID NO: 2843935 - RNA, 18 nt, Human
cucaaacacugcaggcau

SEQ ID NO: 2843936 - RNA, 20 nt, Human
cucaaacuaaaagacauuug

SEQ ID NO: 2843937 - RNA, 22 nt, Human
cucaaacuaaaagacauuuguu

SEQ ID NO: 2843938 - RNA, 12 nt, Human
cucaaacuauga

SEQ ID NO: 2843939 - RNA, 13 nt, Human
cucaauaaagauu

SEQ ID NO: 2843940 - RNA, 16 nt, Human
cucaauaaaugauucu

SEQ ID NO: 2843941 - RNA, 14 nt, Human
cucaauaaaguaca

SEQ ID NO: 2843942 - RNA, 21 nt, Human
cucaauaggaccaggauccag

SEQ ID NO: 2843943 - RNA, 15 nt, Human
cucaauaugcuuaca

SEQ ID NO: 2843944 - RNA, 15 nt, Human
cucaaugcacugaca

SEQ ID NO: 2843945 - RNA, 13 nt, Human
cucaaugcacuga

SEQ ID NO: 2843946 - RNA, 13 nt, Human
cucaauggacugg

SEQ ID NO: 2843947 - RNA, 16 nt, Human
cucaauuuuugucuca

SEQ ID NO: 2843948 - RNA, 17 nt, Human
cucaauuuuugucucag

SEQ ID NO: 2843949 - RNA, 18 nt, Human
cucaauuuuugucucaga

SEQ ID NO: 2843950 - RNA, 20 nt, Human
cucaauuuuugucucagaag

SEQ ID NO: 2843951 - RNA, 11 nt, Human
cucacaaaaga

SEQ ID NO: 2843952 - RNA, 22 nt, Human
cucacaaaccaugcaaaugcua

SEQ ID NO: 2843953 - RNA, 13 nt, Human
cuaucuaaugaca

SEQ ID NO: 2843954 - RNA, 15 nt, Human
cuaucuaaugacaug

SEQ ID NO: 2843955 - RNA, 13 nt, Human
cuaucuaaaguuu

SEQ ID NO: 2843956 - RNA, 14 nt, Human
cuaucuaaaguuug

SEQ ID NO: 2843957 - RNA, 15 nt, Human
cuaucuaucuuccaa

SEQ ID NO: 2843958 - RNA, 19 nt, Human
cuaucauugcuuccuccuc

SEQ ID NO: 2843959 - RNA, 20 nt, Human
cuaucauugcuuccuccucc

SEQ ID NO: 2843960 - RNA, 12 nt, Human
cuaucauuuauu

SEQ ID NO: 2843961 - RNA, 23 nt, Human
cuaucauuuauuggauggguggg

SEQ ID NO: 2843962 - RNA, 14 nt, Human
cuauccaaacaugu

SEQ ID NO: 2843963 - RNA, 18 nt, Human
cuauccaaacauguauuu

SEQ ID NO: 2843964 - RNA, 19 nt, Human
cuauccaaacauguauuua

SEQ ID NO: 2843965 - RNA, 20 nt, Human
cuauccaaacauguauuuau

SEQ ID NO: 2843966 - RNA, 18 nt, Human
cuaucaugucaaacguga

SEQ ID NO: 2843967 - RNA, 18 nt, Human
cuaucauugcuuccuccu

SEQ ID NO: 2843968 - RNA, 18 nt, Human
cuaguuugggaggagcag

SEQ ID NO: 2843969 - RNA, 13 nt, Human
cuaguuugcauuc

SEQ ID NO: 2843970 - RNA, 14 nt, Human
cuaguuuacagaaa

SEQ ID NO: 2843971 - RNA, 21 nt, Human
cuaguuuacagaaaaaucuug

SEQ ID NO: 2843972 - RNA, 16 nt, Human
cuaguuuacuguuuug

SEQ ID NO: 2843973 - RNA, 17 nt, Human
cuaguuuacuguuuuga

SEQ ID NO: 2843974 - RNA, 15 nt, Human
cuaguuuccucuccu

SEQ ID NO: 2843975 - RNA, 18 nt, Human
cuaguuuccucuccuucg

SEQ ID NO: 2843976 - RNA, 22 nt, Human
cuaguuugaccucacagugacc

SEQ ID NO: 2843977 - RNA, 20 nt, Human
cuaguuuuaguuuucucuua

SEQ ID NO: 2843978 - RNA, 17 nt, Human
cuaguuuucuccuccca

SEQ ID NO: 2843979 - RNA, 16 nt, Human
cuaguuuucuccuccc

SEQ ID NO: 2843980 - RNA, 19 nt, Human
cuaguuuucuccucccagg

SEQ ID NO: 2843981 - RNA, 18 nt, Human
cuaguuuucuccucccag

SEQ ID NO: 2843982 - RNA, 13 nt, Human
cuagacacagaua

SEQ ID NO: 2843983 - RNA, 16 nt, Human
cuagcaucucaugagu

SEQ ID NO: 2843984 - RNA, 22 nt, Human
cuaauuucaaaaugcuuuuuau

SEQ ID NO: 2843985 - RNA, 15 nt, Human
cuaauuucccuucuu

SEQ ID NO: 2843986 - RNA, 16 nt, Human
cuaauuucccuucuug

SEQ ID NO: 2843987 - RNA, 19 nt, Human
cuaauuucaaaaugcuuuu

SEQ ID NO: 2843988 - RNA, 18 nt, Human
cuaauuucaaaaugcuuu

SEQ ID NO: 2843989 - RNA, 21 nt, Human
cuaauuuauccugaaauuuca

SEQ ID NO: 2843990 - RNA, 23 nt, Human
cuaauuuauccugaaauuucaga

SEQ ID NO: 2843991 - RNA, 17 nt, Human
cuaauuucaaaaugcuu

SEQ ID NO: 2843992 - RNA, 19 nt, Human
cuaauuucaaaaauauaac

SEQ ID NO: 2843993 - RNA, 21 nt, Human
cuaauuucaaaaauauaacuu

SEQ ID NO: 2843994 - RNA, 11 nt, Human
cuacagugcca

SEQ ID NO: 2843995 - RNA, 12 nt, Human
cuacagugccaa

SEQ ID NO: 2843996 - RNA, 18 nt, Human
cuacagugccaacuccuc

SEQ ID NO: 2843997 - RNA, 19 nt, Human
cuacagugccaacuccuca

SEQ ID NO: 2843998 - RNA, 20 nt, Human
cuacagugccaacuccucac

SEQ ID NO: 2843999 - RNA, 23 nt, Human
cuacauacuuucauccugacucu

SEQ ID NO: 2844000 - RNA, 10 nt, Human
cuacaugaaa

SEQ ID NO: 2844001 - RNA, 16 nt, Human
cuacaucuucugccuu

SEQ ID NO: 2844002 - RNA, 14 nt, Human
cuacaucuucugcc

SEQ ID NO: 2844003 - RNA, 15 nt, Human
cuacaucuucugccu

SEQ ID NO: 2844004 - RNA, 14 nt, Human
cuaccugcccugga

SEQ ID NO: 2844005 - RNA, 17 nt, Human
cuaccugcccuggaaca

SEQ ID NO: 2844006 - RNA, 18 nt, Human
cuaccugcccuggaacau

SEQ ID NO: 2844007 - RNA, 20 nt, Human
cuaccugauuggugcaaccc

SEQ ID NO: 2844008 - RNA, 19 nt, Human
cuaccugcucuccaagucu

SEQ ID NO: 2844009 - RNA, 12 nt, Human
cuaccugcucuc

SEQ ID NO: 2844010 - RNA, 23 nt, Human
cuacaugcagcccaugcccaccu

SEQ ID NO: 2844011 - RNA, 21 nt, Human
cuacaugcagcccaugcccac

SEQ ID NO: 2844012 - RNA, 17 nt, Human
cuacaugcagcccaugc

SEQ ID NO: 2844013 - RNA, 15 nt, Human
cuacaugcagcccau

SEQ ID NO: 2844014 - RNA, 14 nt, Human
cuacaugcagccca

SEQ ID NO: 2844015 - RNA, 18 nt, Human
cuacaucuuuuuucacaa

SEQ ID NO: 2844016 - RNA, 22 nt, Human
cuacaugcaaggcacuguacua

SEQ ID NO: 2844017 - RNA, 13 nt, Human
cuacaugaaacag

SEQ ID NO: 2844018 - RNA, 14 nt, Human
cuacgcucuccuuu

SEQ ID NO: 2844019 - RNA, 14 nt, Human
cuacgccugcaugu

SEQ ID NO: 2844020 - RNA, 15 nt, Human
cuacgccaaucaagg

SEQ ID NO: 2844021 - RNA, 13 nt, Human
cuacgaaucuucc

SEQ ID NO: 2844022 - RNA, 12 nt, Human
cuaccugugccu

SEQ ID NO: 2844023 - RNA, 13 nt, Human
cuaccugugccug

SEQ ID NO: 2844024 - RNA, 15 nt, Human
cuaccugcucuccaa

SEQ ID NO: 2844025 - RNA, 22 nt, Human
cuaccuuaucacugcauuauuc

SEQ ID NO: 2844026 - RNA, 15 nt, Human
cuaccugugugguac

SEQ ID NO: 2844027 - RNA, 18 nt, Human
cuaccugugugguacucu

SEQ ID NO: 2844028 - RNA, 21 nt, Human
cuacgcucuccuuucuuucua

SEQ ID NO: 2844029 - RNA, 14 nt, Human
cuacggaccaggua

SEQ ID NO: 2844030 - RNA, 17 nt, Human
cuacguuaccaggcagg

SEQ ID NO: 2844031 - RNA, 21 nt, Human
cuacucagaagccugaggcug

SEQ ID NO: 2844032 - RNA, 19 nt, Human
cuacucagaagccugaggc

SEQ ID NO: 2844033 - RNA, 17 nt, Human
cuacucagaagccugag

SEQ ID NO: 2844034 - RNA, 16 nt, Human
cuacucagaagccuga

SEQ ID NO: 2844035 - RNA, 13 nt, Human
cuacucagaagcc

SEQ ID NO: 2844036 - RNA, 18 nt, Human
cguguguagaguuaagaa

SEQ ID NO: 2844037 - RNA, 12 nt, Human
cguguguagagu

SEQ ID NO: 2844038 - RNA, 15 nt, Human
cguguguagaguuaa

SEQ ID NO: 2844039 - RNA, 22 nt, Human
cguguguagaguuaagaagcug

SEQ ID NO: 2844040 - RNA, 16 nt, Human
cguguguguugucuga

SEQ ID NO: 2844041 - RNA, 15 nt, Human
cguguguucuaucca

SEQ ID NO: 2844042 - RNA, 11 nt, Human
cgugugugugu

SEQ ID NO: 2844043 - RNA, 23 nt, Human
cuaagugauccucccaccucagc

SEQ ID NO: 2844044 - RNA, 14 nt, Human
cuaaguucacauua

SEQ ID NO: 2844045 - RNA, 18 nt, Human
cuaaguucacauuagaau

SEQ ID NO: 2844046 - RNA, 17 nt, Human
cuaaguuauaagacucu

SEQ ID NO: 2844047 - RNA, 21 nt, Human
cuaaguuauaagacucucaca

SEQ ID NO: 2844048 - RNA, 14 nt, Human
cuaauugcuguuga

SEQ ID NO: 2844049 - RNA, 12 nt, Human
cuaauugacuuu

SEQ ID NO: 2844050 - RNA, 13 nt, Human
cuaauugacuuua

SEQ ID NO: 2844051 - RNA, 17 nt, Human
cuaauugacuuuagaaa

SEQ ID NO: 2844052 - RNA, 20 nt, Human
cuaauugacuuuagaaagcu

SEQ ID NO: 2844053 - RNA, 16 nt, Human
cuaauugcaucucaaa

SEQ ID NO: 2844054 - RNA, 19 nt, Human
cuaauugcaucucaaaauu

SEQ ID NO: 2844055 - RNA, 20 nt, Human
cuaauugcaucucaaaauua

SEQ ID NO: 2844056 - RNA, 16 nt, Human
cuaauucuauuaaagu

SEQ ID NO: 2844057 - RNA, 20 nt, Human
cuaauucuauuaaagugcua

SEQ ID NO: 2844058 - RNA, 18 nt, Human
cuaauucuuacacugccu

SEQ ID NO: 2844059 - RNA, 16 nt, Human
cuaauucuucuguccu

SEQ ID NO: 2844060 - RNA, 18 nt, Human
cuaauucuucuguccuga

SEQ ID NO: 2844061 - RNA, 20 nt, Human
cuagaacacuaacucaccag

SEQ ID NO: 2844062 - RNA, 19 nt, Human
cuagaacacuaacucacca

SEQ ID NO: 2844063 - RNA, 16 nt, Human
cuagaacacuaacuca

SEQ ID NO: 2844064 - RNA, 22 nt, Human
cuagaacacuaacucaccagcc

SEQ ID NO: 2844065 - RNA, 23 nt, Human
cuagaagggccaguccugccugg

SEQ ID NO: 2844066 - RNA, 20 nt, Human
cuagaagggccaguccugcc

SEQ ID NO: 2844067 - RNA, 13 nt, Human
cuagcaucccuga

SEQ ID NO: 2844068 - RNA, 15 nt, Human
cuagacaagauauug

SEQ ID NO: 2844069 - RNA, 18 nt, Human
cuagacaagauauuguac

SEQ ID NO: 2844070 - RNA, 20 nt, Human
cuagacaagauauuguacau

SEQ ID NO: 2844071 - RNA, 23 nt, Human
cuagacaagauauuguacauaaa

SEQ ID NO: 2844072 - RNA, 17 nt, Human
ccugucuuuaaggaaaa

SEQ ID NO: 2844073 - RNA, 13 nt, Human
ccugucuuuccua

SEQ ID NO: 2844074 - RNA, 19 nt, Human
ccugucuuuccuaagaccu

SEQ ID NO: 2844075 - RNA, 20 nt, Human
ccugucuuuccuaagaccug

SEQ ID NO: 2844076 - RNA, 21 nt, Human
ccugucuuuccuaagaccugg

SEQ ID NO: 2844077 - RNA, 14 nt, Human
ccugucuuuaagga

SEQ ID NO: 2844078 - RNA, 17 nt, Human
ccugucugacuacuuug

SEQ ID NO: 2844079 - RNA, 20 nt, Human
ccugucugagacucacagga

SEQ ID NO: 2844080 - RNA, 23 nt, Human
ccugucugagacucacaggaagg

SEQ ID NO: 2844081 - RNA, 13 nt, Human
ccugucugugacc

SEQ ID NO: 2844082 - RNA, 22 nt, Human
ccugucugugaccugcaucuaa

SEQ ID NO: 2844083 - RNA, 11 nt, Human
ccugucuguga

SEQ ID NO: 2844084 - RNA, 16 nt, Human
ccugucucagccuccc

SEQ ID NO: 2844085 - RNA, 15 nt, Human
ccugucucagccucc

SEQ ID NO: 2844086 - RNA, 14 nt, Human
ccugucucagccuc

SEQ ID NO: 2844087 - RNA, 13 nt, Human
ccugucucagccu

SEQ ID NO: 2844088 - RNA, 17 nt, Human
ccugucucauccccagg

SEQ ID NO: 2844089 - RNA, 13 nt, Human
ccugucucugccc

SEQ ID NO: 2844090 - RNA, 16 nt, Human
ccugucgggcuuugug

SEQ ID NO: 2844091 - RNA, 22 nt, Human
ccugucgggcuuugugugaagg

SEQ ID NO: 2844092 - RNA, 16 nt, Human
ccugucuagucucucc

SEQ ID NO: 2844093 - RNA, 18 nt, Human
ccugucuagucucuccug

SEQ ID NO: 2844094 - RNA, 21 nt, Human
ccugucuagucucuccuguaa

SEQ ID NO: 2844095 - RNA, 22 nt, Human
ccugucuagucucuccuguaag

SEQ ID NO: 2844096 - RNA, 23 nt, Human
ccugucuagucucuccuguaagc

SEQ ID NO: 2844097 - RNA, 14 nt, Human
ccugugacaaaauu

SEQ ID NO: 2844098 - RNA, 18 nt, Human
ccugugaaguaaggaugu

SEQ ID NO: 2844099 - RNA, 17 nt, Human
ccugugaacugaacucu

SEQ ID NO: 2844100 - RNA, 16 nt, Human
ccugugaacugaacuc

SEQ ID NO: 2844101 - RNA, 16 nt, Human
ccugugacugucucac

SEQ ID NO: 2844102 - RNA, 19 nt, Human
ccuguaaucccagcacacu

SEQ ID NO: 2844103 - RNA, 17 nt, Human
ccuguccugccuaaggc

SEQ ID NO: 2844104 - RNA, 18 nt, Human
ccuguccugccaugcaag

SEQ ID NO: 2844105 - RNA, 21 nt, Human
ccugucgaguucggcucuggg

SEQ ID NO: 2844106 - RNA, 23 nt, Human
ccugucgaguucggcucugggug

SEQ ID NO: 2844107 - RNA, 19 nt, Human
ccuguccugccuaaggcug

SEQ ID NO: 2844108 - RNA, 15 nt, Human
ccugguucugaugau

SEQ ID NO: 2844109 - RNA, 21 nt, Human
ccugguucugaugaugugccu

SEQ ID NO: 2844110 - RNA, 14 nt, Human
ccugguugaagaag

SEQ ID NO: 2844111 - RNA, 15 nt, Human
ccugguuggguggca

SEQ ID NO: 2844112 - RNA, 18 nt, Human
ccugguuucacuggccca

SEQ ID NO: 2844113 - RNA, 21 nt, Human
ccugguuucauaacuuccugu

SEQ ID NO: 2844114 - RNA, 17 nt, Human
ccugguuucacuggccc

SEQ ID NO: 2844115 - RNA, 14 nt, Human
ccugguuuccugcc

SEQ ID NO: 2844116 - RNA, 13 nt, Human
ccugguuuccugc

SEQ ID NO: 2844117 - RNA, 16 nt, Human
ccuguaagaaacagag

SEQ ID NO: 2844118 - RNA, 15 nt, Human
ccuguaagccaaaga

SEQ ID NO: 2844119 - RNA, 16 nt, Human
ccuguaagccaaagaa

SEQ ID NO: 2844120 - RNA, 17 nt, Human
ccuguaagccaaagaaa

SEQ ID NO: 2844121 - RNA, 18 nt, Human
ccuguaagccaaagaaau

SEQ ID NO: 2844122 - RNA, 23 nt, Human
ccuguaagccaaagaaaugaaca

SEQ ID NO: 2844123 - RNA, 14 nt, Human
ccuguaagccugca

SEQ ID NO: 2844124 - RNA, 16 nt, Human
ccuguaagccugcaag

SEQ ID NO: 2844125 - RNA, 19 nt, Human
ccuguaagccugcaagccu

SEQ ID NO: 2844126 - RNA, 15 nt, Human
ccugguuuccugccc

SEQ ID NO: 2844127 - RNA, 13 nt, Human
ccuggggccugag

SEQ ID NO: 2844128 - RNA, 14 nt, Human
ccuggggccugaga

SEQ ID NO: 2844129 - RNA, 15 nt, Human
ccuggggccugagag

SEQ ID NO: 2844130 - RNA, 16 nt, Human
ccuggggccugagaga

SEQ ID NO: 2844131 - RNA, 17 nt, Human
ccuggggccugagagaa

SEQ ID NO: 2844132 - RNA, 12 nt, Human
ccuggggccugg

SEQ ID NO: 2844133 - RNA, 16 nt, Human
ccuggggccuggaccu

SEQ ID NO: 2844134 - RNA, 17 nt, Human
ccuggggccuggaccug

SEQ ID NO: 2844135 - RNA, 18 nt, Human
ccuggggccuggaccugc

SEQ ID NO: 2844136 - RNA, 19 nt, Human
ccuggggccuggaccugcc

SEQ ID NO: 2844137 - RNA, 21 nt, Human
ccuggggccuggaccugccuc

SEQ ID NO: 2844138 - RNA, 13 nt, Human
ccuggggccuggc

SEQ ID NO: 2844139 - RNA, 14 nt, Human
ccuggggccuggca

SEQ ID NO: 2844140 - RNA, 15 nt, Human
ccuggggccuggcag

SEQ ID NO: 2844141 - RNA, 16 nt, Human
ccuggggccuggcagg

SEQ ID NO: 2844142 - RNA, 14 nt, Human
ccuggggcuggcuu

SEQ ID NO: 2844143 - RNA, 15 nt, Human
ccuggggcuggcuuu

SEQ ID NO: 2844144 - RNA, 12 nt, Human
ccuggggcuggg

SEQ ID NO: 2844145 - RNA, 13 nt, Human
ccuggggcugggc

SEQ ID NO: 2844146 - RNA, 14 nt, Human
ccuggggcugggcc

SEQ ID NO: 2844147 - RNA, 15 nt, Human
ccuggggcugggccc

SEQ ID NO: 2844148 - RNA, 17 nt, Human
ccuggggcugggccccc

SEQ ID NO: 2844149 - RNA, 21 nt, Human
ccugguggcagugggagcugc

SEQ ID NO: 2844150 - RNA, 18 nt, Human
ccugggggaguuuuccuc

SEQ ID NO: 2844151 - RNA, 19 nt, Human
ccugggggaguuuuccucu

SEQ ID NO: 2844152 - RNA, 20 nt, Human
ccugggggaguuuuccucua

SEQ ID NO: 2844153 - RNA, 12 nt, Human
ccuggggccagg

SEQ ID NO: 2844154 - RNA, 13 nt, Human
ccuggggccaggc

SEQ ID NO: 2844155 - RNA, 14 nt, Human
ccuggggccaggcc

SEQ ID NO: 2844156 - RNA, 15 nt, Human
ccuggggccaggccg

SEQ ID NO: 2844157 - RNA, 16 nt, Human
ccuggggccaggccgg

SEQ ID NO: 2844158 - RNA, 13 nt, Human
ccuggccucugug

SEQ ID NO: 2844159 - RNA, 14 nt, Human
ccugggccccagcu

SEQ ID NO: 2844160 - RNA, 20 nt, Human
ccugggccccaguuguauuu

SEQ ID NO: 2844161 - RNA, 21 nt, Human
ccuggccgcguuuagaccaag

SEQ ID NO: 2844162 - RNA, 21 nt, Human
ccuggccgcccccugcccccc

SEQ ID NO: 2844163 - RNA, 22 nt, Human
ccuggccgcccccugcccccca

SEQ ID NO: 2844164 - RNA, 12 nt, Human
ccuggccggcca

SEQ ID NO: 2844165 - RNA, 13 nt, Human
ccuggccggccag

SEQ ID NO: 2844166 - RNA, 14 nt, Human
ccuggccggccagc

SEQ ID NO: 2844167 - RNA, 15 nt, Human
ccuggccggccagcc

SEQ ID NO: 2844168 - RNA, 16 nt, Human
ccuggccggccagcca

SEQ ID NO: 2844169 - RNA, 18 nt, Human
ccuggccggccagccagc

SEQ ID NO: 2844170 - RNA, 22 nt, Human
ccuggccggccagccagccacu

SEQ ID NO: 2844171 - RNA, 23 nt, Human
ccuggccggccagccagccacuc

SEQ ID NO: 2844172 - RNA, 20 nt, Human
ccugaccaacaguuccuuca

SEQ ID NO: 2844173 - RNA, 18 nt, Human
ccugagucacccaugaag

SEQ ID NO: 2844174 - RNA, 15 nt, Human
ccugagucacccaug

SEQ ID NO: 2844175 - RNA, 21 nt, Human
ccugaguagcugggauuacag

SEQ ID NO: 2844176 - RNA, 17 nt, Human
ccugcacuugcagacuc

SEQ ID NO: 2844177 - RNA, 16 nt, Human
ccugcacuugcagacu

SEQ ID NO: 2844178 - RNA, 23 nt, Human
ccugaguccaagaggguccuuua

SEQ ID NO: 2844179 - RNA, 23 nt, Human
ccugagucacccuaccugugccu

SEQ ID NO: 2844180 - RNA, 16 nt, Human
ccugagucagggccca

SEQ ID NO: 2844181 - RNA, 17 nt, Human
ccugagucagggcccag

SEQ ID NO: 2844182 - RNA, 18 nt, Human
ccugagucagggcccaga

SEQ ID NO: 2844183 - RNA, 20 nt, Human
ccugagucagggcccagagg

SEQ ID NO: 2844184 - RNA, 21 nt, Human
ccugagucagggcccagaggc

SEQ ID NO: 2844185 - RNA, 23 nt, Human
ccugagucagggcccagaggcug

SEQ ID NO: 2844186 - RNA, 18 nt, Human
ccugcacuugcagacucu

SEQ ID NO: 2844187 - RNA, 20 nt, Human
ccugcagaugccacccuagc

SEQ ID NO: 2844188 - RNA, 15 nt, Human
ccugcagaugccacc

SEQ ID NO: 2844189 - RNA, 14 nt, Human
ccugcagaugccac

SEQ ID NO: 2844190 - RNA, 13 nt, Human
ccugcagaugcca

SEQ ID NO: 2844191 - RNA, 16 nt, Human
ccugcagaguuuggau

SEQ ID NO: 2844192 - RNA, 19 nt, Human
ccugcagaggggaaaccag

SEQ ID NO: 2844193 - RNA, 21 nt, Human
ccugcagaugccacccuagcc

SEQ ID NO: 2844194 - RNA, 22 nt, Human
ccugcagccuccuccaccucac

SEQ ID NO: 2844195 - RNA, 22 nt, Human
ccugcagccccgcgccuccuuc

SEQ ID NO: 2844196 - RNA, 15 nt, Human
ccugcagcacggaca

SEQ ID NO: 2844197 - RNA, 16 nt, Human
ccugcagcacggacaa

SEQ ID NO: 2844198 - RNA, 21 nt, Human
ccugcagcacggacaauaaac

SEQ ID NO: 2844199 - RNA, 23 nt, Human
ccugcagcacggacaauaaaccu

SEQ ID NO: 2844200 - RNA, 16 nt, Human
ccugcagcaugguccc

SEQ ID NO: 2844201 - RNA, 17 nt, Human
ccugcagcauggucccu

SEQ ID NO: 2844202 - RNA, 18 nt, Human
ccugcagcauggucccug

SEQ ID NO: 2844203 - RNA, 19 nt, Human
ccugcagcauggucccugc

SEQ ID NO: 2844204 - RNA, 22 nt, Human
ccugcagcauggucccugccuu

SEQ ID NO: 2844205 - RNA, 23 nt, Human
ccugcagcauggucccugccuua

SEQ ID NO: 2844206 - RNA, 13 nt, Human
ccugcagccagcu

SEQ ID NO: 2844207 - RNA, 23 nt, Human
ccugccucgaacuggcugcaaag

SEQ ID NO: 2844208 - RNA, 21 nt, Human
ccugccucgaacuggcugcaa

SEQ ID NO: 2844209 - RNA, 19 nt, Human
ccugccucgaacuggcugc

SEQ ID NO: 2844210 - RNA, 12 nt, Human
ccugccuccugc

SEQ ID NO: 2844211 - RNA, 22 nt, Human
ccugcugccuucugacggcccu

SEQ ID NO: 2844212 - RNA, 22 nt, Human
ccugcugccgccucccagccug

SEQ ID NO: 2844213 - RNA, 17 nt, Human
ccugccucucacacaca

SEQ ID NO: 2844214 - RNA, 23 nt, Human
ccugcugccgccucccagccugg

SEQ ID NO: 2844215 - RNA, 12 nt, Human
ccugcccaccug

SEQ ID NO: 2844216 - RNA, 13 nt, Human
ccugcccaccugc

SEQ ID NO: 2844217 - RNA, 14 nt, Human
ccugcccaccugcc

SEQ ID NO: 2844218 - RNA, 15 nt, Human
ccugcccaccugccu

SEQ ID NO: 2844219 - RNA, 16 nt, Human
ccugcccaccugccug

SEQ ID NO: 2844220 - RNA, 17 nt, Human
ccugcccaccugccugg

SEQ ID NO: 2844221 - RNA, 18 nt, Human
ccugcccaccugccuggc

SEQ ID NO: 2844222 - RNA, 19 nt, Human
ccugcccaccugccuggcc

SEQ ID NO: 2844223 - RNA, 13 nt, Human
ccugcccaggccc

SEQ ID NO: 2844224 - RNA, 20 nt, Human
ccugccccaaucccuuuauu

SEQ ID NO: 2844225 - RNA, 17 nt, Human
ccugcccacugcugcag

SEQ ID NO: 2844226 - RNA, 17 nt, Human
ccugccccagggcuccc

SEQ ID NO: 2844227 - RNA, 15 nt, Human
ccucauggccccucu

SEQ ID NO: 2844228 - RNA, 16 nt, Human
ccucauggccccucug

SEQ ID NO: 2844229 - RNA, 19 nt, Human
ccucagcugccucacuucc

SEQ ID NO: 2844230 - RNA, 20 nt, Human
ccucagcugccucacuuccu

SEQ ID NO: 2844231 - RNA, 13 nt, Human
ccucaggacugca

SEQ ID NO: 2844232 - RNA, 18 nt, Human
ccucaggacugcaacagg

SEQ ID NO: 2844233 - RNA, 12 nt, Human
ccucaggaaaga

SEQ ID NO: 2844234 - RNA, 13 nt, Human
ccucaggaaagaa

SEQ ID NO: 2844235 - RNA, 16 nt, Human
ccucaggaaagaauag

SEQ ID NO: 2844236 - RNA, 18 nt, Human
ccucaggaaagaauagaa

SEQ ID NO: 2844237 - RNA, 19 nt, Human
ccucaggaaagaauagaaa

SEQ ID NO: 2844238 - RNA, 21 nt, Human
ccucaggaaagaauagaaaga

SEQ ID NO: 2844239 - RNA, 16 nt, Human
ccucaaaggcccgcuc

SEQ ID NO: 2844240 - RNA, 13 nt, Human
ccucaaacacugc

SEQ ID NO: 2844241 - RNA, 15 nt, Human
ccucaaacacugcag

SEQ ID NO: 2844242 - RNA, 14 nt, Human
ccuauuuuuguaaa

SEQ ID NO: 2844243 - RNA, 13 nt, Human
ccuauuuuuguag

SEQ ID NO: 2844244 - RNA, 17 nt, Human
ccucaaacacugcaggc

SEQ ID NO: 2844245 - RNA, 18 nt, Human
ccucaaacacugcaggca

SEQ ID NO: 2844246 - RNA, 21 nt, Human
ccucaaacacugcaggcauca

SEQ ID NO: 2844247 - RNA, 23 nt, Human
ccucauuuuugaauacaggcaua

SEQ ID NO: 2844248 - RNA, 19 nt, Human
ccucaugguggguucaggg

SEQ ID NO: 2844249 - RNA, 21 nt, Human
ccucauguacauacccuggcc

SEQ ID NO: 2844250 - RNA, 18 nt, Human
ccucauggccccucugac

SEQ ID NO: 2844251 - RNA, 22 nt, Human
ccucauggccccucugaccugc

SEQ ID NO: 2844252 - RNA, 23 nt, Human
ccuccaacacaaggcuccaagac

SEQ ID NO: 2844253 - RNA, 16 nt, Human
ccuccaaaggcccccu

SEQ ID NO: 2844254 - RNA, 17 nt, Human
ccuccaaaggcccccua

SEQ ID NO: 2844255 - RNA, 17 nt, Human
ccucccaccucagccuc

SEQ ID NO: 2844256 - RNA, 15 nt, Human
ccucccaccucagcc

SEQ ID NO: 2844257 - RNA, 12 nt, Human
ccucccaccccc

SEQ ID NO: 2844258 - RNA, 13 nt, Human
ccucccaccccca

SEQ ID NO: 2844259 - RNA, 13 nt, Human
ccucccacccccu

SEQ ID NO: 2844260 - RNA, 17 nt, Human
ccucccacccccaucuc

SEQ ID NO: 2844261 - RNA, 21 nt, Human
ccucccacccccuucucugcu

SEQ ID NO: 2844262 - RNA, 20 nt, Human
ccucccacccccuucucugc

SEQ ID NO: 2844263 - RNA, 14 nt, Human
ccucccauccccug

SEQ ID NO: 2844264 - RNA, 17 nt, Human
ccucccauccccuggac

SEQ ID NO: 2844265 - RNA, 14 nt, Human
ccggccccugcugg

SEQ ID NO: 2844266 - RNA, 17 nt, Human
ccggcgagcccugugga

SEQ ID NO: 2844267 - RNA, 20 nt, Human
ccggcgccuggccuccaggc

SEQ ID NO: 2844268 - RNA, 15 nt, Human
ccggcgagcccugug

SEQ ID NO: 2844269 - RNA, 16 nt, Human
cccugucuugcuguca

SEQ ID NO: 2844270 - RNA, 13 nt, Human
cccugucuugucc

SEQ ID NO: 2844271 - RNA, 19 nt, Human
cccugucuuuacuccucac

SEQ ID NO: 2844272 - RNA, 20 nt, Human
cccugucuuuacuccucaca

SEQ ID NO: 2844273 - RNA, 14 nt, Human
cccugucuuuccua

SEQ ID NO: 2844274 - RNA, 23 nt, Human
cccugucuuuccuaagaccuggg

SEQ ID NO: 2844275 - RNA, 14 nt, Human
cccugugacaaaau

SEQ ID NO: 2844276 - RNA, 13 nt, Human
cccuucgcuccug

SEQ ID NO: 2844277 - RNA, 16 nt, Human
cccuucucugcuccac

SEQ ID NO: 2844278 - RNA, 15 nt, Human
cccuucucugcucca

SEQ ID NO: 2844279 - RNA, 14 nt, Human
cccuucucugcucc

SEQ ID NO: 2844280 - RNA, 13 nt, Human
cccuucucugcuc

SEQ ID NO: 2844281 - RNA, 14 nt, Human
ccgcagcccuggca

SEQ ID NO: 2844282 - RNA, 14 nt, Human
ccgcagccucccuc

SEQ ID NO: 2844283 - RNA, 23 nt, Human
cccuucucugcuccaccacaucc

SEQ ID NO: 2844284 - RNA, 20 nt, Human
cccuucucugcuccaccaca

SEQ ID NO: 2844285 - RNA, 17 nt, Human
cccuucucugcuccacc

SEQ ID NO: 2844286 - RNA, 15 nt, Human
cccuucgcuccugug

SEQ ID NO: 2844287 - RNA, 14 nt, Human
cccuucgcuccugu

SEQ ID NO: 2844288 - RNA, 21 nt, Human
cccuucucucccugccagagg

SEQ ID NO: 2844289 - RNA, 22 nt, Human
ccgcaggcagacuacacaggau

SEQ ID NO: 2844290 - RNA, 13 nt, Human
ccggccccugcug

SEQ ID NO: 2844291 - RNA, 14 nt, Human
ccggcccccugccc

SEQ ID NO: 2844292 - RNA, 13 nt, Human
ccggcccccuggu

SEQ ID NO: 2844293 - RNA, 15 nt, Human
ccggcccccuggucu

SEQ ID NO: 2844294 - RNA, 19 nt, Human
ccggcccccuggucucugg

SEQ ID NO: 2844295 - RNA, 20 nt, Human
ccggcccccuggucucuggu

SEQ ID NO: 2844296 - RNA, 18 nt, Human
ccauugaucauaaacuga

SEQ ID NO: 2844297 - RNA, 18 nt, Human
ccauuuacgugucugaau

SEQ ID NO: 2844298 - RNA, 16 nt, Human
ccauuuauauaugaaa

SEQ ID NO: 2844299 - RNA, 18 nt, Human
ccauuuauauaugaaaac

SEQ ID NO: 2844300 - RNA, 21 nt, Human
ccauuucgugagccccaucuu

SEQ ID NO: 2844301 - RNA, 22 nt, Human
ccauuucgugagccccaucuuc

SEQ ID NO: 2844302 - RNA, 13 nt, Human
ccauuuccugaga

SEQ ID NO: 2844303 - RNA, 21 nt, Human
ccauuucuaccaaggcauauc

SEQ ID NO: 2844304 - RNA, 19 nt, Human
ccauucuuuuuuucuuggc

SEQ ID NO: 2844305 - RNA, 15 nt, Human
ccaugggccuccugu

SEQ ID NO: 2844306 - RNA, 14 nt, Human
ccaugggccuccug

SEQ ID NO: 2844307 - RNA, 20 nt, Human
ccauaauuuuuuuuuuccuu

SEQ ID NO: 2844308 - RNA, 16 nt, Human
ccauaaccgcugauuc

SEQ ID NO: 2844309 - RNA, 17 nt, Human
ccauaaccgcugauucu

SEQ ID NO: 2844310 - RNA, 22 nt, Human
ccauaaccgcugauucucaggg

SEQ ID NO: 2844311 - RNA, 19 nt, Human
ccauacacccccucuucug

SEQ ID NO: 2844312 - RNA, 14 nt, Human
ccauacacccccuc

SEQ ID NO: 2844313 - RNA, 16 nt, Human
ccaucccacacccugg

SEQ ID NO: 2844314 - RNA, 16 nt, Human
ccaucccaaccagugc

SEQ ID NO: 2844315 - RNA, 17 nt, Human
ccaucccaaccagugcc

SEQ ID NO: 2844316 - RNA, 18 nt, Human
ccaucccaaccagugcca

SEQ ID NO: 2844317 - RNA, 20 nt, Human
ccaucccaaccagugccaag

SEQ ID NO: 2844318 - RNA, 21 nt, Human
ccaucccaaccagugccaagg

SEQ ID NO: 2844319 - RNA, 22 nt, Human
ccaucccaaccagugccaagga

SEQ ID NO: 2844320 - RNA, 23 nt, Human
ccaucccaaccagugccaaggac

SEQ ID NO: 2844321 - RNA, 14 nt, Human
ccaucccacacccu

SEQ ID NO: 2844322 - RNA, 12 nt, Human
ccaucccacacc

SEQ ID NO: 2844323 - RNA, 17 nt, Human
ccauaaauccaguucua

SEQ ID NO: 2844324 - RNA, 15 nt, Human
ccauaaccacugaag

SEQ ID NO: 2844325 - RNA, 13 nt, Human
ccaugggccuccu

SEQ ID NO: 2844326 - RNA, 19 nt, Human
ccaugagccucagcauccu

SEQ ID NO: 2844327 - RNA, 18 nt, Human
ccaugagccucagcaucc

SEQ ID NO: 2844328 - RNA, 14 nt, Human
ccaugagccucagc

SEQ ID NO: 2844329 - RNA, 13 nt, Human
ccaugagccucag

SEQ ID NO: 2844330 - RNA, 20 nt, Human
ccauccgguuugccauguug

SEQ ID NO: 2844331 - RNA, 23 nt, Human
ccauccgguuugccauguugcca

SEQ ID NO: 2844332 - RNA, 15 nt, Human
ccauccuaaaagcca

SEQ ID NO: 2844333 - RNA, 15 nt, Human
ccaucccugccuggu

SEQ ID NO: 2844334 - RNA, 16 nt, Human
ccaucccugccugguc

SEQ ID NO: 2844335 - RNA, 15 nt, Human
ccauccccuggacug

SEQ ID NO: 2844336 - RNA, 12 nt, Human
ccaucccugccu

SEQ ID NO: 2844337 - RNA, 13 nt, Human
ccaucccugccug

SEQ ID NO: 2844338 - RNA, 14 nt, Human
ccaucccugccugg

SEQ ID NO: 2844339 - RNA, 12 nt, Human
ccaucccuguga

SEQ ID NO: 2844340 - RNA, 13 nt, Human
ccaucccugugag

SEQ ID NO: 2844341 - RNA, 17 nt, Human
ccaucccugccugguca

SEQ ID NO: 2844342 - RNA, 13 nt, Human
ccauccccuggac

SEQ ID NO: 2844343 - RNA, 16 nt, Human
ccagucaagaagaaaa

SEQ ID NO: 2844344 - RNA, 13 nt, Human
ccagucacaugac

SEQ ID NO: 2844345 - RNA, 14 nt, Human
ccagucacaugacc

SEQ ID NO: 2844346 - RNA, 21 nt, Human
ccagucacaugaccugaucac

SEQ ID NO: 2844347 - RNA, 20 nt, Human
ccagggggacuagccccugu

SEQ ID NO: 2844348 - RNA, 23 nt, Human
ccagggggacuagccccugugga

SEQ ID NO: 2844349 - RNA, 18 nt, Human
ccagggggaaggccaagg

SEQ ID NO: 2844350 - RNA, 19 nt, Human
ccagggggaaggccaaggg

SEQ ID NO: 2844351 - RNA, 17 nt, Human
ccagggggacuagcccc

SEQ ID NO: 2844352 - RNA, 18 nt, Human
ccagggggacuagccccu

SEQ ID NO: 2844353 - RNA, 19 nt, Human
ccagggggacuagccccug

SEQ ID NO: 2844354 - RNA, 18 nt, Human
ccagggggaugccacucc

SEQ ID NO: 2844355 - RNA, 14 nt, Human
ccagucccccugcc

SEQ ID NO: 2844356 - RNA, 14 nt, Human
ccagucccccuauc

SEQ ID NO: 2844357 - RNA, 15 nt, Human
ccagucccccuaucc

SEQ ID NO: 2844358 - RNA, 18 nt, Human
ccagucccccuauccuug

SEQ ID NO: 2844359 - RNA, 15 nt, Human
ccaguccccagcccu

SEQ ID NO: 2844360 - RNA, 13 nt, Human
ccaggauuucuaa

SEQ ID NO: 2844361 - RNA, 17 nt, Human
ccaggauuugcacagaa

SEQ ID NO: 2844362 - RNA, 18 nt, Human
ccaggauuugcugggaga

SEQ ID NO: 2844363 - RNA, 17 nt, Human
ccaggcaacuugggaac

SEQ ID NO: 2844364 - RNA, 21 nt, Human
ccaggcaacuucaguccuggg

SEQ ID NO: 2844365 - RNA, 20 nt, Human
ccaggaguucgaggcugcag

SEQ ID NO: 2844366 - RNA, 22 nt, Human
ccaggauguacaaggacagccc

SEQ ID NO: 2844367 - RNA, 18 nt, Human
ccaggaggucgaccccaa

SEQ ID NO: 2844368 - RNA, 22 nt, Human
ccaggaggugggagugaggagc

SEQ ID NO: 2844369 - RNA, 21 nt, Human
ccaggagguuuuuuugucaac

SEQ ID NO: 2844370 - RNA, 17 nt, Human
ccaggagggcauccaua

SEQ ID NO: 2844371 - RNA, 18 nt, Human
ccaggagggcauccauac

SEQ ID NO: 2844372 - RNA, 20 nt, Human
ccaggagggcauccauacca

SEQ ID NO: 2844373 - RNA, 17 nt, Human
ccaggaggggaacacug

SEQ ID NO: 2844374 - RNA, 20 nt, Human
ccaggaggggaacacugccc

SEQ ID NO: 2844375 - RNA, 21 nt, Human
ccaggaggggaacacugcccu

SEQ ID NO: 2844376 - RNA, 22 nt, Human
ccaggaggggaacacugcccuc

SEQ ID NO: 2844377 - RNA, 14 nt, Human
ccagcucagaaccc

SEQ ID NO: 2844378 - RNA, 15 nt, Human
ccagcucagaaccca

SEQ ID NO: 2844379 - RNA, 16 nt, Human
ccagcucagaacccag

SEQ ID NO: 2844380 - RNA, 17 nt, Human
ccagcucagaacccagg

SEQ ID NO: 2844381 - RNA, 18 nt, Human
ccagcucagaacccaggg

SEQ ID NO: 2844382 - RNA, 19 nt, Human
ccagcucagaacccagggc

SEQ ID NO: 2844383 - RNA, 20 nt, Human
ccagcucagaacccagggcu

SEQ ID NO: 2844384 - RNA, 21 nt, Human
ccagcucagaacccagggcuc

SEQ ID NO: 2844385 - RNA, 15 nt, Human
ccagcucagucccau

SEQ ID NO: 2844386 - RNA, 11 nt, Human
ccagcucaggg

SEQ ID NO: 2844387 - RNA, 14 nt, Human
ccagcucaggggca

SEQ ID NO: 2844388 - RNA, 15 nt, Human
ccagcucaggggcag

SEQ ID NO: 2844389 - RNA, 18 nt, Human
ccagcucaggggcagcuc

SEQ ID NO: 2844390 - RNA, 19 nt, Human
ccagcucaggggcagcuca

SEQ ID NO: 2844391 - RNA, 14 nt, Human
ccagcuaaauaauc

SEQ ID NO: 2844392 - RNA, 18 nt, Human
ccagcuugaaaccuucac

SEQ ID NO: 2844393 - RNA, 22 nt, Human
ccagcucagucccaucagagag

SEQ ID NO: 2844394 - RNA, 12 nt, Human
ccagcucauuca

SEQ ID NO: 2844395 - RNA, 13 nt, Human
ccaggaacaagcu

SEQ ID NO: 2844396 - RNA, 21 nt, Human
ccacucugcucgccuuagcac

SEQ ID NO: 2844397 - RNA, 17 nt, Human
ccacucuccccacacua

SEQ ID NO: 2844398 - RNA, 13 nt, Human
ccacucucuuccc

SEQ ID NO: 2844399 - RNA, 14 nt, Human
ccacucucuucccu

SEQ ID NO: 2844400 - RNA, 15 nt, Human
ccacucucuucccuu

SEQ ID NO: 2844401 - RNA, 23 nt, Human
ccacucucuucccuuuccccagc

SEQ ID NO: 2844402 - RNA, 15 nt, Human
ccacucugauagaau

SEQ ID NO: 2844403 - RNA, 17 nt, Human
ccacucucuaccagaua

SEQ ID NO: 2844404 - RNA, 16 nt, Human
ccccugcaaagcccag

SEQ ID NO: 2844405 - RNA, 13 nt, Human
ccccugcagcacg

SEQ ID NO: 2844406 - RNA, 14 nt, Human
ccccugcagcacgg

SEQ ID NO: 2844407 - RNA, 16 nt, Human
ccccugcagcacggac

SEQ ID NO: 2844408 - RNA, 20 nt, Human
ccccugcagcacggacaaua

SEQ ID NO: 2844409 - RNA, 22 nt, Human
ccccugcagcacggacaauaaa

SEQ ID NO: 2844410 - RNA, 13 nt, Human
ccccugagcccca

SEQ ID NO: 2844411 - RNA, 11 nt, Human
ccccugcagcu

SEQ ID NO: 2844412 - RNA, 18 nt, Human
ccccugaccucacuguga

SEQ ID NO: 2844413 - RNA, 17 nt, Human
ccccugagauccccuga

SEQ ID NO: 2844414 - RNA, 19 nt, Human
ccccugagauccccugagc

SEQ ID NO: 2844415 - RNA, 20 nt, Human
ccccugagauccccugagcc

SEQ ID NO: 2844416 - RNA, 14 nt, Human
ccccugacucauca

SEQ ID NO: 2844417 - RNA, 15 nt, Human
ccccugcaaagccca

SEQ ID NO: 2844418 - RNA, 17 nt, Human
ccccuucgcuccugugu

SEQ ID NO: 2844419 - RNA, 15 nt, Human
ccccuucgcuccugu

SEQ ID NO: 2844420 - RNA, 14 nt, Human
ccccuucgcuccug

SEQ ID NO: 2844421 - RNA, 19 nt, Human
ccccuucgcuccugugucu

SEQ ID NO: 2844422 - RNA, 21 nt, Human
ccccuucuacauuucuuagac

SEQ ID NO: 2844423 - RNA, 16 nt, Human
ccccuucucucccugc

SEQ ID NO: 2844424 - RNA, 21 nt, Human
ccccuucucucccugccagag

SEQ ID NO: 2844425 - RNA, 13 nt, Human
ccccuuccuuuua

SEQ ID NO: 2844426 - RNA, 22 nt, Human
ccccuucuagguggcaaggcug

SEQ ID NO: 2844427 - RNA, 14 nt, Human
ccccauucugccug

SEQ ID NO: 2844428 - RNA, 13 nt, Human
ccccauucugccu

SEQ ID NO: 2844429 - RNA, 15 nt, Human
ccccauucugccugc

SEQ ID NO: 2844430 - RNA, 15 nt, Human
ccccaugaggaagga

SEQ ID NO: 2844431 - RNA, 19 nt, Human
ccccaucuucgggaccagg

SEQ ID NO: 2844432 - RNA, 18 nt, Human
ccccaucuucgggaccag

SEQ ID NO: 2844433 - RNA, 16 nt, Human
ccccaucuucgggacc

SEQ ID NO: 2844434 - RNA, 13 nt, Human
ccccaucugugca

SEQ ID NO: 2844435 - RNA, 21 nt, Human
ccccaucugugcauucuccug

SEQ ID NO: 2844436 - RNA, 16 nt, Human
ccccaucuucacccag

SEQ ID NO: 2844437 - RNA, 17 nt, Human
ccccaucuucacccagg

SEQ ID NO: 2844438 - RNA, 22 nt, Human
ccccaugccaaagcuagggugg

SEQ ID NO: 2844439 - RNA, 16 nt, Human
ccccaugccacguucc

SEQ ID NO: 2844440 - RNA, 13 nt, Human
ccccaugccaaag

SEQ ID NO: 2844441 - RNA, 22 nt, Human
ccccauucgcgcucugcucagu

SEQ ID NO: 2844442 - RNA, 13 nt, Human
ccccauucucauc

SEQ ID NO: 2844443 - RNA, 16 nt, Human
ccccauucucaucugc

SEQ ID NO: 2844444 - RNA, 18 nt, Human
ccccaugaggaaggaaca

SEQ ID NO: 2844445 - RNA, 13 nt, Human
ccccaugcagucu

SEQ ID NO: 2844446 - RNA, 20 nt, Human
cccuaugaaguaaagaacug

SEQ ID NO: 2844447 - RNA, 22 nt, Human
cccuaugaaguaaagaacugca

SEQ ID NO: 2844448 - RNA, 17 nt, Human
cccuaucuccugacaga

SEQ ID NO: 2844449 - RNA, 16 nt, Human
cccuaucuccugacag

SEQ ID NO: 2844450 - RNA, 15 nt, Human
cccuaucuccugaca

SEQ ID NO: 2844451 - RNA, 14 nt, Human
cccuaucuccugac

SEQ ID NO: 2844452 - RNA, 13 nt, Human
cccuaucuccuga

SEQ ID NO: 2844453 - RNA, 14 nt, Human
cccuauccuuggca

SEQ ID NO: 2844454 - RNA, 16 nt, Human
cccuauccuuggcacc

SEQ ID NO: 2844455 - RNA, 19 nt, Human
cccuauccuuggcaccaaa

SEQ ID NO: 2844456 - RNA, 22 nt, Human
cccuaucuccugacagaaggug

SEQ ID NO: 2844457 - RNA, 20 nt, Human
cccuaucuccugacagaagg

SEQ ID NO: 2844458 - RNA, 12 nt, Human
cccucacagccu

SEQ ID NO: 2844459 - RNA, 17 nt, Human
cccucacacauccagac

SEQ ID NO: 2844460 - RNA, 17 nt, Human
cccucacucugccaggg

SEQ ID NO: 2844461 - RNA, 18 nt, Human
cccucacucugccagggc

SEQ ID NO: 2844462 - RNA, 20 nt, Human
cccucacucugccagggcag

SEQ ID NO: 2844463 - RNA, 21 nt, Human
cccucacucugccagggcagu

SEQ ID NO: 2844464 - RNA, 14 nt, Human
cccucacucuggcc

SEQ ID NO: 2844465 - RNA, 16 nt, Human
cccucacucuggccuc

SEQ ID NO: 2844466 - RNA, 12 nt, Human
cccggcugcgga

SEQ ID NO: 2844467 - RNA, 13 nt, Human
cccggcugcccuu

SEQ ID NO: 2844468 - RNA, 12 nt, Human
cccggcugcccu

SEQ ID NO: 2844469 - RNA, 22 nt, Human
cccuauccuacuuccccuuccu

SEQ ID NO: 2844470 - RNA, 20 nt, Human
cccggcuuccuuucccaagc

SEQ ID NO: 2844471 - RNA, 20 nt, Human
ccccuugccaccccacccuc

SEQ ID NO: 2844472 - RNA, 14 nt, Human
ccccuugccacccc

SEQ ID NO: 2844473 - RNA, 21 nt, Human
ccccuugauuuaaacacacag

SEQ ID NO: 2844474 - RNA, 15 nt, Human
cccucagagugcaag

SEQ ID NO: 2844475 - RNA, 14 nt, Human
cccucagauguccc

SEQ ID NO: 2844476 - RNA, 16 nt, Human
cccucagaugucccuu

SEQ ID NO: 2844477 - RNA, 13 nt, Human
cccucagagccac

SEQ ID NO: 2844478 - RNA, 9 nt, Human
cccucagaa

SEQ ID NO: 2844479 - RNA, 18 nt, Human
cccucagaacccuuggcu

SEQ ID NO: 2844480 - RNA, 17 nt, Human
cccucagaacccuuggc

SEQ ID NO: 2844481 - RNA, 23 nt, Human
cccucagaacccuuggcuugccc

SEQ ID NO: 2844482 - RNA, 22 nt, Human
cccucagaacccuuggcuugcc

SEQ ID NO: 2844483 - RNA, 21 nt, Human
cccucagaacccuuggcuugc

SEQ ID NO: 2844484 - RNA, 21 nt, Human
cccaggcuggcgugcaguggu

SEQ ID NO: 2844485 - RNA, 23 nt, Human
cccaggaauuugggacccugcuu

SEQ ID NO: 2844486 - RNA, 19 nt, Human
cccaggacaccacacccag

SEQ ID NO: 2844487 - RNA, 21 nt, Human
cccagggcuacccucccccag

SEQ ID NO: 2844488 - RNA, 13 nt, Human
cccaggcugggca

SEQ ID NO: 2844489 - RNA, 19 nt, Human
cccaggcugggcaaggagg

SEQ ID NO: 2844490 - RNA, 15 nt, Human
cccagggcuacccuc

SEQ ID NO: 2844491 - RNA, 16 nt, Human
cccaggcuggucucaa

SEQ ID NO: 2844492 - RNA, 16 nt, Human
cccaggcuggucuuga

SEQ ID NO: 2844493 - RNA, 23 nt, Human
cccaggcuggucuugaaguccug

SEQ ID NO: 2844494 - RNA, 21 nt, Human
cccaggcugugcagcgcagcu

SEQ ID NO: 2844495 - RNA, 22 nt, Human
cccaggcugugcagcgcagcug

SEQ ID NO: 2844496 - RNA, 23 nt, Human
cccaggcugugcagcgcagcugg

SEQ ID NO: 2844497 - RNA, 12 nt, Human
cccaggcugggc

SEQ ID NO: 2844498 - RNA, 23 nt, Human
cccagcugugcucuggacaggca

SEQ ID NO: 2844499 - RNA, 21 nt, Human
cccagcugugcucuggacagg

SEQ ID NO: 2844500 - RNA, 21 nt, Human
cccaggaagcccaggagggca

SEQ ID NO: 2844501 - RNA, 15 nt, Human
cccaggaacugggcc

SEQ ID NO: 2844502 - RNA, 19 nt, Human
cccagcugugagccuuggc

SEQ ID NO: 2844503 - RNA, 14 nt, Human
cccagcccacuucu

SEQ ID NO: 2844504 - RNA, 18 nt, Human
cccagcugugagccuugg

SEQ ID NO: 2844505 - RNA, 13 nt, Human
cccagcccaaagg

SEQ ID NO: 2844506 - RNA, 19 nt, Human
cccagcccaaaggggacag

SEQ ID NO: 2844507 - RNA, 22 nt, Human
cccagccauuaccauggagaca

SEQ ID NO: 2844508 - RNA, 20 nt, Human
cccagccauuaccauggaga

SEQ ID NO: 2844509 - RNA, 19 nt, Human
cccagccauuaccauggag

SEQ ID NO: 2844510 - RNA, 12 nt, Human
cccagcccaauc

SEQ ID NO: 2844511 - RNA, 19 nt, Human
cccagcccaauccagguac

SEQ ID NO: 2844512 - RNA, 12 nt, Human
cccagcacuuug

SEQ ID NO: 2844513 - RNA, 18 nt, Human
cccagcacuuguguuguc

SEQ ID NO: 2844514 - RNA, 18 nt, Human
cccagccauuaccaugga

SEQ ID NO: 2844515 - RNA, 13 nt, Human
ccauuucuccaga

SEQ ID NO: 2844516 - RNA, 14 nt, Human
ccauuucuccagaa

SEQ ID NO: 2844517 - RNA, 13 nt, Human
ccauuucuccguu

SEQ ID NO: 2844518 - RNA, 19 nt, Human
ccauuuccucagcuuaucu

SEQ ID NO: 2844519 - RNA, 16 nt, Human
cccagggcucugcccc

SEQ ID NO: 2844520 - RNA, 17 nt, Human
cccagggcucugcccca

SEQ ID NO: 2844521 - RNA, 18 nt, Human
cccagggcucugccccag

SEQ ID NO: 2844522 - RNA, 19 nt, Human
cccagggcucugccccagu

SEQ ID NO: 2844523 - RNA, 17 nt, Human
cccagggcugucaucug

SEQ ID NO: 2844524 - RNA, 13 nt, Human
cccaguuguauuu

SEQ ID NO: 2844525 - RNA, 21 nt, Human
cccaguuuuuugaacauggaa

SEQ ID NO: 2844526 - RNA, 18 nt, Human
cccauaaaaauuuuuccu

SEQ ID NO: 2844527 - RNA, 14 nt, Human
cccauaacucaaug

SEQ ID NO: 2844528 - RNA, 22 nt, Human
cccauaauuuuuuuuuuccuuu

SEQ ID NO: 2844529 - RNA, 23 nt, Human
cccauaauuuuuuuuuuccuuuu

SEQ ID NO: 2844530 - RNA, 13 nt, Human
cccauacucagcc

SEQ ID NO: 2844531 - RNA, 14 nt, Human
cccauacucagccu

SEQ ID NO: 2844532 - RNA, 15 nt, Human
cccauacucagccug

SEQ ID NO: 2844533 - RNA, 22 nt, Human
cccauucugccugcccaggccc

SEQ ID NO: 2844534 - RNA, 21 nt, Human
cccauucugccugcccaggcc

SEQ ID NO: 2844535 - RNA, 20 nt, Human
cccauucugccugcccaggc

SEQ ID NO: 2844536 - RNA, 14 nt, Human
ccccaucugggucc

SEQ ID NO: 2844537 - RNA, 19 nt, Human
ccccaucuggguccuugca

SEQ ID NO: 2844538 - RNA, 20 nt, Human
ccccagcaagugagagcugg

SEQ ID NO: 2844539 - RNA, 19 nt, Human
ccccagcaagugagagcug

SEQ ID NO: 2844540 - RNA, 17 nt, Human
ccccagcaagugagagc

SEQ ID NO: 2844541 - RNA, 23 nt, Human
ccccagauugcaacaggcugggc

SEQ ID NO: 2844542 - RNA, 22 nt, Human
ccccagauugcaacaggcuggg

SEQ ID NO: 2844543 - RNA, 21 nt, Human
ccccagauugcaacaggcugg

SEQ ID NO: 2844544 - RNA, 19 nt, Human
cccauuucgugagccccau

SEQ ID NO: 2844545 - RNA, 20 nt, Human
cccauuucgugagccccauc

SEQ ID NO: 2844546 - RNA, 21 nt, Human
cccauuucgugagccccaucu

SEQ ID NO: 2844547 - RNA, 17 nt, Human
ccaacugggcccaagac

SEQ ID NO: 2844548 - RNA, 18 nt, Human
ccaacuguguucauuaga

SEQ ID NO: 2844549 - RNA, 13 nt, Human
ccaacuguguugu

SEQ ID NO: 2844550 - RNA, 20 nt, Human
ccaacuguguuguauuaaca

SEQ ID NO: 2844551 - RNA, 13 nt, Human
ccaacuguauaua

SEQ ID NO: 2844552 - RNA, 13 nt, Human
ccaacugugagca

SEQ ID NO: 2844553 - RNA, 14 nt, Human
ccaacuguggcugg

SEQ ID NO: 2844554 - RNA, 16 nt, Human
ccaacuguggcugguc

SEQ ID NO: 2844555 - RNA, 10 nt, Human
ccaacugugu

SEQ ID NO: 2844556 - RNA, 15 nt, Human
ccaacuguguagcau

SEQ ID NO: 2844557 - RNA, 11 nt, Human
ccaacuguguu

SEQ ID NO: 2844558 - RNA, 16 nt, Human
ccaacugggcccaaga

SEQ ID NO: 2844559 - RNA, 14 nt, Human
ccaacucugagccc

SEQ ID NO: 2844560 - RNA, 15 nt, Human
ccaacucugagccca

SEQ ID NO: 2844561 - RNA, 16 nt, Human
ccaacucugagcccau

SEQ ID NO: 2844562 - RNA, 22 nt, Human
ccaacucugagcccauguucug

SEQ ID NO: 2844563 - RNA, 13 nt, Human
ccaagcucugcuc

SEQ ID NO: 2844564 - RNA, 17 nt, Human
ccaagcucugcuccucu

SEQ ID NO: 2844565 - RNA, 12 nt, Human
ccaagcucugcu

SEQ ID NO: 2844566 - RNA, 11 nt, Human
ccaagcucccu

SEQ ID NO: 2844567 - RNA, 13 nt, Human
ccaagcucccugc

SEQ ID NO: 2844568 - RNA, 15 nt, Human
ccaagcucccugccc

SEQ ID NO: 2844569 - RNA, 17 nt, Human
ccaagcucccugcccca

SEQ ID NO: 2844570 - RNA, 19 nt, Human
ccaagcucccugccccaaa

SEQ ID NO: 2844571 - RNA, 21 nt, Human
ccaagcucccugccccaaaua

SEQ ID NO: 2844572 - RNA, 22 nt, Human
ccaagcucccugccccaaauaa

SEQ ID NO: 2844573 - RNA, 13 nt, Human
ccaagcuccuccu

SEQ ID NO: 2844574 - RNA, 20 nt, Human
ccaagcuccuccucggaacc

SEQ ID NO: 2844575 - RNA, 22 nt, Human
ccaagcuccuccucggaaccgc

SEQ ID NO: 2844576 - RNA, 18 nt, Human
ccaagcucugcuccucuc

SEQ ID NO: 2844577 - RNA, 19 nt, Human
ccaaugcacauccauuccc

SEQ ID NO: 2844578 - RNA, 13 nt, Human
ccaauccagguac

SEQ ID NO: 2844579 - RNA, 21 nt, Human
ccaaugagacucuagggucca

SEQ ID NO: 2844580 - RNA, 23 nt, Human
ccaaugagacucuaggguccagu

SEQ ID NO: 2844581 - RNA, 16 nt, Human
ccaaugagacuugccu

SEQ ID NO: 2844582 - RNA, 17 nt, Human
ccaaugagacuugccuu

SEQ ID NO: 2844583 - RNA, 18 nt, Human
ccaaugagacuugccuuc

SEQ ID NO: 2844584 - RNA, 21 nt, Human
ccaaugagacuugccuuccua

SEQ ID NO: 2844585 - RNA, 12 nt, Human
ccaauauuucug

SEQ ID NO: 2844586 - RNA, 18 nt, Human
ccaauauuucugcuuucu

SEQ ID NO: 2844587 - RNA, 19 nt, Human
ccaauauuucugcuuucuu

SEQ ID NO: 2844588 - RNA, 13 nt, Human
ccaagcuggcugg

SEQ ID NO: 2844589 - RNA, 14 nt, Human
ccaagcuggcuggg

SEQ ID NO: 2844590 - RNA, 17 nt, Human
ccaagcuggcuggggug

SEQ ID NO: 2844591 - RNA, 23 nt, Human
ccaagcuggcugggguggccugu

SEQ ID NO: 2844592 - RNA, 15 nt, Human
ccaaucagagaccag

SEQ ID NO: 2844593 - RNA, 21 nt, Human
ccaaucagagaccaggcccug

SEQ ID NO: 2844594 - RNA, 22 nt, Human
ccaaucagagaccaggcccugg

SEQ ID NO: 2844595 - RNA, 13 nt, Human
ccaaucagcacug

SEQ ID NO: 2844596 - RNA, 14 nt, Human
ccaaucagcacuga

SEQ ID NO: 2844597 - RNA, 15 nt, Human
ccaaucagcacugaa

SEQ ID NO: 2844598 - RNA, 16 nt, Human
ccaaucagcacugaaa

SEQ ID NO: 2844599 - RNA, 17 nt, Human
ccaaucagcacugaaaa

SEQ ID NO: 2844600 - RNA, 18 nt, Human
ccaaucagcacugaaaau

SEQ ID NO: 2844601 - RNA, 16 nt, Human
ccaaugguguuuuucu

SEQ ID NO: 2844602 - RNA, 15 nt, Human
ccaauguaggagcug

SEQ ID NO: 2844603 - RNA, 17 nt, Human
ccaauguaggagcugcc

SEQ ID NO: 2844604 - RNA, 20 nt, Human
ccaauguaggagcugccuug

SEQ ID NO: 2844605 - RNA, 21 nt, Human
ccaauguauugauaagagggc

SEQ ID NO: 2844606 - RNA, 15 nt, Human
cauuugugucaaugg

SEQ ID NO: 2844607 - RNA, 18 nt, Human
cauuuguggcagucccuu

SEQ ID NO: 2844608 - RNA, 23 nt, Human
cauuuguggcagucccuuauaau

SEQ ID NO: 2844609 - RNA, 16 nt, Human
cauuugugccagagga

SEQ ID NO: 2844610 - RNA, 14 nt, Human
cauuugugucaaug

SEQ ID NO: 2844611 - RNA, 22 nt, Human
cauuuguggugauauagaauua

SEQ ID NO: 2844612 - RNA, 15 nt, Human
cauuugugccagagg

SEQ ID NO: 2844613 - RNA, 12 nt, Human
cauuugugauau

SEQ ID NO: 2844614 - RNA, 18 nt, Human
cauuugugauauauguau

SEQ ID NO: 2844615 - RNA, 19 nt, Human
cauuugugauauauguauu

SEQ ID NO: 2844616 - RNA, 22 nt, Human
cauuugugauauauguauuaau

SEQ ID NO: 2844617 - RNA, 11 nt, Human
cauuuguauuu

SEQ ID NO: 2844618 - RNA, 14 nt, Human
cauuuguauuuugu

SEQ ID NO: 2844619 - RNA, 15 nt, Human
cauuuguauuuugug

SEQ ID NO: 2844620 - RNA, 17 nt, Human
cauuuguauuuugugug

SEQ ID NO: 2844621 - RNA, 16 nt, Human
cauuugugaaaugaug

SEQ ID NO: 2844622 - RNA, 18 nt, Human
cauuuuuuaaggaaacaa

SEQ ID NO: 2844623 - RNA, 21 nt, Human
cauuuuuuaugggcauugaca

SEQ ID NO: 2844624 - RNA, 17 nt, Human
cauuuuuuuaauuuauu

SEQ ID NO: 2844625 - RNA, 20 nt, Human
cauuuuuuuaauuuauuauu

SEQ ID NO: 2844626 - RNA, 22 nt, Human
cauuuuuugggcagcaauuuaa

SEQ ID NO: 2844627 - RNA, 19 nt, Human
cauuuuuugggcagcaauu

SEQ ID NO: 2844628 - RNA, 18 nt, Human
cauuuuuugggcagcaau

SEQ ID NO: 2844629 - RNA, 16 nt, Human
ccaaaacugugcagag

SEQ ID NO: 2844630 - RNA, 11 nt, Human
ccaaaacugug

SEQ ID NO: 2844631 - RNA, 18 nt, Human
ccaaaagauugcugaaaa

SEQ ID NO: 2844632 - RNA, 20 nt, Human
ccacagcacagcucccugcc

SEQ ID NO: 2844633 - RNA, 22 nt, Human
ccacagcacagcucccugccaa

SEQ ID NO: 2844634 - RNA, 14 nt, Human
ccacagcagcauuu

SEQ ID NO: 2844635 - RNA, 15 nt, Human
ccacagcagcauuuu

SEQ ID NO: 2844636 - RNA, 18 nt, Human
ccacagcagcauuuuuau

SEQ ID NO: 2844637 - RNA, 19 nt, Human
ccacagauuguuucuauac

SEQ ID NO: 2844638 - RNA, 22 nt, Human
ccacagauuguuucuauacaaa

SEQ ID NO: 2844639 - RNA, 14 nt, Human
ccacagcagguccu

SEQ ID NO: 2844640 - RNA, 21 nt, Human
ccacagcgagggcagcugcua

SEQ ID NO: 2844641 - RNA, 20 nt, Human
ccacagcgagggcagcugcu

SEQ ID NO: 2844642 - RNA, 19 nt, Human
ccacagcgagggcagcugc

SEQ ID NO: 2844643 - RNA, 18 nt, Human
ccacagcgagggcagcug

SEQ ID NO: 2844644 - RNA, 17 nt, Human
ccacagcgagggcagcu

SEQ ID NO: 2844645 - RNA, 15 nt, Human
ccacagcgagggcag

SEQ ID NO: 2844646 - RNA, 16 nt, Human
ccacagcugagaaugu

SEQ ID NO: 2844647 - RNA, 17 nt, Human
ccaccacacccagccca

SEQ ID NO: 2844648 - RNA, 15 nt, Human
ccaccacaccuggcu

SEQ ID NO: 2844649 - RNA, 23 nt, Human
ccaccauauucagugcuguggcc

SEQ ID NO: 2844650 - RNA, 22 nt, Human
ccaccauauucagugcuguggc

SEQ ID NO: 2844651 - RNA, 18 nt, Human
ccaccauauucagugcug

SEQ ID NO: 2844652 - RNA, 21 nt, Human
ccacccuguaccucaucccau

SEQ ID NO: 2844653 - RNA, 14 nt, Human
ccacccuuccccuc

SEQ ID NO: 2844654 - RNA, 15 nt, Human
ccacccuuggccugu

SEQ ID NO: 2844655 - RNA, 14 nt, Human
ccacccuuggccug

SEQ ID NO: 2844656 - RNA, 13 nt, Human
ccacccuuggccu

SEQ ID NO: 2844657 - RNA, 12 nt, Human
ccacccuuggcc

SEQ ID NO: 2844658 - RNA, 17 nt, Human
ccacccuuggccugucu

SEQ ID NO: 2844659 - RNA, 16 nt, Human
ccacccuuggccuguc

SEQ ID NO: 2844660 - RNA, 19 nt, Human
ccacccuuggccugucuca

SEQ ID NO: 2844661 - RNA, 23 nt, Human
ccaccgaaguggacuggccccug

SEQ ID NO: 2844662 - RNA, 22 nt, Human
ccaccgaaguggacuggccccu

SEQ ID NO: 2844663 - RNA, 17 nt, Human
ccaccuuucagcccacg

SEQ ID NO: 2844664 - RNA, 23 nt, Human
ccaccuuuccucaaauguugaca

SEQ ID NO: 2844665 - RNA, 23 nt, Human
ccacgaauuugcuggggaaucuc

SEQ ID NO: 2844666 - RNA, 15 nt, Human
ccacgaauuugcugg

SEQ ID NO: 2844667 - RNA, 19 nt, Human
ccacgaauuugcuggggaa

SEQ ID NO: 2844668 - RNA, 13 nt, Human
ccacgcccggcua

SEQ ID NO: 2844669 - RNA, 14 nt, Human
ccacgcccuccccu

SEQ ID NO: 2844670 - RNA, 15 nt, Human
ccacgcccuccccuc

SEQ ID NO: 2844671 - RNA, 17 nt, Human
ccacgcccuccccuccc

SEQ ID NO: 2844672 - RNA, 11 nt, Human
ccacuccuccc

SEQ ID NO: 2844673 - RNA, 13 nt, Human
ccacuccucccuc

SEQ ID NO: 2844674 - RNA, 14 nt, Human
ccacuccucccucc

SEQ ID NO: 2844675 - RNA, 15 nt, Human
ccacuccucccuccg

SEQ ID NO: 2844676 - RNA, 18 nt, Human
ccacucuacccucccacc

SEQ ID NO: 2844677 - RNA, 20 nt, Human
ccacucuacccucccacccc

SEQ ID NO: 2844678 - RNA, 19 nt, Human
ccacucuacccucccaccc

SEQ ID NO: 2844679 - RNA, 21 nt, Human
ccacucuacccucccaccccc

SEQ ID NO: 2844680 - RNA, 16 nt, Human
ccacucuacccuccca

SEQ ID NO: 2844681 - RNA, 16 nt, Human
ccacucuccccacacu

SEQ ID NO: 2844682 - RNA, 15 nt, Human
ccacucuccccacac

SEQ ID NO: 2844683 - RNA, 14 nt, Human
ccacucuccccaca

SEQ ID NO: 2844684 - RNA, 13 nt, Human
ccacucuccccac

SEQ ID NO: 2844685 - RNA, 12 nt, Human
ccacucucccca

SEQ ID NO: 2844686 - RNA, 17 nt, Human
caugauguuucuuccac

SEQ ID NO: 2844687 - RNA, 22 nt, Human
caugaugguuauuuucuuuucu

SEQ ID NO: 2844688 - RNA, 23 nt, Human
caugaugguuauuuucuuuucuu

SEQ ID NO: 2844689 - RNA, 13 nt, Human
caugauggccagg

SEQ ID NO: 2844690 - RNA, 21 nt, Human
caugauggccaggcugaucuc

SEQ ID NO: 2844691 - RNA, 18 nt, Human
caugauggucacuuaaaa

SEQ ID NO: 2844692 - RNA, 18 nt, Human
caugauuuccuugaaugu

SEQ ID NO: 2844693 - RNA, 16 nt, Human
caugcaaaaagaaaug

SEQ ID NO: 2844694 - RNA, 17 nt, Human
caugcaaaaagaaauga

SEQ ID NO: 2844695 - RNA, 17 nt, Human
caugauuuccuugaaug

SEQ ID NO: 2844696 - RNA, 16 nt, Human
caugauuuccuugaau

SEQ ID NO: 2844697 - RNA, 14 nt, Human
caugauuuccuuga

SEQ ID NO: 2844698 - RNA, 12 nt, Human
caugauuuccuu

SEQ ID NO: 2844699 - RNA, 16 nt, Human
caugcuaucucugugu

SEQ ID NO: 2844700 - RNA, 14 nt, Human
caugcuaggaugcg

SEQ ID NO: 2844701 - RNA, 21 nt, Human
caugcucugagaagaggagcc

SEQ ID NO: 2844702 - RNA, 22 nt, Human
caugcucugagaagaggagccc

SEQ ID NO: 2844703 - RNA, 16 nt, Human
caugcucugcaaaagg

SEQ ID NO: 2844704 - RNA, 21 nt, Human
caugcucuugaccuuguagag

SEQ ID NO: 2844705 - RNA, 15 nt, Human
caugcugaagccaaa

SEQ ID NO: 2844706 - RNA, 16 nt, Human
caugcugaagccaaag

SEQ ID NO: 2844707 - RNA, 20 nt, Human
caugcugaagccaaagccaa

SEQ ID NO: 2844708 - RNA, 20 nt, Human
caugcugggaagacgccuga

SEQ ID NO: 2844709 - RNA, 23 nt, Human
caugcugggaagacgccugagcu

SEQ ID NO: 2844710 - RNA, 20 nt, Human
caugcuggggcaagucccug

SEQ ID NO: 2844711 - RNA, 13 nt, Human
caugcuggccagc

SEQ ID NO: 2844712 - RNA, 15 nt, Human
caugcuggccagccu

SEQ ID NO: 2844713 - RNA, 16 nt, Human
caugcuggccagccug

SEQ ID NO: 2844714 - RNA, 17 nt, Human
caugcuggccagccugg

SEQ ID NO: 2844715 - RNA, 19 nt, Human
caugcugacuguccucucc

SEQ ID NO: 2844716 - RNA, 18 nt, Human
caugcuggaaccugcaaa

SEQ ID NO: 2844717 - RNA, 22 nt, Human
caugcuggaaccugcaaaaaau

SEQ ID NO: 2844718 - RNA, 23 nt, Human
caugcuggaaccugcaaaaaaua

SEQ ID NO: 2844719 - RNA, 21 nt, Human
cauggcucuggacucuaaaga

SEQ ID NO: 2844720 - RNA, 17 nt, Human
cauggcuccagaaaugu

SEQ ID NO: 2844721 - RNA, 16 nt, Human
cauggcugcacaguug

SEQ ID NO: 2844722 - RNA, 18 nt, Human
cauguccuaauucuucug

SEQ ID NO: 2844723 - RNA, 19 nt, Human
cauguccuaauucuucugu

SEQ ID NO: 2844724 - RNA, 14 nt, Human
cauguccuaugugu

SEQ ID NO: 2844725 - RNA, 15 nt, Human
cauguccuaugugug

SEQ ID NO: 2844726 - RNA, 16 nt, Human
cauguccuauguguga

SEQ ID NO: 2844727 - RNA, 18 nt, Human
cauguccuaugugugacu

SEQ ID NO: 2844728 - RNA, 23 nt, Human
caugucccuaccgagucucuucu

SEQ ID NO: 2844729 - RNA, 19 nt, Human
cauguuaggaaaauuucac

SEQ ID NO: 2844730 - RNA, 18 nt, Human
cauguuaggaaaauuuca

SEQ ID NO: 2844731 - RNA, 14 nt, Human
cauguuaggaaaau

SEQ ID NO: 2844732 - RNA, 13 nt, Human
caugucaaacaug

SEQ ID NO: 2844733 - RNA, 14 nt, Human
caugucaaacguga

SEQ ID NO: 2844734 - RNA, 19 nt, Human
caugucaaacgugaaaaug

SEQ ID NO: 2844735 - RNA, 21 nt, Human
caugucaaacaugagaugugu

SEQ ID NO: 2844736 - RNA, 20 nt, Human
caugucaaacaugagaugug

SEQ ID NO: 2844737 - RNA, 18 nt, Human
cauguccccucccagagc

SEQ ID NO: 2844738 - RNA, 16 nt, Human
cauguccccucccaga

SEQ ID NO: 2844739 - RNA, 15 nt, Human
cauguccccucccag

SEQ ID NO: 2844740 - RNA, 16 nt, Human
caugucccuaccgagu

SEQ ID NO: 2844741 - RNA, 22 nt, Human
caugucccuaccgagucucuuc

SEQ ID NO: 2844742 - RNA, 13 nt, Human
cauguuauauauu

SEQ ID NO: 2844743 - RNA, 14 nt, Human
cauguuauauauuu

SEQ ID NO: 2844744 - RNA, 22 nt, Human
cauguuauauauuuuuuguagg

SEQ ID NO: 2844745 - RNA, 20 nt, Human
cauguuauauuuaaugcauu

SEQ ID NO: 2844746 - RNA, 15 nt, Human
cauguuggccaggcu

SEQ ID NO: 2844747 - RNA, 14 nt, Human
cauguuggccaggc

SEQ ID NO: 2844748 - RNA, 16 nt, Human
cauguuggccaggcug

SEQ ID NO: 2844749 - RNA, 21 nt, Human
cauguuggccaggcuggucua

SEQ ID NO: 2844750 - RNA, 20 nt, Human
cauguuauauauuuuuugua

SEQ ID NO: 2844751 - RNA, 20 nt, Human
cauguuggccaggcuggucu

SEQ ID NO: 2844752 - RNA, 22 nt, Human
cauguuggucaaaagcuggauu

SEQ ID NO: 2844753 - RNA, 17 nt, Human
cauguuggucaggcugg

SEQ ID NO: 2844754 - RNA, 18 nt, Human
cauguuggucaggcuggu

SEQ ID NO: 2844755 - RNA, 16 nt, Human
cauguugguugcacuu

SEQ ID NO: 2844756 - RNA, 20 nt, Human
cauguugguugcacuuugua

SEQ ID NO: 2844757 - RNA, 21 nt, Human
cauguugguugcacuuuguag

SEQ ID NO: 2844758 - RNA, 22 nt, Human
cauguugguugcacuuuguagu

SEQ ID NO: 2844759 - RNA, 12 nt, Human
cauguuguaaug

SEQ ID NO: 2844760 - RNA, 15 nt, Human
cauguuguaaugcug

SEQ ID NO: 2844761 - RNA, 16 nt, Human
cauguuguaaugcugc

SEQ ID NO: 2844762 - RNA, 17 nt, Human
cauguuguaaugcugca

SEQ ID NO: 2844763 - RNA, 19 nt, Human
cauguuguaaugcugcacu

SEQ ID NO: 2844764 - RNA, 20 nt, Human
cauguuguaaugcugcacuu

SEQ ID NO: 2844765 - RNA, 20 nt, Human
cauguauuuaucucuauuua

SEQ ID NO: 2844766 - RNA, 23 nt, Human
cauguauuuaucucuauuuaaua

SEQ ID NO: 2844767 - RNA, 15 nt, Human
cauguauuuauguaa

SEQ ID NO: 2844768 - RNA, 15 nt, Human
cauguauuuaucucu

SEQ ID NO: 2844769 - RNA, 16 nt, Human
cauguaggacccugca

SEQ ID NO: 2844770 - RNA, 15 nt, Human
cauguagaagcugca

SEQ ID NO: 2844771 - RNA, 14 nt, Human
cauguagcugaguu

SEQ ID NO: 2844772 - RNA, 15 nt, Human
cauguagcugaguuu

SEQ ID NO: 2844773 - RNA, 18 nt, Human
cauguagcccccuggccu

SEQ ID NO: 2844774 - RNA, 20 nt, Human
cauguagcccccuggccucu

SEQ ID NO: 2844775 - RNA, 21 nt, Human
cauguagcccccuggccucug

SEQ ID NO: 2844776 - RNA, 22 nt, Human
cauguagcccccuggccucugu

SEQ ID NO: 2844777 - RNA, 13 nt, Human
cauguagcccccu

SEQ ID NO: 2844778 - RNA, 17 nt, Human
cauguagcccccuggcc

SEQ ID NO: 2844779 - RNA, 13 nt, Human
cauguagaagcug

SEQ ID NO: 2844780 - RNA, 19 nt, Human
cauguagaagcugcaucuu

SEQ ID NO: 2844781 - RNA, 12 nt, Human
cauguagagaaa

SEQ ID NO: 2844782 - RNA, 13 nt, Human
cauguagagaaaa

SEQ ID NO: 2844783 - RNA, 16 nt, Human
cauguagagaaaagca

SEQ ID NO: 2844784 - RNA, 19 nt, Human
cauguagagaaaagcacac

SEQ ID NO: 2844785 - RNA, 13 nt, Human
cauguacuuguuu

SEQ ID NO: 2844786 - RNA, 21 nt, Human
cauguacuuguuugcaagcag

SEQ ID NO: 2844787 - RNA, 23 nt, Human
cauucuagguaggggcccacuuc

SEQ ID NO: 2844788 - RNA, 13 nt, Human
cauuauaaacgcu

SEQ ID NO: 2844789 - RNA, 19 nt, Human
cauuauagauuuucauguu

SEQ ID NO: 2844790 - RNA, 14 nt, Human
cauguuguuaaaau

SEQ ID NO: 2844791 - RNA, 18 nt, Human
cauguuguuaaaauuaug

SEQ ID NO: 2844792 - RNA, 14 nt, Human
cauguuuaaaccug

SEQ ID NO: 2844793 - RNA, 18 nt, Human
cauauucuguuggccagu

SEQ ID NO: 2844794 - RNA, 17 nt, Human
cauauucuguuggccag

SEQ ID NO: 2844795 - RNA, 17 nt, Human
cauauuccauauuuauu

SEQ ID NO: 2844796 - RNA, 14 nt, Human
cauauucauucaug

SEQ ID NO: 2844797 - RNA, 16 nt, Human
cauauuccauauuuau

SEQ ID NO: 2844798 - RNA, 17 nt, Human
cauauggguuagauguu

SEQ ID NO: 2844799 - RNA, 18 nt, Human
cauauggguuagauguug

SEQ ID NO: 2844800 - RNA, 19 nt, Human
cauauguugaauacuuuuu

SEQ ID NO: 2844801 - RNA, 23 nt, Human
cauaugcuguauauccuuucuaa

SEQ ID NO: 2844802 - RNA, 15 nt, Human
cagugggcuccuggc

SEQ ID NO: 2844803 - RNA, 18 nt, Human
cauauggacucugcacau

SEQ ID NO: 2844804 - RNA, 15 nt, Human
cauauggacucugca

SEQ ID NO: 2844805 - RNA, 17 nt, Human
cauauggacucugcaca

SEQ ID NO: 2844806 - RNA, 20 nt, Human
cauauggacucugcacauga

SEQ ID NO: 2844807 - RNA, 15 nt, Human
cauauucuaaaacca

SEQ ID NO: 2844808 - RNA, 17 nt, Human
cauauucuaaaaccauu

SEQ ID NO: 2844809 - RNA, 13 nt, Human
cauauucugucug

SEQ ID NO: 2844810 - RNA, 15 nt, Human
cauauucuguuggaa

SEQ ID NO: 2844811 - RNA, 16 nt, Human
cauauucuguuggaag

SEQ ID NO: 2844812 - RNA, 12 nt, Human
caucacuguggc

SEQ ID NO: 2844813 - RNA, 13 nt, Human
caucacuguggcu

SEQ ID NO: 2844814 - RNA, 17 nt, Human
caucacuguggcugucu

SEQ ID NO: 2844815 - RNA, 14 nt, Human
caucacuguucaug

SEQ ID NO: 2844816 - RNA, 20 nt, Human
caucacuguucaugcuggcg

SEQ ID NO: 2844817 - RNA, 20 nt, Human
caucacugcuugaugaagca

SEQ ID NO: 2844818 - RNA, 15 nt, Human
cauccuggcacccgg

SEQ ID NO: 2844819 - RNA, 18 nt, Human
caucccuaaugcugcaga

SEQ ID NO: 2844820 - RNA, 12 nt, Human
caucccuacccc

SEQ ID NO: 2844821 - RNA, 17 nt, Human
caucccguguucuccuu

SEQ ID NO: 2844822 - RNA, 21 nt, Human
caucccguguucuccuuuucc

SEQ ID NO: 2844823 - RNA, 14 nt, Human
caucccguguucuc

SEQ ID NO: 2844824 - RNA, 16 nt, Human
caucccguguucuccu

SEQ ID NO: 2844825 - RNA, 21 nt, Human
caucccgggacgcagcaggag

SEQ ID NO: 2844826 - RNA, 15 nt, Human
caucccggaggaaau

SEQ ID NO: 2844827 - RNA, 16 nt, Human
caucccggaggaaauc

SEQ ID NO: 2844828 - RNA, 17 nt, Human
caucccggaggaaaucu

SEQ ID NO: 2844829 - RNA, 18 nt, Human
caucccggaggaaaucug

SEQ ID NO: 2844830 - RNA, 19 nt, Human
caucccggaggaaaucugc

SEQ ID NO: 2844831 - RNA, 20 nt, Human
cauccccuuacccuuagaau

SEQ ID NO: 2844832 - RNA, 22 nt, Human
cauccccuuacccuuagaaucc

SEQ ID NO: 2844833 - RNA, 14 nt, Human
caucacuuguacaa

SEQ ID NO: 2844834 - RNA, 22 nt, Human
cauccuggcacccggccccugc

SEQ ID NO: 2844835 - RNA, 16 nt, Human
cauccugccuucaugg

SEQ ID NO: 2844836 - RNA, 22 nt, Human
cauccugccuucauggaacuca

SEQ ID NO: 2844837 - RNA, 22 nt, Human
cauccugcugcccuuaggccac

SEQ ID NO: 2844838 - RNA, 21 nt, Human
caucgccaacuaagcgaggca

SEQ ID NO: 2844839 - RNA, 20 nt, Human
caucgccagaggugcuucac

SEQ ID NO: 2844840 - RNA, 16 nt, Human
caucgcucguguguuc

SEQ ID NO: 2844841 - RNA, 15 nt, Human
caucgcuggccccuu

SEQ ID NO: 2844842 - RNA, 16 nt, Human
caucgucauuugcugu

SEQ ID NO: 2844843 - RNA, 16 nt, Human
caucuggaaucuggag

SEQ ID NO: 2844844 - RNA, 21 nt, Human
caucuggaaucuggagaccag

SEQ ID NO: 2844845 - RNA, 16 nt, Human
caucugcuuuuauuaa

SEQ ID NO: 2844846 - RNA, 14 nt, Human
caucugugauggga

SEQ ID NO: 2844847 - RNA, 15 nt, Human
caucugugcacgcag

SEQ ID NO: 2844848 - RNA, 11 nt, Human
caucugugcau

SEQ ID NO: 2844849 - RNA, 20 nt, Human
caucuguuguuuuguuuuaa

SEQ ID NO: 2844850 - RNA, 15 nt, Human
caucugugugaaaau

SEQ ID NO: 2844851 - RNA, 14 nt, Human
caucuguguccugg

SEQ ID NO: 2844852 - RNA, 12 nt, Human
caucuguuguuu

SEQ ID NO: 2844853 - RNA, 15 nt, Human
cagcucccuaggaga

SEQ ID NO: 2844854 - RNA, 19 nt, Human
cagcucccuaggagaccaa

SEQ ID NO: 2844855 - RNA, 18 nt, Human
cagcucccuaggagacca

SEQ ID NO: 2844856 - RNA, 20 nt, Human
cagcucccuaggagaccaag

SEQ ID NO: 2844857 - RNA, 13 nt, Human
cagcucccugcca

SEQ ID NO: 2844858 - RNA, 14 nt, Human
cagcucccugccaa

SEQ ID NO: 2844859 - RNA, 19 nt, Human
cagcucccugccaaacuga

SEQ ID NO: 2844860 - RNA, 17 nt, Human
cagcuccgccucugucc

SEQ ID NO: 2844861 - RNA, 14 nt, Human
cagcuccucccaca

SEQ ID NO: 2844862 - RNA, 20 nt, Human
cagcuccucauccagggcuc

SEQ ID NO: 2844863 - RNA, 15 nt, Human
cagcuccucauccag

SEQ ID NO: 2844864 - RNA, 19 nt, Human
cagcuccucauccagggcu

SEQ ID NO: 2844865 - RNA, 23 nt, Human
cagcucccauaaccgcugauucu

SEQ ID NO: 2844866 - RNA, 12 nt, Human
cagcuccccaag

SEQ ID NO: 2844867 - RNA, 13 nt, Human
cagcuccccagag

SEQ ID NO: 2844868 - RNA, 15 nt, Human
cagcuccccagaguc

SEQ ID NO: 2844869 - RNA, 24 nt, Human
cagcuccccagaguccucuaugaa

SEQ ID NO: 2844870 - RNA, 14 nt, Human
cagcuguuuaagau

SEQ ID NO: 2844871 - RNA, 18 nt, Human
cagcuuacacaaaucuau

SEQ ID NO: 2844872 - RNA, 21 nt, Human
cagcuuacacaaaucuauuua

SEQ ID NO: 2844873 - RNA, 24 nt, Human
cagcugugcucuggacaggcaugu

SEQ ID NO: 2844874 - RNA, 20 nt, Human
cagcugugcucuggacaggc

SEQ ID NO: 2844875 - RNA, 19 nt, Human
cagcugugcucuggacagg

SEQ ID NO: 2844876 - RNA, 12 nt, Human
cagcugccugca

SEQ ID NO: 2844877 - RNA, 14 nt, Human
cagcugaguuauga

SEQ ID NO: 2844878 - RNA, 18 nt, Human
cagcugaguuaugaugua

SEQ ID NO: 2844879 - RNA, 15 nt, Human
cagcugauacaaauu

SEQ ID NO: 2844880 - RNA, 23 nt, Human
cagcugauacaaauugcagacug

SEQ ID NO: 2844881 - RNA, 16 nt, Human
cagcugauacuucauu

SEQ ID NO: 2844882 - RNA, 20 nt, Human
cagcugauacuucauuuaaa

SEQ ID NO: 2844883 - RNA, 21 nt, Human
cagcugauacuucauuuaaaa

SEQ ID NO: 2844884 - RNA, 20 nt, Human
cagcugauguuggaagagaa

SEQ ID NO: 2844885 - RNA, 18 nt, Human
cagcugauguuggaagag

SEQ ID NO: 2844886 - RNA, 16 nt, Human
caggaaaagcugcuga

SEQ ID NO: 2844887 - RNA, 15 nt, Human
caggaaaagcugcug

SEQ ID NO: 2844888 - RNA, 18 nt, Human
caggaaaagcugcugaca

SEQ ID NO: 2844889 - RNA, 16 nt, Human
cagccgcucuccugcc

SEQ ID NO: 2844890 - RNA, 17 nt, Human
cagccgcucuccugcca

SEQ ID NO: 2844891 - RNA, 20 nt, Human
cagccgcucuccugccacau

SEQ ID NO: 2844892 - RNA, 13 nt, Human
cagccucugaccc

SEQ ID NO: 2844893 - RNA, 23 nt, Human
cagcccuuuuguugagccaggcc

SEQ ID NO: 2844894 - RNA, 20 nt, Human
cagcccuugagggagaacuu

SEQ ID NO: 2844895 - RNA, 19 nt, Human
cagccugcuaauuccccag

SEQ ID NO: 2844896 - RNA, 22 nt, Human
cagccucugaccccuccucacu

SEQ ID NO: 2844897 - RNA, 23 nt, Human
cagccucugaccccuccucacug

SEQ ID NO: 2844898 - RNA, 13 nt, Human
cagccucuggcau

SEQ ID NO: 2844899 - RNA, 14 nt, Human
cagccucugacccc

SEQ ID NO: 2844900 - RNA, 15 nt, Human
cagccucugaccccu

SEQ ID NO: 2844901 - RNA, 16 nt, Human
cagccucugaccccuc

SEQ ID NO: 2844902 - RNA, 17 nt, Human
cagccucugaccccucc

SEQ ID NO: 2844903 - RNA, 18 nt, Human
cagccucugaccccuccu

SEQ ID NO: 2844904 - RNA, 19 nt, Human
cagccucugaccccuccuc

SEQ ID NO: 2844905 - RNA, 20 nt, Human
cagccucugaccccuccuca

SEQ ID NO: 2844906 - RNA, 21 nt, Human
cagccucugaccccuccucac

SEQ ID NO: 2844907 - RNA, 21 nt, Human
cagcggggacagcuccuucug

SEQ ID NO: 2844908 - RNA, 18 nt, Human
cagcggggccccagggcu

SEQ ID NO: 2844909 - RNA, 16 nt, Human
cagcggggaggggagg

SEQ ID NO: 2844910 - RNA, 19 nt, Human
cagcggggacagcuccuuc

SEQ ID NO: 2844911 - RNA, 18 nt, Human
cagcggggacagcuccuu

SEQ ID NO: 2844912 - RNA, 19 nt, Human
cagcgccuggccuacccag

SEQ ID NO: 2844913 - RNA, 14 nt, Human
cagauccucuuggu

SEQ ID NO: 2844914 - RNA, 22 nt, Human
cagauccugaucuuaagaggcu

SEQ ID NO: 2844915 - RNA, 16 nt, Human
cagaucacugccacac

SEQ ID NO: 2844916 - RNA, 15 nt, Human
cagaucacugccaca

SEQ ID NO: 2844917 - RNA, 16 nt, Human
cagaucaguguaccau

SEQ ID NO: 2844918 - RNA, 17 nt, Human
cagaucagucagagccc

SEQ ID NO: 2844919 - RNA, 15 nt, Human
cagaucauccagaag

SEQ ID NO: 2844920 - RNA, 17 nt, Human
cagaucauguuuuggug

SEQ ID NO: 2844921 - RNA, 19 nt, Human
cagaucauguuuuggugaa

SEQ ID NO: 2844922 - RNA, 13 nt, Human
cagauccucuugg

SEQ ID NO: 2844923 - RNA, 15 nt, Human
cagauccccaagccu

SEQ ID NO: 2844924 - RNA, 19 nt, Human
cagauccccaagccuggca

SEQ ID NO: 2844925 - RNA, 20 nt, Human
cagagguaacagaacagcuu

SEQ ID NO: 2844926 - RNA, 22 nt, Human
cagagguaacagaacagcuuca

SEQ ID NO: 2844927 - RNA, 19 nt, Human
cagaggucagacuaagaaa

SEQ ID NO: 2844928 - RNA, 18 nt, Human
cagagguagggcugccac

SEQ ID NO: 2844929 - RNA, 20 nt, Human
cagagguccacaacacacag

SEQ ID NO: 2844930 - RNA, 15 nt, Human
cagagguccacaaca

SEQ ID NO: 2844931 - RNA, 14 nt, Human
cagaucacugccac

SEQ ID NO: 2844932 - RNA, 13 nt, Human
cagaucacugcca

SEQ ID NO: 2844933 - RNA, 18 nt, Human
cagaucacugaauuuaua

SEQ ID NO: 2844934 - RNA, 19 nt, Human
cagaucacugaauuuauaa

SEQ ID NO: 2844935 - RNA, 13 nt, Human
cagaucaccugag

SEQ ID NO: 2844936 - RNA, 14 nt, Human
cagaucacaguguc

SEQ ID NO: 2844937 - RNA, 13 nt, Human
cagaguaagacau

SEQ ID NO: 2844938 - RNA, 14 nt, Human
cagaguaagacauu

SEQ ID NO: 2844939 - RNA, 15 nt, Human
cagaguaagacauug

SEQ ID NO: 2844940 - RNA, 23 nt, Human
cagagguaacagaacagcuucag

SEQ ID NO: 2844941 - RNA, 13 nt, Human
cagaguagaaaua

SEQ ID NO: 2844942 - RNA, 13 nt, Human
cagaaucccagcc

SEQ ID NO: 2844943 - RNA, 14 nt, Human
cagaaucccagccg

SEQ ID NO: 2844944 - RNA, 18 nt, Human
cagaaucccagccggcca

SEQ ID NO: 2844945 - RNA, 20 nt, Human
cagaaucccucuacauggac

SEQ ID NO: 2844946 - RNA, 16 nt, Human
cagaaucagcacagau

SEQ ID NO: 2844947 - RNA, 18 nt, Human
cagaaucagcacagauaa

SEQ ID NO: 2844948 - RNA, 19 nt, Human
cagagggguaagagaggau

SEQ ID NO: 2844949 - RNA, 23 nt, Human
cagagggguggguuccucuuccc

SEQ ID NO: 2844950 - RNA, 13 nt, Human
cagagggucacag

SEQ ID NO: 2844951 - RNA, 15 nt, Human
cagagggucacagug

SEQ ID NO: 2844952 - RNA, 16 nt, Human
cagagggucacagugu

SEQ ID NO: 2844953 - RNA, 20 nt, Human
cagagggucacaguguuuac

SEQ ID NO: 2844954 - RNA, 16 nt, Human
cagaggguuaggagug

SEQ ID NO: 2844955 - RNA, 17 nt, Human
cagaggguugugauuuu

SEQ ID NO: 2844956 - RNA, 13 nt, Human
cagagguaacaga

SEQ ID NO: 2844957 - RNA, 14 nt, Human
cagagguaacagaa

SEQ ID NO: 2844958 - RNA, 15 nt, Human
cagagguaacagaac

SEQ ID NO: 2844959 - RNA, 16 nt, Human
cagagguaacagaaca

SEQ ID NO: 2844960 - RNA, 17 nt, Human
cagagguaacagaacag

SEQ ID NO: 2844961 - RNA, 18 nt, Human
cagagguaacagaacagc

SEQ ID NO: 2844962 - RNA, 19 nt, Human
cagagguaacagaacagcu

SEQ ID NO: 2844963 - RNA, 23 nt, Human
cagcaguugaaugacaacagaag

SEQ ID NO: 2844964 - RNA, 22 nt, Human
cagcaguguuccccaucugggu

SEQ ID NO: 2844965 - RNA, 23 nt, Human
cagcaguguuccccaucuggguc

SEQ ID NO: 2844966 - RNA, 14 nt, Human
cagcaguguucccc

SEQ ID NO: 2844967 - RNA, 17 nt, Human
cagcaguguuccccauc

SEQ ID NO: 2844968 - RNA, 19 nt, Human
cagcaguguuccccaucug

SEQ ID NO: 2844969 - RNA, 21 nt, Human
cagcaguguuccccaucuggg

SEQ ID NO: 2844970 - RNA, 16 nt, Human
cagcagugcagccggg

SEQ ID NO: 2844971 - RNA, 12 nt, Human
cagcaguguucc

SEQ ID NO: 2844972 - RNA, 13 nt, Human
cagcaguguuccc

SEQ ID NO: 2844973 - RNA, 19 nt, Human
cagcaucaccugccuguua

SEQ ID NO: 2844974 - RNA, 13 nt, Human
cagcaucacuccc

SEQ ID NO: 2844975 - RNA, 14 nt, Human
cagcaucacucccc

SEQ ID NO: 2844976 - RNA, 15 nt, Human
cagcaucacucccca

SEQ ID NO: 2844977 - RNA, 17 nt, Human
cagcaucacuccccaag

SEQ ID NO: 2844978 - RNA, 19 nt, Human
cagcaucacuccccaagga

SEQ ID NO: 2844979 - RNA, 20 nt, Human
cagcaucacuccccaaggaa

SEQ ID NO: 2844980 - RNA, 22 nt, Human
cagcaucacuccccaaggaaga

SEQ ID NO: 2844981 - RNA, 15 nt, Human
cagcaucaccugccu

SEQ ID NO: 2844982 - RNA, 17 nt, Human
cagauugcaacaggcug

SEQ ID NO: 2844983 - RNA, 22 nt, Human
cagauugaguuuucuucuguga

SEQ ID NO: 2844984 - RNA, 12 nt, Human
cagccagcugcc

SEQ ID NO: 2844985 - RNA, 15 nt, Human
cagccagcugcccua

SEQ ID NO: 2844986 - RNA, 22 nt, Human
cagccaggacagucagcucucu

SEQ ID NO: 2844987 - RNA, 22 nt, Human
cagccaggcugccaaggccaga

SEQ ID NO: 2844988 - RNA, 17 nt, Human
cagcaucaccugccugu

SEQ ID NO: 2844989 - RNA, 16 nt, Human
cagcaucaccugccug

SEQ ID NO: 2844990 - RNA, 19 nt, Human
cagcaucccuugaccaggc

SEQ ID NO: 2844991 - RNA, 22 nt, Human
cagcaucccuugaccaggccug

SEQ ID NO: 2844992 - RNA, 23 nt, Human
cagcaucccuugaccaggccugg

SEQ ID NO: 2844993 - RNA, 18 nt, Human
cagcaucccuugaccagg

SEQ ID NO: 2844994 - RNA, 13 nt, Human
cagccagggcugc

SEQ ID NO: 2844995 - RNA, 12 nt, Human
cagccagggcug

SEQ ID NO: 2844996 - RNA, 23 nt, Human
cagccagggcugcuagacggagg

SEQ ID NO: 2844997 - RNA, 15 nt, Human
cagccagggcugcua

SEQ ID NO: 2844998 - RNA, 16 nt, Human
cagccagggcugcuag

SEQ ID NO: 2844999 - RNA, 20 nt, Human
cagccagggaggacaagcag

SEQ ID NO: 2845000 - RNA, 16 nt, Human
cagucugaaugcugcc

SEQ ID NO: 2845001 - RNA, 18 nt, Human
cagucugaaugcugccac

SEQ ID NO: 2845002 - RNA, 20 nt, Human
cagucugaaugcugccacaa

SEQ ID NO: 2845003 - RNA, 12 nt, Human
cagucucugccu

SEQ ID NO: 2845004 - RNA, 13 nt, Human
cagucucugccuu

SEQ ID NO: 2845005 - RNA, 14 nt, Human
cagucucugccuug

SEQ ID NO: 2845006 - RNA, 17 nt, Human
cagucucugccuugccu

SEQ ID NO: 2845007 - RNA, 18 nt, Human
cagucucugccuugccuu

SEQ ID NO: 2845008 - RNA, 19 nt, Human
cagucucugccuugccuuu

SEQ ID NO: 2845009 - RNA, 18 nt, Human
cagucucugcuccaccuu

SEQ ID NO: 2845010 - RNA, 23 nt, Human
cagucucugcuccaccuuucagc

SEQ ID NO: 2845011 - RNA, 17 nt, Human
cagucuggaaugcagug

SEQ ID NO: 2845012 - RNA, 12 nt, Human
cagugcaucuca

SEQ ID NO: 2845013 - RNA, 15 nt, Human
cagucuggaaugcag

SEQ ID NO: 2845014 - RNA, 15 nt, Human
cagugcaucucagcc

SEQ ID NO: 2845015 - RNA, 16 nt, Human
cagugcaucucagccc

SEQ ID NO: 2845016 - RNA, 17 nt, Human
cagugcaucucagccca

SEQ ID NO: 2845017 - RNA, 18 nt, Human
cagugcaucucagcccac

SEQ ID NO: 2845018 - RNA, 23 nt, Human
cagugggagcugccuguucagcu

SEQ ID NO: 2845019 - RNA, 20 nt, Human
cagugggagcugccuguuca

SEQ ID NO: 2845020 - RNA, 17 nt, Human
cagugcccacaggauca

SEQ ID NO: 2845021 - RNA, 15 nt, Human
cagugcccacaggau

SEQ ID NO: 2845022 - RNA, 13 nt, Human
cagugcccacagg

SEQ ID NO: 2845023 - RNA, 15 nt, Human
cagugggauuuggua

SEQ ID NO: 2845024 - RNA, 18 nt, Human
cagugggauuugguaaug

SEQ ID NO: 2845025 - RNA, 21 nt, Human
caguggugcgaucuggguuca

SEQ ID NO: 2845026 - RNA, 20 nt, Human
caguggugcgaucuggguuc

SEQ ID NO: 2845027 - RNA, 20 nt, Human
caguggggaggggcuguggg

SEQ ID NO: 2845028 - RNA, 17 nt, Human
cagucaccccaggacuc

SEQ ID NO: 2845029 - RNA, 12 nt, Human
cagucaccccag

SEQ ID NO: 2845030 - RNA, 15 nt, Human
cagucaauauuuuua

SEQ ID NO: 2845031 - RNA, 17 nt, Human
cagucacaugaccugau

SEQ ID NO: 2845032 - RNA, 18 nt, Human
cagucacguggaggagca

SEQ ID NO: 2845033 - RNA, 23 nt, Human
cagucacguggaggagcagugca

SEQ ID NO: 2845034 - RNA, 17 nt, Human
cagguuugucaucagau

SEQ ID NO: 2845035 - RNA, 15 nt, Human
caggugcaguggcuc

SEQ ID NO: 2845036 - RNA, 16 nt, Human
caggugccagccugag

SEQ ID NO: 2845037 - RNA, 18 nt, Human
caggugccagccugaggc

SEQ ID NO: 2845038 - RNA, 23 nt, Human
caggugccagccugaggcagcca

SEQ ID NO: 2845039 - RNA, 22 nt, Human
caggugcccagcuauaccugug

SEQ ID NO: 2845040 - RNA, 23 nt, Human
caggugcccagcuauaccugugc

SEQ ID NO: 2845041 - RNA, 22 nt, Human
cagguugucugaagucacugca

SEQ ID NO: 2845042 - RNA, 12 nt, Human
caggugccugga

SEQ ID NO: 2845043 - RNA, 15 nt, Human
caggugccuggacau

SEQ ID NO: 2845044 - RNA, 13 nt, Human
cagguuguuggug

SEQ ID NO: 2845045 - RNA, 16 nt, Human
cagguuguuggugacu

SEQ ID NO: 2845046 - RNA, 12 nt, Human
cagguuuaacau

SEQ ID NO: 2845047 - RNA, 15 nt, Human
cagguuuaacauuug

SEQ ID NO: 2845048 - RNA, 16 nt, Human
cagguuuaacauuugc

SEQ ID NO: 2845049 - RNA, 17 nt, Human
cagguuuaacauuugcc

SEQ ID NO: 2845050 - RNA, 18 nt, Human
cagguuuaacauuugccu

SEQ ID NO: 2845051 - RNA, 23 nt, Human
cagguugucugaagucacugcac

SEQ ID NO: 2845052 - RNA, 15 nt, Human
cagguuuuguaaaga

SEQ ID NO: 2845053 - RNA, 19 nt, Human
cagguuuucacauaaaugc

SEQ ID NO: 2845054 - RNA, 20 nt, Human
cagguuuucacauaaaugca

SEQ ID NO: 2845055 - RNA, 16 nt, Human
caguaaacagaggagu

SEQ ID NO: 2845056 - RNA, 20 nt, Human
caggugauccacccaccuca

SEQ ID NO: 2845057 - RNA, 21 nt, Human
caggugauccacccaccucag

SEQ ID NO: 2845058 - RNA, 23 nt, Human
caggugauccacccaccucagcc

SEQ ID NO: 2845059 - RNA, 22 nt, Human
caggugauccacccaccucagc

SEQ ID NO: 2845060 - RNA, 20 nt, Human
caggugauuggaccaggcca

SEQ ID NO: 2845061 - RNA, 20 nt, Human
caggugauguuaguguuuua

SEQ ID NO: 2845062 - RNA, 21 nt, Human
caggugauuggaccaggccau

SEQ ID NO: 2845063 - RNA, 13 nt, Human
caggcacagcuga

SEQ ID NO: 2845064 - RNA, 15 nt, Human
caggcacagcugagu

SEQ ID NO: 2845065 - RNA, 16 nt, Human
caggcacagcugaguu

SEQ ID NO: 2845066 - RNA, 12 nt, Human
caggcacaggau

SEQ ID NO: 2845067 - RNA, 13 nt, Human
caggcacaggaug

SEQ ID NO: 2845068 - RNA, 20 nt, Human
caggcacaggaugcuguguu

SEQ ID NO: 2845069 - RNA, 12 nt, Human
caggcaauuccg

SEQ ID NO: 2845070 - RNA, 24 nt, Human
caggcaauucuccugccuuugccu

SEQ ID NO: 2845071 - RNA, 15 nt, Human
caggccagagggagu

SEQ ID NO: 2845072 - RNA, 13 nt, Human
caggccagaggga

SEQ ID NO: 2845073 - RNA, 18 nt, Human
caggcagauacaggaaaa

SEQ ID NO: 2845074 - RNA, 15 nt, Human
caggccacuugauga

SEQ ID NO: 2845075 - RNA, 16 nt, Human
caggcagaucaccuga

SEQ ID NO: 2845076 - RNA, 23 nt, Human
caggcagagaaucauacuuagca

SEQ ID NO: 2845077 - RNA, 15 nt, Human
caggcagagaaucau

SEQ ID NO: 2845078 - RNA, 14 nt, Human
caggcagagaauca

SEQ ID NO: 2845079 - RNA, 16 nt, Human
caggcagacuacacag

SEQ ID NO: 2845080 - RNA, 21 nt, Human
caggcagacuacacaggauga

SEQ ID NO: 2845081 - RNA, 18 nt, Human
caggcaccagucccuguc

SEQ ID NO: 2845082 - RNA, 12 nt, Human
caggcacagguc

SEQ ID NO: 2845083 - RNA, 13 nt, Human
caggcacagguca

SEQ ID NO: 2845084 - RNA, 15 nt, Human
caggcacaggucagg

SEQ ID NO: 2845085 - RNA, 16 nt, Human
caggcaccagucccug

SEQ ID NO: 2845086 - RNA, 23 nt, Human
cagggcucagcggggacagcucc

SEQ ID NO: 2845087 - RNA, 21 nt, Human
cagggcucagcggggacagcu

SEQ ID NO: 2845088 - RNA, 12 nt, Human
cagggaugagca

SEQ ID NO: 2845089 - RNA, 20 nt, Human
cagggaguguaguaaagccg

SEQ ID NO: 2845090 - RNA, 22 nt, Human
cagggaugagcauggagcuggc

SEQ ID NO: 2845091 - RNA, 23 nt, Human
cagggaugagcauggagcuggcc

SEQ ID NO: 2845092 - RNA, 16 nt, Human
cagggaugagcaugga

SEQ ID NO: 2845093 - RNA, 19 nt, Human
cagggaugagcauggagcu

SEQ ID NO: 2845094 - RNA, 20 nt, Human
cagggaugagcauggagcug

SEQ ID NO: 2845095 - RNA, 21 nt, Human
cagggaugagcauggagcugg

SEQ ID NO: 2845096 - RNA, 23 nt, Human
cagggcugcugggggcaacuggc

SEQ ID NO: 2845097 - RNA, 13 nt, Human
cagggcuccuccc

SEQ ID NO: 2845098 - RNA, 14 nt, Human
cagggcuccuccca

SEQ ID NO: 2845099 - RNA, 15 nt, Human
cagggcuccucccag

SEQ ID NO: 2845100 - RNA, 16 nt, Human
cagggcuccucccagc

SEQ ID NO: 2845101 - RNA, 17 nt, Human
cagggcucugccccagu

SEQ ID NO: 2845102 - RNA, 19 nt, Human
cagggcucugccccagucg

SEQ ID NO: 2845103 - RNA, 21 nt, Human
cagggcugcugggggcaacug

SEQ ID NO: 2845104 - RNA, 18 nt, Human
cagggcugcuagacggag

SEQ ID NO: 2845105 - RNA, 14 nt, Human
cagggcugcuagac

SEQ ID NO: 2845106 - RNA, 15 nt, Human
cagggcugcccugag

SEQ ID NO: 2845107 - RNA, 16 nt, Human
cagggcugcccugaga

SEQ ID NO: 2845108 - RNA, 17 nt, Human
cagggcugcccugagaa

SEQ ID NO: 2845109 - RNA, 22 nt, Human
cagggcugcccugagaagcugc

SEQ ID NO: 2845110 - RNA, 23 nt, Human
cagggcugcccugagaagcugcu

SEQ ID NO: 2845111 - RNA, 20 nt, Human
caggcugggcuucaguggca

SEQ ID NO: 2845112 - RNA, 22 nt, Human
caggcugggcuucaguggcagc

SEQ ID NO: 2845113 - RNA, 21 nt, Human
caggcugggcuucaguggcag

SEQ ID NO: 2845114 - RNA, 22 nt, Human
cagggagccuuugguucuggcc

SEQ ID NO: 2845115 - RNA, 19 nt, Human
cagggagccuagaagcugg

SEQ ID NO: 2845116 - RNA, 16 nt, Human
caggggaaccugccau

SEQ ID NO: 2845117 - RNA, 15 nt, Human
caggggaaccugcca

SEQ ID NO: 2845118 - RNA, 14 nt, Human
caggggaaccugcc

SEQ ID NO: 2845119 - RNA, 19 nt, Human
auuucucaacaaagcacag

SEQ ID NO: 2845120 - RNA, 22 nt, Human
auuucucaacaaagcacagugu

SEQ ID NO: 2845121 - RNA, 20 nt, Human
auuucucaacaaagcacagu

SEQ ID NO: 2845122 - RNA, 12 nt, Human
auuucuccagaa

SEQ ID NO: 2845123 - RNA, 16 nt, Human
auuucuccagaaccca

SEQ ID NO: 2845124 - RNA, 17 nt, Human
auuucuccagaacccau

SEQ ID NO: 2845125 - RNA, 14 nt, Human
auuucucaucacag

SEQ ID NO: 2845126 - RNA, 22 nt, Human
auuuaaugauaaguaaaugcua

SEQ ID NO: 2845127 - RNA, 13 nt, Human
auuuaaugcauua

SEQ ID NO: 2845128 - RNA, 17 nt, Human
auuuaaugcauuaaacc

SEQ ID NO: 2845129 - RNA, 18 nt, Human
auuuaaugcauuaaaccu

SEQ ID NO: 2845130 - RNA, 19 nt, Human
auuuaaugcauuaaaccug

SEQ ID NO: 2845131 - RNA, 20 nt, Human
auuuaaugcauuaaaccugu

SEQ ID NO: 2845132 - RNA, 12 nt, Human
auuuaaugcugc

SEQ ID NO: 2845133 - RNA, 13 nt, Human
auuuaaugcugcc

SEQ ID NO: 2845134 - RNA, 14 nt, Human
auuuaaugcugccu

SEQ ID NO: 2845135 - RNA, 15 nt, Human
auuuaauauuuugca

SEQ ID NO: 2845136 - RNA, 21 nt, Human
auuuaauauggauuuguuaca

SEQ ID NO: 2845137 - RNA, 14 nt, Human
auuuauaauuccua

SEQ ID NO: 2845138 - RNA, 11 nt, Human
auuuauaauug

SEQ ID NO: 2845139 - RNA, 17 nt, Human
auuuauaauugcaucua

SEQ ID NO: 2845140 - RNA, 13 nt, Human
auuuauacaagau

SEQ ID NO: 2845141 - RNA, 15 nt, Human
auuuauacaagauug

SEQ ID NO: 2845142 - RNA, 22 nt, Human
auuuauacaagauugaaaaucu

SEQ ID NO: 2845143 - RNA, 17 nt, Human
auuuauaauucaguaug

SEQ ID NO: 2845144 - RNA, 19 nt, Human
auuuauaauucaguauguu

SEQ ID NO: 2845145 - RNA, 20 nt, Human
auuuauaauucaguauguuu

SEQ ID NO: 2845146 - RNA, 21 nt, Human
auuuaauuaggaaaaaaacua

SEQ ID NO: 2845147 - RNA, 12 nt, Human
auuuaauguuuu

SEQ ID NO: 2845148 - RNA, 17 nt, Human
auuuaauguuuuaaaug

SEQ ID NO: 2845149 - RNA, 18 nt, Human
auuuaauguuuuaaaugu

SEQ ID NO: 2845150 - RNA, 19 nt, Human
auuuaauguuuuaaaugua

SEQ ID NO: 2845151 - RNA, 20 nt, Human
auuuaauguuuuaaauguac

SEQ ID NO: 2845152 - RNA, 21 nt, Human
auuuaauguuuuaaauguaca

SEQ ID NO: 2845153 - RNA, 23 nt, Human
auuuaauguuuuaaauguacaga

SEQ ID NO: 2845154 - RNA, 14 nt, Human
auuuaaugugaguu

SEQ ID NO: 2845155 - RNA, 15 nt, Human
auuuaaugugaguuu

SEQ ID NO: 2845156 - RNA, 16 nt, Human
auuuaaugugaguuug

SEQ ID NO: 2845157 - RNA, 15 nt, Human
auuuaauaucuucag

SEQ ID NO: 2845158 - RNA, 13 nt, Human
auuuaauauuuau

SEQ ID NO: 2845159 - RNA, 14 nt, Human
auuuauacuauuua

SEQ ID NO: 2845160 - RNA, 13 nt, Human
auuuauaccucaa

SEQ ID NO: 2845161 - RNA, 18 nt, Human
auuuauaccucaaacuau

SEQ ID NO: 2845162 - RNA, 22 nt, Human
auuuauaccucaaacuaucugg

SEQ ID NO: 2845163 - RNA, 19 nt, Human
auuuauauuuuuaaaauau

SEQ ID NO: 2845164 - RNA, 14 nt, Human
auuuauaguuugua

SEQ ID NO: 2845165 - RNA, 12 nt, Human
auuuauaguuug

SEQ ID NO: 2845166 - RNA, 16 nt, Human
auuuaucacacuucug

SEQ ID NO: 2845167 - RNA, 12 nt, Human
auuuaucaaauc

SEQ ID NO: 2845168 - RNA, 13 nt, Human
auuuaucaaauca

SEQ ID NO: 2845169 - RNA, 13 nt, Human
auuuaucaaagca

SEQ ID NO: 2845170 - RNA, 14 nt, Human
auuuaucaaagcau

SEQ ID NO: 2845171 - RNA, 20 nt, Human
auuuaucaaagcauagaugu

SEQ ID NO: 2845172 - RNA, 22 nt, Human
auuuaucaaagcauagauguuu

SEQ ID NO: 2845173 - RNA, 14 nt, Human
auuuaucaaaucag

SEQ ID NO: 2845174 - RNA, 17 nt, Human
auuuaucaaaucaguca

SEQ ID NO: 2845175 - RNA, 12 nt, Human
auuucaagguuc

SEQ ID NO: 2845176 - RNA, 13 nt, Human
auuucaagguucu

SEQ ID NO: 2845177 - RNA, 18 nt, Human
auuucagauucccagagc

SEQ ID NO: 2845178 - RNA, 15 nt, Human
auuucagauuuugau

SEQ ID NO: 2845179 - RNA, 16 nt, Human
auuucagauuuugaua

SEQ ID NO: 2845180 - RNA, 17 nt, Human
auuucagauuuugauaa

SEQ ID NO: 2845181 - RNA, 18 nt, Human
auuucagauuuugauaac

SEQ ID NO: 2845182 - RNA, 22 nt, Human
auuucagauuuugauaacuguu

SEQ ID NO: 2845183 - RNA, 14 nt, Human
auuucaucauuguu

SEQ ID NO: 2845184 - RNA, 17 nt, Human
auuucaucauuguuucu

SEQ ID NO: 2845185 - RNA, 18 nt, Human
auuucaucauuguuucug

SEQ ID NO: 2845186 - RNA, 22 nt, Human
auuucagagaggccuuuuggaa

SEQ ID NO: 2845187 - RNA, 13 nt, Human
auuucagauguaa

SEQ ID NO: 2845188 - RNA, 14 nt, Human
auuucagauguaau

SEQ ID NO: 2845189 - RNA, 15 nt, Human
auuucagauguaaug

SEQ ID NO: 2845190 - RNA, 16 nt, Human
auuucagauguaaugu

SEQ ID NO: 2845191 - RNA, 17 nt, Human
auuucagauguaauguu

SEQ ID NO: 2845192 - RNA, 18 nt, Human
auuucagauguaauguuu

SEQ ID NO: 2845193 - RNA, 19 nt, Human
auuucagauguaauguuuu

SEQ ID NO: 2845194 - RNA, 20 nt, Human
auuucagauguaauguuuuc

SEQ ID NO: 2845195 - RNA, 14 nt, Human
auuucaauucucaa

SEQ ID NO: 2845196 - RNA, 16 nt, Human
auuucagagaggccuu

SEQ ID NO: 2845197 - RNA, 17 nt, Human
auuucaagguucuaacc

SEQ ID NO: 2845198 - RNA, 14 nt, Human
auuucaagguucua

SEQ ID NO: 2845199 - RNA, 15 nt, Human
auuucaagguucuaa

SEQ ID NO: 2845200 - RNA, 19 nt, Human
auuguugacaacugugacu

SEQ ID NO: 2845201 - RNA, 12 nt, Human
auuguuuaugua

SEQ ID NO: 2845202 - RNA, 13 nt, Human
auuguuuauguaa

SEQ ID NO: 2845203 - RNA, 14 nt, Human
auuguacagcuguu

SEQ ID NO: 2845204 - RNA, 16 nt, Human
auuguacagcuguuua

SEQ ID NO: 2845205 - RNA, 17 nt, Human
auuguacagcuguuuaa

SEQ ID NO: 2845206 - RNA, 20 nt, Human
auuguacagcuguuuaagau

SEQ ID NO: 2845207 - RNA, 18 nt, Human
auuguugacaacugugac

SEQ ID NO: 2845208 - RNA, 20 nt, Human
auuguugacaacugugacug

SEQ ID NO: 2845209 - RNA, 15 nt, Human
auuguugaaauuuug

SEQ ID NO: 2845210 - RNA, 16 nt, Human
auuguugaaauuuugc

SEQ ID NO: 2845211 - RNA, 17 nt, Human
auuguugaaucuauuuc

SEQ ID NO: 2845212 - RNA, 15 nt, Human
auuguaaaauagcuu

SEQ ID NO: 2845213 - RNA, 19 nt, Human
auuguaaaauagcuuguau

SEQ ID NO: 2845214 - RNA, 21 nt, Human
auuguaaaauagcuuguauag

SEQ ID NO: 2845215 - RNA, 22 nt, Human
auuguaaaauagcuuguauagu

SEQ ID NO: 2845216 - RNA, 15 nt, Human
auuguaaauuauauu

SEQ ID NO: 2845217 - RNA, 21 nt, Human
auuguaaauuauauuugugcu

SEQ ID NO: 2845218 - RNA, 20 nt, Human
auuguaaaaccugucaauga

SEQ ID NO: 2845219 - RNA, 21 nt, Human
auuguaaaaccugucaaugau

SEQ ID NO: 2845220 - RNA, 20 nt, Human
auugaucauuuuccccccac

SEQ ID NO: 2845221 - RNA, 19 nt, Human
auugaucauuuucccccca

SEQ ID NO: 2845222 - RNA, 21 nt, Human
auugaucauuuuccccccacu

SEQ ID NO: 2845223 - RNA, 17 nt, Human
auugaugaaaagauuua

SEQ ID NO: 2845224 - RNA, 18 nt, Human
auugaugaaaagauuuaa

SEQ ID NO: 2845225 - RNA, 21 nt, Human
auugaugaaaagauuuaagca

SEQ ID NO: 2845226 - RNA, 22 nt, Human
auugaugaaaagauuuaagcac

SEQ ID NO: 2845227 - RNA, 14 nt, Human
auucacaaacuuuu

SEQ ID NO: 2845228 - RNA, 22 nt, Human
auucacaaacuuuuauacucuu

SEQ ID NO: 2845229 - RNA, 13 nt, Human
auucacaaacuuu

SEQ ID NO: 2845230 - RNA, 21 nt, Human
auucaagaaugccaguagaaa

SEQ ID NO: 2845231 - RNA, 22 nt, Human
auucaagaaaacaacuucaaua

SEQ ID NO: 2845232 - RNA, 17 nt, Human
auuaugugguuuuagau

SEQ ID NO: 2845233 - RNA, 11 nt, Human
auuaugugugc

SEQ ID NO: 2845234 - RNA, 13 nt, Human
auuaugugugcau

SEQ ID NO: 2845235 - RNA, 19 nt, Human
auuaugugugcaugugugu

SEQ ID NO: 2845236 - RNA, 21 nt, Human
auuaugugugcauguguguau

SEQ ID NO: 2845237 - RNA, 19 nt, Human
auucaaccauggacuuuau

SEQ ID NO: 2845238 - RNA, 20 nt, Human
auucaaccauggacuuuaua

SEQ ID NO: 2845239 - RNA, 21 nt, Human
auucaaccauggacuuuauaa

SEQ ID NO: 2845240 - RNA, 18 nt, Human
auuaaauuuugaguucua

SEQ ID NO: 2845241 - RNA, 17 nt, Human
auuaaauaagauucuaa

SEQ ID NO: 2845242 - RNA, 12 nt, Human
auuaaauuuaau

SEQ ID NO: 2845243 - RNA, 13 nt, Human
auuaaauuuaauu

SEQ ID NO: 2845244 - RNA, 18 nt, Human
auuaaauuuaauucuuca

SEQ ID NO: 2845245 - RNA, 17 nt, Human
auuaaauuugcaacaau

SEQ ID NO: 2845246 - RNA, 21 nt, Human
auuaaauuuguugacaaaauu

SEQ ID NO: 2845247 - RNA, 14 nt, Human
auuaugugguuuua

SEQ ID NO: 2845248 - RNA, 16 nt, Human
auuaugugguuuuaga

SEQ ID NO: 2845249 - RNA, 17 nt, Human
auucacaaacuuuuaua

SEQ ID NO: 2845250 - RNA, 13 nt, Human
auucauuuuuaau

SEQ ID NO: 2845251 - RNA, 14 nt, Human
auucauuuuauauu

SEQ ID NO: 2845252 - RNA, 18 nt, Human
auucauuuuauauugaaa

SEQ ID NO: 2845253 - RNA, 20 nt, Human
auucauuuuauauugaaaaa

SEQ ID NO: 2845254 - RNA, 22 nt, Human
auucauuuuauauugaaaaaaa

SEQ ID NO: 2845255 - RNA, 13 nt, Human
auuccucuguauu

SEQ ID NO: 2845256 - RNA, 20 nt, Human
auuccaaagaguagaauugc

SEQ ID NO: 2845257 - RNA, 12 nt, Human
auucauuucaca

SEQ ID NO: 2845258 - RNA, 13 nt, Human
auucauuucacau

SEQ ID NO: 2845259 - RNA, 20 nt, Human
auucauuucacauuaauggu

SEQ ID NO: 2845260 - RNA, 22 nt, Human
auucauuucacauuaauggucu

SEQ ID NO: 2845261 - RNA, 18 nt, Human
auucauggaccacuguuu

SEQ ID NO: 2845262 - RNA, 20 nt, Human
auucauggaccacuguuucu

SEQ ID NO: 2845263 - RNA, 22 nt, Human
auucauggaccacuguuucuug

SEQ ID NO: 2845264 - RNA, 14 nt, Human
auucaugccuggcu

SEQ ID NO: 2845265 - RNA, 14 nt, Human
auucaugcuaccca

SEQ ID NO: 2845266 - RNA, 13 nt, Human
auucaugccuggc

SEQ ID NO: 2845267 - RNA, 20 nt, Human
auucaucuguuuuucuuuuu

SEQ ID NO: 2845268 - RNA, 16 nt, Human
auucaucuucuucuuu

SEQ ID NO: 2845269 - RNA, 17 nt, Human
auucaucuuguguuuua

SEQ ID NO: 2845270 - RNA, 19 nt, Human
auucaucaaauggaagaca

SEQ ID NO: 2845271 - RNA, 14 nt, Human
auucaucagcauuu

SEQ ID NO: 2845272 - RNA, 20 nt, Human
auugagaaaaauauauacua

SEQ ID NO: 2845273 - RNA, 17 nt, Human
auugagaaggagagaaa

SEQ ID NO: 2845274 - RNA, 14 nt, Human
auugagaaguucau

SEQ ID NO: 2845275 - RNA, 16 nt, Human
auugagaaguucauug

SEQ ID NO: 2845276 - RNA, 14 nt, Human
auugagaaggagag

SEQ ID NO: 2845277 - RNA, 15 nt, Human
auugagaaggagaga

SEQ ID NO: 2845278 - RNA, 16 nt, Human
auugagaaggagagaa

SEQ ID NO: 2845279 - RNA, 13 nt, Human
auugagaaggaga

SEQ ID NO: 2845280 - RNA, 14 nt, Human
auugagacagugca

SEQ ID NO: 2845281 - RNA, 19 nt, Human
auugagacagugcacauga

SEQ ID NO: 2845282 - RNA, 14 nt, Human
auugagaguuuugu

SEQ ID NO: 2845283 - RNA, 19 nt, Human
auugagauuaugaugaaaa

SEQ ID NO: 2845284 - RNA, 22 nt, Human
auugagauuguccucauuucuc

SEQ ID NO: 2845285 - RNA, 12 nt, Human
auugagauuucu

SEQ ID NO: 2845286 - RNA, 16 nt, Human
auugagaguuuugucu

SEQ ID NO: 2845287 - RNA, 20 nt, Human
auugagaguuuugucuugaa

SEQ ID NO: 2845288 - RNA, 16 nt, Human
auugagauacuuuuuc

SEQ ID NO: 2845289 - RNA, 22 nt, Human
auugagauacuuuuucuuuugu

SEQ ID NO: 2845290 - RNA, 17 nt, Human
auugagaugauuaaaau

SEQ ID NO: 2845291 - RNA, 15 nt, Human
auugaucauaaacug

SEQ ID NO: 2845292 - RNA, 18 nt, Human
auugaucauuuucccccc

SEQ ID NO: 2845293 - RNA, 13 nt, Human
auugauauuguga

SEQ ID NO: 2845294 - RNA, 14 nt, Human
auugauauugugaa

SEQ ID NO: 2845295 - RNA, 15 nt, Human
auugauauugugaac

SEQ ID NO: 2845296 - RNA, 19 nt, Human
auugauauugugaacauuu

SEQ ID NO: 2845297 - RNA, 15 nt, Human
auugagcugauauaa

SEQ ID NO: 2845298 - RNA, 19 nt, Human
auugagcugauauaaauuc

SEQ ID NO: 2845299 - RNA, 20 nt, Human
auugagcugauauaaauucu

SEQ ID NO: 2845300 - RNA, 22 nt, Human
auugagcugauauaaauucugu

SEQ ID NO: 2845301 - RNA, 19 nt, Human
auucugagcauacucaaca

SEQ ID NO: 2845302 - RNA, 17 nt, Human
auucugaggcccugccc

SEQ ID NO: 2845303 - RNA, 15 nt, Human
auucugaggcccugc

SEQ ID NO: 2845304 - RNA, 18 nt, Human
auucugaggcccugccca

SEQ ID NO: 2845305 - RNA, 24 nt, Human
auuccugaacuauaacaccugcca

SEQ ID NO: 2845306 - RNA, 15 nt, Human
auucugagaaaacaa

SEQ ID NO: 2845307 - RNA, 19 nt, Human
auucugagacaugugucaa

SEQ ID NO: 2845308 - RNA, 14 nt, Human
auucugagaccaaa

SEQ ID NO: 2845309 - RNA, 14 nt, Human
auucugagaaaaca

SEQ ID NO: 2845310 - RNA, 23 nt, Human
auuccugauaugauuuaaaacau

SEQ ID NO: 2845311 - RNA, 20 nt, Human
auuccugauaugauuuaaaa

SEQ ID NO: 2845312 - RNA, 22 nt, Human
auuccugauaugauuuaaaaca

SEQ ID NO: 2845313 - RNA, 16 nt, Human
auuccugauaugauuu

SEQ ID NO: 2845314 - RNA, 19 nt, Human
auuccugauaugauuuaaa

SEQ ID NO: 2845315 - RNA, 20 nt, Human
auuccugagauuuccuccug

SEQ ID NO: 2845316 - RNA, 22 nt, Human
auuccugagauuuccuccuggc

SEQ ID NO: 2845317 - RNA, 17 nt, Human
auucuugguuggcuggc

SEQ ID NO: 2845318 - RNA, 20 nt, Human
auucuugguuggcuggccuu

SEQ ID NO: 2845319 - RNA, 18 nt, Human
auucuuguaaggcuuuga

SEQ ID NO: 2845320 - RNA, 13 nt, Human
auucuuguacagu

SEQ ID NO: 2845321 - RNA, 12 nt, Human
auucuugugcuu

SEQ ID NO: 2845322 - RNA, 18 nt, Human
auucuugugcuuuuccug

SEQ ID NO: 2845323 - RNA, 18 nt, Human
auucuuguuuucuuucuu

SEQ ID NO: 2845324 - RNA, 21 nt, Human
auucuuguuuucuuucuuuaa

SEQ ID NO: 2845325 - RNA, 23 nt, Human
auucuuguuuucuuucuuuaaau

SEQ ID NO: 2845326 - RNA, 14 nt, Human
auucuugucaaaaa

SEQ ID NO: 2845327 - RNA, 16 nt, Human
caaaucaguuaguuuu

SEQ ID NO: 2845328 - RNA, 13 nt, Human
caaaucagucagu

SEQ ID NO: 2845329 - RNA, 23 nt, Human
caaaucagucagugcaaauguca

SEQ ID NO: 2845330 - RNA, 14 nt, Human
caaaguauuguaaa

SEQ ID NO: 2845331 - RNA, 15 nt, Human
caaaguauuguaaau

SEQ ID NO: 2845332 - RNA, 16 nt, Human
caaaguauuguaaauu

SEQ ID NO: 2845333 - RNA, 17 nt, Human
caaaguauuguaaauua

SEQ ID NO: 2845334 - RNA, 18 nt, Human
caaaguauuguaaauuau

SEQ ID NO: 2845335 - RNA, 19 nt, Human
caaaguauuguaaauuaua

SEQ ID NO: 2845336 - RNA, 20 nt, Human
caaaguauuguaaauuauau

SEQ ID NO: 2845337 - RNA, 22 nt, Human
caaaguauuguaaauuauauuu

SEQ ID NO: 2845338 - RNA, 21 nt, Human
caaaguaaaacuugcugccug

SEQ ID NO: 2845339 - RNA, 13 nt, Human
caaaguaaaagaa

SEQ ID NO: 2845340 - RNA, 14 nt, Human
caaaguaaaagaaa

SEQ ID NO: 2845341 - RNA, 15 nt, Human
caaaguaaaagaaac

SEQ ID NO: 2845342 - RNA, 23 nt, Human
caaaguaaaagaaaccacuucug

SEQ ID NO: 2845343 - RNA, 13 nt, Human
caaagaugaccau

SEQ ID NO: 2845344 - RNA, 19 nt, Human
caaagaugaccauaaccac

SEQ ID NO: 2845345 - RNA, 17 nt, Human
caacaaaaagcuucccc

SEQ ID NO: 2845346 - RNA, 16 nt, Human
caacaaaaagcuuccc

SEQ ID NO: 2845347 - RNA, 17 nt, Human
caaauuuuuuaaaagag

SEQ ID NO: 2845348 - RNA, 19 nt, Human
caaauuuuuuaaaagagac

SEQ ID NO: 2845349 - RNA, 19 nt, Human
caaauuuuuauuuuuuagu

SEQ ID NO: 2845350 - RNA, 23 nt, Human
caaauuuuuauuuuuuagugcau

SEQ ID NO: 2845351 - RNA, 20 nt, Human
caaauuuuucucaguuugua

SEQ ID NO: 2845352 - RNA, 21 nt, Human
caacaauuugggcuuccuguu

SEQ ID NO: 2845353 - RNA, 17 nt, Human
caaaucuauuuaauuag

SEQ ID NO: 2845354 - RNA, 23 nt, Human
caaaucuauuuaauuaggaaaaa

SEQ ID NO: 2845355 - RNA, 21 nt, Human
caaaucucaaugaagccagcu

SEQ ID NO: 2845356 - RNA, 14 nt, Human
caaaucugaagauu

SEQ ID NO: 2845357 - RNA, 19 nt, Human
caaaucguccagcgaccuu

SEQ ID NO: 2845358 - RNA, 21 nt, Human
caaaucguccagcgaccuucc

SEQ ID NO: 2845359 - RNA, 16 nt, Human
caaaucguuuauuuca

SEQ ID NO: 2845360 - RNA, 20 nt, Human
caaaguacaauguguuuuuc

SEQ ID NO: 2845361 - RNA, 19 nt, Human
caaaugcagggauugcugc

SEQ ID NO: 2845362 - RNA, 20 nt, Human
caaaugcagggauugcugcc

SEQ ID NO: 2845363 - RNA, 22 nt, Human
caaaugcagggauugcugccac

SEQ ID NO: 2845364 - RNA, 21 nt, Human
caaauuuugaugccaagaaag

SEQ ID NO: 2845365 - RNA, 23 nt, Human
caaaugcagggauugcugccacu

SEQ ID NO: 2845366 - RNA, 16 nt, Human
caaaugcaguauauuu

SEQ ID NO: 2845367 - RNA, 18 nt, Human
caaaugcaguauauuucu

SEQ ID NO: 2845368 - RNA, 15 nt, Human
caaaugcaauuugau

SEQ ID NO: 2845369 - RNA, 13 nt, Human
caaaugcagcuuu

SEQ ID NO: 2845370 - RNA, 14 nt, Human
caaccauuccccau

SEQ ID NO: 2845371 - RNA, 15 nt, Human
caacccaaggacuga

SEQ ID NO: 2845372 - RNA, 19 nt, Human
caacccaaggacugaggga

SEQ ID NO: 2845373 - RNA, 22 nt, Human
caacccaaggacugagggacuc

SEQ ID NO: 2845374 - RNA, 21 nt, Human
caaccacuaagaauucaaacu

SEQ ID NO: 2845375 - RNA, 12 nt, Human
caaccagacaga

SEQ ID NO: 2845376 - RNA, 13 nt, Human
caaccagacagag

SEQ ID NO: 2845377 - RNA, 15 nt, Human
caaccagacagaggg

SEQ ID NO: 2845378 - RNA, 17 nt, Human
caaccauggacuuuaua

SEQ ID NO: 2845379 - RNA, 18 nt, Human
caaccauggacuuuauaa

SEQ ID NO: 2845380 - RNA, 22 nt, Human
caaccauuccagacugcuucca

SEQ ID NO: 2845381 - RNA, 16 nt, Human
caaccauuccagacug

SEQ ID NO: 2845382 - RNA, 14 nt, Human
caaccauuccagac

SEQ ID NO: 2845383 - RNA, 13 nt, Human
caaccauuccaga

SEQ ID NO: 2845384 - RNA, 17 nt, Human
caacuaugauuuggaaa

SEQ ID NO: 2845385 - RNA, 16 nt, Human
caaccccacccuguuu

SEQ ID NO: 2845386 - RNA, 20 nt, Human
caacuauuuuuccaaaauaa

SEQ ID NO: 2845387 - RNA, 18 nt, Human
caacuaugauuuggaaaa

SEQ ID NO: 2845388 - RNA, 19 nt, Human
caacuaugauuuggaaaau

SEQ ID NO: 2845389 - RNA, 17 nt, Human
caacccccagccugcua

SEQ ID NO: 2845390 - RNA, 16 nt, Human
caacccccagccugcu

SEQ ID NO: 2845391 - RNA, 15 nt, Human
caacccccagccugc

SEQ ID NO: 2845392 - RNA, 17 nt, Human
caaccccaagccagccc

SEQ ID NO: 2845393 - RNA, 22 nt, Human
caacccaugaugagcuccucuu

SEQ ID NO: 2845394 - RNA, 14 nt, Human
caagaaguuuauuc

SEQ ID NO: 2845395 - RNA, 17 nt, Human
caagaaguuuauucuca

SEQ ID NO: 2845396 - RNA, 12 nt, Human
caagaauaaaaa

SEQ ID NO: 2845397 - RNA, 19 nt, Human
caagaagucaaaguaaaac

SEQ ID NO: 2845398 - RNA, 23 nt, Human
caagaaggguuuuccacccugga

SEQ ID NO: 2845399 - RNA, 16 nt, Human
caagaaguagcagugu

SEQ ID NO: 2845400 - RNA, 20 nt, Human
caagaaguagcagugucugu

SEQ ID NO: 2845401 - RNA, 22 nt, Human
caagaaggguuuuccacccugg

SEQ ID NO: 2845402 - RNA, 23 nt, Human
caagaauuucuugguaagaagcc

SEQ ID NO: 2845403 - RNA, 22 nt, Human
caagaauuucuugguaagaagc

SEQ ID NO: 2845404 - RNA, 14 nt, Human
caagacaaaccaag

SEQ ID NO: 2845405 - RNA, 12 nt, Human
caagacaaauca

SEQ ID NO: 2845406 - RNA, 13 nt, Human
caagacaaaucaa

SEQ ID NO: 2845407 - RNA, 14 nt, Human
caagacaaaucaac

SEQ ID NO: 2845408 - RNA, 15 nt, Human
caagacaaaucaaca

SEQ ID NO: 2845409 - RNA, 18 nt, Human
caagacaaaucaacagaa

SEQ ID NO: 2845410 - RNA, 20 nt, Human
caagacaaaucaacagaagc

SEQ ID NO: 2845411 - RNA, 21 nt, Human
caagacaaaucaacagaagca

SEQ ID NO: 2845412 - RNA, 13 nt, Human
caagacacaguga

SEQ ID NO: 2845413 - RNA, 21 nt, Human
caagacagaugccccagagcu

SEQ ID NO: 2845414 - RNA, 16 nt, Human
caagacagaugcccca

SEQ ID NO: 2845415 - RNA, 13 nt, Human
caagacagaugcc

SEQ ID NO: 2845416 - RNA, 15 nt, Human
caagacacaucccua

SEQ ID NO: 2845417 - RNA, 19 nt, Human
caagauguugauuuuuacu

SEQ ID NO: 2845418 - RNA, 14 nt, Human
caagauuaaaugua

SEQ ID NO: 2845419 - RNA, 20 nt, Human
caaaaaaaaaaaaagaagac

SEQ ID NO: 2845420 - RNA, 21 nt, Human
caaaaaaaaaaaaagaagacc

SEQ ID NO: 2845421 - RNA, 17 nt, Human
auuuuuuuuuccuagcc

SEQ ID NO: 2845422 - RNA, 13 nt, Human
caaaaaaaccaca

SEQ ID NO: 2845423 - RNA, 17 nt, Human
caaaaaaaccacaaagg

SEQ ID NO: 2845424 - RNA, 18 nt, Human
caaaaaaaccacaaaggc

SEQ ID NO: 2845425 - RNA, 22 nt, Human
caaaaaaaccacaaaggccaaa

SEQ ID NO: 2845426 - RNA, 15 nt, Human
caaaaaaaagucuau

SEQ ID NO: 2845427 - RNA, 18 nt, Human
caaaaaaauauauuuaau

SEQ ID NO: 2845428 - RNA, 15 nt, Human
auuuuuaaucaugaa

SEQ ID NO: 2845429 - RNA, 12 nt, Human
caaaagcugcuc

SEQ ID NO: 2845430 - RNA, 19 nt, Human
caaaagcuagacagauccc

SEQ ID NO: 2845431 - RNA, 13 nt, Human
caaaagccuugug

SEQ ID NO: 2845432 - RNA, 14 nt, Human
caaaagccuugugu

SEQ ID NO: 2845433 - RNA, 18 nt, Human
caaaagccuuguguauau

SEQ ID NO: 2845434 - RNA, 19 nt, Human
caaaagccuuguguauauu

SEQ ID NO: 2845435 - RNA, 20 nt, Human
caaaagccuuguguauauuu

SEQ ID NO: 2845436 - RNA, 22 nt, Human
caaaagccuuguguauauuugu

SEQ ID NO: 2845437 - RNA, 23 nt, Human
caaaagccuuguguauauuugua

SEQ ID NO: 2845438 - RNA, 17 nt, Human
auuuuuacccuaauguc

SEQ ID NO: 2845439 - RNA, 19 nt, Human
auuuuuacccuaaugucuu

SEQ ID NO: 2845440 - RNA, 21 nt, Human
auuuuuacccuaaugucuuca

SEQ ID NO: 2845441 - RNA, 22 nt, Human
auuuuuacccuaaugucuucau

SEQ ID NO: 2845442 - RNA, 19 nt, Human
auuuuuacauggagaaaac

SEQ ID NO: 2845443 - RNA, 16 nt, Human
auuuuuaaucaugaaa

SEQ ID NO: 2845444 - RNA, 17 nt, Human
auuuuuaaucaugaaau

SEQ ID NO: 2845445 - RNA, 16 nt, Human
auuuuuaauggcagca

SEQ ID NO: 2845446 - RNA, 12 nt, Human
auuuuuaauuaa

SEQ ID NO: 2845447 - RNA, 15 nt, Human
auuuuuaauuaaaaa

SEQ ID NO: 2845448 - RNA, 18 nt, Human
auuuuuaauuaaaaacua

SEQ ID NO: 2845449 - RNA, 19 nt, Human
auuuuuacaagaaguuuau

SEQ ID NO: 2845450 - RNA, 20 nt, Human
auuuuuacaagaaguuuauu

SEQ ID NO: 2845451 - RNA, 22 nt, Human
auuuuuacaagaaguuuauucu

SEQ ID NO: 2845452 - RNA, 14 nt, Human
caaaagcugcucag

SEQ ID NO: 2845453 - RNA, 20 nt, Human
caaaagguucacuaaagcag

SEQ ID NO: 2845454 - RNA, 19 nt, Human
caaaagguucacuaaagca

SEQ ID NO: 2845455 - RNA, 14 nt, Human
caaaaguaaugccu

SEQ ID NO: 2845456 - RNA, 15 nt, Human
caaaaguaaugccuc

SEQ ID NO: 2845457 - RNA, 17 nt, Human
caaaaguaaugccucug

SEQ ID NO: 2845458 - RNA, 22 nt, Human
caaaaguaaugccucugucuag

SEQ ID NO: 2845459 - RNA, 14 nt, Human
caaaccacacugga

SEQ ID NO: 2845460 - RNA, 21 nt, Human
caaaccaagagauugcuaauu

SEQ ID NO: 2845461 - RNA, 17 nt, Human
caaaccaagucggaaca

SEQ ID NO: 2845462 - RNA, 22 nt, Human
caaaccaagucggaacagcaga

SEQ ID NO: 2845463 - RNA, 14 nt, Human
caaaccacaacuga

SEQ ID NO: 2845464 - RNA, 15 nt, Human
caaaccacaacugac

SEQ ID NO: 2845465 - RNA, 21 nt, Human
caaaccacaacugacacagga

SEQ ID NO: 2845466 - RNA, 15 nt, Human
caaaccacacuggac

SEQ ID NO: 2845467 - RNA, 14 nt, Human
caaagaucaaaaua

SEQ ID NO: 2845468 - RNA, 15 nt, Human
caaagaucaaaauaa

SEQ ID NO: 2845469 - RNA, 13 nt, Human
caaagaucaaaau

SEQ ID NO: 2845470 - RNA, 16 nt, Human
caaagaucaaaauaaa

SEQ ID NO: 2845471 - RNA, 17 nt, Human
caaagaucaaaauaaaa

SEQ ID NO: 2845472 - RNA, 18 nt, Human
caaagaucaaaauaaaaa

SEQ ID NO: 2845473 - RNA, 20 nt, Human
caaagaucaaaauaaaaagu

SEQ ID NO: 2845474 - RNA, 15 nt, Human
auuuuauaaagugcu

SEQ ID NO: 2845475 - RNA, 21 nt, Human
auuuuauaaagugcuugugua

SEQ ID NO: 2845476 - RNA, 13 nt, Human
auuuuauauugaa

SEQ ID NO: 2845477 - RNA, 14 nt, Human
auuuuauauugaaa

SEQ ID NO: 2845478 - RNA, 15 nt, Human
auuuuauauugaaaa

SEQ ID NO: 2845479 - RNA, 16 nt, Human
auuuuauauugaaaaa

SEQ ID NO: 2845480 - RNA, 22 nt, Human
auuuuauauugaaaaaaauaau

SEQ ID NO: 2845481 - RNA, 19 nt, Human
auuuuauagacacccuggc

SEQ ID NO: 2845482 - RNA, 19 nt, Human
auuuuauaagcaaauuuca

SEQ ID NO: 2845483 - RNA, 18 nt, Human
auuuugauccaagcuggu

SEQ ID NO: 2845484 - RNA, 18 nt, Human
auuuugaguaaagcuccu

SEQ ID NO: 2845485 - RNA, 17 nt, Human
auuuugagguaaagaua

SEQ ID NO: 2845486 - RNA, 18 nt, Human
auuuugagguaaagauau

SEQ ID NO: 2845487 - RNA, 13 nt, Human
auuuugauaauaa

SEQ ID NO: 2845488 - RNA, 15 nt, Human
auuuugauaauaaau

SEQ ID NO: 2845489 - RNA, 17 nt, Human
auuuugauaauaaauug

SEQ ID NO: 2845490 - RNA, 18 nt, Human
auuuugauaauaaauuga

SEQ ID NO: 2845491 - RNA, 16 nt, Human
auuuugauaauaauau

SEQ ID NO: 2845492 - RNA, 21 nt, Human
auuuugauaauaauauuguuu

SEQ ID NO: 2845493 - RNA, 17 nt, Human
auuuugauaccagaagg

SEQ ID NO: 2845494 - RNA, 19 nt, Human
auuuugauaccagaaggga

SEQ ID NO: 2845495 - RNA, 15 nt, Human
auuuugagaacaaag

SEQ ID NO: 2845496 - RNA, 19 nt, Human
auuuugagaacaaagauga

SEQ ID NO: 2845497 - RNA, 19 nt, Human
auuuugacuuaaugugauu

SEQ ID NO: 2845498 - RNA, 13 nt, Human
auuuucuuuucuu

SEQ ID NO: 2845499 - RNA, 19 nt, Human
auuuucuuuuguaaauguu

SEQ ID NO: 2845500 - RNA, 24 nt, Human
auuuugacaguuauuuugauaaca

SEQ ID NO: 2845501 - RNA, 17 nt, Human
auuuucuuuuguaaaug

SEQ ID NO: 2845502 - RNA, 16 nt, Human
auuuucuuuuguaaau

SEQ ID NO: 2845503 - RNA, 23 nt, Human
auuuucuuuguguagcuuugcuc

SEQ ID NO: 2845504 - RNA, 20 nt, Human
auuuucuuuucuuucaacuu

SEQ ID NO: 2845505 - RNA, 18 nt, Human
auuuucuuuugaauuguu

SEQ ID NO: 2845506 - RNA, 20 nt, Human
auuuucuuuugaauuguuuu

SEQ ID NO: 2845507 - RNA, 16 nt, Human
auuuucuuucuguaac

SEQ ID NO: 2845508 - RNA, 12 nt, Human
auuuucuucuaa

SEQ ID NO: 2845509 - RNA, 13 nt, Human
auuuucuucuaag

SEQ ID NO: 2845510 - RNA, 14 nt, Human
auuuucuucuaagu

SEQ ID NO: 2845511 - RNA, 16 nt, Human
auuuucuucuaaguga

SEQ ID NO: 2845512 - RNA, 20 nt, Human
auuuucuucuaagugaaauu

SEQ ID NO: 2845513 - RNA, 21 nt, Human
auuuuuaagcaaaauauuauu

SEQ ID NO: 2845514 - RNA, 12 nt, Human
auuuuuaaauug

SEQ ID NO: 2845515 - RNA, 13 nt, Human
auuuuuaaauugu

SEQ ID NO: 2845516 - RNA, 14 nt, Human
auuuuuaaauuguu

SEQ ID NO: 2845517 - RNA, 19 nt, Human
auuuuuaaauguaaaacau

SEQ ID NO: 2845518 - RNA, 14 nt, Human
auuuuuaaaguaga

SEQ ID NO: 2845519 - RNA, 19 nt, Human
auuuuuaaaguagaagagg

SEQ ID NO: 2845520 - RNA, 12 nt, Human
auuuuuaaagau

SEQ ID NO: 2845521 - RNA, 15 nt, Human
auuuuuaaagauaga

SEQ ID NO: 2845522 - RNA, 13 nt, Human
auuuuuaaagauc

SEQ ID NO: 2845523 - RNA, 14 nt, Human
auuuuuaaagcaug

SEQ ID NO: 2845524 - RNA, 15 nt, Human
auuuuuaaagcaugg

SEQ ID NO: 2845525 - RNA, 12 nt, Human
cacuuguacaaa

SEQ ID NO: 2845526 - RNA, 15 nt, Human
cacuuggugcuggga

SEQ ID NO: 2845527 - RNA, 17 nt, Human
cacuuggugcugggaac

SEQ ID NO: 2845528 - RNA, 20 nt, Human
cacuuagaaauugcauuucc

SEQ ID NO: 2845529 - RNA, 19 nt, Human
cacuugugauuauaaaauu

SEQ ID NO: 2845530 - RNA, 17 nt, Human
cacuugugauuauuuau

SEQ ID NO: 2845531 - RNA, 18 nt, Human
cacuugugccaacacuca

SEQ ID NO: 2845532 - RNA, 24 nt, Human
cacuugugccaacacucaagaagc

SEQ ID NO: 2845533 - RNA, 15 nt, Human
cacuugugcuuugcu

SEQ ID NO: 2845534 - RNA, 20 nt, Human
cacuuuauaagucauuguau

SEQ ID NO: 2845535 - RNA, 22 nt, Human
cacuuuauaagucauuguaugu

SEQ ID NO: 2845536 - RNA, 16 nt, Human
cacuugucucauuuua

SEQ ID NO: 2845537 - RNA, 19 nt, Human
cacuugucucauuuuaaug

SEQ ID NO: 2845538 - RNA, 22 nt, Human
cacuugucucauuuuaauguaa

SEQ ID NO: 2845539 - RNA, 17 nt, Human
cacuguugcccaggcug

SEQ ID NO: 2845540 - RNA, 21 nt, Human
cacuguuuaaguacuguuuac

SEQ ID NO: 2845541 - RNA, 17 nt, Human
cacuuagaaauugcauu

SEQ ID NO: 2845542 - RNA, 19 nt, Human
cacuuagaaauugcauuuc

SEQ ID NO: 2845543 - RNA, 20 nt, Human
cacuguuucucuugagcugg

SEQ ID NO: 2845544 - RNA, 19 nt, Human
cacuguuucucuugagcug

SEQ ID NO: 2845545 - RNA, 17 nt, Human
cacuuacuguaagacau

SEQ ID NO: 2845546 - RNA, 19 nt, Human
cacuuacuguaagacauua

SEQ ID NO: 2845547 - RNA, 18 nt, Human
cacuguuucucuugagcu

SEQ ID NO: 2845548 - RNA, 17 nt, Human
cacuguuucucuugagc

SEQ ID NO: 2845549 - RNA, 16 nt, Human
cacuggggaaaacucc

SEQ ID NO: 2845550 - RNA, 21 nt, Human
cacuggggagcccgucucagu

SEQ ID NO: 2845551 - RNA, 16 nt, Human
cacuguugcccaggcu

SEQ ID NO: 2845552 - RNA, 15 nt, Human
cacuguugcccaggc

SEQ ID NO: 2845553 - RNA, 14 nt, Human
cacuguugcccagg

SEQ ID NO: 2845554 - RNA, 22 nt, Human
cacugguggcccgacagccugg

SEQ ID NO: 2845555 - RNA, 13 nt, Human
cacugguggcccg

SEQ ID NO: 2845556 - RNA, 21 nt, Human
cacugguggcccgacagccug

SEQ ID NO: 2845557 - RNA, 22 nt, Human
cacuggggagcccgucucagug

SEQ ID NO: 2845558 - RNA, 13 nt, Human
cacuuucccaccc

SEQ ID NO: 2845559 - RNA, 16 nt, Human
cacuuucuaauguuuc

SEQ ID NO: 2845560 - RNA, 12 nt, Human
cacuuuccacuu

SEQ ID NO: 2845561 - RNA, 13 nt, Human
cacuuuccacuuc

SEQ ID NO: 2845562 - RNA, 17 nt, Human
cacuuuccacuucuucc

SEQ ID NO: 2845563 - RNA, 18 nt, Human
cacuuuccacuucuuccu

SEQ ID NO: 2845564 - RNA, 19 nt, Human
cacuuuccacuucuuccuu

SEQ ID NO: 2845565 - RNA, 22 nt, Human
cacuuuccacuucuuccuuucu

SEQ ID NO: 2845566 - RNA, 12 nt, Human
cacuuucaaaac

SEQ ID NO: 2845567 - RNA, 22 nt, Human
cacuugugccaacacucaagaa

SEQ ID NO: 2845568 - RNA, 20 nt, Human
cagaaauuggaacagaaugu

SEQ ID NO: 2845569 - RNA, 21 nt, Human
cagaaauuggaacagaauguu

SEQ ID NO: 2845570 - RNA, 11 nt, Human
cagaaauugga

SEQ ID NO: 2845571 - RNA, 23 nt, Human
cagaaauuagaaaccuuaauaug

SEQ ID NO: 2845572 - RNA, 16 nt, Human
cagaaauuagccgggc

SEQ ID NO: 2845573 - RNA, 21 nt, Human
cagaaguuguggauuucaguu

SEQ ID NO: 2845574 - RNA, 15 nt, Human
cagaaguggagcugg

SEQ ID NO: 2845575 - RNA, 16 nt, Human
cagaaguggagcuggg

SEQ ID NO: 2845576 - RNA, 13 nt, Human
cagaaguggagcu

SEQ ID NO: 2845577 - RNA, 14 nt, Human
cagaaguggagcug

SEQ ID NO: 2845578 - RNA, 12 nt, Human
cagaaguccugu

SEQ ID NO: 2845579 - RNA, 19 nt, Human
cagaaguccuguaugucug

SEQ ID NO: 2845580 - RNA, 20 nt, Human
cagaaguccuguaugucugu

SEQ ID NO: 2845581 - RNA, 21 nt, Human
cagaaguccuguaugucuguc

SEQ ID NO: 2845582 - RNA, 22 nt, Human
cagaaguccuguaugucuguca

SEQ ID NO: 2845583 - RNA, 14 nt, Human
cagaagucuccuca

SEQ ID NO: 2845584 - RNA, 15 nt, Human
cagaagucuccucaa

SEQ ID NO: 2845585 - RNA, 13 nt, Human
cagaagugaaaau

SEQ ID NO: 2845586 - RNA, 15 nt, Human
cagaacaacaacuau

SEQ ID NO: 2845587 - RNA, 19 nt, Human
cagaacacggcucacgcuu

SEQ ID NO: 2845588 - RNA, 15 nt, Human
cagaacacauaauuc

SEQ ID NO: 2845589 - RNA, 19 nt, Human
cagaagucaugaagcccaa

SEQ ID NO: 2845590 - RNA, 18 nt, Human
cagaagucaugaagccca

SEQ ID NO: 2845591 - RNA, 13 nt, Human
cagaauauugcuu

SEQ ID NO: 2845592 - RNA, 22 nt, Human
cagaauauuagugaccucagcu

SEQ ID NO: 2845593 - RNA, 15 nt, Human
cagaauagccacauu

SEQ ID NO: 2845594 - RNA, 22 nt, Human
cagaauagccacauuuggaaua

SEQ ID NO: 2845595 - RNA, 21 nt, Human
cagaauagccacauuuggaau

SEQ ID NO: 2845596 - RNA, 17 nt, Human
cagaauaaucuuugggu

SEQ ID NO: 2845597 - RNA, 15 nt, Human
cagaauaauguucua

SEQ ID NO: 2845598 - RNA, 18 nt, Human
cagaauaauguucuauug

SEQ ID NO: 2845599 - RNA, 18 nt, Human
cagaauaaggcaggcauu

SEQ ID NO: 2845600 - RNA, 20 nt, Human
cagaauaaggcaggcauuga

SEQ ID NO: 2845601 - RNA, 16 nt, Human
cagaaguuuggcaaua

SEQ ID NO: 2845602 - RNA, 17 nt, Human
caccuaagucucuguga

SEQ ID NO: 2845603 - RNA, 16 nt, Human
caccuaagucucugug

SEQ ID NO: 2845604 - RNA, 15 nt, Human
caccuaagucucugu

SEQ ID NO: 2845605 - RNA, 18 nt, Human
caccuaagagauucugau

SEQ ID NO: 2845606 - RNA, 20 nt, Human
caccuaaagguguauuuaaa

SEQ ID NO: 2845607 - RNA, 21 nt, Human
caccuaaagguguauuuaaac

SEQ ID NO: 2845608 - RNA, 18 nt, Human
caccuaccacucacauga

SEQ ID NO: 2845609 - RNA, 13 nt, Human
caccuauuuccau

SEQ ID NO: 2845610 - RNA, 21 nt, Human
caccuaugugccaacuguugu

SEQ ID NO: 2845611 - RNA, 12 nt, Human
caccuaugugcc

SEQ ID NO: 2845612 - RNA, 14 nt, Human
caccuaugugccaa

SEQ ID NO: 2845613 - RNA, 17 nt, Human
caccuaugugccaacug

SEQ ID NO: 2845614 - RNA, 18 nt, Human
caccuaccgaguucaagu

SEQ ID NO: 2845615 - RNA, 20 nt, Human
caccuaccaccacgcccggc

SEQ ID NO: 2845616 - RNA, 22 nt, Human
caccuaccaucagggacaggau

SEQ ID NO: 2845617 - RNA, 23 nt, Human
caccuacccauacacccccucuu

SEQ ID NO: 2845618 - RNA, 17 nt, Human
caccuaccaucagggac

SEQ ID NO: 2845619 - RNA, 18 nt, Human
caccuaccaucagggaca

SEQ ID NO: 2845620 - RNA, 17 nt, Human
caccugccauuugcacc

SEQ ID NO: 2845621 - RNA, 19 nt, Human
caccuugacagggcacacc

SEQ ID NO: 2845622 - RNA, 14 nt, Human
caccuugcggggau

SEQ ID NO: 2845623 - RNA, 13 nt, Human
caccuuggcucaa

SEQ ID NO: 2845624 - RNA, 13 nt, Human
caccuuuguagca

SEQ ID NO: 2845625 - RNA, 14 nt, Human
caccuuuguagcac

SEQ ID NO: 2845626 - RNA, 20 nt, Human
caccuuuguagcacucaggc

SEQ ID NO: 2845627 - RNA, 21 nt, Human
caccuuuguagcacucaggcu

SEQ ID NO: 2845628 - RNA, 18 nt, Human
caccuuugcacaggaugc

SEQ ID NO: 2845629 - RNA, 15 nt, Human
caccuuuagguucuu

SEQ ID NO: 2845630 - RNA, 20 nt, Human
caccuuuaaguagauaagca

SEQ ID NO: 2845631 - RNA, 14 nt, Human
caccuuuacuuuag

SEQ ID NO: 2845632 - RNA, 14 nt, Human
caccuuuagguucu

SEQ ID NO: 2845633 - RNA, 15 nt, Human
caccuugugucugua

SEQ ID NO: 2845634 - RNA, 17 nt, Human
caccuugugucuguaca

SEQ ID NO: 2845635 - RNA, 21 nt, Human
caccuugugucuguacacgug

SEQ ID NO: 2845636 - RNA, 22 nt, Human
caccuuguguguuccaaguuuc

SEQ ID NO: 2845637 - RNA, 14 nt, Human
cacuccccaccuuc

SEQ ID NO: 2845638 - RNA, 13 nt, Human
cacuccccaagga

SEQ ID NO: 2845639 - RNA, 14 nt, Human
cacuccccaaggaa

SEQ ID NO: 2845640 - RNA, 20 nt, Human
cacuccccaaggaagagcca

SEQ ID NO: 2845641 - RNA, 13 nt, Human
cacucccaggcag

SEQ ID NO: 2845642 - RNA, 14 nt, Human
cacucccaggcagc

SEQ ID NO: 2845643 - RNA, 15 nt, Human
cacucccaggcagcc

SEQ ID NO: 2845644 - RNA, 15 nt, Human
cacuccccaccuuca

SEQ ID NO: 2845645 - RNA, 16 nt, Human
cacuccccaugccacg

SEQ ID NO: 2845646 - RNA, 18 nt, Human
cacuccccaugccacguu

SEQ ID NO: 2845647 - RNA, 19 nt, Human
cacuccccaugccacguuc

SEQ ID NO: 2845648 - RNA, 21 nt, Human
cacucccccuaaaccccuguc

SEQ ID NO: 2845649 - RNA, 22 nt, Human
cacucccccuaaaccccugucc

SEQ ID NO: 2845650 - RNA, 18 nt, Human
cacuaggacucugaggcu

SEQ ID NO: 2845651 - RNA, 16 nt, Human
cacuaggcacccagcu

SEQ ID NO: 2845652 - RNA, 19 nt, Human
cacuaggcacccagcugcc

SEQ ID NO: 2845653 - RNA, 20 nt, Human
cacuaggcacccagcugcca

SEQ ID NO: 2845654 - RNA, 17 nt, Human
cacuaggacucugaggc

SEQ ID NO: 2845655 - RNA, 17 nt, Human
cacuagccuuuggcucu

SEQ ID NO: 2845656 - RNA, 18 nt, Human
cacuagccuuuggcucug

SEQ ID NO: 2845657 - RNA, 20 nt, Human
cacuagccuuuggcucugga

SEQ ID NO: 2845658 - RNA, 16 nt, Human
cacuaggacucugagg

SEQ ID NO: 2845659 - RNA, 21 nt, Human
cacuagccuuuggcucuggag

SEQ ID NO: 2845660 - RNA, 22 nt, Human
cacuagccuuuggcucuggaga

SEQ ID NO: 2845661 - RNA, 19 nt, Human
cacucuuauugcccacgcu

SEQ ID NO: 2845662 - RNA, 18 nt, Human
cacucuuauugcccacgc

SEQ ID NO: 2845663 - RNA, 17 nt, Human
cacucuuauugcccacg

SEQ ID NO: 2845664 - RNA, 16 nt, Human
cacuccccuccacucu

SEQ ID NO: 2845665 - RNA, 19 nt, Human
cacuccccgaagucuuuug

SEQ ID NO: 2845666 - RNA, 18 nt, Human
cacuccccgaagucuuuu

SEQ ID NO: 2845667 - RNA, 11 nt, Human
cacucuuaggc

SEQ ID NO: 2845668 - RNA, 19 nt, Human
cacucuuaggcacuuuggg

SEQ ID NO: 2845669 - RNA, 23 nt, Human
cacuacggaauaguuggcuagga

SEQ ID NO: 2845670 - RNA, 13 nt, Human
cacuacaccacac

SEQ ID NO: 2845671 - RNA, 15 nt, Human
cacuacaccacacac

SEQ ID NO: 2845672 - RNA, 16 nt, Human
cacuacaccacacaca

SEQ ID NO: 2845673 - RNA, 17 nt, Human
cacuacaccacacacaa

SEQ ID NO: 2845674 - RNA, 20 nt, Human
cacuacaccacacacaacag

SEQ ID NO: 2845675 - RNA, 21 nt, Human
cacuacaccacacacaacagc

SEQ ID NO: 2845676 - RNA, 23 nt, Human
cacuacaccacacacaacagcca

SEQ ID NO: 2845677 - RNA, 17 nt, Human
cacuaauuugauguuua

SEQ ID NO: 2845678 - RNA, 21 nt, Human
cacuaauuuuaguauucauuc

SEQ ID NO: 2845679 - RNA, 16 nt, Human
cacggccaggccagag

SEQ ID NO: 2845680 - RNA, 15 nt, Human
cacggccaggccaga

SEQ ID NO: 2845681 - RNA, 14 nt, Human
cacggccaggccag

SEQ ID NO: 2845682 - RNA, 19 nt, Human
cacggaucacgauguaaau

SEQ ID NO: 2845683 - RNA, 23 nt, Human
cacggaggcauccuacccuuuuc

SEQ ID NO: 2845684 - RNA, 19 nt, Human
cacggagcccagcccuccc

SEQ ID NO: 2845685 - RNA, 21 nt, Human
cacugaaaagguucuucaucc

SEQ ID NO: 2845686 - RNA, 22 nt, Human
cacugaaaagguucuucauccc

SEQ ID NO: 2845687 - RNA, 22 nt, Human
cacugaaaauaccaucaggccu

SEQ ID NO: 2845688 - RNA, 14 nt, Human
cacugaaaccuuua

SEQ ID NO: 2845689 - RNA, 20 nt, Human
cacugaaaccuuuaagaaaa

SEQ ID NO: 2845690 - RNA, 16 nt, Human
cacugaaauaugugaa

SEQ ID NO: 2845691 - RNA, 17 nt, Human
cacugaaaucugucaag

SEQ ID NO: 2845692 - RNA, 15 nt, Human
cacugaacaaacuaa

SEQ ID NO: 2845693 - RNA, 22 nt, Human
cacugaacaaacuaaaggugca

SEQ ID NO: 2845694 - RNA, 14 nt, Human
cacugaaaaauuau

SEQ ID NO: 2845695 - RNA, 14 nt, Human
cacugaaaaacaac

SEQ ID NO: 2845696 - RNA, 11 nt, Human
cacugaaaaau

SEQ ID NO: 2845697 - RNA, 20 nt, Human
cacugaaagcucuguugcaa

SEQ ID NO: 2845698 - RNA, 13 nt, Human
cacugaaaggaaa

SEQ ID NO: 2845699 - RNA, 13 nt, Human
caaguagauaaau

SEQ ID NO: 2845700 - RNA, 17 nt, Human
caaguagauaaauauuu

SEQ ID NO: 2845701 - RNA, 18 nt, Human
caaguagauaaauauuug

SEQ ID NO: 2845702 - RNA, 19 nt, Human
caaguagcugggauuuuaa

SEQ ID NO: 2845703 - RNA, 21 nt, Human
caaguagcugggauuuuaaac

SEQ ID NO: 2845704 - RNA, 13 nt, Human
caaguagucugcu

SEQ ID NO: 2845705 - RNA, 15 nt, Human
caaguagucugcuca

SEQ ID NO: 2845706 - RNA, 16 nt, Human
caaguagucugcucac

SEQ ID NO: 2845707 - RNA, 16 nt, Human
caaguaccaaaguuuu

SEQ ID NO: 2845708 - RNA, 12 nt, Human
caagauuagaag

SEQ ID NO: 2845709 - RNA, 20 nt, Human
caagauuagaagcugaaaac

SEQ ID NO: 2845710 - RNA, 22 nt, Human
caaguaauccaccugccucggc

SEQ ID NO: 2845711 - RNA, 19 nt, Human
caagauuccggauccuaag

SEQ ID NO: 2845712 - RNA, 22 nt, Human
caagauuccggauccuaagcau

SEQ ID NO: 2845713 - RNA, 10 nt, Human
caagauuccg

SEQ ID NO: 2845714 - RNA, 18 nt, Human
caagauuccggauccuaa

SEQ ID NO: 2845715 - RNA, 17 nt, Human
caaguugaagacuuugu

SEQ ID NO: 2845716 - RNA, 19 nt, Human
caaguugaagacuuuguuu

SEQ ID NO: 2845717 - RNA, 15 nt, Human
caaguucuaagauuc

SEQ ID NO: 2845718 - RNA, 17 nt, Human
caaguucuaagauucua

SEQ ID NO: 2845719 - RNA, 18 nt, Human
caaguucuaagauucuaa

SEQ ID NO: 2845720 - RNA, 20 nt, Human
caaguucuaagauucuaaug

SEQ ID NO: 2845721 - RNA, 21 nt, Human
caaguucuaagauucuaauga

SEQ ID NO: 2845722 - RNA, 18 nt, Human
caaguuggaugcggccau

SEQ ID NO: 2845723 - RNA, 13 nt, Human
caaguuuugugua

SEQ ID NO: 2845724 - RNA, 17 nt, Human
caauaaaauuucuaaga

SEQ ID NO: 2845725 - RNA, 18 nt, Human
caauaaaauuucuaagag

SEQ ID NO: 2845726 - RNA, 17 nt, Human
caauaaaauuauuugca

SEQ ID NO: 2845727 - RNA, 18 nt, Human
caauaaaauuauuugcag

SEQ ID NO: 2845728 - RNA, 19 nt, Human
caauaaaauuauuugcagg

SEQ ID NO: 2845729 - RNA, 22 nt, Human
caauaaaauuauuugcaggucu

SEQ ID NO: 2845730 - RNA, 20 nt, Human
caauaaaauuuuuuuggucu

SEQ ID NO: 2845731 - RNA, 23 nt, Human
caauaaaccuccgccaaugcacg

SEQ ID NO: 2845732 - RNA, 12 nt, Human
caauaaagaaaa

SEQ ID NO: 2845733 - RNA, 19 nt, Human
caauaaagaaaacuuccau

SEQ ID NO: 2845734 - RNA, 20 nt, Human
caauaaaaacauugccuuug

SEQ ID NO: 2845735 - RNA, 18 nt, Human
caauaaacgcauuaucag

SEQ ID NO: 2845736 - RNA, 22 nt, Human
caauaaagaguuagaaugaaaa

SEQ ID NO: 2845737 - RNA, 12 nt, Human
caauaaagagau

SEQ ID NO: 2845738 - RNA, 23 nt, Human
caaugcuggcuguuggcuggggg

SEQ ID NO: 2845739 - RNA, 22 nt, Human
caaugcuggcuguuggcugggg

SEQ ID NO: 2845740 - RNA, 13 nt, Human
caauggaaacaau

SEQ ID NO: 2845741 - RNA, 15 nt, Human
caauggaaaccucac

SEQ ID NO: 2845742 - RNA, 16 nt, Human
caauggaaaccucacg

SEQ ID NO: 2845743 - RNA, 17 nt, Human
caauggaaaccucacgc

SEQ ID NO: 2845744 - RNA, 16 nt, Human
caauucuccugccuca

SEQ ID NO: 2845745 - RNA, 17 nt, Human
caauucuccugccucag

SEQ ID NO: 2845746 - RNA, 14 nt, Human
caauugugcugcca

SEQ ID NO: 2845747 - RNA, 15 nt, Human
caauugugcugccau

SEQ ID NO: 2845748 - RNA, 16 nt, Human
caauugugcugccauu

SEQ ID NO: 2845749 - RNA, 21 nt, Human
caauugugggcauaaacuguu

SEQ ID NO: 2845750 - RNA, 14 nt, Human
caauuguugacagu

SEQ ID NO: 2845751 - RNA, 21 nt, Human
caauuguugacaguucugaag

SEQ ID NO: 2845752 - RNA, 23 nt, Human
caauuguugacaguucugaagaa

SEQ ID NO: 2845753 - RNA, 24 nt, Human
caauuguugacaguucugaagaau

SEQ ID NO: 2845754 - RNA, 14 nt, Human
caauucuguuuuag

SEQ ID NO: 2845755 - RNA, 22 nt, Human
caauucuguuuuagguuaaaaa

SEQ ID NO: 2845756 - RNA, 19 nt, Human
caauucuguagguuaaaaa

SEQ ID NO: 2845757 - RNA, 15 nt, Human
caauucuccugccuu

SEQ ID NO: 2845758 - RNA, 16 nt, Human
caauucuccugccuuu

SEQ ID NO: 2845759 - RNA, 17 nt, Human
caauucuccugccuuug

SEQ ID NO: 2845760 - RNA, 19 nt, Human
caauucuccugccuuugcc

SEQ ID NO: 2845761 - RNA, 20 nt, Human
caauucuccugccuuugccu

SEQ ID NO: 2845762 - RNA, 21 nt, Human
caauucuccugccuuugccuc

SEQ ID NO: 2845763 - RNA, 19 nt, Human
caauucuccugccucagcc

SEQ ID NO: 2845764 - RNA, 22 nt, Human
caauuguuugggguugaaaauu

SEQ ID NO: 2845765 - RNA, 22 nt, Human
caauuguuugggugauuccuaa

SEQ ID NO: 2845766 - RNA, 17 nt, Human
caauucucgagcuuggg

SEQ ID NO: 2845767 - RNA, 21 nt, Human
caauuguuuuaaucugaaauu

SEQ ID NO: 2845768 - RNA, 21 nt, Human
cacaagcagagugcacagcug

SEQ ID NO: 2845769 - RNA, 22 nt, Human
cacaagcagagugcacagcugu

SEQ ID NO: 2845770 - RNA, 23 nt, Human
cacaagcagagugcacagcuguc

SEQ ID NO: 2845771 - RNA, 21 nt, Human
cacaagccacaagucuuccag

SEQ ID NO: 2845772 - RNA, 15 nt, Human
cacaagcccacagca

SEQ ID NO: 2845773 - RNA, 21 nt, Human
cacaagccucgaggugccuuc

SEQ ID NO: 2845774 - RNA, 17 nt, Human
cacccagcccacuucug

SEQ ID NO: 2845775 - RNA, 16 nt, Human
cacccagcccacuucu

SEQ ID NO: 2845776 - RNA, 22 nt, Human
caccagcucugccgucucugga

SEQ ID NO: 2845777 - RNA, 21 nt, Human
caccagcccuuagcagggaaa

SEQ ID NO: 2845778 - RNA, 20 nt, Human
caccagcaucaccugccugu

SEQ ID NO: 2845779 - RNA, 19 nt, Human
caccagcaucaccugccug

SEQ ID NO: 2845780 - RNA, 18 nt, Human
caccagcaucaccugccu

SEQ ID NO: 2845781 - RNA, 15 nt, Human
caccagcaucaccug

SEQ ID NO: 2845782 - RNA, 11 nt, Human
caccagccagc

SEQ ID NO: 2845783 - RNA, 12 nt, Human
caccagccagcg

SEQ ID NO: 2845784 - RNA, 23 nt, Human
cacccaggagccccgaggccuuc

SEQ ID NO: 2845785 - RNA, 20 nt, Human
cacccaggagccccgaggcc

SEQ ID NO: 2845786 - RNA, 19 nt, Human
cacccagcccacuucugcc

SEQ ID NO: 2845787 - RNA, 12 nt, Human
cacccagcccag

SEQ ID NO: 2845788 - RNA, 13 nt, Human
cacccagcccaga

SEQ ID NO: 2845789 - RNA, 16 nt, Human
cacccagcccagauug

SEQ ID NO: 2845790 - RNA, 24 nt, Human
cacccaggagccccgaggccuucu

SEQ ID NO: 2845791 - RNA, 11 nt, Human
cacccaggagg

SEQ ID NO: 2845792 - RNA, 17 nt, Human
cacaucuugcucugcug

SEQ ID NO: 2845793 - RNA, 16 nt, Human
cacaucuugcucugcu

SEQ ID NO: 2845794 - RNA, 18 nt, Human
cacauccuccguccagcc

SEQ ID NO: 2845795 - RNA, 14 nt, Human
cacauccuccgucc

SEQ ID NO: 2845796 - RNA, 17 nt, Human
cacauccgccuuuugua

SEQ ID NO: 2845797 - RNA, 21 nt, Human
cacauccgccuuuuguauaca

SEQ ID NO: 2845798 - RNA, 12 nt, Human
cacauuuuuuau

SEQ ID NO: 2845799 - RNA, 18 nt, Human
cacaucuugcucugcuga

SEQ ID NO: 2845800 - RNA, 13 nt, Human
cacauuucuaaaa

SEQ ID NO: 2845801 - RNA, 17 nt, Human
cacauuucuaaaaucuu

SEQ ID NO: 2845802 - RNA, 16 nt, Human
cacauuuggaauacuu

SEQ ID NO: 2845803 - RNA, 19 nt, Human
cacauuuggaauacuuuuu

SEQ ID NO: 2845804 - RNA, 17 nt, Human
cacauuuggaauacuuu

SEQ ID NO: 2845805 - RNA, 22 nt, Human
cacauuugguucuaagaaaccc

SEQ ID NO: 2845806 - RNA, 11 nt, Human
cacauuuguac

SEQ ID NO: 2845807 - RNA, 12 nt, Human
cacauuuguaca

SEQ ID NO: 2845808 - RNA, 20 nt, Human
cacauuugugccgacacugu

SEQ ID NO: 2845809 - RNA, 18 nt, Human
cacauuuuaguccagaga

SEQ ID NO: 2845810 - RNA, 16 nt, Human
cacauuuucagccaaa

SEQ ID NO: 2845811 - RNA, 12 nt, Human
cacauuuugauu

SEQ ID NO: 2845812 - RNA, 19 nt, Human
cacauuuugguucuucuca

SEQ ID NO: 2845813 - RNA, 16 nt, Human
cacauuuuuaaauugu

SEQ ID NO: 2845814 - RNA, 19 nt, Human
cacaguauuacuucugcua

SEQ ID NO: 2845815 - RNA, 18 nt, Human
cacaguauuacuucugcu

SEQ ID NO: 2845816 - RNA, 16 nt, Human
cacaguauuacuucug

SEQ ID NO: 2845817 - RNA, 16 nt, Human
cacaguagucuugaug

SEQ ID NO: 2845818 - RNA, 14 nt, Human
cacaggucuagacu

SEQ ID NO: 2845819 - RNA, 13 nt, Human
cacaggucuagac

SEQ ID NO: 2845820 - RNA, 13 nt, Human
cacaguagucuug

SEQ ID NO: 2845821 - RNA, 19 nt, Human
cacagcucuguccugggag

SEQ ID NO: 2845822 - RNA, 14 nt, Human
cacagcucuguguu

SEQ ID NO: 2845823 - RNA, 10 nt, Human
cacagcucuu

SEQ ID NO: 2845824 - RNA, 23 nt, Human
cacagcucuguccugggagugag

SEQ ID NO: 2845825 - RNA, 20 nt, Human
cacagcucuguccugggagu

SEQ ID NO: 2845826 - RNA, 15 nt, Human
cacagcuaccucuuc

SEQ ID NO: 2845827 - RNA, 20 nt, Human
cacagcuaacacacagcucc

SEQ ID NO: 2845828 - RNA, 21 nt, Human
cacagcuaacacacagcuccc

SEQ ID NO: 2845829 - RNA, 20 nt, Human
cacagcuaacaauugugaag

SEQ ID NO: 2845830 - RNA, 21 nt, Human
cacagcuaacaauugugaagu

SEQ ID NO: 2845831 - RNA, 15 nt, Human
cacagcucaggaggc

SEQ ID NO: 2845832 - RNA, 13 nt, Human
cacagcucaggag

SEQ ID NO: 2845833 - RNA, 16 nt, Human
cacagcucaggaacua

SEQ ID NO: 2845834 - RNA, 20 nt, Human
cacagcuacuugguuugugu

SEQ ID NO: 2845835 - RNA, 14 nt, Human
cacagcucccugcc

SEQ ID NO: 2845836 - RNA, 15 nt, Human
cacagcucccugcca

SEQ ID NO: 2845837 - RNA, 16 nt, Human
cacagcucccugccaa

SEQ ID NO: 2845838 - RNA, 16 nt, Human
cacaggguugggccca

SEQ ID NO: 2845839 - RNA, 14 nt, Human
cacaggguugggcc

SEQ ID NO: 2845840 - RNA, 23 nt, Human
cacaggguugggcccagaucugg

SEQ ID NO: 2845841 - RNA, 22 nt, Human
cacaggguugggcccagaucug

SEQ ID NO: 2845842 - RNA, 18 nt, Human
cacaggguugggcccaga

SEQ ID NO: 2845843 - RNA, 19 nt, Human
cacaggucaggggugacac

SEQ ID NO: 2845844 - RNA, 20 nt, Human
cacaggucaggggugacaca

SEQ ID NO: 2845845 - RNA, 21 nt, Human
cacaggucaggggugacacag

SEQ ID NO: 2845846 - RNA, 22 nt, Human
cacaggucaggggugacacaga

SEQ ID NO: 2845847 - RNA, 23 nt, Human
cacaggucaggggugacacagac

SEQ ID NO: 2845848 - RNA, 12 nt, Human
cacaggucccac

SEQ ID NO: 2845849 - RNA, 14 nt, Human
cacaggucccaccu

SEQ ID NO: 2845850 - RNA, 15 nt, Human
cacaggucccaccuc

SEQ ID NO: 2845851 - RNA, 19 nt, Human
cacaggucccaccuccagc

SEQ ID NO: 2845852 - RNA, 21 nt, Human
cacaggucccaccuccagccc

SEQ ID NO: 2845853 - RNA, 22 nt, Human
cacaggucccaccuccagcccg

SEQ ID NO: 2845854 - RNA, 18 nt, Human
cacaggucgggcgcagga

SEQ ID NO: 2845855 - RNA, 17 nt, Human
cacagggcagagccggg

SEQ ID NO: 2845856 - RNA, 14 nt, Human
cacagggcagagcc

SEQ ID NO: 2845857 - RNA, 13 nt, Human
cacagggcagagc

SEQ ID NO: 2845858 - RNA, 23 nt, Human
cacagggcaugccccggccaccu

SEQ ID NO: 2845859 - RNA, 20 nt, Human
cacagggcaugccccggcca

SEQ ID NO: 2845860 - RNA, 13 nt, Human
cacagacagguuu

SEQ ID NO: 2845861 - RNA, 21 nt, Human
cacagacagguuuucacauaa

SEQ ID NO: 2845862 - RNA, 22 nt, Human
cacagacagguuuucacauaaa

SEQ ID NO: 2845863 - RNA, 21 nt, Human
cacagcggagucuguccugug

SEQ ID NO: 2845864 - RNA, 23 nt, Human
cacagcggagucuguccugugac

SEQ ID NO: 2845865 - RNA, 14 nt, Human
cacagcggccccug

SEQ ID NO: 2845866 - RNA, 16 nt, Human
cacagcggccccugca

SEQ ID NO: 2845867 - RNA, 20 nt, Human
cacagcggggccccagggcu

SEQ ID NO: 2845868 - RNA, 15 nt, Human
cacagcgucccuagc

SEQ ID NO: 2845869 - RNA, 20 nt, Human
cacagcgucccuagcaguga

SEQ ID NO: 2845870 - RNA, 22 nt, Human
cacagcgucccuagcagugaac

SEQ ID NO: 2845871 - RNA, 12 nt, Human
cacagaaguccu

SEQ ID NO: 2845872 - RNA, 13 nt, Human
cacagaaguccug

SEQ ID NO: 2845873 - RNA, 14 nt, Human
cacagaaguccugu

SEQ ID NO: 2845874 - RNA, 22 nt, Human
cacagaaguccuguaugucugu

SEQ ID NO: 2845875 - RNA, 12 nt, Human
cacagacacaca

SEQ ID NO: 2845876 - RNA, 13 nt, Human
cacagacacacac

SEQ ID NO: 2845877 - RNA, 14 nt, Human
cacagacacacaca

SEQ ID NO: 2845878 - RNA, 17 nt, Human
cacagacacacacacgc

SEQ ID NO: 2845879 - RNA, 18 nt, Human
cacagacacacacacgca

SEQ ID NO: 2845880 - RNA, 20 nt, Human
cacagacacacacacgcacg

SEQ ID NO: 2845881 - RNA, 22 nt, Human
cacagacacacacacgcacgca

SEQ ID NO: 2845882 - RNA, 16 nt, Human
ggcgagagaggagcca

SEQ ID NO: 2845883 - RNA, 18 nt, Human
ggcgagagaggagccaga

SEQ ID NO: 2845884 - RNA, 21 nt, Human
ggcgagcccuguggaugagcc

SEQ ID NO: 2845885 - RNA, 22 nt, Human
ggcgauccaccugucucagccu

SEQ ID NO: 2845886 - RNA, 18 nt, Human
ggcgauccaccugucuca

SEQ ID NO: 2845887 - RNA, 17 nt, Human
ggcgauccaccugucuc

SEQ ID NO: 2845888 - RNA, 23 nt, Human
ggcgagugaaugccagugugcug

SEQ ID NO: 2845889 - RNA, 23 nt, Human
ggcguugggagggggagaaaagg

SEQ ID NO: 2845890 - RNA, 20 nt, Human
ggcuaaaugccuaauaaaca

SEQ ID NO: 2845891 - RNA, 17 nt, Human
ggcuaacuauauuugcu

SEQ ID NO: 2845892 - RNA, 21 nt, Human
ggcgaucgcggcggagcuggc

SEQ ID NO: 2845893 - RNA, 16 nt, Human
ggcgugagaccugccc

SEQ ID NO: 2845894 - RNA, 14 nt, Human
ggcgugagaccugc

SEQ ID NO: 2845895 - RNA, 12 nt, Human
ggcgugaucucg

SEQ ID NO: 2845896 - RNA, 18 nt, Human
ggcgugagaccugccccu

SEQ ID NO: 2845897 - RNA, 17 nt, Human
ggcgugagaccugcccc

SEQ ID NO: 2845898 - RNA, 12 nt, Human
ggcuacccuccc

SEQ ID NO: 2845899 - RNA, 15 nt, Human
ggcuacugcagcuuu

SEQ ID NO: 2845900 - RNA, 20 nt, Human
ggcuagaggccagccccacc

SEQ ID NO: 2845901 - RNA, 18 nt, Human
ggcuagaggccagcccca

SEQ ID NO: 2845902 - RNA, 16 nt, Human
ggcuagaggccagccc

SEQ ID NO: 2845903 - RNA, 18 nt, Human
ggcuacugcagcuuuaca

SEQ ID NO: 2845904 - RNA, 23 nt, Human
ggcuacugcagcuuuacaugcaa

SEQ ID NO: 2845905 - RNA, 14 nt, Human
ggcuacauuauaaa

SEQ ID NO: 2845906 - RNA, 23 nt, Human
ggcuacaccuuagccugcccucc

SEQ ID NO: 2845907 - RNA, 15 nt, Human
ggcuacacagggaug

SEQ ID NO: 2845908 - RNA, 22 nt, Human
ggcuacaccuuagccugcccuc

SEQ ID NO: 2845909 - RNA, 13 nt, Human
ggcuaauuuuugu

SEQ ID NO: 2845910 - RNA, 12 nt, Human
ggcuacacaggg

SEQ ID NO: 2845911 - RNA, 20 nt, Human
ggcuaagugauccucccacc

SEQ ID NO: 2845912 - RNA, 18 nt, Human
ggcuaauuuuuguuuugu

SEQ ID NO: 2845913 - RNA, 19 nt, Human
ggcuaaggcguggagcugc

SEQ ID NO: 2845914 - RNA, 22 nt, Human
ggcuaaggcguggagcugccug

SEQ ID NO: 2845915 - RNA, 15 nt, Human
ggcuaauuaaauaaa

SEQ ID NO: 2845916 - RNA, 14 nt, Human
ggcuaagaggcugc

SEQ ID NO: 2845917 - RNA, 16 nt, Human
ggcuaagaggcugcug

SEQ ID NO: 2845918 - RNA, 14 nt, Human
ggccugaugcuccc

SEQ ID NO: 2845919 - RNA, 20 nt, Human
ggccugaugcucccuccccu

SEQ ID NO: 2845920 - RNA, 18 nt, Human
ggccugaugcucccuccc

SEQ ID NO: 2845921 - RNA, 17 nt, Human
ggccugaugcucccucc

SEQ ID NO: 2845922 - RNA, 15 nt, Human
ggccugaugcucccu

SEQ ID NO: 2845923 - RNA, 23 nt, Human
ggccugaugcucccuccccugcc

SEQ ID NO: 2845924 - RNA, 22 nt, Human
ggccugaugcucccuccccugc

SEQ ID NO: 2845925 - RNA, 14 nt, Human
ggccugcacaguga

SEQ ID NO: 2845926 - RNA, 12 nt, Human
ggccugcacaca

SEQ ID NO: 2845927 - RNA, 13 nt, Human
ggccugcacacaa

SEQ ID NO: 2845928 - RNA, 14 nt, Human
ggccugcacacaag

SEQ ID NO: 2845929 - RNA, 13 nt, Human
ggccugcacuaau

SEQ ID NO: 2845930 - RNA, 19 nt, Human
ggccugcagcaggaguggu

SEQ ID NO: 2845931 - RNA, 20 nt, Human
ggccugcagcaggaguggug

SEQ ID NO: 2845932 - RNA, 17 nt, Human
ggccugcaggaccugcc

SEQ ID NO: 2845933 - RNA, 21 nt, Human
ggccugcaggaccugccugua

SEQ ID NO: 2845934 - RNA, 20 nt, Human
ggccugcaggaccugccugu

SEQ ID NO: 2845935 - RNA, 15 nt, Human
ggccuggccagaugc

SEQ ID NO: 2845936 - RNA, 12 nt, Human
ggccuggccaga

SEQ ID NO: 2845937 - RNA, 15 nt, Human
ggccuggcagggagg

SEQ ID NO: 2845938 - RNA, 21 nt, Human
ggccuggcagggaggucaggc

SEQ ID NO: 2845939 - RNA, 13 nt, Human
ggccuggcauucu

SEQ ID NO: 2845940 - RNA, 15 nt, Human
ggccuggcauucuug

SEQ ID NO: 2845941 - RNA, 19 nt, Human
ggccuggcauucuuguaca

SEQ ID NO: 2845942 - RNA, 14 nt, Human
ggccuggcagccgu

SEQ ID NO: 2845943 - RNA, 15 nt, Human
ggccuggcagccgug

SEQ ID NO: 2845944 - RNA, 16 nt, Human
ggccuggccagaugca

SEQ ID NO: 2845945 - RNA, 21 nt, Human
ggccuguuuuagaagguucuc

SEQ ID NO: 2845946 - RNA, 12 nt, Human
ggccuuaagcuu

SEQ ID NO: 2845947 - RNA, 14 nt, Human
ggccuggccaccuc

SEQ ID NO: 2845948 - RNA, 16 nt, Human
ggccuggccaccucuc

SEQ ID NO: 2845949 - RNA, 17 nt, Human
ggccuggccaccucucu

SEQ ID NO: 2845950 - RNA, 14 nt, Human
ggccuuaccccugc

SEQ ID NO: 2845951 - RNA, 15 nt, Human
ggccuuaccccugcc

SEQ ID NO: 2845952 - RNA, 16 nt, Human
ggccuuagugggccag

SEQ ID NO: 2845953 - RNA, 21 nt, Human
ggccuuagugggccagggcug

SEQ ID NO: 2845954 - RNA, 22 nt, Human
ggccuuagugggccagggcugc

SEQ ID NO: 2845955 - RNA, 17 nt, Human
ggccuucagggagugag

SEQ ID NO: 2845956 - RNA, 14 nt, Human
ggccuucauaaugg

SEQ ID NO: 2845957 - RNA, 14 nt, Human
ggccuuccagcugc

SEQ ID NO: 2845958 - RNA, 15 nt, Human
ggccuuccagcugcu

SEQ ID NO: 2845959 - RNA, 16 nt, Human
ggccuuccagcugcug

SEQ ID NO: 2845960 - RNA, 17 nt, Human
ggccuuccagcugcugu

SEQ ID NO: 2845961 - RNA, 12 nt, Human
ggccugccuggc

SEQ ID NO: 2845962 - RNA, 14 nt, Human
ggccugccuggccc

SEQ ID NO: 2845963 - RNA, 23 nt, Human
ggccugccuggccccucgccugu

SEQ ID NO: 2845964 - RNA, 18 nt, Human
ggccugccuugaagccac

SEQ ID NO: 2845965 - RNA, 11 nt, Human
ggccugccugu

SEQ ID NO: 2845966 - RNA, 17 nt, Human
ggccucccacagacuca

SEQ ID NO: 2845967 - RNA, 20 nt, Human
ggccccagcaccucagccug

SEQ ID NO: 2845968 - RNA, 17 nt, Human
ggccccagcaccucagc

SEQ ID NO: 2845969 - RNA, 16 nt, Human
ggccagaugcaccagc

SEQ ID NO: 2845970 - RNA, 15 nt, Human
ggccagaugcaccag

SEQ ID NO: 2845971 - RNA, 21 nt, Human
ggcccuagcccagcgcucugc

SEQ ID NO: 2845972 - RNA, 23 nt, Human
ggcccuagcccagcgcucugccu

SEQ ID NO: 2845973 - RNA, 21 nt, Human
ggcccuaggggucacuguacu

SEQ ID NO: 2845974 - RNA, 16 nt, Human
ggcccuaauucagcca

SEQ ID NO: 2845975 - RNA, 21 nt, Human
ggcccuaauucagccauguac

SEQ ID NO: 2845976 - RNA, 14 nt, Human
ggcccgucugucca

SEQ ID NO: 2845977 - RNA, 18 nt, Human
ggcccgucuguccaucug

SEQ ID NO: 2845978 - RNA, 19 nt, Human
ggcccgucuguccaucugc

SEQ ID NO: 2845979 - RNA, 20 nt, Human
ggcccgucuguccaucugcc

SEQ ID NO: 2845980 - RNA, 21 nt, Human
ggcccgucuguccaucugccc

SEQ ID NO: 2845981 - RNA, 13 nt, Human
ggccucagugcca

SEQ ID NO: 2845982 - RNA, 16 nt, Human
ggccucccacagacuc

SEQ ID NO: 2845983 - RNA, 14 nt, Human
ggccucccacagac

SEQ ID NO: 2845984 - RNA, 16 nt, Human
ggccgcgcccuuuccc

SEQ ID NO: 2845985 - RNA, 16 nt, Human
ggccgcccccugcccc

SEQ ID NO: 2845986 - RNA, 18 nt, Human
ggccgcccccugcccccc

SEQ ID NO: 2845987 - RNA, 19 nt, Human
ggccgcccccugcccccca

SEQ ID NO: 2845988 - RNA, 22 nt, Human
ggccgcccccugccccccagcc

SEQ ID NO: 2845989 - RNA, 13 nt, Human
ggccucagcugcc

SEQ ID NO: 2845990 - RNA, 16 nt, Human
ggccucagcugccuca

SEQ ID NO: 2845991 - RNA, 15 nt, Human
ggccucagcugccuc

SEQ ID NO: 2845992 - RNA, 22 nt, Human
ggccucagcugccucacuuccu

SEQ ID NO: 2845993 - RNA, 17 nt, Human
ggccucagcugccucac

SEQ ID NO: 2845994 - RNA, 23 nt, Human
aaaaauaccucaggaaagaauag

SEQ ID NO: 2845995 - RNA, 17 nt, Human
aaaaauacaaaaauuug

SEQ ID NO: 2845996 - RNA, 13 nt, Human
aaaaauacaaaau

SEQ ID NO: 2845997 - RNA, 14 nt, Human
aaaaauacaugcau

SEQ ID NO: 2845998 - RNA, 14 nt, Human
aaaaauacauguuc

SEQ ID NO: 2845999 - RNA, 14 nt, Human
ggcuggguuggagg

SEQ ID NO: 2846000 - RNA, 18 nt, Human
aaaaauagaugucuuuua

SEQ ID NO: 2846001 - RNA, 18 nt, Human
aaaaauacuuuuucuaau

SEQ ID NO: 2846002 - RNA, 21 nt, Human
aaaaauacuuuuucuaaugag

SEQ ID NO: 2846003 - RNA, 19 nt, Human
ggcugguaacaguucaugu

SEQ ID NO: 2846004 - RNA, 19 nt, Human
ggcugguauugguggcuuu

SEQ ID NO: 2846005 - RNA, 20 nt, Human
aaaaagccugcaauuucaua

SEQ ID NO: 2846006 - RNA, 17 nt, Human
aaaaagccuccagucca

SEQ ID NO: 2846007 - RNA, 14 nt, Human
aaaaaguuuccaua

SEQ ID NO: 2846008 - RNA, 17 nt, Human
aaaaaguuuacaagugu

SEQ ID NO: 2846009 - RNA, 13 nt, Human
aaaaaguuguuca

SEQ ID NO: 2846010 - RNA, 14 nt, Human
aaaaaguuguucaa

SEQ ID NO: 2846011 - RNA, 17 nt, Human
aaaaaggcauuguuuga

SEQ ID NO: 2846012 - RNA, 21 nt, Human
aaaaaggccaguggaaauuca

SEQ ID NO: 2846013 - RNA, 15 nt, Human
aaaaaggauacauaa

SEQ ID NO: 2846014 - RNA, 17 nt, Human
aaaaaggauacauaaug

SEQ ID NO: 2846015 - RNA, 16 nt, Human
aaaaaggacaucagca

SEQ ID NO: 2846016 - RNA, 11 nt, Human
aaaaaaauuua

SEQ ID NO: 2846017 - RNA, 13 nt, Human
aaaaaaauguugu

SEQ ID NO: 2846018 - RNA, 11 nt, Human
aaaaaaaugcc

SEQ ID NO: 2846019 - RNA, 14 nt, Human
aaaaaaaugccaua

SEQ ID NO: 2846020 - RNA, 11 nt, Human
aaaaaaauagu

SEQ ID NO: 2846021 - RNA, 12 nt, Human
aaaaaaaucaca

SEQ ID NO: 2846022 - RNA, 12 nt, Human
aaaaaaaucuuc

SEQ ID NO: 2846023 - RNA, 13 nt, Human
aaaaaaaugaaug

SEQ ID NO: 2846024 - RNA, 12 nt, Human
aaaaaaagcaua

SEQ ID NO: 2846025 - RNA, 12 nt, Human
aaaaaaagcaug

SEQ ID NO: 2846026 - RNA, 13 nt, Human
aaaaaaagcaugu

SEQ ID NO: 2846027 - RNA, 11 nt, Human
aaaaaaagcuu

SEQ ID NO: 2846028 - RNA, 12 nt, Human
aaaaaaagcuuu

SEQ ID NO: 2846029 - RNA, 23 nt, Human
aaaaagauuuucagaaaauauua

SEQ ID NO: 2846030 - RNA, 14 nt, Human
aaaaagauuagcaa

SEQ ID NO: 2846031 - RNA, 13 nt, Human
aaaaagauucuuu

SEQ ID NO: 2846032 - RNA, 15 nt, Human
aaaaagauucuuuuu

SEQ ID NO: 2846033 - RNA, 18 nt, Human
aaaaagauuguauugcug

SEQ ID NO: 2846034 - RNA, 10 nt, Human
aaaaaagaaa

SEQ ID NO: 2846035 - RNA, 15 nt, Human
aaaaaacagaggcca

SEQ ID NO: 2846036 - RNA, 16 nt, Human
aaaaaaccacaaaggc

SEQ ID NO: 2846037 - RNA, 17 nt, Human
aaaaagcauaaaaacau

SEQ ID NO: 2846038 - RNA, 20 nt, Human
aaaaagcauaaaaacauuuu

SEQ ID NO: 2846039 - RNA, 15 nt, Human
aaaaagcauguguca

SEQ ID NO: 2846040 - RNA, 10 nt, Human
aaaaaaacug

SEQ ID NO: 2846041 - RNA, 11 nt, Human
aaaaaaagaaa

SEQ ID NO: 2846042 - RNA, 13 nt, Human
aaaaaaagaaaau

SEQ ID NO: 2846043 - RNA, 13 nt, Human
aaaaaaagaagaa

SEQ ID NO: 2846044 - RNA, 10 nt, Human
aaaaaaagaa

SEQ ID NO: 2846045 - RNA, 11 nt, Human
aaaaaaagaca

SEQ ID NO: 2846046 - RNA, 13 nt, Human
aaaaaaagacaag

SEQ ID NO: 2846047 - RNA, 14 nt, Human
aaaaaaagaucugu

SEQ ID NO: 2846048 - RNA, 10 nt, Human
aaaaaaagac

SEQ ID NO: 2846049 - RNA, 17 nt, Human
ggcuggcccugcccugg

SEQ ID NO: 2846050 - RNA, 19 nt, Human
ggcuggccucuggcucuca

SEQ ID NO: 2846051 - RNA, 15 nt, Human
ggcucacugcagccu

SEQ ID NO: 2846052 - RNA, 14 nt, Human
ggcucacugcagcc

SEQ ID NO: 2846053 - RNA, 13 nt, Human
ggcucacugcagc

SEQ ID NO: 2846054 - RNA, 15 nt, Human
ggcuacgaaucuucc

SEQ ID NO: 2846055 - RNA, 17 nt, Human
ggcucggaggcugcccc

SEQ ID NO: 2846056 - RNA, 16 nt, Human
ggcucggaggcugccc

SEQ ID NO: 2846057 - RNA, 13 nt, Human
ggcucgccaggcc

SEQ ID NO: 2846058 - RNA, 16 nt, Human
ggcucccucuucuuuc

SEQ ID NO: 2846059 - RNA, 20 nt, Human
ggcuccccuuuuucuuccuc

SEQ ID NO: 2846060 - RNA, 16 nt, Human
ggcucccguggccugu

SEQ ID NO: 2846061 - RNA, 23 nt, Human
ggcucuucuccuuucacaaccuu

SEQ ID NO: 2846062 - RNA, 19 nt, Human
ggcucuugauaccccccuc

SEQ ID NO: 2846063 - RNA, 20 nt, Human
ggcucuugauaccccccucu

SEQ ID NO: 2846064 - RNA, 21 nt, Human
ggcucuugauaccccccucug

SEQ ID NO: 2846065 - RNA, 20 nt, Human
ggcucuugugcuggauggag

SEQ ID NO: 2846066 - RNA, 23 nt, Human
ggcucuugugcuggauggagccc

SEQ ID NO: 2846067 - RNA, 15 nt, Human
ggcucuuugggcugg

SEQ ID NO: 2846068 - RNA, 15 nt, Human
ggcugacgugugagg

SEQ ID NO: 2846069 - RNA, 23 nt, Human
ggcugacgugugagggaggacag

SEQ ID NO: 2846070 - RNA, 17 nt, Human
ggcugaccugccucuca

SEQ ID NO: 2846071 - RNA, 23 nt, Human
ggcugaccugccucucacacaca

SEQ ID NO: 2846072 - RNA, 22 nt, Human
ggcugacuagaagggccagucc

SEQ ID NO: 2846073 - RNA, 19 nt, Human
ggcugacuagaagggccag

SEQ ID NO: 2846074 - RNA, 24 nt, Human
ggcugacuagaagggccaguccug

SEQ ID NO: 2846075 - RNA, 15 nt, Human
ggcugccccucucac

SEQ ID NO: 2846076 - RNA, 21 nt, Human
ggcugagacugcgggaugguc

SEQ ID NO: 2846077 - RNA, 13 nt, Human
ggcugccccucuc

SEQ ID NO: 2846078 - RNA, 14 nt, Human
ggcugagaacacug

SEQ ID NO: 2846079 - RNA, 17 nt, Human
ggcugagacaggagaaa

SEQ ID NO: 2846080 - RNA, 13 nt, Human
ggcugcccugcca

SEQ ID NO: 2846081 - RNA, 12 nt, Human
ggcugcccugcc

SEQ ID NO: 2846082 - RNA, 13 nt, Human
ggcugcccugaga

SEQ ID NO: 2846083 - RNA, 14 nt, Human
ggcugcccugagaa

SEQ ID NO: 2846084 - RNA, 18 nt, Human
ggcugcccugagaagcug

SEQ ID NO: 2846085 - RNA, 21 nt, Human
ggcugcccugagaagcugcuc

SEQ ID NO: 2846086 - RNA, 24 nt, Human
ggcugcccugagaagcugcuccag

SEQ ID NO: 2846087 - RNA, 18 nt, Human
ggcugcccuugggccacc

SEQ ID NO: 2846088 - RNA, 16 nt, Human
ggcugcccuugggcca

SEQ ID NO: 2846089 - RNA, 18 nt, Human
ggcugcccuuucugggca

SEQ ID NO: 2846090 - RNA, 14 nt, Human
ggcugcccuuucug

SEQ ID NO: 2846091 - RNA, 12 nt, Human
ggcugcccuggu

SEQ ID NO: 2846092 - RNA, 22 nt, Human
ggcugcccuggugcugccacac

SEQ ID NO: 2846093 - RNA, 11 nt, Human
ggcugcccuuu

SEQ ID NO: 2846094 - RNA, 10 nt, Human
ggcugcccuu

SEQ ID NO: 2846095 - RNA, 13 nt, Human
ggcuggccagccg

SEQ ID NO: 2846096 - RNA, 15 nt, Human
ggcuggccagccgcu

SEQ ID NO: 2846097 - RNA, 16 nt, Human
ggcuggccagccgcuc

SEQ ID NO: 2846098 - RNA, 23 nt, Human
ggcuggccagccgcucuccugcc

SEQ ID NO: 2846099 - RNA, 12 nt, Human
ggcuggccagcc

SEQ ID NO: 2846100 - RNA, 14 nt, Human
ggcuggcagguaug

SEQ ID NO: 2846101 - RNA, 13 nt, Human
ggcuggcagggcu

SEQ ID NO: 2846102 - RNA, 15 nt, Human
ggcuggcagggcugg

SEQ ID NO: 2846103 - RNA, 18 nt, Human
ggcacaccgggcacucag

SEQ ID NO: 2846104 - RNA, 18 nt, Human
ggcacauuuaagagacag

SEQ ID NO: 2846105 - RNA, 10 nt, Human
ggcaccaaag

SEQ ID NO: 2846106 - RNA, 15 nt, Human
ggcaccaaagaugca

SEQ ID NO: 2846107 - RNA, 16 nt, Human
ggcaccaaagaugcag

SEQ ID NO: 2846108 - RNA, 17 nt, Human
ggcaccaaagaugcagc

SEQ ID NO: 2846109 - RNA, 18 nt, Human
ggcaccaaagaugcagcc

SEQ ID NO: 2846110 - RNA, 20 nt, Human
ggcaccaaagaugcagccgc

SEQ ID NO: 2846111 - RNA, 22 nt, Human
ggcaccacugcacuccagccug

SEQ ID NO: 2846112 - RNA, 16 nt, Human
ggcaccaaagccacca

SEQ ID NO: 2846113 - RNA, 12 nt, Human
ggcacugccuga

SEQ ID NO: 2846114 - RNA, 18 nt, Human
ggcacauugagcugugca

SEQ ID NO: 2846115 - RNA, 12 nt, Human
ggcacacgccuc

SEQ ID NO: 2846116 - RNA, 15 nt, Human
ggcacacgccuccca

SEQ ID NO: 2846117 - RNA, 17 nt, Human
ggcacacgccucccacu

SEQ ID NO: 2846118 - RNA, 18 nt, Human
ggcacacgccucccacug

SEQ ID NO: 2846119 - RNA, 19 nt, Human
ggcacacgccucccacugg

SEQ ID NO: 2846120 - RNA, 15 nt, Human
ggcacacucugccag

SEQ ID NO: 2846121 - RNA, 21 nt, Human
ggcacacucugccagcaaaga

SEQ ID NO: 2846122 - RNA, 12 nt, Human
ggauuucuuagg

SEQ ID NO: 2846123 - RNA, 13 nt, Human
ggauuucuuaggg

SEQ ID NO: 2846124 - RNA, 16 nt, Human
ggauuuugucaagcag

SEQ ID NO: 2846125 - RNA, 15 nt, Human
ggauuuuuaauuaaa

SEQ ID NO: 2846126 - RNA, 19 nt, Human
ggauuuccagccagggcug

SEQ ID NO: 2846127 - RNA, 15 nt, Human
ggcaaaaccuugcua

SEQ ID NO: 2846128 - RNA, 15 nt, Human
ggcaaaagccuugug

SEQ ID NO: 2846129 - RNA, 16 nt, Human
ggcaaaagccuugugu

SEQ ID NO: 2846130 - RNA, 20 nt, Human
ggcaaaagccuuguguauau

SEQ ID NO: 2846131 - RNA, 24 nt, Human
ggcaggaggauugcuugagcccag

SEQ ID NO: 2846132 - RNA, 18 nt, Human
ggcagcgccaagugcgug

SEQ ID NO: 2846133 - RNA, 20 nt, Human
ggcagcgccaagugcgugcc

SEQ ID NO: 2846134 - RNA, 22 nt, Human
ggcagcgccaagugcgugccgu

SEQ ID NO: 2846135 - RNA, 22 nt, Human
ggcaggcugggccauguccaaa

SEQ ID NO: 2846136 - RNA, 16 nt, Human
ggcaggcugggccaug

SEQ ID NO: 2846137 - RNA, 15 nt, Human
ggcaggcugggccau

SEQ ID NO: 2846138 - RNA, 14 nt, Human
ggcaggcugggcca

SEQ ID NO: 2846139 - RNA, 14 nt, Human
ggcagggaccacac

SEQ ID NO: 2846140 - RNA, 15 nt, Human
ggcaggaugacccug

SEQ ID NO: 2846141 - RNA, 14 nt, Human
ggcaggagggcccu

SEQ ID NO: 2846142 - RNA, 19 nt, Human
ggcaggauggccuggccag

SEQ ID NO: 2846143 - RNA, 15 nt, Human
ggcaggauggccugg

SEQ ID NO: 2846144 - RNA, 16 nt, Human
ggcaggauggccuggc

SEQ ID NO: 2846145 - RNA, 10 nt, Human
ggcagggagg

SEQ ID NO: 2846146 - RNA, 18 nt, Human
ggcagggagggccugggc

SEQ ID NO: 2846147 - RNA, 17 nt, Human
ggcagggagggccuggg

SEQ ID NO: 2846148 - RNA, 15 nt, Human
ggcagggaggucagg

SEQ ID NO: 2846149 - RNA, 17 nt, Human
ggcagggaggucaggcc

SEQ ID NO: 2846150 - RNA, 19 nt, Human
ggcagggaggucaggcccu

SEQ ID NO: 2846151 - RNA, 22 nt, Human
ggcagggaggucaggcccugga

SEQ ID NO: 2846152 - RNA, 23 nt, Human
ggcagggcaaaugacaugcacug

SEQ ID NO: 2846153 - RNA, 20 nt, Human
ggcagggagggccugggccc

SEQ ID NO: 2846154 - RNA, 19 nt, Human
ggcagggagggccugggcc

SEQ ID NO: 2846155 - RNA, 19 nt, Human
ggcagcauagcaagacaca

SEQ ID NO: 2846156 - RNA, 17 nt, Human
ggcagcauagcaagaca

SEQ ID NO: 2846157 - RNA, 18 nt, Human
ggcagccaaacccaugag

SEQ ID NO: 2846158 - RNA, 16 nt, Human
ggcagccaaacccaug

SEQ ID NO: 2846159 - RNA, 20 nt, Human
ggcagccaaacccaugaggc

SEQ ID NO: 2846160 - RNA, 19 nt, Human
ggcagccaaacccaugagg

SEQ ID NO: 2846161 - RNA, 23 nt, Human
ggcagccacuucggccaggucac

SEQ ID NO: 2846162 - RNA, 22 nt, Human
ggcagcccagagacuuuguaga

SEQ ID NO: 2846163 - RNA, 21 nt, Human
ggcagcccagagacuuuguag

SEQ ID NO: 2846164 - RNA, 15 nt, Human
ggcagcccagagacu

SEQ ID NO: 2846165 - RNA, 13 nt, Human
ggcagccagggcu

SEQ ID NO: 2846166 - RNA, 14 nt, Human
ggcagccagugaga

SEQ ID NO: 2846167 - RNA, 22 nt, Human
ggcagccagugagaugagggau

SEQ ID NO: 2846168 - RNA, 22 nt, Human
ggcagccccauucugccugccc

SEQ ID NO: 2846169 - RNA, 16 nt, Human
ggcagccucuucaaaa

SEQ ID NO: 2846170 - RNA, 21 nt, Human
ggcagccccauucugccugcc

SEQ ID NO: 2846171 - RNA, 20 nt, Human
ggcagccccauucugccugc

SEQ ID NO: 2846172 - RNA, 16 nt, Human
ggcagccccauucugc

SEQ ID NO: 2846173 - RNA, 16 nt, Human
ggcaggggcuggaggg

SEQ ID NO: 2846174 - RNA, 11 nt, Human
ggcauuuccua

SEQ ID NO: 2846175 - RNA, 13 nt, Human
ggcaucaugcaug

SEQ ID NO: 2846176 - RNA, 20 nt, Human
ggcaucgcaauguaagacuc

SEQ ID NO: 2846177 - RNA, 23 nt, Human
ggcaucacagggcagagccggga

SEQ ID NO: 2846178 - RNA, 22 nt, Human
ggcaucacagggcagagccggg

SEQ ID NO: 2846179 - RNA, 13 nt, Human
ggcaucagcuggc

SEQ ID NO: 2846180 - RNA, 16 nt, Human
ggcaucagcuggcguc

SEQ ID NO: 2846181 - RNA, 18 nt, Human
ggcaucagucccuaugua

SEQ ID NO: 2846182 - RNA, 17 nt, Human
ggcaucacagggcagag

SEQ ID NO: 2846183 - RNA, 11 nt, Human
ggccagacucg

SEQ ID NO: 2846184 - RNA, 17 nt, Human
ggccaagauaggaccuu

SEQ ID NO: 2846185 - RNA, 19 nt, Human
ggccaagauaggaccuugg

SEQ ID NO: 2846186 - RNA, 19 nt, Human
ggccagagggagugacaga

SEQ ID NO: 2846187 - RNA, 17 nt, Human
ggccagagggagugaca

SEQ ID NO: 2846188 - RNA, 15 nt, Human
ggccaagacuuggca

SEQ ID NO: 2846189 - RNA, 23 nt, Human
ggccaagacuuggcaacagaagc

SEQ ID NO: 2846190 - RNA, 21 nt, Human
ggccaacuugagggcccagag

SEQ ID NO: 2846191 - RNA, 20 nt, Human
ggcauccuuccucacaccag

SEQ ID NO: 2846192 - RNA, 12 nt, Human
ggcauuuguuca

SEQ ID NO: 2846193 - RNA, 22 nt, Human
ggccaacuugagggcccagagc

SEQ ID NO: 2846194 - RNA, 23 nt, Human
ggccaacuugagggcccagagca

SEQ ID NO: 2846195 - RNA, 23 nt, Human
ggccaagagaaaggccugcacac

SEQ ID NO: 2846196 - RNA, 14 nt, Human
ggagugggcagagc

SEQ ID NO: 2846197 - RNA, 17 nt, Human
ggaguggcucgccaggc

SEQ ID NO: 2846198 - RNA, 18 nt, Human
ggaguggcucgccaggcc

SEQ ID NO: 2846199 - RNA, 22 nt, Human
ggaguguggcugaggaggccuc

SEQ ID NO: 2846200 - RNA, 15 nt, Human
ggaguggugcagaca

SEQ ID NO: 2846201 - RNA, 16 nt, Human
ggaguggugcagacag

SEQ ID NO: 2846202 - RNA, 19 nt, Human
ggagugggugacaagagcc

SEQ ID NO: 2846203 - RNA, 20 nt, Human
ggagugggugacaagagccu

SEQ ID NO: 2846204 - RNA, 17 nt, Human
ggaguggguggaggcag

SEQ ID NO: 2846205 - RNA, 14 nt, Human
ggaguguuauguau

SEQ ID NO: 2846206 - RNA, 16 nt, Human
ggaguguuauguauuu

SEQ ID NO: 2846207 - RNA, 15 nt, Human
ggaguguuucauggg

SEQ ID NO: 2846208 - RNA, 16 nt, Human
ggaugguccuggggcu

SEQ ID NO: 2846209 - RNA, 14 nt, Human
ggaugguccugggg

SEQ ID NO: 2846210 - RNA, 14 nt, Human
ggauggguuuuaug

SEQ ID NO: 2846211 - RNA, 22 nt, Human
ggaugguccuggggcucugugc

SEQ ID NO: 2846212 - RNA, 20 nt, Human
ggaugguccuggggcucugu

SEQ ID NO: 2846213 - RNA, 13 nt, Human
ggauggugcccug

SEQ ID NO: 2846214 - RNA, 15 nt, Human
ggauggugggcuuca

SEQ ID NO: 2846215 - RNA, 17 nt, Human
ggauggugggcuucagg

SEQ ID NO: 2846216 - RNA, 21 nt, Human
ggaugguguuacugcaguuga

SEQ ID NO: 2846217 - RNA, 22 nt, Human
ggaugggggcuggccucuggcu

SEQ ID NO: 2846218 - RNA, 13 nt, Human
ggauuguuuauac

SEQ ID NO: 2846219 - RNA, 17 nt, Human
ggauuuaaaaacuggaa

SEQ ID NO: 2846220 - RNA, 18 nt, Human
ggauuuaaaaacuggaac

SEQ ID NO: 2846221 - RNA, 16 nt, Human
ggauuguuaauuucag

SEQ ID NO: 2846222 - RNA, 19 nt, Human
ggauuguuaauuucagucc

SEQ ID NO: 2846223 - RNA, 14 nt, Human
ggauuuaauuucca

SEQ ID NO: 2846224 - RNA, 14 nt, Human
ggauuuagaagugu

SEQ ID NO: 2846225 - RNA, 23 nt, Human
ggauuuagaagugucauguuuau

SEQ ID NO: 2846226 - RNA, 14 nt, Human
ggaucuugaaugug

SEQ ID NO: 2846227 - RNA, 15 nt, Human
ggaucuugaaugugg

SEQ ID NO: 2846228 - RNA, 20 nt, Human
ggaucuugaauguggucuca

SEQ ID NO: 2846229 - RNA, 21 nt, Human
ggaucuugaauguggucucag

SEQ ID NO: 2846230 - RNA, 22 nt, Human
ggaucuugaauguggucucagg

SEQ ID NO: 2846231 - RNA, 15 nt, Human
ggaucggccuccucu

SEQ ID NO: 2846232 - RNA, 14 nt, Human
ggaguuccacagau

SEQ ID NO: 2846233 - RNA, 17 nt, Human
ggaguuccagcaaacaa

SEQ ID NO: 2846234 - RNA, 15 nt, Human
ggaucucagcuuuga

SEQ ID NO: 2846235 - RNA, 17 nt, Human
ggaucucagcuuugaga

SEQ ID NO: 2846236 - RNA, 16 nt, Human
ggaucucagcuuugag

SEQ ID NO: 2846237 - RNA, 22 nt, Human
ggaucucagcuuugagaagccu

SEQ ID NO: 2846238 - RNA, 19 nt, Human
ggagguggggcgaggcagg

SEQ ID NO: 2846239 - RNA, 22 nt, Human
ggaggugucacauggugccccu

SEQ ID NO: 2846240 - RNA, 16 nt, Human
ggaggugggagcagga

SEQ ID NO: 2846241 - RNA, 19 nt, Human
ggaggugggagcaggagau

SEQ ID NO: 2846242 - RNA, 17 nt, Human
ggagguggcagcccugu

SEQ ID NO: 2846243 - RNA, 15 nt, Human
ggagguggcagcccu

SEQ ID NO: 2846244 - RNA, 19 nt, Human
ggagggugggagagcccag

SEQ ID NO: 2846245 - RNA, 20 nt, Human
ggagggugggggccaccugc

SEQ ID NO: 2846246 - RNA, 22 nt, Human
ggagggugggggccaccugccu

SEQ ID NO: 2846247 - RNA, 20 nt, Human
ggaggguuggccugaguuag

SEQ ID NO: 2846248 - RNA, 19 nt, Human
ggagggaaaagggaaguag

SEQ ID NO: 2846249 - RNA, 15 nt, Human
ggagggggagaaaag

SEQ ID NO: 2846250 - RNA, 23 nt, Human
ggagggggagaaaaggaaaagaa

SEQ ID NO: 2846251 - RNA, 13 nt, Human
ggaggcuggcagg

SEQ ID NO: 2846252 - RNA, 22 nt, Human
ggaggcugcccccggcccccug

SEQ ID NO: 2846253 - RNA, 10 nt, Human
ggaggcugcg

SEQ ID NO: 2846254 - RNA, 17 nt, Human
ggaggcugcgugccagu

SEQ ID NO: 2846255 - RNA, 12 nt, Human
ggaggcugcccc

SEQ ID NO: 2846256 - RNA, 13 nt, Human
ggaggcugccccc

SEQ ID NO: 2846257 - RNA, 17 nt, Human
ggaggcugcccccggcc

SEQ ID NO: 2846258 - RNA, 21 nt, Human
ggaggcugcccccggcccccu

SEQ ID NO: 2846259 - RNA, 21 nt, Human
ggaggcuccuguuagcuccuc

SEQ ID NO: 2846260 - RNA, 20 nt, Human
ggaggcucccgaggggaagg

SEQ ID NO: 2846261 - RNA, 10 nt, Human
ggaggcugcc

SEQ ID NO: 2846262 - RNA, 20 nt, Human
ggaggcggagcuugcaguga

SEQ ID NO: 2846263 - RNA, 20 nt, Human
ggaggcggcacuccaaccua

SEQ ID NO: 2846264 - RNA, 20 nt, Human
ggaggcgggggcugcccuug

SEQ ID NO: 2846265 - RNA, 18 nt, Human
ggaggcgucucgggagag

SEQ ID NO: 2846266 - RNA, 15 nt, Human
gguuuuauauuuuua

SEQ ID NO: 2846267 - RNA, 15 nt, Human
gguuuuagguucuaa

SEQ ID NO: 2846268 - RNA, 16 nt, Human
gguuuuagguucuaaa

SEQ ID NO: 2846269 - RNA, 19 nt, Human
aaaguaaguaccacucagg

SEQ ID NO: 2846270 - RNA, 22 nt, Human
aaaguaacucauuuguuaaaau

SEQ ID NO: 2846271 - RNA, 21 nt, Human
gguuuucacauaaaugcagcc

SEQ ID NO: 2846272 - RNA, 22 nt, Human
gguuuucacauaaaugcagccc

SEQ ID NO: 2846273 - RNA, 17 nt, Human
gguuucguuucuguaua

SEQ ID NO: 2846274 - RNA, 17 nt, Human
gguuugguuccucucug

SEQ ID NO: 2846275 - RNA, 23 nt, Human
gguuugucgggcaccagccagcg

SEQ ID NO: 2846276 - RNA, 15 nt, Human
gguuugguuugcuuu

SEQ ID NO: 2846277 - RNA, 14 nt, Human
gguuuguguucuuc

SEQ ID NO: 2846278 - RNA, 17 nt, Human
gguuuuagguagaaaaa

SEQ ID NO: 2846279 - RNA, 18 nt, Human
gguuuuagguagaaaaac

SEQ ID NO: 2846280 - RNA, 17 nt, Human
gguuuuaaguuguuugc

SEQ ID NO: 2846281 - RNA, 14 nt, Human
gguucucaaugaaa

SEQ ID NO: 2846282 - RNA, 13 nt, Human
gguucucaaugaa

SEQ ID NO: 2846283 - RNA, 15 nt, Human
gguuucccaauggug

SEQ ID NO: 2846284 - RNA, 18 nt, Human
gguuucccaaugguguuu

SEQ ID NO: 2846285 - RNA, 20 nt, Human
gguuucccaaugguguuuuu

SEQ ID NO: 2846286 - RNA, 14 nt, Human
gguuuccacaugcu

SEQ ID NO: 2846287 - RNA, 12 nt, Human
gguuuccugccc

SEQ ID NO: 2846288 - RNA, 15 nt, Human
gguuuccugcccugg

SEQ ID NO: 2846289 - RNA, 13 nt, Human
gguuuccugcccu

SEQ ID NO: 2846290 - RNA, 19 nt, Human
gguuuccugcccugggagg

SEQ ID NO: 2846291 - RNA, 16 nt, Human
gguuuccugcccuggg

SEQ ID NO: 2846292 - RNA, 16 nt, Human
gguuucgcagccugag

SEQ ID NO: 2846293 - RNA, 17 nt, Human
aaaguaaugaucucaaa

SEQ ID NO: 2846294 - RNA, 12 nt, Human
aaaguaauguaa

SEQ ID NO: 2846295 - RNA, 13 nt, Human
aaaguaauguaaa

SEQ ID NO: 2846296 - RNA, 16 nt, Human
aaaguacaauguguuu

SEQ ID NO: 2846297 - RNA, 17 nt, Human
aaaguacaauguguuuu

SEQ ID NO: 2846298 - RNA, 18 nt, Human
aaaguacuugaguguaau

SEQ ID NO: 2846299 - RNA, 20 nt, Human
aaaguagaagaggguuuuag

SEQ ID NO: 2846300 - RNA, 20 nt, Human
aaaguagacaaucauuguuu

SEQ ID NO: 2846301 - RNA, 11 nt, Human
aaaguagaggu

SEQ ID NO: 2846302 - RNA, 21 nt, Human
aaaguggguuauucuggaguu

SEQ ID NO: 2846303 - RNA, 21 nt, Human
aaagugggaggucaggaaacu

SEQ ID NO: 2846304 - RNA, 17 nt, Human
aaagugggcuugauucu

SEQ ID NO: 2846305 - RNA, 20 nt, Human
aaaguauguaaaguauguaa

SEQ ID NO: 2846306 - RNA, 19 nt, Human
aaaguauguaaaguaugua

SEQ ID NO: 2846307 - RNA, 21 nt, Human
aaaguauccugcuucugauau

SEQ ID NO: 2846308 - RNA, 13 nt, Human
gguguuuauacag

SEQ ID NO: 2846309 - RNA, 17 nt, Human
gguguuuuaaaaaaucu

SEQ ID NO: 2846310 - RNA, 12 nt, Human
gguuccccaccg

SEQ ID NO: 2846311 - RNA, 17 nt, Human
gguucuaaaguucuaag

SEQ ID NO: 2846312 - RNA, 22 nt, Human
gguucuaaaguucuaagauucu

SEQ ID NO: 2846313 - RNA, 11 nt, Human
gguucuaaggc

SEQ ID NO: 2846314 - RNA, 12 nt, Human
gguucuaaggcc

SEQ ID NO: 2846315 - RNA, 12 nt, Human
gguucucaauga

SEQ ID NO: 2846316 - RNA, 21 nt, Human
gguuccgcacuuuccacuucu

SEQ ID NO: 2846317 - RNA, 23 nt, Human
gguucuaaggccuaggauucuaa

SEQ ID NO: 2846318 - RNA, 15 nt, Human
gguucuagguuucaa

SEQ ID NO: 2846319 - RNA, 18 nt, Human
gguucuaggcaucucugu

SEQ ID NO: 2846320 - RNA, 21 nt, Human
gguucuaggcaucucuguacu

SEQ ID NO: 2846321 - RNA, 23 nt, Human
gguucuaggcaucucuguacuuu

SEQ ID NO: 2846322 - RNA, 11 nt, Human
gguucuaaagu

SEQ ID NO: 2846323 - RNA, 12 nt, Human
gguucuaaaguu

SEQ ID NO: 2846324 - RNA, 13 nt, Human
gguucuaaaguuc

SEQ ID NO: 2846325 - RNA, 14 nt, Human
gguucuaaaguucu

SEQ ID NO: 2846326 - RNA, 15 nt, Human
gguucuaaaguucua

SEQ ID NO: 2846327 - RNA, 20 nt, Human
gguuccuuccucugagccuu

SEQ ID NO: 2846328 - RNA, 12 nt, Human
gguguggcuccu

SEQ ID NO: 2846329 - RNA, 13 nt, Human
gguguucuaagau

SEQ ID NO: 2846330 - RNA, 11 nt, Human
gguguucuaag

SEQ ID NO: 2846331 - RNA, 17 nt, Human
gguguuacugcaguuga

SEQ ID NO: 2846332 - RNA, 14 nt, Human
gguguguguagcca

SEQ ID NO: 2846333 - RNA, 21 nt, Human
gguguguuggacagagaaggg

SEQ ID NO: 2846334 - RNA, 12 nt, Human
ggugugucugcu

SEQ ID NO: 2846335 - RNA, 20 nt, Human
ggugggggccaccugccugc

SEQ ID NO: 2846336 - RNA, 19 nt, Human
aaagguuugcauucucaca

SEQ ID NO: 2846337 - RNA, 14 nt, Human
ggugggcuucccag

SEQ ID NO: 2846338 - RNA, 20 nt, Human
ggugggcuucccaguggcug

SEQ ID NO: 2846339 - RNA, 12 nt, Human
ggugggggagga

SEQ ID NO: 2846340 - RNA, 20 nt, Human
aaagggcccagagagggugg

SEQ ID NO: 2846341 - RNA, 20 nt, Human
aaagcuuauccauaaaaaaa

SEQ ID NO: 2846342 - RNA, 23 nt, Human
aaagcuuauccauaaaaaaaaau

SEQ ID NO: 2846343 - RNA, 17 nt, Human
aaaggggaaagaacaua

SEQ ID NO: 2846344 - RNA, 15 nt, Human
aaaggggacaggccu

SEQ ID NO: 2846345 - RNA, 16 nt, Human
aaaggggacaggccuc

SEQ ID NO: 2846346 - RNA, 19 nt, Human
aaaggggaucauaaaguua

SEQ ID NO: 2846347 - RNA, 17 nt, Human
aaaggggguccguggaa

SEQ ID NO: 2846348 - RNA, 13 nt, Human
aaagguguauuua

SEQ ID NO: 2846349 - RNA, 14 nt, Human
aaagguguauuuaa

SEQ ID NO: 2846350 - RNA, 15 nt, Human
aaagguguauuuaaa

SEQ ID NO: 2846351 - RNA, 19 nt, Human
aaagguggauuuuguuuaa

SEQ ID NO: 2846352 - RNA, 13 nt, Human
aaagguggccaca

SEQ ID NO: 2846353 - RNA, 21 nt, Human
aaagguggccacaaauucuuu

SEQ ID NO: 2846354 - RNA, 17 nt, Human
aaagguucacuaaagca

SEQ ID NO: 2846355 - RNA, 13 nt, Human
aaagguucuaggu

SEQ ID NO: 2846356 - RNA, 20 nt, Human
aaagguucuagguuucaaag

SEQ ID NO: 2846357 - RNA, 21 nt, Human
aaagguucuagguuucaaaga

SEQ ID NO: 2846358 - RNA, 14 nt, Human
aaagguucuucauc

SEQ ID NO: 2846359 - RNA, 15 nt, Human
aaagguucuucaucc

SEQ ID NO: 2846360 - RNA, 21 nt, Human
aaagguucuucaucccuuucc

SEQ ID NO: 2846361 - RNA, 22 nt, Human
aaagguucuucaucccuuucca

SEQ ID NO: 2846362 - RNA, 18 nt, Human
aaagggcacagcaucugu

SEQ ID NO: 2846363 - RNA, 19 nt, Human
aaagguugcuguuucacaa

SEQ ID NO: 2846364 - RNA, 12 nt, Human
gguggcuggguu

SEQ ID NO: 2846365 - RNA, 18 nt, Human
gguggcuggguuggaggg

SEQ ID NO: 2846366 - RNA, 23 nt, Human
ggugggaaggggagcacaauuuc

SEQ ID NO: 2846367 - RNA, 15 nt, Human
ggugggaaggggagc

SEQ ID NO: 2846368 - RNA, 21 nt, Human
ggugggaaccaugaagacagg

SEQ ID NO: 2846369 - RNA, 18 nt, Human
aaaguaacucauuuguua

SEQ ID NO: 2846370 - RNA, 20 nt, Human
aaaguaacucauuuguuaaa

SEQ ID NO: 2846371 - RNA, 14 nt, Human
aaaguaacucauuu

SEQ ID NO: 2846372 - RNA, 15 nt, Human
aaaguaacucauuug

SEQ ID NO: 2846373 - RNA, 13 nt, Human
gguggcuucagcu

SEQ ID NO: 2846374 - RNA, 14 nt, Human
gguggcuucagcuc

SEQ ID NO: 2846375 - RNA, 15 nt, Human
gguggcuucagcucc

SEQ ID NO: 2846376 - RNA, 16 nt, Human
gguggcuucagcucca

SEQ ID NO: 2846377 - RNA, 17 nt, Human
gguggcuucagcuccag

SEQ ID NO: 2846378 - RNA, 21 nt, Human
gguggcuucuuuucuuuguau

SEQ ID NO: 2846379 - RNA, 21 nt, Human
gguggcuuuccuuguggcaga

SEQ ID NO: 2846380 - RNA, 22 nt, Human
gguggcuuuccuuguggcagag

SEQ ID NO: 2846381 - RNA, 23 nt, Human
gguggcuuuccuuguggcagagg

SEQ ID NO: 2846382 - RNA, 14 nt, Human
aaaguaaaccacaa

SEQ ID NO: 2846383 - RNA, 21 nt, Human
aaaguaaaccacaaaaaaaua

SEQ ID NO: 2846384 - RNA, 14 nt, Human
aaagguuuuccucu

SEQ ID NO: 2846385 - RNA, 23 nt, Human
aaagguuuuggaucuugaaugug

SEQ ID NO: 2846386 - RNA, 17 nt, Human
ggugggcugagcccugg

SEQ ID NO: 2846387 - RNA, 15 nt, Human
ggugggcugagcccu

SEQ ID NO: 2846388 - RNA, 18 nt, Human
ggugggcugagcccuggc

SEQ ID NO: 2846389 - RNA, 16 nt, Human
ggugggcuucagggca

SEQ ID NO: 2846390 - RNA, 17 nt, Human
ggugggcuucagggcag

SEQ ID NO: 2846391 - RNA, 13 nt, Human
ggugggagcagga

SEQ ID NO: 2846392 - RNA, 16 nt, Human
ggugggagagcccagc

SEQ ID NO: 2846393 - RNA, 15 nt, Human
ggugggagagcccag

SEQ ID NO: 2846394 - RNA, 13 nt, Human
ggugggcugagcc

SEQ ID NO: 2846395 - RNA, 16 nt, Human
ggugggagcaggagau

SEQ ID NO: 2846396 - RNA, 16 nt, Human
ggugcugccugaaucc

SEQ ID NO: 2846397 - RNA, 13 nt, Human
gguggacacacaa

SEQ ID NO: 2846398 - RNA, 15 nt, Human
gguggacauggcccc

SEQ ID NO: 2846399 - RNA, 18 nt, Human
gguggacaguccugggag

SEQ ID NO: 2846400 - RNA, 17 nt, Human
gguggacaguccuggga

SEQ ID NO: 2846401 - RNA, 16 nt, Human
gguggacaguccuggg

SEQ ID NO: 2846402 - RNA, 15 nt, Human
gguggacaguccugg

SEQ ID NO: 2846403 - RNA, 14 nt, Human
gguggacaguccug

SEQ ID NO: 2846404 - RNA, 16 nt, Human
ggugcuggagguggga

SEQ ID NO: 2846405 - RNA, 21 nt, Human
ggugcuggaggugggagcagg

SEQ ID NO: 2846406 - RNA, 22 nt, Human
ggugcuggaggugggagcagga

SEQ ID NO: 2846407 - RNA, 22 nt, Human
aaagcagauaccucacccugcu

SEQ ID NO: 2846408 - RNA, 15 nt, Human
gguggcagcccugua

SEQ ID NO: 2846409 - RNA, 18 nt, Human
gguggcagcccuguaggg

SEQ ID NO: 2846410 - RNA, 18 nt, Human
gguggcacaggcccccuu

SEQ ID NO: 2846411 - RNA, 13 nt, Human
gguggcacugcca

SEQ ID NO: 2846412 - RNA, 18 nt, Human
gguggacccagggaacag

SEQ ID NO: 2846413 - RNA, 22 nt, Human
gguggaccuuuuaaaguguuuc

SEQ ID NO: 2846414 - RNA, 13 nt, Human
gguggacccaggg

SEQ ID NO: 2846415 - RNA, 17 nt, Human
gguggacuuagaaagca

SEQ ID NO: 2846416 - RNA, 18 nt, Human
gguggacuuagaaagcag

SEQ ID NO: 2846417 - RNA, 21 nt, Human
gguggacuuagaaagcagggg

SEQ ID NO: 2846418 - RNA, 19 nt, Human
gguggacuuagaaagcagg

SEQ ID NO: 2846419 - RNA, 20 nt, Human
gguggacuuagaaagcaggg

SEQ ID NO: 2846420 - RNA, 23 nt, Human
gguggacuuagaaagcaggggcu

SEQ ID NO: 2846421 - RNA, 21 nt, Human
gguggacuugaacuuuccugg

SEQ ID NO: 2846422 - RNA, 14 nt, Human
aaagcuguuaaacu

SEQ ID NO: 2846423 - RNA, 15 nt, Human
aaagcuguuaaacug

SEQ ID NO: 2846424 - RNA, 16 nt, Human
aaagcuguuaaacugu

SEQ ID NO: 2846425 - RNA, 18 nt, Human
aaagcuguuaaacuguua

SEQ ID NO: 2846426 - RNA, 23 nt, Human
aaagcuguuaaacuguuagcacu

SEQ ID NO: 2846427 - RNA, 21 nt, Human
aaagcuguguuguugcuucuu

SEQ ID NO: 2846428 - RNA, 15 nt, Human
aaagcugacauugcc

SEQ ID NO: 2846429 - RNA, 18 nt, Human
aaagcugacauugccaaa

SEQ ID NO: 2846430 - RNA, 19 nt, Human
aaagcugacauugccaaaa

SEQ ID NO: 2846431 - RNA, 17 nt, Human
aaagcugagaacuccug

SEQ ID NO: 2846432 - RNA, 18 nt, Human
aaagcugagaacuccuga

SEQ ID NO: 2846433 - RNA, 20 nt, Human
aaagcugagaacuccugacu

SEQ ID NO: 2846434 - RNA, 16 nt, Human
aaagcuaggccuggcc

SEQ ID NO: 2846435 - RNA, 14 nt, Human
aaagcuaggccugg

SEQ ID NO: 2846436 - RNA, 22 nt, Human
aaagcaguagaaauaauaugca

SEQ ID NO: 2846437 - RNA, 18 nt, Human
aaagcaggggcuacaaga

SEQ ID NO: 2846438 - RNA, 21 nt, Human
aaagcaggggcuacaagaggg

SEQ ID NO: 2846439 - RNA, 22 nt, Human
aaagcaggggcuacaagaggga

SEQ ID NO: 2846440 - RNA, 20 nt, Human
guacaaaauccagcuaugaa

SEQ ID NO: 2846441 - RNA, 16 nt, Human
guacaaaauaaacaaa

SEQ ID NO: 2846442 - RNA, 14 nt, Human
guacaaaauaaaca

SEQ ID NO: 2846443 - RNA, 12 nt, Human
guacaaaauaaa

SEQ ID NO: 2846444 - RNA, 12 nt, Human
guacaaaaauaa

SEQ ID NO: 2846445 - RNA, 18 nt, Human
guacaaaaauaaauuuau

SEQ ID NO: 2846446 - RNA, 15 nt, Human
guaauuuuuuucacc

SEQ ID NO: 2846447 - RNA, 17 nt, Human
guacaaggcgaucccau

SEQ ID NO: 2846448 - RNA, 17 nt, Human
guacaagucaguuucua

SEQ ID NO: 2846449 - RNA, 11 nt, Human
guacaauaaaa

SEQ ID NO: 2846450 - RNA, 16 nt, Human
guacaauaaaaguaaa

SEQ ID NO: 2846451 - RNA, 22 nt, Human
guacaauaaguguuuuuguauu

SEQ ID NO: 2846452 - RNA, 16 nt, Human
guacaauaauucauau

SEQ ID NO: 2846453 - RNA, 19 nt, Human
guacaauaauucauauucu

SEQ ID NO: 2846454 - RNA, 22 nt, Human
guacaaccuguucugcuuuccu

SEQ ID NO: 2846455 - RNA, 18 nt, Human
guacaaacuaaggugcua

SEQ ID NO: 2846456 - RNA, 22 nt, Human
guacaaaugccuuaaaauggaa

SEQ ID NO: 2846457 - RNA, 22 nt, Human
guacaaauuauaaaaagccacu

SEQ ID NO: 2846458 - RNA, 15 nt, Human
guaaucgaccugccu

SEQ ID NO: 2846459 - RNA, 16 nt, Human
guaaucaauaaagaaa

SEQ ID NO: 2846460 - RNA, 19 nt, Human
guaaucaauaaagaaaacu

SEQ ID NO: 2846461 - RNA, 19 nt, Human
guaaucccccaggagaaca

SEQ ID NO: 2846462 - RNA, 17 nt, Human
guaaguucagcacuugu

SEQ ID NO: 2846463 - RNA, 18 nt, Human
guaaguuaauaagcaaaa

SEQ ID NO: 2846464 - RNA, 17 nt, Human
guaacuaggcucagaga

SEQ ID NO: 2846465 - RNA, 22 nt, Human
guaacuauagacuggaaaaaau

SEQ ID NO: 2846466 - RNA, 23 nt, Human
guaaguugaauggccugccuuga

SEQ ID NO: 2846467 - RNA, 21 nt, Human
guaaguuuaaaggauguuggu

SEQ ID NO: 2846468 - RNA, 16 nt, Human
guaaguuucaggugac

SEQ ID NO: 2846469 - RNA, 22 nt, Human
guaaguuucaggugacauguga

SEQ ID NO: 2846470 - RNA, 13 nt, Human
guaaguuuuuuga

SEQ ID NO: 2846471 - RNA, 13 nt, Human
guaaguuucaggu

SEQ ID NO: 2846472 - RNA, 14 nt, Human
guaaguuucaggug

SEQ ID NO: 2846473 - RNA, 12 nt, Human
guaaccagccag

SEQ ID NO: 2846474 - RNA, 13 nt, Human
guaaccagccaga

SEQ ID NO: 2846475 - RNA, 20 nt, Human
guaaccagccagauccucuu

SEQ ID NO: 2846476 - RNA, 20 nt, Human
guaaccauuuuauaaagugc

SEQ ID NO: 2846477 - RNA, 12 nt, Human
guaauaaacuau

SEQ ID NO: 2846478 - RNA, 14 nt, Human
guaauaaacuauuu

SEQ ID NO: 2846479 - RNA, 23 nt, Human
guaauaagacauaacguuuuucc

SEQ ID NO: 2846480 - RNA, 16 nt, Human
guaauaaacuguguuu

SEQ ID NO: 2846481 - RNA, 13 nt, Human
guaauaauaccuc

SEQ ID NO: 2846482 - RNA, 14 nt, Human
guaauaauaccuca

SEQ ID NO: 2846483 - RNA, 15 nt, Human
guaauaauaccucaa

SEQ ID NO: 2846484 - RNA, 21 nt, Human
guaauaauaccucaauguuug

SEQ ID NO: 2846485 - RNA, 22 nt, Human
guaauaauaccucaauguuuga

SEQ ID NO: 2846486 - RNA, 15 nt, Human
guaauagagcaaaau

SEQ ID NO: 2846487 - RNA, 15 nt, Human
guaauagaaaacuga

SEQ ID NO: 2846488 - RNA, 19 nt, Human
guaauagaaaacugaaaau

SEQ ID NO: 2846489 - RNA, 18 nt, Human
guaauauuuauauauuua

SEQ ID NO: 2846490 - RNA, 12 nt, Human
guaaucaaugaa

SEQ ID NO: 2846491 - RNA, 18 nt, Human
guaaucaaugaauauuga

SEQ ID NO: 2846492 - RNA, 19 nt, Human
guaaucaaugaauauugaa

SEQ ID NO: 2846493 - RNA, 21 nt, Human
guaaucaaugaauauugaagu

SEQ ID NO: 2846494 - RNA, 13 nt, Human
guaauauuuugua

SEQ ID NO: 2846495 - RNA, 19 nt, Human
guaauauuuuguauuauug

SEQ ID NO: 2846496 - RNA, 13 nt, Human
guaauauuuuuau

SEQ ID NO: 2846497 - RNA, 18 nt, Human
guaauauuuuuauauaca

SEQ ID NO: 2846498 - RNA, 18 nt, Human
aaagugucaccuuuucuu

SEQ ID NO: 2846499 - RNA, 20 nt, Human
aaagugucaccuuuucuugc

SEQ ID NO: 2846500 - RNA, 21 nt, Human
aaagugucaccuuuucuugcc

SEQ ID NO: 2846501 - RNA, 23 nt, Human
aaagugguagguacuuuuuguga

SEQ ID NO: 2846502 - RNA, 17 nt, Human
aaaguguuuauuuuuca

SEQ ID NO: 2846503 - RNA, 18 nt, Human
aaaguguuuauuuuucau

SEQ ID NO: 2846504 - RNA, 20 nt, Human
aaaguguuuauuuuucauau

SEQ ID NO: 2846505 - RNA, 15 nt, Human
aaaguguuucuguua

SEQ ID NO: 2846506 - RNA, 21 nt, Human
aaaguguuuauuuuucauauu

SEQ ID NO: 2846507 - RNA, 12 nt, Human
aaaguguuucag

SEQ ID NO: 2846508 - RNA, 13 nt, Human
aaaguguuucagc

SEQ ID NO: 2846509 - RNA, 15 nt, Human
aaaguguuucagcua

SEQ ID NO: 2846510 - RNA, 21 nt, Human
aaaguguuucagcuaagggaa

SEQ ID NO: 2846511 - RNA, 13 nt, Human
aaaguguuugccu

SEQ ID NO: 2846512 - RNA, 14 nt, Human
aaaguuacagaaau

SEQ ID NO: 2846513 - RNA, 17 nt, Human
aaaguuacagaaauacu

SEQ ID NO: 2846514 - RNA, 16 nt, Human
aaaguuaacagauuuu

SEQ ID NO: 2846515 - RNA, 16 nt, Human
aaaguuaaucuucaug

SEQ ID NO: 2846516 - RNA, 15 nt, Human
aaaguuaaugcuuaa

SEQ ID NO: 2846517 - RNA, 22 nt, Human
aaaguuaaugcuuaagagggaa

SEQ ID NO: 2846518 - RNA, 15 nt, Human
aaauaauucuaaagg

SEQ ID NO: 2846519 - RNA, 13 nt, Human
aaauaauucuaaa

SEQ ID NO: 2846520 - RNA, 14 nt, Human
aaauaauucuaaag

SEQ ID NO: 2846521 - RNA, 16 nt, Human
guaaaauguugaauaa

SEQ ID NO: 2846522 - RNA, 15 nt, Human
guaaaauguugaaua

SEQ ID NO: 2846523 - RNA, 16 nt, Human
guaaacgcugucccua

SEQ ID NO: 2846524 - RNA, 20 nt, Human
guaaacgcugucccuaguaa

SEQ ID NO: 2846525 - RNA, 14 nt, Human
guaaacaaacucuu

SEQ ID NO: 2846526 - RNA, 19 nt, Human
guaaacaaacucuugaaga

SEQ ID NO: 2846527 - RNA, 22 nt, Human
guaaacacgccugcaaacgcug

SEQ ID NO: 2846528 - RNA, 19 nt, Human
guaaacacagucaaaauaa

SEQ ID NO: 2846529 - RNA, 13 nt, Human
guaaaauuuauuu

SEQ ID NO: 2846530 - RNA, 19 nt, Human
guaaaauugcugugcuuua

SEQ ID NO: 2846531 - RNA, 16 nt, Human
guaacaagccacccca

SEQ ID NO: 2846532 - RNA, 15 nt, Human
guaacagaacagcuu

SEQ ID NO: 2846533 - RNA, 18 nt, Human
guaacagaacagcuucag

SEQ ID NO: 2846534 - RNA, 21 nt, Human
guaacagaacagcuucagguu

SEQ ID NO: 2846535 - RNA, 22 nt, Human
guaacagaacagcuucagguua

SEQ ID NO: 2846536 - RNA, 15 nt, Human
guaacaucaaagauu

SEQ ID NO: 2846537 - RNA, 19 nt, Human
guaacaucacuauccaugc

SEQ ID NO: 2846538 - RNA, 20 nt, Human
guaacaucacuauccaugca

SEQ ID NO: 2846539 - RNA, 22 nt, Human
guaacaguucauguuugcuuca

SEQ ID NO: 2846540 - RNA, 14 nt, Human
guaacauaauaaau

SEQ ID NO: 2846541 - RNA, 11 nt, Human
guaaccagcca

SEQ ID NO: 2846542 - RNA, 11 nt, Human
guaaacugcca

SEQ ID NO: 2846543 - RNA, 17 nt, Human
guaaacuggaauuaaaa

SEQ ID NO: 2846544 - RNA, 18 nt, Human
guaaacuggaauuaaaag

SEQ ID NO: 2846545 - RNA, 23 nt, Human
guaaacucaaaauauuuguacau

SEQ ID NO: 2846546 - RNA, 16 nt, Human
guaaacucaaaauauu

SEQ ID NO: 2846547 - RNA, 14 nt, Human
guaaacgacacucu

SEQ ID NO: 2846548 - RNA, 22 nt, Human
guaaacuaucuuggugaauuuu

SEQ ID NO: 2846549 - RNA, 15 nt, Human
guaaacucaaaacuu

SEQ ID NO: 2846550 - RNA, 21 nt, Human
guaaacucaaaacuuaacaua

SEQ ID NO: 2846551 - RNA, 15 nt, Human
guaaagccauuaaau

SEQ ID NO: 2846552 - RNA, 12 nt, Human
guaaagcuccua

SEQ ID NO: 2846553 - RNA, 16 nt, Human
guaaaguauguaaaca

SEQ ID NO: 2846554 - RNA, 21 nt, Human
guaaaguauguaaacaggaga

SEQ ID NO: 2846555 - RNA, 15 nt, Human
guaaagguuuuuauu

SEQ ID NO: 2846556 - RNA, 18 nt, Human
aaauaucauuuauuuuuu

SEQ ID NO: 2846557 - RNA, 20 nt, Human
aaauaucccaaacugugaug

SEQ ID NO: 2846558 - RNA, 14 nt, Human
aaauaucccuuccg

SEQ ID NO: 2846559 - RNA, 15 nt, Human
aaauauauuuaauga

SEQ ID NO: 2846560 - RNA, 11 nt, Human
aaauauaugua

SEQ ID NO: 2846561 - RNA, 23 nt, Human
aaauauauuuuaccauacauuua

SEQ ID NO: 2846562 - RNA, 14 nt, Human
aaauauauuuaaug

SEQ ID NO: 2846563 - RNA, 22 nt, Human
aaauauauuguuaaucucuguu

SEQ ID NO: 2846564 - RNA, 15 nt, Human
aaauauaugaacauu

SEQ ID NO: 2846565 - RNA, 13 nt, Human
aaauauauauagu

SEQ ID NO: 2846566 - RNA, 14 nt, Human
aaauauauguauuu

SEQ ID NO: 2846567 - RNA, 22 nt, Human
aaauauauguauuuuuauauaa

SEQ ID NO: 2846568 - RNA, 16 nt, Human
guacaauguacacacu

SEQ ID NO: 2846569 - RNA, 16 nt, Human
aaauaccaggauuuuu

SEQ ID NO: 2846570 - RNA, 16 nt, Human
guacacacacauacac

SEQ ID NO: 2846571 - RNA, 13 nt, Human
guacaauguguuu

SEQ ID NO: 2846572 - RNA, 17 nt, Human
guacaauguguuuuucu

SEQ ID NO: 2846573 - RNA, 21 nt, Human
guacaauugugggcauaaacu

SEQ ID NO: 2846574 - RNA, 21 nt, Human
guacacaacuaguuuuguuua

SEQ ID NO: 2846575 - RNA, 20 nt, Human
guacacaauaagcaaaaaca

SEQ ID NO: 2846576 - RNA, 18 nt, Human
guacacaauaagcaaaaa

SEQ ID NO: 2846577 - RNA, 21 nt, Human
aaauacccguuaccauauuua

SEQ ID NO: 2846578 - RNA, 21 nt, Human
aaauacccuucuuuuaugagc

SEQ ID NO: 2846579 - RNA, 14 nt, Human
aaauaccucaggaa

SEQ ID NO: 2846580 - RNA, 15 nt, Human
aaauaccucaggaaa

SEQ ID NO: 2846581 - RNA, 17 nt, Human
aaauaccucaggaaaga

SEQ ID NO: 2846582 - RNA, 18 nt, Human
aaauaccucaggaaagaa

SEQ ID NO: 2846583 - RNA, 21 nt, Human
aaauaccucaggaaagaauag

SEQ ID NO: 2846584 - RNA, 14 nt, Human
aaauaccucauguu

SEQ ID NO: 2846585 - RNA, 15 nt, Human
aaauaccucauguuu

SEQ ID NO: 2846586 - RNA, 16 nt, Human
aaauaccucauguuua

SEQ ID NO: 2846587 - RNA, 17 nt, Human
aaauaccucauguuuau

SEQ ID NO: 2846588 - RNA, 22 nt, Human
aaauaccucauguuuaugaaaa

SEQ ID NO: 2846589 - RNA, 16 nt, Human
aaauaccauugacaca

SEQ ID NO: 2846590 - RNA, 18 nt, Human
aaauauagaucaguuaua

SEQ ID NO: 2846591 - RNA, 12 nt, Human
aaauauagauua

SEQ ID NO: 2846592 - RNA, 13 nt, Human
aaauauagauuag

SEQ ID NO: 2846593 - RNA, 16 nt, Human
aaauauagauuagaaa

SEQ ID NO: 2846594 - RNA, 17 nt, Human
aaauauagauuagaaaa

SEQ ID NO: 2846595 - RNA, 18 nt, Human
aaauauagauuagaaaaa

SEQ ID NO: 2846596 - RNA, 19 nt, Human
aaauauagauuagaaaaau

SEQ ID NO: 2846597 - RNA, 10 nt, Human
aaauauagcg

SEQ ID NO: 2846598 - RNA, 14 nt, Human
aaauauaguuccua

SEQ ID NO: 2846599 - RNA, 18 nt, Human
aaauauaguuccuaagaa

SEQ ID NO: 2846600 - RNA, 23 nt, Human
aaauauauacccccccaugcagu

SEQ ID NO: 2846601 - RNA, 18 nt, Human
aaauauauacgaacaaaa

SEQ ID NO: 2846602 - RNA, 12 nt, Human
aaauauauacua

SEQ ID NO: 2846603 - RNA, 13 nt, Human
aaauauauauaaa

SEQ ID NO: 2846604 - RNA, 16 nt, Human
aaauauauacuaaaca

SEQ ID NO: 2846605 - RNA, 21 nt, Human
aaauauauauaaagaauauau

SEQ ID NO: 2846606 - RNA, 14 nt, Human
aaauauauauacau

SEQ ID NO: 2846607 - RNA, 15 nt, Human
aaauauauauacaua

SEQ ID NO: 2846608 - RNA, 16 nt, Human
aaauauauauacauau

SEQ ID NO: 2846609 - RNA, 18 nt, Human
aaauauauauacauaugu

SEQ ID NO: 2846610 - RNA, 19 nt, Human
aaauauauauacauaugua

SEQ ID NO: 2846611 - RNA, 14 nt, Human
aaauauauauagaa

SEQ ID NO: 2846612 - RNA, 20 nt, Human
aaauaucuuguguuguccuu

SEQ ID NO: 2846613 - RNA, 21 nt, Human
aaauaucuuguguuguccuuu

SEQ ID NO: 2846614 - RNA, 13 nt, Human
aaauaucuuuuau

SEQ ID NO: 2846615 - RNA, 14 nt, Human
aaauaucuuuuaug

SEQ ID NO: 2846616 - RNA, 15 nt, Human
aaauaucuuuuaugu

SEQ ID NO: 2846617 - RNA, 19 nt, Human
aaauaucuuuuauguuuga

SEQ ID NO: 2846618 - RNA, 20 nt, Human
aaauaucuuuuauguuugaa

SEQ ID NO: 2846619 - RNA, 21 nt, Human
aaauaucuuuuauguuugaau

SEQ ID NO: 2846620 - RNA, 22 nt, Human
aaauaucuuuuauguuugaaua

SEQ ID NO: 2846621 - RNA, 23 nt, Human
aaauaucuuuuauguuugaauau

SEQ ID NO: 2846622 - RNA, 14 nt, Human
aaauaucugcucaa

SEQ ID NO: 2846623 - RNA, 16 nt, Human
aaauaucugaacauuu

SEQ ID NO: 2846624 - RNA, 17 nt, Human
aaauaucugaacauuua

SEQ ID NO: 2846625 - RNA, 19 nt, Human
aaauaucugaacauuuacu

SEQ ID NO: 2846626 - RNA, 10 nt, Human
aaauaucuga

SEQ ID NO: 2846627 - RNA, 23 nt, Human
aaauaugagugguuauugaaaau

SEQ ID NO: 2846628 - RNA, 18 nt, Human
aaauaugaacccuuuguu

SEQ ID NO: 2846629 - RNA, 19 nt, Human
aaauaugaacccuuuguuu

SEQ ID NO: 2846630 - RNA, 21 nt, Human
aaauaugaacccuuuguuucu

SEQ ID NO: 2846631 - RNA, 18 nt, Human
aaauaugucucgcuagug

SEQ ID NO: 2846632 - RNA, 13 nt, Human
aaauauguuuuua

SEQ ID NO: 2846633 - RNA, 21 nt, Human
aaauaugugagauuuuuuauu

SEQ ID NO: 2846634 - RNA, 23 nt, Human
aaauaugugagauuuuuuauugc

SEQ ID NO: 2846635 - RNA, 24 nt, Human
aaauaugugagauuuuuuauugcu

SEQ ID NO: 2846636 - RNA, 12 nt, Human
aaauauguacaa

SEQ ID NO: 2846637 - RNA, 20 nt, Human
aaauauggacacuuaauacu

SEQ ID NO: 2846638 - RNA, 16 nt, Human
aaauauggacacuuaa

SEQ ID NO: 2846639 - RNA, 15 nt, Human
aaauauggacacuua

SEQ ID NO: 2846640 - RNA, 23 nt, Human
aaauaugcagugauauggcagaa

SEQ ID NO: 2846641 - RNA, 18 nt, Human
aaauaugcagugauaugg

SEQ ID NO: 2846642 - RNA, 22 nt, Human
aaauaugcagugauauggcaga

SEQ ID NO: 2846643 - RNA, 10 nt, Human
aaauaugcaa

SEQ ID NO: 2846644 - RNA, 14 nt, Human
aaauaugcagugau

SEQ ID NO: 2846645 - RNA, 16 nt, Human
aaauauggaacuucua

SEQ ID NO: 2846646 - RNA, 17 nt, Human
aaauauggaacuucuaa

SEQ ID NO: 2846647 - RNA, 18 nt, Human
aaauauggaacuucuaau

SEQ ID NO: 2846648 - RNA, 19 nt, Human
aaauauggaacuucuaaua

SEQ ID NO: 2846649 - RNA, 20 nt, Human
aaauauggaacuucuaauau

SEQ ID NO: 2846650 - RNA, 15 nt, Human
aaauaugcuaauuug

SEQ ID NO: 2846651 - RNA, 19 nt, Human
aaauaugcuaauuugggga

SEQ ID NO: 2846652 - RNA, 13 nt, Human
aaauaugcucuuu

SEQ ID NO: 2846653 - RNA, 18 nt, Human
aaauaugcucuuuuguuu

SEQ ID NO: 2846654 - RNA, 20 nt, Human
aaauauuguguugugaaugu

SEQ ID NO: 2846655 - RNA, 13 nt, Human
aaaucauauugau

SEQ ID NO: 2846656 - RNA, 13 nt, Human
aaauauucuauau

SEQ ID NO: 2846657 - RNA, 20 nt, Human
aaauauuccugcauuuguga

SEQ ID NO: 2846658 - RNA, 13 nt, Human
aaauauugcuggg

SEQ ID NO: 2846659 - RNA, 15 nt, Human
aaauauugcuguaua

SEQ ID NO: 2846660 - RNA, 15 nt, Human
aaauauugaggcuuu

SEQ ID NO: 2846661 - RNA, 17 nt, Human
aaauauugaggcuuugu

SEQ ID NO: 2846662 - RNA, 18 nt, Human
aaauauugaggcuuugug

SEQ ID NO: 2846663 - RNA, 19 nt, Human
aaauauugaggcuuugugu

SEQ ID NO: 2846664 - RNA, 20 nt, Human
aaauauugaggcuuuguguu

SEQ ID NO: 2846665 - RNA, 21 nt, Human
aaauauugaggcuuuguguug

SEQ ID NO: 2846666 - RNA, 23 nt, Human
aaauauugaggcuuuguguugua

SEQ ID NO: 2846667 - RNA, 14 nt, Human
aaauauucuauaug

SEQ ID NO: 2846668 - RNA, 18 nt, Human
aaauauucuauaugaauu

SEQ ID NO: 2846669 - RNA, 20 nt, Human
aaauauucuauaugaauuua

SEQ ID NO: 2846670 - RNA, 17 nt, Human
ggguuuuccacccugga

SEQ ID NO: 2846671 - RNA, 16 nt, Human
ggguuuuccacccugg

SEQ ID NO: 2846672 - RNA, 20 nt, Human
ggguuuugccauguuggcca

SEQ ID NO: 2846673 - RNA, 23 nt, Human
ggguuuugccauguuggccaggc

SEQ ID NO: 2846674 - RNA, 17 nt, Human
aaacuuagugacaaaau

SEQ ID NO: 2846675 - RNA, 18 nt, Human
gggugucauuucauucca

SEQ ID NO: 2846676 - RNA, 13 nt, Human
ggguguagccagg

SEQ ID NO: 2846677 - RNA, 15 nt, Human
gggugguggugauag

SEQ ID NO: 2846678 - RNA, 14 nt, Human
gguaacagaacagc

SEQ ID NO: 2846679 - RNA, 15 nt, Human
gguaacagaacagcu

SEQ ID NO: 2846680 - RNA, 16 nt, Human
gguaacagaacagcuu

SEQ ID NO: 2846681 - RNA, 18 nt, Human
gguaacagaacagcuuca

SEQ ID NO: 2846682 - RNA, 17 nt, Human
gguaaaugcaaaguucu

SEQ ID NO: 2846683 - RNA, 13 nt, Human
gguaaaugccaca

SEQ ID NO: 2846684 - RNA, 20 nt, Human
gguaaaugccacacaccuuu

SEQ ID NO: 2846685 - RNA, 20 nt, Human
gguaaauaccaaguauuuau

SEQ ID NO: 2846686 - RNA, 15 nt, Human
gguaaauuaagacau

SEQ ID NO: 2846687 - RNA, 16 nt, Human
gguaaacacgccugca

SEQ ID NO: 2846688 - RNA, 13 nt, Human
gguaaaauguauu

SEQ ID NO: 2846689 - RNA, 15 nt, Human
gguaaaauguauuuu

SEQ ID NO: 2846690 - RNA, 17 nt, Human
gguaaaauguauuuuuc

SEQ ID NO: 2846691 - RNA, 16 nt, Human
gguaaaauuagaugca

SEQ ID NO: 2846692 - RNA, 22 nt, Human
gguaaaauuagaugcauguuga

SEQ ID NO: 2846693 - RNA, 14 nt, Human
gguaaaacaaaaca

SEQ ID NO: 2846694 - RNA, 19 nt, Human
aaacuguuaauaguucagg

SEQ ID NO: 2846695 - RNA, 20 nt, Human
aaacuguucccaccugcugg

SEQ ID NO: 2846696 - RNA, 21 nt, Human
aaacuguuaccuaaaguauuu

SEQ ID NO: 2846697 - RNA, 12 nt, Human
aaacuguuagca

SEQ ID NO: 2846698 - RNA, 16 nt, Human
aaacuguuagcacugu

SEQ ID NO: 2846699 - RNA, 19 nt, Human
aaacuguuagcacuguuga

SEQ ID NO: 2846700 - RNA, 21 nt, Human
aaacuguuagcacuguugaug

SEQ ID NO: 2846701 - RNA, 22 nt, Human
aaacuguuagcacuguugaugu

SEQ ID NO: 2846702 - RNA, 22 nt, Human
aaacuguucaagaaauaauaaa

SEQ ID NO: 2846703 - RNA, 13 nt, Human
aaacuaaaucucu

SEQ ID NO: 2846704 - RNA, 17 nt, Human
aaacuaaaucucuaaua

SEQ ID NO: 2846705 - RNA, 20 nt, Human
aaacuguuuuggguagcugc

SEQ ID NO: 2846706 - RNA, 23 nt, Human
aaacuguuuuggguagcugccac

SEQ ID NO: 2846707 - RNA, 17 nt, Human
aaacuuaacauauuuac

SEQ ID NO: 2846708 - RNA, 23 nt, Human
aaacuuaacuuuaacugaacaau

SEQ ID NO: 2846709 - RNA, 23 nt, Human
aaacuguuucagauuuuuuauuu

SEQ ID NO: 2846710 - RNA, 21 nt, Human
aaacuguucccaccugcugga

SEQ ID NO: 2846711 - RNA, 12 nt, Human
aaacgcuaccuc

SEQ ID NO: 2846712 - RNA, 13 nt, Human
aaacgcuaccucu

SEQ ID NO: 2846713 - RNA, 14 nt, Human
aaacgcgcagaugu

SEQ ID NO: 2846714 - RNA, 15 nt, Human
aaacgcgcagaugug

SEQ ID NO: 2846715 - RNA, 18 nt, Human
aaacgcgcagaugugcag

SEQ ID NO: 2846716 - RNA, 21 nt, Human
aaacgcgcagaugugcagcag

SEQ ID NO: 2846717 - RNA, 23 nt, Human
aaacgcgcagaugugcagcagau

SEQ ID NO: 2846718 - RNA, 24 nt, Human
aaacgcgcagaugugcagcagauu

SEQ ID NO: 2846719 - RNA, 15 nt, Human
aaacuaaaagacauu

SEQ ID NO: 2846720 - RNA, 18 nt, Human
aaacuaaaagacauuugu

SEQ ID NO: 2846721 - RNA, 21 nt, Human
aaacgacacucucuggaagcc

SEQ ID NO: 2846722 - RNA, 20 nt, Human
aaacuuaccuaagugacauu

SEQ ID NO: 2846723 - RNA, 23 nt, Human
aaacuuaccuaagugacauuugu

SEQ ID NO: 2846724 - RNA, 14 nt, Human
aaacuuacuauuuu

SEQ ID NO: 2846725 - RNA, 15 nt, Human
aaacuuacuauuuug

SEQ ID NO: 2846726 - RNA, 12 nt, Human
aaacuuaugaau

SEQ ID NO: 2846727 - RNA, 13 nt, Human
aaacuuaugaaug

SEQ ID NO: 2846728 - RNA, 14 nt, Human
aaacuuaugaaugu

SEQ ID NO: 2846729 - RNA, 16 nt, Human
aaacuuaugaauguuu

SEQ ID NO: 2846730 - RNA, 17 nt, Human
aaacuuaugaauguuuc

SEQ ID NO: 2846731 - RNA, 15 nt, Human
aaacuuauaaaucau

SEQ ID NO: 2846732 - RNA, 20 nt, Human
aaacuuauaaaucauauuga

SEQ ID NO: 2846733 - RNA, 21 nt, Human
aaacuuauaaaucauauugau

SEQ ID NO: 2846734 - RNA, 18 nt, Human
aaacuuauuuuauauuuu

SEQ ID NO: 2846735 - RNA, 22 nt, Human
aaacuuauuuuauauuuucccu

SEQ ID NO: 2846736 - RNA, 11 nt, Human
ggguggccucg

SEQ ID NO: 2846737 - RNA, 11 nt, Human
ggguggccugu

SEQ ID NO: 2846738 - RNA, 24 nt, Human
ggucaguguccaaagcagggucug

SEQ ID NO: 2846739 - RNA, 22 nt, Human
ggucauaaagaggcguugcuuu

SEQ ID NO: 2846740 - RNA, 16 nt, Human
ggucagucugguggga

SEQ ID NO: 2846741 - RNA, 19 nt, Human
gguaucaggugcugccauc

SEQ ID NO: 2846742 - RNA, 18 nt, Human
ggucagguuuaacauuug

SEQ ID NO: 2846743 - RNA, 19 nt, Human
ggucagguuuaacauuugc

SEQ ID NO: 2846744 - RNA, 18 nt, Human
aaacuuuaggguaaaaau

SEQ ID NO: 2846745 - RNA, 19 nt, Human
aaacuuuaggguaaaaauu

SEQ ID NO: 2846746 - RNA, 13 nt, Human
aaacuuuauacau

SEQ ID NO: 2846747 - RNA, 16 nt, Human
aaacuuuauacauuag

SEQ ID NO: 2846748 - RNA, 23 nt, Human
aaacuuuauacauuaguaaaugu

SEQ ID NO: 2846749 - RNA, 21 nt, Human
aaacuucccuuucugcuugug

SEQ ID NO: 2846750 - RNA, 17 nt, Human
aaacuuccccaucuucu

SEQ ID NO: 2846751 - RNA, 19 nt, Human
aaacuugacuccauuucau

SEQ ID NO: 2846752 - RNA, 17 nt, Human
aaacuucuggcucccuc

SEQ ID NO: 2846753 - RNA, 13 nt, Human
aaacuucuuaaau

SEQ ID NO: 2846754 - RNA, 15 nt, Human
aaacuucuuaaauau

SEQ ID NO: 2846755 - RNA, 16 nt, Human
aaacuucuuaaauauc

SEQ ID NO: 2846756 - RNA, 17 nt, Human
aaacuucuuaaauaucu

SEQ ID NO: 2846757 - RNA, 19 nt, Human
aaacuucuuaaauaucuuu

SEQ ID NO: 2846758 - RNA, 20 nt, Human
aaacuucuuaaauaucuuuu

SEQ ID NO: 2846759 - RNA, 21 nt, Human
aaacuucuuaaauaucuuuua

SEQ ID NO: 2846760 - RNA, 15 nt, Human
aaacuucuugucaga

SEQ ID NO: 2846761 - RNA, 17 nt, Human
aaacuucuugucagaca

SEQ ID NO: 2846762 - RNA, 23 nt, Human
aaacuucuugucagacauaaagc

SEQ ID NO: 2846763 - RNA, 13 nt, Human
aaacuugaaaaua

SEQ ID NO: 2846764 - RNA, 14 nt, Human
aaacuugaaaauau

SEQ ID NO: 2846765 - RNA, 15 nt, Human
gguccagcuggccug

SEQ ID NO: 2846766 - RNA, 22 nt, Human
gguccagccucguuggaagagg

SEQ ID NO: 2846767 - RNA, 13 nt, Human
gguccagcuggcc

SEQ ID NO: 2846768 - RNA, 20 nt, Human
gguccagcuggccuggacag

SEQ ID NO: 2846769 - RNA, 18 nt, Human
gguccagcuggccuggac

SEQ ID NO: 2846770 - RNA, 21 nt, Human
gguaacagaacagcuucaggu

SEQ ID NO: 2846771 - RNA, 23 nt, Human
gguaagaagccgggaacagacaa

SEQ ID NO: 2846772 - RNA, 23 nt, Human
gguaagagacagaauguaucugu

SEQ ID NO: 2846773 - RNA, 20 nt, Human
gguaagcacuuaaugaauga

SEQ ID NO: 2846774 - RNA, 20 nt, Human
gguaggccuuuuaacauuuu

SEQ ID NO: 2846775 - RNA, 14 nt, Human
gguagggaggcagc

SEQ ID NO: 2846776 - RNA, 15 nt, Human
gguagggaggcagcc

SEQ ID NO: 2846777 - RNA, 17 nt, Human
gguagggaggcagccuc

SEQ ID NO: 2846778 - RNA, 14 nt, Human
gguaucaggugcug

SEQ ID NO: 2846779 - RNA, 15 nt, Human
gguauaucugggcug

SEQ ID NO: 2846780 - RNA, 23 nt, Human
gguauaucugggcuggccaguug

SEQ ID NO: 2846781 - RNA, 18 nt, Human
gguauauauccgccuggc

SEQ ID NO: 2846782 - RNA, 20 nt, Human
gguauaaugguugacugggu

SEQ ID NO: 2846783 - RNA, 23 nt, Human
gguagggugggccuucagggagu

SEQ ID NO: 2846784 - RNA, 11 nt, Human
gguaggguggg

SEQ ID NO: 2846785 - RNA, 14 nt, Human
gggguaugaagagc

SEQ ID NO: 2846786 - RNA, 17 nt, Human
gggguccagggagcagg

SEQ ID NO: 2846787 - RNA, 13 nt, Human
ggggucaggcagc

SEQ ID NO: 2846788 - RNA, 14 nt, Human
gggggccaaaagga

SEQ ID NO: 2846789 - RNA, 19 nt, Human
gggggcucccguggccugu

SEQ ID NO: 2846790 - RNA, 22 nt, Human
gggggcagaucuuggacucaug

SEQ ID NO: 2846791 - RNA, 12 nt, Human
gggggccaccug

SEQ ID NO: 2846792 - RNA, 13 nt, Human
gggggccaccugc

SEQ ID NO: 2846793 - RNA, 22 nt, Human
gggggcuauagcuacaggaagc

SEQ ID NO: 2846794 - RNA, 20 nt, Human
gggggcaagaaguagcagug

SEQ ID NO: 2846795 - RNA, 14 nt, Human
ggggcccugcccug

SEQ ID NO: 2846796 - RNA, 21 nt, Human
gggggaugccacuccucccuc

SEQ ID NO: 2846797 - RNA, 22 nt, Human
gggggaugccacuccucccucc

SEQ ID NO: 2846798 - RNA, 12 nt, Human
ggggcccagggg

SEQ ID NO: 2846799 - RNA, 17 nt, Human
ggggcccaggggaggcg

SEQ ID NO: 2846800 - RNA, 19 nt, Human
ggggcccaaggcggccccu

SEQ ID NO: 2846801 - RNA, 22 nt, Human
ggggcccaaggcggccccuccc

SEQ ID NO: 2846802 - RNA, 14 nt, Human
ggggccccagggcu

SEQ ID NO: 2846803 - RNA, 15 nt, Human
ggggccccccugccc

SEQ ID NO: 2846804 - RNA, 12 nt, Human
aaaauguauuuu

SEQ ID NO: 2846805 - RNA, 19 nt, Human
aaaauguaaaggagucaaa

SEQ ID NO: 2846806 - RNA, 11 nt, Human
aaaauguaaau

SEQ ID NO: 2846807 - RNA, 20 nt, Human
aaaauguaaauauucuauau

SEQ ID NO: 2846808 - RNA, 14 nt, Human
aaaaugguuuauuu

SEQ ID NO: 2846809 - RNA, 18 nt, Human
aaaaugguuuauuuugua

SEQ ID NO: 2846810 - RNA, 22 nt, Human
aaaaugguuuauuuuguauugu

SEQ ID NO: 2846811 - RNA, 22 nt, Human
aaaauguaagauuauagauucu

SEQ ID NO: 2846812 - RNA, 13 nt, Human
aaaauguauuuuu

SEQ ID NO: 2846813 - RNA, 16 nt, Human
aaaauguauuuuucua

SEQ ID NO: 2846814 - RNA, 22 nt, Human
aaaaugucaaagagaaaacuua

SEQ ID NO: 2846815 - RNA, 11 nt, Human
aaaaugucugu

SEQ ID NO: 2846816 - RNA, 16 nt, Human
aaaauguccugccuuu

SEQ ID NO: 2846817 - RNA, 17 nt, Human
aaaauguccugccuuuu

SEQ ID NO: 2846818 - RNA, 18 nt, Human
aaaauguccugccuuuua

SEQ ID NO: 2846819 - RNA, 12 nt, Human
aaaaugucugua

SEQ ID NO: 2846820 - RNA, 18 nt, Human
gggguccugccggagagg

SEQ ID NO: 2846821 - RNA, 19 nt, Human
gggguccuggagcagacca

SEQ ID NO: 2846822 - RNA, 21 nt, Human
ggguaugaagagcuugcuuug

SEQ ID NO: 2846823 - RNA, 22 nt, Human
ggguauguuuaaucuguuaugu

SEQ ID NO: 2846824 - RNA, 16 nt, Human
ggguauugcuugccac

SEQ ID NO: 2846825 - RNA, 12 nt, Human
ggguauuggaaa

SEQ ID NO: 2846826 - RNA, 10 nt, Human
ggguauuuuu

SEQ ID NO: 2846827 - RNA, 17 nt, Human
gggucacccucuccagc

SEQ ID NO: 2846828 - RNA, 21 nt, Human
gggucauccugugcucggagg

SEQ ID NO: 2846829 - RNA, 21 nt, Human
gggucagucuggugggaggac

SEQ ID NO: 2846830 - RNA, 19 nt, Human
aaacauuuucagaaauauu

SEQ ID NO: 2846831 - RNA, 18 nt, Human
ggguccuggcuccugagg

SEQ ID NO: 2846832 - RNA, 20 nt, Human
aaacauuucauuaugagguc

SEQ ID NO: 2846833 - RNA, 14 nt, Human
aaacauuuuaaaaa

SEQ ID NO: 2846834 - RNA, 13 nt, Human
ggguccuggcucc

SEQ ID NO: 2846835 - RNA, 20 nt, Human
gggucauguuugcaggggug

SEQ ID NO: 2846836 - RNA, 21 nt, Human
gggucauguuugcagggguga

SEQ ID NO: 2846837 - RNA, 20 nt, Human
ggguccuaauuaccagucuu

SEQ ID NO: 2846838 - RNA, 18 nt, Human
aaaccugucaaugauaca

SEQ ID NO: 2846839 - RNA, 18 nt, Human
aaaccugucuccacugug

SEQ ID NO: 2846840 - RNA, 18 nt, Human
aaaccugugaagcugaaa

SEQ ID NO: 2846841 - RNA, 17 nt, Human
aaaccuucacuuaggaa

SEQ ID NO: 2846842 - RNA, 20 nt, Human
aaaccuguuuuuuuuucauu

SEQ ID NO: 2846843 - RNA, 20 nt, Human
aaaccuugcuaauuuucuca

SEQ ID NO: 2846844 - RNA, 14 nt, Human
aaaccuucugccuu

SEQ ID NO: 2846845 - RNA, 18 nt, Human
aaaccuuuuuuaagauuu

SEQ ID NO: 2846846 - RNA, 19 nt, Human
aaaccuuuuuuaagauuuu

SEQ ID NO: 2846847 - RNA, 20 nt, Human
aaaccuuuuuuaagauuuuu

SEQ ID NO: 2846848 - RNA, 21 nt, Human
aaaccuuuuuuaagauuuuuc

SEQ ID NO: 2846849 - RNA, 22 nt, Human
aaaccuuuuuuaagauuuuucu

SEQ ID NO: 2846850 - RNA, 23 nt, Human
aaaccuuuuuuaagauuuuucuc

SEQ ID NO: 2846851 - RNA, 15 nt, Human
aaaccuuuaagaaaa

SEQ ID NO: 2846852 - RNA, 23 nt, Human
aaaccaccagugcccaaagucug

SEQ ID NO: 2846853 - RNA, 16 nt, Human
aaaccacuagaacucu

SEQ ID NO: 2846854 - RNA, 16 nt, Human
aaaccagacaaggaaa

SEQ ID NO: 2846855 - RNA, 21 nt, Human
aaaccugggauucaggaaugu

SEQ ID NO: 2846856 - RNA, 18 nt, Human
aaaccugggcucugguuu

SEQ ID NO: 2846857 - RNA, 12 nt, Human
aaaccuguaucu

SEQ ID NO: 2846858 - RNA, 13 nt, Human
aaaccuguaucuu

SEQ ID NO: 2846859 - RNA, 16 nt, Human
aaaccuguaucuuucu

SEQ ID NO: 2846860 - RNA, 17 nt, Human
aaaccuguaucuuucua

SEQ ID NO: 2846861 - RNA, 18 nt, Human
aaaccugggauucaggaa

SEQ ID NO: 2846862 - RNA, 15 nt, Human
aaaccuggaugucac

SEQ ID NO: 2846863 - RNA, 12 nt, Human
aaaccugccugg

SEQ ID NO: 2846864 - RNA, 16 nt, Human
aaaccugccuggguuu

SEQ ID NO: 2846865 - RNA, 12 nt, Human
aaaauacauuua

SEQ ID NO: 2846866 - RNA, 18 nt, Human
aaaauacauuuaaaacuu

SEQ ID NO: 2846867 - RNA, 21 nt, Human
aaaauacaguuugucacauga

SEQ ID NO: 2846868 - RNA, 18 nt, Human
aaaauaauuuuaaaaaug

SEQ ID NO: 2846869 - RNA, 19 nt, Human
aaaauaauuuuaaaaaugg

SEQ ID NO: 2846870 - RNA, 17 nt, Human
aaaauaauuucucuaca

SEQ ID NO: 2846871 - RNA, 20 nt, Human
aaaauaauuuuaaacaaagg

SEQ ID NO: 2846872 - RNA, 19 nt, Human
aaaauaauuuuaaacaaag

SEQ ID NO: 2846873 - RNA, 14 nt, Human
aaaauaaugcugca

SEQ ID NO: 2846874 - RNA, 12 nt, Human
aaaauaauguaa

SEQ ID NO: 2846875 - RNA, 13 nt, Human
aaaauaauucuaa

SEQ ID NO: 2846876 - RNA, 14 nt, Human
aaaauaauucuaaa

SEQ ID NO: 2846877 - RNA, 12 nt, Human
aaaauaauaauu

SEQ ID NO: 2846878 - RNA, 22 nt, Human
aaaauaauaauuuuuauauuua

SEQ ID NO: 2846879 - RNA, 13 nt, Human
aaaauaagugaau

SEQ ID NO: 2846880 - RNA, 21 nt, Human
aaaauaagugaauaauaauua

SEQ ID NO: 2846881 - RNA, 16 nt, Human
aaaauaagaauagaaa

SEQ ID NO: 2846882 - RNA, 16 nt, Human
aaaauaacuucaagca

SEQ ID NO: 2846883 - RNA, 22 nt, Human
aaaaggagccaauuuaaagaaa

SEQ ID NO: 2846884 - RNA, 19 nt, Human
aaaaggacaucagcaaaca

SEQ ID NO: 2846885 - RNA, 22 nt, Human
aaaaggagagacucccaugaag

SEQ ID NO: 2846886 - RNA, 17 nt, Human
aaaaggacaucagcaaa

SEQ ID NO: 2846887 - RNA, 23 nt, Human
ggcuggucuugaaguccuggcuu

SEQ ID NO: 2846888 - RNA, 18 nt, Human
aaaagguauuuugaauac

SEQ ID NO: 2846889 - RNA, 19 nt, Human
aaaagguauuuugaauacc

SEQ ID NO: 2846890 - RNA, 21 nt, Human
aaaagguauuuugaauaccau

SEQ ID NO: 2846891 - RNA, 15 nt, Human
aaaagguauuaaauu

SEQ ID NO: 2846892 - RNA, 14 nt, Human
aaaauaacacacau

SEQ ID NO: 2846893 - RNA, 19 nt, Human
aaaagguucacuaaagcag

SEQ ID NO: 2846894 - RNA, 20 nt, Human
aaaagguucuucaucccuuu

SEQ ID NO: 2846895 - RNA, 15 nt, Human
aaaaggauacauaau

SEQ ID NO: 2846896 - RNA, 15 nt, Human
aaaaggauaguauuu

SEQ ID NO: 2846897 - RNA, 16 nt, Human
aaaaggauaguauuuu

SEQ ID NO: 2846898 - RNA, 17 nt, Human
aaaaggauaguauuuuu

SEQ ID NO: 2846899 - RNA, 22 nt, Human
aaaaggauaguauuuuuaucca

SEQ ID NO: 2846900 - RNA, 18 nt, Human
aaaaggauuuuuaucuuu

SEQ ID NO: 2846901 - RNA, 18 nt, Human
aaaaggccaguggaaauu

SEQ ID NO: 2846902 - RNA, 14 nt, Human
aaaaggcauuguuu

SEQ ID NO: 2846903 - RNA, 16 nt, Human
aaaaggcaaaugugua

SEQ ID NO: 2846904 - RNA, 17 nt, Human
aaaaggcauuguuugag

SEQ ID NO: 2846905 - RNA, 15 nt, Human
aaaauauuuguacau

SEQ ID NO: 2846906 - RNA, 23 nt, Human
aaaauauuuauuaaauaaaauca

SEQ ID NO: 2846907 - RNA, 21 nt, Human
aaaauauuugacuauucugua

SEQ ID NO: 2846908 - RNA, 11 nt, Human
aaaauauuuau

SEQ ID NO: 2846909 - RNA, 12 nt, Human
aaaauauuuaaa

SEQ ID NO: 2846910 - RNA, 16 nt, Human
aaaauauuuaaaaaug

SEQ ID NO: 2846911 - RNA, 19 nt, Human
aaaauauuuaaaaaugucu

SEQ ID NO: 2846912 - RNA, 20 nt, Human
aaaauauuuaaaaaugucuu

SEQ ID NO: 2846913 - RNA, 16 nt, Human
aaaauauggaacuucu

SEQ ID NO: 2846914 - RNA, 15 nt, Human
aaaauauauuuaaug

SEQ ID NO: 2846915 - RNA, 13 nt, Human
aaaauagacacuc

SEQ ID NO: 2846916 - RNA, 15 nt, Human
aaaauagaagcugua

SEQ ID NO: 2846917 - RNA, 15 nt, Human
aaaauacuuuuccuu

SEQ ID NO: 2846918 - RNA, 16 nt, Human
aaaauacuuuuccuua

SEQ ID NO: 2846919 - RNA, 19 nt, Human
aaaauacuuuuucuaauga

SEQ ID NO: 2846920 - RNA, 12 nt, Human
aaaauagaaaag

SEQ ID NO: 2846921 - RNA, 15 nt, Human
aaaauagaaaaguua

SEQ ID NO: 2846922 - RNA, 16 nt, Human
aaaauagaaaaguuau

SEQ ID NO: 2846923 - RNA, 16 nt, Human
aaaauauauuuaauga

SEQ ID NO: 2846924 - RNA, 20 nt, Human
aaaauagaguguaguuuaca

SEQ ID NO: 2846925 - RNA, 16 nt, Human
aaaauagagcuuuuaa

SEQ ID NO: 2846926 - RNA, 21 nt, Human
aaaauagagcuuuuaaaaaug

SEQ ID NO: 2846927 - RNA, 18 nt, Human
aaaauaucugaaauguga

SEQ ID NO: 2846928 - RNA, 22 nt, Human
aaaauaugaccacacuccagcu

SEQ ID NO: 2846929 - RNA, 15 nt, Human
aaaauauuccugcau

SEQ ID NO: 2846930 - RNA, 13 nt, Human
aaaauggaaagaa

SEQ ID NO: 2846931 - RNA, 14 nt, Human
aaaauggaaagaau

SEQ ID NO: 2846932 - RNA, 14 nt, Human
aaaauggaacugug

SEQ ID NO: 2846933 - RNA, 22 nt, Human
aaaaugcuuuuuauuucugcau

SEQ ID NO: 2846934 - RNA, 12 nt, Human
aaaauggaaaga

SEQ ID NO: 2846935 - RNA, 14 nt, Human
aaaaugcuucaaag

SEQ ID NO: 2846936 - RNA, 13 nt, Human
aaaaugcuuuuua

SEQ ID NO: 2846937 - RNA, 19 nt, Human
aaaaugcuuuuuauuucug

SEQ ID NO: 2846938 - RNA, 18 nt, Human
aaaaugcuuuuuauuucu

SEQ ID NO: 2846939 - RNA, 23 nt, Human
aaaaugcuguauuagucacagag

SEQ ID NO: 2846940 - RNA, 21 nt, Human
aaaaugcuguauuagucacag

SEQ ID NO: 2846941 - RNA, 11 nt, Human
aaaaugcaaua

SEQ ID NO: 2846942 - RNA, 12 nt, Human
aaaaugcaauau

SEQ ID NO: 2846943 - RNA, 15 nt, Human
aaaaugcaauauuug

SEQ ID NO: 2846944 - RNA, 17 nt, Human
aaaaugcaauauuugua

SEQ ID NO: 2846945 - RNA, 15 nt, Human
aaaaugccauaauac

SEQ ID NO: 2846946 - RNA, 17 nt, Human
aaaaugccauaauacaa

SEQ ID NO: 2846947 - RNA, 18 nt, Human
aaaaugccauaauacaaa

SEQ ID NO: 2846948 - RNA, 21 nt, Human
aaaaugccauaauacaaaagg

SEQ ID NO: 2846949 - RNA, 15 nt, Human
aaaaugcccauuugc

SEQ ID NO: 2846950 - RNA, 18 nt, Human
aaaaugagcauacaucuu

SEQ ID NO: 2846951 - RNA, 16 nt, Human
aaaaugauguucauuu

SEQ ID NO: 2846952 - RNA, 16 nt, Human
aaaaugauuguaaaau

SEQ ID NO: 2846953 - RNA, 19 nt, Human
aaaaugauuguaaaauagc

SEQ ID NO: 2846954 - RNA, 20 nt, Human
aaaaugauuguaaaauagcu

SEQ ID NO: 2846955 - RNA, 22 nt, Human
aaaaugauuuguaguggaaaca

SEQ ID NO: 2846956 - RNA, 15 nt, Human
aaaaucugcuaggga

SEQ ID NO: 2846957 - RNA, 14 nt, Human
aaaaugacuacuua

SEQ ID NO: 2846958 - RNA, 18 nt, Human
aaaaugacuacuuagcau

SEQ ID NO: 2846959 - RNA, 19 nt, Human
aaaaugacuacuuagcauc

SEQ ID NO: 2846960 - RNA, 15 nt, Human
aaaaugacaucuuuu

SEQ ID NO: 2846961 - RNA, 16 nt, Human
aaaaugacaucuuuuu

SEQ ID NO: 2846962 - RNA, 17 nt, Human
aaaaugacaucuuuuua

SEQ ID NO: 2846963 - RNA, 15 nt, Human
aaaaugguauaagua

SEQ ID NO: 2846964 - RNA, 18 nt, Human
aaaaugguauaaguaacu

SEQ ID NO: 2846965 - RNA, 23 nt, Human
aaaaugguauaaguaacuuuauu

SEQ ID NO: 2846966 - RNA, 15 nt, Human
aaaaugguggcuuca

SEQ ID NO: 2846967 - RNA, 18 nt, Human
aaaaugguggcuucagcu

SEQ ID NO: 2846968 - RNA, 19 nt, Human
aaaaugguggcuucagcuc

SEQ ID NO: 2846969 - RNA, 21 nt, Human
aaaaugguggcuucagcucca

SEQ ID NO: 2846970 - RNA, 12 nt, Human
gggcuggggagg

SEQ ID NO: 2846971 - RNA, 23 nt, Human
aaaauggccauuugcuuuuucac

SEQ ID NO: 2846972 - RNA, 19 nt, Human
aaaauggccauuugcuuuu

SEQ ID NO: 2846973 - RNA, 14 nt, Human
gggcugcuccucau

SEQ ID NO: 2846974 - RNA, 11 nt, Human
gggcugcuccu

SEQ ID NO: 2846975 - RNA, 21 nt, Human
gggcugcccuggugcugccac

SEQ ID NO: 2846976 - RNA, 17 nt, Human
gggcuagguagaaaaag

SEQ ID NO: 2846977 - RNA, 19 nt, Human
gggcucagcggggacagcu

SEQ ID NO: 2846978 - RNA, 17 nt, Human
gggcucagcggggacag

SEQ ID NO: 2846979 - RNA, 15 nt, Human
gggcuaguugggcuu

SEQ ID NO: 2846980 - RNA, 20 nt, Human
gggcuaggaaauccagggug

SEQ ID NO: 2846981 - RNA, 18 nt, Human
gggcuaguugggcuuccu

SEQ ID NO: 2846982 - RNA, 21 nt, Human
gggcucagcggggacagcucc

SEQ ID NO: 2846983 - RNA, 22 nt, Human
gggcucaggucacauaaaacuu

SEQ ID NO: 2846984 - RNA, 14 nt, Human
gggccucgggaccu

SEQ ID NO: 2846985 - RNA, 22 nt, Human
gggccucggacuuagcugggag

SEQ ID NO: 2846986 - RNA, 16 nt, Human
gggccucgggaccuca

SEQ ID NO: 2846987 - RNA, 21 nt, Human
gggccugcaggaccugccugu

SEQ ID NO: 2846988 - RNA, 24 nt, Human
gggccugcaggaccugccuguagc

SEQ ID NO: 2846989 - RNA, 20 nt, Human
gggccucaccgagugggggc

SEQ ID NO: 2846990 - RNA, 20 nt, Human
gggccucaaaggcccgcucu

SEQ ID NO: 2846991 - RNA, 15 nt, Human
gggccucagugccac

SEQ ID NO: 2846992 - RNA, 14 nt, Human
gggccucagugcca

SEQ ID NO: 2846993 - RNA, 13 nt, Human
gggccucagugcc

SEQ ID NO: 2846994 - RNA, 21 nt, Human
gggcggugagaggggaacaga

SEQ ID NO: 2846995 - RNA, 19 nt, Human
gggcgugagaccugccccu

SEQ ID NO: 2846996 - RNA, 18 nt, Human
gggcgugagaccugcccc

SEQ ID NO: 2846997 - RNA, 14 nt, Human
gggcgugagguccc

SEQ ID NO: 2846998 - RNA, 16 nt, Human
gggcgugaggucccag

SEQ ID NO: 2846999 - RNA, 20 nt, Human
gggcuacugcagcuuuacau

SEQ ID NO: 2847000 - RNA, 13 nt, Human
gggccugccuggc

SEQ ID NO: 2847001 - RNA, 14 nt, Human
gggccugccuggcc

SEQ ID NO: 2847002 - RNA, 20 nt, Human
gggccacugugguggcagug

SEQ ID NO: 2847003 - RNA, 22 nt, Human
gggccagaggaacuguccagag

SEQ ID NO: 2847004 - RNA, 23 nt, Human
gggccagaggaacuguccagaga

SEQ ID NO: 2847005 - RNA, 14 nt, Human
gggccaggccgggc

SEQ ID NO: 2847006 - RNA, 22 nt, Human
gggccaggccgggccuguacag

SEQ ID NO: 2847007 - RNA, 23 nt, Human
gggccaggccgggccuguacagu

SEQ ID NO: 2847008 - RNA, 20 nt, Human
gggccagaguauuggucucc

SEQ ID NO: 2847009 - RNA, 11 nt, Human
gggccaggcag

SEQ ID NO: 2847010 - RNA, 12 nt, Human
gggccaggcagg

SEQ ID NO: 2847011 - RNA, 13 nt, Human
gggccaggcaggu

SEQ ID NO: 2847012 - RNA, 20 nt, Human
gggccaggcaggugccugga

SEQ ID NO: 2847013 - RNA, 23 nt, Human
gggccaggcaggugccuggacau

SEQ ID NO: 2847014 - RNA, 21 nt, Human
gggccauguccaaagaggcug

SEQ ID NO: 2847015 - RNA, 17 nt, Human
gggccauguccaaagag

SEQ ID NO: 2847016 - RNA, 16 nt, Human
gggccauguccaaaga

SEQ ID NO: 2847017 - RNA, 15 nt, Human
gggccauguccaaag

SEQ ID NO: 2847018 - RNA, 14 nt, Human
gggccauguccaaa

SEQ ID NO: 2847019 - RNA, 23 nt, Human
gggccauguccaaagaggcugcc

SEQ ID NO: 2847020 - RNA, 22 nt, Human
gggccauguccaaagaggcugc

SEQ ID NO: 2847021 - RNA, 18 nt, Human
gggcccaagacagaugcc

SEQ ID NO: 2847022 - RNA, 23 nt, Human
gggccgcguggugccauccccag

SEQ ID NO: 2847023 - RNA, 15 nt, Human
gggccggagggucag

SEQ ID NO: 2847024 - RNA, 20 nt, Human
gggccgcguggugccauccc

SEQ ID NO: 2847025 - RNA, 21 nt, Human
gcuauuauuuucacuguagaa

SEQ ID NO: 2847026 - RNA, 18 nt, Human
gcuauuauuuucacugua

SEQ ID NO: 2847027 - RNA, 17 nt, Human
gcuauuauuuucacugu

SEQ ID NO: 2847028 - RNA, 18 nt, Human
gcuauuagccaggaucau

SEQ ID NO: 2847029 - RNA, 19 nt, Human
gcuauuagccaggaucaug

SEQ ID NO: 2847030 - RNA, 15 nt, Human
gcuauuacugucugg

SEQ ID NO: 2847031 - RNA, 13 nt, Human
gcuauuagccagg

SEQ ID NO: 2847032 - RNA, 17 nt, Human
gcuauuagccaggauca

SEQ ID NO: 2847033 - RNA, 21 nt, Human
gcuauuagccaggaucauggu

SEQ ID NO: 2847034 - RNA, 14 nt, Human
gcucaaauaaaaau

SEQ ID NO: 2847035 - RNA, 16 nt, Human
gcuaguugggcuuccu

SEQ ID NO: 2847036 - RNA, 14 nt, Human
gcuaguugggcuuc

SEQ ID NO: 2847037 - RNA, 12 nt, Human
gcuauuacaaau

SEQ ID NO: 2847038 - RNA, 13 nt, Human
gcuauuacaaaua

SEQ ID NO: 2847039 - RNA, 15 nt, Human
gcuauuaaaacucag

SEQ ID NO: 2847040 - RNA, 16 nt, Human
gcuauuaaaacucagc

SEQ ID NO: 2847041 - RNA, 20 nt, Human
gcuauuaaaacucagccugg

SEQ ID NO: 2847042 - RNA, 20 nt, Human
gcuagguagaaaaaggguca

SEQ ID NO: 2847043 - RNA, 14 nt, Human
gcuaguguucuguc

SEQ ID NO: 2847044 - RNA, 15 nt, Human
gcuaguguucugucu

SEQ ID NO: 2847045 - RNA, 14 nt, Human
gcuaggguggcccu

SEQ ID NO: 2847046 - RNA, 17 nt, Human
gcuaggggacaucagag

SEQ ID NO: 2847047 - RNA, 15 nt, Human
gcuaggguggcccuu

SEQ ID NO: 2847048 - RNA, 20 nt, Human
gcuaggaccccuccaugugg

SEQ ID NO: 2847049 - RNA, 18 nt, Human
gcuaggaaugaaauccug

SEQ ID NO: 2847050 - RNA, 13 nt, Human
gcuaggaaugaaa

SEQ ID NO: 2847051 - RNA, 12 nt, Human
gcuaggaaugaa

SEQ ID NO: 2847052 - RNA, 22 nt, Human
gcuaagugauccucccaccuca

SEQ ID NO: 2847053 - RNA, 18 nt, Human
gcuaagugauccucccac

SEQ ID NO: 2847054 - RNA, 22 nt, Human
gcuaaggcguggagcugccuga

SEQ ID NO: 2847055 - RNA, 20 nt, Human
gcuaaggcguggagcugccu

SEQ ID NO: 2847056 - RNA, 21 nt, Human
gcuaaggcguggagcugccug

SEQ ID NO: 2847057 - RNA, 19 nt, Human
gcuaagggugggugcucag

SEQ ID NO: 2847058 - RNA, 20 nt, Human
gcuaagggugggugcucaga

SEQ ID NO: 2847059 - RNA, 21 nt, Human
gcuaagggugggugcucagaa

SEQ ID NO: 2847060 - RNA, 22 nt, Human
gcuaagggugggugcucagaau

SEQ ID NO: 2847061 - RNA, 14 nt, Human
gcuaagguucuaag

SEQ ID NO: 2847062 - RNA, 15 nt, Human
gcuaagguucuaagg

SEQ ID NO: 2847063 - RNA, 16 nt, Human
gcuaagguucuaaggc

SEQ ID NO: 2847064 - RNA, 17 nt, Human
gcuaagguucuaaggcc

SEQ ID NO: 2847065 - RNA, 21 nt, Human
gcuaaguacacaauaagcaaa

SEQ ID NO: 2847066 - RNA, 20 nt, Human
gcuaaguacacaauaagcaa

SEQ ID NO: 2847067 - RNA, 22 nt, Human
gcuaaguacacaauaagcaaaa

SEQ ID NO: 2847068 - RNA, 15 nt, Human
gcucaggggcagcuc

SEQ ID NO: 2847069 - RNA, 16 nt, Human
gcucaggggcagcuca

SEQ ID NO: 2847070 - RNA, 19 nt, Human
gcucaggggcagcucauag

SEQ ID NO: 2847071 - RNA, 17 nt, Human
gcucaggaggcuuggaa

SEQ ID NO: 2847072 - RNA, 16 nt, Human
gcucaggaggcuugga

SEQ ID NO: 2847073 - RNA, 15 nt, Human
gcucaggaggcgccc

SEQ ID NO: 2847074 - RNA, 18 nt, Human
gcucagagaugugcaccc

SEQ ID NO: 2847075 - RNA, 15 nt, Human
gcucaggaggcuugg

SEQ ID NO: 2847076 - RNA, 13 nt, Human
gcucaggaggcuu

SEQ ID NO: 2847077 - RNA, 16 nt, Human
gcucaacaauaaaaca

SEQ ID NO: 2847078 - RNA, 15 nt, Human
gcucagaauaaggca

SEQ ID NO: 2847079 - RNA, 20 nt, Human
gcucagaauaaggcaggcau

SEQ ID NO: 2847080 - RNA, 17 nt, Human
gcucagaacaguaucuu

SEQ ID NO: 2847081 - RNA, 14 nt, Human
gcucagaacccagg

SEQ ID NO: 2847082 - RNA, 15 nt, Human
gcucagaacccaggg

SEQ ID NO: 2847083 - RNA, 16 nt, Human
gcucagaacccagggc

SEQ ID NO: 2847084 - RNA, 17 nt, Human
gcucagaacccagggcu

SEQ ID NO: 2847085 - RNA, 18 nt, Human
gcucagaacccagggcuc

SEQ ID NO: 2847086 - RNA, 22 nt, Human
gcucagaacccagggcucugcc

SEQ ID NO: 2847087 - RNA, 23 nt, Human
gcucagaacccagggcucugccc

SEQ ID NO: 2847088 - RNA, 19 nt, Human
gcucagagggggacugcug

SEQ ID NO: 2847089 - RNA, 20 nt, Human
gcucagagggggacugcugc

SEQ ID NO: 2847090 - RNA, 23 nt, Human
gcucaagcagcgaccgcccccuc

SEQ ID NO: 2847091 - RNA, 21 nt, Human
gcucaagcagcgaccgccccc

SEQ ID NO: 2847092 - RNA, 22 nt, Human
gcucaagcagcgaccgcccccu

SEQ ID NO: 2847093 - RNA, 14 nt, Human
gcucaacuuucugu

SEQ ID NO: 2847094 - RNA, 15 nt, Human
gcucaagcagcgacc

SEQ ID NO: 2847095 - RNA, 21 nt, Human
gcucaagcaauccucucaccu

SEQ ID NO: 2847096 - RNA, 14 nt, Human
gccuucgugccccc

SEQ ID NO: 2847097 - RNA, 19 nt, Human
gccuucgugcccccccuuc

SEQ ID NO: 2847098 - RNA, 16 nt, Human
gccuucucugaaggac

SEQ ID NO: 2847099 - RNA, 15 nt, Human
gccuucucugaagga

SEQ ID NO: 2847100 - RNA, 17 nt, Human
gccuguucagcuccagc

SEQ ID NO: 2847101 - RNA, 16 nt, Human
gccuguucagcuccag

SEQ ID NO: 2847102 - RNA, 14 nt, Human
gccuguucagcucc

SEQ ID NO: 2847103 - RNA, 14 nt, Human
gccuguggcccugu

SEQ ID NO: 2847104 - RNA, 15 nt, Human
gccuguggcccuguc

SEQ ID NO: 2847105 - RNA, 17 nt, Human
gccuguggcccuguccu

SEQ ID NO: 2847106 - RNA, 15 nt, Human
gccuguucagcucca

SEQ ID NO: 2847107 - RNA, 22 nt, Human
gccuucuuuugauuauguuuuu

SEQ ID NO: 2847108 - RNA, 15 nt, Human
gccuucuuuugauua

SEQ ID NO: 2847109 - RNA, 11 nt, Human
gccuucuuuga

SEQ ID NO: 2847110 - RNA, 13 nt, Human
gccuucuuugaag

SEQ ID NO: 2847111 - RNA, 14 nt, Human
gccuucuuugaaga

SEQ ID NO: 2847112 - RNA, 15 nt, Human
gccuucuuugaagaa

SEQ ID NO: 2847113 - RNA, 20 nt, Human
gccuucuuccaucccaggac

SEQ ID NO: 2847114 - RNA, 22 nt, Human
gccuucuuccaucccaggacac

SEQ ID NO: 2847115 - RNA, 14 nt, Human
gccuucuucagggc

SEQ ID NO: 2847116 - RNA, 15 nt, Human
gccuucuucagggcc

SEQ ID NO: 2847117 - RNA, 17 nt, Human
gccuucuucagggccug

SEQ ID NO: 2847118 - RNA, 18 nt, Human
gccuucuucagggccugg

SEQ ID NO: 2847119 - RNA, 19 nt, Human
gccuucuucagggccuggu

SEQ ID NO: 2847120 - RNA, 14 nt, Human
gccuucuuccaucc

SEQ ID NO: 2847121 - RNA, 17 nt, Human
gccuucuuccaucccag

SEQ ID NO: 2847122 - RNA, 13 nt, Human
gccuucuccuccc

SEQ ID NO: 2847123 - RNA, 14 nt, Human
gccuucuccucccc

SEQ ID NO: 2847124 - RNA, 17 nt, Human
gccuucugacggcccug

SEQ ID NO: 2847125 - RNA, 18 nt, Human
gccuucugacggcccugc

SEQ ID NO: 2847126 - RNA, 19 nt, Human
gccuucugacggcccugca

SEQ ID NO: 2847127 - RNA, 20 nt, Human
gccuucugacggcccugcaa

SEQ ID NO: 2847128 - RNA, 14 nt, Human
gccuucugaugucu

SEQ ID NO: 2847129 - RNA, 23 nt, Human
gccuucugaugucucuaaagcac

SEQ ID NO: 2847130 - RNA, 16 nt, Human
gccuguggaaugagug

SEQ ID NO: 2847131 - RNA, 17 nt, Human
gccuguggaaugagugu

SEQ ID NO: 2847132 - RNA, 18 nt, Human
gccuguggaaugagugug

SEQ ID NO: 2847133 - RNA, 19 nt, Human
gccuguggaaugagugugc

SEQ ID NO: 2847134 - RNA, 17 nt, Human
gccuguggagcucagcc

SEQ ID NO: 2847135 - RNA, 18 nt, Human
gccuguggagcucagccc

SEQ ID NO: 2847136 - RNA, 19 nt, Human
gccuguggagcucagcccc

SEQ ID NO: 2847137 - RNA, 22 nt, Human
gccuguggaugaucaauccuuu

SEQ ID NO: 2847138 - RNA, 22 nt, Human
gccuguggcaucuuugccuugg

SEQ ID NO: 2847139 - RNA, 10 nt, Human
gccuguggcc

SEQ ID NO: 2847140 - RNA, 14 nt, Human
gccugugcugugac

SEQ ID NO: 2847141 - RNA, 13 nt, Human
gccugugcuguga

SEQ ID NO: 2847142 - RNA, 12 nt, Human
gccugggcaaga

SEQ ID NO: 2847143 - RNA, 21 nt, Human
gccugggauuucuaugcagug

SEQ ID NO: 2847144 - RNA, 23 nt, Human
gccugggcaacaaagugagacuc

SEQ ID NO: 2847145 - RNA, 20 nt, Human
gccugggcaacagagcaaga

SEQ ID NO: 2847146 - RNA, 19 nt, Human
gccugggcaacagagcaag

SEQ ID NO: 2847147 - RNA, 16 nt, Human
gccugggcaacagagc

SEQ ID NO: 2847148 - RNA, 22 nt, Human
gccucugggucagugguccaca

SEQ ID NO: 2847149 - RNA, 13 nt, Human
gccucugggucag

SEQ ID NO: 2847150 - RNA, 12 nt, Human
gccucuggguca

SEQ ID NO: 2847151 - RNA, 22 nt, Human
gccucugucccggaagagucau

SEQ ID NO: 2847152 - RNA, 15 nt, Human
gccucuguccucgcu

SEQ ID NO: 2847153 - RNA, 15 nt, Human
gccucugucuagcau

SEQ ID NO: 2847154 - RNA, 16 nt, Human
gccucugucuagcaug

SEQ ID NO: 2847155 - RNA, 17 nt, Human
gccucugucuagcaugc

SEQ ID NO: 2847156 - RNA, 16 nt, Human
gccuggcuccguccag

SEQ ID NO: 2847157 - RNA, 10 nt, Human
gccuggcucu

SEQ ID NO: 2847158 - RNA, 19 nt, Human
gccuggcucuugugcugga

SEQ ID NO: 2847159 - RNA, 21 nt, Human
gccuggcucuugugcuggaug

SEQ ID NO: 2847160 - RNA, 23 nt, Human
gccuggcucuuucgucacccuug

SEQ ID NO: 2847161 - RNA, 23 nt, Human
gcgauucuucugcuucagccucc

SEQ ID NO: 2847162 - RNA, 20 nt, Human
gcgcaagauagauuuggaau

SEQ ID NO: 2847163 - RNA, 14 nt, Human
gcgcagccccaucu

SEQ ID NO: 2847164 - RNA, 15 nt, Human
gcgcagccccaucug

SEQ ID NO: 2847165 - RNA, 19 nt, Human
gcgcagccccaucugugca

SEQ ID NO: 2847166 - RNA, 14 nt, Human
gcgcaggcuggccc

SEQ ID NO: 2847167 - RNA, 16 nt, Human
gcgcaggcuggcccug

SEQ ID NO: 2847168 - RNA, 15 nt, Human
gcgcaggcuggcccu

SEQ ID NO: 2847169 - RNA, 15 nt, Human
gcgauuuuauuacug

SEQ ID NO: 2847170 - RNA, 18 nt, Human
gcgcagcuggacucugca

SEQ ID NO: 2847171 - RNA, 15 nt, Human
gccuugaagccacug

SEQ ID NO: 2847172 - RNA, 14 nt, Human
gccuugaauaauaa

SEQ ID NO: 2847173 - RNA, 14 nt, Human
gccuugaagccacu

SEQ ID NO: 2847174 - RNA, 14 nt, Human
gccuugaaccugug

SEQ ID NO: 2847175 - RNA, 17 nt, Human
gccuugaaccugugagu

SEQ ID NO: 2847176 - RNA, 16 nt, Human
gccuugaacucugggc

SEQ ID NO: 2847177 - RNA, 17 nt, Human
gcgauucuucugcuuca

SEQ ID NO: 2847178 - RNA, 22 nt, Human
gcgauucuucugcuucagccuc

SEQ ID NO: 2847179 - RNA, 15 nt, Human
gccuugaguuccagu

SEQ ID NO: 2847180 - RNA, 16 nt, Human
gccuugacaucaguuc

SEQ ID NO: 2847181 - RNA, 18 nt, Human
gccuugacaucaguuccu

SEQ ID NO: 2847182 - RNA, 21 nt, Human
gccuugacaucaguuccuuug

SEQ ID NO: 2847183 - RNA, 13 nt, Human
gccuugcagaacu

SEQ ID NO: 2847184 - RNA, 15 nt, Human
gccuugcagaacugc

SEQ ID NO: 2847185 - RNA, 17 nt, Human
gccuugcagaacugcca

SEQ ID NO: 2847186 - RNA, 18 nt, Human
gccuugcagaacugccau

SEQ ID NO: 2847187 - RNA, 20 nt, Human
gccuugcagaacugccauua

SEQ ID NO: 2847188 - RNA, 23 nt, Human
gcguucuuaggcugcugggaugg

SEQ ID NO: 2847189 - RNA, 22 nt, Human
gcuaaggaggggaaaaaaaugu

SEQ ID NO: 2847190 - RNA, 16 nt, Human
gcuaaggcguggagcu

SEQ ID NO: 2847191 - RNA, 17 nt, Human
gcuaaggcguggagcug

SEQ ID NO: 2847192 - RNA, 18 nt, Human
gcuaaggcguggagcugc

SEQ ID NO: 2847193 - RNA, 11 nt, Human
gcuaaggcucu

SEQ ID NO: 2847194 - RNA, 16 nt, Human
gcuaagggaagacauu

SEQ ID NO: 2847195 - RNA, 18 nt, Human
gcuaagggaagacauuuc

SEQ ID NO: 2847196 - RNA, 19 nt, Human
gcuaagggaagacauuucu

SEQ ID NO: 2847197 - RNA, 20 nt, Human
gcuaagggaagacauuucuu

SEQ ID NO: 2847198 - RNA, 22 nt, Human
gcuaagggaagacauuucuuuu

SEQ ID NO: 2847199 - RNA, 23 nt, Human
gcuaagggaagacauuucuuuuc

SEQ ID NO: 2847200 - RNA, 17 nt, Human
gcguuccaugaugcugg

SEQ ID NO: 2847201 - RNA, 18 nt, Human
gcguuccaugaugcuggg

SEQ ID NO: 2847202 - RNA, 18 nt, Human
gcguuauaguaacuccca

SEQ ID NO: 2847203 - RNA, 19 nt, Human
gcguuauaguaacucccau

SEQ ID NO: 2847204 - RNA, 16 nt, Human
gcguuacuaauuggcc

SEQ ID NO: 2847205 - RNA, 22 nt, Human
gcguuauuggucggcagccuuc

SEQ ID NO: 2847206 - RNA, 12 nt, Human
gcguggagcugc

SEQ ID NO: 2847207 - RNA, 15 nt, Human
gcguggagcugccug

SEQ ID NO: 2847208 - RNA, 17 nt, Human
gcguggacucugcacau

SEQ ID NO: 2847209 - RNA, 18 nt, Human
gcguggacucugcacaug

SEQ ID NO: 2847210 - RNA, 16 nt, Human
gcguggagcugccuga

SEQ ID NO: 2847211 - RNA, 14 nt, Human
gcguggagcaggcg

SEQ ID NO: 2847212 - RNA, 17 nt, Human
gcguuacacccuuucuu

SEQ ID NO: 2847213 - RNA, 14 nt, Human
gcgugccgugugag

SEQ ID NO: 2847214 - RNA, 17 nt, Human
gcgugccgugugagugu

SEQ ID NO: 2847215 - RNA, 20 nt, Human
gcgugccgugugagugugac

SEQ ID NO: 2847216 - RNA, 21 nt, Human
gcgugccgugugagugugaca

SEQ ID NO: 2847217 - RNA, 22 nt, Human
gcgugccgugugagugugacag

SEQ ID NO: 2847218 - RNA, 24 nt, Human
gcgugccgugugagugugacaggg

SEQ ID NO: 2847219 - RNA, 19 nt, Human
gcgggaauauuguuucuuu

SEQ ID NO: 2847220 - RNA, 19 nt, Human
gcgggaauggcagcugcca

SEQ ID NO: 2847221 - RNA, 21 nt, Human
gcgggagcgguggcccugucc

SEQ ID NO: 2847222 - RNA, 18 nt, Human
gcgggagcgguggcccug

SEQ ID NO: 2847223 - RNA, 13 nt, Human
gcguggacucugc

SEQ ID NO: 2847224 - RNA, 14 nt, Human
gcguggacucugca

SEQ ID NO: 2847225 - RNA, 21 nt, Human
gcgugcucaguucagaaucac

SEQ ID NO: 2847226 - RNA, 14 nt, Human
gcguggacaggugu

SEQ ID NO: 2847227 - RNA, 19 nt, Human
gcggauuaauuugcaucug

SEQ ID NO: 2847228 - RNA, 18 nt, Human
gcggauuaauuugcaucu

SEQ ID NO: 2847229 - RNA, 20 nt, Human
gcggauuaauuugcaucuga

SEQ ID NO: 2847230 - RNA, 15 nt, Human
gcggcacuccaaccu

SEQ ID NO: 2847231 - RNA, 18 nt, Human
gcggcggagcuggccccg

SEQ ID NO: 2847232 - RNA, 20 nt, Human
gcggcggagcuggccccgcc

SEQ ID NO: 2847233 - RNA, 14 nt, Human
gcggcgggcggcug

SEQ ID NO: 2847234 - RNA, 16 nt, Human
gcggcggagcuggccc

SEQ ID NO: 2847235 - RNA, 20 nt, Human
gcggccagccccggcccugg

SEQ ID NO: 2847236 - RNA, 16 nt, Human
gcggcgaccgcccucc

SEQ ID NO: 2847237 - RNA, 18 nt, Human
gcggcgaccgcccuccgc

SEQ ID NO: 2847238 - RNA, 16 nt, Human
gcggcauuaaagccau

SEQ ID NO: 2847239 - RNA, 21 nt, Human
gcggccaagauaggaccuugg

SEQ ID NO: 2847240 - RNA, 11 nt, Human
gcggccagccc

SEQ ID NO: 2847241 - RNA, 13 nt, Human
gcggccagccccg

SEQ ID NO: 2847242 - RNA, 17 nt, Human
gcggccagccccggccc

SEQ ID NO: 2847243 - RNA, 18 nt, Human
gcggccagccccggcccu

SEQ ID NO: 2847244 - RNA, 19 nt, Human
gcggccagccccggcccug

SEQ ID NO: 2847245 - RNA, 21 nt, Human
gcggccagccccggcccuggg

SEQ ID NO: 2847246 - RNA, 19 nt, Human
gcggccaguauuagacugg

SEQ ID NO: 2847247 - RNA, 19 nt, Human
gccucaugcuaagacucag

SEQ ID NO: 2847248 - RNA, 12 nt, Human
gccuccagaacu

SEQ ID NO: 2847249 - RNA, 23 nt, Human
gccuccacagcgagggcagcugc

SEQ ID NO: 2847250 - RNA, 22 nt, Human
gccuccacagcgagggcagcug

SEQ ID NO: 2847251 - RNA, 21 nt, Human
gccuccacagcgagggcagcu

SEQ ID NO: 2847252 - RNA, 20 nt, Human
gccuccacagcgagggcagc

SEQ ID NO: 2847253 - RNA, 14 nt, Human
gccuccacagcgag

SEQ ID NO: 2847254 - RNA, 15 nt, Human
gccuccacagcgagg

SEQ ID NO: 2847255 - RNA, 21 nt, Human
gccuccucugucugcccuuca

SEQ ID NO: 2847256 - RNA, 13 nt, Human
gccuccucuucac

SEQ ID NO: 2847257 - RNA, 17 nt, Human
gccuccucuucaccccg

SEQ ID NO: 2847258 - RNA, 20 nt, Human
gccuccucuucaccccggca

SEQ ID NO: 2847259 - RNA, 21 nt, Human
gccuccucuucaccccggcag

SEQ ID NO: 2847260 - RNA, 17 nt, Human
gccuccucugucugccc

SEQ ID NO: 2847261 - RNA, 19 nt, Human
gccuccucugucugcccuu

SEQ ID NO: 2847262 - RNA, 19 nt, Human
gccuccugaguagcuggga

SEQ ID NO: 2847263 - RNA, 13 nt, Human
gccucgaacuggc

SEQ ID NO: 2847264 - RNA, 16 nt, Human
gccucgaacuggcugc

SEQ ID NO: 2847265 - RNA, 16 nt, Human
gccucgaaacacagaa

SEQ ID NO: 2847266 - RNA, 17 nt, Human
gccuacaggagugagca

SEQ ID NO: 2847267 - RNA, 23 nt, Human
gccuacagcuuugaucccugaca

SEQ ID NO: 2847268 - RNA, 22 nt, Human
gccuacagcuuugaucccugac

SEQ ID NO: 2847269 - RNA, 12 nt, Human
gccuagcaagcu

SEQ ID NO: 2847270 - RNA, 15 nt, Human
gccuagcaagcuggc

SEQ ID NO: 2847271 - RNA, 16 nt, Human
gccuagcaagcuggcc

SEQ ID NO: 2847272 - RNA, 17 nt, Human
gccuagcaagcuggccu

SEQ ID NO: 2847273 - RNA, 18 nt, Human
gccuagcaagcuggccuc

SEQ ID NO: 2847274 - RNA, 19 nt, Human
gccuagcaagcuggccucu

SEQ ID NO: 2847275 - RNA, 13 nt, Human
gccuagaagcugg

SEQ ID NO: 2847276 - RNA, 17 nt, Human
gccuagaagcugguggc

SEQ ID NO: 2847277 - RNA, 14 nt, Human
gcccgucucagugu

SEQ ID NO: 2847278 - RNA, 14 nt, Human
gcccgucuguccau

SEQ ID NO: 2847279 - RNA, 18 nt, Human
gcccgucuguccaucugc

SEQ ID NO: 2847280 - RNA, 19 nt, Human
gcccgucuguccaucugcc

SEQ ID NO: 2847281 - RNA, 21 nt, Human
gcccgucuguccaucugcccg

SEQ ID NO: 2847282 - RNA, 22 nt, Human
gcccgucugugugugaccccuc

SEQ ID NO: 2847283 - RNA, 23 nt, Human
gcccgucugugugugaccccucc

SEQ ID NO: 2847284 - RNA, 13 nt, Human
gcccgucucagug

SEQ ID NO: 2847285 - RNA, 13 nt, Human
gccggagaggaag

SEQ ID NO: 2847286 - RNA, 14 nt, Human
gccggagaggaaga

SEQ ID NO: 2847287 - RNA, 18 nt, Human
gccggagaggaagagaca

SEQ ID NO: 2847288 - RNA, 16 nt, Human
gccuacaggagugagc

SEQ ID NO: 2847289 - RNA, 22 nt, Human
gccuaaucucauaccucugacc

SEQ ID NO: 2847290 - RNA, 23 nt, Human
gccuaauuacgauaaggaagaaa

SEQ ID NO: 2847291 - RNA, 18 nt, Human
gcccuuccuccuccacca

SEQ ID NO: 2847292 - RNA, 19 nt, Human
gcccuuccuccuccaccac

SEQ ID NO: 2847293 - RNA, 20 nt, Human
gcccuuccuccuccaccacc

SEQ ID NO: 2847294 - RNA, 12 nt, Human
gcccuuccucuc

SEQ ID NO: 2847295 - RNA, 22 nt, Human
gcccuuccaugucgccucugca

SEQ ID NO: 2847296 - RNA, 22 nt, Human
gcccuucacauuuuuuaugggc

SEQ ID NO: 2847297 - RNA, 15 nt, Human
gcccuucaccccagu

SEQ ID NO: 2847298 - RNA, 21 nt, Human
gcccuucaccccaguggccac

SEQ ID NO: 2847299 - RNA, 12 nt, Human
gcccuuccaugu

SEQ ID NO: 2847300 - RNA, 21 nt, Human
gcccuuccaugucgccucugc

SEQ ID NO: 2847301 - RNA, 21 nt, Human
gccgcguggugccauccccag

SEQ ID NO: 2847302 - RNA, 17 nt, Human
gccgcguuuagaccaag

SEQ ID NO: 2847303 - RNA, 19 nt, Human
gccgcguuuagaccaagga

SEQ ID NO: 2847304 - RNA, 20 nt, Human
gccgcguuuagaccaaggaa

SEQ ID NO: 2847305 - RNA, 11 nt, Human
gccgcuaccuc

SEQ ID NO: 2847306 - RNA, 15 nt, Human
gccgcuaccucccuc

SEQ ID NO: 2847307 - RNA, 16 nt, Human
gccgcuaccucccucc

SEQ ID NO: 2847308 - RNA, 17 nt, Human
gccgcuaccucccuccc

SEQ ID NO: 2847309 - RNA, 15 nt, Human
gccgcuccaccagca

SEQ ID NO: 2847310 - RNA, 20 nt, Human
gccgcguggugccaucccca

SEQ ID NO: 2847311 - RNA, 16 nt, Human
gccgcguggugccauc

SEQ ID NO: 2847312 - RNA, 17 nt, Human
gccgcgucgcccuccca

SEQ ID NO: 2847313 - RNA, 14 nt, Human
gcccuuccucucca

SEQ ID NO: 2847314 - RNA, 15 nt, Human
gcccuuccucuccac

SEQ ID NO: 2847315 - RNA, 22 nt, Human
gcccuguggaugagcccucaga

SEQ ID NO: 2847316 - RNA, 18 nt, Human
gcccugugggaccccagg

SEQ ID NO: 2847317 - RNA, 19 nt, Human
gcccugugggaccccaggc

SEQ ID NO: 2847318 - RNA, 20 nt, Human
gcccugugggaccccaggcc

SEQ ID NO: 2847319 - RNA, 14 nt, Human
gcccuuaccuuccc

SEQ ID NO: 2847320 - RNA, 18 nt, Human
gcccuuacuucuugcccu

SEQ ID NO: 2847321 - RNA, 19 nt, Human
gcccuuacuucuugcccug

SEQ ID NO: 2847322 - RNA, 20 nt, Human
gcccuuaucugugcucagga

SEQ ID NO: 2847323 - RNA, 19 nt, Human
gcccuuaucugugcucagg

SEQ ID NO: 2847324 - RNA, 18 nt, Human
gcccuuaucugugcucag

SEQ ID NO: 2847325 - RNA, 20 nt, Human
gcccuuauuuucaagaaacu

SEQ ID NO: 2847326 - RNA, 18 nt, Human
gcccuuauuuucaagaaa

SEQ ID NO: 2847327 - RNA, 17 nt, Human
gcccuuauuuucaagaa

SEQ ID NO: 2847328 - RNA, 13 nt, Human
gcccuuaccuucc

SEQ ID NO: 2847329 - RNA, 21 nt, Human
gcccuguggaugagcccucag

SEQ ID NO: 2847330 - RNA, 14 nt, Human
gcccugcuccugca

SEQ ID NO: 2847331 - RNA, 15 nt, Human
gcccugcuccugcag

SEQ ID NO: 2847332 - RNA, 16 nt, Human
gcccugcuccugcagc

SEQ ID NO: 2847333 - RNA, 17 nt, Human
gcccugcuccugcagca

SEQ ID NO: 2847334 - RNA, 20 nt, Human
gcccugcgggucacaggagg

SEQ ID NO: 2847335 - RNA, 12 nt, Human
gcccugcucccu

SEQ ID NO: 2847336 - RNA, 13 nt, Human
gcccugcucccuc

SEQ ID NO: 2847337 - RNA, 20 nt, Human
gcccugcucccucucccccu

SEQ ID NO: 2847338 - RNA, 20 nt, Human
gccccaaacgggcugcccug

SEQ ID NO: 2847339 - RNA, 18 nt, Human
gccccaaacaaauaugca

SEQ ID NO: 2847340 - RNA, 19 nt, Human
gccccaaacaaauaugcaa

SEQ ID NO: 2847341 - RNA, 17 nt, Human
gccccaaacaaauaugc

SEQ ID NO: 2847342 - RNA, 14 nt, Human
gccccaaccugcug

SEQ ID NO: 2847343 - RNA, 15 nt, Human
gccccaaccugcuga

SEQ ID NO: 2847344 - RNA, 22 nt, Human
gccccaaaguaaaagaaaccac

SEQ ID NO: 2847345 - RNA, 20 nt, Human
gccccaaauaacuucagucc

SEQ ID NO: 2847346 - RNA, 22 nt, Human
gccccaaauaacuucaguccug

SEQ ID NO: 2847347 - RNA, 12 nt, Human
gccccaaauaua

SEQ ID NO: 2847348 - RNA, 21 nt, Human
gccccaaauauagcguuccca

SEQ ID NO: 2847349 - RNA, 13 nt, Human
gccccaaccugcu

SEQ ID NO: 2847350 - RNA, 15 nt, Human
gccccacccaggagg

SEQ ID NO: 2847351 - RNA, 12 nt, Human
gccccacccagg

SEQ ID NO: 2847352 - RNA, 22 nt, Human
gccccacccagaugggggaaag

SEQ ID NO: 2847353 - RNA, 11 nt, Human
gccccacccag

SEQ ID NO: 2847354 - RNA, 12 nt, Human
gccccacccaga

SEQ ID NO: 2847355 - RNA, 13 nt, Human
gccccacccagau

SEQ ID NO: 2847356 - RNA, 16 nt, Human
gccccugcugguucag

SEQ ID NO: 2847357 - RNA, 15 nt, Human
gccccugcugguuca

SEQ ID NO: 2847358 - RNA, 12 nt, Human
gccccugcuggu

SEQ ID NO: 2847359 - RNA, 11 nt, Human
gcccccugccc

SEQ ID NO: 2847360 - RNA, 17 nt, Human
gcccccucugcccugcg

SEQ ID NO: 2847361 - RNA, 14 nt, Human
gcccccucugcccu

SEQ ID NO: 2847362 - RNA, 13 nt, Human
gcccccagcccaa

SEQ ID NO: 2847363 - RNA, 14 nt, Human
gcccccagcccaaa

SEQ ID NO: 2847364 - RNA, 15 nt, Human
gcccccagcccaaag

SEQ ID NO: 2847365 - RNA, 15 nt, Human
gcccccagccccucc

SEQ ID NO: 2847366 - RNA, 19 nt, Human
gcccccagccccuccccca

SEQ ID NO: 2847367 - RNA, 20 nt, Human
gcccccagccccucccccau

SEQ ID NO: 2847368 - RNA, 12 nt, Human
gcccccagccua

SEQ ID NO: 2847369 - RNA, 14 nt, Human
gcccccagccuaug

SEQ ID NO: 2847370 - RNA, 23 nt, Human
gcccccagccuaugagcauccug

SEQ ID NO: 2847371 - RNA, 16 nt, Human
gcccccucugcccugc

SEQ ID NO: 2847372 - RNA, 15 nt, Human
gcccccucugcccug

SEQ ID NO: 2847373 - RNA, 18 nt, Human
gcauuuacuuuguguuca

SEQ ID NO: 2847374 - RNA, 16 nt, Human
gccauuaccauggaga

SEQ ID NO: 2847375 - RNA, 13 nt, Human
gccauuaccaugg

SEQ ID NO: 2847376 - RNA, 15 nt, Human
gccauuaaaugaaua

SEQ ID NO: 2847377 - RNA, 21 nt, Human
gccauuaaaugaauauuuuga

SEQ ID NO: 2847378 - RNA, 23 nt, Human
gccauuaaaugaauauuuugaua

SEQ ID NO: 2847379 - RNA, 18 nt, Human
gccauuaccauggagaca

SEQ ID NO: 2847380 - RNA, 18 nt, Human
gccauuacccagcuaaau

SEQ ID NO: 2847381 - RNA, 19 nt, Human
gccauuacccagcuaaaua

SEQ ID NO: 2847382 - RNA, 22 nt, Human
gccauuaucccugaaucccccu

SEQ ID NO: 2847383 - RNA, 12 nt, Human
gccauuauuuuc

SEQ ID NO: 2847384 - RNA, 16 nt, Human
gccauuauuuucuguc

SEQ ID NO: 2847385 - RNA, 17 nt, Human
gccauuauuuucuguca

SEQ ID NO: 2847386 - RNA, 18 nt, Human
gccauuauuuucugucag

SEQ ID NO: 2847387 - RNA, 19 nt, Human
gccauuauuuucugucaga

SEQ ID NO: 2847388 - RNA, 19 nt, Human
gccauugccaccaggagaa

SEQ ID NO: 2847389 - RNA, 18 nt, Human
gccauugccaccaggaga

SEQ ID NO: 2847390 - RNA, 17 nt, Human
gccauugccaccaggag

SEQ ID NO: 2847391 - RNA, 19 nt, Human
gccauugaucauaaacuga

SEQ ID NO: 2847392 - RNA, 21 nt, Human
gccauugcacccagcccagau

SEQ ID NO: 2847393 - RNA, 17 nt, Human
gccauugacuucuuccc

SEQ ID NO: 2847394 - RNA, 13 nt, Human
gcccacuucugcc

SEQ ID NO: 2847395 - RNA, 21 nt, Human
gcccacgcuggagugcaguga

SEQ ID NO: 2847396 - RNA, 19 nt, Human
gcccacgcuggagugcagu

SEQ ID NO: 2847397 - RNA, 23 nt, Human
gcccacgcuggagugcagugagc

SEQ ID NO: 2847398 - RNA, 20 nt, Human
gccauucuuuuuuucuuggc

SEQ ID NO: 2847399 - RNA, 12 nt, Human
gccauuggaguc

SEQ ID NO: 2847400 - RNA, 15 nt, Human
gcccacggcuaagag

SEQ ID NO: 2847401 - RNA, 18 nt, Human
gcccacggcuaagaggcu

SEQ ID NO: 2847402 - RNA, 19 nt, Human
gcccacggcuaagaggcug

SEQ ID NO: 2847403 - RNA, 20 nt, Human
gcccacggcuaagaggcugc

SEQ ID NO: 2847404 - RNA, 21 nt, Human
gcccacggcuaagaggcugcu

SEQ ID NO: 2847405 - RNA, 23 nt, Human
gcccacggcuaagaggcugcuga

SEQ ID NO: 2847406 - RNA, 21 nt, Human
gcccacugcugcaguagggga

SEQ ID NO: 2847407 - RNA, 11 nt, Human
gcccaggcagg

SEQ ID NO: 2847408 - RNA, 22 nt, Human
gcccaggaccaucuucccgaga

SEQ ID NO: 2847409 - RNA, 22 nt, Human
gcccaggagagagaaagccagg

SEQ ID NO: 2847410 - RNA, 23 nt, Human
gcccaggagagagaaagccaggc

SEQ ID NO: 2847411 - RNA, 15 nt, Human
gcccaggagagagaa

SEQ ID NO: 2847412 - RNA, 16 nt, Human
gcccaggagagagaaa

SEQ ID NO: 2847413 - RNA, 17 nt, Human
gcccaggagagagaaag

SEQ ID NO: 2847414 - RNA, 20 nt, Human
gcccaggagagagaaagcca

SEQ ID NO: 2847415 - RNA, 11 nt, Human
gcccaggagac

SEQ ID NO: 2847416 - RNA, 12 nt, Human
gcccaggagaga

SEQ ID NO: 2847417 - RNA, 13 nt, Human
gcccaggagagag

SEQ ID NO: 2847418 - RNA, 14 nt, Human
gcccaggagagaga

SEQ ID NO: 2847419 - RNA, 22 nt, Human
gcccaggccccugccacccugg

SEQ ID NO: 2847420 - RNA, 18 nt, Human
gcccaggccccugccacc

SEQ ID NO: 2847421 - RNA, 21 nt, Human
gcccaggccccugccacccug

SEQ ID NO: 2847422 - RNA, 20 nt, Human
gcccaggccccugccacccu

SEQ ID NO: 2847423 - RNA, 12 nt, Human
gcccaggccccu

SEQ ID NO: 2847424 - RNA, 11 nt, Human
gcccaggcccc

SEQ ID NO: 2847425 - RNA, 14 nt, Human
gcccaggcaggcca

SEQ ID NO: 2847426 - RNA, 15 nt, Human
gcuuuuuuuuuucca

SEQ ID NO: 2847427 - RNA, 16 nt, Human
gcuuuuuuuuuuccag

SEQ ID NO: 2847428 - RNA, 17 nt, Human
gcuuuuuuuuuuccagc

SEQ ID NO: 2847429 - RNA, 21 nt, Human
gcuuuuuuuuuuccagcaagu

SEQ ID NO: 2847430 - RNA, 12 nt, Human
ggaaaaaaagac

SEQ ID NO: 2847431 - RNA, 17 nt, Human
ggaaaaaaagacucuuu

SEQ ID NO: 2847432 - RNA, 19 nt, Human
ggaaaaaaaucaucuauuu

SEQ ID NO: 2847433 - RNA, 21 nt, Human
ggaaaaaaaucaucuauuuug

SEQ ID NO: 2847434 - RNA, 17 nt, Human
ggaaaaaaaaaaaagag

SEQ ID NO: 2847435 - RNA, 18 nt, Human
ggaaaaaaaaaaaagagg

SEQ ID NO: 2847436 - RNA, 17 nt, Human
gcuuuuuaaaacauuag

SEQ ID NO: 2847437 - RNA, 18 nt, Human
gcuuuuguuccaauguca

SEQ ID NO: 2847438 - RNA, 17 nt, Human
ggaaacucuuaucucag

SEQ ID NO: 2847439 - RNA, 15 nt, Human
ggaaacucuugcuau

SEQ ID NO: 2847440 - RNA, 20 nt, Human
ggaaacucuugcuauugaau

SEQ ID NO: 2847441 - RNA, 18 nt, Human
ggaaaccacagcugcugg

SEQ ID NO: 2847442 - RNA, 19 nt, Human
ggaaaccacagcugcugga

SEQ ID NO: 2847443 - RNA, 21 nt, Human
ggaaaccacagcugcuggaga

SEQ ID NO: 2847444 - RNA, 15 nt, Human
ggaaaccacagcugc

SEQ ID NO: 2847445 - RNA, 16 nt, Human
ggaaaccacagcugcu

SEQ ID NO: 2847446 - RNA, 20 nt, Human
ggaaacagcuaaugggacac

SEQ ID NO: 2847447 - RNA, 13 nt, Human
ggaaacagaggcu

SEQ ID NO: 2847448 - RNA, 17 nt, Human
ggaaaaaaaugaaugag

SEQ ID NO: 2847449 - RNA, 12 nt, Human
ggaaaaaaaugu

SEQ ID NO: 2847450 - RNA, 13 nt, Human
ggaaaaaaauguu

SEQ ID NO: 2847451 - RNA, 16 nt, Human
ggaaagacacugccug

SEQ ID NO: 2847452 - RNA, 15 nt, Human
ggaaagacacugccu

SEQ ID NO: 2847453 - RNA, 20 nt, Human
ggaaagacacugccugggcu

SEQ ID NO: 2847454 - RNA, 14 nt, Human
ggaaagacacugcc

SEQ ID NO: 2847455 - RNA, 16 nt, Human
ggaaagaaagaaggaa

SEQ ID NO: 2847456 - RNA, 15 nt, Human
ggaaagaaaguugca

SEQ ID NO: 2847457 - RNA, 17 nt, Human
ggaaacuugucacuugc

SEQ ID NO: 2847458 - RNA, 19 nt, Human
ggaaacuugucacuugcau

SEQ ID NO: 2847459 - RNA, 20 nt, Human
ggaaacuugucacuugcaug

SEQ ID NO: 2847460 - RNA, 21 nt, Human
ggaaaggaugaucaaaaauaa

SEQ ID NO: 2847461 - RNA, 18 nt, Human
ggaaaggcaaaugcccaa

SEQ ID NO: 2847462 - RNA, 20 nt, Human
ggaaaggcaaaugcccaagg

SEQ ID NO: 2847463 - RNA, 16 nt, Human
ggaaagccucugcugc

SEQ ID NO: 2847464 - RNA, 14 nt, Human
ggaaagccucugcu

SEQ ID NO: 2847465 - RNA, 23 nt, Human
ggaaagcucagcuacugauuuuu

SEQ ID NO: 2847466 - RNA, 13 nt, Human
ggaaagccucugc

SEQ ID NO: 2847467 - RNA, 19 nt, Human
ggaaagcaucaccucaggc

SEQ ID NO: 2847468 - RNA, 18 nt, Human
ggaaagcaucaccucagg

SEQ ID NO: 2847469 - RNA, 16 nt, Human
ggaaagcacagguggg

SEQ ID NO: 2847470 - RNA, 17 nt, Human
ggaaagcacaggugggc

SEQ ID NO: 2847471 - RNA, 12 nt, Human
gcuuuucuguuu

SEQ ID NO: 2847472 - RNA, 17 nt, Human
gcuuuucuguuuccugu

SEQ ID NO: 2847473 - RNA, 18 nt, Human
gcuuuucuguuuccugua

SEQ ID NO: 2847474 - RNA, 12 nt, Human
gcuuuucccucu

SEQ ID NO: 2847475 - RNA, 14 nt, Human
gcuuuucccucuuu

SEQ ID NO: 2847476 - RNA, 15 nt, Human
gcuuuucccucuuuu

SEQ ID NO: 2847477 - RNA, 17 nt, Human
gcuuuucccucuuuucu

SEQ ID NO: 2847478 - RNA, 22 nt, Human
gcuuuuccuauuuguuuucaug

SEQ ID NO: 2847479 - RNA, 14 nt, Human
gcuuugcuuugucu

SEQ ID NO: 2847480 - RNA, 16 nt, Human
gcuuugcuuugucugg

SEQ ID NO: 2847481 - RNA, 12 nt, Human
gcuuugcccagc

SEQ ID NO: 2847482 - RNA, 20 nt, Human
gcuuugccugguuuugucuu

SEQ ID NO: 2847483 - RNA, 12 nt, Human
gcuuugcucugc

SEQ ID NO: 2847484 - RNA, 16 nt, Human
gcuuugcuaccaaagc

SEQ ID NO: 2847485 - RNA, 13 nt, Human
gcuuugcucugcc

SEQ ID NO: 2847486 - RNA, 21 nt, Human
gcuuugcucuugucccacgug

SEQ ID NO: 2847487 - RNA, 23 nt, Human
gcuguuuauggccucagcugccu

SEQ ID NO: 2847488 - RNA, 17 nt, Human
gcuguuuauguuuuuau

SEQ ID NO: 2847489 - RNA, 22 nt, Human
gcuguuuauggccucagcugcc

SEQ ID NO: 2847490 - RNA, 17 nt, Human
gcuguuuauggccucag

SEQ ID NO: 2847491 - RNA, 16 nt, Human
gcuguuuauggccuca

SEQ ID NO: 2847492 - RNA, 15 nt, Human
gcuguuuauggccuc

SEQ ID NO: 2847493 - RNA, 14 nt, Human
gcuguuuauggccu

SEQ ID NO: 2847494 - RNA, 11 nt, Human
gcuguuuccuu

SEQ ID NO: 2847495 - RNA, 14 nt, Human
gcuguuugcuucac

SEQ ID NO: 2847496 - RNA, 20 nt, Human
gcuguuugcuucaccgugga

SEQ ID NO: 2847497 - RNA, 16 nt, Human
gcuuaagggaguuuaa

SEQ ID NO: 2847498 - RNA, 17 nt, Human
gcuuaagggaguuuaau

SEQ ID NO: 2847499 - RNA, 11 nt, Human
gcuuaaguucc

SEQ ID NO: 2847500 - RNA, 13 nt, Human
gcuuaaguuccag

SEQ ID NO: 2847501 - RNA, 17 nt, Human
gcuuaauaaaaaugaca

SEQ ID NO: 2847502 - RNA, 19 nt, Human
gcuuaauaaaaaugacaga

SEQ ID NO: 2847503 - RNA, 21 nt, Human
gcuuaauaaaaaugacagacu

SEQ ID NO: 2847504 - RNA, 20 nt, Human
gcuuaagaaaucuaguauuu

SEQ ID NO: 2847505 - RNA, 22 nt, Human
gcuuucuacccagcgagcccug

SEQ ID NO: 2847506 - RNA, 19 nt, Human
gcuuucuacccagcgagcc

SEQ ID NO: 2847507 - RNA, 13 nt, Human
gcuuucuacccag

SEQ ID NO: 2847508 - RNA, 13 nt, Human
gcuuucguccaca

SEQ ID NO: 2847509 - RNA, 19 nt, Human
gcuuucguccacagcuucc

SEQ ID NO: 2847510 - RNA, 20 nt, Human
gcuuucguccacagcuuccu

SEQ ID NO: 2847511 - RNA, 21 nt, Human
gcuuucguccacagcuuccug

SEQ ID NO: 2847512 - RNA, 23 nt, Human
gcuuucuacccagcgagcccugg

SEQ ID NO: 2847513 - RNA, 12 nt, Human
gcuuugauucau

SEQ ID NO: 2847514 - RNA, 19 nt, Human
gcuuucguguaaauuaugu

SEQ ID NO: 2847515 - RNA, 18 nt, Human
gcuuuccuuguggcagag

SEQ ID NO: 2847516 - RNA, 19 nt, Human
gcuuuccuuguggcagagg

SEQ ID NO: 2847517 - RNA, 22 nt, Human
gcuuuccuuguggcagaggaug

SEQ ID NO: 2847518 - RNA, 21 nt, Human
gcuuugauuaguuuucuuguu

SEQ ID NO: 2847519 - RNA, 20 nt, Human
gcuuugauucauaguaacuu

SEQ ID NO: 2847520 - RNA, 15 nt, Human
gcuuugauucauagu

SEQ ID NO: 2847521 - RNA, 16 nt, Human
gcuuuccucuuccuga

SEQ ID NO: 2847522 - RNA, 20 nt, Human
ggaaauccuaguuuccucuc

SEQ ID NO: 2847523 - RNA, 22 nt, Human
ggaaauccuaguuuccucuccu

SEQ ID NO: 2847524 - RNA, 18 nt, Human
ggaaaucucaccccaucc

SEQ ID NO: 2847525 - RNA, 18 nt, Human
ggaaaucuguaacaggua

SEQ ID NO: 2847526 - RNA, 12 nt, Human
ggaaaggcucag

SEQ ID NO: 2847527 - RNA, 16 nt, Human
ggaaauccaggguggu

SEQ ID NO: 2847528 - RNA, 19 nt, Human
ggaaaucaucgaaaauuca

SEQ ID NO: 2847529 - RNA, 18 nt, Human
ggacaguaucccacaucc

SEQ ID NO: 2847530 - RNA, 12 nt, Human
ggacagucacug

SEQ ID NO: 2847531 - RNA, 15 nt, Human
ggacagucagcucuu

SEQ ID NO: 2847532 - RNA, 20 nt, Human
ggacaggugugccgacagaa

SEQ ID NO: 2847533 - RNA, 20 nt, Human
ggacaguaauaagaauggaa

SEQ ID NO: 2847534 - RNA, 15 nt, Human
ggacagggcauggcc

SEQ ID NO: 2847535 - RNA, 22 nt, Human
ggacagggcauggccagguggc

SEQ ID NO: 2847536 - RNA, 22 nt, Human
ggacagggaugagcauggagcu

SEQ ID NO: 2847537 - RNA, 17 nt, Human
ggacagggaggugaccc

SEQ ID NO: 2847538 - RNA, 16 nt, Human
ggacaggccgcagcuc

SEQ ID NO: 2847539 - RNA, 11 nt, Human
ggacaggccuc

SEQ ID NO: 2847540 - RNA, 16 nt, Human
ggacaggccucaccuc

SEQ ID NO: 2847541 - RNA, 23 nt, Human
ggacaggccucaccucuacccaa

SEQ ID NO: 2847542 - RNA, 13 nt, Human
ggacaggcucugc

SEQ ID NO: 2847543 - RNA, 14 nt, Human
ggacaggcucugcu

SEQ ID NO: 2847544 - RNA, 23 nt, Human
ggacaggcauguucucugaggac

SEQ ID NO: 2847545 - RNA, 15 nt, Human
ggacaccugcccugc

SEQ ID NO: 2847546 - RNA, 14 nt, Human
ggacaccugcccug

SEQ ID NO: 2847547 - RNA, 15 nt, Human
ggacacccccucgcu

SEQ ID NO: 2847548 - RNA, 15 nt, Human
ggacaccgggccagu

SEQ ID NO: 2847549 - RNA, 18 nt, Human
ggaaugauaugcauuuga

SEQ ID NO: 2847550 - RNA, 18 nt, Human
ggacauccuguauaagca

SEQ ID NO: 2847551 - RNA, 16 nt, Human
ggacaugcugaagcca

SEQ ID NO: 2847552 - RNA, 19 nt, Human
ggacaugcugaagccaaag

SEQ ID NO: 2847553 - RNA, 12 nt, Human
ggacaucagcaa

SEQ ID NO: 2847554 - RNA, 15 nt, Human
ggacaucagcaaaca

SEQ ID NO: 2847555 - RNA, 14 nt, Human
ggacaucagcaaac

SEQ ID NO: 2847556 - RNA, 23 nt, Human
ggacauagagguauauuggaaga

SEQ ID NO: 2847557 - RNA, 20 nt, Human
ggacauccccccgccaaaag

SEQ ID NO: 2847558 - RNA, 14 nt, Human
ggacaucagcuggu

SEQ ID NO: 2847559 - RNA, 15 nt, Human
ggacaguucacaccc

SEQ ID NO: 2847560 - RNA, 16 nt, Human
ggacaguucacacccu

SEQ ID NO: 2847561 - RNA, 17 nt, Human
ggacaguucacacccug

SEQ ID NO: 2847562 - RNA, 18 nt, Human
ggacaguucacacccugc

SEQ ID NO: 2847563 - RNA, 19 nt, Human
ggacaguucacacccugca

SEQ ID NO: 2847564 - RNA, 20 nt, Human
ggacaguucacacccugcaa

SEQ ID NO: 2847565 - RNA, 19 nt, Human
ggacaguuuaucaugaagc

SEQ ID NO: 2847566 - RNA, 20 nt, Human
ggacaguuuaucaugaagcc

SEQ ID NO: 2847567 - RNA, 21 nt, Human
ggacaguuuaucaugaagccu

SEQ ID NO: 2847568 - RNA, 22 nt, Human
ggacaguuuaucaugaagccug

SEQ ID NO: 2847569 - RNA, 23 nt, Human
ggacagugcuucagccugaggcu

SEQ ID NO: 2847570 - RNA, 22 nt, Human
ggacagugcuucagccugaggc

SEQ ID NO: 2847571 - RNA, 21 nt, Human
ggacagugcuucagccugagg

SEQ ID NO: 2847572 - RNA, 20 nt, Human
ggacagugcuucagccugag

SEQ ID NO: 2847573 - RNA, 19 nt, Human
ggacagugcuucagccuga

SEQ ID NO: 2847574 - RNA, 18 nt, Human
ggacagugcuucagccug

SEQ ID NO: 2847575 - RNA, 16 nt, Human
ggacaguccugggaga

SEQ ID NO: 2847576 - RNA, 15 nt, Human
ggacaguccugggag

SEQ ID NO: 2847577 - RNA, 14 nt, Human
ggacaguccuggga

SEQ ID NO: 2847578 - RNA, 13 nt, Human
ggacaguccuggg

SEQ ID NO: 2847579 - RNA, 17 nt, Human
ggacagugcuucagccu

SEQ ID NO: 2847580 - RNA, 16 nt, Human
ggacagugcuucagcc

SEQ ID NO: 2847581 - RNA, 19 nt, Human
ggacaguccugggagaacc

SEQ ID NO: 2847582 - RNA, 19 nt, Human
ggacagucugcucuagaug

SEQ ID NO: 2847583 - RNA, 14 nt, Human
ggacagugcuucag

SEQ ID NO: 2847584 - RNA, 23 nt, Human
ggaagcgaugaauuuggagacuc

SEQ ID NO: 2847585 - RNA, 14 nt, Human
ggaagccugcaguc

SEQ ID NO: 2847586 - RNA, 20 nt, Human
ggaagccuuuacugacccug

SEQ ID NO: 2847587 - RNA, 20 nt, Human
ggaagcggagguugcaggga

SEQ ID NO: 2847588 - RNA, 20 nt, Human
ggaagcgcgagggccucaaa

SEQ ID NO: 2847589 - RNA, 16 nt, Human
ggaagcgcucagaaca

SEQ ID NO: 2847590 - RNA, 17 nt, Human
ggaagcgcucagaacag

SEQ ID NO: 2847591 - RNA, 22 nt, Human
ggaauaaugggcuuagagcagu

SEQ ID NO: 2847592 - RNA, 21 nt, Human
ggaauaauuauuuauuuaaua

SEQ ID NO: 2847593 - RNA, 14 nt, Human
ggaauaauugcuuu

SEQ ID NO: 2847594 - RNA, 13 nt, Human
ggaauaauuauuu

SEQ ID NO: 2847595 - RNA, 12 nt, Human
ggaauacuuuuu

SEQ ID NO: 2847596 - RNA, 17 nt, Human
ggaauacuuuuuguuau

SEQ ID NO: 2847597 - RNA, 16 nt, Human
ggaauagaagcaaauu

SEQ ID NO: 2847598 - RNA, 15 nt, Human
ggaauauuuauaaau

SEQ ID NO: 2847599 - RNA, 17 nt, Human
ggacaccacacccagcc

SEQ ID NO: 2847600 - RNA, 18 nt, Human
ggacaccacacccagccu

SEQ ID NO: 2847601 - RNA, 19 nt, Human
ggacaccacacccagccuc

SEQ ID NO: 2847602 - RNA, 20 nt, Human
ggacaccacacccagccuca

SEQ ID NO: 2847603 - RNA, 21 nt, Human
ggacaccacacccagccucag

SEQ ID NO: 2847604 - RNA, 22 nt, Human
ggacaccacacccagccucagu

SEQ ID NO: 2847605 - RNA, 13 nt, Human
ggacacagcucuu

SEQ ID NO: 2847606 - RNA, 16 nt, Human
ggacacagaugaaaca

SEQ ID NO: 2847607 - RNA, 16 nt, Human
ggaaucaagagcugcc

SEQ ID NO: 2847608 - RNA, 14 nt, Human
ggaaucaaaaauug

SEQ ID NO: 2847609 - RNA, 22 nt, Human
ggaaucaagaugucagacuggc

SEQ ID NO: 2847610 - RNA, 18 nt, Human
ggaaucacaucuuuuaag

SEQ ID NO: 2847611 - RNA, 17 nt, Human
ggaaucaagagcugccc

SEQ ID NO: 2847612 - RNA, 19 nt, Human
ggaaucaagagcugcccuc

SEQ ID NO: 2847613 - RNA, 23 nt, Human
ggaaucaagagcugcccuccuug

SEQ ID NO: 2847614 - RNA, 12 nt, Human
ggacacagcucu

SEQ ID NO: 2847615 - RNA, 21 nt, Human
ggacacacaaggugcaaauca

SEQ ID NO: 2847616 - RNA, 13 nt, Human
ggacacacaaggu

SEQ ID NO: 2847617 - RNA, 15 nt, Human
ggaaugagugugcau

SEQ ID NO: 2847618 - RNA, 15 nt, Human
ggacaauuguuuuaa

SEQ ID NO: 2847619 - RNA, 17 nt, Human
ggacacaaaacuccgcc

SEQ ID NO: 2847620 - RNA, 18 nt, Human
ggacacaaaacuccgccc

SEQ ID NO: 2847621 - RNA, 20 nt, Human
ggacacaaaacuccgccccc

SEQ ID NO: 2847622 - RNA, 21 nt, Human
ggacacaaaacuccgccccca

SEQ ID NO: 2847623 - RNA, 22 nt, Human
ggacacaaaacuccgcccccag

SEQ ID NO: 2847624 - RNA, 23 nt, Human
ggacacaaaacuccgcccccagc

SEQ ID NO: 2847625 - RNA, 20 nt, Human
ggaaugagaaguagccacag

SEQ ID NO: 2847626 - RNA, 13 nt, Human
ggaaugagcccag

SEQ ID NO: 2847627 - RNA, 17 nt, Human
ggaaugagcccagagaa

SEQ ID NO: 2847628 - RNA, 20 nt, Human
ggaaugagcccagagaacag

SEQ ID NO: 2847629 - RNA, 21 nt, Human
ggaaugagcccagagaacagc

SEQ ID NO: 2847630 - RNA, 14 nt, Human
gcugugagccuugg

SEQ ID NO: 2847631 - RNA, 13 nt, Human
gcugugagccuug

SEQ ID NO: 2847632 - RNA, 23 nt, Human
gcugugcaacgccgugggcugcg

SEQ ID NO: 2847633 - RNA, 20 nt, Human
gcugugcaacgccgugggcu

SEQ ID NO: 2847634 - RNA, 19 nt, Human
gcugugcaacgccgugggc

SEQ ID NO: 2847635 - RNA, 13 nt, Human
gcugugcaacgcc

SEQ ID NO: 2847636 - RNA, 22 nt, Human
gcugugauuuuuguugauuaaa

SEQ ID NO: 2847637 - RNA, 20 nt, Human
gcugugagucuuugguucua

SEQ ID NO: 2847638 - RNA, 22 nt, Human
gcugugagucuuugguucuaag

SEQ ID NO: 2847639 - RNA, 17 nt, Human
gcugugagccuuggcug

SEQ ID NO: 2847640 - RNA, 16 nt, Human
gcugugaggccccugg

SEQ ID NO: 2847641 - RNA, 18 nt, Human
gcugugaggccccuggac

SEQ ID NO: 2847642 - RNA, 22 nt, Human
gcugugaggccccuggacaagc

SEQ ID NO: 2847643 - RNA, 19 nt, Human
gcuguaucccaugagccuc

SEQ ID NO: 2847644 - RNA, 17 nt, Human
gcuguaucccaugagcc

SEQ ID NO: 2847645 - RNA, 20 nt, Human
gcuguaguagcccuuucugu

SEQ ID NO: 2847646 - RNA, 21 nt, Human
gcuguaguagcccuuucugug

SEQ ID NO: 2847647 - RNA, 15 nt, Human
gcuguuggcuggggg

SEQ ID NO: 2847648 - RNA, 20 nt, Human
gcuguuggcugggggccuca

SEQ ID NO: 2847649 - RNA, 16 nt, Human
gcuguuggcugggggc

SEQ ID NO: 2847650 - RNA, 17 nt, Human
gcugugcugcccugaag

SEQ ID NO: 2847651 - RNA, 16 nt, Human
gcugugcugcccugaa

SEQ ID NO: 2847652 - RNA, 19 nt, Human
gcugugcugcccugaagaa

SEQ ID NO: 2847653 - RNA, 14 nt, Human
gcuguuggcugggg

SEQ ID NO: 2847654 - RNA, 16 nt, Human
gcugugcucuggacag

SEQ ID NO: 2847655 - RNA, 15 nt, Human
gcugugcucuggaca

SEQ ID NO: 2847656 - RNA, 12 nt, Human
gcugugcucaga

SEQ ID NO: 2847657 - RNA, 14 nt, Human
gcugugcucagaga

SEQ ID NO: 2847658 - RNA, 19 nt, Human
gcugugcucucaccagcug

SEQ ID NO: 2847659 - RNA, 13 nt, Human
gcugugcucugga

SEQ ID NO: 2847660 - RNA, 16 nt, Human
gcugugccucugccug

SEQ ID NO: 2847661 - RNA, 14 nt, Human
gcugugccucugcc

SEQ ID NO: 2847662 - RNA, 15 nt, Human
gcugugccucugccu

SEQ ID NO: 2847663 - RNA, 22 nt, Human
gcugcugaaaaccaucuggccu

SEQ ID NO: 2847664 - RNA, 14 nt, Human
gcuggcgugcagug

SEQ ID NO: 2847665 - RNA, 18 nt, Human
gcuggagacuccuaggca

SEQ ID NO: 2847666 - RNA, 20 nt, Human
gcuggagacuccuaggcagg

SEQ ID NO: 2847667 - RNA, 13 nt, Human
gcuggagacuccu

SEQ ID NO: 2847668 - RNA, 12 nt, Human
gcuggagaagag

SEQ ID NO: 2847669 - RNA, 13 nt, Human
gcuggagaagaga

SEQ ID NO: 2847670 - RNA, 14 nt, Human
gcuggagaagagag

SEQ ID NO: 2847671 - RNA, 15 nt, Human
gcuggagaagagagg

SEQ ID NO: 2847672 - RNA, 16 nt, Human
gcuggagaagagagga

SEQ ID NO: 2847673 - RNA, 17 nt, Human
gcuggagaagagaggag

SEQ ID NO: 2847674 - RNA, 18 nt, Human
gcuggagaagagaggaga

SEQ ID NO: 2847675 - RNA, 20 nt, Human
gcuggagaagagaggagagg

SEQ ID NO: 2847676 - RNA, 21 nt, Human
gcuggagaagagaggagagga

SEQ ID NO: 2847677 - RNA, 19 nt, Human
gcuggcuguuggcuggggg

SEQ ID NO: 2847678 - RNA, 18 nt, Human
gcuggcuguuggcugggg

SEQ ID NO: 2847679 - RNA, 14 nt, Human
gcuggcugccuuag

SEQ ID NO: 2847680 - RNA, 20 nt, Human
gcuggcugccuuagaaccuu

SEQ ID NO: 2847681 - RNA, 14 nt, Human
gcuggcugcaguga

SEQ ID NO: 2847682 - RNA, 13 nt, Human
gcuggcugcagug

SEQ ID NO: 2847683 - RNA, 11 nt, Human
gcuggcugccu

SEQ ID NO: 2847684 - RNA, 18 nt, Human
gcuggcgugcaguggugc

SEQ ID NO: 2847685 - RNA, 15 nt, Human
gcuggcgugcagugg

SEQ ID NO: 2847686 - RNA, 21 nt, Human
gcuggagacuccuaggcagga

SEQ ID NO: 2847687 - RNA, 13 nt, Human
gcuggcucuucug

SEQ ID NO: 2847688 - RNA, 14 nt, Human
gcuggcucuucugc

SEQ ID NO: 2847689 - RNA, 16 nt, Human
gcuggcucuucugccc

SEQ ID NO: 2847690 - RNA, 18 nt, Human
gcuggcucuucugcccaa

SEQ ID NO: 2847691 - RNA, 17 nt, Human
gcugggccccccagcuc

SEQ ID NO: 2847692 - RNA, 18 nt, Human
gcugggccccccagcuca

SEQ ID NO: 2847693 - RNA, 19 nt, Human
gcugggccccccagcucag

SEQ ID NO: 2847694 - RNA, 20 nt, Human
gcugggccccccagcucagg

SEQ ID NO: 2847695 - RNA, 21 nt, Human
gcugggccccccagcucaggg

SEQ ID NO: 2847696 - RNA, 22 nt, Human
gcugggccccccagcucagggg

SEQ ID NO: 2847697 - RNA, 23 nt, Human
gcuggcuguuggcugggggccuc

SEQ ID NO: 2847698 - RNA, 20 nt, Human
gcuggcuguuggcugggggc

SEQ ID NO: 2847699 - RNA, 17 nt, Human
gcuggcuguuggcuggg

SEQ ID NO: 2847700 - RNA, 14 nt, Human
gcuggcuuuucugu

SEQ ID NO: 2847701 - RNA, 15 nt, Human
gcuggcuuuucuguu

SEQ ID NO: 2847702 - RNA, 18 nt, Human
gcuggcuuuucuguuucc

SEQ ID NO: 2847703 - RNA, 21 nt, Human
gcuggcuuuucuguuuccugu

SEQ ID NO: 2847704 - RNA, 11 nt, Human
gcugggaaaca

SEQ ID NO: 2847705 - RNA, 20 nt, Human
gcugggaaacacuccuugca

SEQ ID NO: 2847706 - RNA, 16 nt, Human
gcugggaacucaccug

SEQ ID NO: 2847707 - RNA, 18 nt, Human
gcugggaacucaccuggg

SEQ ID NO: 2847708 - RNA, 21 nt, Human
gcugggaacucaccuggggcu

SEQ ID NO: 2847709 - RNA, 23 nt, Human
gcugggaacucaccuggggcugc

SEQ ID NO: 2847710 - RNA, 20 nt, Human
gcugggccauguccaaagag

SEQ ID NO: 2847711 - RNA, 19 nt, Human
gcugggccauguccaaaga

SEQ ID NO: 2847712 - RNA, 17 nt, Human
gcugggccauguccaaa

SEQ ID NO: 2847713 - RNA, 19 nt, Human
gcugggcaugguaccagcc

SEQ ID NO: 2847714 - RNA, 22 nt, Human
gcugggcaugguaccagcccug

SEQ ID NO: 2847715 - RNA, 23 nt, Human
gcugggcaugguaccagcccugg

SEQ ID NO: 2847716 - RNA, 14 nt, Human
gcugguaaacuauu

SEQ ID NO: 2847717 - RNA, 15 nt, Human
gcugguaaacuauuu

SEQ ID NO: 2847718 - RNA, 13 nt, Human
gcugguaacaguu

SEQ ID NO: 2847719 - RNA, 16 nt, Human
gcugguaacaguucau

SEQ ID NO: 2847720 - RNA, 22 nt, Human
gcugguaacaguucauguuugc

SEQ ID NO: 2847721 - RNA, 19 nt, Human
gcugguaggcuccugccag

SEQ ID NO: 2847722 - RNA, 13 nt, Human
gcugccucaugcu

SEQ ID NO: 2847723 - RNA, 13 nt, Human
gcugccugaaucc

SEQ ID NO: 2847724 - RNA, 13 nt, Human
gcugccuguucag

SEQ ID NO: 2847725 - RNA, 12 nt, Human
gcugccuguuca

SEQ ID NO: 2847726 - RNA, 17 nt, Human
gcugccuguucagcucc

SEQ ID NO: 2847727 - RNA, 20 nt, Human
gcugccuguaguuaggaaau

SEQ ID NO: 2847728 - RNA, 23 nt, Human
gcugcucuugaacuccugaccuc

SEQ ID NO: 2847729 - RNA, 19 nt, Human
gcugccuguaguuaggaaa

SEQ ID NO: 2847730 - RNA, 16 nt, Human
gcugccuguaguuagg

SEQ ID NO: 2847731 - RNA, 15 nt, Human
gcugccuguaguuag

SEQ ID NO: 2847732 - RNA, 13 nt, Human
gcugccuguaguu

SEQ ID NO: 2847733 - RNA, 12 nt, Human
gcugccuguagu

SEQ ID NO: 2847734 - RNA, 21 nt, Human
gcugcccuaaauaacccuuca

SEQ ID NO: 2847735 - RNA, 12 nt, Human
gcugccucacuu

SEQ ID NO: 2847736 - RNA, 22 nt, Human
gcugccuagcaagcuggccucu

SEQ ID NO: 2847737 - RNA, 21 nt, Human
gcugcagauuugggcuggaac

SEQ ID NO: 2847738 - RNA, 17 nt, Human
gcugcagauuugggcug

SEQ ID NO: 2847739 - RNA, 18 nt, Human
gcugcagauuugggcugg

SEQ ID NO: 2847740 - RNA, 18 nt, Human
gcugccccucucaccaaa

SEQ ID NO: 2847741 - RNA, 14 nt, Human
gcugccccucucug

SEQ ID NO: 2847742 - RNA, 15 nt, Human
gcugccccucucugg

SEQ ID NO: 2847743 - RNA, 16 nt, Human
gcugccccucucuggg

SEQ ID NO: 2847744 - RNA, 17 nt, Human
gcugccccucucugggc

SEQ ID NO: 2847745 - RNA, 19 nt, Human
gcugccccucucugggccu

SEQ ID NO: 2847746 - RNA, 23 nt, Human
gcugccccucucugggccucaga

SEQ ID NO: 2847747 - RNA, 16 nt, Human
gcugccccucucacca

SEQ ID NO: 2847748 - RNA, 15 nt, Human
gcugccccucucacc

SEQ ID NO: 2847749 - RNA, 14 nt, Human
gcugccccucucac

SEQ ID NO: 2847750 - RNA, 13 nt, Human
gcugccccucuca

SEQ ID NO: 2847751 - RNA, 12 nt, Human
gcugccccucuc

SEQ ID NO: 2847752 - RNA, 14 nt, Human
gcugcccccggccc

SEQ ID NO: 2847753 - RNA, 18 nt, Human
gcugcccccggcccccug

SEQ ID NO: 2847754 - RNA, 19 nt, Human
gcugcccccggcccccugg

SEQ ID NO: 2847755 - RNA, 20 nt, Human
gcugcccccggcccccuggu

SEQ ID NO: 2847756 - RNA, 23 nt, Human
gcugcccccggcccccuggucuc

SEQ ID NO: 2847757 - RNA, 20 nt, Human
gcugcaaggacauucuugua

SEQ ID NO: 2847758 - RNA, 20 nt, Human
gcugcaagugacaucucuuu

SEQ ID NO: 2847759 - RNA, 15 nt, Human
gcugcagagucacaa

SEQ ID NO: 2847760 - RNA, 23 nt, Human
gcugcagagucacaagccucgag

SEQ ID NO: 2847761 - RNA, 23 nt, Human
gcugcagauaacagaaaggcuuu

SEQ ID NO: 2847762 - RNA, 22 nt, Human
gcugaggccccuucuagguggc

SEQ ID NO: 2847763 - RNA, 20 nt, Human
gcugagaucgugccacugca

SEQ ID NO: 2847764 - RNA, 19 nt, Human
gcugaggguguuucuuccu

SEQ ID NO: 2847765 - RNA, 21 nt, Human
gcugaggaggccuccaucuca

SEQ ID NO: 2847766 - RNA, 12 nt, Human
gcugagcccugg

SEQ ID NO: 2847767 - RNA, 16 nt, Human
gcugaggaggccucca

SEQ ID NO: 2847768 - RNA, 11 nt, Human
gcugagcccug

SEQ ID NO: 2847769 - RNA, 12 nt, Human
gcugaggcacaa

SEQ ID NO: 2847770 - RNA, 19 nt, Human
gcugaggcacaagaaucac

SEQ ID NO: 2847771 - RNA, 15 nt, Human
gcugaggcaggagga

SEQ ID NO: 2847772 - RNA, 16 nt, Human
gcugagaggagagaga

SEQ ID NO: 2847773 - RNA, 22 nt, Human
gcugagaggcagacuucccuga

SEQ ID NO: 2847774 - RNA, 11 nt, Human
gcugagccagg

SEQ ID NO: 2847775 - RNA, 12 nt, Human
gcugagccaggc

SEQ ID NO: 2847776 - RNA, 13 nt, Human
gcugagccaggcu

SEQ ID NO: 2847777 - RNA, 18 nt, Human
gcagaaaauaaaggaagc

SEQ ID NO: 2847778 - RNA, 14 nt, Human
gcagaaaauugcac

SEQ ID NO: 2847779 - RNA, 12 nt, Human
gcacuccagccu

SEQ ID NO: 2847780 - RNA, 17 nt, Human
gcagaaaaaggcugugc

SEQ ID NO: 2847781 - RNA, 19 nt, Human
gcagaaaaaggcugugcug

SEQ ID NO: 2847782 - RNA, 18 nt, Human
gcagaaaaaugucauuga

SEQ ID NO: 2847783 - RNA, 14 nt, Human
gcacucaggcucuc

SEQ ID NO: 2847784 - RNA, 17 nt, Human
gcacucaggcucuccau

SEQ ID NO: 2847785 - RNA, 17 nt, Human
gcacucauuuucuauaa

SEQ ID NO: 2847786 - RNA, 20 nt, Human
gcacucauuuucuauaacag

SEQ ID NO: 2847787 - RNA, 18 nt, Human
gcacuccaaccuaaccug

SEQ ID NO: 2847788 - RNA, 20 nt, Human
gcacuccaaccuaaccugug

SEQ ID NO: 2847789 - RNA, 23 nt, Human
gcacuccaaccuaaccugugucu

SEQ ID NO: 2847790 - RNA, 14 nt, Human
gcacuccagccugg

SEQ ID NO: 2847791 - RNA, 18 nt, Human
gcaagugagagcugggug

SEQ ID NO: 2847792 - RNA, 17 nt, Human
gcacucagaagacacug

SEQ ID NO: 2847793 - RNA, 20 nt, Human
gcacucagaagacacugaug

SEQ ID NO: 2847794 - RNA, 13 nt, Human
gcagaacggagcc

SEQ ID NO: 2847795 - RNA, 24 nt, Human
gcagaacggagccccaggccucug

SEQ ID NO: 2847796 - RNA, 12 nt, Human
gcagaacugcca

SEQ ID NO: 2847797 - RNA, 19 nt, Human
gcagaacugccauuauuuu

SEQ ID NO: 2847798 - RNA, 21 nt, Human
gcagaacugccauuauuuucu

SEQ ID NO: 2847799 - RNA, 17 nt, Human
gcagagcuuggacugga

SEQ ID NO: 2847800 - RNA, 22 nt, Human
gcagagcuucuuccaggugccc

SEQ ID NO: 2847801 - RNA, 16 nt, Human
gcagagcuucuuccag

SEQ ID NO: 2847802 - RNA, 12 nt, Human
gcagaggcagcg

SEQ ID NO: 2847803 - RNA, 16 nt, Human
gcagaggauguucaua

SEQ ID NO: 2847804 - RNA, 14 nt, Human
gcagccaaccuaag

SEQ ID NO: 2847805 - RNA, 15 nt, Human
gcagcauugacuggu

SEQ ID NO: 2847806 - RNA, 12 nt, Human
gcagccaaggga

SEQ ID NO: 2847807 - RNA, 15 nt, Human
gcagcauggucccug

SEQ ID NO: 2847808 - RNA, 20 nt, Human
gcagcauggucccugccuua

SEQ ID NO: 2847809 - RNA, 13 nt, Human
gcagcauguauag

SEQ ID NO: 2847810 - RNA, 21 nt, Human
gcagccaaacccaugaggcaa

SEQ ID NO: 2847811 - RNA, 11 nt, Human
gcagcauuuga

SEQ ID NO: 2847812 - RNA, 15 nt, Human
gcagcauuugauaau

SEQ ID NO: 2847813 - RNA, 18 nt, Human
gcagcauuugauaaugau

SEQ ID NO: 2847814 - RNA, 12 nt, Human
gcagcaucuucu

SEQ ID NO: 2847815 - RNA, 14 nt, Human
gcagcaucuucugg

SEQ ID NO: 2847816 - RNA, 23 nt, Human
gcagccagggcuuaccuguacac

SEQ ID NO: 2847817 - RNA, 13 nt, Human
gcagccagugaga

SEQ ID NO: 2847818 - RNA, 17 nt, Human
gcagccaggcugccaag

SEQ ID NO: 2847819 - RNA, 14 nt, Human
gcagccaggcugcc

SEQ ID NO: 2847820 - RNA, 13 nt, Human
gcagccaggcugc

SEQ ID NO: 2847821 - RNA, 12 nt, Human
gcagccaggcug

SEQ ID NO: 2847822 - RNA, 19 nt, Human
gcagcucaucucuguccca

SEQ ID NO: 2847823 - RNA, 21 nt, Human
gcagcucaucucugucccacu

SEQ ID NO: 2847824 - RNA, 15 nt, Human
gcagcucccauucua

SEQ ID NO: 2847825 - RNA, 14 nt, Human
gcagcucaucucug

SEQ ID NO: 2847826 - RNA, 23 nt, Human
gcagcucauagaguccccccucc

SEQ ID NO: 2847827 - RNA, 22 nt, Human
gcagugauauggcagaagacac

SEQ ID NO: 2847828 - RNA, 16 nt, Human
gcagugauauggcaga

SEQ ID NO: 2847829 - RNA, 19 nt, Human
gcagugauauggcagaaga

SEQ ID NO: 2847830 - RNA, 21 nt, Human
gcagugauauggcagaagaca

SEQ ID NO: 2847831 - RNA, 13 nt, Human
gcaguugugucag

SEQ ID NO: 2847832 - RNA, 16 nt, Human
gcagucuccucuuuaa

SEQ ID NO: 2847833 - RNA, 17 nt, Human
gcagucuccucuuuaaa

SEQ ID NO: 2847834 - RNA, 18 nt, Human
gcagucuccucuuuaaaa

SEQ ID NO: 2847835 - RNA, 20 nt, Human
gcagucuccucuuuaaaaca

SEQ ID NO: 2847836 - RNA, 21 nt, Human
gcagucuccucuuuaaaacaa

SEQ ID NO: 2847837 - RNA, 22 nt, Human
gcagucuccucuuuaaaacaaa

SEQ ID NO: 2847838 - RNA, 23 nt, Human
gcagucuccucuuuaaaacaaaa

SEQ ID NO: 2847839 - RNA, 16 nt, Human
gcagcugauacaaauu

SEQ ID NO: 2847840 - RNA, 21 nt, Human
gcagcugauguuggaagagaa

SEQ ID NO: 2847841 - RNA, 12 nt, Human
gcagcucucccc

SEQ ID NO: 2847842 - RNA, 20 nt, Human
gcagcugagaaaaugaguga

SEQ ID NO: 2847843 - RNA, 13 nt, Human
gcagucucugccu

SEQ ID NO: 2847844 - RNA, 13 nt, Human
gcagugagcagaa

SEQ ID NO: 2847845 - RNA, 22 nt, Human
gcagugagggguauaucugggc

SEQ ID NO: 2847846 - RNA, 15 nt, Human
gcagugagugagccu

SEQ ID NO: 2847847 - RNA, 17 nt, Human
gcagugagugagccugg

SEQ ID NO: 2847848 - RNA, 18 nt, Human
gcagugagugagccuggc

SEQ ID NO: 2847849 - RNA, 19 nt, Human
gcagugagugagccuggcu

SEQ ID NO: 2847850 - RNA, 20 nt, Human
gcagugagugagccuggcuc

SEQ ID NO: 2847851 - RNA, 21 nt, Human
gcagugagugagccuggcucu

SEQ ID NO: 2847852 - RNA, 20 nt, Human
gcagugagaaaaagcuccug

SEQ ID NO: 2847853 - RNA, 18 nt, Human
gcagugacgugcaccugu

SEQ ID NO: 2847854 - RNA, 14 nt, Human
gcagugaacuauuu

SEQ ID NO: 2847855 - RNA, 21 nt, Human
gcagugagaaaaagcuccugu

SEQ ID NO: 2847856 - RNA, 23 nt, Human
gcagugagaaaaagcuccugucc

SEQ ID NO: 2847857 - RNA, 22 nt, Human
gcagugagaaaaagcuccuguc

SEQ ID NO: 2847858 - RNA, 18 nt, Human
gcauccagcagucucugc

SEQ ID NO: 2847859 - RNA, 19 nt, Human
gcauccagcagucucugcc

SEQ ID NO: 2847860 - RNA, 20 nt, Human
gcauccagcagucucugccu

SEQ ID NO: 2847861 - RNA, 15 nt, Human
gcauccaguuaacca

SEQ ID NO: 2847862 - RNA, 12 nt, Human
gcauccauacca

SEQ ID NO: 2847863 - RNA, 17 nt, Human
gcauccauaccagcucg

SEQ ID NO: 2847864 - RNA, 19 nt, Human
gcauccauaccagcucgca

SEQ ID NO: 2847865 - RNA, 15 nt, Human
gcaucccagcaccug

SEQ ID NO: 2847866 - RNA, 20 nt, Human
gcaucccagcaccugccucc

SEQ ID NO: 2847867 - RNA, 21 nt, Human
gcaucccagcaccugccuccu

SEQ ID NO: 2847868 - RNA, 22 nt, Human
gcaucccagcaccugccuccuc

SEQ ID NO: 2847869 - RNA, 20 nt, Human
gcaucccaggaugcugggug

SEQ ID NO: 2847870 - RNA, 18 nt, Human
gcaucccugaggagccag

SEQ ID NO: 2847871 - RNA, 20 nt, Human
gcauccccuuggcugugagg

SEQ ID NO: 2847872 - RNA, 19 nt, Human
gcauccccuuggcugugag

SEQ ID NO: 2847873 - RNA, 21 nt, Human
gcauccccuuggcugugaggc

SEQ ID NO: 2847874 - RNA, 13 nt, Human
gcaucccggagga

SEQ ID NO: 2847875 - RNA, 16 nt, Human
gcaucccggaggaaau

SEQ ID NO: 2847876 - RNA, 18 nt, Human
gcaucccggaggaaaucu

SEQ ID NO: 2847877 - RNA, 19 nt, Human
gcaucccggaggaaaucug

SEQ ID NO: 2847878 - RNA, 22 nt, Human
gcaucccggaggaaaucugcag

SEQ ID NO: 2847879 - RNA, 12 nt, Human
gcaucccccaaa

SEQ ID NO: 2847880 - RNA, 16 nt, Human
gcaucccccaaaguuc

SEQ ID NO: 2847881 - RNA, 20 nt, Human
gcaucccccaaaguucacaa

SEQ ID NO: 2847882 - RNA, 13 nt, Human
gcauccuaagaaa

SEQ ID NO: 2847883 - RNA, 14 nt, Human
gcauccuaagaaau

SEQ ID NO: 2847884 - RNA, 15 nt, Human
gcauccuaagaaaua

SEQ ID NO: 2847885 - RNA, 21 nt, Human
gcauccuaagaaauaugugag

SEQ ID NO: 2847886 - RNA, 24 nt, Human
gcauccuaagaaauaugugagauu

SEQ ID NO: 2847887 - RNA, 22 nt, Human
gcaucccuugaccaggccuggg

SEQ ID NO: 2847888 - RNA, 20 nt, Human
gcaucccuugaccaggccug

SEQ ID NO: 2847889 - RNA, 18 nt, Human
gcaucccuugaccaggcc

SEQ ID NO: 2847890 - RNA, 15 nt, Human
gcauuuacuuugugu

SEQ ID NO: 2847891 - RNA, 17 nt, Human
gcauguaaaagcggaaa

SEQ ID NO: 2847892 - RNA, 14 nt, Human
gcaugugcccuccu

SEQ ID NO: 2847893 - RNA, 19 nt, Human
gcaugugcccuccugaggg

SEQ ID NO: 2847894 - RNA, 17 nt, Human
gcauguggcuuuuuuaa

SEQ ID NO: 2847895 - RNA, 13 nt, Human
gcaugugggcuuc

SEQ ID NO: 2847896 - RNA, 15 nt, Human
gcaugugggcuucaa

SEQ ID NO: 2847897 - RNA, 19 nt, Human
gcaugugguuugguuccuc

SEQ ID NO: 2847898 - RNA, 20 nt, Human
gcaugugguuugguuccucu

SEQ ID NO: 2847899 - RNA, 23 nt, Human
gcaugugguuugguuccucucug

SEQ ID NO: 2847900 - RNA, 15 nt, Human
gcauguaaacacgcc

SEQ ID NO: 2847901 - RNA, 19 nt, Human
gcauguaaacacgccugca

SEQ ID NO: 2847902 - RNA, 17 nt, Human
gcauguaaacacgccug

SEQ ID NO: 2847903 - RNA, 17 nt, Human
gcauggcuuuauuuguu

SEQ ID NO: 2847904 - RNA, 23 nt, Human
gcauggggauaaaggagaaggca

SEQ ID NO: 2847905 - RNA, 18 nt, Human
gcauggggggugggggga

SEQ ID NO: 2847906 - RNA, 17 nt, Human
gcaugguaccagcccug

SEQ ID NO: 2847907 - RNA, 18 nt, Human
gcaugguaccagcccugg

SEQ ID NO: 2847908 - RNA, 19 nt, Human
gcaugguaccagcccuggg

SEQ ID NO: 2847909 - RNA, 20 nt, Human
gcaugguaccagcccugggg

SEQ ID NO: 2847910 - RNA, 22 nt, Human
gcaugguaccagcccuggggcu

SEQ ID NO: 2847911 - RNA, 23 nt, Human
gcaugguaccagcccuggggcug

SEQ ID NO: 2847912 - RNA, 15 nt, Human
gcauggucacacacu

SEQ ID NO: 2847913 - RNA, 18 nt, Human
gcauggucacacacugau

SEQ ID NO: 2847914 - RNA, 22 nt, Human
gcauggucaacccucaggggaa

SEQ ID NO: 2847915 - RNA, 18 nt, Human
gcauggugcgggcaccug

SEQ ID NO: 2847916 - RNA, 18 nt, Human
gcauggucccugccuuag

SEQ ID NO: 2847917 - RNA, 13 nt, Human
gcauccuggcacc

SEQ ID NO: 2847918 - RNA, 17 nt, Human
gcauccuccgccucccg

SEQ ID NO: 2847919 - RNA, 14 nt, Human
gcauccugagcccc

SEQ ID NO: 2847920 - RNA, 21 nt, Human
gcauccugagccccgcccucu

SEQ ID NO: 2847921 - RNA, 22 nt, Human
gcauccugagccccgcccucuu

SEQ ID NO: 2847922 - RNA, 17 nt, Human
gcaucguccccuccccc

SEQ ID NO: 2847923 - RNA, 15 nt, Human
gcaucuaagcccaug

SEQ ID NO: 2847924 - RNA, 19 nt, Human
gcaucuaaguuauaagacu

SEQ ID NO: 2847925 - RNA, 22 nt, Human
gcaucuaaguuauaagacucuc

SEQ ID NO: 2847926 - RNA, 13 nt, Human
gcauggcccuggg

SEQ ID NO: 2847927 - RNA, 16 nt, Human
gcauggcccugggguc

SEQ ID NO: 2847928 - RNA, 17 nt, Human
gcauggcccuggggucc

SEQ ID NO: 2847929 - RNA, 18 nt, Human
gcauggcuccagaaaugu

SEQ ID NO: 2847930 - RNA, 19 nt, Human
gcauggcuccagaaauguc

SEQ ID NO: 2847931 - RNA, 22 nt, Human
gcauggcccuggggucccacga

SEQ ID NO: 2847932 - RNA, 17 nt, Human
gcauggcuccagaaaug

SEQ ID NO: 2847933 - RNA, 18 nt, Human
gauacugcagggccagga

SEQ ID NO: 2847934 - RNA, 21 nt, Human
gauacugcagggccaggacug

SEQ ID NO: 2847935 - RNA, 20 nt, Human
gauacucuuucuaaugcuga

SEQ ID NO: 2847936 - RNA, 15 nt, Human
gauacugcuguguaa

SEQ ID NO: 2847937 - RNA, 11 nt, Human
gauacauaaaa

SEQ ID NO: 2847938 - RNA, 20 nt, Human
gauacauaacuaaauuugau

SEQ ID NO: 2847939 - RNA, 21 nt, Human
gauacauaacuaaauuugaua

SEQ ID NO: 2847940 - RNA, 23 nt, Human
gauacauaacuaaauuugauacu

SEQ ID NO: 2847941 - RNA, 13 nt, Human
gauacauaauaaa

SEQ ID NO: 2847942 - RNA, 14 nt, Human
gauacauaauaaaa

SEQ ID NO: 2847943 - RNA, 15 nt, Human
gauacauaauaaaaa

SEQ ID NO: 2847944 - RNA, 17 nt, Human
gauacagucaacaagcc

SEQ ID NO: 2847945 - RNA, 18 nt, Human
gauacagucaacaagccu

SEQ ID NO: 2847946 - RNA, 19 nt, Human
gauacagucaacaagccug

SEQ ID NO: 2847947 - RNA, 13 nt, Human
gauacaucacugc

SEQ ID NO: 2847948 - RNA, 14 nt, Human
gauacaucacugcu

SEQ ID NO: 2847949 - RNA, 16 nt, Human
gauacaucacugcuug

SEQ ID NO: 2847950 - RNA, 17 nt, Human
gauacaucacugcuuga

SEQ ID NO: 2847951 - RNA, 21 nt, Human
gauacaucacugcuugaugaa

SEQ ID NO: 2847952 - RNA, 18 nt, Human
gauacagucccuaaagaa

SEQ ID NO: 2847953 - RNA, 19 nt, Human
gauacagucccuaaagaaa

SEQ ID NO: 2847954 - RNA, 19 nt, Human
gauaccaagaugccaucug

SEQ ID NO: 2847955 - RNA, 14 nt, Human
gauaccagaaggga

SEQ ID NO: 2847956 - RNA, 21 nt, Human
gauauuuucaacgcagcccug

SEQ ID NO: 2847957 - RNA, 22 nt, Human
gauauuuucaacgcagcccugc

SEQ ID NO: 2847958 - RNA, 23 nt, Human
gauauuuucaacgcagcccugcu

SEQ ID NO: 2847959 - RNA, 17 nt, Human
gaucaaaauaaaaagug

SEQ ID NO: 2847960 - RNA, 20 nt, Human
gaucaaaauaaaaagugaca

SEQ ID NO: 2847961 - RNA, 22 nt, Human
gaucaaaauaaaaagugacaca

SEQ ID NO: 2847962 - RNA, 22 nt, Human
gaucaaaccccgaccaccugcc

SEQ ID NO: 2847963 - RNA, 20 nt, Human
gauacuuuuucuuuuguaag

SEQ ID NO: 2847964 - RNA, 21 nt, Human
gauacuuuuucuuuuguaagu

SEQ ID NO: 2847965 - RNA, 23 nt, Human
gauacuuuuucuuuuguaagugc

SEQ ID NO: 2847966 - RNA, 16 nt, Human
gauagaaagcauuaca

SEQ ID NO: 2847967 - RNA, 13 nt, Human
gauauugugaaca

SEQ ID NO: 2847968 - RNA, 20 nt, Human
gauauugugaacauuuguga

SEQ ID NO: 2847969 - RNA, 21 nt, Human
gauauugugaacauuugugau

SEQ ID NO: 2847970 - RNA, 13 nt, Human
gauacuuuacaug

SEQ ID NO: 2847971 - RNA, 18 nt, Human
gauacuuugauauuuuca

SEQ ID NO: 2847972 - RNA, 21 nt, Human
gauauuuuaccucuuauugca

SEQ ID NO: 2847973 - RNA, 22 nt, Human
gauauuucccuccccuggggac

SEQ ID NO: 2847974 - RNA, 13 nt, Human
gauauuuggcuua

SEQ ID NO: 2847975 - RNA, 14 nt, Human
gauauuuggcuuaa

SEQ ID NO: 2847976 - RNA, 18 nt, Human
gauauuuggcuuaaauau

SEQ ID NO: 2847977 - RNA, 19 nt, Human
gauauuuggcuuaaauaua

SEQ ID NO: 2847978 - RNA, 19 nt, Human
gauauuuucaacgcagccc

SEQ ID NO: 2847979 - RNA, 13 nt, Human
gauauuguucaaa

SEQ ID NO: 2847980 - RNA, 22 nt, Human
gauauuguucaaacaauaucau

SEQ ID NO: 2847981 - RNA, 22 nt, Human
gauauuuaggagugugugacau

SEQ ID NO: 2847982 - RNA, 17 nt, Human
gauauuucucuaguagu

SEQ ID NO: 2847983 - RNA, 22 nt, Human
gauauuucucuaguaguuaaaa

SEQ ID NO: 2847984 - RNA, 19 nt, Human
gauccacccaccucagccu

SEQ ID NO: 2847985 - RNA, 18 nt, Human
gauccacccaccucagcc

SEQ ID NO: 2847986 - RNA, 21 nt, Human
gauccaagcuggucccacuca

SEQ ID NO: 2847987 - RNA, 16 nt, Human
gauccaauguuagaga

SEQ ID NO: 2847988 - RNA, 22 nt, Human
gauccaauguuagagacuuuuu

SEQ ID NO: 2847989 - RNA, 15 nt, Human
gauccaagcuaagca

SEQ ID NO: 2847990 - RNA, 17 nt, Human
gauccaagcuaagcacu

SEQ ID NO: 2847991 - RNA, 22 nt, Human
gauccaagcuaagcacugccac

SEQ ID NO: 2847992 - RNA, 21 nt, Human
gauccacccaccucagccucc

SEQ ID NO: 2847993 - RNA, 20 nt, Human
gauccacccaccucagccuc

SEQ ID NO: 2847994 - RNA, 22 nt, Human
gauccacccaccucagccuccc

SEQ ID NO: 2847995 - RNA, 17 nt, Human
gauccacccaacccuau

SEQ ID NO: 2847996 - RNA, 16 nt, Human
gauccacccaacccua

SEQ ID NO: 2847997 - RNA, 19 nt, Human
gauccaagcuggucccacu

SEQ ID NO: 2847998 - RNA, 17 nt, Human
gauccaagcugguccca

SEQ ID NO: 2847999 - RNA, 16 nt, Human
gauccaagcugguccc

SEQ ID NO: 2848000 - RNA, 12 nt, Human
gauccaagcugg

SEQ ID NO: 2848001 - RNA, 19 nt, Human
gauccaaauugugcuucuc

SEQ ID NO: 2848002 - RNA, 20 nt, Human
gauccaaauugugcuucucc

SEQ ID NO: 2848003 - RNA, 22 nt, Human
gauggaaaaaccacccccaaau

SEQ ID NO: 2848004 - RNA, 23 nt, Human
gauggaaaggauuguaggugcaa

SEQ ID NO: 2848005 - RNA, 22 nt, Human
gaugauuucuugaaaagggugu

SEQ ID NO: 2848006 - RNA, 13 nt, Human
gaugauuugcaau

SEQ ID NO: 2848007 - RNA, 18 nt, Human
gaugauuugcaaugggau

SEQ ID NO: 2848008 - RNA, 18 nt, Human
gaugauagaggauuuuau

SEQ ID NO: 2848009 - RNA, 18 nt, Human
gaugaucaauccuuuauu

SEQ ID NO: 2848010 - RNA, 19 nt, Human
gaugaucaauccuuuauua

SEQ ID NO: 2848011 - RNA, 22 nt, Human
gaugaucaauuauaguuucuga

SEQ ID NO: 2848012 - RNA, 13 nt, Human
gaugaucaauuau

SEQ ID NO: 2848013 - RNA, 20 nt, Human
gaugaucaauuauaguuucu

SEQ ID NO: 2848014 - RNA, 23 nt, Human
gaugauccaugaguuugcccugg

SEQ ID NO: 2848015 - RNA, 22 nt, Human
gaugauccaugaguuugcccug

SEQ ID NO: 2848016 - RNA, 19 nt, Human
gauccaccugucucagccu

SEQ ID NO: 2848017 - RNA, 18 nt, Human
gauccaccugucucagcc

SEQ ID NO: 2848018 - RNA, 14 nt, Human
gauccaccugucuc

SEQ ID NO: 2848019 - RNA, 24 nt, Human
gaucccaucuugauaagaccacca

SEQ ID NO: 2848020 - RNA, 23 nt, Human
gaucccaggggcccaaggcggcc

SEQ ID NO: 2848021 - RNA, 15 nt, Human
gaucccacacaggcu

SEQ ID NO: 2848022 - RNA, 22 nt, Human
gaucucugggauuuaugcucau

SEQ ID NO: 2848023 - RNA, 12 nt, Human
gaucucuuccug

SEQ ID NO: 2848024 - RNA, 13 nt, Human
gaucucuuccugu

SEQ ID NO: 2848025 - RNA, 17 nt, Human
gaucugaugcaagcaag

SEQ ID NO: 2848026 - RNA, 20 nt, Human
gaucugcagggggugugucu

SEQ ID NO: 2848027 - RNA, 15 nt, Human
gcaagugagagcugg

SEQ ID NO: 2848028 - RNA, 16 nt, Human
gcaagugagagcuggg

SEQ ID NO: 2848029 - RNA, 14 nt, Human
gcaacauuccaaga

SEQ ID NO: 2848030 - RNA, 21 nt, Human
gcaacauuguucaccuuugua

SEQ ID NO: 2848031 - RNA, 22 nt, Human
gcaacauuguucaccuuuguag

SEQ ID NO: 2848032 - RNA, 23 nt, Human
gcaacauuuacaguccuucaaaa

SEQ ID NO: 2848033 - RNA, 19 nt, Human
gcaacaggcugggcuucag

SEQ ID NO: 2848034 - RNA, 16 nt, Human
gcaacaggcugggcuu

SEQ ID NO: 2848035 - RNA, 18 nt, Human
gcaacaggaaucaagagc

SEQ ID NO: 2848036 - RNA, 21 nt, Human
gcaacaggaaucaagagcugc

SEQ ID NO: 2848037 - RNA, 19 nt, Human
gcaaaaucaagcaagccuc

SEQ ID NO: 2848038 - RNA, 17 nt, Human
gcaacauccaaaauagu

SEQ ID NO: 2848039 - RNA, 13 nt, Human
gcaacauccaaaa

SEQ ID NO: 2848040 - RNA, 13 nt, Human
gcaacaggcuggg

SEQ ID NO: 2848041 - RNA, 15 nt, Human
gcaacaggcugggcu

SEQ ID NO: 2848042 - RNA, 14 nt, Human
gcaacaggcugggc

SEQ ID NO: 2848043 - RNA, 20 nt, Human
gcaaaauaauuuuaaacaaa

SEQ ID NO: 2848044 - RNA, 20 nt, Human
gcaaaauauucacugggcca

SEQ ID NO: 2848045 - RNA, 13 nt, Human
gcaaaauagcauu

SEQ ID NO: 2848046 - RNA, 22 nt, Human
gcaaaauggaacgcuaaugaaa

SEQ ID NO: 2848047 - RNA, 20 nt, Human
gcaaaagguucacuaaagca

SEQ ID NO: 2848048 - RNA, 21 nt, Human
gcaaaagguucacuaaagcag

SEQ ID NO: 2848049 - RNA, 15 nt, Human
gcaaaauaaaaacua

SEQ ID NO: 2848050 - RNA, 16 nt, Human
gcaaaauaaaaacuau

SEQ ID NO: 2848051 - RNA, 15 nt, Human
gcaaaauaauuuuaa

SEQ ID NO: 2848052 - RNA, 13 nt, Human
gcaaaauaauuuu

SEQ ID NO: 2848053 - RNA, 19 nt, Human
gcaaccuccgccucuuggg

SEQ ID NO: 2848054 - RNA, 16 nt, Human
gcaacccccagccugc

SEQ ID NO: 2848055 - RNA, 15 nt, Human
gcaacccccagccug

SEQ ID NO: 2848056 - RNA, 14 nt, Human
gcaacccccagccu

SEQ ID NO: 2848057 - RNA, 16 nt, Human
gcaacccaaggacuga

SEQ ID NO: 2848058 - RNA, 20 nt, Human
gcaacccaaggacugaggga

SEQ ID NO: 2848059 - RNA, 13 nt, Human
gcaaccacacacc

SEQ ID NO: 2848060 - RNA, 15 nt, Human
gcaaccacacaccuc

SEQ ID NO: 2848061 - RNA, 14 nt, Human
gcaaccacuaagaa

SEQ ID NO: 2848062 - RNA, 20 nt, Human
gcaaccuccgccucuugggu

SEQ ID NO: 2848063 - RNA, 17 nt, Human
gcaaccugauuguaaac

SEQ ID NO: 2848064 - RNA, 18 nt, Human
gcaaccugauuguaaacu

SEQ ID NO: 2848065 - RNA, 23 nt, Human
gcaaccucugccuccuggguuca

SEQ ID NO: 2848066 - RNA, 20 nt, Human
gcaaccucugcuucccaggu

SEQ ID NO: 2848067 - RNA, 13 nt, Human
gcaacaucuuuuu

SEQ ID NO: 2848068 - RNA, 20 nt, Human
gcaaccuucgccaccugggu

SEQ ID NO: 2848069 - RNA, 17 nt, Human
gauggaaguaaagccuc

SEQ ID NO: 2848070 - RNA, 15 nt, Human
gauggaauucuuccu

SEQ ID NO: 2848071 - RNA, 15 nt, Human
gauucuucugcuuca

SEQ ID NO: 2848072 - RNA, 13 nt, Human
gauucuucugcuu

SEQ ID NO: 2848073 - RNA, 12 nt, Human
gauucuucugcu

SEQ ID NO: 2848074 - RNA, 20 nt, Human
gauucuucugcuucagccuc

SEQ ID NO: 2848075 - RNA, 17 nt, Human
gauuuaauaaaauaauu

SEQ ID NO: 2848076 - RNA, 19 nt, Human
gauuuaauaaaauaauucu

SEQ ID NO: 2848077 - RNA, 22 nt, Human
gauuuaauaaaauaauucuaaa

SEQ ID NO: 2848078 - RNA, 23 nt, Human
gauuuaauaaaauaauucuaaag

SEQ ID NO: 2848079 - RNA, 16 nt, Human
gcaaaaaaguccaauu

SEQ ID NO: 2848080 - RNA, 21 nt, Human
gcaaaaaaguccaauuuuaau

SEQ ID NO: 2848081 - RNA, 11 nt, Human
gcaaaaaauac

SEQ ID NO: 2848082 - RNA, 12 nt, Human
gcaaaaaauacu

SEQ ID NO: 2848083 - RNA, 18 nt, Human
gcaaaaaauacuuuuucu

SEQ ID NO: 2848084 - RNA, 20 nt, Human
gcaaaaaauacuuuuucuaa

SEQ ID NO: 2848085 - RNA, 21 nt, Human
gcaaaaaauacuuuuucuaau

SEQ ID NO: 2848086 - RNA, 15 nt, Human
gcaaaaacaaaaaga

SEQ ID NO: 2848087 - RNA, 18 nt, Human
gcaaaagcagugggcucc

SEQ ID NO: 2848088 - RNA, 14 nt, Human
gcaaaagccuugug

SEQ ID NO: 2848089 - RNA, 23 nt, Human
gcaaaagccuuguguauauuugu

SEQ ID NO: 2848090 - RNA, 14 nt, Human
gauuuaauauggau

SEQ ID NO: 2848091 - RNA, 12 nt, Human
gcaaaaggagag

SEQ ID NO: 2848092 - RNA, 21 nt, Human
gcaaaaggagagacucccaug

SEQ ID NO: 2848093 - RNA, 11 nt, Human
gcaaaaauaua

SEQ ID NO: 2848094 - RNA, 13 nt, Human
gcaaaaauauaaa

SEQ ID NO: 2848095 - RNA, 14 nt, Human
gcaaaaauauaaaa

SEQ ID NO: 2848096 - RNA, 16 nt, Human
gcaaaaauauaaaaua

SEQ ID NO: 2848097 - RNA, 21 nt, Human
gcaaaaacaaaaagaaaagaa

SEQ ID NO: 2848098 - RNA, 20 nt, Human
gcaaaaacaaaaagaaaaga

SEQ ID NO: 2848099 - RNA, 17 nt, Human
gauuuauuuuucaguuc

SEQ ID NO: 2848100 - RNA, 20 nt, Human
gauuuauuuuucaguuccaa

SEQ ID NO: 2848101 - RNA, 12 nt, Human
gauuucaagaaa

SEQ ID NO: 2848102 - RNA, 19 nt, Human
gauuucaagaaaaaauaaa

SEQ ID NO: 2848103 - RNA, 22 nt, Human
gauuucaagaaaaaauaaaugg

SEQ ID NO: 2848104 - RNA, 15 nt, Human
gauuucaagauccuc

SEQ ID NO: 2848105 - RNA, 21 nt, Human
gauuuacagcaaguagauaaa

SEQ ID NO: 2848106 - RNA, 13 nt, Human
gauuuaauuucca

SEQ ID NO: 2848107 - RNA, 14 nt, Human
gauuuaauuuccag

SEQ ID NO: 2848108 - RNA, 19 nt, Human
gaggcugacgugugaggga

SEQ ID NO: 2848109 - RNA, 16 nt, Human
gagggcccaggcaggc

SEQ ID NO: 2848110 - RNA, 13 nt, Human
gagggcccaggca

SEQ ID NO: 2848111 - RNA, 15 nt, Human
gagggcccagagcag

SEQ ID NO: 2848112 - RNA, 16 nt, Human
gagggcccagagcagg

SEQ ID NO: 2848113 - RNA, 18 nt, Human
gagggcccagagcaggaa

SEQ ID NO: 2848114 - RNA, 20 nt, Human
gagggcccagagcaggaagc

SEQ ID NO: 2848115 - RNA, 22 nt, Human
gagggcccagagcaggaagcau

SEQ ID NO: 2848116 - RNA, 13 nt, Human
gagggcccagagc

SEQ ID NO: 2848117 - RNA, 14 nt, Human
gagggcccagagca

SEQ ID NO: 2848118 - RNA, 13 nt, Human
gaggcugaggcag

SEQ ID NO: 2848119 - RNA, 16 nt, Human
gaggcucuuucugggc

SEQ ID NO: 2848120 - RNA, 14 nt, Human
gaggcugagacagg

SEQ ID NO: 2848121 - RNA, 16 nt, Human
gaggcugaggcaagag

SEQ ID NO: 2848122 - RNA, 13 nt, Human
gaggcugaggcac

SEQ ID NO: 2848123 - RNA, 14 nt, Human
gaggcugaggcaca

SEQ ID NO: 2848124 - RNA, 15 nt, Human
gaggcugaggcacaa

SEQ ID NO: 2848125 - RNA, 17 nt, Human
gaggccaaaggcuggug

SEQ ID NO: 2848126 - RNA, 18 nt, Human
gaggccaaaggcuggugg

SEQ ID NO: 2848127 - RNA, 19 nt, Human
gaggccaaaggcugguggc

SEQ ID NO: 2848128 - RNA, 17 nt, Human
gaggccaacacuguggg

SEQ ID NO: 2848129 - RNA, 18 nt, Human
gaggccaacacugugggu

SEQ ID NO: 2848130 - RNA, 15 nt, Human
gagggcccuaccuga

SEQ ID NO: 2848131 - RNA, 21 nt, Human
gaggggaggaucacuggagcc

SEQ ID NO: 2848132 - RNA, 15 nt, Human
gaggggaggaacagg

SEQ ID NO: 2848133 - RNA, 12 nt, Human
gaggggagaagc

SEQ ID NO: 2848134 - RNA, 12 nt, Human
gaggggacucug

SEQ ID NO: 2848135 - RNA, 13 nt, Human
gaggggacucugg

SEQ ID NO: 2848136 - RNA, 15 nt, Human
gaggggacucugggc

SEQ ID NO: 2848137 - RNA, 19 nt, Human
gaggggacucugggcuaug

SEQ ID NO: 2848138 - RNA, 23 nt, Human
gaggggacucugggcuauggaca

SEQ ID NO: 2848139 - RNA, 12 nt, Human
gagggccugggc

SEQ ID NO: 2848140 - RNA, 22 nt, Human
gagggccucaaaggcccgcucu

SEQ ID NO: 2848141 - RNA, 18 nt, Human
gaggacaugauggagcgc

SEQ ID NO: 2848142 - RNA, 21 nt, Human
gaggacauguuuuuguuuucu

SEQ ID NO: 2848143 - RNA, 21 nt, Human
gaggaccacaggugugagcca

SEQ ID NO: 2848144 - RNA, 23 nt, Human
gaggacuuuucuuuguggcuucc

SEQ ID NO: 2848145 - RNA, 20 nt, Human
gaggacuuuucuuuguggcu

SEQ ID NO: 2848146 - RNA, 16 nt, Human
gaggacuuuucuuugu

SEQ ID NO: 2848147 - RNA, 14 nt, Human
gaggacuugugucu

SEQ ID NO: 2848148 - RNA, 17 nt, Human
gaggacuugugucucug

SEQ ID NO: 2848149 - RNA, 16 nt, Human
gaggacuugugucucu

SEQ ID NO: 2848150 - RNA, 16 nt, Human
gaggacggugcaaccc

SEQ ID NO: 2848151 - RNA, 17 nt, Human
gaggacggugcaaccca

SEQ ID NO: 2848152 - RNA, 20 nt, Human
gaggacggugcaacccaagg

SEQ ID NO: 2848153 - RNA, 19 nt, Human
gaggacucgcuuguaaaua

SEQ ID NO: 2848154 - RNA, 20 nt, Human
gaggacucgcuuguaaauac

SEQ ID NO: 2848155 - RNA, 21 nt, Human
gaggacucgcuuguaaauacc

SEQ ID NO: 2848156 - RNA, 22 nt, Human
gaggacucgcuuguaaauacca

SEQ ID NO: 2848157 - RNA, 16 nt, Human
gaggagagaaaauaua

SEQ ID NO: 2848158 - RNA, 9 nt, Human
gaggagaaa

SEQ ID NO: 2848159 - RNA, 22 nt, Human
gaggacuugugucucugugcuu

SEQ ID NO: 2848160 - RNA, 23 nt, Human
gaggacuuugauugcacauuguu

SEQ ID NO: 2848161 - RNA, 18 nt, Human
gaggacuugugucucugu

SEQ ID NO: 2848162 - RNA, 11 nt, Human
gaggagagagg

SEQ ID NO: 2848163 - RNA, 18 nt, Human
gaggcagggucucacucu

SEQ ID NO: 2848164 - RNA, 16 nt, Human
gaggagcaaaggcuga

SEQ ID NO: 2848165 - RNA, 13 nt, Human
gaggagaggagag

SEQ ID NO: 2848166 - RNA, 14 nt, Human
gaggagaggagaga

SEQ ID NO: 2848167 - RNA, 16 nt, Human
gaggagaggagagagg

SEQ ID NO: 2848168 - RNA, 17 nt, Human
gaggagaggagagaggc

SEQ ID NO: 2848169 - RNA, 12 nt, Human
gaggagagaggc

SEQ ID NO: 2848170 - RNA, 13 nt, Human
gaggagagaggca

SEQ ID NO: 2848171 - RNA, 14 nt, Human
gaggagagaggcag

SEQ ID NO: 2848172 - RNA, 15 nt, Human
gaggagagaggcaga

SEQ ID NO: 2848173 - RNA, 17 nt, Human
gaggagagaggcagaga

SEQ ID NO: 2848174 - RNA, 20 nt, Human
gaggagagauagccuguggc

SEQ ID NO: 2848175 - RNA, 24 nt, Human
gaggagagauagccuguggcccug

SEQ ID NO: 2848176 - RNA, 16 nt, Human
gaggagagaggcagag

SEQ ID NO: 2848177 - RNA, 20 nt, Human
gaggcagggucucacucugu

SEQ ID NO: 2848178 - RNA, 19 nt, Human
gaggcagggucucacucug

SEQ ID NO: 2848179 - RNA, 17 nt, Human
gaggcaucgcaauguaa

SEQ ID NO: 2848180 - RNA, 13 nt, Human
gaggcauggcccu

SEQ ID NO: 2848181 - RNA, 14 nt, Human
gaggcauggcccug

SEQ ID NO: 2848182 - RNA, 15 nt, Human
gaggcauggcccugg

SEQ ID NO: 2848183 - RNA, 17 nt, Human
gaggcauggcccugggg

SEQ ID NO: 2848184 - RNA, 18 nt, Human
gaggcauggcccuggggu

SEQ ID NO: 2848185 - RNA, 16 nt, Human
gagcaggggcagggug

SEQ ID NO: 2848186 - RNA, 16 nt, Human
gagcaggguguuggga

SEQ ID NO: 2848187 - RNA, 20 nt, Human
gagcaguccugccucagccu

SEQ ID NO: 2848188 - RNA, 16 nt, Human
gagcaguccaugcaug

SEQ ID NO: 2848189 - RNA, 18 nt, Human
gagcaguccaugcaugac

SEQ ID NO: 2848190 - RNA, 16 nt, Human
gagcaguccugccuca

SEQ ID NO: 2848191 - RNA, 21 nt, Human
gagcagggcucagcggggaca

SEQ ID NO: 2848192 - RNA, 13 nt, Human
gagcaggggcagg

SEQ ID NO: 2848193 - RNA, 17 nt, Human
gagcaugaaauuuuuaa

SEQ ID NO: 2848194 - RNA, 13 nt, Human
gagcccauacuca

SEQ ID NO: 2848195 - RNA, 16 nt, Human
gagcccauacucagcc

SEQ ID NO: 2848196 - RNA, 17 nt, Human
gagcccauacucagccu

SEQ ID NO: 2848197 - RNA, 18 nt, Human
gagcccauacucagccug

SEQ ID NO: 2848198 - RNA, 19 nt, Human
gagcccauacucagccugc

SEQ ID NO: 2848199 - RNA, 20 nt, Human
gagcccauacucagccugcu

SEQ ID NO: 2848200 - RNA, 22 nt, Human
gagcccauacucagccugcugc

SEQ ID NO: 2848201 - RNA, 18 nt, Human
gagcccauguucugcccc

SEQ ID NO: 2848202 - RNA, 20 nt, Human
gagcccauguucugccccca

SEQ ID NO: 2848203 - RNA, 21 nt, Human
gagcccauguucugcccccag

SEQ ID NO: 2848204 - RNA, 22 nt, Human
gagcccauguucugcccccagc

SEQ ID NO: 2848205 - RNA, 23 nt, Human
gagcccauguucugcccccagcc

SEQ ID NO: 2848206 - RNA, 23 nt, Human
gagcaucucuugaggccaggagu

SEQ ID NO: 2848207 - RNA, 22 nt, Human
gagcaucucuugaggccaggag

SEQ ID NO: 2848208 - RNA, 20 nt, Human
gagcaucucuugaggccagg

SEQ ID NO: 2848209 - RNA, 19 nt, Human
gagcaucucuugaggccag

SEQ ID NO: 2848210 - RNA, 18 nt, Human
gagcaucucuugaggcca

SEQ ID NO: 2848211 - RNA, 19 nt, Human
gagcaucccccaaaguuca

SEQ ID NO: 2848212 - RNA, 13 nt, Human
gagcaucccggag

SEQ ID NO: 2848213 - RNA, 19 nt, Human
gagcaucccggaggaaauc

SEQ ID NO: 2848214 - RNA, 20 nt, Human
gagcaucccggaggaaaucu

SEQ ID NO: 2848215 - RNA, 14 nt, Human
gagcauccugagcc

SEQ ID NO: 2848216 - RNA, 15 nt, Human
gagcauccugagccc

SEQ ID NO: 2848217 - RNA, 16 nt, Human
gagcauccugagcccc

SEQ ID NO: 2848218 - RNA, 18 nt, Human
gagcauccugagccccgc

SEQ ID NO: 2848219 - RNA, 22 nt, Human
gagcauccugagccccgcccuc

SEQ ID NO: 2848220 - RNA, 14 nt, Human
gagccccgaggccu

SEQ ID NO: 2848221 - RNA, 13 nt, Human
gagccccgaggcc

SEQ ID NO: 2848222 - RNA, 13 nt, Human
gagccccgcagac

SEQ ID NO: 2848223 - RNA, 18 nt, Human
gagccccgcagaccuccc

SEQ ID NO: 2848224 - RNA, 22 nt, Human
gagccccgcagaccuccccagc

SEQ ID NO: 2848225 - RNA, 17 nt, Human
gagccccgaggccuucu

SEQ ID NO: 2848226 - RNA, 23 nt, Human
gagccccgcagaccuccccagcc

SEQ ID NO: 2848227 - RNA, 13 nt, Human
gagccccgcccuc

SEQ ID NO: 2848228 - RNA, 14 nt, Human
gagccccgcccucu

SEQ ID NO: 2848229 - RNA, 15 nt, Human
gagccccgcccucuu

SEQ ID NO: 2848230 - RNA, 16 nt, Human
gagccccgcccucuuc

SEQ ID NO: 2848231 - RNA, 17 nt, Human
gagccccgcccucuucc

SEQ ID NO: 2848232 - RNA, 18 nt, Human
gagccccgcccucuuccu

SEQ ID NO: 2848233 - RNA, 19 nt, Human
gagccccgcccucuuccug

SEQ ID NO: 2848234 - RNA, 20 nt, Human
gagccccgcccucuuccuga

SEQ ID NO: 2848235 - RNA, 21 nt, Human
gagccccgcccucuuccugac

SEQ ID NO: 2848236 - RNA, 12 nt, Human
gagccccugguc

SEQ ID NO: 2848237 - RNA, 15 nt, Human
gagcccucagaaccc

SEQ ID NO: 2848238 - RNA, 12 nt, Human
gagcccucccca

SEQ ID NO: 2848239 - RNA, 13 nt, Human
gagcccuccccag

SEQ ID NO: 2848240 - RNA, 14 nt, Human
gagcccuccccagg

SEQ ID NO: 2848241 - RNA, 15 nt, Human
gagcccuccgccuuc

SEQ ID NO: 2848242 - RNA, 17 nt, Human
gagcccuccgccuucac

SEQ ID NO: 2848243 - RNA, 18 nt, Human
gagcccuccgccuucaca

SEQ ID NO: 2848244 - RNA, 23 nt, Human
gagcccuccgccuucacauuccc

SEQ ID NO: 2848245 - RNA, 20 nt, Human
gagccccugguccugagggu

SEQ ID NO: 2848246 - RNA, 13 nt, Human
gagccccuggucc

SEQ ID NO: 2848247 - RNA, 14 nt, Human
gagccccugguccu

SEQ ID NO: 2848248 - RNA, 17 nt, Human
gagcuguuuauggccuc

SEQ ID NO: 2848249 - RNA, 16 nt, Human
gagcuguuuauggccu

SEQ ID NO: 2848250 - RNA, 18 nt, Human
gagcuguuuauggccuca

SEQ ID NO: 2848251 - RNA, 16 nt, Human
gagcuggccucucuag

SEQ ID NO: 2848252 - RNA, 11 nt, Human
gagcuggccuc

SEQ ID NO: 2848253 - RNA, 19 nt, Human
gagcuggccgugggccugg

SEQ ID NO: 2848254 - RNA, 20 nt, Human
gagcuggccgugggccuggg

SEQ ID NO: 2848255 - RNA, 17 nt, Human
gagcuggccgugggccu

SEQ ID NO: 2848256 - RNA, 13 nt, Human
gagcuggccccgc

SEQ ID NO: 2848257 - RNA, 14 nt, Human
gagcuggccccgcc

SEQ ID NO: 2848258 - RNA, 16 nt, Human
gagcuggccccgccgc

SEQ ID NO: 2848259 - RNA, 17 nt, Human
gagcuggccccgccgcc

SEQ ID NO: 2848260 - RNA, 14 nt, Human
gagcccugguggca

SEQ ID NO: 2848261 - RNA, 13 nt, Human
gagcccugguggc

SEQ ID NO: 2848262 - RNA, 23 nt, Human
gagcccuggcaggaugacccugc

SEQ ID NO: 2848263 - RNA, 13 nt, Human
gagcccuggcagg

SEQ ID NO: 2848264 - RNA, 14 nt, Human
gagcuggagccugg

SEQ ID NO: 2848265 - RNA, 15 nt, Human
gagcuggagccuggu

SEQ ID NO: 2848266 - RNA, 20 nt, Human
gagcuggagccuggugcccu

SEQ ID NO: 2848267 - RNA, 12 nt, Human
gagcuggagccu

SEQ ID NO: 2848268 - RNA, 21 nt, Human
gagauugugccacuucacucc

SEQ ID NO: 2848269 - RNA, 16 nt, Human
gagauuggcauggcuu

SEQ ID NO: 2848270 - RNA, 17 nt, Human
gagauuggacggccuga

SEQ ID NO: 2848271 - RNA, 19 nt, Human
gagagggagagcagagaaa

SEQ ID NO: 2848272 - RNA, 15 nt, Human
gagaugcuggagaag

SEQ ID NO: 2848273 - RNA, 16 nt, Human
gagaugcuggagaaga

SEQ ID NO: 2848274 - RNA, 14 nt, Human
gagaugcggccaag

SEQ ID NO: 2848275 - RNA, 21 nt, Human
gagaugcguuguuacaggaag

SEQ ID NO: 2848276 - RNA, 14 nt, Human
gagaugugcaccca

SEQ ID NO: 2848277 - RNA, 16 nt, Human
gagaugcugagggugu

SEQ ID NO: 2848278 - RNA, 12 nt, Human
gagauugcuaau

SEQ ID NO: 2848279 - RNA, 13 nt, Human
gagauugcuaauu

SEQ ID NO: 2848280 - RNA, 14 nt, Human
gagauuacaggcau

SEQ ID NO: 2848281 - RNA, 15 nt, Human
gagauuauguucuuu

SEQ ID NO: 2848282 - RNA, 20 nt, Human
gagauguguggacuguggca

SEQ ID NO: 2848283 - RNA, 16 nt, Human
gagauguguggacugu

SEQ ID NO: 2848284 - RNA, 14 nt, Human
gagauguuuuuaaa

SEQ ID NO: 2848285 - RNA, 17 nt, Human
gagauguuuuuaaaagu

SEQ ID NO: 2848286 - RNA, 18 nt, Human
gagauguuuuuaaaaguu

SEQ ID NO: 2848287 - RNA, 19 nt, Human
gagauguuuuuaaaaguuu

SEQ ID NO: 2848288 - RNA, 21 nt, Human
gagauguuuuuaaaaguuuca

SEQ ID NO: 2848289 - RNA, 16 nt, Human
gagacucccaugaagc

SEQ ID NO: 2848290 - RNA, 17 nt, Human
gagacucccaugaagcc

SEQ ID NO: 2848291 - RNA, 18 nt, Human
gagacucccaugaagccu

SEQ ID NO: 2848292 - RNA, 19 nt, Human
gagacucccaugaagccuu

SEQ ID NO: 2848293 - RNA, 20 nt, Human
gagacucccaugaagccuuu

SEQ ID NO: 2848294 - RNA, 18 nt, Human
gagacguggaaccucugu

SEQ ID NO: 2848295 - RNA, 20 nt, Human
gagacguggaaccucugucu

SEQ ID NO: 2848296 - RNA, 21 nt, Human
gagacguggaaccucugucuc

SEQ ID NO: 2848297 - RNA, 22 nt, Human
gagacguggaaccucugucuca

SEQ ID NO: 2848298 - RNA, 12 nt, Human
gagacucagccu

SEQ ID NO: 2848299 - RNA, 13 nt, Human
gagacucagccug

SEQ ID NO: 2848300 - RNA, 14 nt, Human
gagacucagccugc

SEQ ID NO: 2848301 - RNA, 15 nt, Human
gagacucagccugca

SEQ ID NO: 2848302 - RNA, 17 nt, Human
gagacucagccugcagu

SEQ ID NO: 2848303 - RNA, 19 nt, Human
gagacggugucuuguucug

SEQ ID NO: 2848304 - RNA, 22 nt, Human
gagacggugucuuguucuguca

SEQ ID NO: 2848305 - RNA, 16 nt, Human
gagacuccuaggcagg

SEQ ID NO: 2848306 - RNA, 14 nt, Human
gagagcggucucag

SEQ ID NO: 2848307 - RNA, 21 nt, Human
gagagcggucucaggcuggug

SEQ ID NO: 2848308 - RNA, 13 nt, Human
gagagcugggugu

SEQ ID NO: 2848309 - RNA, 13 nt, Human
gagagcuggagcc

SEQ ID NO: 2848310 - RNA, 20 nt, Human
gagagcugggugucaagagg

SEQ ID NO: 2848311 - RNA, 14 nt, Human
gagagcuggugccc

SEQ ID NO: 2848312 - RNA, 13 nt, Human
gagagcuggugcc

SEQ ID NO: 2848313 - RNA, 21 nt, Human
gagagcuggagccuggugccc

SEQ ID NO: 2848314 - RNA, 14 nt, Human
gagagcuggagccu

SEQ ID NO: 2848315 - RNA, 16 nt, Human
gagagcuggagccugg

SEQ ID NO: 2848316 - RNA, 17 nt, Human
gagagcuggugcccgga

SEQ ID NO: 2848317 - RNA, 22 nt, Human
gagagcuucuguugcugccuca

SEQ ID NO: 2848318 - RNA, 22 nt, Human
gagaggaacuccuuggccuagc

SEQ ID NO: 2848319 - RNA, 23 nt, Human
gagaggaacuccuuggccuagcc

SEQ ID NO: 2848320 - RNA, 20 nt, Human
gagaggaaauauugcugggg

SEQ ID NO: 2848321 - RNA, 21 nt, Human
gagaggaaauauugcuggggu

SEQ ID NO: 2848322 - RNA, 16 nt, Human
gagagcuuaaugauaa

SEQ ID NO: 2848323 - RNA, 18 nt, Human
gagagcuuagccuggagc

SEQ ID NO: 2848324 - RNA, 11 nt, Human
gagaggagaga

SEQ ID NO: 2848325 - RNA, 12 nt, Human
gagaggagagag

SEQ ID NO: 2848326 - RNA, 15 nt, Human
gagaggagagaggca

SEQ ID NO: 2848327 - RNA, 15 nt, Human
gagaggcaauggcca

SEQ ID NO: 2848328 - RNA, 18 nt, Human
gagaggaugagagcccag

SEQ ID NO: 2848329 - RNA, 19 nt, Human
gagaggaugagagcccaga

SEQ ID NO: 2848330 - RNA, 21 nt, Human
gagaggaugagagcccagagg

SEQ ID NO: 2848331 - RNA, 14 nt, Human
gagaggaugugcaa

SEQ ID NO: 2848332 - RNA, 14 nt, Human
gagaggaugagagc

SEQ ID NO: 2848333 - RNA, 16 nt, Human
gagaggaugagagccc

SEQ ID NO: 2848334 - RNA, 13 nt, Human
gagaggaggcaac

SEQ ID NO: 2848335 - RNA, 18 nt, Human
gagaggagagaggcagag

SEQ ID NO: 2848336 - RNA, 19 nt, Human
gagaggagagaggcagaga

SEQ ID NO: 2848337 - RNA, 18 nt, Human
gagaggagaggagagagg

SEQ ID NO: 2848338 - RNA, 13 nt, Human
gagaggagccaga

SEQ ID NO: 2848339 - RNA, 17 nt, Human
gagaggagccagacaga

SEQ ID NO: 2848340 - RNA, 19 nt, Human
gagaggagccagacagacc

SEQ ID NO: 2848341 - RNA, 18 nt, Human
gagaggccuuuuggaaug

SEQ ID NO: 2848342 - RNA, 20 nt, Human
gagaggaugagagcccagag

SEQ ID NO: 2848343 - RNA, 17 nt, Human
gagaggccaaaggcugg

SEQ ID NO: 2848344 - RNA, 18 nt, Human
gagaggccaaaggcuggu

SEQ ID NO: 2848345 - RNA, 15 nt, Human
gagaggccuuuugga

SEQ ID NO: 2848346 - RNA, 17 nt, Human
gacuuuguuuuuaaaau

SEQ ID NO: 2848347 - RNA, 21 nt, Human
gacuuuuaaugucauuuguua

SEQ ID NO: 2848348 - RNA, 18 nt, Human
gacuuuuauuuccaguga

SEQ ID NO: 2848349 - RNA, 18 nt, Human
gacuuuuuucuaguacac

SEQ ID NO: 2848350 - RNA, 10 nt, Human
gagaaaaaaa

SEQ ID NO: 2848351 - RNA, 16 nt, Human
gagaaaaaaaaaauag

SEQ ID NO: 2848352 - RNA, 13 nt, Human
gagaaaaaaacaa

SEQ ID NO: 2848353 - RNA, 13 nt, Human
gagaaaaaugcuu

SEQ ID NO: 2848354 - RNA, 19 nt, Human
gagaaaaagcuccuguccu

SEQ ID NO: 2848355 - RNA, 17 nt, Human
gagaaaaagcuccuguc

SEQ ID NO: 2848356 - RNA, 23 nt, Human
gagaagguggguuuucaucaaga

SEQ ID NO: 2848357 - RNA, 16 nt, Human
gagaaggggugugcau

SEQ ID NO: 2848358 - RNA, 17 nt, Human
gagaaggggaagcacuc

SEQ ID NO: 2848359 - RNA, 12 nt, Human
gagaaggcagcc

SEQ ID NO: 2848360 - RNA, 16 nt, Human
gagaaggcagccacca

SEQ ID NO: 2848361 - RNA, 15 nt, Human
gagaaggagagaaag

SEQ ID NO: 2848362 - RNA, 11 nt, Human
gagaaggcagc

SEQ ID NO: 2848363 - RNA, 15 nt, Human
gagaagggauggagg

SEQ ID NO: 2848364 - RNA, 20 nt, Human
gagaagggaauccuccucca

SEQ ID NO: 2848365 - RNA, 20 nt, Human
gagaagggauaacccuacac

SEQ ID NO: 2848366 - RNA, 23 nt, Human
gagaaggggcgggaauauuguuu

SEQ ID NO: 2848367 - RNA, 17 nt, Human
gagaagggcauaaaaca

SEQ ID NO: 2848368 - RNA, 23 nt, Human
gagaaggacccggaggggccugg

SEQ ID NO: 2848369 - RNA, 12 nt, Human
gagaaggagaga

SEQ ID NO: 2848370 - RNA, 14 nt, Human
gagaaggagagaaa

SEQ ID NO: 2848371 - RNA, 14 nt, Human
gagacggaguccca

SEQ ID NO: 2848372 - RNA, 13 nt, Human
gagaccugccccu

SEQ ID NO: 2848373 - RNA, 20 nt, Human
gagaccgggguauccugggg

SEQ ID NO: 2848374 - RNA, 13 nt, Human
gagaccguccuca

SEQ ID NO: 2848375 - RNA, 14 nt, Human
gagaccguccucac

SEQ ID NO: 2848376 - RNA, 15 nt, Human
gagaccguccucacc

SEQ ID NO: 2848377 - RNA, 16 nt, Human
gagaccguccucaccc

SEQ ID NO: 2848378 - RNA, 22 nt, Human
gagaccguccucaccccugucc

SEQ ID NO: 2848379 - RNA, 19 nt, Human
gagacggagucccaccuug

SEQ ID NO: 2848380 - RNA, 16 nt, Human
gagacggagucccacc

SEQ ID NO: 2848381 - RNA, 23 nt, Human
gagaccuguuuuaaaaaggaacu

SEQ ID NO: 2848382 - RNA, 12 nt, Human
gagaccuuaccc

SEQ ID NO: 2848383 - RNA, 13 nt, Human
gagaccuuacccc

SEQ ID NO: 2848384 - RNA, 18 nt, Human
gagaccuuaccccuggcu

SEQ ID NO: 2848385 - RNA, 22 nt, Human
gagaccuuaccccuggcuguuu

SEQ ID NO: 2848386 - RNA, 15 nt, Human
gagacgacaggcgag

SEQ ID NO: 2848387 - RNA, 23 nt, Human
gagaaugaaagggcccagagagg

SEQ ID NO: 2848388 - RNA, 15 nt, Human
gagaaugaaagggcc

SEQ ID NO: 2848389 - RNA, 18 nt, Human
gagaauaggcagccccca

SEQ ID NO: 2848390 - RNA, 20 nt, Human
gagaauauaacaugaaauga

SEQ ID NO: 2848391 - RNA, 18 nt, Human
gagaauaagagaaagaaa

SEQ ID NO: 2848392 - RNA, 16 nt, Human
gagaaguuuuguuuuu

SEQ ID NO: 2848393 - RNA, 22 nt, Human
gagaauaagagaaagaaaauga

SEQ ID NO: 2848394 - RNA, 21 nt, Human
gagaaucuacccccagaucca

SEQ ID NO: 2848395 - RNA, 22 nt, Human
gagaaucuauauuuaacaagau

SEQ ID NO: 2848396 - RNA, 15 nt, Human
gagaaucuauauuua

SEQ ID NO: 2848397 - RNA, 22 nt, Human
gaauauugcuuuggucauauga

SEQ ID NO: 2848398 - RNA, 22 nt, Human
gaauauacagcaggugcucaau

SEQ ID NO: 2848399 - RNA, 16 nt, Human
gaauauauuuaagcaa

SEQ ID NO: 2848400 - RNA, 13 nt, Human
gaauauauuuauu

SEQ ID NO: 2848401 - RNA, 16 nt, Human
gaauauauuuauuuaa

SEQ ID NO: 2848402 - RNA, 17 nt, Human
gaauauauuuauuuaaa

SEQ ID NO: 2848403 - RNA, 21 nt, Human
gaauauauuuauuuaaagcau

SEQ ID NO: 2848404 - RNA, 14 nt, Human
gaauauauggcauu

SEQ ID NO: 2848405 - RNA, 19 nt, Human
gaauauauggcauuugcag

SEQ ID NO: 2848406 - RNA, 23 nt, Human
gaauauauggcauuugcagauuu

SEQ ID NO: 2848407 - RNA, 15 nt, Human
gaauauauauauaua

SEQ ID NO: 2848408 - RNA, 14 nt, Human
gaauauaggucucu

SEQ ID NO: 2848409 - RNA, 20 nt, Human
gaauauaggucucuucuccc

SEQ ID NO: 2848410 - RNA, 22 nt, Human
gaauauaggucucuucucccag

SEQ ID NO: 2848411 - RNA, 23 nt, Human
gaauauaggucucuucucccaga

SEQ ID NO: 2848412 - RNA, 16 nt, Human
gaauauccauguacuu

SEQ ID NO: 2848413 - RNA, 19 nt, Human
gaauauccauguacuuguu

SEQ ID NO: 2848414 - RNA, 17 nt, Human
gaauaucuauuaauaua

SEQ ID NO: 2848415 - RNA, 14 nt, Human
gaauaucuuucgau

SEQ ID NO: 2848416 - RNA, 13 nt, Human
gaauaugccugua

SEQ ID NO: 2848417 - RNA, 16 nt, Human
gaauaugccuguaauu

SEQ ID NO: 2848418 - RNA, 18 nt, Human
gaauaugccuguaauuca

SEQ ID NO: 2848419 - RNA, 20 nt, Human
gaauaugccuguaauucagu

SEQ ID NO: 2848420 - RNA, 18 nt, Human
gaauauucccaagcccau

SEQ ID NO: 2848421 - RNA, 16 nt, Human
gaauauucauauugga

SEQ ID NO: 2848422 - RNA, 21 nt, Human
gaaugagucuguuguguguca

SEQ ID NO: 2848423 - RNA, 14 nt, Human
gaaugagugugcau

SEQ ID NO: 2848424 - RNA, 16 nt, Human
gaaugaucucuucuuu

SEQ ID NO: 2848425 - RNA, 15 nt, Human
gaaugauaugcauuu

SEQ ID NO: 2848426 - RNA, 15 nt, Human
gaaugauucauguua

SEQ ID NO: 2848427 - RNA, 19 nt, Human
gaaugauucauguuauauu

SEQ ID NO: 2848428 - RNA, 20 nt, Human
gaaugauucauguuauauuu

SEQ ID NO: 2848429 - RNA, 17 nt, Human
gaaugaucucuucuuuu

SEQ ID NO: 2848430 - RNA, 14 nt, Human
gaaugauuucaugc

SEQ ID NO: 2848431 - RNA, 23 nt, Human
gaaugauucuaauuuuuaagcaa

SEQ ID NO: 2848432 - RNA, 17 nt, Human
gaauguuugccucugcc

SEQ ID NO: 2848433 - RNA, 16 nt, Human
gaauguuugccucugc

SEQ ID NO: 2848434 - RNA, 15 nt, Human
gaauguuugccucug

SEQ ID NO: 2848435 - RNA, 14 nt, Human
gaaugauuuuuaga

SEQ ID NO: 2848436 - RNA, 16 nt, Human
gaaugauuuuuagaug

SEQ ID NO: 2848437 - RNA, 20 nt, Human
gaauuaaauaaacccuuccu

SEQ ID NO: 2848438 - RNA, 12 nt, Human
gaauuaaauaaa

SEQ ID NO: 2848439 - RNA, 19 nt, Human
gaauguuugccucugccuc

SEQ ID NO: 2848440 - RNA, 18 nt, Human
gaauguuugccucugccu

SEQ ID NO: 2848441 - RNA, 11 nt, Human
gaauuaaaacu

SEQ ID NO: 2848442 - RNA, 12 nt, Human
gaauuaaaacuu

SEQ ID NO: 2848443 - RNA, 14 nt, Human
gaauuaaaacuucu

SEQ ID NO: 2848444 - RNA, 16 nt, Human
gaauuaaaacuucuua

SEQ ID NO: 2848445 - RNA, 17 nt, Human
gaauuaaaacuucuuaa

SEQ ID NO: 2848446 - RNA, 18 nt, Human
gaauuaaaacuucuuaaa

SEQ ID NO: 2848447 - RNA, 19 nt, Human
gaauuaaaacuucuuaaau

SEQ ID NO: 2848448 - RNA, 22 nt, Human
gaauuaaaacuucuuaaauauc

SEQ ID NO: 2848449 - RNA, 19 nt, Human
gaauuaaaaggauaguauu

SEQ ID NO: 2848450 - RNA, 20 nt, Human
gaauuaaaaggauaguauuu

SEQ ID NO: 2848451 - RNA, 21 nt, Human
gaauuaaaaggauaguauuuu

SEQ ID NO: 2848452 - RNA, 11 nt, Human
gaauuaaaagu

SEQ ID NO: 2848453 - RNA, 18 nt, Human
gaauuaaaagucauuuaa

SEQ ID NO: 2848454 - RNA, 21 nt, Human
gaauuacauguaaaacauuau

SEQ ID NO: 2848455 - RNA, 15 nt, Human
gaauuaauagcuuuu

SEQ ID NO: 2848456 - RNA, 21 nt, Human
gaauuaaucaucuauaaagaa

SEQ ID NO: 2848457 - RNA, 15 nt, Human
gaauuaaguuaucuu

SEQ ID NO: 2848458 - RNA, 20 nt, Human
gaauuaaguuaucuuuaaaa

SEQ ID NO: 2848459 - RNA, 13 nt, Human
gaauuaagaauau

SEQ ID NO: 2848460 - RNA, 17 nt, Human
gaauuaagauacaaauu

SEQ ID NO: 2848461 - RNA, 22 nt, Human
gaauuacauguaaaacauuauc

SEQ ID NO: 2848462 - RNA, 15 nt, Human
gaauuagauuauauu

SEQ ID NO: 2848463 - RNA, 16 nt, Human
gaauuacuuuuuucca

SEQ ID NO: 2848464 - RNA, 16 nt, Human
gaauuaguaaaguuag

SEQ ID NO: 2848465 - RNA, 16 nt, Human
gaauucaaacuggggc

SEQ ID NO: 2848466 - RNA, 18 nt, Human
gaauucaaacuggggccu

SEQ ID NO: 2848467 - RNA, 21 nt, Human
gaauucaaacuggggccucca

SEQ ID NO: 2848468 - RNA, 22 nt, Human
gaauucaaacuggggccuccag

SEQ ID NO: 2848469 - RNA, 23 nt, Human
gaauuuuugcuugacuucaguua

SEQ ID NO: 2848470 - RNA, 17 nt, Human
gaauuuuuuugucuuua

SEQ ID NO: 2848471 - RNA, 22 nt, Human
gaauuuuuuuuuccuagcccuc

SEQ ID NO: 2848472 - RNA, 21 nt, Human
gaauuuuuuuuguuguuucag

SEQ ID NO: 2848473 - RNA, 22 nt, Human
gaauuuuuuuuguuguuucagu

SEQ ID NO: 2848474 - RNA, 23 nt, Human
gaauuuuuuuuguuguuucagug

SEQ ID NO: 2848475 - RNA, 22 nt, Human
gacaaacaccucccaggagaca

SEQ ID NO: 2848476 - RNA, 17 nt, Human
gacaaacaccucccagg

SEQ ID NO: 2848477 - RNA, 19 nt, Human
gacaaacaccucccaggag

SEQ ID NO: 2848478 - RNA, 17 nt, Human
gacaaacuggagucugg

SEQ ID NO: 2848479 - RNA, 18 nt, Human
gacaaacuggagucugga

SEQ ID NO: 2848480 - RNA, 14 nt, Human
gacaaacuguaaaa

SEQ ID NO: 2848481 - RNA, 19 nt, Human
gacaaacuguaaaaaaugu

SEQ ID NO: 2848482 - RNA, 20 nt, Human
gacaaagccaaacucugcca

SEQ ID NO: 2848483 - RNA, 17 nt, Human
gacaaagauggcucaga

SEQ ID NO: 2848484 - RNA, 17 nt, Human
gacaaaggacauuuguu

SEQ ID NO: 2848485 - RNA, 20 nt, Human
gacacagcucuucuccaggc

SEQ ID NO: 2848486 - RNA, 19 nt, Human
gacacagcucuucuccagg

SEQ ID NO: 2848487 - RNA, 12 nt, Human
gacacagcucuu

SEQ ID NO: 2848488 - RNA, 15 nt, Human
gacacagaugaaaca

SEQ ID NO: 2848489 - RNA, 11 nt, Human
gacacagcagc

SEQ ID NO: 2848490 - RNA, 15 nt, Human
gacacagcagcuuca

SEQ ID NO: 2848491 - RNA, 18 nt, Human
gacacagcagcuucacca

SEQ ID NO: 2848492 - RNA, 19 nt, Human
gacacagcagcuucaccag

SEQ ID NO: 2848493 - RNA, 20 nt, Human
gacacagcagcuucaccaga

SEQ ID NO: 2848494 - RNA, 21 nt, Human
gacacagcagcuucaccagag

SEQ ID NO: 2848495 - RNA, 21 nt, Human
gacacagaaaauguugagaau

SEQ ID NO: 2848496 - RNA, 12 nt, Human
gacacagacuca

SEQ ID NO: 2848497 - RNA, 20 nt, Human
gacacagacucauccugaac

SEQ ID NO: 2848498 - RNA, 12 nt, Human
gacacagauaau

SEQ ID NO: 2848499 - RNA, 19 nt, Human
gacacagaaaauguugaga

SEQ ID NO: 2848500 - RNA, 15 nt, Human
gacaaaucaaagcag

SEQ ID NO: 2848501 - RNA, 13 nt, Human
gacaaaucaacag

SEQ ID NO: 2848502 - RNA, 17 nt, Human
gacaaaucaacagaagc

SEQ ID NO: 2848503 - RNA, 18 nt, Human
gacaaaucaacagaagca

SEQ ID NO: 2848504 - RNA, 19 nt, Human
gacaaaucaacagaagcau

SEQ ID NO: 2848505 - RNA, 19 nt, Human
gacaaaguggaggagggcc

SEQ ID NO: 2848506 - RNA, 23 nt, Human
gacaaaguuacugauucacugca

SEQ ID NO: 2848507 - RNA, 18 nt, Human
gacaaagguuuuccucuu

SEQ ID NO: 2848508 - RNA, 21 nt, Human
gacacagcucuucuccaggcu

SEQ ID NO: 2848509 - RNA, 22 nt, Human
gacacagcagcuucaccagagc

SEQ ID NO: 2848510 - RNA, 23 nt, Human
gacacagcagcuucaccagagca

SEQ ID NO: 2848511 - RNA, 13 nt, Human
gacacagcguccc

SEQ ID NO: 2848512 - RNA, 21 nt, Human
gacacagcgucccuagcagug

SEQ ID NO: 2848513 - RNA, 22 nt, Human
gacacagcgucccuagcaguga

SEQ ID NO: 2848514 - RNA, 19 nt, Human
gacagcuccuucuguccua

SEQ ID NO: 2848515 - RNA, 20 nt, Human
gacagccccagagcagggug

SEQ ID NO: 2848516 - RNA, 18 nt, Human
gacagccccagagcaggg

SEQ ID NO: 2848517 - RNA, 19 nt, Human
gacagccccagagcagggu

SEQ ID NO: 2848518 - RNA, 15 nt, Human
gacaguccagccugg

SEQ ID NO: 2848519 - RNA, 16 nt, Human
gacaguccagccugga

SEQ ID NO: 2848520 - RNA, 16 nt, Human
gacagcucuuuuugug

SEQ ID NO: 2848521 - RNA, 20 nt, Human
gacagcucuuuuugugaagu

SEQ ID NO: 2848522 - RNA, 17 nt, Human
gacagcugauacuucau

SEQ ID NO: 2848523 - RNA, 22 nt, Human
gacagucacugccacuuugcac

SEQ ID NO: 2848524 - RNA, 23 nt, Human
gacagucacugccacuuugcaca

SEQ ID NO: 2848525 - RNA, 17 nt, Human
gacagucaucaucaggg

SEQ ID NO: 2848526 - RNA, 18 nt, Human
gacagucaucaucagggc

SEQ ID NO: 2848527 - RNA, 19 nt, Human
gacagucaucaucagggcc

SEQ ID NO: 2848528 - RNA, 20 nt, Human
gacagucaucaucagggccu

SEQ ID NO: 2848529 - RNA, 21 nt, Human
gacagucaucaucagggccug

SEQ ID NO: 2848530 - RNA, 22 nt, Human
gacagucaucaucagggccugg

SEQ ID NO: 2848531 - RNA, 23 nt, Human
gacagucaucaucagggccuggg

SEQ ID NO: 2848532 - RNA, 17 nt, Human
gacauguuuuccgugaa

SEQ ID NO: 2848533 - RNA, 15 nt, Human
gacauguuguaaauu

SEQ ID NO: 2848534 - RNA, 15 nt, Human
gacauguuauauauu

SEQ ID NO: 2848535 - RNA, 18 nt, Human
gacauguuauauauuuuu

SEQ ID NO: 2848536 - RNA, 17 nt, Human
gacaguccagccuggag

SEQ ID NO: 2848537 - RNA, 19 nt, Human
gacaguccagccuggagau

SEQ ID NO: 2848538 - RNA, 23 nt, Human
gacaugugaaaccuuuuuuaaga

SEQ ID NO: 2848539 - RNA, 13 nt, Human
gacacuggccccu

SEQ ID NO: 2848540 - RNA, 14 nt, Human
gacacuggccccuc

SEQ ID NO: 2848541 - RNA, 19 nt, Human
gacacugguauuccugccu

SEQ ID NO: 2848542 - RNA, 20 nt, Human
gacacugguauuccugccuc

SEQ ID NO: 2848543 - RNA, 15 nt, Human
gacacuggccccuca

SEQ ID NO: 2848544 - RNA, 14 nt, Human
gacagccccagagc

SEQ ID NO: 2848545 - RNA, 16 nt, Human
gacagccccagagcag

SEQ ID NO: 2848546 - RNA, 17 nt, Human
gacagccccagagcagg

SEQ ID NO: 2848547 - RNA, 18 nt, Human
gacagcuccuucuguccu

SEQ ID NO: 2848548 - RNA, 17 nt, Human
gacagcuccuucugucc

SEQ ID NO: 2848549 - RNA, 16 nt, Human
gacagcuccuucuguc

SEQ ID NO: 2848550 - RNA, 23 nt, Human
gacauugcggacagccacggcca

SEQ ID NO: 2848551 - RNA, 17 nt, Human
gacauugcggacagcca

SEQ ID NO: 2848552 - RNA, 21 nt, Human
gacauugcguuugaccuuuua

SEQ ID NO: 2848553 - RNA, 14 nt, Human
gacauugcguuuga

SEQ ID NO: 2848554 - RNA, 14 nt, Human
gacauguuuuuguu

SEQ ID NO: 2848555 - RNA, 21 nt, Human
gacauugggucuauuccagcu

SEQ ID NO: 2848556 - RNA, 23 nt, Human
gacauugggucuauuccagcuca

SEQ ID NO: 2848557 - RNA, 14 nt, Human
gacauuuuaacaag

SEQ ID NO: 2848558 - RNA, 15 nt, Human
gacauuuuaacaaga

SEQ ID NO: 2848559 - RNA, 16 nt, Human
gacauuuuaacaagaa

SEQ ID NO: 2848560 - RNA, 19 nt, Human
gacauuuuaacaagaagau

SEQ ID NO: 2848561 - RNA, 20 nt, Human
gacauuuuaacaagaagaug

SEQ ID NO: 2848562 - RNA, 22 nt, Human
gacauuuuaacaagaagaugaa

SEQ ID NO: 2848563 - RNA, 13 nt, Human
gacauuggagaug

SEQ ID NO: 2848564 - RNA, 20 nt, Human
gacauuuucuuucaugggca

SEQ ID NO: 2848565 - RNA, 21 nt, Human
gacauuuuacauuaaauuuuu

SEQ ID NO: 2848566 - RNA, 15 nt, Human
gacauuuuacauuaa

SEQ ID NO: 2848567 - RNA, 14 nt, Human
gacauuuuacauua

SEQ ID NO: 2848568 - RNA, 13 nt, Human
gacauuuuacauu

SEQ ID NO: 2848569 - RNA, 19 nt, Human
gaccuccucccuguuauuu

SEQ ID NO: 2848570 - RNA, 20 nt, Human
gaccuccucuucccccuucc

SEQ ID NO: 2848571 - RNA, 13 nt, Human
gaccuccccagcc

SEQ ID NO: 2848572 - RNA, 14 nt, Human
gaccuccccagccc

SEQ ID NO: 2848573 - RNA, 16 nt, Human
gaccuccccagccccu

SEQ ID NO: 2848574 - RNA, 12 nt, Human
gaccuccugccu

SEQ ID NO: 2848575 - RNA, 14 nt, Human
gaccuccugccucc

SEQ ID NO: 2848576 - RNA, 14 nt, Human
gaccucauccaaac

SEQ ID NO: 2848577 - RNA, 12 nt, Human
gaccucccuucc

SEQ ID NO: 2848578 - RNA, 14 nt, Human
gaccucccuuccga

SEQ ID NO: 2848579 - RNA, 19 nt, Human
gaccucccuuccgacccuc

SEQ ID NO: 2848580 - RNA, 20 nt, Human
gaccucccuuccgacccucu

SEQ ID NO: 2848581 - RNA, 21 nt, Human
gaccucccuuccgacccucug

SEQ ID NO: 2848582 - RNA, 22 nt, Human
gaccucccuuccgacccucugg

SEQ ID NO: 2848583 - RNA, 23 nt, Human
gaccucccuuccgacccucuggg

SEQ ID NO: 2848584 - RNA, 13 nt, Human
gaccucugccuga

SEQ ID NO: 2848585 - RNA, 19 nt, Human
gaccucaggugauccgccc

SEQ ID NO: 2848586 - RNA, 12 nt, Human
gacgccacccag

SEQ ID NO: 2848587 - RNA, 11 nt, Human
gacgcccaccc

SEQ ID NO: 2848588 - RNA, 15 nt, Human
gacgcccucucccca

SEQ ID NO: 2848589 - RNA, 18 nt, Human
gacgcccucuccccaccc

SEQ ID NO: 2848590 - RNA, 23 nt, Human
gacgcccucuccccaccccuacc

SEQ ID NO: 2848591 - RNA, 21 nt, Human
gacgccggggacagaggccug

SEQ ID NO: 2848592 - RNA, 17 nt, Human
gacgccugagcucacuc

SEQ ID NO: 2848593 - RNA, 22 nt, Human
gacgccggggacagaggccugc

SEQ ID NO: 2848594 - RNA, 13 nt, Human
gacgccugagcuc

SEQ ID NO: 2848595 - RNA, 13 nt, Human
gacgccacccagc

SEQ ID NO: 2848596 - RNA, 14 nt, Human
gacgccacccagca

SEQ ID NO: 2848597 - RNA, 20 nt, Human
gacccggaggggccuggcag

SEQ ID NO: 2848598 - RNA, 18 nt, Human
gacccggaggggccuggc

SEQ ID NO: 2848599 - RNA, 19 nt, Human
gacccggaggggccuggca

SEQ ID NO: 2848600 - RNA, 16 nt, Human
gaccccugagcuugca

SEQ ID NO: 2848601 - RNA, 17 nt, Human
gaccccuccucacuggc

SEQ ID NO: 2848602 - RNA, 19 nt, Human
gaccccuccucacuggcca

SEQ ID NO: 2848603 - RNA, 23 nt, Human
gaccccuccucacuggccauccc

SEQ ID NO: 2848604 - RNA, 11 nt, Human
gaccccuccug

SEQ ID NO: 2848605 - RNA, 12 nt, Human
gaccccuccugg

SEQ ID NO: 2848606 - RNA, 13 nt, Human
gaccccuccuggg

SEQ ID NO: 2848607 - RNA, 14 nt, Human
gaccccuccugggg

SEQ ID NO: 2848608 - RNA, 16 nt, Human
gaccccuccuggggcc

SEQ ID NO: 2848609 - RNA, 17 nt, Human
gaccccuccuggggcca

SEQ ID NO: 2848610 - RNA, 19 nt, Human
gaccccuccuggggccagg

SEQ ID NO: 2848611 - RNA, 20 nt, Human
gaccccuccuggggccaggc

SEQ ID NO: 2848612 - RNA, 22 nt, Human
gaccccuccuggggccaggccg

SEQ ID NO: 2848613 - RNA, 23 nt, Human
gaccccuccuggggccaggccgg

SEQ ID NO: 2848614 - RNA, 17 nt, Human
gacccggaggggccugg

SEQ ID NO: 2848615 - RNA, 12 nt, Human
gaccccuccuca

SEQ ID NO: 2848616 - RNA, 13 nt, Human
gaccccuccucac

SEQ ID NO: 2848617 - RNA, 14 nt, Human
gaccccuccucacu

SEQ ID NO: 2848618 - RNA, 15 nt, Human
gaccccuccucacug

SEQ ID NO: 2848619 - RNA, 14 nt, Human
gacccucugccacc

SEQ ID NO: 2848620 - RNA, 20 nt, Human
gacccucugacccuagcucu

SEQ ID NO: 2848621 - RNA, 21 nt, Human
gacccugaaaagaaggacggg

SEQ ID NO: 2848622 - RNA, 15 nt, Human
gacccucugccacca

SEQ ID NO: 2848623 - RNA, 16 nt, Human
gacccucugccaccag

SEQ ID NO: 2848624 - RNA, 20 nt, Human
gacccucugccaccagagac

SEQ ID NO: 2848625 - RNA, 11 nt, Human
gacccucugcu

SEQ ID NO: 2848626 - RNA, 16 nt, Human
gacccucugcugaaga

SEQ ID NO: 2848627 - RNA, 17 nt, Human
gacccucugcugaagac

SEQ ID NO: 2848628 - RNA, 13 nt, Human
gacccucugggaa

SEQ ID NO: 2848629 - RNA, 14 nt, Human
gacccucugggaac

SEQ ID NO: 2848630 - RNA, 20 nt, Human
gacccucugggaaccuccca

SEQ ID NO: 2848631 - RNA, 21 nt, Human
gacccucugggaaccucccag

SEQ ID NO: 2848632 - RNA, 22 nt, Human
gacccucugggaaccucccaga

SEQ ID NO: 2848633 - RNA, 23 nt, Human
gacccucugggaaccucccagag

SEQ ID NO: 2848634 - RNA, 23 nt, Human
gaccucagguaaucgaccugccu

SEQ ID NO: 2848635 - RNA, 22 nt, Human
gaccucagguaaucgaccugcc

SEQ ID NO: 2848636 - RNA, 21 nt, Human
gaccucaggugauccacccac

SEQ ID NO: 2848637 - RNA, 20 nt, Human
gaccucaggugauccaccca

SEQ ID NO: 2848638 - RNA, 19 nt, Human
gaccucaggugauccaccc

SEQ ID NO: 2848639 - RNA, 12 nt, Human
cuggucucuggu

SEQ ID NO: 2848640 - RNA, 20 nt, Human
cuggucucuaggcuggggaa

SEQ ID NO: 2848641 - RNA, 14 nt, Human
cuggucucuaggcu

SEQ ID NO: 2848642 - RNA, 16 nt, Human
cuggucucuaggcugg

SEQ ID NO: 2848643 - RNA, 17 nt, Human
cuggucucuaggcuggg

SEQ ID NO: 2848644 - RNA, 18 nt, Human
cuggucucuaggcugggg

SEQ ID NO: 2848645 - RNA, 21 nt, Human
cuggucucgaacuccugaccu

SEQ ID NO: 2848646 - RNA, 15 nt, Human
cuguaacacagcuga

SEQ ID NO: 2848647 - RNA, 21 nt, Human
cuguaacacagcugagagacu

SEQ ID NO: 2848648 - RNA, 21 nt, Human
cuguaagacucauucccuaga

SEQ ID NO: 2848649 - RNA, 12 nt, Human
cuguaagacauu

SEQ ID NO: 2848650 - RNA, 16 nt, Human
cuguaagacauuagua

SEQ ID NO: 2848651 - RNA, 15 nt, Human
cuguaagaugucugu

SEQ ID NO: 2848652 - RNA, 16 nt, Human
cuguaagaugucuguu

SEQ ID NO: 2848653 - RNA, 18 nt, Human
cuguaagaugucuguuug

SEQ ID NO: 2848654 - RNA, 21 nt, Human
cuguaagaugucuguuugcug

SEQ ID NO: 2848655 - RNA, 22 nt, Human
cuguaagaugucuguuugcuga

SEQ ID NO: 2848656 - RNA, 14 nt, Human
cuguaagccaaaga

SEQ ID NO: 2848657 - RNA, 15 nt, Human
cuguaagccaaagaa

SEQ ID NO: 2848658 - RNA, 19 nt, Human
cuguaagccaaagaaauga

SEQ ID NO: 2848659 - RNA, 21 nt, Human
cuguaagccaaagaaaugaac

SEQ ID NO: 2848660 - RNA, 22 nt, Human
cuguaagccaaagaaaugaaca

SEQ ID NO: 2848661 - RNA, 23 nt, Human
cuguaagccaaagaaaugaacau

SEQ ID NO: 2848662 - RNA, 13 nt, Human
cuguaagccugca

SEQ ID NO: 2848663 - RNA, 16 nt, Human
cuguaagccugcaagc

SEQ ID NO: 2848664 - RNA, 17 nt, Human
cuguaagccugcaagcc

SEQ ID NO: 2848665 - RNA, 18 nt, Human
cuguaagccugcaagccu

SEQ ID NO: 2848666 - RNA, 13 nt, Human
cuguaagcuccuu

SEQ ID NO: 2848667 - RNA, 14 nt, Human
cuguaaauauguuu

SEQ ID NO: 2848668 - RNA, 12 nt, Human
cuguaaauacca

SEQ ID NO: 2848669 - RNA, 13 nt, Human
cuguaaauaccau

SEQ ID NO: 2848670 - RNA, 15 nt, Human
cuguaaauaccauug

SEQ ID NO: 2848671 - RNA, 16 nt, Human
cuguaaauaccauuga

SEQ ID NO: 2848672 - RNA, 16 nt, Human
cuguaaagcgcagaua

SEQ ID NO: 2848673 - RNA, 15 nt, Human
cuguaaagugccuua

SEQ ID NO: 2848674 - RNA, 19 nt, Human
cuguaaaaacacugaaaaa

SEQ ID NO: 2848675 - RNA, 20 nt, Human
cuguaaaaacacugaaaaau

SEQ ID NO: 2848676 - RNA, 22 nt, Human
cuguaaaaacacugaaaaauua

SEQ ID NO: 2848677 - RNA, 22 nt, Human
cuguacuugaagucuaaaagca

SEQ ID NO: 2848678 - RNA, 13 nt, Human
cuguagaugaugu

SEQ ID NO: 2848679 - RNA, 16 nt, Human
cuguagaugauguauu

SEQ ID NO: 2848680 - RNA, 18 nt, Human
cuguagauggaaaaacuu

SEQ ID NO: 2848681 - RNA, 13 nt, Human
cuguagauucugu

SEQ ID NO: 2848682 - RNA, 15 nt, Human
cuguagauucugugg

SEQ ID NO: 2848683 - RNA, 20 nt, Human
cuguagauucuguggaacaa

SEQ ID NO: 2848684 - RNA, 20 nt, Human
cuguagcagugagaaaaagc

SEQ ID NO: 2848685 - RNA, 21 nt, Human
cuguagcagugagaaaaagcu

SEQ ID NO: 2848686 - RNA, 17 nt, Human
cuguacuugaugacaga

SEQ ID NO: 2848687 - RNA, 13 nt, Human
cugguuuuaacaa

SEQ ID NO: 2848688 - RNA, 13 nt, Human
cugucggaggaaa

SEQ ID NO: 2848689 - RNA, 15 nt, Human
cugucggaggaaaga

SEQ ID NO: 2848690 - RNA, 17 nt, Human
cugucggaggaaagaca

SEQ ID NO: 2848691 - RNA, 15 nt, Human
cugucgggcuuugug

SEQ ID NO: 2848692 - RNA, 19 nt, Human
cugucgggcuuugugugaa

SEQ ID NO: 2848693 - RNA, 15 nt, Human
cugucgugauggggc

SEQ ID NO: 2848694 - RNA, 21 nt, Human
cugucgugauggggcaagggc

SEQ ID NO: 2848695 - RNA, 13 nt, Human
cugucuaaaaaac

SEQ ID NO: 2848696 - RNA, 16 nt, Human
cugucuaaaaaccaga

SEQ ID NO: 2848697 - RNA, 13 nt, Human
cugucuacaaaua

SEQ ID NO: 2848698 - RNA, 13 nt, Human
cugucuaacuuua

SEQ ID NO: 2848699 - RNA, 12 nt, Human
cuguccugugac

SEQ ID NO: 2848700 - RNA, 14 nt, Human
cuguccugugaggu

SEQ ID NO: 2848701 - RNA, 16 nt, Human
cuguccugugagguuu

SEQ ID NO: 2848702 - RNA, 20 nt, Human
cuguccugugagguuuccca

SEQ ID NO: 2848703 - RNA, 21 nt, Human
cuguccugugagguuucccaa

SEQ ID NO: 2848704 - RNA, 22 nt, Human
cuguccugugagguuucccaau

SEQ ID NO: 2848705 - RNA, 13 nt, Human
cuguccuugcccu

SEQ ID NO: 2848706 - RNA, 19 nt, Human
cuguccuugaaugccauag

SEQ ID NO: 2848707 - RNA, 16 nt, Human
cuguagcccacucugc

SEQ ID NO: 2848708 - RNA, 21 nt, Human
cuguagcccacucugcucgcc

SEQ ID NO: 2848709 - RNA, 20 nt, Human
cuguagcccacucugcucgc

SEQ ID NO: 2848710 - RNA, 15 nt, Human
cuguagccagcaccu

SEQ ID NO: 2848711 - RNA, 18 nt, Human
cuguagcuuguucccugu

SEQ ID NO: 2848712 - RNA, 14 nt, Human
cugucauuugagca

SEQ ID NO: 2848713 - RNA, 14 nt, Human
cugucaugcuucau

SEQ ID NO: 2848714 - RNA, 14 nt, Human
cugucauucaaaug

SEQ ID NO: 2848715 - RNA, 17 nt, Human
cugucauucaaaugggu

SEQ ID NO: 2848716 - RNA, 19 nt, Human
cugucauucaaauggguga

SEQ ID NO: 2848717 - RNA, 14 nt, Human
cugucaucuuucuu

SEQ ID NO: 2848718 - RNA, 18 nt, Human
cugucaugaaaucagcaa

SEQ ID NO: 2848719 - RNA, 20 nt, Human
cugucaugaaaucagcaaga

SEQ ID NO: 2848720 - RNA, 21 nt, Human
cugucaugaaaucagcaagag

SEQ ID NO: 2848721 - RNA, 14 nt, Human
cuguccugggagug

SEQ ID NO: 2848722 - RNA, 13 nt, Human
cuguccugggagu

SEQ ID NO: 2848723 - RNA, 20 nt, Human
cuguccugggagugagcugg

SEQ ID NO: 2848724 - RNA, 13 nt, Human
cuguccugcuucu

SEQ ID NO: 2848725 - RNA, 14 nt, Human
cuguccugcuucug

SEQ ID NO: 2848726 - RNA, 15 nt, Human
cuguccugcuucuga

SEQ ID NO: 2848727 - RNA, 13 nt, Human
cugugacacacua

SEQ ID NO: 2848728 - RNA, 14 nt, Human
cugugacacacuac

SEQ ID NO: 2848729 - RNA, 17 nt, Human
cugugacacacuacacc

SEQ ID NO: 2848730 - RNA, 21 nt, Human
cugugacacacuacaccacac

SEQ ID NO: 2848731 - RNA, 22 nt, Human
cugugacacacuacaccacaca

SEQ ID NO: 2848732 - RNA, 15 nt, Human
cugugaacugaaauu

SEQ ID NO: 2848733 - RNA, 22 nt, Human
cugugaacugaaauuaaaacua

SEQ ID NO: 2848734 - RNA, 15 nt, Human
cugugagcaagaagu

SEQ ID NO: 2848735 - RNA, 23 nt, Human
cugugagcaaggagcacaagcca

SEQ ID NO: 2848736 - RNA, 22 nt, Human
cugugagauggcuggcugguga

SEQ ID NO: 2848737 - RNA, 15 nt, Human
cugugcucuggacag

SEQ ID NO: 2848738 - RNA, 17 nt, Human
cugugcucuggacaggc

SEQ ID NO: 2848739 - RNA, 23 nt, Human
cugugaaguuuacauuguaaaua

SEQ ID NO: 2848740 - RNA, 18 nt, Human
cugugaaguuuacauugu

SEQ ID NO: 2848741 - RNA, 16 nt, Human
cugugaacugaacucu

SEQ ID NO: 2848742 - RNA, 15 nt, Human
cugugaacugaacuc

SEQ ID NO: 2848743 - RNA, 13 nt, Human
cugugaacugaac

SEQ ID NO: 2848744 - RNA, 19 nt, Human
cuguuagcuuuuuaaaaca

SEQ ID NO: 2848745 - RNA, 21 nt, Human
cuguuagcuuuuuaaaacauu

SEQ ID NO: 2848746 - RNA, 13 nt, Human
cuguuagcacugu

SEQ ID NO: 2848747 - RNA, 14 nt, Human
cuguuagcacuguu

SEQ ID NO: 2848748 - RNA, 15 nt, Human
cuguuagcacuguug

SEQ ID NO: 2848749 - RNA, 16 nt, Human
cuguuagcacuguuga

SEQ ID NO: 2848750 - RNA, 17 nt, Human
cuguuagcacuguugau

SEQ ID NO: 2848751 - RNA, 18 nt, Human
cuguuagcacuguugaug

SEQ ID NO: 2848752 - RNA, 20 nt, Human
cuguuagcacuguugaugua

SEQ ID NO: 2848753 - RNA, 15 nt, Human
cugugucauaaacag

SEQ ID NO: 2848754 - RNA, 23 nt, Human
cugugucauaaacagaugaauaa

SEQ ID NO: 2848755 - RNA, 17 nt, Human
cuguguccaccuguggg

SEQ ID NO: 2848756 - RNA, 22 nt, Human
cugugucagguggggcagcuug

SEQ ID NO: 2848757 - RNA, 15 nt, Human
cuguguauggaaaaa

SEQ ID NO: 2848758 - RNA, 19 nt, Human
cuguguauggaaaaaccau

SEQ ID NO: 2848759 - RNA, 19 nt, Human
cugugcucuggacaggcau

SEQ ID NO: 2848760 - RNA, 18 nt, Human
cugugcucuggacaggca

SEQ ID NO: 2848761 - RNA, 12 nt, Human
cuguguauauua

SEQ ID NO: 2848762 - RNA, 13 nt, Human
cuguguauauuau

SEQ ID NO: 2848763 - RNA, 15 nt, Human
cuguguauauuauuu

SEQ ID NO: 2848764 - RNA, 17 nt, Human
cuguguauauuauuugg

SEQ ID NO: 2848765 - RNA, 18 nt, Human
cuguguauauuauuuggc

SEQ ID NO: 2848766 - RNA, 19 nt, Human
cuguguauauuauuuggca

SEQ ID NO: 2848767 - RNA, 20 nt, Human
cuguguauauuauuuggcag

SEQ ID NO: 2848768 - RNA, 16 nt, Human
cuguuauauccccugc

SEQ ID NO: 2848769 - RNA, 18 nt, Human
cuguuauauccccugcua

SEQ ID NO: 2848770 - RNA, 15 nt, Human
cuguucagcuccagc

SEQ ID NO: 2848771 - RNA, 13 nt, Human
cuguucacucuac

SEQ ID NO: 2848772 - RNA, 14 nt, Human
cuguucagcuccag

SEQ ID NO: 2848773 - RNA, 22 nt, Human
cuguucagcuccagcucaccag

SEQ ID NO: 2848774 - RNA, 19 nt, Human
cuguucagcuccagcucac

SEQ ID NO: 2848775 - RNA, 18 nt, Human
cuguucagcuccagcuca

SEQ ID NO: 2848776 - RNA, 16 nt, Human
cuguucagcuccagcu

SEQ ID NO: 2848777 - RNA, 18 nt, Human
cuguuacuguuaaccauu

SEQ ID NO: 2848778 - RNA, 17 nt, Human
cuuaaaauaaacaguug

SEQ ID NO: 2848779 - RNA, 20 nt, Human
cuuaaaauaaacaguuguga

SEQ ID NO: 2848780 - RNA, 21 nt, Human
cuuaaaauaaacaguugugaa

SEQ ID NO: 2848781 - RNA, 23 nt, Human
cuuaaaauaaacaguugugaacc

SEQ ID NO: 2848782 - RNA, 15 nt, Human
cuuaaacaccccuca

SEQ ID NO: 2848783 - RNA, 13 nt, Human
cuuaaaauagaaa

SEQ ID NO: 2848784 - RNA, 22 nt, Human
cuuaaaauagcaacacucuaua

SEQ ID NO: 2848785 - RNA, 22 nt, Human
cuuaaaauaggggauauuuaag

SEQ ID NO: 2848786 - RNA, 18 nt, Human
cuuaaaauagaaauaagu

SEQ ID NO: 2848787 - RNA, 14 nt, Human
cuuaaacuugugaa

SEQ ID NO: 2848788 - RNA, 15 nt, Human
cuuaaacuugugaau

SEQ ID NO: 2848789 - RNA, 13 nt, Human
cuuaaagaaacag

SEQ ID NO: 2848790 - RNA, 16 nt, Human
cuuaaagaaacagcuu

SEQ ID NO: 2848791 - RNA, 17 nt, Human
cuuaaagaaacagcuuu

SEQ ID NO: 2848792 - RNA, 22 nt, Human
cuuaaagaaacagcuuucaagu

SEQ ID NO: 2848793 - RNA, 23 nt, Human
cuuaaagaaacagcuuucaagug

SEQ ID NO: 2848794 - RNA, 12 nt, Human
cuuaaagaaagu

SEQ ID NO: 2848795 - RNA, 21 nt, Human
cuuaaagaaagucgaauuaau

SEQ ID NO: 2848796 - RNA, 15 nt, Human
cuguuggccagugug

SEQ ID NO: 2848797 - RNA, 14 nt, Human
cuguuggcagugag

SEQ ID NO: 2848798 - RNA, 21 nt, Human
cuguuggcagugagugagccu

SEQ ID NO: 2848799 - RNA, 22 nt, Human
cuguuggcagugagugagccug

SEQ ID NO: 2848800 - RNA, 13 nt, Human
cuguugugccaca

SEQ ID NO: 2848801 - RNA, 15 nt, Human
cuguugugccacaga

SEQ ID NO: 2848802 - RNA, 16 nt, Human
cuguugugccacagag

SEQ ID NO: 2848803 - RNA, 23 nt, Human
cuguugugccacagaguguagcc

SEQ ID NO: 2848804 - RNA, 12 nt, Human
cuguuggccagu

SEQ ID NO: 2848805 - RNA, 18 nt, Human
cuguugcccaggcuggcg

SEQ ID NO: 2848806 - RNA, 20 nt, Human
cuguugcccuuucuguacca

SEQ ID NO: 2848807 - RNA, 18 nt, Human
cuguugcccuuucuguac

SEQ ID NO: 2848808 - RNA, 22 nt, Human
cuguugccuuuuucauuuucca

SEQ ID NO: 2848809 - RNA, 21 nt, Human
cuguugcccuuucuguaccau

SEQ ID NO: 2848810 - RNA, 18 nt, Human
cuguugcgugacacucuc

SEQ ID NO: 2848811 - RNA, 23 nt, Human
cuguugcgugacacucuccuugc

SEQ ID NO: 2848812 - RNA, 15 nt, Human
cuggaaaaaaugagc

SEQ ID NO: 2848813 - RNA, 24 nt, Human
cugcuuccaauuuucuggaauaca

SEQ ID NO: 2848814 - RNA, 23 nt, Human
cugcuucagccucccgaguagcu

SEQ ID NO: 2848815 - RNA, 19 nt, Human
cugcuucaguguauggaaa

SEQ ID NO: 2848816 - RNA, 21 nt, Human
cugcuucaguguauggaaaua

SEQ ID NO: 2848817 - RNA, 12 nt, Human
cugcuucagugg

SEQ ID NO: 2848818 - RNA, 22 nt, Human
cuggacuccucuguccaggcac

SEQ ID NO: 2848819 - RNA, 23 nt, Human
cuggacuccucuguccaggcacu

SEQ ID NO: 2848820 - RNA, 14 nt, Human
cuggacucuaaaga

SEQ ID NO: 2848821 - RNA, 18 nt, Human
cuggacucuaaagaccaa

SEQ ID NO: 2848822 - RNA, 19 nt, Human
cuggacucuaaagaccaaa

SEQ ID NO: 2848823 - RNA, 21 nt, Human
cuggacucuaaagaccaaacu

SEQ ID NO: 2848824 - RNA, 20 nt, Human
cuggacuccucuguccaggc

SEQ ID NO: 2848825 - RNA, 23 nt, Human
cuggaaaggcucagucucaggag

SEQ ID NO: 2848826 - RNA, 22 nt, Human
cuggaaaggcucagucucagga

SEQ ID NO: 2848827 - RNA, 21 nt, Human
cuggaaaggcucagucucagg

SEQ ID NO: 2848828 - RNA, 20 nt, Human
cuggaaaggcucagucucag

SEQ ID NO: 2848829 - RNA, 17 nt, Human
cuggaaaggcucagucu

SEQ ID NO: 2848830 - RNA, 15 nt, Human
cuggaaaggcucagu

SEQ ID NO: 2848831 - RNA, 14 nt, Human
cuggaaaggcucag

SEQ ID NO: 2848832 - RNA, 13 nt, Human
cuggaaaggcuca

SEQ ID NO: 2848833 - RNA, 19 nt, Human
cuggaaagcccccccuuau

SEQ ID NO: 2848834 - RNA, 14 nt, Human
cuggagaacuagag

SEQ ID NO: 2848835 - RNA, 15 nt, Human
cuggagaacuagaga

SEQ ID NO: 2848836 - RNA, 18 nt, Human
cuggaguggcucgccagg

SEQ ID NO: 2848837 - RNA, 20 nt, Human
cuggaguggcucgccaggcc

SEQ ID NO: 2848838 - RNA, 21 nt, Human
cuggaguggcucgccaggcca

SEQ ID NO: 2848839 - RNA, 13 nt, Human
cuggagugggcag

SEQ ID NO: 2848840 - RNA, 16 nt, Human
cuggagugggcagagc

SEQ ID NO: 2848841 - RNA, 19 nt, Human
cuggagaagacccuccccg

SEQ ID NO: 2848842 - RNA, 12 nt, Human
cuggagaagaga

SEQ ID NO: 2848843 - RNA, 14 nt, Human
cuggagaagagagg

SEQ ID NO: 2848844 - RNA, 17 nt, Human
cuggauccaucaggcca

SEQ ID NO: 2848845 - RNA, 18 nt, Human
cuggaguguggcugagga

SEQ ID NO: 2848846 - RNA, 19 nt, Human
cuggaguguggcugaggag

SEQ ID NO: 2848847 - RNA, 20 nt, Human
cuggaguguggcugaggagg

SEQ ID NO: 2848848 - RNA, 21 nt, Human
cuggaguguggcugaggaggc

SEQ ID NO: 2848849 - RNA, 22 nt, Human
cuggaguguggcugaggaggcc

SEQ ID NO: 2848850 - RNA, 19 nt, Human
cuggauccaucaggccacu

SEQ ID NO: 2848851 - RNA, 18 nt, Human
cuggauccccucugucua

SEQ ID NO: 2848852 - RNA, 23 nt, Human
cuggauccccucugucuacaaau

SEQ ID NO: 2848853 - RNA, 20 nt, Human
cuggaucuccauucucucag

SEQ ID NO: 2848854 - RNA, 13 nt, Human
cuggcagccgugc

SEQ ID NO: 2848855 - RNA, 15 nt, Human
cuggcucuguggcuu

SEQ ID NO: 2848856 - RNA, 14 nt, Human
cuggcucuguggcu

SEQ ID NO: 2848857 - RNA, 18 nt, Human
cuggcucuguggcuugcu

SEQ ID NO: 2848858 - RNA, 17 nt, Human
cugggacuacaggugug

SEQ ID NO: 2848859 - RNA, 21 nt, Human
cugggacuacaggcacccacc

SEQ ID NO: 2848860 - RNA, 17 nt, Human
cugggacuacaggcacc

SEQ ID NO: 2848861 - RNA, 15 nt, Human
cuggcagauucaaau

SEQ ID NO: 2848862 - RNA, 12 nt, Human
cuggcucccucu

SEQ ID NO: 2848863 - RNA, 17 nt, Human
cuggcagccgugccuuc

SEQ ID NO: 2848864 - RNA, 18 nt, Human
cuggcagccgugccuuca

SEQ ID NO: 2848865 - RNA, 22 nt, Human
cuggccgcguuuagaccaagga

SEQ ID NO: 2848866 - RNA, 13 nt, Human
cuggccgcccccu

SEQ ID NO: 2848867 - RNA, 14 nt, Human
cuggccgcccccug

SEQ ID NO: 2848868 - RNA, 22 nt, Human
cuggccgcccccugccccccag

SEQ ID NO: 2848869 - RNA, 19 nt, Human
cuggcccucgacacucacc

SEQ ID NO: 2848870 - RNA, 22 nt, Human
cuggcucccacaggcccuuccu

SEQ ID NO: 2848871 - RNA, 19 nt, Human
cuggcucccacaggcccuu

SEQ ID NO: 2848872 - RNA, 18 nt, Human
cuggcucccacaggcccu

SEQ ID NO: 2848873 - RNA, 13 nt, Human
cuggccggccagc

SEQ ID NO: 2848874 - RNA, 14 nt, Human
cuggccggccagcc

SEQ ID NO: 2848875 - RNA, 15 nt, Human
cuggccggccagcca

SEQ ID NO: 2848876 - RNA, 21 nt, Human
cuggccggccagccagccacu

SEQ ID NO: 2848877 - RNA, 22 nt, Human
cuggccggccagccagccacuc

SEQ ID NO: 2848878 - RNA, 23 nt, Human
cuggccggccagccagccacucu

SEQ ID NO: 2848879 - RNA, 24 nt, Human
cugccuccucuucaacugaccagc

SEQ ID NO: 2848880 - RNA, 13 nt, Human
cugccuccugccu

SEQ ID NO: 2848881 - RNA, 12 nt, Human
cugccuccugcc

SEQ ID NO: 2848882 - RNA, 19 nt, Human
cugccuccugccugccccu

SEQ ID NO: 2848883 - RNA, 15 nt, Human
cugccuccuggguuc

SEQ ID NO: 2848884 - RNA, 15 nt, Human
cugccuccugccugc

SEQ ID NO: 2848885 - RNA, 16 nt, Human
cugccuccugccugcc

SEQ ID NO: 2848886 - RNA, 17 nt, Human
cugccuccugccugccc

SEQ ID NO: 2848887 - RNA, 14 nt, Human
cugccucgaacugg

SEQ ID NO: 2848888 - RNA, 20 nt, Human
cugccucgaacuggcugcaa

SEQ ID NO: 2848889 - RNA, 19 nt, Human
cugccucgaacuggcugca

SEQ ID NO: 2848890 - RNA, 18 nt, Human
cugccucgaaacacagaa

SEQ ID NO: 2848891 - RNA, 15 nt, Human
cugccucgaaacaca

SEQ ID NO: 2848892 - RNA, 13 nt, Human
cugccucucacac

SEQ ID NO: 2848893 - RNA, 16 nt, Human
cugccucucacacaca

SEQ ID NO: 2848894 - RNA, 21 nt, Human
cugccucucacacacauagau

SEQ ID NO: 2848895 - RNA, 19 nt, Human
cugccucgaaacacagaaa

SEQ ID NO: 2848896 - RNA, 21 nt, Human
cugccuguaguuaggaaauaa

SEQ ID NO: 2848897 - RNA, 20 nt, Human
cugccuguaguuaggaaaua

SEQ ID NO: 2848898 - RNA, 19 nt, Human
cugccuguaguuaggaaau

SEQ ID NO: 2848899 - RNA, 18 nt, Human
cugccuguaguuaggaaa

SEQ ID NO: 2848900 - RNA, 16 nt, Human
cugccuguaguuagga

SEQ ID NO: 2848901 - RNA, 17 nt, Human
cugccuguaguuaggaa

SEQ ID NO: 2848902 - RNA, 22 nt, Human
cugccuguaguuaggaaauaaa

SEQ ID NO: 2848903 - RNA, 13 nt, Human
cugccuguauacu

SEQ ID NO: 2848904 - RNA, 17 nt, Human
cugccuguauacuuuag

SEQ ID NO: 2848905 - RNA, 19 nt, Human
cugccuguauacuuuagua

SEQ ID NO: 2848906 - RNA, 20 nt, Human
cugccuguauacuuuaguau

SEQ ID NO: 2848907 - RNA, 16 nt, Human
cugcuagcaaauggca

SEQ ID NO: 2848908 - RNA, 12 nt, Human
cugcuagaacuu

SEQ ID NO: 2848909 - RNA, 13 nt, Human
cugcuagaacuuu

SEQ ID NO: 2848910 - RNA, 14 nt, Human
cugcuagaacuuuu

SEQ ID NO: 2848911 - RNA, 15 nt, Human
cugcuagaacuuuuu

SEQ ID NO: 2848912 - RNA, 17 nt, Human
cugcuagaacuuuuuua

SEQ ID NO: 2848913 - RNA, 20 nt, Human
cugcuagaacuuuuuuaaau

SEQ ID NO: 2848914 - RNA, 21 nt, Human
cugcuagaacuuuuuuaaaua

SEQ ID NO: 2848915 - RNA, 22 nt, Human
cugcuagaacuuuuuuaaauaa

SEQ ID NO: 2848916 - RNA, 23 nt, Human
cugcuagaacuuuuuuaaauaaa

SEQ ID NO: 2848917 - RNA, 21 nt, Human
cugccuguugcgugacacucu

SEQ ID NO: 2848918 - RNA, 23 nt, Human
cugccuguugcgugacacucucc

SEQ ID NO: 2848919 - RNA, 19 nt, Human
cugccuguucccauucuug

SEQ ID NO: 2848920 - RNA, 15 nt, Human
cugccuguucccauu

SEQ ID NO: 2848921 - RNA, 23 nt, Human
cugccuguucagcuccagcucac

SEQ ID NO: 2848922 - RNA, 20 nt, Human
cugccuguucagcuccagcu

SEQ ID NO: 2848923 - RNA, 17 nt, Human
cugcuauuuauuuuccu

SEQ ID NO: 2848924 - RNA, 16 nt, Human
cugcuauccugccaaa

SEQ ID NO: 2848925 - RNA, 21 nt, Human
cugcuauuuauuuuccuaaag

SEQ ID NO: 2848926 - RNA, 20 nt, Human
cugcuauuuauuuuccuaaa

SEQ ID NO: 2848927 - RNA, 19 nt, Human
cugcuauuuauuuuccuaa

SEQ ID NO: 2848928 - RNA, 23 nt, Human
cugcccuggugcugccacacuuc

SEQ ID NO: 2848929 - RNA, 17 nt, Human
cugcccugguuuccugc

SEQ ID NO: 2848930 - RNA, 19 nt, Human
cugcccugguuuccugccc

SEQ ID NO: 2848931 - RNA, 18 nt, Human
cugcccugguuuccugcc

SEQ ID NO: 2848932 - RNA, 15 nt, Human
cugcccugguccagg

SEQ ID NO: 2848933 - RNA, 14 nt, Human
cugcccugguccag

SEQ ID NO: 2848934 - RNA, 21 nt, Human
cugcccugguccagggaagcu

SEQ ID NO: 2848935 - RNA, 20 nt, Human
cugcccugguccagggaagc

SEQ ID NO: 2848936 - RNA, 12 nt, Human
cugcccuggugc

SEQ ID NO: 2848937 - RNA, 13 nt, Human
cugcccuggugcu

SEQ ID NO: 2848938 - RNA, 14 nt, Human
cugcccuggugcug

SEQ ID NO: 2848939 - RNA, 23 nt, Human
cugcccugguccagggaagcugg

SEQ ID NO: 2848940 - RNA, 15 nt, Human
cugcccuggugcugc

SEQ ID NO: 2848941 - RNA, 22 nt, Human
cugcccccugguggacaguccu

SEQ ID NO: 2848942 - RNA, 14 nt, Human
cugcccccuggugg

SEQ ID NO: 2848943 - RNA, 13 nt, Human
cugcccccuggug

SEQ ID NO: 2848944 - RNA, 12 nt, Human
cugcccccuggu

SEQ ID NO: 2848945 - RNA, 15 nt, Human
cugcccccugcuggc

SEQ ID NO: 2848946 - RNA, 17 nt, Human
cugcccccugcuggcuc

SEQ ID NO: 2848947 - RNA, 19 nt, Human
cugcccccugcuggcucuu

SEQ ID NO: 2848948 - RNA, 19 nt, Human
cugcccccucugcccugcg

SEQ ID NO: 2848949 - RNA, 14 nt, Human
cugcccccugcugg

SEQ ID NO: 2848950 - RNA, 20 nt, Human
cugcccugguuuccugcccu

SEQ ID NO: 2848951 - RNA, 11 nt, Human
cugcccugugg

SEQ ID NO: 2848952 - RNA, 21 nt, Human
cugcccuucaccccaguggcc

SEQ ID NO: 2848953 - RNA, 16 nt, Human
cugcccuucaccccag

SEQ ID NO: 2848954 - RNA, 17 nt, Human
cugcccuucaccccagu

SEQ ID NO: 2848955 - RNA, 15 nt, Human
cugcccuuaggccac

SEQ ID NO: 2848956 - RNA, 20 nt, Human
cugcccugugggaccccagg

SEQ ID NO: 2848957 - RNA, 21 nt, Human
cugcccugugggaccccaggc

SEQ ID NO: 2848958 - RNA, 22 nt, Human
cugcccugugggaccccaggcc

SEQ ID NO: 2848959 - RNA, 16 nt, Human
cuugguguuaaaacac

SEQ ID NO: 2848960 - RNA, 17 nt, Human
cuugguguuaaaacacu

SEQ ID NO: 2848961 - RNA, 21 nt, Human
cuugguguuaaaacacuucug

SEQ ID NO: 2848962 - RNA, 21 nt, Human
cuugguuauuuguuuaccacu

SEQ ID NO: 2848963 - RNA, 15 nt, Human
cuugucucauuuuaa

SEQ ID NO: 2848964 - RNA, 18 nt, Human
cuugucucauuuuaaugu

SEQ ID NO: 2848965 - RNA, 19 nt, Human
cuugucucauuuuaaugua

SEQ ID NO: 2848966 - RNA, 23 nt, Human
cuugucucauuuuaauguaaaga

SEQ ID NO: 2848967 - RNA, 14 nt, Human
cuugguuggcuggc

SEQ ID NO: 2848968 - RNA, 17 nt, Human
cuugguucccuugugug

SEQ ID NO: 2848969 - RNA, 20 nt, Human
cuugucuggcaaaagaaaaa

SEQ ID NO: 2848970 - RNA, 18 nt, Human
cuugucuccuacuccuga

SEQ ID NO: 2848971 - RNA, 19 nt, Human
cuugucuccuacuccugac

SEQ ID NO: 2848972 - RNA, 20 nt, Human
cuugucuccuacuccugacu

SEQ ID NO: 2848973 - RNA, 22 nt, Human
cuuucacauuguuugcugcuau

SEQ ID NO: 2848974 - RNA, 24 nt, Human
cuuucacauuguuugcugcuauug

SEQ ID NO: 2848975 - RNA, 15 nt, Human
cuuucaccccagggc

SEQ ID NO: 2848976 - RNA, 21 nt, Human
cuuucaccccagggccugagc

SEQ ID NO: 2848977 - RNA, 16 nt, Human
cuuucaccccagggcc

SEQ ID NO: 2848978 - RNA, 16 nt, Human
cuuucacaaccuucug

SEQ ID NO: 2848979 - RNA, 15 nt, Human
cuuucacagcuccuc

SEQ ID NO: 2848980 - RNA, 18 nt, Human
cuuucacagcuccuccca

SEQ ID NO: 2848981 - RNA, 13 nt, Human
cuuucacagcucc

SEQ ID NO: 2848982 - RNA, 14 nt, Human
cuuucacagcuccu

SEQ ID NO: 2848983 - RNA, 20 nt, Human
cuuuaaugucacaggcaggu

SEQ ID NO: 2848984 - RNA, 19 nt, Human
cuuuaaugucacaggcagg

SEQ ID NO: 2848985 - RNA, 18 nt, Human
cuuuaaugucacaggcag

SEQ ID NO: 2848986 - RNA, 17 nt, Human
cuuuaaugucacaggca

SEQ ID NO: 2848987 - RNA, 22 nt, Human
cuuuaaugucacaggcaggucc

SEQ ID NO: 2848988 - RNA, 19 nt, Human
cuuuaauggacuuauuucu

SEQ ID NO: 2848989 - RNA, 22 nt, Human
cuuuaauggacuuauuucuuca

SEQ ID NO: 2848990 - RNA, 17 nt, Human
cuugucuuuucaaaaua

SEQ ID NO: 2848991 - RNA, 18 nt, Human
cuugucuuuucaaaauau

SEQ ID NO: 2848992 - RNA, 15 nt, Human
cuuuaagagagaaau

SEQ ID NO: 2848993 - RNA, 17 nt, Human
cuuuaagagagaaaucu

SEQ ID NO: 2848994 - RNA, 11 nt, Human
cuuuaagaaaa

SEQ ID NO: 2848995 - RNA, 12 nt, Human
cuuuaagaaaaa

SEQ ID NO: 2848996 - RNA, 15 nt, Human
cuuuaagcagagaag

SEQ ID NO: 2848997 - RNA, 12 nt, Human
cuuuaaggaaaa

SEQ ID NO: 2848998 - RNA, 17 nt, Human
cuuuaagggcaugccuu

SEQ ID NO: 2848999 - RNA, 14 nt, Human
cuuggcccuuuccu

SEQ ID NO: 2849000 - RNA, 20 nt, Human
cuuggcccuuuccuuccaga

SEQ ID NO: 2849001 - RNA, 15 nt, Human
cuuggcccuuuccuu

SEQ ID NO: 2849002 - RNA, 19 nt, Human
cuuggccggcugugcucag

SEQ ID NO: 2849003 - RNA, 20 nt, Human
cuuggccggcugugcucaga

SEQ ID NO: 2849004 - RNA, 21 nt, Human
cuuggccggcugugcucagag

SEQ ID NO: 2849005 - RNA, 22 nt, Human
cuuggccggcugugcucagaga

SEQ ID NO: 2849006 - RNA, 15 nt, Human
cuugccuccguguca

SEQ ID NO: 2849007 - RNA, 21 nt, Human
cuugccgcgucgcccucccag

SEQ ID NO: 2849008 - RNA, 18 nt, Human
cuugccgcgucgcccucc

SEQ ID NO: 2849009 - RNA, 13 nt, Human
cuugccgaggagc

SEQ ID NO: 2849010 - RNA, 15 nt, Human
cuugccgaggagcca

SEQ ID NO: 2849011 - RNA, 17 nt, Human
cuugccgaggagccagg

SEQ ID NO: 2849012 - RNA, 18 nt, Human
cuugccgaggagccaggc

SEQ ID NO: 2849013 - RNA, 20 nt, Human
cuugccgaggagccaggcaa

SEQ ID NO: 2849014 - RNA, 23 nt, Human
cuugccgcgucgcccucccaggc

SEQ ID NO: 2849015 - RNA, 13 nt, Human
cuugauucugcag

SEQ ID NO: 2849016 - RNA, 20 nt, Human
cuugauucugcaguaaaucu

SEQ ID NO: 2849017 - RNA, 17 nt, Human
cuugauucugcaguaaa

SEQ ID NO: 2849018 - RNA, 23 nt, Human
cuugauuggggaauuaaaaguca

SEQ ID NO: 2849019 - RNA, 17 nt, Human
cuugcccuuucccccca

SEQ ID NO: 2849020 - RNA, 22 nt, Human
cuugcccuuuccccccauguug

SEQ ID NO: 2849021 - RNA, 22 nt, Human
cuugauucugcaguaaaucuuu

SEQ ID NO: 2849022 - RNA, 21 nt, Human
cuugauucugcaguaaaucuu

SEQ ID NO: 2849023 - RNA, 18 nt, Human
cuugauuuaaacacacag

SEQ ID NO: 2849024 - RNA, 19 nt, Human
cuugauuuaaacacacaga

SEQ ID NO: 2849025 - RNA, 21 nt, Human
cuugauggcuccgaacacccu

SEQ ID NO: 2849026 - RNA, 14 nt, Human
cuuacagcugggug

SEQ ID NO: 2849027 - RNA, 22 nt, Human
cuuacagcuggguggcacugcc

SEQ ID NO: 2849028 - RNA, 22 nt, Human
cuuaaagaaagucgaauuaaua

SEQ ID NO: 2849029 - RNA, 23 nt, Human
cuuacagcuggguggcacugcca

SEQ ID NO: 2849030 - RNA, 16 nt, Human
cuuacauaauuuuuua

SEQ ID NO: 2849031 - RNA, 22 nt, Human
cuuacauaauuuuuuauucaag

SEQ ID NO: 2849032 - RNA, 22 nt, Human
cuuacauaguuuuaaacucauu

SEQ ID NO: 2849033 - RNA, 15 nt, Human
cuuccauauuuggaa

SEQ ID NO: 2849034 - RNA, 16 nt, Human
cuuccauauuuggaag

SEQ ID NO: 2849035 - RNA, 19 nt, Human
cuuccauauuuggaagaaa

SEQ ID NO: 2849036 - RNA, 20 nt, Human
cuuacauuagcaguuugcuu

SEQ ID NO: 2849037 - RNA, 17 nt, Human
cuuccaucccaaccagu

SEQ ID NO: 2849038 - RNA, 19 nt, Human
cuuccaucccaaccagugc

SEQ ID NO: 2849039 - RNA, 21 nt, Human
cuuccaucccaaccagugcca

SEQ ID NO: 2849040 - RNA, 22 nt, Human
cuuccaucccaaccagugccaa

SEQ ID NO: 2849041 - RNA, 14 nt, Human
cuuccaucccagga

SEQ ID NO: 2849042 - RNA, 17 nt, Human
cuuccaucccaggacac

SEQ ID NO: 2849043 - RNA, 16 nt, Human
cuuccaucccuacccc

SEQ ID NO: 2849044 - RNA, 15 nt, Human
cuuccaucccuaccc

SEQ ID NO: 2849045 - RNA, 14 nt, Human
cuuccaucccuacc

SEQ ID NO: 2849046 - RNA, 12 nt, Human
cuuccaucccua

SEQ ID NO: 2849047 - RNA, 19 nt, Human
cuuccaucccuacccccua

SEQ ID NO: 2849048 - RNA, 17 nt, Human
cuuccaucccuaccccc

SEQ ID NO: 2849049 - RNA, 16 nt, Human
cuuccaucucugacuu

SEQ ID NO: 2849050 - RNA, 22 nt, Human
cuuccaucccaggacaccacac

SEQ ID NO: 2849051 - RNA, 18 nt, Human
cuuccaucuuuccugaug

SEQ ID NO: 2849052 - RNA, 22 nt, Human
cuuccaucuuuccugauggcag

SEQ ID NO: 2849053 - RNA, 12 nt, Human
cuuccauuuaua

SEQ ID NO: 2849054 - RNA, 17 nt, Human
cuuccauuuuccuacag

SEQ ID NO: 2849055 - RNA, 18 nt, Human
cuucccaaggccuuaagc

SEQ ID NO: 2849056 - RNA, 17 nt, Human
cuucccaaguaagaggc

SEQ ID NO: 2849057 - RNA, 21 nt, Human
cuucccaaguaagaggcugga

SEQ ID NO: 2849058 - RNA, 23 nt, Human
cuucccaaguaagaggcuggagu

SEQ ID NO: 2849059 - RNA, 15 nt, Human
cuucccaaucagcac

SEQ ID NO: 2849060 - RNA, 17 nt, Human
cuucccaaucagcacug

SEQ ID NO: 2849061 - RNA, 18 nt, Human
cuucccaaucagcacuga

SEQ ID NO: 2849062 - RNA, 19 nt, Human
cuucccaaucagcacugaa

SEQ ID NO: 2849063 - RNA, 20 nt, Human
cuucccaaucagcacugaaa

SEQ ID NO: 2849064 - RNA, 21 nt, Human
cuucccaaucagcacugaaaa

SEQ ID NO: 2849065 - RNA, 22 nt, Human
cuucccaaucagcacugaaaau

SEQ ID NO: 2849066 - RNA, 13 nt, Human
cuucuugcauccu

SEQ ID NO: 2849067 - RNA, 18 nt, Human
cuucuugcauccuuccua

SEQ ID NO: 2849068 - RNA, 20 nt, Human
cuucuugcauccuuccuaua

SEQ ID NO: 2849069 - RNA, 22 nt, Human
cuucuugcauccuuccuauaac

SEQ ID NO: 2849070 - RNA, 12 nt, Human
cuucuugcccug

SEQ ID NO: 2849071 - RNA, 14 nt, Human
cuucuugcccuggg

SEQ ID NO: 2849072 - RNA, 12 nt, Human
cuucuucuccau

SEQ ID NO: 2849073 - RNA, 22 nt, Human
cuucuuagcuaucauugcuucc

SEQ ID NO: 2849074 - RNA, 22 nt, Human
cuucuuauggaauugauuugca

SEQ ID NO: 2849075 - RNA, 23 nt, Human
cuucuuauggaauugauuugcau

SEQ ID NO: 2849076 - RNA, 16 nt, Human
cuucuuauuauauaua

SEQ ID NO: 2849077 - RNA, 19 nt, Human
cuucuuauuauauauauaa

SEQ ID NO: 2849078 - RNA, 19 nt, Human
cuucuuauggaauugauuu

SEQ ID NO: 2849079 - RNA, 22 nt, Human
cuucucugcuccaccacauccu

SEQ ID NO: 2849080 - RNA, 21 nt, Human
cuucucugcuccaccacaucc

SEQ ID NO: 2849081 - RNA, 16 nt, Human
cuucucugcuccacca

SEQ ID NO: 2849082 - RNA, 15 nt, Human
cuucucugcuccacc

SEQ ID NO: 2849083 - RNA, 14 nt, Human
cuucucugcuccac

SEQ ID NO: 2849084 - RNA, 13 nt, Human
cuucucugcucca

SEQ ID NO: 2849085 - RNA, 12 nt, Human
cuucucugcucc

SEQ ID NO: 2849086 - RNA, 11 nt, Human
cuucucugcuc

SEQ ID NO: 2849087 - RNA, 19 nt, Human
cuucucugccuuugacauu

SEQ ID NO: 2849088 - RNA, 23 nt, Human
cuucucugccuuugacauuuaau

SEQ ID NO: 2849089 - RNA, 15 nt, Human
cuucugaaaugaaac

SEQ ID NO: 2849090 - RNA, 23 nt, Human
cuucugaaaugaaacaaauaauc

SEQ ID NO: 2849091 - RNA, 17 nt, Human
cuucuaccaugaacaga

SEQ ID NO: 2849092 - RNA, 18 nt, Human
cuucuacugagccuucag

SEQ ID NO: 2849093 - RNA, 13 nt, Human
cuucuaugaccca

SEQ ID NO: 2849094 - RNA, 20 nt, Human
cuucuaugacccagcauggg

SEQ ID NO: 2849095 - RNA, 23 nt, Human
cuucuauggacugguuguugcca

SEQ ID NO: 2849096 - RNA, 18 nt, Human
cuucuauguaggaaaaaa

SEQ ID NO: 2849097 - RNA, 22 nt, Human
cuucuauguaggaaaaaaauag

SEQ ID NO: 2849098 - RNA, 20 nt, Human
cuucuaauauauuuuuauau

SEQ ID NO: 2849099 - RNA, 16 nt, Human
cuucuaauaucauuca

SEQ ID NO: 2849100 - RNA, 15 nt, Human
cuuccucuucggccc

SEQ ID NO: 2849101 - RNA, 19 nt, Human
cuuccucuucggcccucag

SEQ ID NO: 2849102 - RNA, 20 nt, Human
cuuccucuucggcccucaga

SEQ ID NO: 2849103 - RNA, 14 nt, Human
cuuccucuggggcu

SEQ ID NO: 2849104 - RNA, 15 nt, Human
cuuccucuggggcuc

SEQ ID NO: 2849105 - RNA, 20 nt, Human
cuuccucuggggcucuaggg

SEQ ID NO: 2849106 - RNA, 12 nt, Human
cuuccucugcug

SEQ ID NO: 2849107 - RNA, 13 nt, Human
cuuccucugcuga

SEQ ID NO: 2849108 - RNA, 16 nt, Human
cuuccucuccacugcc

SEQ ID NO: 2849109 - RNA, 17 nt, Human
cuuccucuccacugccu

SEQ ID NO: 2849110 - RNA, 19 nt, Human
cuuccucuccacugccuuc

SEQ ID NO: 2849111 - RNA, 21 nt, Human
cuuccucuccacugccuucga

SEQ ID NO: 2849112 - RNA, 11 nt, Human
cuuccucugcu

SEQ ID NO: 2849113 - RNA, 15 nt, Human
cuuccucccucauuc

SEQ ID NO: 2849114 - RNA, 22 nt, Human
gaaacuguucccaccugcugga

SEQ ID NO: 2849115 - RNA, 21 nt, Human
gaaacuguucccaccugcugg

SEQ ID NO: 2849116 - RNA, 21 nt, Human
gaaacugucgguuugcuuuga

SEQ ID NO: 2849117 - RNA, 20 nt, Human
gaaacuguucccaccugcug

SEQ ID NO: 2849118 - RNA, 16 nt, Human
gaaacuugucacuugc

SEQ ID NO: 2849119 - RNA, 17 nt, Human
gaaacuugucacuugca

SEQ ID NO: 2849120 - RNA, 19 nt, Human
gaaacuugucacuugcaug

SEQ ID NO: 2849121 - RNA, 20 nt, Human
gaaacuugucacuugcaugu

SEQ ID NO: 2849122 - RNA, 21 nt, Human
gaaacuugucacuugcauguc

SEQ ID NO: 2849123 - RNA, 13 nt, Human
gaaacuuguuauu

SEQ ID NO: 2849124 - RNA, 15 nt, Human
gaaacuuguuauugu

SEQ ID NO: 2849125 - RNA, 16 nt, Human
gaaacuuguuauugug

SEQ ID NO: 2849126 - RNA, 17 nt, Human
gaaacuuguuauuguga

SEQ ID NO: 2849127 - RNA, 19 nt, Human
gaaacuuguuauugugaau

SEQ ID NO: 2849128 - RNA, 20 nt, Human
gaaacuuguuauugugaaug

SEQ ID NO: 2849129 - RNA, 12 nt, Human
gaaacuuuauac

SEQ ID NO: 2849130 - RNA, 19 nt, Human
gaaagacacugccugggcu

SEQ ID NO: 2849131 - RNA, 18 nt, Human
gaaagacacugccugggc

SEQ ID NO: 2849132 - RNA, 15 nt, Human
gaaagacacugccug

SEQ ID NO: 2849133 - RNA, 14 nt, Human
gaaagacacugccu

SEQ ID NO: 2849134 - RNA, 13 nt, Human
gaaagacacugcc

SEQ ID NO: 2849135 - RNA, 14 nt, Human
gaaagacaacacaa

SEQ ID NO: 2849136 - RNA, 18 nt, Human
gaaagacaccauuuaucu

SEQ ID NO: 2849137 - RNA, 13 nt, Human
gaaagaauauauu

SEQ ID NO: 2849138 - RNA, 15 nt, Human
gaaagaauauauuua

SEQ ID NO: 2849139 - RNA, 16 nt, Human
gaaagaauauauuuau

SEQ ID NO: 2849140 - RNA, 18 nt, Human
gaaagaauauauuuauuu

SEQ ID NO: 2849141 - RNA, 12 nt, Human
gaaagaauagaa

SEQ ID NO: 2849142 - RNA, 13 nt, Human
gaaagaauagaaa

SEQ ID NO: 2849143 - RNA, 14 nt, Human
gaaagaauagaaag

SEQ ID NO: 2849144 - RNA, 15 nt, Human
gaaagaauagaaaga

SEQ ID NO: 2849145 - RNA, 19 nt, Human
gaaagaauagaaagaaagu

SEQ ID NO: 2849146 - RNA, 18 nt, Human
gaaagaaguggggacaga

SEQ ID NO: 2849147 - RNA, 11 nt, Human
gaaagaaggaa

SEQ ID NO: 2849148 - RNA, 22 nt, Human
gaaagaacugucauguaaacau

SEQ ID NO: 2849149 - RNA, 19 nt, Human
gaaaucaaagagagaaaau

SEQ ID NO: 2849150 - RNA, 13 nt, Human
gaaauauuuugau

SEQ ID NO: 2849151 - RNA, 19 nt, Human
gaaauauuuugauaauaaa

SEQ ID NO: 2849152 - RNA, 20 nt, Human
gaaauauuuugauaauaaau

SEQ ID NO: 2849153 - RNA, 21 nt, Human
gaaauauuuugauaauaaauu

SEQ ID NO: 2849154 - RNA, 22 nt, Human
gaaauauuuugauaauaaauug

SEQ ID NO: 2849155 - RNA, 23 nt, Human
gaaauauuuugauaauaaauuga

SEQ ID NO: 2849156 - RNA, 21 nt, Human
gaaauauuuuuuaauuuaaag

SEQ ID NO: 2849157 - RNA, 21 nt, Human
gaaaguacuucuccacccugc

SEQ ID NO: 2849158 - RNA, 16 nt, Human
gaaagguuuacauugu

SEQ ID NO: 2849159 - RNA, 13 nt, Human
gaaagguuuugga

SEQ ID NO: 2849160 - RNA, 14 nt, Human
gaaagguuuacauu

SEQ ID NO: 2849161 - RNA, 14 nt, Human
gaaagguucugccc

SEQ ID NO: 2849162 - RNA, 15 nt, Human
gaaagguucugcccg

SEQ ID NO: 2849163 - RNA, 13 nt, Human
gaaagguucugcc

SEQ ID NO: 2849164 - RNA, 20 nt, Human
gaaagacacugccugggcug

SEQ ID NO: 2849165 - RNA, 14 nt, Human
gaaagacaucuuuc

SEQ ID NO: 2849166 - RNA, 17 nt, Human
gaaagacaucuuucucu

SEQ ID NO: 2849167 - RNA, 16 nt, Human
gaaagacagcuucuca

SEQ ID NO: 2849168 - RNA, 17 nt, Human
gaaagacagcuucucau

SEQ ID NO: 2849169 - RNA, 23 nt, Human
gaaaucaagucaucuauaguuga

SEQ ID NO: 2849170 - RNA, 13 nt, Human
gaaaugaaauuua

SEQ ID NO: 2849171 - RNA, 17 nt, Human
gaaaugaaauuuaaaca

SEQ ID NO: 2849172 - RNA, 19 nt, Human
gaaaugaaauuuaaacauu

SEQ ID NO: 2849173 - RNA, 12 nt, Human
gaaaugaacauu

SEQ ID NO: 2849174 - RNA, 13 nt, Human
gaaaugaacauuc

SEQ ID NO: 2849175 - RNA, 14 nt, Human
gaaaugaacauucc

SEQ ID NO: 2849176 - RNA, 15 nt, Human
gaaaugaacauucca

SEQ ID NO: 2849177 - RNA, 16 nt, Human
gaaaugaacauuccaa

SEQ ID NO: 2849178 - RNA, 13 nt, Human
gaaauuuuuauca

SEQ ID NO: 2849179 - RNA, 24 nt, Human
gaaauuuugcaaauauaaacaucu

SEQ ID NO: 2849180 - RNA, 13 nt, Human
gaacaacugauac

SEQ ID NO: 2849181 - RNA, 16 nt, Human
gaaaucaaugcaagag

SEQ ID NO: 2849182 - RNA, 18 nt, Human
gaaaagacuuguaauauu

SEQ ID NO: 2849183 - RNA, 14 nt, Human
gaaaagagaagaag

SEQ ID NO: 2849184 - RNA, 15 nt, Human
gaaaagagaagaaga

SEQ ID NO: 2849185 - RNA, 16 nt, Human
gaaaagagaagaagaa

SEQ ID NO: 2849186 - RNA, 19 nt, Human
gaaaagagaagaagaaaaa

SEQ ID NO: 2849187 - RNA, 13 nt, Human
gaaaacuuauuuu

SEQ ID NO: 2849188 - RNA, 11 nt, Human
gaaaacuguua

SEQ ID NO: 2849189 - RNA, 23 nt, Human
gaaaacuguuaccuaaaguauuu

SEQ ID NO: 2849190 - RNA, 17 nt, Human
gaaaacuggaauaagaa

SEQ ID NO: 2849191 - RNA, 19 nt, Human
gaaaacugcaacuuguaaa

SEQ ID NO: 2849192 - RNA, 20 nt, Human
gaaaacugaaaaucuaauau

SEQ ID NO: 2849193 - RNA, 18 nt, Human
gaaaacugaaaaucuaau

SEQ ID NO: 2849194 - RNA, 16 nt, Human
gaaaacugaaaaucua

SEQ ID NO: 2849195 - RNA, 17 nt, Human
gaaaacucauuacuuuu

SEQ ID NO: 2849196 - RNA, 13 nt, Human
gaaaacuauacaa

SEQ ID NO: 2849197 - RNA, 14 nt, Human
gaaaacuauacaac

SEQ ID NO: 2849198 - RNA, 18 nt, Human
gaaaacuccaccuuccca

SEQ ID NO: 2849199 - RNA, 18 nt, Human
gaaaacucccauuuacgu

SEQ ID NO: 2849200 - RNA, 19 nt, Human
gaaaaaaugauguucauuu

SEQ ID NO: 2849201 - RNA, 18 nt, Human
gaaaagagagcagagaau

SEQ ID NO: 2849202 - RNA, 21 nt, Human
gaaaagagagcagagaauaua

SEQ ID NO: 2849203 - RNA, 17 nt, Human
gaaaagcagcucucccc

SEQ ID NO: 2849204 - RNA, 14 nt, Human
gaaaagcagcucuc

SEQ ID NO: 2849205 - RNA, 10 nt, Human
gaaaagcaua

SEQ ID NO: 2849206 - RNA, 19 nt, Human
gaaaagcauacaugcaaaa

SEQ ID NO: 2849207 - RNA, 18 nt, Human
gaaaagcggacaucagcu

SEQ ID NO: 2849208 - RNA, 20 nt, Human
gaaaauguuuuucugccagg

SEQ ID NO: 2849209 - RNA, 18 nt, Human
gaaaauuaggauuucaug

SEQ ID NO: 2849210 - RNA, 20 nt, Human
gaaaagcggacaucagcugg

SEQ ID NO: 2849211 - RNA, 21 nt, Human
gaaaauguugagaaucccaaa

SEQ ID NO: 2849212 - RNA, 20 nt, Human
gaaaauguugagaaucccaa

SEQ ID NO: 2849213 - RNA, 12 nt, Human
gaaacaaacuuu

SEQ ID NO: 2849214 - RNA, 23 nt, Human
gaaacaaaaacacuaaaaauaaa

SEQ ID NO: 2849215 - RNA, 19 nt, Human
gaaacaaaaacacuaaaaa

SEQ ID NO: 2849216 - RNA, 14 nt, Human
gaaacaaaaacacu

SEQ ID NO: 2849217 - RNA, 16 nt, Human
gaaaauuuuuguagua

SEQ ID NO: 2849218 - RNA, 13 nt, Human
gaaaauuuuugua

SEQ ID NO: 2849219 - RNA, 19 nt, Human
gaaaauuuuaaaaauacau

SEQ ID NO: 2849220 - RNA, 20 nt, Human
gaaaauuuuaaaaauacaua

SEQ ID NO: 2849221 - RNA, 21 nt, Human
gaaaauuuuaaaaauacauau

SEQ ID NO: 2849222 - RNA, 19 nt, Human
gaaaauuuuaccagcagaa

SEQ ID NO: 2849223 - RNA, 20 nt, Human
gaaaauuuuaccagcagaag

SEQ ID NO: 2849224 - RNA, 12 nt, Human
cuuuuguuacug

SEQ ID NO: 2849225 - RNA, 13 nt, Human
cuuuuguuacugu

SEQ ID NO: 2849226 - RNA, 14 nt, Human
cuuuuguuacuguu

SEQ ID NO: 2849227 - RNA, 15 nt, Human
cuuuuguuacuguuc

SEQ ID NO: 2849228 - RNA, 16 nt, Human
cuuuuguuacuguucu

SEQ ID NO: 2849229 - RNA, 17 nt, Human
cuuuuguuacuguucuu

SEQ ID NO: 2849230 - RNA, 18 nt, Human
cuuuuguuacuguucuug

SEQ ID NO: 2849231 - RNA, 21 nt, Human
cuuuuuuuggugauucaaaug

SEQ ID NO: 2849232 - RNA, 15 nt, Human
cuuuuuuuucuuuaa

SEQ ID NO: 2849233 - RNA, 14 nt, Human
cuuuuuuuucuuua

SEQ ID NO: 2849234 - RNA, 17 nt, Human
cuuuuguguaaugaaaa

SEQ ID NO: 2849235 - RNA, 17 nt, Human
cuuuugugugaauugac

SEQ ID NO: 2849236 - RNA, 19 nt, Human
cuuuugugugaauugacua

SEQ ID NO: 2849237 - RNA, 15 nt, Human
cuuuuguuaaauaau

SEQ ID NO: 2849238 - RNA, 18 nt, Human
cuuuuguuaaauaauaug

SEQ ID NO: 2849239 - RNA, 10 nt, Human
cuuuuguuac

SEQ ID NO: 2849240 - RNA, 11 nt, Human
cuuuuguuacu

SEQ ID NO: 2849241 - RNA, 16 nt, Human
cuuuuguguaaugaaa

SEQ ID NO: 2849242 - RNA, 16 nt, Human
cuuuugucuaauuaaa

SEQ ID NO: 2849243 - RNA, 17 nt, Human
cuuuugucauguggcua

SEQ ID NO: 2849244 - RNA, 17 nt, Human
gaaaaaaaaaaaagagg

SEQ ID NO: 2849245 - RNA, 18 nt, Human
gaaaaaaaaaaaagagga

SEQ ID NO: 2849246 - RNA, 21 nt, Human
gaaaaaaaaaaaagaggaaaa

SEQ ID NO: 2849247 - RNA, 22 nt, Human
gaaaaaaaaaaaagaggaaaac

SEQ ID NO: 2849248 - RNA, 18 nt, Human
cuuuuuuuuuuuuuuggu

SEQ ID NO: 2849249 - RNA, 19 nt, Human
cuuuuuuuuuuuuuuggua

SEQ ID NO: 2849250 - RNA, 15 nt, Human
cuuuuuuuuguaugu

SEQ ID NO: 2849251 - RNA, 18 nt, Human
cuuuugugccuggcuucu

SEQ ID NO: 2849252 - RNA, 15 nt, Human
gaaaaaaaaacagcu

SEQ ID NO: 2849253 - RNA, 23 nt, Human
cuuuuuuuuuuuuuaaagacaga

SEQ ID NO: 2849254 - RNA, 16 nt, Human
gaaaaaaaaaagaaga

SEQ ID NO: 2849255 - RNA, 17 nt, Human
gaaaaaaaaaagaagaa

SEQ ID NO: 2849256 - RNA, 18 nt, Human
gaaaaaaaaaagaagaag

SEQ ID NO: 2849257 - RNA, 19 nt, Human
gaaaaaaaaaagaagaaga

SEQ ID NO: 2849258 - RNA, 12 nt, Human
cuuuuguauaca

SEQ ID NO: 2849259 - RNA, 19 nt, Human
cuuuuguauacauccuggg

SEQ ID NO: 2849260 - RNA, 23 nt, Human
cuuuuguauacauccuggguaau

SEQ ID NO: 2849261 - RNA, 15 nt, Human
cuuuugguguguugg

SEQ ID NO: 2849262 - RNA, 17 nt, Human
cuuuugguguguuggac

SEQ ID NO: 2849263 - RNA, 18 nt, Human
cuuuugguguguuggaca

SEQ ID NO: 2849264 - RNA, 19 nt, Human
cuuuugguguguuggacag

SEQ ID NO: 2849265 - RNA, 20 nt, Human
cuuuugguguguuggacaga

SEQ ID NO: 2849266 - RNA, 17 nt, Human
cuuuugucuaugggacu

SEQ ID NO: 2849267 - RNA, 16 nt, Human
cuuuuggucuguguga

SEQ ID NO: 2849268 - RNA, 15 nt, Human
cuuuuggucugugug

SEQ ID NO: 2849269 - RNA, 14 nt, Human
cuuuuggucucccu

SEQ ID NO: 2849270 - RNA, 15 nt, Human
cuuuugcuacuaagu

SEQ ID NO: 2849271 - RNA, 23 nt, Human
cuuuugcuacuaaguucacauua

SEQ ID NO: 2849272 - RNA, 14 nt, Human
cuuuugcuuuauuc

SEQ ID NO: 2849273 - RNA, 22 nt, Human
cuuuugcucuuagcugucugcu

SEQ ID NO: 2849274 - RNA, 16 nt, Human
cuuuuauuguauaaac

SEQ ID NO: 2849275 - RNA, 13 nt, Human
cuuuuauuguaua

SEQ ID NO: 2849276 - RNA, 19 nt, Human
cuuuuauuguauaaacuau

SEQ ID NO: 2849277 - RNA, 13 nt, Human
cuuuuauguuuga

SEQ ID NO: 2849278 - RNA, 14 nt, Human
cuuuuauguuugaa

SEQ ID NO: 2849279 - RNA, 15 nt, Human
cuuuuauguuugaau

SEQ ID NO: 2849280 - RNA, 16 nt, Human
cuuuuauguuugaaua

SEQ ID NO: 2849281 - RNA, 17 nt, Human
cuuuuauguuugaauau

SEQ ID NO: 2849282 - RNA, 18 nt, Human
cuuuuauguuugaauaug

SEQ ID NO: 2849283 - RNA, 22 nt, Human
cuuuuauguuugaauauggaca

SEQ ID NO: 2849284 - RNA, 23 nt, Human
cuuuuauguuugaauauggacaa

SEQ ID NO: 2849285 - RNA, 18 nt, Human
cuuuuauucauuagcugu

SEQ ID NO: 2849286 - RNA, 18 nt, Human
cuuuuauugacacagaaa

SEQ ID NO: 2849287 - RNA, 17 nt, Human
cuuuuauugacacagaa

SEQ ID NO: 2849288 - RNA, 16 nt, Human
aaggggacccccgccc

SEQ ID NO: 2849289 - RNA, 20 nt, Human
aaggggacccccgcccccug

SEQ ID NO: 2849290 - RNA, 16 nt, Human
aaggggagaagggaau

SEQ ID NO: 2849291 - RNA, 14 nt, Human
aagggcuuacuauu

SEQ ID NO: 2849292 - RNA, 15 nt, Human
aagggcuuacuauuu

SEQ ID NO: 2849293 - RNA, 12 nt, Human
aaggggacaggc

SEQ ID NO: 2849294 - RNA, 15 nt, Human
aaggggacaggccuc

SEQ ID NO: 2849295 - RNA, 16 nt, Human
aaggggacaggccuca

SEQ ID NO: 2849296 - RNA, 16 nt, Human
aagggcuauguaaaua

SEQ ID NO: 2849297 - RNA, 17 nt, Human
aagggcugaccugccuc

SEQ ID NO: 2849298 - RNA, 18 nt, Human
aagggcugaccugccucu

SEQ ID NO: 2849299 - RNA, 21 nt, Human
aaggcugugcugcccugaaga

SEQ ID NO: 2849300 - RNA, 17 nt, Human
aaggcugugcugcccug

SEQ ID NO: 2849301 - RNA, 22 nt, Human
aaggcugugcucccugguucug

SEQ ID NO: 2849302 - RNA, 13 nt, Human
aaggcuguuugcu

SEQ ID NO: 2849303 - RNA, 16 nt, Human
aaggcugugcucccug

SEQ ID NO: 2849304 - RNA, 12 nt, Human
aaguaaaugcua

SEQ ID NO: 2849305 - RNA, 23 nt, Human
aagguuuuagguucuaaaguucu

SEQ ID NO: 2849306 - RNA, 15 nt, Human
aagguuuuagguucu

SEQ ID NO: 2849307 - RNA, 16 nt, Human
aagguuuuagguucua

SEQ ID NO: 2849308 - RNA, 17 nt, Human
aagguuuuagguucuaa

SEQ ID NO: 2849309 - RNA, 19 nt, Human
aagguuuuagguucuaaag

SEQ ID NO: 2849310 - RNA, 20 nt, Human
aagguuuuagguucuaaagu

SEQ ID NO: 2849311 - RNA, 15 nt, Human
aaguaacuuuauucu

SEQ ID NO: 2849312 - RNA, 19 nt, Human
aaguaacuuuauucuugaa

SEQ ID NO: 2849313 - RNA, 21 nt, Human
aaguaacuuuauucuugaaag

SEQ ID NO: 2849314 - RNA, 21 nt, Human
aaguaacucauuuguuaaaau

SEQ ID NO: 2849315 - RNA, 14 nt, Human
aaguaacucauuug

SEQ ID NO: 2849316 - RNA, 12 nt, Human
aaguaacucauu

SEQ ID NO: 2849317 - RNA, 16 nt, Human
aaguaacucauuuguu

SEQ ID NO: 2849318 - RNA, 15 nt, Human
aaguaacauaacuag

SEQ ID NO: 2849319 - RNA, 15 nt, Human
aaguaacgcaauaaa

SEQ ID NO: 2849320 - RNA, 22 nt, Human
aagguauuaaauugauguugcu

SEQ ID NO: 2849321 - RNA, 18 nt, Human
aagguauuaaauugaugu

SEQ ID NO: 2849322 - RNA, 12 nt, Human
aagguuuuaagu

SEQ ID NO: 2849323 - RNA, 21 nt, Human
aagguuucguuucuguauaca

SEQ ID NO: 2849324 - RNA, 22 nt, Human
aagguuucguuucuguauacaa

SEQ ID NO: 2849325 - RNA, 23 nt, Human
aagguuucagaaagaagugggga

SEQ ID NO: 2849326 - RNA, 16 nt, Human
aagguuucguuucugu

SEQ ID NO: 2849327 - RNA, 15 nt, Human
aagggggaggggaag

SEQ ID NO: 2849328 - RNA, 18 nt, Human
aagggggaggggaagucc

SEQ ID NO: 2849329 - RNA, 18 nt, Human
aagguagcuuaccugaca

SEQ ID NO: 2849330 - RNA, 20 nt, Human
aagguagcuuaccugacaca

SEQ ID NO: 2849331 - RNA, 18 nt, Human
aagggggggcuacauuau

SEQ ID NO: 2849332 - RNA, 19 nt, Human
aagggggggcuacauuaua

SEQ ID NO: 2849333 - RNA, 20 nt, Human
aagggggggcuacauuauaa

SEQ ID NO: 2849334 - RNA, 18 nt, Human
guuuaugagaugcugguu

SEQ ID NO: 2849335 - RNA, 21 nt, Human
guuuaugagaugcugguuuuc

SEQ ID NO: 2849336 - RNA, 17 nt, Human
guuuaauagagaaggaa

SEQ ID NO: 2849337 - RNA, 14 nt, Human
guuuauuagaugaa

SEQ ID NO: 2849338 - RNA, 18 nt, Human
guuuauuauaaacuguau

SEQ ID NO: 2849339 - RNA, 23 nt, Human
guuuauggccucagcugccucac

SEQ ID NO: 2849340 - RNA, 22 nt, Human
guuuauggccucagcugccuca

SEQ ID NO: 2849341 - RNA, 18 nt, Human
guuuauggccucagcugc

SEQ ID NO: 2849342 - RNA, 15 nt, Human
guuuauggccucagc

SEQ ID NO: 2849343 - RNA, 14 nt, Human
guuuauggccucag

SEQ ID NO: 2849344 - RNA, 13 nt, Human
guuuauggccuca

SEQ ID NO: 2849345 - RNA, 17 nt, Human
guuuaugcaaggaagga

SEQ ID NO: 2849346 - RNA, 21 nt, Human
guuuaugauaauaaaggcacc

SEQ ID NO: 2849347 - RNA, 18 nt, Human
guuuauggccacauuuaa

SEQ ID NO: 2849348 - RNA, 23 nt, Human
guuuauggccacauuuaauaucu

SEQ ID NO: 2849349 - RNA, 21 nt, Human
guuuauugaguuuguagguaa

SEQ ID NO: 2849350 - RNA, 18 nt, Human
guuucaaggcacucuaga

SEQ ID NO: 2849351 - RNA, 23 nt, Human
guuucaaccaagucaugugcauu

SEQ ID NO: 2849352 - RNA, 19 nt, Human
guuucaaagaugcugugag

SEQ ID NO: 2849353 - RNA, 20 nt, Human
guuucaaagaugcugugagu

SEQ ID NO: 2849354 - RNA, 15 nt, Human
guuuauucuucuaga

SEQ ID NO: 2849355 - RNA, 16 nt, Human
guuuauucuucuagag

SEQ ID NO: 2849356 - RNA, 19 nt, Human
guuuauucuucuagaguuc

SEQ ID NO: 2849357 - RNA, 20 nt, Human
guuuauucuucuagaguuca

SEQ ID NO: 2849358 - RNA, 20 nt, Human
guuguuuuuuccuuugcucu

SEQ ID NO: 2849359 - RNA, 15 nt, Human
guuucaauucagugc

SEQ ID NO: 2849360 - RNA, 13 nt, Human
guuucaaugugau

SEQ ID NO: 2849361 - RNA, 14 nt, Human
guuucaaucacugu

SEQ ID NO: 2849362 - RNA, 15 nt, Human
guuucaaucacuguc

SEQ ID NO: 2849363 - RNA, 19 nt, Human
guuucaaugugauucuaau

SEQ ID NO: 2849364 - RNA, 21 nt, Human
guuucaaugugauucuaaugu

SEQ ID NO: 2849365 - RNA, 19 nt, Human
guuucaaggcacucuagau

SEQ ID NO: 2849366 - RNA, 23 nt, Human
guuucaaggcacucuagauucca

SEQ ID NO: 2849367 - RNA, 16 nt, Human
guuucacccuuaaccc

SEQ ID NO: 2849368 - RNA, 21 nt, Human
guuucacccuuaacccaagga

SEQ ID NO: 2849369 - RNA, 22 nt, Human
guuucacccuuaacccaaggag

SEQ ID NO: 2849370 - RNA, 22 nt, Human
guuucaccaugauggccaggcu

SEQ ID NO: 2849371 - RNA, 14 nt, Human
guuuaaagagucua

SEQ ID NO: 2849372 - RNA, 17 nt, Human
guuuaaagagucuagau

SEQ ID NO: 2849373 - RNA, 18 nt, Human
guuuaaagagucuagauu

SEQ ID NO: 2849374 - RNA, 19 nt, Human
guuuaaagagucuagauuc

SEQ ID NO: 2849375 - RNA, 14 nt, Human
aaggaaaacugcau

SEQ ID NO: 2849376 - RNA, 16 nt, Human
aaggaaaacugcaugg

SEQ ID NO: 2849377 - RNA, 17 nt, Human
aaggaaaacugcaugga

SEQ ID NO: 2849378 - RNA, 13 nt, Human
aaggaaaagaaaa

SEQ ID NO: 2849379 - RNA, 14 nt, Human
aaggaaaagaaaaa

SEQ ID NO: 2849380 - RNA, 15 nt, Human
aaggaaaagaaaaaa

SEQ ID NO: 2849381 - RNA, 16 nt, Human
aaggaaaagaaaaaaa

SEQ ID NO: 2849382 - RNA, 12 nt, Human
aaggaaaaagcu

SEQ ID NO: 2849383 - RNA, 13 nt, Human
aaggaaaaagcuc

SEQ ID NO: 2849384 - RNA, 14 nt, Human
aaggaaaaagcucc

SEQ ID NO: 2849385 - RNA, 15 nt, Human
aaggaaaaagcucca

SEQ ID NO: 2849386 - RNA, 23 nt, Human
aaggaaaaagcuccaugugccuc

SEQ ID NO: 2849387 - RNA, 17 nt, Human
aaggaaaaauaaauauu

SEQ ID NO: 2849388 - RNA, 12 nt, Human
guuguuugcaug

SEQ ID NO: 2849389 - RNA, 21 nt, Human
aaggaaaccgccuaguuuacu

SEQ ID NO: 2849390 - RNA, 12 nt, Human
aaggaaacucuu

SEQ ID NO: 2849391 - RNA, 13 nt, Human
aaggaaacucuua

SEQ ID NO: 2849392 - RNA, 18 nt, Human
aaggaaaaccugaagacu

SEQ ID NO: 2849393 - RNA, 16 nt, Human
aaggaaacgcuaccuc

SEQ ID NO: 2849394 - RNA, 16 nt, Human
aaggaaacucuuaucu

SEQ ID NO: 2849395 - RNA, 19 nt, Human
aaggaaacucuuaucucag

SEQ ID NO: 2849396 - RNA, 19 nt, Human
aaguauguguaaaauguga

SEQ ID NO: 2849397 - RNA, 18 nt, Human
aaguacuacacauuuuua

SEQ ID NO: 2849398 - RNA, 14 nt, Human
aaguacuguaauaa

SEQ ID NO: 2849399 - RNA, 19 nt, Human
aaguacuguaauaauaccu

SEQ ID NO: 2849400 - RNA, 20 nt, Human
aaguacuguaauaauaccuc

SEQ ID NO: 2849401 - RNA, 21 nt, Human
aaguacuguaauaauaccuca

SEQ ID NO: 2849402 - RNA, 22 nt, Human
aaguacuguaauaauaccucaa

SEQ ID NO: 2849403 - RNA, 18 nt, Human
aaguacuucuccacccug

SEQ ID NO: 2849404 - RNA, 20 nt, Human
aaguacuucuccacccugcu

SEQ ID NO: 2849405 - RNA, 19 nt, Human
aaguacuucuccacccugc

SEQ ID NO: 2849406 - RNA, 19 nt, Human
guuuugauuuguacugaaa

SEQ ID NO: 2849407 - RNA, 13 nt, Human
aaguaauuaugca

SEQ ID NO: 2849408 - RNA, 16 nt, Human
aaguaauuaugcacua

SEQ ID NO: 2849409 - RNA, 19 nt, Human
aaguaauuaugcacuaaau

SEQ ID NO: 2849410 - RNA, 14 nt, Human
aaguaaugccucug

SEQ ID NO: 2849411 - RNA, 15 nt, Human
aaguaaugccucugu

SEQ ID NO: 2849412 - RNA, 17 nt, Human
aaguaaugccucugucu

SEQ ID NO: 2849413 - RNA, 13 nt, Human
aaguaauguggaa

SEQ ID NO: 2849414 - RNA, 14 nt, Human
aaguaauguggaag

SEQ ID NO: 2849415 - RNA, 14 nt, Human
aaguaauuccucuc

SEQ ID NO: 2849416 - RNA, 18 nt, Human
aaguacacaauaagcaaa

SEQ ID NO: 2849417 - RNA, 17 nt, Human
aaguacacaauaagcaa

SEQ ID NO: 2849418 - RNA, 16 nt, Human
aaguacacaauaagca

SEQ ID NO: 2849419 - RNA, 19 nt, Human
aaguacaaacuaaggugcu

SEQ ID NO: 2849420 - RNA, 21 nt, Human
aaguacaauaauucauauucu

SEQ ID NO: 2849421 - RNA, 18 nt, Human
aaguacaauguguuuuuc

SEQ ID NO: 2849422 - RNA, 19 nt, Human
aaguacaauguguuuuucu

SEQ ID NO: 2849423 - RNA, 19 nt, Human
aaguacacaauaagcaaaa

SEQ ID NO: 2849424 - RNA, 20 nt, Human
aagucacuuacuauuguugc

SEQ ID NO: 2849425 - RNA, 14 nt, Human
aagucacugcacag

SEQ ID NO: 2849426 - RNA, 20 nt, Human
aagucagacugcugggacug

SEQ ID NO: 2849427 - RNA, 17 nt, Human
aagucagacugcuggga

SEQ ID NO: 2849428 - RNA, 16 nt, Human
aagucagacugcuggg

SEQ ID NO: 2849429 - RNA, 19 nt, Human
aaguauuuuuauaaauaua

SEQ ID NO: 2849430 - RNA, 21 nt, Human
aaguauuuuuauaaauauaag

SEQ ID NO: 2849431 - RNA, 18 nt, Human
aagucaaaauauuuuuaa

SEQ ID NO: 2849432 - RNA, 21 nt, Human
aagucaaaauauuuuuaaaag

SEQ ID NO: 2849433 - RNA, 22 nt, Human
aagucaaaauauuuuuaaaaga

SEQ ID NO: 2849434 - RNA, 14 nt, Human
aagucaaaguaaaa

SEQ ID NO: 2849435 - RNA, 22 nt, Human
aagucaaaguaaaacuugcugc

SEQ ID NO: 2849436 - RNA, 22 nt, Human
aagucacugcacagugcaucuc

SEQ ID NO: 2849437 - RNA, 14 nt, Human
aaguacuguuuacc

SEQ ID NO: 2849438 - RNA, 19 nt, Human
aaguacuguuuaccauuuu

SEQ ID NO: 2849439 - RNA, 20 nt, Human
aaguacuguuuaccauuuuu

SEQ ID NO: 2849440 - RNA, 11 nt, Human
aaguauuuuga

SEQ ID NO: 2849441 - RNA, 14 nt, Human
aaguauuuugaagu

SEQ ID NO: 2849442 - RNA, 15 nt, Human
aaguauuuugaaguu

SEQ ID NO: 2849443 - RNA, 16 nt, Human
aaguauuuugaaguuu

SEQ ID NO: 2849444 - RNA, 19 nt, Human
aaguauuuugaaguuuaca

SEQ ID NO: 2849445 - RNA, 20 nt, Human
aaguauuuugaaguuuacau

SEQ ID NO: 2849446 - RNA, 21 nt, Human
aaguauuuugaaguuuacauu

SEQ ID NO: 2849447 - RNA, 22 nt, Human
aaguauuuugaaguuuacauuu

SEQ ID NO: 2849448 - RNA, 23 nt, Human
aaguauuuugaaguuuacauuuu

SEQ ID NO: 2849449 - RNA, 18 nt, Human
aaguauuuuguguuugga

SEQ ID NO: 2849450 - RNA, 12 nt, Human
aaguauuguaaa

SEQ ID NO: 2849451 - RNA, 13 nt, Human
aaguauuguaaau

SEQ ID NO: 2849452 - RNA, 14 nt, Human
aaguauuguaaauu

SEQ ID NO: 2849453 - RNA, 15 nt, Human
aaguauuguaaauua

SEQ ID NO: 2849454 - RNA, 17 nt, Human
aaguauuguaaauuaua

SEQ ID NO: 2849455 - RNA, 20 nt, Human
aaguauuguaaauuauauuu

SEQ ID NO: 2849456 - RNA, 21 nt, Human
aaguauuguaaauuauauuug

SEQ ID NO: 2849457 - RNA, 22 nt, Human
aaguauuguaaauuauauuugu

SEQ ID NO: 2849458 - RNA, 13 nt, Human
guuuggagacaga

SEQ ID NO: 2849459 - RNA, 21 nt, Human
guuuggacugcagaagcaagg

SEQ ID NO: 2849460 - RNA, 23 nt, Human
guuuggacuuuguauacuuuaaa

SEQ ID NO: 2849461 - RNA, 20 nt, Human
guuugcuuuguaugcacuuu

SEQ ID NO: 2849462 - RNA, 17 nt, Human
guuuggaagauccugug

SEQ ID NO: 2849463 - RNA, 14 nt, Human
guuuuaaacucauu

SEQ ID NO: 2849464 - RNA, 12 nt, Human
guuuuaaauucu

SEQ ID NO: 2849465 - RNA, 13 nt, Human
guuuuaaauucug

SEQ ID NO: 2849466 - RNA, 14 nt, Human
guuuuaaauucuga

SEQ ID NO: 2849467 - RNA, 16 nt, Human
guuuuaaauucugaga

SEQ ID NO: 2849468 - RNA, 22 nt, Human
guuuuaaauacgcacuacaugu

SEQ ID NO: 2849469 - RNA, 13 nt, Human
guuuuaaauguac

SEQ ID NO: 2849470 - RNA, 14 nt, Human
guuuuaaauguaca

SEQ ID NO: 2849471 - RNA, 15 nt, Human
guuuuaaauguacag

SEQ ID NO: 2849472 - RNA, 22 nt, Human
guuuuaaauguacagacauauu

SEQ ID NO: 2849473 - RNA, 16 nt, Human
guuuuaaauguacagu

SEQ ID NO: 2849474 - RNA, 18 nt, Human
guuuggauucuuauguag

SEQ ID NO: 2849475 - RNA, 16 nt, Human
guuuggauguaauuua

SEQ ID NO: 2849476 - RNA, 21 nt, Human
guuuggaggagcaaaggcuga

SEQ ID NO: 2849477 - RNA, 16 nt, Human
guuugcugauggucug

SEQ ID NO: 2849478 - RNA, 12 nt, Human
guuugcugcuau

SEQ ID NO: 2849479 - RNA, 17 nt, Human
guuugcuucauaaauga

SEQ ID NO: 2849480 - RNA, 16 nt, Human
guuugcuucauaaaug

SEQ ID NO: 2849481 - RNA, 14 nt, Human
guuugcuuguuucu

SEQ ID NO: 2849482 - RNA, 17 nt, Human
guuugcuuguuucuugg

SEQ ID NO: 2849483 - RNA, 13 nt, Human
guuugcugugaac

SEQ ID NO: 2849484 - RNA, 21 nt, Human
guuuuaacaaaugcuauuaaa

SEQ ID NO: 2849485 - RNA, 22 nt, Human
guuuuaacaauuuccuuuauau

SEQ ID NO: 2849486 - RNA, 20 nt, Human
guuuuaaccgcacaugcaca

SEQ ID NO: 2849487 - RNA, 18 nt, Human
guuuuaaguuguuugcau

SEQ ID NO: 2849488 - RNA, 14 nt, Human
guuuuaaucugaaa

SEQ ID NO: 2849489 - RNA, 16 nt, Human
guuuuaaucugaaauu

SEQ ID NO: 2849490 - RNA, 18 nt, Human
guuuuaaucugaaauucu

SEQ ID NO: 2849491 - RNA, 19 nt, Human
guuuuaaucugaaauucua

SEQ ID NO: 2849492 - RNA, 20 nt, Human
guuuuaaucugaaauucuaa

SEQ ID NO: 2849493 - RNA, 21 nt, Human
guuuuaaucugaaauucuaaa

SEQ ID NO: 2849494 - RNA, 12 nt, Human
guuuuaauguau

SEQ ID NO: 2849495 - RNA, 17 nt, Human
guuuuaaguuguuugca

SEQ ID NO: 2849496 - RNA, 16 nt, Human
guuuuaaguacuacac

SEQ ID NO: 2849497 - RNA, 22 nt, Human
guuuuaagugaaagugaggaaa

SEQ ID NO: 2849498 - RNA, 20 nt, Human
guuuuaauuccaauaugaug

SEQ ID NO: 2849499 - RNA, 23 nt, Human
guuuuaauuccaauaugaugacu

SEQ ID NO: 2849500 - RNA, 20 nt, Human
guuuuauuccuguauguugu

SEQ ID NO: 2849501 - RNA, 14 nt, Human
guuuuauuccugua

SEQ ID NO: 2849502 - RNA, 21 nt, Human
guuuuauuauuucuauuaaau

SEQ ID NO: 2849503 - RNA, 14 nt, Human
guuuuauucauugg

SEQ ID NO: 2849504 - RNA, 19 nt, Human
guuuuaugagauggaucac

SEQ ID NO: 2849505 - RNA, 22 nt, Human
guuuuaugagauggaucacaua

SEQ ID NO: 2849506 - RNA, 21 nt, Human
guuuuaauuuaaacaccuccu

SEQ ID NO: 2849507 - RNA, 14 nt, Human
guuuuaauuuaaac

SEQ ID NO: 2849508 - RNA, 19 nt, Human
guuuuauauuuuuauagac

SEQ ID NO: 2849509 - RNA, 11 nt, Human
guuuuaucaag

SEQ ID NO: 2849510 - RNA, 14 nt, Human
guuuuaucaugaca

SEQ ID NO: 2849511 - RNA, 22 nt, Human
guuuuaucaugacauguuauau

SEQ ID NO: 2849512 - RNA, 14 nt, Human
guuuuauuuuaugu

SEQ ID NO: 2849513 - RNA, 17 nt, Human
guuuuauuuuauguuua

SEQ ID NO: 2849514 - RNA, 21 nt, Human
guuuugauguuuguggccuca

SEQ ID NO: 2849515 - RNA, 14 nt, Human
guuuugauaugagu

SEQ ID NO: 2849516 - RNA, 15 nt, Human
guuuugauaugagua

SEQ ID NO: 2849517 - RNA, 16 nt, Human
guuuugauaugaguau

SEQ ID NO: 2849518 - RNA, 19 nt, Human
guuuugaugacuggcauuu

SEQ ID NO: 2849519 - RNA, 22 nt, Human
guuuugaguagauauuacuuua

SEQ ID NO: 2849520 - RNA, 23 nt, Human
guuuugauguuuguggccucaga

SEQ ID NO: 2849521 - RNA, 22 nt, Human
guuuugauguuuguggccucag

SEQ ID NO: 2849522 - RNA, 16 nt, Human
guuuugagaguaaugc

SEQ ID NO: 2849523 - RNA, 15 nt, Human
guuuugaaggcaaaa

SEQ ID NO: 2849524 - RNA, 21 nt, Human
guuuugaaggcaaaauugcaa

SEQ ID NO: 2849525 - RNA, 18 nt, Human
guuuugaauauuacuccu

SEQ ID NO: 2849526 - RNA, 17 nt, Human
guuuugacaucagccag

SEQ ID NO: 2849527 - RNA, 18 nt, Human
guuuugacaucagccagc

SEQ ID NO: 2849528 - RNA, 21 nt, Human
uaaaauggugaagaacuagca

SEQ ID NO: 2849529 - RNA, 16 nt, Human
uaaaaugguuuguccu

SEQ ID NO: 2849530 - RNA, 18 nt, Human
uaaaaugguuuguccuga

SEQ ID NO: 2849531 - RNA, 17 nt, Human
aaguuugaaggaaacag

SEQ ID NO: 2849532 - RNA, 11 nt, Human
uaaaaugugaa

SEQ ID NO: 2849533 - RNA, 14 nt, Human
uaaaaugucuucaa

SEQ ID NO: 2849534 - RNA, 13 nt, Human
uaaaauguauuuu

SEQ ID NO: 2849535 - RNA, 14 nt, Human
uaaaauguauuuuu

SEQ ID NO: 2849536 - RNA, 17 nt, Human
uaaaauguauuuuucua

SEQ ID NO: 2849537 - RNA, 14 nt, Human
uaaaauguaagauu

SEQ ID NO: 2849538 - RNA, 13 nt, Human
uaaaaugugaagu

SEQ ID NO: 2849539 - RNA, 17 nt, Human
uaaaaugugauguucua

SEQ ID NO: 2849540 - RNA, 19 nt, Human
uaaaaugugauguucuaag

SEQ ID NO: 2849541 - RNA, 20 nt, Human
uaaaaugugauguucuaagg

SEQ ID NO: 2849542 - RNA, 21 nt, Human
uaaaaugugauguucuaaggc

SEQ ID NO: 2849543 - RNA, 13 nt, Human
uaaaaugugcagu

SEQ ID NO: 2849544 - RNA, 22 nt, Human
uaaaaugugauguucuaaggcu

SEQ ID NO: 2849545 - RNA, 14 nt, Human
uaaaauguguugaa

SEQ ID NO: 2849546 - RNA, 15 nt, Human
uaaaauguguugaaa

SEQ ID NO: 2849547 - RNA, 18 nt, Human
uaaaauguguugaaacug

SEQ ID NO: 2849548 - RNA, 19 nt, Human
uaaaauguguugaaacugc

SEQ ID NO: 2849549 - RNA, 14 nt, Human
uaaaauuauuugca

SEQ ID NO: 2849550 - RNA, 18 nt, Human
uaaaauugcuauguuacu

SEQ ID NO: 2849551 - RNA, 23 nt, Human
uaaaauugcuauguuacuauuuu

SEQ ID NO: 2849552 - RNA, 16 nt, Human
aaguuuccuuggcugg

SEQ ID NO: 2849553 - RNA, 20 nt, Human
aaguuuccuuggcuggugca

SEQ ID NO: 2849554 - RNA, 11 nt, Human
aaguuucuaag

SEQ ID NO: 2849555 - RNA, 17 nt, Human
aaguuuccuuggcuggu

SEQ ID NO: 2849556 - RNA, 18 nt, Human
aaguuuccuuggcuggug

SEQ ID NO: 2849557 - RNA, 12 nt, Human
aaguuucuaaga

SEQ ID NO: 2849558 - RNA, 13 nt, Human
aaguuucuaagau

SEQ ID NO: 2849559 - RNA, 15 nt, Human
aaguuucuaagauuc

SEQ ID NO: 2849560 - RNA, 16 nt, Human
aaguuucuaagauucu

SEQ ID NO: 2849561 - RNA, 21 nt, Human
aaguuucuaagauucuaaagg

SEQ ID NO: 2849562 - RNA, 17 nt, Human
aaguuucuaagauucua

SEQ ID NO: 2849563 - RNA, 18 nt, Human
aaguuucuaagauucuaa

SEQ ID NO: 2849564 - RNA, 19 nt, Human
aaguuucuaagauucuaaa

SEQ ID NO: 2849565 - RNA, 20 nt, Human
aaguuucuaagauucuaaag

SEQ ID NO: 2849566 - RNA, 13 nt, Human
aaguuucucagau

SEQ ID NO: 2849567 - RNA, 22 nt, Human
aaguuucucagauccuuguuuc

SEQ ID NO: 2849568 - RNA, 23 nt, Human
aaguuucucagauccuuguuuca

SEQ ID NO: 2849569 - RNA, 11 nt, Human
aaguucacaaa

SEQ ID NO: 2849570 - RNA, 17 nt, Human
aaguucacaaaauggug

SEQ ID NO: 2849571 - RNA, 14 nt, Human
aaguucagaguuuu

SEQ ID NO: 2849572 - RNA, 16 nt, Human
aaguucagaguuuucu

SEQ ID NO: 2849573 - RNA, 19 nt, Human
aaguuccaguguucucucu

SEQ ID NO: 2849574 - RNA, 19 nt, Human
aaguuccaugggauacaac

SEQ ID NO: 2849575 - RNA, 12 nt, Human
aaguuucccuuc

SEQ ID NO: 2849576 - RNA, 14 nt, Human
aaguuucccuuccu

SEQ ID NO: 2849577 - RNA, 21 nt, Human
aaguuuccuaaucagaaauuu

SEQ ID NO: 2849578 - RNA, 12 nt, Human
aaguuuccauau

SEQ ID NO: 2849579 - RNA, 18 nt, Human
aaguuuccauauguuaua

SEQ ID NO: 2849580 - RNA, 20 nt, Human
aaguuuccauagcaacagga

SEQ ID NO: 2849581 - RNA, 11 nt, Human
aaguuccuucc

SEQ ID NO: 2849582 - RNA, 14 nt, Human
aaguuccuuugggu

SEQ ID NO: 2849583 - RNA, 14 nt, Human
aaguucccuacuuc

SEQ ID NO: 2849584 - RNA, 17 nt, Human
aaguucccuacuuccug

SEQ ID NO: 2849585 - RNA, 14 nt, Human
aaguuccucuagug

SEQ ID NO: 2849586 - RNA, 20 nt, Human
aaguucccuacuuccuguga

SEQ ID NO: 2849587 - RNA, 15 nt, Human
aagugccaaaugcuc

SEQ ID NO: 2849588 - RNA, 17 nt, Human
aagugccaaaugcucuc

SEQ ID NO: 2849589 - RNA, 13 nt, Human
aagugcauuucug

SEQ ID NO: 2849590 - RNA, 14 nt, Human
aagugcauuucuga

SEQ ID NO: 2849591 - RNA, 22 nt, Human
aagugcauuucugaauagaaau

SEQ ID NO: 2849592 - RNA, 23 nt, Human
aagugcauuucugaauagaaaug

SEQ ID NO: 2849593 - RNA, 21 nt, Human
aagugccacucauuccuguag

SEQ ID NO: 2849594 - RNA, 20 nt, Human
aagugccacucauuccugua

SEQ ID NO: 2849595 - RNA, 17 nt, Human
aagugugaacaaaagau

SEQ ID NO: 2849596 - RNA, 16 nt, Human
aagugucucugccuug

SEQ ID NO: 2849597 - RNA, 17 nt, Human
aagugucucugccuuga

SEQ ID NO: 2849598 - RNA, 21 nt, Human
aagugccagucuugugucugc

SEQ ID NO: 2849599 - RNA, 12 nt, Human
aagugcccccuc

SEQ ID NO: 2849600 - RNA, 14 nt, Human
aagugcccccuccc

SEQ ID NO: 2849601 - RNA, 12 nt, Human
aagugucauguu

SEQ ID NO: 2849602 - RNA, 13 nt, Human
aagugucauguuu

SEQ ID NO: 2849603 - RNA, 16 nt, Human
aagugucaccuuuucu

SEQ ID NO: 2849604 - RNA, 23 nt, Human
aagugucaccuuuucuugccuga

SEQ ID NO: 2849605 - RNA, 23 nt, Human
aaguguguggucccaaguuggaa

SEQ ID NO: 2849606 - RNA, 20 nt, Human
aagugugucaaaucaauaaa

SEQ ID NO: 2849607 - RNA, 20 nt, Human
aagugugcacguugcuucag

SEQ ID NO: 2849608 - RNA, 11 nt, Human
aaguguuacuu

SEQ ID NO: 2849609 - RNA, 11 nt, Human
aaguuaagaau

SEQ ID NO: 2849610 - RNA, 21 nt, Human
aaguguguuuccuucagugca

SEQ ID NO: 2849611 - RNA, 17 nt, Human
aaguguguuuccuucag

SEQ ID NO: 2849612 - RNA, 17 nt, Human
aaguguguguggcagca

SEQ ID NO: 2849613 - RNA, 13 nt, Human
aaguuagcucagg

SEQ ID NO: 2849614 - RNA, 14 nt, Human
aaguuaauaagcaa

SEQ ID NO: 2849615 - RNA, 12 nt, Human
aaguuaauagau

SEQ ID NO: 2849616 - RNA, 18 nt, Human
aaguuaagagaaacuuua

SEQ ID NO: 2849617 - RNA, 19 nt, Human
aaguuaagagaaacuuuau

SEQ ID NO: 2849618 - RNA, 20 nt, Human
aaguuaagagaaacuuuaua

SEQ ID NO: 2849619 - RNA, 21 nt, Human
aaguuaagagaaacuuuauac

SEQ ID NO: 2849620 - RNA, 22 nt, Human
aaguuaagagaaacuuuauaca

SEQ ID NO: 2849621 - RNA, 23 nt, Human
aaguuaagaauguucuuauguug

SEQ ID NO: 2849622 - RNA, 16 nt, Human
aaguuaaugcuuaaga

SEQ ID NO: 2849623 - RNA, 21 nt, Human
aaguuaaugcuuaagagggaa

SEQ ID NO: 2849624 - RNA, 23 nt, Human
aaguuagugcuuguucuaagauu

SEQ ID NO: 2849625 - RNA, 15 nt, Human
aaguuauaagacucu

SEQ ID NO: 2849626 - RNA, 15 nt, Human
aaguuagcucaggag

SEQ ID NO: 2849627 - RNA, 14 nt, Human
aaguuagcucagga

SEQ ID NO: 2849628 - RNA, 11 nt, Human
aaguuauugua

SEQ ID NO: 2849629 - RNA, 12 nt, Human
aaguuauuguac

SEQ ID NO: 2849630 - RNA, 20 nt, Human
aaguuauuguacagcuguuu

SEQ ID NO: 2849631 - RNA, 12 nt, Human
aaguuauauuuc

SEQ ID NO: 2849632 - RNA, 13 nt, Human
aaguuauauuuca

SEQ ID NO: 2849633 - RNA, 14 nt, Human
aaguuauauuucag

SEQ ID NO: 2849634 - RNA, 17 nt, Human
aaguuauauuucagaug

SEQ ID NO: 2849635 - RNA, 23 nt, Human
aaguuauauuucagauguaaugu

SEQ ID NO: 2849636 - RNA, 14 nt, Human
aaguuauaagacuc

SEQ ID NO: 2849637 - RNA, 24 nt, Human
uaaaauaacuaguguugcuuggac

SEQ ID NO: 2849638 - RNA, 15 nt, Human
uaaaagugaucuaca

SEQ ID NO: 2849639 - RNA, 17 nt, Human
uaaaagugcacaccuua

SEQ ID NO: 2849640 - RNA, 18 nt, Human
uaaaagugaaugaaagau

SEQ ID NO: 2849641 - RNA, 19 nt, Human
uaaaagugaaugaaagauu

SEQ ID NO: 2849642 - RNA, 23 nt, Human
uaaaagugaaugaaagauuaaac

SEQ ID NO: 2849643 - RNA, 15 nt, Human
uaaaagucacaaugu

SEQ ID NO: 2849644 - RNA, 22 nt, Human
uaaaagucacaauguucuuuau

SEQ ID NO: 2849645 - RNA, 23 nt, Human
uaaaagucacaauguucuuuaua

SEQ ID NO: 2849646 - RNA, 21 nt, Human
uaaaagucauuuaacugaaga

SEQ ID NO: 2849647 - RNA, 19 nt, Human
uaaaagugggcuugauucu

SEQ ID NO: 2849648 - RNA, 16 nt, Human
uaaaauaaacaguugu

SEQ ID NO: 2849649 - RNA, 17 nt, Human
uaaaauaaacaguugug

SEQ ID NO: 2849650 - RNA, 21 nt, Human
uaaaauaacuaguguugcuug

SEQ ID NO: 2849651 - RNA, 17 nt, Human
uaaaauaaaguauauau

SEQ ID NO: 2849652 - RNA, 13 nt, Human
uaaaauaaaguau

SEQ ID NO: 2849653 - RNA, 17 nt, Human
uaaaagaauauucagag

SEQ ID NO: 2849654 - RNA, 15 nt, Human
uaaaagaaaccacuu

SEQ ID NO: 2849655 - RNA, 16 nt, Human
uaaaacuuugcugcca

SEQ ID NO: 2849656 - RNA, 16 nt, Human
uaaaacuuuucugcug

SEQ ID NO: 2849657 - RNA, 15 nt, Human
uaaaagaaauuuauu

SEQ ID NO: 2849658 - RNA, 18 nt, Human
uaaaagaacuuacugauu

SEQ ID NO: 2849659 - RNA, 19 nt, Human
uaaaagaacuuacugauua

SEQ ID NO: 2849660 - RNA, 20 nt, Human
aagugauucuccugccucag

SEQ ID NO: 2849661 - RNA, 16 nt, Human
aagugauucucaugcc

SEQ ID NO: 2849662 - RNA, 13 nt, Human
aagugauucucau

SEQ ID NO: 2849663 - RNA, 23 nt, Human
aagugauccucccaccucagccu

SEQ ID NO: 2849664 - RNA, 22 nt, Human
aagugaucuacaugaggaacug

SEQ ID NO: 2849665 - RNA, 13 nt, Human
aagugaugacaua

SEQ ID NO: 2849666 - RNA, 14 nt, Human
aagugaugacauau

SEQ ID NO: 2849667 - RNA, 14 nt, Human
aagugcaguucuua

SEQ ID NO: 2849668 - RNA, 22 nt, Human
aagugcaguucuuagcccucua

SEQ ID NO: 2849669 - RNA, 18 nt, Human
aagugcauaugaaauccu

SEQ ID NO: 2849670 - RNA, 17 nt, Human
aagugcacacagaaaua

SEQ ID NO: 2849671 - RNA, 18 nt, Human
aagugcacacagaaauau

SEQ ID NO: 2849672 - RNA, 20 nt, Human
aagugcacacagaaauauau

SEQ ID NO: 2849673 - RNA, 21 nt, Human
aagugcacacagaaauauaua

SEQ ID NO: 2849674 - RNA, 22 nt, Human
aagugcacacagaaauauauau

SEQ ID NO: 2849675 - RNA, 23 nt, Human
aagugcacacagaaauauauaua

SEQ ID NO: 2849676 - RNA, 15 nt, Human
aagugcacuuucuaa

SEQ ID NO: 2849677 - RNA, 16 nt, Human
aagugcacuuucuaau

SEQ ID NO: 2849678 - RNA, 18 nt, Human
aagugauugggacagagg

SEQ ID NO: 2849679 - RNA, 21 nt, Human
aagugauucuccugccucagc

SEQ ID NO: 2849680 - RNA, 17 nt, Human
aagugauucucaugccu

SEQ ID NO: 2849681 - RNA, 18 nt, Human
aagugaugggcuuucucu

SEQ ID NO: 2849682 - RNA, 20 nt, Human
aagugauccucccaccucag

SEQ ID NO: 2849683 - RNA, 19 nt, Human
aagugauccucccaccuca

SEQ ID NO: 2849684 - RNA, 13 nt, Human
aagugauccuccc

SEQ ID NO: 2849685 - RNA, 14 nt, Human
uaaaauauaaacaa

SEQ ID NO: 2849686 - RNA, 18 nt, Human
uaaaauagcuuguauagu

SEQ ID NO: 2849687 - RNA, 19 nt, Human
uaaaauaggggauauuuaa

SEQ ID NO: 2849688 - RNA, 13 nt, Human
uaaaauacauuua

SEQ ID NO: 2849689 - RNA, 14 nt, Human
uaaaauacauuuaa

SEQ ID NO: 2849690 - RNA, 15 nt, Human
uaaaauacauuuaaa

SEQ ID NO: 2849691 - RNA, 16 nt, Human
uaaaauacauuuaaaa

SEQ ID NO: 2849692 - RNA, 18 nt, Human
uaaaauacauuuaaaacu

SEQ ID NO: 2849693 - RNA, 14 nt, Human
uaaaauaaauuagu

SEQ ID NO: 2849694 - RNA, 18 nt, Human
uaaaauaaugcaaagaau

SEQ ID NO: 2849695 - RNA, 17 nt, Human
uaaaauaguuguccaua

SEQ ID NO: 2849696 - RNA, 23 nt, Human
uaaaauaguuguccauauuuuca

SEQ ID NO: 2849697 - RNA, 14 nt, Human
uaaaauagcuugua

SEQ ID NO: 2849698 - RNA, 21 nt, Human
uaaaauagcaacacucuauau

SEQ ID NO: 2849699 - RNA, 22 nt, Human
uaaaaagccugcaauuucauau

SEQ ID NO: 2849700 - RNA, 19 nt, Human
uaaaaagccugcaauuuca

SEQ ID NO: 2849701 - RNA, 22 nt, Human
uaaaaagcuccaaaugcagcuu

SEQ ID NO: 2849702 - RNA, 20 nt, Human
uaaaaagcuuccaugauucu

SEQ ID NO: 2849703 - RNA, 16 nt, Human
aagucaguauggucua

SEQ ID NO: 2849704 - RNA, 21 nt, Human
aagucaggcccuuauuuucaa

SEQ ID NO: 2849705 - RNA, 22 nt, Human
uaaaaaaaaaaaaaagcuuuau

SEQ ID NO: 2849706 - RNA, 18 nt, Human
uaaaaaaaaaaaaaggaa

SEQ ID NO: 2849707 - RNA, 19 nt, Human
uaaaaaaaaaaaaaggaaa

SEQ ID NO: 2849708 - RNA, 20 nt, Human
uaaaaaaaaaaaaaggaaaa

SEQ ID NO: 2849709 - RNA, 22 nt, Human
uaaaaaaaaaaaaaggaaaaaa

SEQ ID NO: 2849710 - RNA, 23 nt, Human
uaaaaaaaaaaaaaggaaaaaaa

SEQ ID NO: 2849711 - RNA, 22 nt, Human
uaaaaaaaaaaaccaaaacugu

SEQ ID NO: 2849712 - RNA, 18 nt, Human
uaaaaaaaaaaagauugu

SEQ ID NO: 2849713 - RNA, 19 nt, Human
uaaaaaaaaaaagauugua

SEQ ID NO: 2849714 - RNA, 17 nt, Human
uaaaaaaaaaaguuaca

SEQ ID NO: 2849715 - RNA, 21 nt, Human
uaaaaaaaaaaguuacagaaa

SEQ ID NO: 2849716 - RNA, 21 nt, Human
uaaaaaggacaucagcaaaca

SEQ ID NO: 2849717 - RNA, 20 nt, Human
uaaaaaggagaauuuuuccu

SEQ ID NO: 2849718 - RNA, 19 nt, Human
uaaaaaggacaucagcaaa

SEQ ID NO: 2849719 - RNA, 20 nt, Human
uaaaaaggaauccacuccca

SEQ ID NO: 2849720 - RNA, 15 nt, Human
uaaaaaggaacugca

SEQ ID NO: 2849721 - RNA, 17 nt, Human
uaaaaaggaacugcagc

SEQ ID NO: 2849722 - RNA, 18 nt, Human
uaaaaaggaacugcagca

SEQ ID NO: 2849723 - RNA, 18 nt, Human
uaaaaaggacaucagcaa

SEQ ID NO: 2849724 - RNA, 11 nt, Human
uaaaaaggaca

SEQ ID NO: 2849725 - RNA, 14 nt, Human
uaaaaauauugugu

SEQ ID NO: 2849726 - RNA, 19 nt, Human
uaaaaauauggaacuucua

SEQ ID NO: 2849727 - RNA, 13 nt, Human
uaaaaauauauau

SEQ ID NO: 2849728 - RNA, 22 nt, Human
uaaaaauauauauagugcuaua

SEQ ID NO: 2849729 - RNA, 14 nt, Human
uaaaaauacauauc

SEQ ID NO: 2849730 - RNA, 15 nt, Human
uaaaaagugacacag

SEQ ID NO: 2849731 - RNA, 17 nt, Human
uaaaaagugacacagca

SEQ ID NO: 2849732 - RNA, 18 nt, Human
uaaaaagugacacagcag

SEQ ID NO: 2849733 - RNA, 13 nt, Human
uaaaaaugacaga

SEQ ID NO: 2849734 - RNA, 22 nt, Human
uaaaaauauuguguugugaaug

SEQ ID NO: 2849735 - RNA, 21 nt, Human
uaaaaauauuguguugugaau

SEQ ID NO: 2849736 - RNA, 23 nt, Human
uaaaaauauggaacuucuaauau

SEQ ID NO: 2849737 - RNA, 15 nt, Human
uaaaaauauguacaa

SEQ ID NO: 2849738 - RNA, 15 nt, Human
uaaaacuuugcugcc

SEQ ID NO: 2849739 - RNA, 14 nt, Human
uaaaacuuugcugc

SEQ ID NO: 2849740 - RNA, 20 nt, Human
uaaaacuuaccuaagugaca

SEQ ID NO: 2849741 - RNA, 13 nt, Human
uaaaacuucuuaa

SEQ ID NO: 2849742 - RNA, 19 nt, Human
aagucagcccaacaggcag

SEQ ID NO: 2849743 - RNA, 22 nt, Human
uaaaacuauauucauuuccacu

SEQ ID NO: 2849744 - RNA, 12 nt, Human
uaaaacugcuuu

SEQ ID NO: 2849745 - RNA, 13 nt, Human
uaaaacugcuuuu

SEQ ID NO: 2849746 - RNA, 21 nt, Human
uaaaacugcuuuuuuuuuucc

SEQ ID NO: 2849747 - RNA, 16 nt, Human
uaaaacuggccugacu

SEQ ID NO: 2849748 - RNA, 20 nt, Human
uaaaacugggccuguagcuc

SEQ ID NO: 2849749 - RNA, 17 nt, Human
aagcaccuccugccucg

SEQ ID NO: 2849750 - RNA, 19 nt, Human
aagcaccgccuccaaaugc

SEQ ID NO: 2849751 - RNA, 14 nt, Human
aagcaccccaugcc

SEQ ID NO: 2849752 - RNA, 12 nt, Human
aagcacucgugu

SEQ ID NO: 2849753 - RNA, 13 nt, Human
aagcacuagagaa

SEQ ID NO: 2849754 - RNA, 20 nt, Human
aagcacuagagaaugcacag

SEQ ID NO: 2849755 - RNA, 16 nt, Human
aagcaccuuagcuggc

SEQ ID NO: 2849756 - RNA, 19 nt, Human
aagcaccuuagcuggcauu

SEQ ID NO: 2849757 - RNA, 16 nt, Human
aagcaccuccugccuc

SEQ ID NO: 2849758 - RNA, 15 nt, Human
aagcaccuccugccu

SEQ ID NO: 2849759 - RNA, 14 nt, Human
aagcaccuccugcc

SEQ ID NO: 2849760 - RNA, 13 nt, Human
aagcaccuccugc

SEQ ID NO: 2849761 - RNA, 16 nt, Human
aagcacaucugcauuu

SEQ ID NO: 2849762 - RNA, 18 nt, Human
aagcacaguuugaacaaa

SEQ ID NO: 2849763 - RNA, 16 nt, Human
aagcacaguuugaaca

SEQ ID NO: 2849764 - RNA, 17 nt, Human
aagcacaguuugaacaa

SEQ ID NO: 2849765 - RNA, 14 nt, Human
aagcaccaagcuca

SEQ ID NO: 2849766 - RNA, 11 nt, Human
aagcacagcug

SEQ ID NO: 2849767 - RNA, 14 nt, Human
aagcacaggagaca

SEQ ID NO: 2849768 - RNA, 18 nt, Human
aagcacaggagacacugu

SEQ ID NO: 2849769 - RNA, 13 nt, Human
aagcacaguguua

SEQ ID NO: 2849770 - RNA, 18 nt, Human
aagcacaguguuaaauga

SEQ ID NO: 2849771 - RNA, 20 nt, Human
aagcacaguguuaaaugaaa

SEQ ID NO: 2849772 - RNA, 14 nt, Human
aagcacaguuugaa

SEQ ID NO: 2849773 - RNA, 15 nt, Human
aagcacaguuugaac

SEQ ID NO: 2849774 - RNA, 23 nt, Human
aagcacaagcagagugcacagcu

SEQ ID NO: 2849775 - RNA, 15 nt, Human
aagcacaaacuuuag

SEQ ID NO: 2849776 - RNA, 18 nt, Human
aagcacacacaaaauaaa

SEQ ID NO: 2849777 - RNA, 19 nt, Human
aagcacacucauccccuca

SEQ ID NO: 2849778 - RNA, 20 nt, Human
gugugaaguacaauaauuca

SEQ ID NO: 2849779 - RNA, 17 nt, Human
guguuucuauugacuuc

SEQ ID NO: 2849780 - RNA, 12 nt, Human
guguuucuauga

SEQ ID NO: 2849781 - RNA, 19 nt, Human
guguuucuaugaguggaaa

SEQ ID NO: 2849782 - RNA, 15 nt, Human
guguuucuguuauua

SEQ ID NO: 2849783 - RNA, 13 nt, Human
aagcauugugagu

SEQ ID NO: 2849784 - RNA, 14 nt, Human
aagcauugugagua

SEQ ID NO: 2849785 - RNA, 16 nt, Human
aagcauguuucauguu

SEQ ID NO: 2849786 - RNA, 20 nt, Human
aagcauguuucauguuuugu

SEQ ID NO: 2849787 - RNA, 18 nt, Human
aagcauuuacaagugcug

SEQ ID NO: 2849788 - RNA, 19 nt, Human
aagccaaagaaaugaacau

SEQ ID NO: 2849789 - RNA, 20 nt, Human
aagccaaagaaaugaacauu

SEQ ID NO: 2849790 - RNA, 22 nt, Human
aagccaaagaaaugaacauucc

SEQ ID NO: 2849791 - RNA, 23 nt, Human
aagccaaagaaaugaacauucca

SEQ ID NO: 2849792 - RNA, 14 nt, Human
aagcauuuguauuu

SEQ ID NO: 2849793 - RNA, 17 nt, Human
aagcauuuguauuuugu

SEQ ID NO: 2849794 - RNA, 18 nt, Human
aagcauuuguauuuugug

SEQ ID NO: 2849795 - RNA, 19 nt, Human
aagcauuuguauuuugugu

SEQ ID NO: 2849796 - RNA, 21 nt, Human
aagcauuuguauuuuguguga

SEQ ID NO: 2849797 - RNA, 17 nt, Human
aagccaauaacacacag

SEQ ID NO: 2849798 - RNA, 18 nt, Human
aagccaauaacacacagc

SEQ ID NO: 2849799 - RNA, 20 nt, Human
aagccaauaacacacagcua

SEQ ID NO: 2849800 - RNA, 21 nt, Human
aagccaaggugucauuuaugu

SEQ ID NO: 2849801 - RNA, 18 nt, Human
aagccaaagcuaggccug

SEQ ID NO: 2849802 - RNA, 17 nt, Human
aagccaaagcuaggccu

SEQ ID NO: 2849803 - RNA, 20 nt, Human
aagccaaagcuaggccuggc

SEQ ID NO: 2849804 - RNA, 13 nt, Human
aagccaaagccaa

SEQ ID NO: 2849805 - RNA, 17 nt, Human
aagcacucuuaaagcaa

SEQ ID NO: 2849806 - RNA, 13 nt, Human
aagcacugaaaaa

SEQ ID NO: 2849807 - RNA, 11 nt, Human
aagcacugaua

SEQ ID NO: 2849808 - RNA, 12 nt, Human
aagcacugugcu

SEQ ID NO: 2849809 - RNA, 14 nt, Human
aagcacacuuguag

SEQ ID NO: 2849810 - RNA, 21 nt, Human
aagcauauggguuagauguug

SEQ ID NO: 2849811 - RNA, 19 nt, Human
aagcauauggguuagaugu

SEQ ID NO: 2849812 - RNA, 15 nt, Human
aagcauauagagaug

SEQ ID NO: 2849813 - RNA, 16 nt, Human
aagcauauagagauga

SEQ ID NO: 2849814 - RNA, 19 nt, Human
aagcaucaccucaggccag

SEQ ID NO: 2849815 - RNA, 18 nt, Human
aagcaucaccucaggcca

SEQ ID NO: 2849816 - RNA, 16 nt, Human
aagcaucaccucaggc

SEQ ID NO: 2849817 - RNA, 15 nt, Human
aagcaucaccucagg

SEQ ID NO: 2849818 - RNA, 23 nt, Human
aagcaucaccucaggccaggugc

SEQ ID NO: 2849819 - RNA, 18 nt, Human
aagcaucagggggaagaa

SEQ ID NO: 2849820 - RNA, 23 nt, Human
aagcaucagggggaagaagcaga

SEQ ID NO: 2849821 - RNA, 19 nt, Human
aagcaucaguucuacggau

SEQ ID NO: 2849822 - RNA, 12 nt, Human
aagcauguuuca

SEQ ID NO: 2849823 - RNA, 14 nt, Human
aagcauguuucaug

SEQ ID NO: 2849824 - RNA, 15 nt, Human
aagcauguuucaugu

SEQ ID NO: 2849825 - RNA, 13 nt, Human
aagcaugugucau

SEQ ID NO: 2849826 - RNA, 17 nt, Human
aagcaugugucaugcau

SEQ ID NO: 2849827 - RNA, 22 nt, Human
aagcaugcuugugaaaaugugu

SEQ ID NO: 2849828 - RNA, 13 nt, Human
aagcaugcauucu

SEQ ID NO: 2849829 - RNA, 11 nt, Human
aagcauggacu

SEQ ID NO: 2849830 - RNA, 21 nt, Human
aagcaugcuugugaaaaugug

SEQ ID NO: 2849831 - RNA, 13 nt, Human
aagcaaauuucaa

SEQ ID NO: 2849832 - RNA, 20 nt, Human
aagcaaauuucaaaagacau

SEQ ID NO: 2849833 - RNA, 22 nt, Human
aagcaaauuucaaaagacaugu

SEQ ID NO: 2849834 - RNA, 14 nt, Human
aagauuuuuucauu

SEQ ID NO: 2849835 - RNA, 17 nt, Human
aagauuuuuucauuuca

SEQ ID NO: 2849836 - RNA, 13 nt, Human
aagcaaaaaauga

SEQ ID NO: 2849837 - RNA, 20 nt, Human
aagcaaaaaaugaaugucua

SEQ ID NO: 2849838 - RNA, 23 nt, Human
aagcaaaaacaaaccaugacuga

SEQ ID NO: 2849839 - RNA, 12 nt, Human
aagcaaaaaugc

SEQ ID NO: 2849840 - RNA, 13 nt, Human
aagcaaaaaugcu

SEQ ID NO: 2849841 - RNA, 14 nt, Human
aagcaaaaaugcua

SEQ ID NO: 2849842 - RNA, 16 nt, Human
aagcaaaaaugcuaau

SEQ ID NO: 2849843 - RNA, 17 nt, Human
aagcaaaaaugcuaaua

SEQ ID NO: 2849844 - RNA, 11 nt, Human
aagcaaaagaa

SEQ ID NO: 2849845 - RNA, 13 nt, Human
aagcaaaagaaaa

SEQ ID NO: 2849846 - RNA, 14 nt, Human
aagcaaaagaaaaa

SEQ ID NO: 2849847 - RNA, 15 nt, Human
aagcaaaagaaaaag

SEQ ID NO: 2849848 - RNA, 15 nt, Human
aagcaaaauaaaaac

SEQ ID NO: 2849849 - RNA, 16 nt, Human
aagcaaaauaaaaacu

SEQ ID NO: 2849850 - RNA, 18 nt, Human
aagcaaaauaaaaacuau

SEQ ID NO: 2849851 - RNA, 13 nt, Human
aagcaaaauccug

SEQ ID NO: 2849852 - RNA, 13 nt, Human
aagcaaaauauua

SEQ ID NO: 2849853 - RNA, 14 nt, Human
aagcaaaauauuau

SEQ ID NO: 2849854 - RNA, 18 nt, Human
aagauggaguuucuaagg

SEQ ID NO: 2849855 - RNA, 20 nt, Human
aagauggaguuucuaagguc

SEQ ID NO: 2849856 - RNA, 17 nt, Human
aagauggcugacuuugc

SEQ ID NO: 2849857 - RNA, 17 nt, Human
aagauggcucagagggg

SEQ ID NO: 2849858 - RNA, 19 nt, Human
aagauggcucagaggggga

SEQ ID NO: 2849859 - RNA, 21 nt, Human
aagauggcucagagggggacu

SEQ ID NO: 2849860 - RNA, 16 nt, Human
aagauggcugugccuc

SEQ ID NO: 2849861 - RNA, 15 nt, Human
aagauuuuucucaaa

SEQ ID NO: 2849862 - RNA, 19 nt, Human
aagauuuuucucaaaguuu

SEQ ID NO: 2849863 - RNA, 20 nt, Human
aagauuuuucucaaaguuuu

SEQ ID NO: 2849864 - RNA, 21 nt, Human
aagauuuuucucaaaguuuug

SEQ ID NO: 2849865 - RNA, 22 nt, Human
aagaucaaaagcuuauucaucu

SEQ ID NO: 2849866 - RNA, 15 nt, Human
aagauggaguuucua

SEQ ID NO: 2849867 - RNA, 16 nt, Human
aagauggaguuucuaa

SEQ ID NO: 2849868 - RNA, 17 nt, Human
aagauggaguuucuaag

SEQ ID NO: 2849869 - RNA, 13 nt, Human
gugucuguacacg

SEQ ID NO: 2849870 - RNA, 16 nt, Human
gugucuguacacgugu

SEQ ID NO: 2849871 - RNA, 21 nt, Human
gugucuguacacguguccugu

SEQ ID NO: 2849872 - RNA, 22 nt, Human
gugucuguacacguguccugua

SEQ ID NO: 2849873 - RNA, 19 nt, Human
gugucagguggggcagcuu

SEQ ID NO: 2849874 - RNA, 12 nt, Human
gugucuguacac

SEQ ID NO: 2849875 - RNA, 23 nt, Human
gugugaaccaccacacccagccc

SEQ ID NO: 2849876 - RNA, 14 nt, Human
gugucuguauuuau

SEQ ID NO: 2849877 - RNA, 21 nt, Human
gugucuguauuucauguggcu

SEQ ID NO: 2849878 - RNA, 13 nt, Human
gugucuguauuua

SEQ ID NO: 2849879 - RNA, 18 nt, Human
gugucuguaaaagagccu

SEQ ID NO: 2849880 - RNA, 14 nt, Human
gugucuuaauuauu

SEQ ID NO: 2849881 - RNA, 21 nt, Human
gugugaaaggaagcuccacug

SEQ ID NO: 2849882 - RNA, 18 nt, Human
gugugaaagucagaugcc

SEQ ID NO: 2849883 - RNA, 15 nt, Human
gugucuuaauuauua

SEQ ID NO: 2849884 - RNA, 19 nt, Human
gugucuuaauuauuauuug

SEQ ID NO: 2849885 - RNA, 14 nt, Human
gugucaccugaaga

SEQ ID NO: 2849886 - RNA, 21 nt, Human
guguauucuuaaaaugcaaua

SEQ ID NO: 2849887 - RNA, 17 nt, Human
guguauuuaacagggag

SEQ ID NO: 2849888 - RNA, 18 nt, Human
guguauuuaacagggagg

SEQ ID NO: 2849889 - RNA, 12 nt, Human
guguauguguau

SEQ ID NO: 2849890 - RNA, 18 nt, Human
gugucagguggggcagcu

SEQ ID NO: 2849891 - RNA, 14 nt, Human
gugucagguggggc

SEQ ID NO: 2849892 - RNA, 22 nt, Human
gugucaccugaagacucauucu

SEQ ID NO: 2849893 - RNA, 14 nt, Human
gugucaccccagag

SEQ ID NO: 2849894 - RNA, 15 nt, Human
gugucaccccagagc

SEQ ID NO: 2849895 - RNA, 16 nt, Human
gugucaccccagagcc

SEQ ID NO: 2849896 - RNA, 17 nt, Human
gugucaccccagagcca

SEQ ID NO: 2849897 - RNA, 19 nt, Human
gugucaccccagagccaca

SEQ ID NO: 2849898 - RNA, 21 nt, Human
gugucaccccagagccacaca

SEQ ID NO: 2849899 - RNA, 22 nt, Human
gugucaccccagagccacacau

SEQ ID NO: 2849900 - RNA, 24 nt, Human
gugucaccccagagccacacaugg

SEQ ID NO: 2849901 - RNA, 17 nt, Human
gugucaccuuuucuugc

SEQ ID NO: 2849902 - RNA, 18 nt, Human
gugucaccuuuucuugcc

SEQ ID NO: 2849903 - RNA, 13 nt, Human
gugucacaaagaa

SEQ ID NO: 2849904 - RNA, 17 nt, Human
aagauagcuucacccca

SEQ ID NO: 2849905 - RNA, 20 nt, Human
aagauauaacuauugcccag

SEQ ID NO: 2849906 - RNA, 22 nt, Human
aagagggucugaggaauccaga

SEQ ID NO: 2849907 - RNA, 22 nt, Human
aagaggguuuuagguagaaaaa

SEQ ID NO: 2849908 - RNA, 23 nt, Human
aagaggguuuuagguagaaaaac

SEQ ID NO: 2849909 - RNA, 15 nt, Human
aagagguacaggguu

SEQ ID NO: 2849910 - RNA, 16 nt, Human
aagagguacaggguuu

SEQ ID NO: 2849911 - RNA, 17 nt, Human
aagagguacaggguuuu

SEQ ID NO: 2849912 - RNA, 20 nt, Human
aagagguacaggguuuuuac

SEQ ID NO: 2849913 - RNA, 21 nt, Human
aagagguauuuaucuuuacuu

SEQ ID NO: 2849914 - RNA, 16 nt, Human
aagaggugggagggcc

SEQ ID NO: 2849915 - RNA, 15 nt, Human
aagaggugggagggc

SEQ ID NO: 2849916 - RNA, 17 nt, Human
aagaggugggagggccc

SEQ ID NO: 2849917 - RNA, 18 nt, Human
aagagggagauggagacu

SEQ ID NO: 2849918 - RNA, 23 nt, Human
aagaggcccugucuguaccuaac

SEQ ID NO: 2849919 - RNA, 12 nt, Human
aagaggcugcug

SEQ ID NO: 2849920 - RNA, 22 nt, Human
aagagggaauccccgaaggugc

SEQ ID NO: 2849921 - RNA, 11 nt, Human
aagaggcaggg

SEQ ID NO: 2849922 - RNA, 14 nt, Human
aagaggcagggucu

SEQ ID NO: 2849923 - RNA, 16 nt, Human
aagaggcagaaaauug

SEQ ID NO: 2849924 - RNA, 19 nt, Human
aagaggcagaaaauugcac

SEQ ID NO: 2849925 - RNA, 14 nt, Human
guguaaauguuagu

SEQ ID NO: 2849926 - RNA, 13 nt, Human
guguaaauuaugu

SEQ ID NO: 2849927 - RNA, 22 nt, Human
guguaaauuauguaaugcaaaa

SEQ ID NO: 2849928 - RNA, 15 nt, Human
guguaaaaugugaag

SEQ ID NO: 2849929 - RNA, 20 nt, Human
gugguuggggcccugcccug

SEQ ID NO: 2849930 - RNA, 12 nt, Human
gugguuuucuua

SEQ ID NO: 2849931 - RNA, 23 nt, Human
gugguuuucuuaaggugaggccu

SEQ ID NO: 2849932 - RNA, 14 nt, Human
gugguugaagagca

SEQ ID NO: 2849933 - RNA, 13 nt, Human
gugcucauuuaag

SEQ ID NO: 2849934 - RNA, 18 nt, Human
gugguuccccaccgaagu

SEQ ID NO: 2849935 - RNA, 20 nt, Human
guuagagacuuuuuucuagu

SEQ ID NO: 2849936 - RNA, 20 nt, Human
guuagagagggaccaugugu

SEQ ID NO: 2849937 - RNA, 21 nt, Human
guuagagagggaccauguguc

SEQ ID NO: 2849938 - RNA, 22 nt, Human
guuagagagggaccauguguca

SEQ ID NO: 2849939 - RNA, 23 nt, Human
guuagagagggaccaugugucac

SEQ ID NO: 2849940 - RNA, 13 nt, Human
guuacuguaauuc

SEQ ID NO: 2849941 - RNA, 10 nt, Human
guuacuguuc

SEQ ID NO: 2849942 - RNA, 11 nt, Human
guuacuguucu

SEQ ID NO: 2849943 - RNA, 12 nt, Human
guuacuguucuu

SEQ ID NO: 2849944 - RNA, 13 nt, Human
guuacuguucuug

SEQ ID NO: 2849945 - RNA, 14 nt, Human
guuacuguucuugc

SEQ ID NO: 2849946 - RNA, 15 nt, Human
guuacuguucuugcu

SEQ ID NO: 2849947 - RNA, 16 nt, Human
guuacuguucuugcug

SEQ ID NO: 2849948 - RNA, 17 nt, Human
guuacuguucuugcugc

SEQ ID NO: 2849949 - RNA, 18 nt, Human
guuacuguucuugcugcu

SEQ ID NO: 2849950 - RNA, 19 nt, Human
guuacuguucuugcugcua

SEQ ID NO: 2849951 - RNA, 20 nt, Human
guuacuguucuugcugcuag

SEQ ID NO: 2849952 - RNA, 21 nt, Human
guuacuguucuugcugcuaga

SEQ ID NO: 2849953 - RNA, 22 nt, Human
guuacuguucuugcugcuagaa

SEQ ID NO: 2849954 - RNA, 23 nt, Human
guuacuguucuugcugcuagaac

SEQ ID NO: 2849955 - RNA, 24 nt, Human
guuacuguucuugcugcuagaacu

SEQ ID NO: 2849956 - RNA, 22 nt, Human
guuagaccgcucucuuuucugu

SEQ ID NO: 2849957 - RNA, 23 nt, Human
guuagaccgcucucuuuucugua

SEQ ID NO: 2849958 - RNA, 9 nt, Human
guuacuguu

SEQ ID NO: 2849959 - RNA, 18 nt, Human
guuacuguuaaccauuua

SEQ ID NO: 2849960 - RNA, 22 nt, Human
guuagacugacuuguuugucuu

SEQ ID NO: 2849961 - RNA, 23 nt, Human
guuagacugacuuguuugucuuc

SEQ ID NO: 2849962 - RNA, 15 nt, Human
guuaauuuuuacaug

SEQ ID NO: 2849963 - RNA, 10 nt, Human
guuagagcac

SEQ ID NO: 2849964 - RNA, 17 nt, Human
guuauuguacagcuguu

SEQ ID NO: 2849965 - RNA, 12 nt, Human
guuauugugaau

SEQ ID NO: 2849966 - RNA, 14 nt, Human
guuauugugaauga

SEQ ID NO: 2849967 - RNA, 15 nt, Human
guuauugugaaugau

SEQ ID NO: 2849968 - RNA, 14 nt, Human
guuauuguuuuguu

SEQ ID NO: 2849969 - RNA, 17 nt, Human
guuauuuguuuaccacu

SEQ ID NO: 2849970 - RNA, 18 nt, Human
guuauuuguuauuuucag

SEQ ID NO: 2849971 - RNA, 19 nt, Human
guuauuuguuauuuucagu

SEQ ID NO: 2849972 - RNA, 12 nt, Human
guuauuuucagu

SEQ ID NO: 2849973 - RNA, 14 nt, Human
guuauuuucaguau

SEQ ID NO: 2849974 - RNA, 15 nt, Human
guuauuuucaguauu

SEQ ID NO: 2849975 - RNA, 18 nt, Human
aagccauuaaaugaauau

SEQ ID NO: 2849976 - RNA, 22 nt, Human
aagccauuaaaugaauauuuug

SEQ ID NO: 2849977 - RNA, 20 nt, Human
aagccauucuaaggaaauua

SEQ ID NO: 2849978 - RNA, 23 nt, Human
aagcccacagcacagcucccugc

SEQ ID NO: 2849979 - RNA, 18 nt, Human
guuaauacgcaggcaucu

SEQ ID NO: 2849980 - RNA, 19 nt, Human
guuaauaagcaaaauccug

SEQ ID NO: 2849981 - RNA, 21 nt, Human
guuaauauaucccagaaauua

SEQ ID NO: 2849982 - RNA, 13 nt, Human
aagcccagcuuga

SEQ ID NO: 2849983 - RNA, 17 nt, Human
guuaauuuaucuaaauu

SEQ ID NO: 2849984 - RNA, 21 nt, Human
guuaauuuaucuaaauuaaag

SEQ ID NO: 2849985 - RNA, 18 nt, Human
guuaauuuuauucaagaa

SEQ ID NO: 2849986 - RNA, 18 nt, Human
guuaauuuuuugguacaa

SEQ ID NO: 2849987 - RNA, 20 nt, Human
guuaauuuuuugguacaaaa

SEQ ID NO: 2849988 - RNA, 23 nt, Human
guuacucuucaguuaagccuuug

SEQ ID NO: 2849989 - RNA, 19 nt, Human
guuaauauuuauaggucac

SEQ ID NO: 2849990 - RNA, 19 nt, Human
guuaauuccaauuauauga

SEQ ID NO: 2849991 - RNA, 22 nt, Human
aagccuucgggcgucugugugc

SEQ ID NO: 2849992 - RNA, 19 nt, Human
aagccuucagcuccaggga

SEQ ID NO: 2849993 - RNA, 14 nt, Human
aagccuuagggaag

SEQ ID NO: 2849994 - RNA, 15 nt, Human
aagccuucagcucca

SEQ ID NO: 2849995 - RNA, 17 nt, Human
aagccuucagcuccagg

SEQ ID NO: 2849996 - RNA, 16 nt, Human
aagccuucagcuccag

SEQ ID NO: 2849997 - RNA, 20 nt, Human
aagcuaguguaccuccucuc

SEQ ID NO: 2849998 - RNA, 21 nt, Human
aagcuaguguaccuccucuca

SEQ ID NO: 2849999 - RNA, 22 nt, Human
aagcuaggguggcccuugcagu

SEQ ID NO: 2850000 - RNA, 19 nt, Human
aagcuaggguggcccuugc

SEQ ID NO: 2850001 - RNA, 15 nt, Human
aagcuaggguggccc

SEQ ID NO: 2850002 - RNA, 12 nt, Human
aagccuccacag

SEQ ID NO: 2850003 - RNA, 20 nt, Human
aagccucauauuuaaagaca

SEQ ID NO: 2850004 - RNA, 14 nt, Human
aagccucauauuua

SEQ ID NO: 2850005 - RNA, 15 nt, Human
aagccuccacagcga

SEQ ID NO: 2850006 - RNA, 13 nt, Human
aagccuccacagc

SEQ ID NO: 2850007 - RNA, 23 nt, Human
aagccuccacagcgagggcagcu

SEQ ID NO: 2850008 - RNA, 13 nt, Human
aagccugugcaaa

SEQ ID NO: 2850009 - RNA, 16 nt, Human
aagccugugcaaaaaa

SEQ ID NO: 2850010 - RNA, 17 nt, Human
aagccugugcaaaaaaa

SEQ ID NO: 2850011 - RNA, 18 nt, Human
aagccugugcaaaaaaau

SEQ ID NO: 2850012 - RNA, 14 nt, Human
aagccuguggauga

SEQ ID NO: 2850013 - RNA, 15 nt, Human
aagccuguggaugau

SEQ ID NO: 2850014 - RNA, 17 nt, Human
aagccuguggaugauca

SEQ ID NO: 2850015 - RNA, 22 nt, Human
aagccuguggaugaucaauccu

SEQ ID NO: 2850016 - RNA, 12 nt, Human
aagccuguggcu

SEQ ID NO: 2850017 - RNA, 13 nt, Human
aagccuguggcug

SEQ ID NO: 2850018 - RNA, 15 nt, Human
aagccuguggcugug

SEQ ID NO: 2850019 - RNA, 18 nt, Human
guucagguaacaggcaga

SEQ ID NO: 2850020 - RNA, 17 nt, Human
guucagguaacaggcag

SEQ ID NO: 2850021 - RNA, 18 nt, Human
guucaguauuauguaguu

SEQ ID NO: 2850022 - RNA, 23 nt, Human
guucagucugaaugcugccacaa

SEQ ID NO: 2850023 - RNA, 16 nt, Human
guucagggcuuuucuu

SEQ ID NO: 2850024 - RNA, 18 nt, Human
guucaggggacucagccc

SEQ ID NO: 2850025 - RNA, 15 nt, Human
guucaggggacucag

SEQ ID NO: 2850026 - RNA, 22 nt, Human
aagccguuguuuacuuaaagau

SEQ ID NO: 2850027 - RNA, 15 nt, Human
aagccguggcuuccc

SEQ ID NO: 2850028 - RNA, 13 nt, Human
aagccguggcuuc

SEQ ID NO: 2850029 - RNA, 14 nt, Human
aagccguggcuucc

SEQ ID NO: 2850030 - RNA, 22 nt, Human
guucaggguuggccccugcccg

SEQ ID NO: 2850031 - RNA, 21 nt, Human
guucaggguuggccccugccc

SEQ ID NO: 2850032 - RNA, 20 nt, Human
guucaggguuggccccugcc

SEQ ID NO: 2850033 - RNA, 21 nt, Human
guucaggagucccaaggaaag

SEQ ID NO: 2850034 - RNA, 20 nt, Human
guucaggagucccaaggaaa

SEQ ID NO: 2850035 - RNA, 23 nt, Human
guucagcuuguaaauagcucagg

SEQ ID NO: 2850036 - RNA, 18 nt, Human
guucaggagucccaagga

SEQ ID NO: 2850037 - RNA, 15 nt, Human
guucaggagucccaa

SEQ ID NO: 2850038 - RNA, 17 nt, Human
guuauuuucaguauuuu

SEQ ID NO: 2850039 - RNA, 15 nt, Human
guuauuuucuucuaa

SEQ ID NO: 2850040 - RNA, 15 nt, Human
guuauuuugauaaca

SEQ ID NO: 2850041 - RNA, 15 nt, Human
guucagcuguccucc

SEQ ID NO: 2850042 - RNA, 17 nt, Human
guucagcuguccucccu

SEQ ID NO: 2850043 - RNA, 18 nt, Human
guucagcuguccucccuc

SEQ ID NO: 2850044 - RNA, 19 nt, Human
guucagcuguccucccucc

SEQ ID NO: 2850045 - RNA, 21 nt, Human
guucagcuguccucccuccac

SEQ ID NO: 2850046 - RNA, 18 nt, Human
guucccucugcucagcca

SEQ ID NO: 2850047 - RNA, 12 nt, Human
guucccuuggcc

SEQ ID NO: 2850048 - RNA, 15 nt, Human
guucccugaaacacg

SEQ ID NO: 2850049 - RNA, 16 nt, Human
guucccugaaacacga

SEQ ID NO: 2850050 - RNA, 16 nt, Human
guucccugucuugucc

SEQ ID NO: 2850051 - RNA, 15 nt, Human
guucccuguucuucc

SEQ ID NO: 2850052 - RNA, 16 nt, Human
guucccuguucuuccu

SEQ ID NO: 2850053 - RNA, 17 nt, Human
guucccuguucuuccuc

SEQ ID NO: 2850054 - RNA, 18 nt, Human
guucccuguucuuccucc

SEQ ID NO: 2850055 - RNA, 15 nt, Human
guucccuuggccuca

SEQ ID NO: 2850056 - RNA, 14 nt, Human
guucccuuggccuc

SEQ ID NO: 2850057 - RNA, 13 nt, Human
guucccuuggccu

SEQ ID NO: 2850058 - RNA, 14 nt, Human
guuccgcacuuucc

SEQ ID NO: 2850059 - RNA, 18 nt, Human
guuccgcacuuuccacuu

SEQ ID NO: 2850060 - RNA, 23 nt, Human
guuccgcacuuuccacuucuucc

SEQ ID NO: 2850061 - RNA, 16 nt, Human
guucccuuugucuuuc

SEQ ID NO: 2850062 - RNA, 19 nt, Human
guucccuuugucuuucaaa

SEQ ID NO: 2850063 - RNA, 20 nt, Human
guucccuuugucuuucaaac

SEQ ID NO: 2850064 - RNA, 23 nt, Human
guuccccaucuggguccuugcac

SEQ ID NO: 2850065 - RNA, 14 nt, Human
guuccccaugcaga

SEQ ID NO: 2850066 - RNA, 18 nt, Human
guuccccaucuggguccu

SEQ ID NO: 2850067 - RNA, 19 nt, Human
guuccccaucuggguccuu

SEQ ID NO: 2850068 - RNA, 12 nt, Human
guucccccaucu

SEQ ID NO: 2850069 - RNA, 15 nt, Human
guuccccaagacauu

SEQ ID NO: 2850070 - RNA, 16 nt, Human
aagcuuuuuccuccug

SEQ ID NO: 2850071 - RNA, 11 nt, Human
aagcuuagaac

SEQ ID NO: 2850072 - RNA, 10 nt, Human
aagcuuagaa

SEQ ID NO: 2850073 - RNA, 12 nt, Human
aagcuucuuaau

SEQ ID NO: 2850074 - RNA, 19 nt, Human
aagcuucuuaauuaauuug

SEQ ID NO: 2850075 - RNA, 21 nt, Human
aagcuucuuaauuaauuugau

SEQ ID NO: 2850076 - RNA, 12 nt, Human
aagcuugacucc

SEQ ID NO: 2850077 - RNA, 15 nt, Human
aagcuugacucccaa

SEQ ID NO: 2850078 - RNA, 17 nt, Human
aagcuugacucccaagu

SEQ ID NO: 2850079 - RNA, 18 nt, Human
aagcuugacucccaaguu

SEQ ID NO: 2850080 - RNA, 14 nt, Human
aagcuugcucacau

SEQ ID NO: 2850081 - RNA, 20 nt, Human
aagcuuccaugauucuauuu

SEQ ID NO: 2850082 - RNA, 22 nt, Human
aagcuucgaggcccagcgaccu

SEQ ID NO: 2850083 - RNA, 11 nt, Human
aagcuucuaau

SEQ ID NO: 2850084 - RNA, 14 nt, Human
aagcuucuaauaaa

SEQ ID NO: 2850085 - RNA, 16 nt, Human
aagcuucuaauaaauu

SEQ ID NO: 2850086 - RNA, 18 nt, Human
aagcuucuaauaaauuau

SEQ ID NO: 2850087 - RNA, 19 nt, Human
aagcuucuaauaaauuaua

SEQ ID NO: 2850088 - RNA, 21 nt, Human
aagcuuccaugauucuauuua

SEQ ID NO: 2850089 - RNA, 18 nt, Human
aagcuuauccauaaaaaa

SEQ ID NO: 2850090 - RNA, 22 nt, Human
aagcuuauccauaaaaaaaaau

SEQ ID NO: 2850091 - RNA, 17 nt, Human
aagcucugcuccucucc

SEQ ID NO: 2850092 - RNA, 22 nt, Human
aagcucuuacacuacauuagaa

SEQ ID NO: 2850093 - RNA, 12 nt, Human
aagcugaaaaua

SEQ ID NO: 2850094 - RNA, 14 nt, Human
aagcugaaaauaua

SEQ ID NO: 2850095 - RNA, 15 nt, Human
aagcucagauuauuu

SEQ ID NO: 2850096 - RNA, 16 nt, Human
aagcucagauuauuua

SEQ ID NO: 2850097 - RNA, 21 nt, Human
guucuugcagucaucagaagu

SEQ ID NO: 2850098 - RNA, 12 nt, Human
guucuugcugcu

SEQ ID NO: 2850099 - RNA, 13 nt, Human
guucuugcugcua

SEQ ID NO: 2850100 - RNA, 14 nt, Human
guucuugcugcuag

SEQ ID NO: 2850101 - RNA, 15 nt, Human
guucuugcugcuaga

SEQ ID NO: 2850102 - RNA, 16 nt, Human
guucuugcugcuagaa

SEQ ID NO: 2850103 - RNA, 17 nt, Human
guucuugcugcuagaac

SEQ ID NO: 2850104 - RNA, 18 nt, Human
guucuugcugcuagaacu

SEQ ID NO: 2850105 - RNA, 19 nt, Human
guucuugcugcuagaacuu

SEQ ID NO: 2850106 - RNA, 20 nt, Human
guucuugcugcuagaacuuu

SEQ ID NO: 2850107 - RNA, 21 nt, Human
guucuugcugcuagaacuuuu

SEQ ID NO: 2850108 - RNA, 22 nt, Human
guucuugcugcuagaacuuuuu

SEQ ID NO: 2850109 - RNA, 21 nt, Human
guucuuccuccagcugcacca

SEQ ID NO: 2850110 - RNA, 16 nt, Human
guucuucucaaaagaa

SEQ ID NO: 2850111 - RNA, 21 nt, Human
guucuucuguucugcagacac

SEQ ID NO: 2850112 - RNA, 16 nt, Human
guugaccaugucuaug

SEQ ID NO: 2850113 - RNA, 22 nt, Human
guugaccaugucuaugauucgu

SEQ ID NO: 2850114 - RNA, 19 nt, Human
guugacuuauaguacauga

SEQ ID NO: 2850115 - RNA, 10 nt, Human
aaggaaaaag

SEQ ID NO: 2850116 - RNA, 18 nt, Human
aaggaaaaagaaaauaaa

SEQ ID NO: 2850117 - RNA, 24 nt, Human
guugacuuauaguacaugauaaau

SEQ ID NO: 2850118 - RNA, 14 nt, Human
guugacuuucaggu

SEQ ID NO: 2850119 - RNA, 22 nt, Human
guugacuuccaggcacgguuug

SEQ ID NO: 2850120 - RNA, 16 nt, Human
guugagaaucccaaau

SEQ ID NO: 2850121 - RNA, 19 nt, Human
guugagaaucccaaauuug

SEQ ID NO: 2850122 - RNA, 22 nt, Human
guucuaggcacuguaguucuaa

SEQ ID NO: 2850123 - RNA, 23 nt, Human
guucuaggcacuguaguucuaag

SEQ ID NO: 2850124 - RNA, 14 nt, Human
guucuagguuucaa

SEQ ID NO: 2850125 - RNA, 16 nt, Human
guucuagguuucaaag

SEQ ID NO: 2850126 - RNA, 19 nt, Human
guucuagguuucaaagaug

SEQ ID NO: 2850127 - RNA, 22 nt, Human
guucuagguuucaaagaugcug

SEQ ID NO: 2850128 - RNA, 12 nt, Human
guucucugagga

SEQ ID NO: 2850129 - RNA, 13 nt, Human
aaauuaaucacaa

SEQ ID NO: 2850130 - RNA, 15 nt, Human
aaauguggcuccugg

SEQ ID NO: 2850131 - RNA, 14 nt, Human
aaauuaaucugggc

SEQ ID NO: 2850132 - RNA, 14 nt, Human
aaauuaauuuuacu

SEQ ID NO: 2850133 - RNA, 16 nt, Human
aaauuacacccaaaga

SEQ ID NO: 2850134 - RNA, 22 nt, Human
aaauuacacccaaagagguauu

SEQ ID NO: 2850135 - RNA, 15 nt, Human
aaauuagccgggcgu

SEQ ID NO: 2850136 - RNA, 21 nt, Human
aaauucaaaaaguguuuauuu

SEQ ID NO: 2850137 - RNA, 13 nt, Human
aaauuauguaaug

SEQ ID NO: 2850138 - RNA, 17 nt, Human
aaauuaugugacauuuu

SEQ ID NO: 2850139 - RNA, 22 nt, Human
aaauuaugugacauuuuacauu

SEQ ID NO: 2850140 - RNA, 20 nt, Human
aaauuaugugacauuuuaca

SEQ ID NO: 2850141 - RNA, 13 nt, Human
aaauuaugacaau

SEQ ID NO: 2850142 - RNA, 19 nt, Human
aaauuaggauuucaugauu

SEQ ID NO: 2850143 - RNA, 16 nt, Human
aaauuaucuauagcua

SEQ ID NO: 2850144 - RNA, 22 nt, Human
aaauuaggaggcucaacaauaa

SEQ ID NO: 2850145 - RNA, 23 nt, Human
aaauuaggaggcucaacaauaaa

SEQ ID NO: 2850146 - RNA, 18 nt, Human
aaauuaggauuucaugau

SEQ ID NO: 2850147 - RNA, 21 nt, Human
aaauucuauucugaucuuauu

SEQ ID NO: 2850148 - RNA, 13 nt, Human
aaauugucagcaa

SEQ ID NO: 2850149 - RNA, 19 nt, Human
aaauuguuuggcuuccucc

SEQ ID NO: 2850150 - RNA, 21 nt, Human
aaauuguuuggcuuccuccug

SEQ ID NO: 2850151 - RNA, 22 nt, Human
aaauuguuuggcuuccuccuga

SEQ ID NO: 2850152 - RNA, 23 nt, Human
aaauuguccguguucauacauuu

SEQ ID NO: 2850153 - RNA, 13 nt, Human
aaauuuaaacauu

SEQ ID NO: 2850154 - RNA, 14 nt, Human
aaauuuaaacauua

SEQ ID NO: 2850155 - RNA, 18 nt, Human
aaauugucagaugcugug

SEQ ID NO: 2850156 - RNA, 18 nt, Human
aaauucacaaacuuuuau

SEQ ID NO: 2850157 - RNA, 17 nt, Human
aaauucacaaacuuuua

SEQ ID NO: 2850158 - RNA, 15 nt, Human
aaauucacaaacuuu

SEQ ID NO: 2850159 - RNA, 14 nt, Human
aaauucacaaacuu

SEQ ID NO: 2850160 - RNA, 19 nt, Human
aaauucgcccgagcuguuu

SEQ ID NO: 2850161 - RNA, 13 nt, Human
aaauuccacugga

SEQ ID NO: 2850162 - RNA, 21 nt, Human
aaauuccaaagucucuaauuc

SEQ ID NO: 2850163 - RNA, 22 nt, Human
aaauuccaaagucucuaauucu

SEQ ID NO: 2850164 - RNA, 14 nt, Human
aaauuagggcaauu

SEQ ID NO: 2850165 - RNA, 12 nt, Human
aaauuccaaagu

SEQ ID NO: 2850166 - RNA, 14 nt, Human
aaauuccaaagucu

SEQ ID NO: 2850167 - RNA, 17 nt, Human
aaauuccaaagucucua

SEQ ID NO: 2850168 - RNA, 18 nt, Human
aaauuccaaagucucuaa

SEQ ID NO: 2850169 - RNA, 17 nt, Human
guauuguaaacaugugu

SEQ ID NO: 2850170 - RNA, 12 nt, Human
guauuguaaauu

SEQ ID NO: 2850171 - RNA, 13 nt, Human
guauuguaaauua

SEQ ID NO: 2850172 - RNA, 19 nt, Human
guauuguaaauuauauuug

SEQ ID NO: 2850173 - RNA, 20 nt, Human
guauuguaaauuauauuugu

SEQ ID NO: 2850174 - RNA, 14 nt, Human
guauugaauauugu

SEQ ID NO: 2850175 - RNA, 23 nt, Human
guauugaauauuguguuccuuuu

SEQ ID NO: 2850176 - RNA, 19 nt, Human
guauucuagcuaauguaau

SEQ ID NO: 2850177 - RNA, 21 nt, Human
aaaucauugcuuugaagcagu

SEQ ID NO: 2850178 - RNA, 14 nt, Human
guauucuugucaaa

SEQ ID NO: 2850179 - RNA, 19 nt, Human
aaaucauuaauacucuucu

SEQ ID NO: 2850180 - RNA, 17 nt, Human
aaaucaucgaaaauuca

SEQ ID NO: 2850181 - RNA, 12 nt, Human
aaaucaucuauu

SEQ ID NO: 2850182 - RNA, 13 nt, Human
aaaucaucuauuu

SEQ ID NO: 2850183 - RNA, 14 nt, Human
aaaucaucuauuuu

SEQ ID NO: 2850184 - RNA, 16 nt, Human
aaaucaucuauuuuga

SEQ ID NO: 2850185 - RNA, 17 nt, Human
aaaucaucuauuuugau

SEQ ID NO: 2850186 - RNA, 19 nt, Human
aaaucaucuauuuugaugc

SEQ ID NO: 2850187 - RNA, 19 nt, Human
guauuuacgcuuugauuca

SEQ ID NO: 2850188 - RNA, 17 nt, Human
guauuuacgcuuugauu

SEQ ID NO: 2850189 - RNA, 16 nt, Human
guauuuacgcuuugau

SEQ ID NO: 2850190 - RNA, 12 nt, Human
guauuuauaaua

SEQ ID NO: 2850191 - RNA, 13 nt, Human
guauuuauauauu

SEQ ID NO: 2850192 - RNA, 12 nt, Human
guauuuauauau

SEQ ID NO: 2850193 - RNA, 19 nt, Human
guauuuauguaaugaagua

SEQ ID NO: 2850194 - RNA, 22 nt, Human
guauuuauguaaugaaguaaag

SEQ ID NO: 2850195 - RNA, 16 nt, Human
guauuuauauauuuau

SEQ ID NO: 2850196 - RNA, 15 nt, Human
guauuuauauauuua

SEQ ID NO: 2850197 - RNA, 17 nt, Human
guauuuauauauuuaua

SEQ ID NO: 2850198 - RNA, 13 nt, Human
guauuuaucuuua

SEQ ID NO: 2850199 - RNA, 18 nt, Human
guauuuaaacuaucuugu

SEQ ID NO: 2850200 - RNA, 22 nt, Human
guauuuaaacuaucuuguguga

SEQ ID NO: 2850201 - RNA, 9 nt, Human
guauuuaac

SEQ ID NO: 2850202 - RNA, 12 nt, Human
guauugugguau

SEQ ID NO: 2850203 - RNA, 21 nt, Human
aaaugucucuuuaaugucaca

SEQ ID NO: 2850204 - RNA, 14 nt, Human
aaaugucuguaaau

SEQ ID NO: 2850205 - RNA, 20 nt, Human
aaaugucuguaaauauguuu

SEQ ID NO: 2850206 - RNA, 15 nt, Human
aaaugucuuaauuuu

SEQ ID NO: 2850207 - RNA, 18 nt, Human
aaaugucuuaauuuuuga

SEQ ID NO: 2850208 - RNA, 16 nt, Human
aaaugucuuauauagc

SEQ ID NO: 2850209 - RNA, 18 nt, Human
aaaugucuuauauagcag

SEQ ID NO: 2850210 - RNA, 11 nt, Human
aaaugugcagu

SEQ ID NO: 2850211 - RNA, 14 nt, Human
aaaugucuuccugg

SEQ ID NO: 2850212 - RNA, 12 nt, Human
aaaugucuugcu

SEQ ID NO: 2850213 - RNA, 22 nt, Human
aaaugucuugcuguugacauau

SEQ ID NO: 2850214 - RNA, 23 nt, Human
aaaugucuugcuguugacauauu

SEQ ID NO: 2850215 - RNA, 16 nt, Human
aaauguaguugaugua

SEQ ID NO: 2850216 - RNA, 19 nt, Human
aaauguaguugauguaucc

SEQ ID NO: 2850217 - RNA, 11 nt, Human
aaauguauacu

SEQ ID NO: 2850218 - RNA, 13 nt, Human
aaauguauauaca

SEQ ID NO: 2850219 - RNA, 14 nt, Human
aaauguauauacac

SEQ ID NO: 2850220 - RNA, 15 nt, Human
aaauguauauacaca

SEQ ID NO: 2850221 - RNA, 16 nt, Human
aaauguauauacacau

SEQ ID NO: 2850222 - RNA, 17 nt, Human
aaauguauauacacaua

SEQ ID NO: 2850223 - RNA, 18 nt, Human
aaauguauauacacauau

SEQ ID NO: 2850224 - RNA, 19 nt, Human
aaauguauauacacauaua

SEQ ID NO: 2850225 - RNA, 22 nt, Human
aaauguauauacacauauaccu

SEQ ID NO: 2850226 - RNA, 23 nt, Human
aaauguauauacacauauaccua

SEQ ID NO: 2850227 - RNA, 13 nt, Human
aaauguauauauu

SEQ ID NO: 2850228 - RNA, 14 nt, Human
aaauguauauauuu

SEQ ID NO: 2850229 - RNA, 16 nt, Human
aaauguauauauuuag

SEQ ID NO: 2850230 - RNA, 17 nt, Human
aaauguauauauuuagu

SEQ ID NO: 2850231 - RNA, 18 nt, Human
aaauguauauauuuagug

SEQ ID NO: 2850232 - RNA, 21 nt, Human
aaauguauauauuuagugcug

SEQ ID NO: 2850233 - RNA, 17 nt, Human
aaauguaucauagaaau

SEQ ID NO: 2850234 - RNA, 20 nt, Human
aaauguaucauagaaaugua

SEQ ID NO: 2850235 - RNA, 13 nt, Human
gucagaaacuguu

SEQ ID NO: 2850236 - RNA, 13 nt, Human
gucagaaagugua

SEQ ID NO: 2850237 - RNA, 16 nt, Human
gucagaaaguguaaau

SEQ ID NO: 2850238 - RNA, 18 nt, Human
gucagaaaguguaaaugu

SEQ ID NO: 2850239 - RNA, 17 nt, Human
gucacuuuguuuuacug

SEQ ID NO: 2850240 - RNA, 14 nt, Human
gucacuuaaaaugu

SEQ ID NO: 2850241 - RNA, 18 nt, Human
gucacuuaaaaugugcag

SEQ ID NO: 2850242 - RNA, 18 nt, Human
gucacuugugcuuugcuc

SEQ ID NO: 2850243 - RNA, 24 nt, Human
gucacuugugcuuugcucuugucc

SEQ ID NO: 2850244 - RNA, 24 nt, Human
gucacuucgcgugcccucgcugcu

SEQ ID NO: 2850245 - RNA, 18 nt, Human
gucacuucgcgugcccuc

SEQ ID NO: 2850246 - RNA, 19 nt, Human
gucacuggaccacugggca

SEQ ID NO: 2850247 - RNA, 17 nt, Human
gucacugcuuuuggccu

SEQ ID NO: 2850248 - RNA, 19 nt, Human
gucacugcuuuuggccugg

SEQ ID NO: 2850249 - RNA, 17 nt, Human
gucacuguuccuuguca

SEQ ID NO: 2850250 - RNA, 21 nt, Human
gucacugguagaccaaaauaa

SEQ ID NO: 2850251 - RNA, 20 nt, Human
gucacuguacugacuugagg

SEQ ID NO: 2850252 - RNA, 14 nt, Human
gucacugucccucc

SEQ ID NO: 2850253 - RNA, 15 nt, Human
gucacugucccuccu

SEQ ID NO: 2850254 - RNA, 16 nt, Human
gucacugucccuccug

SEQ ID NO: 2850255 - RNA, 17 nt, Human
gucacugucccuccugg

SEQ ID NO: 2850256 - RNA, 18 nt, Human
gucacugucccuccuggu

SEQ ID NO: 2850257 - RNA, 21 nt, Human
gucacugucccuccugguguc

SEQ ID NO: 2850258 - RNA, 17 nt, Human
gucaguguccaaagcag

SEQ ID NO: 2850259 - RNA, 20 nt, Human
gucaguguccaaagcagggu

SEQ ID NO: 2850260 - RNA, 23 nt, Human
gucaguguccaaagcagggucug

SEQ ID NO: 2850261 - RNA, 22 nt, Human
gucagugguccacaucccggga

SEQ ID NO: 2850262 - RNA, 13 nt, Human
gucagguuuaaca

SEQ ID NO: 2850263 - RNA, 15 nt, Human
gucagguuuaacauu

SEQ ID NO: 2850264 - RNA, 16 nt, Human
gucagguuuaacauuu

SEQ ID NO: 2850265 - RNA, 14 nt, Human
gucaggugacccug

SEQ ID NO: 2850266 - RNA, 17 nt, Human
gucaggguuggugugcu

SEQ ID NO: 2850267 - RNA, 18 nt, Human
gucaggguuggugugcug

SEQ ID NO: 2850268 - RNA, 22 nt, Human
gucaggguuggugugcugaggu

SEQ ID NO: 2850269 - RNA, 22 nt, Human
gucagucaugauggcaccacug

SEQ ID NO: 2850270 - RNA, 19 nt, Human
gucagucaugauggcacca

SEQ ID NO: 2850271 - RNA, 18 nt, Human
gucaguggggcucucuga

SEQ ID NO: 2850272 - RNA, 18 nt, Human
gucagugcaaaugucaga

SEQ ID NO: 2850273 - RNA, 16 nt, Human
gucagucuuuuucugu

SEQ ID NO: 2850274 - RNA, 17 nt, Human
gucagucuuuuucuguu

SEQ ID NO: 2850275 - RNA, 21 nt, Human
gucagucuuuuucuguuguaa

SEQ ID NO: 2850276 - RNA, 22 nt, Human
gucagguggggcagcuugaggg

SEQ ID NO: 2850277 - RNA, 18 nt, Human
gucagguggggcagcuug

SEQ ID NO: 2850278 - RNA, 17 nt, Human
gucagguggggcagcuu

SEQ ID NO: 2850279 - RNA, 16 nt, Human
gucagguggggcagcu

SEQ ID NO: 2850280 - RNA, 18 nt, Human
gucaggaguccaagacca

SEQ ID NO: 2850281 - RNA, 19 nt, Human
gucaggaguccaagaccag

SEQ ID NO: 2850282 - RNA, 16 nt, Human
gucaggaacagaagga

SEQ ID NO: 2850283 - RNA, 15 nt, Human
gucaggaacagaagg

SEQ ID NO: 2850284 - RNA, 17 nt, Human
gucaggaacagaaggau

SEQ ID NO: 2850285 - RNA, 13 nt, Human
gucagggagugcu

SEQ ID NO: 2850286 - RNA, 14 nt, Human
gucagggagugcug

SEQ ID NO: 2850287 - RNA, 19 nt, Human
gucagggagugcuggcuca

SEQ ID NO: 2850288 - RNA, 22 nt, Human
gucagggagugcuggcucacag

SEQ ID NO: 2850289 - RNA, 14 nt, Human
gucagggcccagag

SEQ ID NO: 2850290 - RNA, 15 nt, Human
gucagggcccagagg

SEQ ID NO: 2850291 - RNA, 16 nt, Human
gucagggcccagaggc

SEQ ID NO: 2850292 - RNA, 19 nt, Human
gucagggcccagaggcuga

SEQ ID NO: 2850293 - RNA, 20 nt, Human
gucagggcccagaggcugag

SEQ ID NO: 2850294 - RNA, 21 nt, Human
gucagggcccagaggcugagu

SEQ ID NO: 2850295 - RNA, 15 nt, Human
gucaggggugacaca

SEQ ID NO: 2850296 - RNA, 17 nt, Human
gucaggggugacacaga

SEQ ID NO: 2850297 - RNA, 18 nt, Human
gucaggggugacacagac

SEQ ID NO: 2850298 - RNA, 20 nt, Human
gucaggggugacacagacuc

SEQ ID NO: 2850299 - RNA, 21 nt, Human
gucaggggugacacagacuca

SEQ ID NO: 2850300 - RNA, 17 nt, Human
gucacaggacucugccu

SEQ ID NO: 2850301 - RNA, 18 nt, Human
gucacaggacucugccuc

SEQ ID NO: 2850302 - RNA, 12 nt, Human
gucacaggcagg

SEQ ID NO: 2850303 - RNA, 19 nt, Human
gucacaggacucugccucc

SEQ ID NO: 2850304 - RNA, 16 nt, Human
gucacaggagggaggg

SEQ ID NO: 2850305 - RNA, 21 nt, Human
gucacauggccuaugcacaua

SEQ ID NO: 2850306 - RNA, 23 nt, Human
gucacauggccuaugcacauaug

SEQ ID NO: 2850307 - RNA, 20 nt, Human
gucacagggcaugccccggc

SEQ ID NO: 2850308 - RNA, 12 nt, Human
gucacagggcca

SEQ ID NO: 2850309 - RNA, 13 nt, Human
gucacagggccaa

SEQ ID NO: 2850310 - RNA, 15 nt, Human
gucacagggccaacu

SEQ ID NO: 2850311 - RNA, 14 nt, Human
gucacauaaaacuu

SEQ ID NO: 2850312 - RNA, 15 nt, Human
gucacaucacaggac

SEQ ID NO: 2850313 - RNA, 16 nt, Human
gucacaucagauaaga

SEQ ID NO: 2850314 - RNA, 17 nt, Human
gucacaucagauaagac

SEQ ID NO: 2850315 - RNA, 13 nt, Human
gucacaugaaaca

SEQ ID NO: 2850316 - RNA, 17 nt, Human
gucacaaagaauuuaaa

SEQ ID NO: 2850317 - RNA, 14 nt, Human
gucacaaagaguuc

SEQ ID NO: 2850318 - RNA, 13 nt, Human
aaauuuaaugcug

SEQ ID NO: 2850319 - RNA, 15 nt, Human
aaauuuaaugcugcc

SEQ ID NO: 2850320 - RNA, 17 nt, Human
aaauuuaaugcugccuu

SEQ ID NO: 2850321 - RNA, 15 nt, Human
aaauuuaaguaucuu

SEQ ID NO: 2850322 - RNA, 23 nt, Human
aaauuuaaguaucuuuuuucaaa

SEQ ID NO: 2850323 - RNA, 16 nt, Human
aaauuuaagugcgugu

SEQ ID NO: 2850324 - RNA, 21 nt, Human
aaauuuaagugcguguguaga

SEQ ID NO: 2850325 - RNA, 13 nt, Human
aaauuuaaagaua

SEQ ID NO: 2850326 - RNA, 15 nt, Human
aaauuuaaagauauu

SEQ ID NO: 2850327 - RNA, 14 nt, Human
gucacugacacaaa

SEQ ID NO: 2850328 - RNA, 16 nt, Human
gucacugacacaaagg

SEQ ID NO: 2850329 - RNA, 20 nt, Human
gucacugcacagugcaucuc

SEQ ID NO: 2850330 - RNA, 23 nt, Human
gucacugcacagugcaucucagc

SEQ ID NO: 2850331 - RNA, 16 nt, Human
gucacugccacuuugc

SEQ ID NO: 2850332 - RNA, 17 nt, Human
gucacugccacuuugca

SEQ ID NO: 2850333 - RNA, 18 nt, Human
gucacugaggccugagac

SEQ ID NO: 2850334 - RNA, 23 nt, Human
gucacugaggccugagacccagg

SEQ ID NO: 2850335 - RNA, 22 nt, Human
gucacugauguacaauuaaaaa

SEQ ID NO: 2850336 - RNA, 21 nt, Human
gucacaguguuuacacuuugg

SEQ ID NO: 2850337 - RNA, 13 nt, Human
gucacauugcauu

SEQ ID NO: 2850338 - RNA, 17 nt, Human
gucacauugcauucuau

SEQ ID NO: 2850339 - RNA, 18 nt, Human
gucacauugcauucuauu

SEQ ID NO: 2850340 - RNA, 21 nt, Human
gucacauugcauucuauugcc

SEQ ID NO: 2850341 - RNA, 13 nt, Human
gucaccaaggaaa

SEQ ID NO: 2850342 - RNA, 14 nt, Human
gucaccaaggaaac

SEQ ID NO: 2850343 - RNA, 23 nt, Human
gucaccaaggaaacgcuaccucu

SEQ ID NO: 2850344 - RNA, 15 nt, Human
gucaccaagcccagu

SEQ ID NO: 2850345 - RNA, 12 nt, Human
gucaccaagccc

SEQ ID NO: 2850346 - RNA, 11 nt, Human
aacaguauuua

SEQ ID NO: 2850347 - RNA, 12 nt, Human
aacaguauuuau

SEQ ID NO: 2850348 - RNA, 16 nt, Human
aacaguauuuauuuug

SEQ ID NO: 2850349 - RNA, 17 nt, Human
aacaguauuuauuuugu

SEQ ID NO: 2850350 - RNA, 18 nt, Human
aacaguauuuauuuugua

SEQ ID NO: 2850351 - RNA, 19 nt, Human
aacaguauuuauuuuguaa

SEQ ID NO: 2850352 - RNA, 20 nt, Human
aacaguauuuauuuuguaau

SEQ ID NO: 2850353 - RNA, 23 nt, Human
aacaguauuuauuuuguaauuau

SEQ ID NO: 2850354 - RNA, 22 nt, Human
aacaguauuucauugccugugu

SEQ ID NO: 2850355 - RNA, 12 nt, Human
aacagucauguu

SEQ ID NO: 2850356 - RNA, 13 nt, Human
aacagucauguuu

SEQ ID NO: 2850357 - RNA, 14 nt, Human
aacagucauguuuu

SEQ ID NO: 2850358 - RNA, 15 nt, Human
aacagucauguuuua

SEQ ID NO: 2850359 - RNA, 21 nt, Human
aacagucauguuuuaaaugua

SEQ ID NO: 2850360 - RNA, 14 nt, Human
guccgguguucuaa

SEQ ID NO: 2850361 - RNA, 15 nt, Human
guccgguguucuaag

SEQ ID NO: 2850362 - RNA, 16 nt, Human
guccgguguucuaaga

SEQ ID NO: 2850363 - RNA, 17 nt, Human
guccgguguucuaagau

SEQ ID NO: 2850364 - RNA, 22 nt, Human
gucccuuccccucccuggcucc

SEQ ID NO: 2850365 - RNA, 20 nt, Human
gucccuuccccucccuggcu

SEQ ID NO: 2850366 - RNA, 19 nt, Human
gucccuuccccucccuggc

SEQ ID NO: 2850367 - RNA, 22 nt, Human
aacauaaaaaggacaucagcaa

SEQ ID NO: 2850368 - RNA, 20 nt, Human
aacauaaaaaggacaucagc

SEQ ID NO: 2850369 - RNA, 19 nt, Human
aacauaaaaaggacaucag

SEQ ID NO: 2850370 - RNA, 15 nt, Human
aacauaaaaaggaca

SEQ ID NO: 2850371 - RNA, 16 nt, Human
aacauaaaaaaacuuc

SEQ ID NO: 2850372 - RNA, 23 nt, Human
aacaguccccguggccaucccug

SEQ ID NO: 2850373 - RNA, 15 nt, Human
aacauauaaaauaau

SEQ ID NO: 2850374 - RNA, 17 nt, Human
aacauauaaaauaaugc

SEQ ID NO: 2850375 - RNA, 19 nt, Human
aacauaguaaguucagcac

SEQ ID NO: 2850376 - RNA, 20 nt, Human
aacauaguaaguucagcacu

SEQ ID NO: 2850377 - RNA, 21 nt, Human
aacauaguaaguucagcacuu

SEQ ID NO: 2850378 - RNA, 19 nt, Human
aacauaaagguaaaacaaa

SEQ ID NO: 2850379 - RNA, 12 nt, Human
aacauaaaacaa

SEQ ID NO: 2850380 - RNA, 13 nt, Human
aacauguguuuua

SEQ ID NO: 2850381 - RNA, 12 nt, Human
aacauguauuua

SEQ ID NO: 2850382 - RNA, 15 nt, Human
aacauguauuuaugu

SEQ ID NO: 2850383 - RNA, 16 nt, Human
aacauguauuuaugua

SEQ ID NO: 2850384 - RNA, 21 nt, Human
aacauguauuuauguaaugaa

SEQ ID NO: 2850385 - RNA, 12 nt, Human
aacauuauuuau

SEQ ID NO: 2850386 - RNA, 16 nt, Human
aacauuauuuauucag

SEQ ID NO: 2850387 - RNA, 23 nt, Human
aacauuauuuauucagcuucauu

SEQ ID NO: 2850388 - RNA, 12 nt, Human
aacauuccaaga

SEQ ID NO: 2850389 - RNA, 13 nt, Human
aacauuccaagaa

SEQ ID NO: 2850390 - RNA, 17 nt, Human
aacauuccuaaaaugcu

SEQ ID NO: 2850391 - RNA, 18 nt, Human
aacauuccuaaaaugcuu

SEQ ID NO: 2850392 - RNA, 11 nt, Human
aacauuccaag

SEQ ID NO: 2850393 - RNA, 17 nt, Human
aacauuccaagacucua

SEQ ID NO: 2850394 - RNA, 20 nt, Human
aacauuccaaggaguuggaa

SEQ ID NO: 2850395 - RNA, 17 nt, Human
guccucguagccaucuc

SEQ ID NO: 2850396 - RNA, 13 nt, Human
guccucgauggga

SEQ ID NO: 2850397 - RNA, 22 nt, Human
guccucgaugggagggauggcc

SEQ ID NO: 2850398 - RNA, 18 nt, Human
aacauugccuuugaaugu

SEQ ID NO: 2850399 - RNA, 22 nt, Human
aacauugccuuugaauguuaau

SEQ ID NO: 2850400 - RNA, 16 nt, Human
aacauuggauuauccu

SEQ ID NO: 2850401 - RNA, 12 nt, Human
aacauuggauua

SEQ ID NO: 2850402 - RNA, 16 nt, Human
guccuuuucuugcuua

SEQ ID NO: 2850403 - RNA, 18 nt, Human
guccuuugcgccugugac

SEQ ID NO: 2850404 - RNA, 21 nt, Human
guccuuuggggcauagaucag

SEQ ID NO: 2850405 - RNA, 19 nt, Human
guccuuuuacuacagcuau

SEQ ID NO: 2850406 - RNA, 11 nt, Human
guccuuucccu

SEQ ID NO: 2850407 - RNA, 22 nt, Human
guccuuuauguggaaaacagaa

SEQ ID NO: 2850408 - RNA, 18 nt, Human
guccuuuccaaggcuucu

SEQ ID NO: 2850409 - RNA, 20 nt, Human
guccuuuccaaggcuucucc

SEQ ID NO: 2850410 - RNA, 22 nt, Human
guccuuuccaaggcuucuccaa

SEQ ID NO: 2850411 - RNA, 19 nt, Human
guccuggagcagaccaccc

SEQ ID NO: 2850412 - RNA, 17 nt, Human
guccuggauguugugug

SEQ ID NO: 2850413 - RNA, 21 nt, Human
guccuuuauguggaaaacaga

SEQ ID NO: 2850414 - RNA, 16 nt, Human
gucgaggacagggagg

SEQ ID NO: 2850415 - RNA, 14 nt, Human
gucgaggggcucuc

SEQ ID NO: 2850416 - RNA, 15 nt, Human
gucgaggggcucuca

SEQ ID NO: 2850417 - RNA, 16 nt, Human
gucgaggggcucucag

SEQ ID NO: 2850418 - RNA, 19 nt, Human
gucgaggggcucucagcuc

SEQ ID NO: 2850419 - RNA, 21 nt, Human
guccuggaagcgcgagggccu

SEQ ID NO: 2850420 - RNA, 20 nt, Human
guccuggacaccgggccagu

SEQ ID NO: 2850421 - RNA, 17 nt, Human
guccuggagcaaucaca

SEQ ID NO: 2850422 - RNA, 12 nt, Human
guccugcuucug

SEQ ID NO: 2850423 - RNA, 13 nt, Human
guccugcuucuga

SEQ ID NO: 2850424 - RNA, 14 nt, Human
guccucuuuucuga

SEQ ID NO: 2850425 - RNA, 19 nt, Human
guccucucccaaguccaca

SEQ ID NO: 2850426 - RNA, 12 nt, Human
gucgccucugca

SEQ ID NO: 2850427 - RNA, 22 nt, Human
gucuaugggacucaaugcacug

SEQ ID NO: 2850428 - RNA, 15 nt, Human
gucuauguuccgaau

SEQ ID NO: 2850429 - RNA, 22 nt, Human
gucuauguuccgaauugagcac

SEQ ID NO: 2850430 - RNA, 15 nt, Human
gucuaugggacucaa

SEQ ID NO: 2850431 - RNA, 10 nt, Human
gucuauuuaa

SEQ ID NO: 2850432 - RNA, 21 nt, Human
gucuaguugccaaaucuggcu

SEQ ID NO: 2850433 - RNA, 23 nt, Human
gucuaguugccaaaucuggcucc

SEQ ID NO: 2850434 - RNA, 12 nt, Human
gucuauuccagc

SEQ ID NO: 2850435 - RNA, 13 nt, Human
gucuauuccagcu

SEQ ID NO: 2850436 - RNA, 14 nt, Human
gucuauuccagcuc

SEQ ID NO: 2850437 - RNA, 15 nt, Human
gucuauuccagcuca

SEQ ID NO: 2850438 - RNA, 16 nt, Human
gucuauuccagcucau

SEQ ID NO: 2850439 - RNA, 20 nt, Human
gucuauuccagcucauucau

SEQ ID NO: 2850440 - RNA, 21 nt, Human
gucuauuccagcucauucauu

SEQ ID NO: 2850441 - RNA, 19 nt, Human
gucuagcagagcaggggca

SEQ ID NO: 2850442 - RNA, 14 nt, Human
gucuagcaugccaa

SEQ ID NO: 2850443 - RNA, 12 nt, Human
gucuagauucuc

SEQ ID NO: 2850444 - RNA, 14 nt, Human
gucuagucucuccu

SEQ ID NO: 2850445 - RNA, 18 nt, Human
gucuagucucuccuguaa

SEQ ID NO: 2850446 - RNA, 22 nt, Human
gucuagauguuuauucuucuag

SEQ ID NO: 2850447 - RNA, 11 nt, Human
gucuagauuca

SEQ ID NO: 2850448 - RNA, 15 nt, Human
gucuagauucaaagg

SEQ ID NO: 2850449 - RNA, 19 nt, Human
gucuagauucaaagguucu

SEQ ID NO: 2850450 - RNA, 20 nt, Human
gucuagauucaaagguucua

SEQ ID NO: 2850451 - RNA, 21 nt, Human
gucuagauucaaagguucuag

SEQ ID NO: 2850452 - RNA, 22 nt, Human
gucuagauucaaagguucuagg

SEQ ID NO: 2850453 - RNA, 20 nt, Human
aacacacagauacacacaca

SEQ ID NO: 2850454 - RNA, 14 nt, Human
aacacagccugggc

SEQ ID NO: 2850455 - RNA, 13 nt, Human
aacacagccuggg

SEQ ID NO: 2850456 - RNA, 16 nt, Human
aacacaaguccuguga

SEQ ID NO: 2850457 - RNA, 17 nt, Human
aacacaaggucauggcc

SEQ ID NO: 2850458 - RNA, 21 nt, Human
aacacaaggucauggccacac

SEQ ID NO: 2850459 - RNA, 24 nt, Human
gucaguguccaaagcagggucugg

SEQ ID NO: 2850460 - RNA, 16 nt, Human
aaauuucuaagagagc

SEQ ID NO: 2850461 - RNA, 22 nt, Human
aaauuucuagccugcacuuuga

SEQ ID NO: 2850462 - RNA, 23 nt, Human
aaauuucucaucacagggauuua

SEQ ID NO: 2850463 - RNA, 13 nt, Human
aacacaaacugua

SEQ ID NO: 2850464 - RNA, 14 nt, Human
aaauuugagacuau

SEQ ID NO: 2850465 - RNA, 13 nt, Human
aaauuugauacuu

SEQ ID NO: 2850466 - RNA, 15 nt, Human
aaauuugauacuuau

SEQ ID NO: 2850467 - RNA, 19 nt, Human
aacacaaacuguaaauaaa

SEQ ID NO: 2850468 - RNA, 16 nt, Human
aacacaaacuguaaau

SEQ ID NO: 2850469 - RNA, 15 nt, Human
aacacaaacuguaaa

SEQ ID NO: 2850470 - RNA, 21 nt, Human
aacacugggggcaccuuaaga

SEQ ID NO: 2850471 - RNA, 15 nt, Human
aacacuggcagacug

SEQ ID NO: 2850472 - RNA, 21 nt, Human
aacacucacauuuauucugcu

SEQ ID NO: 2850473 - RNA, 16 nt, Human
aacacagccugggccc

SEQ ID NO: 2850474 - RNA, 15 nt, Human
aacacaggcaaaauc

SEQ ID NO: 2850475 - RNA, 19 nt, Human
aacacagcugagagacuuu

SEQ ID NO: 2850476 - RNA, 11 nt, Human
aacacagcugu

SEQ ID NO: 2850477 - RNA, 17 nt, Human
aacacagcuguucuucu

SEQ ID NO: 2850478 - RNA, 18 nt, Human
aacacagcuguucuucug

SEQ ID NO: 2850479 - RNA, 24 nt, Human
aacacagcuguucuucuguucugc

SEQ ID NO: 2850480 - RNA, 20 nt, Human
aacacagcuuacaaucgcaa

SEQ ID NO: 2850481 - RNA, 17 nt, Human
aacacucaagaagcagg

SEQ ID NO: 2850482 - RNA, 16 nt, Human
aacacuauguuuauuu

SEQ ID NO: 2850483 - RNA, 23 nt, Human
aacacugguggaggauggaaagg

SEQ ID NO: 2850484 - RNA, 17 nt, Human
aacacuggugugaccug

SEQ ID NO: 2850485 - RNA, 20 nt, Human
aacacuggugugaccugagg

SEQ ID NO: 2850486 - RNA, 22 nt, Human
aacacuggugugaccugagggc

SEQ ID NO: 2850487 - RNA, 14 nt, Human
gucauuuaaaugug

SEQ ID NO: 2850488 - RNA, 15 nt, Human
gucauuuaaaugugu

SEQ ID NO: 2850489 - RNA, 23 nt, Human
gucauuuaacugaagauguugag

SEQ ID NO: 2850490 - RNA, 16 nt, Human
gucauuuacuaaacau

SEQ ID NO: 2850491 - RNA, 17 nt, Human
gucauuuacuaaacaua

SEQ ID NO: 2850492 - RNA, 21 nt, Human
gucauuuaugugucaguucau

SEQ ID NO: 2850493 - RNA, 16 nt, Human
gucauuuauuuuaaaa

SEQ ID NO: 2850494 - RNA, 21 nt, Human
gucauuuauuuuaaaaaauga

SEQ ID NO: 2850495 - RNA, 12 nt, Human
gucauuucauuc

SEQ ID NO: 2850496 - RNA, 14 nt, Human
gucauuucauucca

SEQ ID NO: 2850497 - RNA, 15 nt, Human
gucauuucauuccau

SEQ ID NO: 2850498 - RNA, 16 nt, Human
gucauuucauuccauu

SEQ ID NO: 2850499 - RNA, 20 nt, Human
gucauuucauuccauugccu

SEQ ID NO: 2850500 - RNA, 21 nt, Human
gucauuucauuccauugccua

SEQ ID NO: 2850501 - RNA, 17 nt, Human
gucauuugagcagggcu

SEQ ID NO: 2850502 - RNA, 20 nt, Human
guccaaauaacaaguaccaa

SEQ ID NO: 2850503 - RNA, 22 nt, Human
guccaaauguccuccagaagcc

SEQ ID NO: 2850504 - RNA, 16 nt, Human
guccauauuuucacag

SEQ ID NO: 2850505 - RNA, 17 nt, Human
guccaucagccaggaca

SEQ ID NO: 2850506 - RNA, 15 nt, Human
guccaucagccccuc

SEQ ID NO: 2850507 - RNA, 19 nt, Human
gucauuugagcagggcuca

SEQ ID NO: 2850508 - RNA, 19 nt, Human
guccaaagaggcugccccu

SEQ ID NO: 2850509 - RNA, 16 nt, Human
guccaaagaggcugcc

SEQ ID NO: 2850510 - RNA, 14 nt, Human
guccaaaggaggcu

SEQ ID NO: 2850511 - RNA, 17 nt, Human
guccaaagcagggucug

SEQ ID NO: 2850512 - RNA, 20 nt, Human
guccaaaggaggcuggcagg

SEQ ID NO: 2850513 - RNA, 16 nt, Human
guccaaaggaggcugg

SEQ ID NO: 2850514 - RNA, 14 nt, Human
guccccaccuggga

SEQ ID NO: 2850515 - RNA, 23 nt, Human
gucccaaugcacauccauuccca

SEQ ID NO: 2850516 - RNA, 20 nt, Human
gucccaaugguccugacuuu

SEQ ID NO: 2850517 - RNA, 23 nt, Human
gucccaaggaaagccccagcacu

SEQ ID NO: 2850518 - RNA, 13 nt, Human
guccaucugcccg

SEQ ID NO: 2850519 - RNA, 14 nt, Human
guccaucugcccgc

SEQ ID NO: 2850520 - RNA, 16 nt, Human
guccaucugcccgccu

SEQ ID NO: 2850521 - RNA, 17 nt, Human
guccaucugcccgccug

SEQ ID NO: 2850522 - RNA, 19 nt, Human
guccaucugcccgccugcc

SEQ ID NO: 2850523 - RNA, 21 nt, Human
guccaucugcccgccugccca

SEQ ID NO: 2850524 - RNA, 22 nt, Human
guccaucugcccgccugcccac

SEQ ID NO: 2850525 - RNA, 17 nt, Human
gucccuaaagaaaaaaa

SEQ ID NO: 2850526 - RNA, 16 nt, Human
gucccugguuuucagu

SEQ ID NO: 2850527 - RNA, 15 nt, Human
gucccuaaagaaaaa

SEQ ID NO: 2850528 - RNA, 18 nt, Human
gucccuuccccucccugg

SEQ ID NO: 2850529 - RNA, 17 nt, Human
gucccuuccccucccug

SEQ ID NO: 2850530 - RNA, 14 nt, Human
gucccuuccccucc

SEQ ID NO: 2850531 - RNA, 13 nt, Human
gucccuuccccuc

SEQ ID NO: 2850532 - RNA, 12 nt, Human
gucccuuccccu

SEQ ID NO: 2850533 - RNA, 15 nt, Human
gucccuucaccuccu

SEQ ID NO: 2850534 - RNA, 18 nt, Human
gucccuucaccuccucgc

SEQ ID NO: 2850535 - RNA, 11 nt, Human
guccccugcuu

SEQ ID NO: 2850536 - RNA, 23 nt, Human
guccccugucgaguucggcucug

SEQ ID NO: 2850537 - RNA, 15 nt, Human
gucccggggcuccac

SEQ ID NO: 2850538 - RNA, 15 nt, Human
guccccaccugggac

SEQ ID NO: 2850539 - RNA, 18 nt, Human
guccccagagaccaggcu

SEQ ID NO: 2850540 - RNA, 14 nt, Human
guccccagcccuuc

SEQ ID NO: 2850541 - RNA, 12 nt, Human
guccccuccccc

SEQ ID NO: 2850542 - RNA, 22 nt, Human
guccccucccccaccccugcug

SEQ ID NO: 2850543 - RNA, 16 nt, Human
aacuucacauuaaaaa

SEQ ID NO: 2850544 - RNA, 17 nt, Human
aacuucacauuaaaaaa

SEQ ID NO: 2850545 - RNA, 21 nt, Human
aacuucagaugggaggaaaga

SEQ ID NO: 2850546 - RNA, 12 nt, Human
aacuucagcacc

SEQ ID NO: 2850547 - RNA, 13 nt, Human
aacuucagcacca

SEQ ID NO: 2850548 - RNA, 14 nt, Human
aacuucuaauauau

SEQ ID NO: 2850549 - RNA, 16 nt, Human
aacuucuaauauauuu

SEQ ID NO: 2850550 - RNA, 12 nt, Human
aacuugaaaaau

SEQ ID NO: 2850551 - RNA, 15 nt, Human
aacuugaaaaauacu

SEQ ID NO: 2850552 - RNA, 14 nt, Human
aacuugaaaauaua

SEQ ID NO: 2850553 - RNA, 22 nt, Human
aacuugaaaauauaugauggcu

SEQ ID NO: 2850554 - RNA, 19 nt, Human
aacuugaaauuauaucugu

SEQ ID NO: 2850555 - RNA, 22 nt, Human
aacuucuuucuauuugacuugu

SEQ ID NO: 2850556 - RNA, 15 nt, Human
aacuucuuugaauuu

SEQ ID NO: 2850557 - RNA, 13 nt, Human
aacuucuugucag

SEQ ID NO: 2850558 - RNA, 14 nt, Human
aacuucuugucaga

SEQ ID NO: 2850559 - RNA, 16 nt, Human
aacuucuugucagaca

SEQ ID NO: 2850560 - RNA, 17 nt, Human
aacuucuugucagacau

SEQ ID NO: 2850561 - RNA, 18 nt, Human
aacuucuugucagacaua

SEQ ID NO: 2850562 - RNA, 20 nt, Human
aacuucuugucagacauaaa

SEQ ID NO: 2850563 - RNA, 21 nt, Human
aacuucuugucagacauaaag

SEQ ID NO: 2850564 - RNA, 22 nt, Human
aacuucuugucagacauaaagc

SEQ ID NO: 2850565 - RNA, 23 nt, Human
aacuucuugucagacauaaagcc

SEQ ID NO: 2850566 - RNA, 13 nt, Human
aacuucacucugg

SEQ ID NO: 2850567 - RNA, 13 nt, Human
aacuugaauaaua

SEQ ID NO: 2850568 - RNA, 16 nt, Human
aacuugaaugugucag

SEQ ID NO: 2850569 - RNA, 16 nt, Human
aacuugacuccauuuc

SEQ ID NO: 2850570 - RNA, 15 nt, Human
aacuugagauguaug

SEQ ID NO: 2850571 - RNA, 20 nt, Human
aacuugagauguaugaaggc

SEQ ID NO: 2850572 - RNA, 22 nt, Human
aacuugagauguaugaaggcuu

SEQ ID NO: 2850573 - RNA, 22 nt, Human
aacuugagcgugaaucuguauc

SEQ ID NO: 2850574 - RNA, 19 nt, Human
aacuugagcgugaaucugu

SEQ ID NO: 2850575 - RNA, 19 nt, Human
aacuugagggcccagagca

SEQ ID NO: 2850576 - RNA, 14 nt, Human
aacuguguguaauu

SEQ ID NO: 2850577 - RNA, 21 nt, Human
aacuguguguaauuguuccuu

SEQ ID NO: 2850578 - RNA, 22 nt, Human
aacuguguguaauuguuccuuu

SEQ ID NO: 2850579 - RNA, 17 nt, Human
aacuguguucauuagaa

SEQ ID NO: 2850580 - RNA, 12 nt, Human
aacuguguugua

SEQ ID NO: 2850581 - RNA, 19 nt, Human
aacugugaaguuuacauug

SEQ ID NO: 2850582 - RNA, 23 nt, Human
aacugugaugaagccgaccuuag

SEQ ID NO: 2850583 - RNA, 22 nt, Human
aacugugcagagucuagaaguu

SEQ ID NO: 2850584 - RNA, 21 nt, Human
aacugugcugaaugcuuuaga

SEQ ID NO: 2850585 - RNA, 17 nt, Human
aacugugaaguuuacau

SEQ ID NO: 2850586 - RNA, 18 nt, Human
aacugucuuuaaaagaga

SEQ ID NO: 2850587 - RNA, 19 nt, Human
aacugucuuuaaaagagag

SEQ ID NO: 2850588 - RNA, 13 nt, Human
aacuguguagcau

SEQ ID NO: 2850589 - RNA, 15 nt, Human
aacuguguagcaucu

SEQ ID NO: 2850590 - RNA, 22 nt, Human
aacuguggauacccuuacccuu

SEQ ID NO: 2850591 - RNA, 11 nt, Human
aacuguggccg

SEQ ID NO: 2850592 - RNA, 20 nt, Human
aacuguggccguuaucugga

SEQ ID NO: 2850593 - RNA, 14 nt, Human
aacuguccagagag

SEQ ID NO: 2850594 - RNA, 16 nt, Human
aacugucggaggaaag

SEQ ID NO: 2850595 - RNA, 17 nt, Human
aacugucggaggaaaga

SEQ ID NO: 2850596 - RNA, 19 nt, Human
aacugucggaggaaagaca

SEQ ID NO: 2850597 - RNA, 14 nt, Human
aacuguaugucaga

SEQ ID NO: 2850598 - RNA, 16 nt, Human
aacuguccagagagca

SEQ ID NO: 2850599 - RNA, 11 nt, Human
aacugccauua

SEQ ID NO: 2850600 - RNA, 12 nt, Human
aacugccauuau

SEQ ID NO: 2850601 - RNA, 18 nt, Human
aacugccauuauuuucug

SEQ ID NO: 2850602 - RNA, 21 nt, Human
aacugccauuauuuucuguca

SEQ ID NO: 2850603 - RNA, 22 nt, Human
aacugccauuauuuucugucag

SEQ ID NO: 2850604 - RNA, 23 nt, Human
aacugccauuauuuucugucaga

SEQ ID NO: 2850605 - RNA, 17 nt, Human
aacugcccccucugccc

SEQ ID NO: 2850606 - RNA, 16 nt, Human
aacugcccccucugcc

SEQ ID NO: 2850607 - RNA, 21 nt, Human
aacugcccccucugcccugcg

SEQ ID NO: 2850608 - RNA, 20 nt, Human
aacugcccccucugcccugc

SEQ ID NO: 2850609 - RNA, 19 nt, Human
aacugcccccucugcccug

SEQ ID NO: 2850610 - RNA, 18 nt, Human
aacugcccccucugcccu

SEQ ID NO: 2850611 - RNA, 14 nt, Human
gugauguuugcucu

SEQ ID NO: 2850612 - RNA, 12 nt, Human
gugauucaaaug

SEQ ID NO: 2850613 - RNA, 22 nt, Human
gugauucaauucaacacucccu

SEQ ID NO: 2850614 - RNA, 22 nt, Human
gugauuagagggaggagaauga

SEQ ID NO: 2850615 - RNA, 23 nt, Human
gugauccucccaccucagccucc

SEQ ID NO: 2850616 - RNA, 14 nt, Human
gugaucucagauca

SEQ ID NO: 2850617 - RNA, 22 nt, Human
gugaucgaugauucaggugcag

SEQ ID NO: 2850618 - RNA, 15 nt, Human
gugaucucagaucag

SEQ ID NO: 2850619 - RNA, 22 nt, Human
gugaucuuggcuuacugcagcc

SEQ ID NO: 2850620 - RNA, 15 nt, Human
gugaucuuuuaaagu

SEQ ID NO: 2850621 - RNA, 13 nt, Human
gugaucugucuug

SEQ ID NO: 2850622 - RNA, 15 nt, Human
gugaucugucuugua

SEQ ID NO: 2850623 - RNA, 19 nt, Human
gugaucugucuuguaauau

SEQ ID NO: 2850624 - RNA, 21 nt, Human
gugaucuuaauauauuugaaa

SEQ ID NO: 2850625 - RNA, 12 nt, Human
gugaucuuauuu

SEQ ID NO: 2850626 - RNA, 19 nt, Human
gugaucuuauuuuucuaaa

SEQ ID NO: 2850627 - RNA, 14 nt, Human
gugaugaacuuucu

SEQ ID NO: 2850628 - RNA, 23 nt, Human
gugaugguuccccuguucacucu

SEQ ID NO: 2850629 - RNA, 15 nt, Human
gugauguuuuuauga

SEQ ID NO: 2850630 - RNA, 16 nt, Human
gugauguuuuuaugau

SEQ ID NO: 2850631 - RNA, 19 nt, Human
gugauguucuaaggcucug

SEQ ID NO: 2850632 - RNA, 22 nt, Human
gugauguucuaaggcucugaga

SEQ ID NO: 2850633 - RNA, 12 nt, Human
gugauguucuaa

SEQ ID NO: 2850634 - RNA, 13 nt, Human
gugauguucuaag

SEQ ID NO: 2850635 - RNA, 16 nt, Human
gugauguucuaaggcu

SEQ ID NO: 2850636 - RNA, 18 nt, Human
gugauguucuaaggcucu

SEQ ID NO: 2850637 - RNA, 18 nt, Human
gugaugucuuuucuuggc

SEQ ID NO: 2850638 - RNA, 13 nt, Human
gugauguuagugu

SEQ ID NO: 2850639 - RNA, 22 nt, Human
gugaugguuccccuguucacuc

SEQ ID NO: 2850640 - RNA, 19 nt, Human
gugauguauauuccuuuga

SEQ ID NO: 2850641 - RNA, 21 nt, Human
gugcaccuguacucaggaggc

SEQ ID NO: 2850642 - RNA, 18 nt, Human
gugcaccuguacucagga

SEQ ID NO: 2850643 - RNA, 20 nt, Human
gugcaccuuaccaacuuucu

SEQ ID NO: 2850644 - RNA, 21 nt, Human
gugcaccuuaccaacuuucug

SEQ ID NO: 2850645 - RNA, 17 nt, Human
gugcauugggauuuuag

SEQ ID NO: 2850646 - RNA, 19 nt, Human
gugcauugggauuuuagaa

SEQ ID NO: 2850647 - RNA, 15 nt, Human
gugcauuguuucugu

SEQ ID NO: 2850648 - RNA, 19 nt, Human
gugcauuguuucugugggc

SEQ ID NO: 2850649 - RNA, 14 nt, Human
gugcauuucugaau

SEQ ID NO: 2850650 - RNA, 15 nt, Human
gugccaaaugcucuc

SEQ ID NO: 2850651 - RNA, 18 nt, Human
gugcaccaccacacccgg

SEQ ID NO: 2850652 - RNA, 21 nt, Human
gugcacaugcacgugugugca

SEQ ID NO: 2850653 - RNA, 15 nt, Human
gugcacccagaagaa

SEQ ID NO: 2850654 - RNA, 19 nt, Human
gugcacccaugggcucuga

SEQ ID NO: 2850655 - RNA, 23 nt, Human
gugcacccaugggcucugacaga

SEQ ID NO: 2850656 - RNA, 20 nt, Human
gugcacaaauauuuauuuuc

SEQ ID NO: 2850657 - RNA, 15 nt, Human
gugcuacugucuuug

SEQ ID NO: 2850658 - RNA, 20 nt, Human
gugcuacugucuuuggaaaa

SEQ ID NO: 2850659 - RNA, 19 nt, Human
gugcuagaauacuuuuuaa

SEQ ID NO: 2850660 - RNA, 14 nt, Human
gugcuagugagcug

SEQ ID NO: 2850661 - RNA, 21 nt, Human
aagaauaauucaauuuuaaag

SEQ ID NO: 2850662 - RNA, 22 nt, Human
aagaauaauucaauuuuaaaga

SEQ ID NO: 2850663 - RNA, 22 nt, Human
aagaagaugcuccagcaacaca

SEQ ID NO: 2850664 - RNA, 17 nt, Human
aagaagauguugaagaa

SEQ ID NO: 2850665 - RNA, 12 nt, Human
aagaagaugcuc

SEQ ID NO: 2850666 - RNA, 16 nt, Human
aagaagcaaggaacca

SEQ ID NO: 2850667 - RNA, 16 nt, Human
aagaagcaaauaaaua

SEQ ID NO: 2850668 - RNA, 12 nt, Human
aagaaguuuauu

SEQ ID NO: 2850669 - RNA, 19 nt, Human
aagaaguuuauucucauuu

SEQ ID NO: 2850670 - RNA, 15 nt, Human
aagaaaggaacauuu

SEQ ID NO: 2850671 - RNA, 14 nt, Human
aagaagagaagcug

SEQ ID NO: 2850672 - RNA, 16 nt, Human
aagaagagaagcugcu

SEQ ID NO: 2850673 - RNA, 17 nt, Human
aagaagagaagcugcug

SEQ ID NO: 2850674 - RNA, 18 nt, Human
aagaagagaagcugcuga

SEQ ID NO: 2850675 - RNA, 19 nt, Human
aagaagagaagcugcugac

SEQ ID NO: 2850676 - RNA, 14 nt, Human
aagaagagccacag

SEQ ID NO: 2850677 - RNA, 15 nt, Human
aagaagagccacagu

SEQ ID NO: 2850678 - RNA, 22 nt, Human
aagaagaugaucaguggacagu

SEQ ID NO: 2850679 - RNA, 19 nt, Human
aagaagauccuaaaacaaa

SEQ ID NO: 2850680 - RNA, 14 nt, Human
aagaagaucuguaa

SEQ ID NO: 2850681 - RNA, 14 nt, Human
aagaagaugaaugg

SEQ ID NO: 2850682 - RNA, 15 nt, Human
aagaagaugaauggc

SEQ ID NO: 2850683 - RNA, 18 nt, Human
aagaagaugaauggcguc

SEQ ID NO: 2850684 - RNA, 14 nt, Human
gugcucuggacagg

SEQ ID NO: 2850685 - RNA, 13 nt, Human
gugcucuggacag

SEQ ID NO: 2850686 - RNA, 16 nt, Human
gugcucugaucaucca

SEQ ID NO: 2850687 - RNA, 15 nt, Human
gugcucucaccagcu

SEQ ID NO: 2850688 - RNA, 13 nt, Human
gugcucagggcua

SEQ ID NO: 2850689 - RNA, 13 nt, Human
gugcuauaguauu

SEQ ID NO: 2850690 - RNA, 14 nt, Human
gugcuauaguauuu

SEQ ID NO: 2850691 - RNA, 15 nt, Human
gugcuauaguauuug

SEQ ID NO: 2850692 - RNA, 13 nt, Human
gugcuauauauau

SEQ ID NO: 2850693 - RNA, 20 nt, Human
gugcuauauauauaaauauu

SEQ ID NO: 2850694 - RNA, 13 nt, Human
gugcuccaggcag

SEQ ID NO: 2850695 - RNA, 16 nt, Human
gugcuccccucugaaa

SEQ ID NO: 2850696 - RNA, 14 nt, Human
gugcuccuccuugg

SEQ ID NO: 2850697 - RNA, 12 nt, Human
aagaaagcaacu

SEQ ID NO: 2850698 - RNA, 14 nt, Human
aagaaagcaacuuu

SEQ ID NO: 2850699 - RNA, 17 nt, Human
aagaaagauguauauag

SEQ ID NO: 2850700 - RNA, 17 nt, Human
aagaaagcugguaaacu

SEQ ID NO: 2850701 - RNA, 22 nt, Human
aagaaagcuucaaacugcauga

SEQ ID NO: 2850702 - RNA, 16 nt, Human
aagaaacagauaccau

SEQ ID NO: 2850703 - RNA, 22 nt, Human
aagaaaauuuuuguaguagcgu

SEQ ID NO: 2850704 - RNA, 22 nt, Human
gugccagaggaauccuggcagc

SEQ ID NO: 2850705 - RNA, 21 nt, Human
gugccagaggaauccuggcag

SEQ ID NO: 2850706 - RNA, 20 nt, Human
gugccagaggaauccuggca

SEQ ID NO: 2850707 - RNA, 13 nt, Human
gugccaacacuca

SEQ ID NO: 2850708 - RNA, 18 nt, Human
gugccaacacucaagaag

SEQ ID NO: 2850709 - RNA, 21 nt, Human
aacuuuagaagugcauuucug

SEQ ID NO: 2850710 - RNA, 22 nt, Human
aacuuuagaagugcauuucuga

SEQ ID NO: 2850711 - RNA, 14 nt, Human
aagaaaacaacuuc

SEQ ID NO: 2850712 - RNA, 16 nt, Human
gucuggaaugcagugg

SEQ ID NO: 2850713 - RNA, 15 nt, Human
gucuggaaugcagug

SEQ ID NO: 2850714 - RNA, 21 nt, Human
gucuucaaggcuucagucuca

SEQ ID NO: 2850715 - RNA, 17 nt, Human
gucuucaaacugugaag

SEQ ID NO: 2850716 - RNA, 17 nt, Human
gucuucaaauugucuuu

SEQ ID NO: 2850717 - RNA, 20 nt, Human
gucuucaaauugucuuuugu

SEQ ID NO: 2850718 - RNA, 22 nt, Human
gucuucaacauaacccacuugu

SEQ ID NO: 2850719 - RNA, 16 nt, Human
gucuucaacauccugc

SEQ ID NO: 2850720 - RNA, 17 nt, Human
gucuucaacauccugcc

SEQ ID NO: 2850721 - RNA, 18 nt, Human
gucuucaacauccugcca

SEQ ID NO: 2850722 - RNA, 19 nt, Human
gucuucaacauccugccag

SEQ ID NO: 2850723 - RNA, 20 nt, Human
gucuucaacauccugccagc

SEQ ID NO: 2850724 - RNA, 21 nt, Human
gucuucaacauccugccagcc

SEQ ID NO: 2850725 - RNA, 22 nt, Human
gucuucaacauccugccagccc

SEQ ID NO: 2850726 - RNA, 15 nt, Human
gucuuaucaagcagc

SEQ ID NO: 2850727 - RNA, 20 nt, Human
gucuuaucugagcugagcca

SEQ ID NO: 2850728 - RNA, 22 nt, Human
gucuuaucugagcugagccagg

SEQ ID NO: 2850729 - RNA, 23 nt, Human
gucuuaucugagcugagccaggc

SEQ ID NO: 2850730 - RNA, 21 nt, Human
gucuuucaggaccuuuugaag

SEQ ID NO: 2850731 - RNA, 13 nt, Human
gucuuguucuguc

SEQ ID NO: 2850732 - RNA, 16 nt, Human
gucuuguucugucacu

SEQ ID NO: 2850733 - RNA, 21 nt, Human
gucuuguucugucacucaggc

SEQ ID NO: 2850734 - RNA, 23 nt, Human
gucuuguucugucacucaggcug

SEQ ID NO: 2850735 - RNA, 13 nt, Human
gucuuguuagaaa

SEQ ID NO: 2850736 - RNA, 16 nt, Human
gucuuguuagaaaaca

SEQ ID NO: 2850737 - RNA, 17 nt, Human
gucuuguuagaaaacaa

SEQ ID NO: 2850738 - RNA, 22 nt, Human
gucuuguuuuuuuuuuccacuu

SEQ ID NO: 2850739 - RNA, 15 nt, Human
gucuuuaaaagagag

SEQ ID NO: 2850740 - RNA, 16 nt, Human
gucuuuaaaggcccag

SEQ ID NO: 2850741 - RNA, 18 nt, Human
gucuuuaaaggcccagcc

SEQ ID NO: 2850742 - RNA, 19 nt, Human
gucuuuaaaggcccagccc

SEQ ID NO: 2850743 - RNA, 20 nt, Human
gucuuuaaaggcccagcccc

SEQ ID NO: 2850744 - RNA, 22 nt, Human
gucuuuaaaggcccagccccua

SEQ ID NO: 2850745 - RNA, 16 nt, Human
gucuuuaaauagauac

SEQ ID NO: 2850746 - RNA, 13 nt, Human
gucuuuaaaucau

SEQ ID NO: 2850747 - RNA, 14 nt, Human
gucugacaggcaau

SEQ ID NO: 2850748 - RNA, 13 nt, Human
gucugacaggcaa

SEQ ID NO: 2850749 - RNA, 12 nt, Human
gucugacaggca

SEQ ID NO: 2850750 - RNA, 18 nt, Human
gucugacaggcaaugcug

SEQ ID NO: 2850751 - RNA, 15 nt, Human
gucugacaggcaaug

SEQ ID NO: 2850752 - RNA, 20 nt, Human
gucugacaggcaaugcuggc

SEQ ID NO: 2850753 - RNA, 14 nt, Human
gucuggaaguccaa

SEQ ID NO: 2850754 - RNA, 22 nt, Human
gucugcuuuaaagggccugccu

SEQ ID NO: 2850755 - RNA, 23 nt, Human
gucugcuuuaaagggccugccug

SEQ ID NO: 2850756 - RNA, 19 nt, Human
gucuggaagaaagauaaaa

SEQ ID NO: 2850757 - RNA, 14 nt, Human
gucucaaaaaaaca

SEQ ID NO: 2850758 - RNA, 12 nt, Human
gucuauuuaagc

SEQ ID NO: 2850759 - RNA, 16 nt, Human
gucuauuuaagccuca

SEQ ID NO: 2850760 - RNA, 16 nt, Human
gucuauuuuugucuua

SEQ ID NO: 2850761 - RNA, 16 nt, Human
gucucuuuauuccuag

SEQ ID NO: 2850762 - RNA, 17 nt, Human
gucucuuuauuccuagu

SEQ ID NO: 2850763 - RNA, 22 nt, Human
gucucuuuauuccuaguuggug

SEQ ID NO: 2850764 - RNA, 11 nt, Human
gucuauuuuaa

SEQ ID NO: 2850765 - RNA, 15 nt, Human
gucuauuuuaaaaua

SEQ ID NO: 2850766 - RNA, 16 nt, Human
gucuauuuuaaaauaa

SEQ ID NO: 2850767 - RNA, 11 nt, Human
gucucuuuugu

SEQ ID NO: 2850768 - RNA, 12 nt, Human
gucucuuuugua

SEQ ID NO: 2850769 - RNA, 17 nt, Human
gucucuuuuguaaauua

SEQ ID NO: 2850770 - RNA, 18 nt, Human
gucucuuuuguaaauuaa

SEQ ID NO: 2850771 - RNA, 19 nt, Human
gucucuuuuguaaauuaaa

SEQ ID NO: 2850772 - RNA, 11 nt, Human
gucugaacuuu

SEQ ID NO: 2850773 - RNA, 16 nt, Human
gucugaacuuugggaa

SEQ ID NO: 2850774 - RNA, 14 nt, Human
gucugaaaauguug

SEQ ID NO: 2850775 - RNA, 19 nt, Human
gucugaaaauguuguuaug

SEQ ID NO: 2850776 - RNA, 15 nt, Human
aacuauguugauaaa

SEQ ID NO: 2850777 - RNA, 22 nt, Human
aacuauuaagaggcagaaaauu

SEQ ID NO: 2850778 - RNA, 21 nt, Human
aacuauuaaggauguagcuuu

SEQ ID NO: 2850779 - RNA, 24 nt, Human
aacuauuaaggauguagcuuuuca

SEQ ID NO: 2850780 - RNA, 23 nt, Human
aacuauucaggagaguagaacag

SEQ ID NO: 2850781 - RNA, 20 nt, Human
aacucauuuuugccauacau

SEQ ID NO: 2850782 - RNA, 12 nt, Human
aacuauucaguu

SEQ ID NO: 2850783 - RNA, 16 nt, Human
aacuauucaguugugu

SEQ ID NO: 2850784 - RNA, 17 nt, Human
aacuauucaguuguguu

SEQ ID NO: 2850785 - RNA, 21 nt, Human
aacuauucaguuguguuuguu

SEQ ID NO: 2850786 - RNA, 14 nt, Human
aacuauucaugcua

SEQ ID NO: 2850787 - RNA, 17 nt, Human
aacuauucgaaugaaaa

SEQ ID NO: 2850788 - RNA, 20 nt, Human
aacuauucgaaugaaaagac

SEQ ID NO: 2850789 - RNA, 15 nt, Human
aacuaguccuuuacu

SEQ ID NO: 2850790 - RNA, 14 nt, Human
aacuaguuuuguuu

SEQ ID NO: 2850791 - RNA, 15 nt, Human
aacuaguuuuguuua

SEQ ID NO: 2850792 - RNA, 14 nt, Human
aacuauaugugaau

SEQ ID NO: 2850793 - RNA, 20 nt, Human
aacuauauucauuuccacuc

SEQ ID NO: 2850794 - RNA, 16 nt, Human
aacuauaaauauguac

SEQ ID NO: 2850795 - RNA, 16 nt, Human
aacuauacuugaacaa

SEQ ID NO: 2850796 - RNA, 17 nt, Human
aacuauacuugaacaaa

SEQ ID NO: 2850797 - RNA, 18 nt, Human
aacuauacuugaacaaaa

SEQ ID NO: 2850798 - RNA, 20 nt, Human
aacuauacuugaacaaaagg

SEQ ID NO: 2850799 - RNA, 22 nt, Human
aacuauacuugaacaaaagggu

SEQ ID NO: 2850800 - RNA, 17 nt, Human
aacuaguaguucucuug

SEQ ID NO: 2850801 - RNA, 18 nt, Human
aacuauggaucagaauag

SEQ ID NO: 2850802 - RNA, 23 nt, Human
aacguuuucuguuuggaggagca

SEQ ID NO: 2850803 - RNA, 23 nt, Human
aacguuuuuccuuuaaaaaaauu

SEQ ID NO: 2850804 - RNA, 14 nt, Human
aacuaaaagacauu

SEQ ID NO: 2850805 - RNA, 12 nt, Human
aacgugaaaaug

SEQ ID NO: 2850806 - RNA, 14 nt, Human
aacgugauacauuu

SEQ ID NO: 2850807 - RNA, 15 nt, Human
aacgugauacauuug

SEQ ID NO: 2850808 - RNA, 16 nt, Human
aacgugauacauuugg

SEQ ID NO: 2850809 - RNA, 11 nt, Human
aacgugcaacu

SEQ ID NO: 2850810 - RNA, 12 nt, Human
aacgugcaacug

SEQ ID NO: 2850811 - RNA, 20 nt, Human
aacgugcaacugacacuccc

SEQ ID NO: 2850812 - RNA, 12 nt, Human
aaccuucuggcc

SEQ ID NO: 2850813 - RNA, 19 nt, Human
aaccuuccuuccugcuuga

SEQ ID NO: 2850814 - RNA, 21 nt, Human
aaccuucgccaccuggguucc

SEQ ID NO: 2850815 - RNA, 22 nt, Human
aaccuuccauacauuuuuuucu

SEQ ID NO: 2850816 - RNA, 14 nt, Human
aaccugggauucag

SEQ ID NO: 2850817 - RNA, 17 nt, Human
aaccugggauucaggaa

SEQ ID NO: 2850818 - RNA, 20 nt, Human
aaccugggauucaggaaugu

SEQ ID NO: 2850819 - RNA, 21 nt, Human
aaccugggauucaggaaugug

SEQ ID NO: 2850820 - RNA, 17 nt, Human
aaccuuauccugcauug

SEQ ID NO: 2850821 - RNA, 18 nt, Human
aaccuuauccugcauugu

SEQ ID NO: 2850822 - RNA, 19 nt, Human
aaccuuauccugcauuguu

SEQ ID NO: 2850823 - RNA, 22 nt, Human
aaccuuauccugcauuguuagc

SEQ ID NO: 2850824 - RNA, 14 nt, Human
gucuuucuccaaag

SEQ ID NO: 2850825 - RNA, 16 nt, Human
gucuuucuccaaaguu

SEQ ID NO: 2850826 - RNA, 16 nt, Human
gucuuuccuggcacua

SEQ ID NO: 2850827 - RNA, 19 nt, Human
aaccuggccgcguuuagac

SEQ ID NO: 2850828 - RNA, 23 nt, Human
aaccuggccgcguuuagaccaag

SEQ ID NO: 2850829 - RNA, 20 nt, Human
gugagacaguccagccugga

SEQ ID NO: 2850830 - RNA, 21 nt, Human
gugacuuccucgccucuccca

SEQ ID NO: 2850831 - RNA, 15 nt, Human
gugacuucuccaggu

SEQ ID NO: 2850832 - RNA, 16 nt, Human
gugacuucagcucugu

SEQ ID NO: 2850833 - RNA, 14 nt, Human
gugacaugugaaac

SEQ ID NO: 2850834 - RNA, 15 nt, Human
gugacaugugaaacc

SEQ ID NO: 2850835 - RNA, 16 nt, Human
gugacaugugaaaccu

SEQ ID NO: 2850836 - RNA, 17 nt, Human
gugacaugugaaaccuu

SEQ ID NO: 2850837 - RNA, 18 nt, Human
gugacaugugaaaccuuu

SEQ ID NO: 2850838 - RNA, 19 nt, Human
gugacaugugaaaccuuuu

SEQ ID NO: 2850839 - RNA, 20 nt, Human
gugacaugugaaaccuuuuu

SEQ ID NO: 2850840 - RNA, 22 nt, Human
gugacaugugaaaccuuuuuua

SEQ ID NO: 2850841 - RNA, 19 nt, Human
gugacuguaucuguguaga

SEQ ID NO: 2850842 - RNA, 15 nt, Human
gugacuguaucugug

SEQ ID NO: 2850843 - RNA, 22 nt, Human
gugacauguguuggcagccucu

SEQ ID NO: 2850844 - RNA, 21 nt, Human
gugacauuuauuuuucucaug

SEQ ID NO: 2850845 - RNA, 16 nt, Human
gugagacucugucuca

SEQ ID NO: 2850846 - RNA, 14 nt, Human
gugagacucugucu

SEQ ID NO: 2850847 - RNA, 16 nt, Human
gugagacccugucucu

SEQ ID NO: 2850848 - RNA, 23 nt, Human
gugagaccugccccuccucucug

SEQ ID NO: 2850849 - RNA, 16 nt, Human
gugagaccugccccuc

SEQ ID NO: 2850850 - RNA, 15 nt, Human
gugagacccccacac

SEQ ID NO: 2850851 - RNA, 14 nt, Human
gugagacccccaca

SEQ ID NO: 2850852 - RNA, 17 nt, Human
gugagacccccacaccu

SEQ ID NO: 2850853 - RNA, 16 nt, Human
gugagacccccacacc

SEQ ID NO: 2850854 - RNA, 13 nt, Human
gugagaccugccc

SEQ ID NO: 2850855 - RNA, 15 nt, Human
gugagaccugccccu

SEQ ID NO: 2850856 - RNA, 14 nt, Human
gugagaccugcccc

SEQ ID NO: 2850857 - RNA, 22 nt, Human
gugacagagugagacucugucu

SEQ ID NO: 2850858 - RNA, 20 nt, Human
gugacagagugagacucugu

SEQ ID NO: 2850859 - RNA, 23 nt, Human
gugacagaggcagccccauucug

SEQ ID NO: 2850860 - RNA, 12 nt, Human
gugaauaauaau

SEQ ID NO: 2850861 - RNA, 18 nt, Human
aacuccaagguucccuug

SEQ ID NO: 2850862 - RNA, 22 nt, Human
gugacaguugcagcccuuguga

SEQ ID NO: 2850863 - RNA, 23 nt, Human
gugacauaauauauucuauuuuu

SEQ ID NO: 2850864 - RNA, 18 nt, Human
gugacaguggauugcauu

SEQ ID NO: 2850865 - RNA, 11 nt, Human
gugacagucau

SEQ ID NO: 2850866 - RNA, 13 nt, Human
gugacagucauca

SEQ ID NO: 2850867 - RNA, 16 nt, Human
gugacagucaucauca

SEQ ID NO: 2850868 - RNA, 18 nt, Human
gugacagucaucaucagg

SEQ ID NO: 2850869 - RNA, 19 nt, Human
gugacagucaucaucaggg

SEQ ID NO: 2850870 - RNA, 20 nt, Human
gugacagucaucaucagggc

SEQ ID NO: 2850871 - RNA, 21 nt, Human
gugacagucaucaucagggcc

SEQ ID NO: 2850872 - RNA, 22 nt, Human
gugacagucaucaucagggccu

SEQ ID NO: 2850873 - RNA, 23 nt, Human
gugacagucaucaucagggccug

SEQ ID NO: 2850874 - RNA, 22 nt, Human
gugacagcucuuuuugugaagu

SEQ ID NO: 2850875 - RNA, 12 nt, Human
gugacagggcca

SEQ ID NO: 2850876 - RNA, 13 nt, Human
gugacagggccag

SEQ ID NO: 2850877 - RNA, 14 nt, Human
gugacagggccagu

SEQ ID NO: 2850878 - RNA, 19 nt, Human
gugacagggccaguggggc

SEQ ID NO: 2850879 - RNA, 20 nt, Human
gugacagggccaguggggcc

SEQ ID NO: 2850880 - RNA, 21 nt, Human
gugacagggccaguggggccu

SEQ ID NO: 2850881 - RNA, 23 nt, Human
gugacagggccaguggggccugu

SEQ ID NO: 2850882 - RNA, 14 nt, Human
gugaaguuuacauu

SEQ ID NO: 2850883 - RNA, 18 nt, Human
gugaauaaacuucagcac

SEQ ID NO: 2850884 - RNA, 20 nt, Human
gugaauaaacuucagcacca

SEQ ID NO: 2850885 - RNA, 23 nt, Human
aacuccugacgucugaagcuuga

SEQ ID NO: 2850886 - RNA, 18 nt, Human
aacuccugagaaauguua

SEQ ID NO: 2850887 - RNA, 19 nt, Human
aacuccaccuugcggggau

SEQ ID NO: 2850888 - RNA, 15 nt, Human
aacuccaccuuccca

SEQ ID NO: 2850889 - RNA, 14 nt, Human
aacuccgcccccag

SEQ ID NO: 2850890 - RNA, 15 nt, Human
aacuccgcccccagc

SEQ ID NO: 2850891 - RNA, 18 nt, Human
aacuccgcccccagccua

SEQ ID NO: 2850892 - RNA, 19 nt, Human
aacuccgcccccagccuau

SEQ ID NO: 2850893 - RNA, 12 nt, Human
aacuccggauug

SEQ ID NO: 2850894 - RNA, 21 nt, Human
aacuccggauugcguuccucc

SEQ ID NO: 2850895 - RNA, 21 nt, Human
aacuccuagggccacugaaga

SEQ ID NO: 2850896 - RNA, 16 nt, Human
aacuccugacagucuu

SEQ ID NO: 2850897 - RNA, 19 nt, Human
aacuccucgacaucacugu

SEQ ID NO: 2850898 - RNA, 22 nt, Human
aacuccucgacaucacuguuca

SEQ ID NO: 2850899 - RNA, 23 nt, Human
aacuccucgacaucacuguucau

SEQ ID NO: 2850900 - RNA, 21 nt, Human
aacuccucacacacccugagg

SEQ ID NO: 2850901 - RNA, 22 nt, Human
aacuccucacacacccugaggu

SEQ ID NO: 2850902 - RNA, 14 nt, Human
aacuccugaccuca

SEQ ID NO: 2850903 - RNA, 12 nt, Human
aacuccugaccu

SEQ ID NO: 2850904 - RNA, 18 nt, Human
gugagacucugucucaaa

SEQ ID NO: 2850905 - RNA, 17 nt, Human
gugagagagaugggagc

SEQ ID NO: 2850906 - RNA, 19 nt, Human
gugagucaccaagcccagu

SEQ ID NO: 2850907 - RNA, 17 nt, Human
gugagucaccaagccca

SEQ ID NO: 2850908 - RNA, 16 nt, Human
gugaggccugucugug

SEQ ID NO: 2850909 - RNA, 19 nt, Human
gugaggccugucugugacc

SEQ ID NO: 2850910 - RNA, 21 nt, Human
gugaggccugucugugaccug

SEQ ID NO: 2850911 - RNA, 14 nt, Human
gugagagauucugu

SEQ ID NO: 2850912 - RNA, 16 nt, Human
gugaguaucagaauug

SEQ ID NO: 2850913 - RNA, 22 nt, Human
aacugcauugacuuucaguaaa

SEQ ID NO: 2850914 - RNA, 12 nt, Human
aacucucugaac

SEQ ID NO: 2850915 - RNA, 22 nt, Human
aacucucuccacccuauaugua

SEQ ID NO: 2850916 - RNA, 12 nt, Human
aacucucuccac

SEQ ID NO: 2850917 - RNA, 14 nt, Human
aacucugaacuuug

SEQ ID NO: 2850918 - RNA, 16 nt, Human
aacucugaacuuugga

SEQ ID NO: 2850919 - RNA, 17 nt, Human
aacucugaacuuuggag

SEQ ID NO: 2850920 - RNA, 18 nt, Human
aacucugaacuuuggaga

SEQ ID NO: 2850921 - RNA, 11 nt, Human
aacucuugauu

SEQ ID NO: 2850922 - RNA, 17 nt, Human
aacucuugauuauccau

SEQ ID NO: 2850923 - RNA, 16 nt, Human
aacucugacaacagac

SEQ ID NO: 2850924 - RNA, 18 nt, Human
uagggaccucagagguuu

SEQ ID NO: 2850925 - RNA, 12 nt, Human
uaggcauuuccu

SEQ ID NO: 2850926 - RNA, 21 nt, Human
uagggaagggugguggagcca

SEQ ID NO: 2850927 - RNA, 20 nt, Human
uagggaagggugguggagcc

SEQ ID NO: 2850928 - RNA, 21 nt, Human
uaggacuuuggugguuuaaaa

SEQ ID NO: 2850929 - RNA, 14 nt, Human
uagggaaguaacag

SEQ ID NO: 2850930 - RNA, 22 nt, Human
uagggaauaaaauccuaagaca

SEQ ID NO: 2850931 - RNA, 18 nt, Human
uaggcaaccuuuauuuuu

SEQ ID NO: 2850932 - RNA, 14 nt, Human
uaggagggagacac

SEQ ID NO: 2850933 - RNA, 18 nt, Human
uaggcacucuuaaaugau

SEQ ID NO: 2850934 - RNA, 19 nt, Human
uaggcaaggcuaugugauu

SEQ ID NO: 2850935 - RNA, 18 nt, Human
uaggcacuguaguucuaa

SEQ ID NO: 2850936 - RNA, 19 nt, Human
uaggcacuguaguucuaag

SEQ ID NO: 2850937 - RNA, 20 nt, Human
uaggcacuguaguucuaaga

SEQ ID NO: 2850938 - RNA, 22 nt, Human
uaggcacuguaguucuaagacu

SEQ ID NO: 2850939 - RNA, 21 nt, Human
uaggcacuguaguucuaagac

SEQ ID NO: 2850940 - RNA, 19 nt, Human
uaggaaauaaaaccuuuca

SEQ ID NO: 2850941 - RNA, 13 nt, Human
uagcugugggggu

SEQ ID NO: 2850942 - RNA, 14 nt, Human
uagcugugggggug

SEQ ID NO: 2850943 - RNA, 20 nt, Human
uaggaaauaaaaccuuucaa

SEQ ID NO: 2850944 - RNA, 16 nt, Human
uaggaaauccagggug

SEQ ID NO: 2850945 - RNA, 15 nt, Human
uaggacgccacccag

SEQ ID NO: 2850946 - RNA, 16 nt, Human
uaggacucugaggcuc

SEQ ID NO: 2850947 - RNA, 15 nt, Human
uaggacucugaggcu

SEQ ID NO: 2850948 - RNA, 14 nt, Human
uaggacucugaggc

SEQ ID NO: 2850949 - RNA, 16 nt, Human
uaggacgccacccagc

SEQ ID NO: 2850950 - RNA, 11 nt, Human
uaggagccugc

SEQ ID NO: 2850951 - RNA, 23 nt, Human
uaggagacuugccagagccgggc

SEQ ID NO: 2850952 - RNA, 14 nt, Human
uaggagaggaugag

SEQ ID NO: 2850953 - RNA, 18 nt, Human
uaggagaggaugagagcc

SEQ ID NO: 2850954 - RNA, 15 nt, Human
uaggagaucagaaaa

SEQ ID NO: 2850955 - RNA, 22 nt, Human
uaggagaggaugagagcccaga

SEQ ID NO: 2850956 - RNA, 18 nt, Human
uaggagcugccuuggcuc

SEQ ID NO: 2850957 - RNA, 17 nt, Human
uaggagcuaaggcucua

SEQ ID NO: 2850958 - RNA, 16 nt, Human
uaggagcugagguuuc

SEQ ID NO: 2850959 - RNA, 15 nt, Human
uaggagccugcuggu

SEQ ID NO: 2850960 - RNA, 23 nt, Human
uaggagccugcuggucacagccu

SEQ ID NO: 2850961 - RNA, 13 nt, Human
uaggagcuaaggc

SEQ ID NO: 2850962 - RNA, 14 nt, Human
uaggagcuaaggcu

SEQ ID NO: 2850963 - RNA, 23 nt, Human
uaggagcugccuuggcucagaca

SEQ ID NO: 2850964 - RNA, 16 nt, Human
uaggagcuaaggcucu

SEQ ID NO: 2850965 - RNA, 20 nt, Human
uaggagacuugccagagccg

SEQ ID NO: 2850966 - RNA, 17 nt, Human
uaggagacuugccagag

SEQ ID NO: 2850967 - RNA, 21 nt, Human
uaggagaccaaggcgggagca

SEQ ID NO: 2850968 - RNA, 14 nt, Human
uaggagaccaaggc

SEQ ID NO: 2850969 - RNA, 18 nt, Human
uaggacucugaggcucuu

SEQ ID NO: 2850970 - RNA, 13 nt, Human
acaauaauuucag

SEQ ID NO: 2850971 - RNA, 12 nt, Human
acaauaauuuca

SEQ ID NO: 2850972 - RNA, 12 nt, Human
acaauacagaua

SEQ ID NO: 2850973 - RNA, 14 nt, Human
acaauacagauaac

SEQ ID NO: 2850974 - RNA, 17 nt, Human
acaauacagauaacauu

SEQ ID NO: 2850975 - RNA, 18 nt, Human
acaauaauauuguuguau

SEQ ID NO: 2850976 - RNA, 21 nt, Human
acaauaauauuguuguauaau

SEQ ID NO: 2850977 - RNA, 22 nt, Human
acaauaauauuguuguauaauu

SEQ ID NO: 2850978 - RNA, 23 nt, Human
acaauaauauuguuguauaauuu

SEQ ID NO: 2850979 - RNA, 13 nt, Human
acaauaauggaaa

SEQ ID NO: 2850980 - RNA, 21 nt, Human
acaauaauucuggagauacug

SEQ ID NO: 2850981 - RNA, 16 nt, Human
acaauaagcaaaaaca

SEQ ID NO: 2850982 - RNA, 15 nt, Human
acaauaagcaaaaac

SEQ ID NO: 2850983 - RNA, 14 nt, Human
acaauaaaugugca

SEQ ID NO: 2850984 - RNA, 21 nt, Human
acaauaacacuaaaauuuuag

SEQ ID NO: 2850985 - RNA, 14 nt, Human
acaauaaagagauu

SEQ ID NO: 2850986 - RNA, 19 nt, Human
acaagaccccgucucaaaa

SEQ ID NO: 2850987 - RNA, 12 nt, Human
acaauaaaccuc

SEQ ID NO: 2850988 - RNA, 12 nt, Human
acaauaaagaga

SEQ ID NO: 2850989 - RNA, 19 nt, Human
acaaggacuaggguccugg

SEQ ID NO: 2850990 - RNA, 18 nt, Human
acaaggacuaggguccug

SEQ ID NO: 2850991 - RNA, 21 nt, Human
acaaggacagccccuccucca

SEQ ID NO: 2850992 - RNA, 22 nt, Human
acaaggacagccccuccuccau

SEQ ID NO: 2850993 - RNA, 20 nt, Human
uagcuacaggaagcacccca

SEQ ID NO: 2850994 - RNA, 15 nt, Human
uagcuacaggaagca

SEQ ID NO: 2850995 - RNA, 19 nt, Human
uagcuaauguaauaacugu

SEQ ID NO: 2850996 - RNA, 12 nt, Human
uagcuaauguaa

SEQ ID NO: 2850997 - RNA, 13 nt, Human
acaauacaucuga

SEQ ID NO: 2850998 - RNA, 24 nt, Human
uagcuaauaaugagcuauuaaaac

SEQ ID NO: 2850999 - RNA, 15 nt, Human
uagcuaauaauguua

SEQ ID NO: 2851000 - RNA, 16 nt, Human
uagcuaggauuugaac

SEQ ID NO: 2851001 - RNA, 17 nt, Human
uagcuaucaagaggcug

SEQ ID NO: 2851002 - RNA, 14 nt, Human
uagcuaucagaaga

SEQ ID NO: 2851003 - RNA, 15 nt, Human
uagcuaucagaagac

SEQ ID NO: 2851004 - RNA, 10 nt, Human
uagcuguggg

SEQ ID NO: 2851005 - RNA, 22 nt, Human
uagcuaaguacacaauaagcaa

SEQ ID NO: 2851006 - RNA, 15 nt, Human
uagcuaaguacacaa

SEQ ID NO: 2851007 - RNA, 18 nt, Human
acaaucauuugcuuuuug

SEQ ID NO: 2851008 - RNA, 16 nt, Human
acaaucauuguuuuga

SEQ ID NO: 2851009 - RNA, 17 nt, Human
acaaucauuguuuugaa

SEQ ID NO: 2851010 - RNA, 20 nt, Human
acaaucauuguuuugaauau

SEQ ID NO: 2851011 - RNA, 21 nt, Human
acaaucauuguuuugaauauu

SEQ ID NO: 2851012 - RNA, 18 nt, Human
acaaucaugaaauaugca

SEQ ID NO: 2851013 - RNA, 19 nt, Human
acaaucaugaaauaugcau

SEQ ID NO: 2851014 - RNA, 16 nt, Human
aauuguugaaauuuug

SEQ ID NO: 2851015 - RNA, 18 nt, Human
aauuguugaaauuuugca

SEQ ID NO: 2851016 - RNA, 20 nt, Human
aauuguugaaauuuugcaaa

SEQ ID NO: 2851017 - RNA, 23 nt, Human
aauuguugaaauuuugcaaauau

SEQ ID NO: 2851018 - RNA, 20 nt, Human
aauuguugaacagguguuuu

SEQ ID NO: 2851019 - RNA, 21 nt, Human
aauuguugaacagguguuuuu

SEQ ID NO: 2851020 - RNA, 22 nt, Human
aauuguugaacagguguuuuuc

SEQ ID NO: 2851021 - RNA, 14 nt, Human
aauuguugacaaau

SEQ ID NO: 2851022 - RNA, 13 nt, Human
aauuguugacagu

SEQ ID NO: 2851023 - RNA, 18 nt, Human
aauuguugacaguucuga

SEQ ID NO: 2851024 - RNA, 20 nt, Human
acaaaggauuaauugcugca

SEQ ID NO: 2851025 - RNA, 14 nt, Human
acaaagggcccaga

SEQ ID NO: 2851026 - RNA, 15 nt, Human
acaaaggggaaagaa

SEQ ID NO: 2851027 - RNA, 17 nt, Human
acaaaggggaaagaaca

SEQ ID NO: 2851028 - RNA, 18 nt, Human
acaaaggggaaagaacau

SEQ ID NO: 2851029 - RNA, 19 nt, Human
acaaaggggaucauaaagu

SEQ ID NO: 2851030 - RNA, 21 nt, Human
acaaaggggaucauaaaguua

SEQ ID NO: 2851031 - RNA, 19 nt, Human
acaaaggcaaguuaagaga

SEQ ID NO: 2851032 - RNA, 23 nt, Human
acaaaggcaaguuaagagaaacu

SEQ ID NO: 2851033 - RNA, 14 nt, Human
acaaaggccaaacu

SEQ ID NO: 2851034 - RNA, 15 nt, Human
acaaaggccaaacug

SEQ ID NO: 2851035 - RNA, 17 nt, Human
acaaaggccaaacugcu

SEQ ID NO: 2851036 - RNA, 20 nt, Human
acaaagggcacagcaucugu

SEQ ID NO: 2851037 - RNA, 22 nt, Human
acaaagggcacagcaucuguag

SEQ ID NO: 2851038 - RNA, 20 nt, Human
aauuguugacaguucugaag

SEQ ID NO: 2851039 - RNA, 23 nt, Human
acaaagaguucuggaaaagaacu

SEQ ID NO: 2851040 - RNA, 14 nt, Human
acaaagauaucuuu

SEQ ID NO: 2851041 - RNA, 17 nt, Human
acaaagauaucuuuucu

SEQ ID NO: 2851042 - RNA, 20 nt, Human
acaaagauaucuuuucuuua

SEQ ID NO: 2851043 - RNA, 21 nt, Human
acaaagauaucuuuucuuuag

SEQ ID NO: 2851044 - RNA, 20 nt, Human
acaaagauggcucagagggg

SEQ ID NO: 2851045 - RNA, 15 nt, Human
acaaagcacaguguu

SEQ ID NO: 2851046 - RNA, 14 nt, Human
acaaagcacagugu

SEQ ID NO: 2851047 - RNA, 19 nt, Human
acaaagcacaguuugaaca

SEQ ID NO: 2851048 - RNA, 15 nt, Human
acaaagcacuagaga

SEQ ID NO: 2851049 - RNA, 17 nt, Human
acaaagcacuagagaau

SEQ ID NO: 2851050 - RNA, 23 nt, Human
acaaagcacuagagaaugcacag

SEQ ID NO: 2851051 - RNA, 16 nt, Human
acaaagcacaguguua

SEQ ID NO: 2851052 - RNA, 16 nt, Human
acaaagcacaguuuga

SEQ ID NO: 2851053 - RNA, 17 nt, Human
acaaagcacaguuugaa

SEQ ID NO: 2851054 - RNA, 18 nt, Human
acaaagcacaguuugaac

SEQ ID NO: 2851055 - RNA, 22 nt, Human
uagagcaaaauugauguguuua

SEQ ID NO: 2851056 - RNA, 15 nt, Human
uagagauuugucuaa

SEQ ID NO: 2851057 - RNA, 16 nt, Human
uagagauuugucuaau

SEQ ID NO: 2851058 - RNA, 20 nt, Human
uagagauuugucuaauugca

SEQ ID NO: 2851059 - RNA, 21 nt, Human
uagagcaaaauugauguguuu

SEQ ID NO: 2851060 - RNA, 14 nt, Human
uagagcaaaauuga

SEQ ID NO: 2851061 - RNA, 17 nt, Human
uagagaugacugagucc

SEQ ID NO: 2851062 - RNA, 20 nt, Human
uagagauauauauacuugug

SEQ ID NO: 2851063 - RNA, 12 nt, Human
uagagauguuuu

SEQ ID NO: 2851064 - RNA, 13 nt, Human
uagagaugugcaa

SEQ ID NO: 2851065 - RNA, 21 nt, Human
uagagaugugcaauugauuuc

SEQ ID NO: 2851066 - RNA, 17 nt, Human
uagagauggagucuugc

SEQ ID NO: 2851067 - RNA, 23 nt, Human
uagagaugaaguuuguaguuguu

SEQ ID NO: 2851068 - RNA, 23 nt, Human
uagagaugcuguaacuuaaaaua

SEQ ID NO: 2851069 - RNA, 19 nt, Human
uagagauguuuuuaaaagu

SEQ ID NO: 2851070 - RNA, 20 nt, Human
uagagauguuuuuaaaaguu

SEQ ID NO: 2851071 - RNA, 23 nt, Human
uagagauguuuuuaaaaguuuca

SEQ ID NO: 2851072 - RNA, 20 nt, Human
uagagcaccuaguccaguga

SEQ ID NO: 2851073 - RNA, 18 nt, Human
uagaggccagccccaccc

SEQ ID NO: 2851074 - RNA, 20 nt, Human
uagaggaucccucucuggau

SEQ ID NO: 2851075 - RNA, 20 nt, Human
uagaggccagccccacccag

SEQ ID NO: 2851076 - RNA, 14 nt, Human
uagaugauguauuu

SEQ ID NO: 2851077 - RNA, 23 nt, Human
uagaugagcccagcccuguucug

SEQ ID NO: 2851078 - RNA, 17 nt, Human
uagaugagcugggccgg

SEQ ID NO: 2851079 - RNA, 21 nt, Human
uagaugagauuguuuuaucau

SEQ ID NO: 2851080 - RNA, 15 nt, Human
uagagaugagguuuc

SEQ ID NO: 2851081 - RNA, 14 nt, Human
uagauauuacuuua

SEQ ID NO: 2851082 - RNA, 15 nt, Human
uagauauuacuuuau

SEQ ID NO: 2851083 - RNA, 17 nt, Human
uagauauuacuuuauca

SEQ ID NO: 2851084 - RNA, 22 nt, Human
uagauauuacuuuaucacuuuu

SEQ ID NO: 2851085 - RNA, 16 nt, Human
uagaugcacuuaugca

SEQ ID NO: 2851086 - RNA, 19 nt, Human
uagaugauuaaauaagauu

SEQ ID NO: 2851087 - RNA, 20 nt, Human
uagaugauuaaauaagauuc

SEQ ID NO: 2851088 - RNA, 21 nt, Human
uagaugauuaaauaagauucu

SEQ ID NO: 2851089 - RNA, 23 nt, Human
uagaugauuaaauaagauucuaa

SEQ ID NO: 2851090 - RNA, 23 nt, Human
uagaugcugacuguacuccuccc

SEQ ID NO: 2851091 - RNA, 14 nt, Human
uagaugcugacugu

SEQ ID NO: 2851092 - RNA, 18 nt, Human
uagauggccucuuacuaa

SEQ ID NO: 2851093 - RNA, 20 nt, Human
uagaugcuuuccuaaaucag

SEQ ID NO: 2851094 - RNA, 17 nt, Human
uagauggaaaaacuugu

SEQ ID NO: 2851095 - RNA, 22 nt, Human
uagaugaccucauuaaccgaug

SEQ ID NO: 2851096 - RNA, 23 nt, Human
uagccaaggugggcugagcccug

SEQ ID NO: 2851097 - RNA, 21 nt, Human
uagccaaggugggcugagccc

SEQ ID NO: 2851098 - RNA, 20 nt, Human
uagccaaggugggcugagcc

SEQ ID NO: 2851099 - RNA, 14 nt, Human
uagcauuuuugauu

SEQ ID NO: 2851100 - RNA, 20 nt, Human
uagcauuuuugauuuaugca

SEQ ID NO: 2851101 - RNA, 17 nt, Human
acaacaaaaagcuuccc

SEQ ID NO: 2851102 - RNA, 13 nt, Human
acaacagaaguca

SEQ ID NO: 2851103 - RNA, 11 nt, Human
acaacagaagu

SEQ ID NO: 2851104 - RNA, 13 nt, Human
acaacagaagcuu

SEQ ID NO: 2851105 - RNA, 19 nt, Human
acaacagaagcuucagaag

SEQ ID NO: 2851106 - RNA, 21 nt, Human
uagccaaugucuccuccccuu

SEQ ID NO: 2851107 - RNA, 17 nt, Human
uagugaaccucaccccg

SEQ ID NO: 2851108 - RNA, 15 nt, Human
uaguccuagugaacc

SEQ ID NO: 2851109 - RNA, 16 nt, Human
uaguccuagugaaccu

SEQ ID NO: 2851110 - RNA, 23 nt, Human
uagucccuuccccucccuggcuc

SEQ ID NO: 2851111 - RNA, 22 nt, Human
uagucccuuccccucccuggcu

SEQ ID NO: 2851112 - RNA, 20 nt, Human
uagucccuuccccucccugg

SEQ ID NO: 2851113 - RNA, 16 nt, Human
uagucccuuccccucc

SEQ ID NO: 2851114 - RNA, 15 nt, Human
uagucccuuccccuc

SEQ ID NO: 2851115 - RNA, 14 nt, Human
uagucccuuccccu

SEQ ID NO: 2851116 - RNA, 21 nt, Human
uagucccccaacucugagccc

SEQ ID NO: 2851117 - RNA, 22 nt, Human
uagucccccaacucugagccca

SEQ ID NO: 2851118 - RNA, 21 nt, Human
uagucccagcuacucagaagc

SEQ ID NO: 2851119 - RNA, 15 nt, Human
uaguaccugaaaagu

SEQ ID NO: 2851120 - RNA, 18 nt, Human
uaguaccugaaaaguaac

SEQ ID NO: 2851121 - RNA, 16 nt, Human
uaguaccugaaaagua

SEQ ID NO: 2851122 - RNA, 14 nt, Human
uaguacuaagcauu

SEQ ID NO: 2851123 - RNA, 15 nt, Human
uaguacuaagcauuu

SEQ ID NO: 2851124 - RNA, 16 nt, Human
uaguguuuuaaaacac

SEQ ID NO: 2851125 - RNA, 18 nt, Human
uaguguuuuaagaaaugu

SEQ ID NO: 2851126 - RNA, 19 nt, Human
uaguguuuuaagaaaugua

SEQ ID NO: 2851127 - RNA, 20 nt, Human
uaguguuuuaagaaauguag

SEQ ID NO: 2851128 - RNA, 21 nt, Human
uaguuaaaaaaaaaaaaagga

SEQ ID NO: 2851129 - RNA, 22 nt, Human
uagugaccccuucccuguccuu

SEQ ID NO: 2851130 - RNA, 12 nt, Human
uaguuaauuuau

SEQ ID NO: 2851131 - RNA, 14 nt, Human
uaguuaauuuaucu

SEQ ID NO: 2851132 - RNA, 15 nt, Human
uaguuaauuuaucua

SEQ ID NO: 2851133 - RNA, 16 nt, Human
uaguuaauuuaucuaa

SEQ ID NO: 2851134 - RNA, 18 nt, Human
uaguuaauuuaucuaaau

SEQ ID NO: 2851135 - RNA, 13 nt, Human
uaguuaauggauu

SEQ ID NO: 2851136 - RNA, 19 nt, Human
uaguuaauggauuaaauuu

SEQ ID NO: 2851137 - RNA, 23 nt, Human
uaguuaauauugugaagaaaaau

SEQ ID NO: 2851138 - RNA, 23 nt, Human
uaguuaagacaugauuuccuuga

SEQ ID NO: 2851139 - RNA, 20 nt, Human
uaguuaacauaguaaguuca

SEQ ID NO: 2851140 - RNA, 21 nt, Human
uaguuaagacaugauuuccuu

SEQ ID NO: 2851141 - RNA, 19 nt, Human
uaguuaagacaugauuucc

SEQ ID NO: 2851142 - RNA, 14 nt, Human
uaguuaagacauga

SEQ ID NO: 2851143 - RNA, 16 nt, Human
acacaguauuacuucu

SEQ ID NO: 2851144 - RNA, 18 nt, Human
acacaguauuacuucugc

SEQ ID NO: 2851145 - RNA, 17 nt, Human
acacacugaugcuuaga

SEQ ID NO: 2851146 - RNA, 15 nt, Human
acacacugaugcuua

SEQ ID NO: 2851147 - RNA, 16 nt, Human
acacacugguacuuag

SEQ ID NO: 2851148 - RNA, 17 nt, Human
acacacugguacuuaga

SEQ ID NO: 2851149 - RNA, 19 nt, Human
acacacugucaugcuucau

SEQ ID NO: 2851150 - RNA, 22 nt, Human
acacacugucaugcuucaucau

SEQ ID NO: 2851151 - RNA, 22 nt, Human
acacaguauuacuucugcuaca

SEQ ID NO: 2851152 - RNA, 19 nt, Human
acacaguauuacuucugcu

SEQ ID NO: 2851153 - RNA, 13 nt, Human
acacagugagucg

SEQ ID NO: 2851154 - RNA, 13 nt, Human
acacacuguuguu

SEQ ID NO: 2851155 - RNA, 19 nt, Human
acacagugggaacucugac

SEQ ID NO: 2851156 - RNA, 20 nt, Human
acacagugggaacucugaca

SEQ ID NO: 2851157 - RNA, 22 nt, Human
acacagugggaacucugacaag

SEQ ID NO: 2851158 - RNA, 15 nt, Human
uaguaaaauuuauuu

SEQ ID NO: 2851159 - RNA, 18 nt, Human
uaguaaaauuuauuucau

SEQ ID NO: 2851160 - RNA, 13 nt, Human
acacauacaguuu

SEQ ID NO: 2851161 - RNA, 17 nt, Human
acacauacaguuuuaug

SEQ ID NO: 2851162 - RNA, 22 nt, Human
acacauacaguuuuaugcucuu

SEQ ID NO: 2851163 - RNA, 15 nt, Human
uaguacaaauuauaa

SEQ ID NO: 2851164 - RNA, 16 nt, Human
uaguacaaauuauaaa

SEQ ID NO: 2851165 - RNA, 13 nt, Human
uaguacacuuuua

SEQ ID NO: 2851166 - RNA, 19 nt, Human
uaguacacuuuuaugagcu

SEQ ID NO: 2851167 - RNA, 18 nt, Human
uaguaacuucuuauggaa

SEQ ID NO: 2851168 - RNA, 20 nt, Human
uaguaacucccaucaccucu

SEQ ID NO: 2851169 - RNA, 12 nt, Human
uaguaacugaca

SEQ ID NO: 2851170 - RNA, 13 nt, Human
uaguaacugacau

SEQ ID NO: 2851171 - RNA, 15 nt, Human
uaguaacugacauga

SEQ ID NO: 2851172 - RNA, 11 nt, Human
uaguaaauguc

SEQ ID NO: 2851173 - RNA, 12 nt, Human
uaguaaaugucu

SEQ ID NO: 2851174 - RNA, 13 nt, Human
uaguaaaugucuu

SEQ ID NO: 2851175 - RNA, 14 nt, Human
uaguaaaugucuuu

SEQ ID NO: 2851176 - RNA, 15 nt, Human
uaguaaaugucuuug

SEQ ID NO: 2851177 - RNA, 16 nt, Human
uaguaaaugucuuugu

SEQ ID NO: 2851178 - RNA, 17 nt, Human
uaguaaaugucuuugua

SEQ ID NO: 2851179 - RNA, 18 nt, Human
uaguaaaugucuuuguaa

SEQ ID NO: 2851180 - RNA, 19 nt, Human
uaguaaaugucuuuguaag

SEQ ID NO: 2851181 - RNA, 20 nt, Human
uaguaaaugucuuuguaagu

SEQ ID NO: 2851182 - RNA, 22 nt, Human
uaguaaaugucuuuguaaguca

SEQ ID NO: 2851183 - RNA, 23 nt, Human
uaguaaaugucuuuguaagucag

SEQ ID NO: 2851184 - RNA, 11 nt, Human
uaguaaauguu

SEQ ID NO: 2851185 - RNA, 13 nt, Human
uaguaaauguuau

SEQ ID NO: 2851186 - RNA, 15 nt, Human
acacacgcgcgcaca

SEQ ID NO: 2851187 - RNA, 16 nt, Human
acacacgcgcgcacac

SEQ ID NO: 2851188 - RNA, 13 nt, Human
acacacugaugcu

SEQ ID NO: 2851189 - RNA, 13 nt, Human
acacacuacacca

SEQ ID NO: 2851190 - RNA, 16 nt, Human
acacacuacaccacac

SEQ ID NO: 2851191 - RNA, 17 nt, Human
acacacuacaccacaca

SEQ ID NO: 2851192 - RNA, 18 nt, Human
acacacuacaccacacac

SEQ ID NO: 2851193 - RNA, 19 nt, Human
acacacuacaccacacaca

SEQ ID NO: 2851194 - RNA, 21 nt, Human
acacacgcgugcacacaccag

SEQ ID NO: 2851195 - RNA, 20 nt, Human
acacaccagagcccaccuug

SEQ ID NO: 2851196 - RNA, 15 nt, Human
acacaccagagccca

SEQ ID NO: 2851197 - RNA, 14 nt, Human
acacaccagagccc

SEQ ID NO: 2851198 - RNA, 14 nt, Human
acacacagcucugu

SEQ ID NO: 2851199 - RNA, 13 nt, Human
acacacagcucug

SEQ ID NO: 2851200 - RNA, 17 nt, Human
acacacagcucuguccu

SEQ ID NO: 2851201 - RNA, 22 nt, Human
acacacacgcgugcacacacca

SEQ ID NO: 2851202 - RNA, 14 nt, Human
acacacacgcacgc

SEQ ID NO: 2851203 - RNA, 19 nt, Human
acacacacgcacgcacaca

SEQ ID NO: 2851204 - RNA, 21 nt, Human
acacacacgcacgcacacaca

SEQ ID NO: 2851205 - RNA, 12 nt, Human
acacacacgcac

SEQ ID NO: 2851206 - RNA, 15 nt, Human
acacacacgcacaua

SEQ ID NO: 2851207 - RNA, 11 nt, Human
acacacacauc

SEQ ID NO: 2851208 - RNA, 14 nt, Human
acacacacauccac

SEQ ID NO: 2851209 - RNA, 14 nt, Human
acacacacaugcac

SEQ ID NO: 2851210 - RNA, 15 nt, Human
acacacacaugcaca

SEQ ID NO: 2851211 - RNA, 15 nt, Human
acacacacacacaca

SEQ ID NO: 2851212 - RNA, 16 nt, Human
acacacacacacacac

SEQ ID NO: 2851213 - RNA, 17 nt, Human
acacacacauacacgaa

SEQ ID NO: 2851214 - RNA, 13 nt, Human
uagggaggcagcc

SEQ ID NO: 2851215 - RNA, 16 nt, Human
uagggaggcagccucc

SEQ ID NO: 2851216 - RNA, 17 nt, Human
uagggaggcagccucca

SEQ ID NO: 2851217 - RNA, 13 nt, Human
uagggagauauuu

SEQ ID NO: 2851218 - RNA, 13 nt, Human
uagggaggaccac

SEQ ID NO: 2851219 - RNA, 23 nt, Human
uagggaggaccacaggugugagc

SEQ ID NO: 2851220 - RNA, 14 nt, Human
acacacacauacac

SEQ ID NO: 2851221 - RNA, 14 nt, Human
acacacacacacac

SEQ ID NO: 2851222 - RNA, 14 nt, Human
acacacacacacaa

SEQ ID NO: 2851223 - RNA, 15 nt, Human
acacacacacacaaa

SEQ ID NO: 2851224 - RNA, 15 nt, Human
acacacacacacaag

SEQ ID NO: 2851225 - RNA, 13 nt, Human
acacacacacaca

SEQ ID NO: 2851226 - RNA, 12 nt, Human
acacacacacac

SEQ ID NO: 2851227 - RNA, 14 nt, Human
acacacacaaguaa

SEQ ID NO: 2851228 - RNA, 10 nt, Human
acacacacac

SEQ ID NO: 2851229 - RNA, 11 nt, Human
acacacacaca

SEQ ID NO: 2851230 - RNA, 15 nt, Human
acacacacacaaacc

SEQ ID NO: 2851231 - RNA, 16 nt, Human
acacaaugguuuuuaa

SEQ ID NO: 2851232 - RNA, 22 nt, Human
acacaaugguuuuuaaauuuug

SEQ ID NO: 2851233 - RNA, 23 nt, Human
acacaaugguuuuuaaauuuugu

SEQ ID NO: 2851234 - RNA, 21 nt, Human
acacaauuggaauugucuuua

SEQ ID NO: 2851235 - RNA, 14 nt, Human
acacacaacaauua

SEQ ID NO: 2851236 - RNA, 14 nt, Human
acacacaacagcca

SEQ ID NO: 2851237 - RNA, 15 nt, Human
acacacaacagccaa

SEQ ID NO: 2851238 - RNA, 17 nt, Human
acacacaacagccaaca

SEQ ID NO: 2851239 - RNA, 14 nt, Human
acacacaaguaaga

SEQ ID NO: 2851240 - RNA, 9 nt, Human
acacacaca

SEQ ID NO: 2851241 - RNA, 10 nt, Human
acacacacaa

SEQ ID NO: 2851242 - RNA, 13 nt, Human
acacacacaaacc

SEQ ID NO: 2851243 - RNA, 11 nt, Human
acaaugucugc

SEQ ID NO: 2851244 - RNA, 16 nt, Human
acaaugucugcagccc

SEQ ID NO: 2851245 - RNA, 19 nt, Human
acaaugucugcagcccuga

SEQ ID NO: 2851246 - RNA, 15 nt, Human
acaaugucaguauuu

SEQ ID NO: 2851247 - RNA, 18 nt, Human
acaaugucaguauuucag

SEQ ID NO: 2851248 - RNA, 22 nt, Human
acaaugucaguauuucagugua

SEQ ID NO: 2851249 - RNA, 23 nt, Human
acaaugucaguauuucaguguag

SEQ ID NO: 2851250 - RNA, 22 nt, Human
acaaugucauauacugccaugu

SEQ ID NO: 2851251 - RNA, 20 nt, Human
acaauguauuuauuuaaaag

SEQ ID NO: 2851252 - RNA, 21 nt, Human
acaauguauuuauuuaaaaga

SEQ ID NO: 2851253 - RNA, 23 nt, Human
acaauguauuuauuuaaaagauu

SEQ ID NO: 2851254 - RNA, 18 nt, Human
acacuaucauaguuaaca

SEQ ID NO: 2851255 - RNA, 19 nt, Human
acacuaucauaguuaacau

SEQ ID NO: 2851256 - RNA, 11 nt, Human
acacuauuuua

SEQ ID NO: 2851257 - RNA, 20 nt, Human
acacuaacucaccagcccca

SEQ ID NO: 2851258 - RNA, 19 nt, Human
acacuaacucaccagcccc

SEQ ID NO: 2851259 - RNA, 17 nt, Human
acacuaacucaccagcc

SEQ ID NO: 2851260 - RNA, 15 nt, Human
acacuaaccuggguu

SEQ ID NO: 2851261 - RNA, 15 nt, Human
acacucaagaagcag

SEQ ID NO: 2851262 - RNA, 16 nt, Human
acacucaagaagcagg

SEQ ID NO: 2851263 - RNA, 20 nt, Human
acacucacauuuauucugcu

SEQ ID NO: 2851264 - RNA, 22 nt, Human
acacucacauuuauucugcuca

SEQ ID NO: 2851265 - RNA, 17 nt, Human
acacucaagaagcaggc

SEQ ID NO: 2851266 - RNA, 16 nt, Human
uauaacuucaaauuuu

SEQ ID NO: 2851267 - RNA, 15 nt, Human
uauaacuucuuaaaa

SEQ ID NO: 2851268 - RNA, 16 nt, Human
uauaacuucuuaaaag

SEQ ID NO: 2851269 - RNA, 12 nt, Human
uauaacuugaug

SEQ ID NO: 2851270 - RNA, 17 nt, Human
uauaacuugaugcaugu

SEQ ID NO: 2851271 - RNA, 20 nt, Human
acacuaaccacgcuggaccu

SEQ ID NO: 2851272 - RNA, 21 nt, Human
acaccuuuuauugacacagaa

SEQ ID NO: 2851273 - RNA, 14 nt, Human
acacgaaagagaga

SEQ ID NO: 2851274 - RNA, 15 nt, Human
acacgaaagagagag

SEQ ID NO: 2851275 - RNA, 23 nt, Human
acaccuuuuauugacacagaaaa

SEQ ID NO: 2851276 - RNA, 13 nt, Human
acacgaaacuugu

SEQ ID NO: 2851277 - RNA, 14 nt, Human
acacgaaacuuguu

SEQ ID NO: 2851278 - RNA, 17 nt, Human
acacgaaacuuguuauu

SEQ ID NO: 2851279 - RNA, 23 nt, Human
acacgaaacuuguuauugugaau

SEQ ID NO: 2851280 - RNA, 14 nt, Human
acacgaaagaaaug

SEQ ID NO: 2851281 - RNA, 15 nt, Human
acacgaaagaaaugu

SEQ ID NO: 2851282 - RNA, 13 nt, Human
acacgaaagagag

SEQ ID NO: 2851283 - RNA, 15 nt, Human
acaccuuuagguucu

SEQ ID NO: 2851284 - RNA, 16 nt, Human
acaccuuuagguucuu

SEQ ID NO: 2851285 - RNA, 17 nt, Human
acaccugggcuuaagaa

SEQ ID NO: 2851286 - RNA, 21 nt, Human
acaccuuagccugcccuccuu

SEQ ID NO: 2851287 - RNA, 21 nt, Human
acaccuugugaccuucucuau

SEQ ID NO: 2851288 - RNA, 22 nt, Human
acaccuugugaccuucucuaua

SEQ ID NO: 2851289 - RNA, 23 nt, Human
acaccuugugaccuucucuauau

SEQ ID NO: 2851290 - RNA, 20 nt, Human
acaccuuccagcuccuguaa

SEQ ID NO: 2851291 - RNA, 14 nt, Human
acaccuucauuuug

SEQ ID NO: 2851292 - RNA, 15 nt, Human
acaccuucauuuuga

SEQ ID NO: 2851293 - RNA, 14 nt, Human
acaccuuccagcuc

SEQ ID NO: 2851294 - RNA, 16 nt, Human
acaccuuccagcuccu

SEQ ID NO: 2851295 - RNA, 11 nt, Human
acacccugcaa

SEQ ID NO: 2851296 - RNA, 13 nt, Human
acacccugcaagg

SEQ ID NO: 2851297 - RNA, 20 nt, Human
acacccugcaaggcccacag

SEQ ID NO: 2851298 - RNA, 23 nt, Human
acacccugcaaggcccacaggag

SEQ ID NO: 2851299 - RNA, 11 nt, Human
acacccuuccu

SEQ ID NO: 2851300 - RNA, 13 nt, Human
acacccuuagaaa

SEQ ID NO: 2851301 - RNA, 15 nt, Human
acacccuuagaaaau

SEQ ID NO: 2851302 - RNA, 16 nt, Human
acaccgggcacucaga

SEQ ID NO: 2851303 - RNA, 14 nt, Human
acaccgggccugga

SEQ ID NO: 2851304 - RNA, 20 nt, Human
acaccggcuggcagggcugg

SEQ ID NO: 2851305 - RNA, 13 nt, Human
acaccgacuagcc

SEQ ID NO: 2851306 - RNA, 16 nt, Human
acaccgacuagccagg

SEQ ID NO: 2851307 - RNA, 19 nt, Human
acaccugagaaacaucuag

SEQ ID NO: 2851308 - RNA, 12 nt, Human
acaccucugcca

SEQ ID NO: 2851309 - RNA, 13 nt, Human
acaccucugccag

SEQ ID NO: 2851310 - RNA, 14 nt, Human
acaccucugccaga

SEQ ID NO: 2851311 - RNA, 15 nt, Human
acaccucugcuuucu

SEQ ID NO: 2851312 - RNA, 21 nt, Human
acaccucugcuuucugauguu

SEQ ID NO: 2851313 - RNA, 18 nt, Human
acaccaucgcuggccccu

SEQ ID NO: 2851314 - RNA, 19 nt, Human
acaccaucgcuggccccuu

SEQ ID NO: 2851315 - RNA, 19 nt, Human
acacccaaagagguauuua

SEQ ID NO: 2851316 - RNA, 20 nt, Human
acacccaaagagguauuuau

SEQ ID NO: 2851317 - RNA, 20 nt, Human
acacccaaagcauggacuaa

SEQ ID NO: 2851318 - RNA, 22 nt, Human
acacccaaagcauggacuaacc

SEQ ID NO: 2851319 - RNA, 17 nt, Human
acacccucaaccucuuc

SEQ ID NO: 2851320 - RNA, 18 nt, Human
acacccucaaccucuucu

SEQ ID NO: 2851321 - RNA, 18 nt, Human
acacccgugagcgccugu

SEQ ID NO: 2851322 - RNA, 21 nt, Human
acacccgugagcgccugugca

SEQ ID NO: 2851323 - RNA, 19 nt, Human
acacccucccccgccacuc

SEQ ID NO: 2851324 - RNA, 22 nt, Human
acacccucgaagcgcgccacuc

SEQ ID NO: 2851325 - RNA, 14 nt, Human
acacccucccccgc

SEQ ID NO: 2851326 - RNA, 16 nt, Human
acacccucccccgcca

SEQ ID NO: 2851327 - RNA, 13 nt, Human
acacccucccccg

SEQ ID NO: 2851328 - RNA, 17 nt, Human
acacccucacucugcca

SEQ ID NO: 2851329 - RNA, 19 nt, Human
acacccucacucugccagg

SEQ ID NO: 2851330 - RNA, 20 nt, Human
acacccucacucugccaggg

SEQ ID NO: 2851331 - RNA, 18 nt, Human
uaguucagguaacaggca

SEQ ID NO: 2851332 - RNA, 18 nt, Human
uauaaaaagcuuccauga

SEQ ID NO: 2851333 - RNA, 13 nt, Human
uauaaaaacaaaa

SEQ ID NO: 2851334 - RNA, 17 nt, Human
uaguuuuuucuuuuaac

SEQ ID NO: 2851335 - RNA, 23 nt, Human
uaguuuuuuuuuuuuuuauguga

SEQ ID NO: 2851336 - RNA, 18 nt, Human
acacauagauuaauggca

SEQ ID NO: 2851337 - RNA, 20 nt, Human
acacauagauuaauggcacu

SEQ ID NO: 2851338 - RNA, 21 nt, Human
acacauagauuaauggcacug

SEQ ID NO: 2851339 - RNA, 22 nt, Human
acacauagauuaauggcacuga

SEQ ID NO: 2851340 - RNA, 23 nt, Human
acacauagauuaauggcacugau

SEQ ID NO: 2851341 - RNA, 20 nt, Human
uauaaaaggcaaauguguac

SEQ ID NO: 2851342 - RNA, 16 nt, Human
acacauauauauuaca

SEQ ID NO: 2851343 - RNA, 21 nt, Human
acacauauaccuauaaugugu

SEQ ID NO: 2851344 - RNA, 23 nt, Human
acacauauaccuauaaugugugu

SEQ ID NO: 2851345 - RNA, 22 nt, Human
acacauauaaacaucacacaca

SEQ ID NO: 2851346 - RNA, 14 nt, Human
acacauauaaacau

SEQ ID NO: 2851347 - RNA, 19 nt, Human
uauaaaaggcaaaugugua

SEQ ID NO: 2851348 - RNA, 12 nt, Human
uauaaaaagcca

SEQ ID NO: 2851349 - RNA, 14 nt, Human
uauaaaaagccacu

SEQ ID NO: 2851350 - RNA, 19 nt, Human
uauauuguguuuguguauu

SEQ ID NO: 2851351 - RNA, 18 nt, Human
uauauuguguuuguguau

SEQ ID NO: 2851352 - RNA, 14 nt, Human
uauauuuagugcug

SEQ ID NO: 2851353 - RNA, 16 nt, Human
uauauuuaguuauagu

SEQ ID NO: 2851354 - RNA, 18 nt, Human
uauauuuaguuauaguuu

SEQ ID NO: 2851355 - RNA, 21 nt, Human
uauauuuagauuguuaaaaua

SEQ ID NO: 2851356 - RNA, 16 nt, Human
uauauuuauaacucau

SEQ ID NO: 2851357 - RNA, 15 nt, Human
uauauuuauaacuca

SEQ ID NO: 2851358 - RNA, 14 nt, Human
uauauuuauaacuc

SEQ ID NO: 2851359 - RNA, 12 nt, Human
uauauuuauaac

SEQ ID NO: 2851360 - RNA, 20 nt, Human
acagaccacaucuuuaucug

SEQ ID NO: 2851361 - RNA, 21 nt, Human
acagaccacaucuuuaucugu

SEQ ID NO: 2851362 - RNA, 11 nt, Human
uauauuacaag

SEQ ID NO: 2851363 - RNA, 18 nt, Human
uauauuaccagcaagaau

SEQ ID NO: 2851364 - RNA, 21 nt, Human
uauauuaccagcaagaauaaa

SEQ ID NO: 2851365 - RNA, 17 nt, Human
uauauuacacauuugua

SEQ ID NO: 2851366 - RNA, 20 nt, Human
uauauuacacauuuguacag

SEQ ID NO: 2851367 - RNA, 21 nt, Human
uauauuacacauuuguacaga

SEQ ID NO: 2851368 - RNA, 22 nt, Human
acagaccacaucuuuaucuguu

SEQ ID NO: 2851369 - RNA, 13 nt, Human
uauauuaagcaga

SEQ ID NO: 2851370 - RNA, 14 nt, Human
uauauuaagcagaa

SEQ ID NO: 2851371 - RNA, 15 nt, Human
uauauuaagcagaaa

SEQ ID NO: 2851372 - RNA, 15 nt, Human
uauauuaauguacuu

SEQ ID NO: 2851373 - RNA, 17 nt, Human
uauauuaauguacuugu

SEQ ID NO: 2851374 - RNA, 14 nt, Human
uauauuaguugcuu

SEQ ID NO: 2851375 - RNA, 18 nt, Human
uauauuaguugcuuuguu

SEQ ID NO: 2851376 - RNA, 14 nt, Human
uauauuauaaauau

SEQ ID NO: 2851377 - RNA, 20 nt, Human
uauauuauaaauauauauaa

SEQ ID NO: 2851378 - RNA, 21 nt, Human
uauauuauaaauauauauaaa

SEQ ID NO: 2851379 - RNA, 22 nt, Human
uauauuauaaauauauauaaag

SEQ ID NO: 2851380 - RNA, 13 nt, Human
uauaaguuugaag

SEQ ID NO: 2851381 - RNA, 17 nt, Human
uauaaguucacaaaaug

SEQ ID NO: 2851382 - RNA, 13 nt, Human
uauaagaaagaca

SEQ ID NO: 2851383 - RNA, 14 nt, Human
uauaagaaagacau

SEQ ID NO: 2851384 - RNA, 15 nt, Human
uauaagaaagacauc

SEQ ID NO: 2851385 - RNA, 17 nt, Human
uauaagaaagacaucuu

SEQ ID NO: 2851386 - RNA, 21 nt, Human
uauaagaaagacaucuuucuc

SEQ ID NO: 2851387 - RNA, 22 nt, Human
uauaagaaagacaucuuucucu

SEQ ID NO: 2851388 - RNA, 21 nt, Human
uauacaaaauaagaacgagga

SEQ ID NO: 2851389 - RNA, 16 nt, Human
uauacaacaaaggcaa

SEQ ID NO: 2851390 - RNA, 22 nt, Human
uauacaaaccuaccaaaaugga

SEQ ID NO: 2851391 - RNA, 12 nt, Human
uauacaaauaua

SEQ ID NO: 2851392 - RNA, 14 nt, Human
uauacaaauauauu

SEQ ID NO: 2851393 - RNA, 16 nt, Human
uauacaaauauauugu

SEQ ID NO: 2851394 - RNA, 20 nt, Human
uauacaaauauauuguuaau

SEQ ID NO: 2851395 - RNA, 16 nt, Human
uauacaaauuaaaaag

SEQ ID NO: 2851396 - RNA, 17 nt, Human
uauacaaauuaaaaaga

SEQ ID NO: 2851397 - RNA, 18 nt, Human
uauacaaauuaaaaagau

SEQ ID NO: 2851398 - RNA, 23 nt, Human
uauacaaauuaaaaagauucuuu

SEQ ID NO: 2851399 - RNA, 14 nt, Human
uauacaaaauaaga

SEQ ID NO: 2851400 - RNA, 19 nt, Human
uauaauuuuuuguaaugug

SEQ ID NO: 2851401 - RNA, 16 nt, Human
uauaaguuugaaggaa

SEQ ID NO: 2851402 - RNA, 17 nt, Human
acagaaauuagccgggc

SEQ ID NO: 2851403 - RNA, 19 nt, Human
uaucuauucugagaaaaca

SEQ ID NO: 2851404 - RNA, 18 nt, Human
uaucuauucugagaaaac

SEQ ID NO: 2851405 - RNA, 23 nt, Human
uaucuauucugagaaaacaagca

SEQ ID NO: 2851406 - RNA, 22 nt, Human
uaucucagucaugcauaaauau

SEQ ID NO: 2851407 - RNA, 14 nt, Human
uaucucaucaacaa

SEQ ID NO: 2851408 - RNA, 23 nt, Human
uaucucaucaacaaagaaauauu

SEQ ID NO: 2851409 - RNA, 14 nt, Human
uaucuaucuuccaa

SEQ ID NO: 2851410 - RNA, 23 nt, Human
uaucuaucuuccaaaugcaauuu

SEQ ID NO: 2851411 - RNA, 12 nt, Human
uaucuauuaaua

SEQ ID NO: 2851412 - RNA, 13 nt, Human
uaucuauuaauau

SEQ ID NO: 2851413 - RNA, 15 nt, Human
uaucuauuaauauau

SEQ ID NO: 2851414 - RNA, 17 nt, Human
uaucuauuaauauaugu

SEQ ID NO: 2851415 - RNA, 18 nt, Human
uaucuauuaauauaugua

SEQ ID NO: 2851416 - RNA, 16 nt, Human
uaucuauucugagaaa

SEQ ID NO: 2851417 - RNA, 19 nt, Human
uaucuauuaauauauguau

SEQ ID NO: 2851418 - RNA, 15 nt, Human
uaucuccaagaccag

SEQ ID NO: 2851419 - RNA, 18 nt, Human
uaucucagucaugcauaa

SEQ ID NO: 2851420 - RNA, 18 nt, Human
acagagaaaguacuucuc

SEQ ID NO: 2851421 - RNA, 11 nt, Human
acagagaaagu

SEQ ID NO: 2851422 - RNA, 19 nt, Human
acagagaaagaggaagcuu

SEQ ID NO: 2851423 - RNA, 20 nt, Human
acagagaagcggauuuccag

SEQ ID NO: 2851424 - RNA, 14 nt, Human
acagagaagcuggg

SEQ ID NO: 2851425 - RNA, 17 nt, Human
acagagaagcuggggag

SEQ ID NO: 2851426 - RNA, 15 nt, Human
uauccaggucaacag

SEQ ID NO: 2851427 - RNA, 17 nt, Human
uauccaggucaacagaa

SEQ ID NO: 2851428 - RNA, 18 nt, Human
uauccaggucaacagaau

SEQ ID NO: 2851429 - RNA, 19 nt, Human
uauccaggucaacagaaug

SEQ ID NO: 2851430 - RNA, 20 nt, Human
uauccaggucaacagaauga

SEQ ID NO: 2851431 - RNA, 21 nt, Human
uauccaggucaacagaaugaa

SEQ ID NO: 2851432 - RNA, 22 nt, Human
uauccaggucaacagaaugaaa

SEQ ID NO: 2851433 - RNA, 14 nt, Human
uauccaguuacugc

SEQ ID NO: 2851434 - RNA, 14 nt, Human
uauccauaaaaaaa

SEQ ID NO: 2851435 - RNA, 17 nt, Human
uauccauaaaaaaaaau

SEQ ID NO: 2851436 - RNA, 17 nt, Human
uauccauauugagucaa

SEQ ID NO: 2851437 - RNA, 18 nt, Human
uauccagaggacccaacu

SEQ ID NO: 2851438 - RNA, 18 nt, Human
uauccacuuugcacagcu

SEQ ID NO: 2851439 - RNA, 15 nt, Human
uauccacuuugcaca

SEQ ID NO: 2851440 - RNA, 11 nt, Human
uaucccuuccg

SEQ ID NO: 2851441 - RNA, 12 nt, Human
uaucccuuccgg

SEQ ID NO: 2851442 - RNA, 12 nt, Human
uaucccuucuca

SEQ ID NO: 2851443 - RNA, 18 nt, Human
uaucccuucucacagcac

SEQ ID NO: 2851444 - RNA, 19 nt, Human
uauccaaaccaaauaaaaa

SEQ ID NO: 2851445 - RNA, 17 nt, Human
uauccaaaucugaagau

SEQ ID NO: 2851446 - RNA, 20 nt, Human
uauccaaaucugaagauugc

SEQ ID NO: 2851447 - RNA, 18 nt, Human
uauccaaaauguguauuu

SEQ ID NO: 2851448 - RNA, 22 nt, Human
uauccaaaauguguauuucuua

SEQ ID NO: 2851449 - RNA, 23 nt, Human
uauccaaaauguguauuucuuau

SEQ ID NO: 2851450 - RNA, 14 nt, Human
uauccaaacaugua

SEQ ID NO: 2851451 - RNA, 20 nt, Human
uaucauuuauuuuuuacauu

SEQ ID NO: 2851452 - RNA, 14 nt, Human
uaucaagacauagc

SEQ ID NO: 2851453 - RNA, 15 nt, Human
uaucaagacauagca

SEQ ID NO: 2851454 - RNA, 16 nt, Human
uaucaagacauagcau

SEQ ID NO: 2851455 - RNA, 20 nt, Human
uaucaagaggcugagacagg

SEQ ID NO: 2851456 - RNA, 13 nt, Human
uaucaacuuuaau

SEQ ID NO: 2851457 - RNA, 15 nt, Human
uaucaacuuuaauca

SEQ ID NO: 2851458 - RNA, 21 nt, Human
uaucaacacuguuacuuucgu

SEQ ID NO: 2851459 - RNA, 15 nt, Human
uaucaagcagccaag

SEQ ID NO: 2851460 - RNA, 22 nt, Human
uaucaaggaagaaaugguucag

SEQ ID NO: 2851461 - RNA, 22 nt, Human
uaucaaggacucugguuucuca

SEQ ID NO: 2851462 - RNA, 18 nt, Human
acagccucugaccccucc

SEQ ID NO: 2851463 - RNA, 20 nt, Human
acagccucugaccccuccuc

SEQ ID NO: 2851464 - RNA, 21 nt, Human
acagccucugaccccuccuca

SEQ ID NO: 2851465 - RNA, 22 nt, Human
acagccucugaccccuccucac

SEQ ID NO: 2851466 - RNA, 23 nt, Human
acagccucugaccccuccucacu

SEQ ID NO: 2851467 - RNA, 22 nt, Human
uauggguuagauguugccaugu

SEQ ID NO: 2851468 - RNA, 15 nt, Human
uaugcugaucaucgc

SEQ ID NO: 2851469 - RNA, 20 nt, Human
uaugcugaucaucgccagag

SEQ ID NO: 2851470 - RNA, 22 nt, Human
uaugcugaucaucgccagaggu

SEQ ID NO: 2851471 - RNA, 22 nt, Human
uaugcugcuuuuauaucuguau

SEQ ID NO: 2851472 - RNA, 12 nt, Human
uaugcugcuuuu

SEQ ID NO: 2851473 - RNA, 19 nt, Human
uaugccuucuuauugcuuu

SEQ ID NO: 2851474 - RNA, 18 nt, Human
uaugccuuggggaggaca

SEQ ID NO: 2851475 - RNA, 23 nt, Human
uaugccuuggggaggacaaaacu

SEQ ID NO: 2851476 - RNA, 10 nt, Human
uaugccugug

SEQ ID NO: 2851477 - RNA, 14 nt, Human
uaugccuucuuauu

SEQ ID NO: 2851478 - RNA, 22 nt, Human
uaugaacccuuccugagcuuua

SEQ ID NO: 2851479 - RNA, 23 nt, Human
uaugaacccuuccugagcuuuau

SEQ ID NO: 2851480 - RNA, 16 nt, Human
uaugaacccuuuguuu

SEQ ID NO: 2851481 - RNA, 18 nt, Human
uaugaacccuuuguuucu

SEQ ID NO: 2851482 - RNA, 19 nt, Human
uaugaacccuuuguuucuu

SEQ ID NO: 2851483 - RNA, 20 nt, Human
uaugaacccuuuguuucuug

SEQ ID NO: 2851484 - RNA, 21 nt, Human
uaugaacccuuuguuucuugu

SEQ ID NO: 2851485 - RNA, 14 nt, Human
uaugaacaacucca

SEQ ID NO: 2851486 - RNA, 15 nt, Human
uaucuuuuuucaaaa

SEQ ID NO: 2851487 - RNA, 13 nt, Human
uaucuuuucuuua

SEQ ID NO: 2851488 - RNA, 14 nt, Human
uaucuuuucuuuag

SEQ ID NO: 2851489 - RNA, 15 nt, Human
uaucuuuucuuuaga

SEQ ID NO: 2851490 - RNA, 20 nt, Human
uaucuuuucuuuagagaacu

SEQ ID NO: 2851491 - RNA, 22 nt, Human
uaucuuuucuuuagagaacuga

SEQ ID NO: 2851492 - RNA, 18 nt, Human
uaucuuugugauaauuua

SEQ ID NO: 2851493 - RNA, 14 nt, Human
uaucuuuuauguuu

SEQ ID NO: 2851494 - RNA, 16 nt, Human
uaucuuuuauguuuga

SEQ ID NO: 2851495 - RNA, 17 nt, Human
uaucuuuuauguuugaa

SEQ ID NO: 2851496 - RNA, 19 nt, Human
uaucuuuuauguuugaaua

SEQ ID NO: 2851497 - RNA, 18 nt, Human
acagccguuuguucccca

SEQ ID NO: 2851498 - RNA, 17 nt, Human
acagccuauuccugaac

SEQ ID NO: 2851499 - RNA, 12 nt, Human
acagccucacuu

SEQ ID NO: 2851500 - RNA, 23 nt, Human
acagccgcagccucccucugacc

SEQ ID NO: 2851501 - RNA, 22 nt, Human
acagccgcagccucccucugac

SEQ ID NO: 2851502 - RNA, 15 nt, Human
acagauuucauaccu

SEQ ID NO: 2851503 - RNA, 16 nt, Human
acagauuucauaccuc

SEQ ID NO: 2851504 - RNA, 17 nt, Human
acagauuucauaccuca

SEQ ID NO: 2851505 - RNA, 17 nt, Human
acagagaauaugucugc

SEQ ID NO: 2851506 - RNA, 23 nt, Human
acagaucgaaccguuuugaagcu

SEQ ID NO: 2851507 - RNA, 18 nt, Human
acagauccccaagccugg

SEQ ID NO: 2851508 - RNA, 22 nt, Human
acagaucucugcuuuggaaauc

SEQ ID NO: 2851509 - RNA, 13 nt, Human
acagauaguugug

SEQ ID NO: 2851510 - RNA, 15 nt, Human
acagauauacuuugu

SEQ ID NO: 2851511 - RNA, 19 nt, Human
acagauauacuuuguggac

SEQ ID NO: 2851512 - RNA, 17 nt, Human
acagauccccaagccug

SEQ ID NO: 2851513 - RNA, 14 nt, Human
acagauuugagcuc

SEQ ID NO: 2851514 - RNA, 20 nt, Human
acagauuuaauacaguuuau

SEQ ID NO: 2851515 - RNA, 13 nt, Human
acagauuguuucu

SEQ ID NO: 2851516 - RNA, 14 nt, Human
acagauuguuucua

SEQ ID NO: 2851517 - RNA, 15 nt, Human
acagauuguuucuau

SEQ ID NO: 2851518 - RNA, 16 nt, Human
acagauuguuucuaua

SEQ ID NO: 2851519 - RNA, 18 nt, Human
acagauuguuucuauaca

SEQ ID NO: 2851520 - RNA, 21 nt, Human
acagauuguuucuauacaaau

SEQ ID NO: 2851521 - RNA, 23 nt, Human
acagauuguuucuauacaaauau

SEQ ID NO: 2851522 - RNA, 14 nt, Human
acagaugaauguau

SEQ ID NO: 2851523 - RNA, 19 nt, Human
acagaugaaacacaaacaa

SEQ ID NO: 2851524 - RNA, 20 nt, Human
acagaugaaacacaaacaau

SEQ ID NO: 2851525 - RNA, 12 nt, Human
acagaugaaaau

SEQ ID NO: 2851526 - RNA, 13 nt, Human
acagaugaaaauu

SEQ ID NO: 2851527 - RNA, 15 nt, Human
acagaugaaaauuug

SEQ ID NO: 2851528 - RNA, 16 nt, Human
acagaugaaaauuuga

SEQ ID NO: 2851529 - RNA, 23 nt, Human
acagaugaaaauuugagacuauu

SEQ ID NO: 2851530 - RNA, 17 nt, Human
acagaugaauguauuua

SEQ ID NO: 2851531 - RNA, 14 nt, Human
acagaugaauaaac

SEQ ID NO: 2851532 - RNA, 19 nt, Human
acagaugaugagaauuucu

SEQ ID NO: 2851533 - RNA, 20 nt, Human
acagaugaugagaauuucua

SEQ ID NO: 2851534 - RNA, 24 nt, Human
acagauuggagagggcucugugcu

SEQ ID NO: 2851535 - RNA, 22 nt, Human
acagggaaugccugagugccug

SEQ ID NO: 2851536 - RNA, 22 nt, Human
acagggacugaaaaccucuccu

SEQ ID NO: 2851537 - RNA, 15 nt, Human
acagggaagagcaga

SEQ ID NO: 2851538 - RNA, 14 nt, Human
acaggcuggcgggg

SEQ ID NO: 2851539 - RNA, 19 nt, Human
acaggcuguucugcacuga

SEQ ID NO: 2851540 - RNA, 20 nt, Human
acaggcuguucugcacugaa

SEQ ID NO: 2851541 - RNA, 21 nt, Human
acaggcuguucugcacugaaa

SEQ ID NO: 2851542 - RNA, 22 nt, Human
acaggcuguucugcacugaaaa

SEQ ID NO: 2851543 - RNA, 23 nt, Human
acaggcugggcuucaguggcagc

SEQ ID NO: 2851544 - RNA, 22 nt, Human
acaggcugggcuucaguggcag

SEQ ID NO: 2851545 - RNA, 12 nt, Human
acaggcugggcu

SEQ ID NO: 2851546 - RNA, 22 nt, Human
acaggcuccugccaccacgccc

SEQ ID NO: 2851547 - RNA, 21 nt, Human
acaggcuccugccaccacgcc

SEQ ID NO: 2851548 - RNA, 15 nt, Human
acaggcuccugccac

SEQ ID NO: 2851549 - RNA, 13 nt, Human
acaggcuccugcc

SEQ ID NO: 2851550 - RNA, 18 nt, Human
acagucacugauguacaa

SEQ ID NO: 2851551 - RNA, 19 nt, Human
acagucacugccacuuugc

SEQ ID NO: 2851552 - RNA, 20 nt, Human
acagucacugccacuuugca

SEQ ID NO: 2851553 - RNA, 22 nt, Human
acagucacugccacuuugcaca

SEQ ID NO: 2851554 - RNA, 23 nt, Human
acagucacugccacuuugcacau

SEQ ID NO: 2851555 - RNA, 15 nt, Human
acagucagcucuuca

SEQ ID NO: 2851556 - RNA, 16 nt, Human
acagucagcucuucau

SEQ ID NO: 2851557 - RNA, 18 nt, Human
acagucagcucuucaucu

SEQ ID NO: 2851558 - RNA, 14 nt, Human
acagucaucaucag

SEQ ID NO: 2851559 - RNA, 17 nt, Human
acagucaucaucagggc

SEQ ID NO: 2851560 - RNA, 18 nt, Human
acagucaucaucagggcc

SEQ ID NO: 2851561 - RNA, 19 nt, Human
acagucaucaucagggccu

SEQ ID NO: 2851562 - RNA, 20 nt, Human
acagucaucaucagggccug

SEQ ID NO: 2851563 - RNA, 21 nt, Human
acagucaucaucagggccugg

SEQ ID NO: 2851564 - RNA, 17 nt, Human
acagucaucgcucgugu

SEQ ID NO: 2851565 - RNA, 21 nt, Human
acagucaucgcucguguguuc

SEQ ID NO: 2851566 - RNA, 23 nt, Human
acaguaguuagaauuauaucacu

SEQ ID NO: 2851567 - RNA, 16 nt, Human
acaguauaaaaauaga

SEQ ID NO: 2851568 - RNA, 23 nt, Human
acaguagucuugaugaccaaagu

SEQ ID NO: 2851569 - RNA, 16 nt, Human
acaguagagccagcuu

SEQ ID NO: 2851570 - RNA, 14 nt, Human
acaguagucuugau

SEQ ID NO: 2851571 - RNA, 18 nt, Human
acaguaggugacacuaua

SEQ ID NO: 2851572 - RNA, 20 nt, Human
acagggcacaccgggcacuc

SEQ ID NO: 2851573 - RNA, 15 nt, Human
acaguaacuuuaugu

SEQ ID NO: 2851574 - RNA, 16 nt, Human
acaguaacuuuaugug

SEQ ID NO: 2851575 - RNA, 18 nt, Human
acaguaacuuuaugugua

SEQ ID NO: 2851576 - RNA, 21 nt, Human
acagggaugagcauggagcug

SEQ ID NO: 2851577 - RNA, 23 nt, Human
acagggaugagcauggagcuggc

SEQ ID NO: 2851578 - RNA, 12 nt, Human
acagggcacacc

SEQ ID NO: 2851579 - RNA, 13 nt, Human
acagggaugagca

SEQ ID NO: 2851580 - RNA, 14 nt, Human
acagggaugagcau

SEQ ID NO: 2851581 - RNA, 10 nt, Human
acagggaggg

SEQ ID NO: 2851582 - RNA, 12 nt, Human
acagggagggga

SEQ ID NO: 2851583 - RNA, 20 nt, Human
acagggauuuagacuuacua

SEQ ID NO: 2851584 - RNA, 19 nt, Human
acaguaacuuuauguguaa

SEQ ID NO: 2851585 - RNA, 21 nt, Human
acaguaacuuuauguguaaau

SEQ ID NO: 2851586 - RNA, 15 nt, Human
acaguacagcaugug

SEQ ID NO: 2851587 - RNA, 17 nt, Human
acaguacagcaugugcc

SEQ ID NO: 2851588 - RNA, 19 nt, Human
acaguacagcaugugccuu

SEQ ID NO: 2851589 - RNA, 13 nt, Human
acaguagagccag

SEQ ID NO: 2851590 - RNA, 15 nt, Human
acaguagagccagcu

SEQ ID NO: 2851591 - RNA, 14 nt, Human
acaguagagccagc

SEQ ID NO: 2851592 - RNA, 17 nt, Human
uauuaaaaugauuguaa

SEQ ID NO: 2851593 - RNA, 18 nt, Human
uauuaaaaugauuguaaa

SEQ ID NO: 2851594 - RNA, 19 nt, Human
uauuaaaaugauuguaaaa

SEQ ID NO: 2851595 - RNA, 20 nt, Human
uauuaaaaugauuguaaaau

SEQ ID NO: 2851596 - RNA, 22 nt, Human
uauuaaaaugauuguaaaauag

SEQ ID NO: 2851597 - RNA, 14 nt, Human
uauuacuucugcua

SEQ ID NO: 2851598 - RNA, 18 nt, Human
uauuacuguuuauuucug

SEQ ID NO: 2851599 - RNA, 21 nt, Human
uauuacuguuuauuucuguuu

SEQ ID NO: 2851600 - RNA, 23 nt, Human
uauuacuuauuuuugacaguguu

SEQ ID NO: 2851601 - RNA, 13 nt, Human
uauuacuucugcu

SEQ ID NO: 2851602 - RNA, 19 nt, Human
uauuacuggcguggauuaa

SEQ ID NO: 2851603 - RNA, 21 nt, Human
uauuacuggcguggauuaaac

SEQ ID NO: 2851604 - RNA, 22 nt, Human
uauuacuggcguggauuaaacu

SEQ ID NO: 2851605 - RNA, 22 nt, Human
uauuacuaugacugcuccccag

SEQ ID NO: 2851606 - RNA, 14 nt, Human
uauuacucaguuua

SEQ ID NO: 2851607 - RNA, 17 nt, Human
uauuacuccuauuuuug

SEQ ID NO: 2851608 - RNA, 18 nt, Human
uauuacugucugguuuua

SEQ ID NO: 2851609 - RNA, 23 nt, Human
uauuacugucugguuuuaacaau

SEQ ID NO: 2851610 - RNA, 21 nt, Human
uauuacuguugauaauucuua

SEQ ID NO: 2851611 - RNA, 19 nt, Human
uauuagugaccucagcuuu

SEQ ID NO: 2851612 - RNA, 23 nt, Human
uauucaaaaauuaucuauagcua

SEQ ID NO: 2851613 - RNA, 23 nt, Human
uauuagaaauuagaaaaaaauua

SEQ ID NO: 2851614 - RNA, 14 nt, Human
uauuacuuuaucac

SEQ ID NO: 2851615 - RNA, 18 nt, Human
uauuacuuuaucacuuuu

SEQ ID NO: 2851616 - RNA, 23 nt, Human
uauuacuuuaucacuuuuugaac

SEQ ID NO: 2851617 - RNA, 14 nt, Human
uauuacuuguugca

SEQ ID NO: 2851618 - RNA, 21 nt, Human
uauuacuuguugcaaaggucu

SEQ ID NO: 2851619 - RNA, 21 nt, Human
uauuaggugcaauuucaaggu

SEQ ID NO: 2851620 - RNA, 21 nt, Human
uauuaguacugcucuuguuuc

SEQ ID NO: 2851621 - RNA, 17 nt, Human
uauuaggugcaauuuca

SEQ ID NO: 2851622 - RNA, 21 nt, Human
uauucacaucgcuucugugua

SEQ ID NO: 2851623 - RNA, 22 nt, Human
uauucacaucgcuucuguguau

SEQ ID NO: 2851624 - RNA, 21 nt, Human
uauucagcuucauuuguguca

SEQ ID NO: 2851625 - RNA, 17 nt, Human
uauucagcuucauuugu

SEQ ID NO: 2851626 - RNA, 19 nt, Human
uauucagcuucauuugugu

SEQ ID NO: 2851627 - RNA, 14 nt, Human
uauucagcuucauu

SEQ ID NO: 2851628 - RNA, 16 nt, Human
uauucagcuucauuug

SEQ ID NO: 2851629 - RNA, 22 nt, Human
uauucagugcuguggccugggc

SEQ ID NO: 2851630 - RNA, 18 nt, Human
uauucagugcuguggccu

SEQ ID NO: 2851631 - RNA, 15 nt, Human
uauucagugcugugg

SEQ ID NO: 2851632 - RNA, 21 nt, Human
uauucagugcuguggccuggg

SEQ ID NO: 2851633 - RNA, 22 nt, Human
acaggcgugagccaccgugccu

SEQ ID NO: 2851634 - RNA, 17 nt, Human
acaggcgggaggaggug

SEQ ID NO: 2851635 - RNA, 12 nt, Human
acaggcuccugc

SEQ ID NO: 2851636 - RNA, 20 nt, Human
acaggaagguggugcuuaca

SEQ ID NO: 2851637 - RNA, 15 nt, Human
acaggaagugaagaa

SEQ ID NO: 2851638 - RNA, 20 nt, Human
acaggaagcaccccaugcca

SEQ ID NO: 2851639 - RNA, 15 nt, Human
acaggaagcacccca

SEQ ID NO: 2851640 - RNA, 17 nt, Human
acaggaaaagcugcuga

SEQ ID NO: 2851641 - RNA, 16 nt, Human
acaggaaaagcugcug

SEQ ID NO: 2851642 - RNA, 15 nt, Human
acaggaaaagcugcu

SEQ ID NO: 2851643 - RNA, 19 nt, Human
acagcuaacaauugugaag

SEQ ID NO: 2851644 - RNA, 15 nt, Human
acagcuaacacacag

SEQ ID NO: 2851645 - RNA, 16 nt, Human
acagcggggccccagg

SEQ ID NO: 2851646 - RNA, 19 nt, Human
acagcgucccuagcaguga

SEQ ID NO: 2851647 - RNA, 21 nt, Human
acagcgucccuagcagugaac

SEQ ID NO: 2851648 - RNA, 23 nt, Human
acagcgucccuagcagugaacua

SEQ ID NO: 2851649 - RNA, 11 nt, Human
acagccuggca

SEQ ID NO: 2851650 - RNA, 20 nt, Human
acagcuuuccccucauuuuu

SEQ ID NO: 2851651 - RNA, 12 nt, Human
acagcuuucuga

SEQ ID NO: 2851652 - RNA, 14 nt, Human
acagcuuucugacc

SEQ ID NO: 2851653 - RNA, 15 nt, Human
acagcuuucugaccu

SEQ ID NO: 2851654 - RNA, 17 nt, Human
acagcuuucugaccuuc

SEQ ID NO: 2851655 - RNA, 18 nt, Human
acagcuuucugaccuuca

SEQ ID NO: 2851656 - RNA, 19 nt, Human
acagcuuucugaccuucag

SEQ ID NO: 2851657 - RNA, 22 nt, Human
acagcuuucugaccuucagcuc

SEQ ID NO: 2851658 - RNA, 17 nt, Human
acagcuuucuugcuccc

SEQ ID NO: 2851659 - RNA, 21 nt, Human
acagcuuucuugcucccuuca

SEQ ID NO: 2851660 - RNA, 22 nt, Human
acagcuuucuugcucccuucag

SEQ ID NO: 2851661 - RNA, 12 nt, Human
acagcuuugacu

SEQ ID NO: 2851662 - RNA, 15 nt, Human
acagcuuucaagugc

SEQ ID NO: 2851663 - RNA, 15 nt, Human
acagcuuuacacaca

SEQ ID NO: 2851664 - RNA, 16 nt, Human
acagcuuuacacacac

SEQ ID NO: 2851665 - RNA, 18 nt, Human
acagcuaacacacagcuc

SEQ ID NO: 2851666 - RNA, 19 nt, Human
acagcuaacacacagcucc

SEQ ID NO: 2851667 - RNA, 21 nt, Human
acagcuuuggggugucuuuuu

SEQ ID NO: 2851668 - RNA, 22 nt, Human
acagcuuuggggugucuuuuuu

SEQ ID NO: 2851669 - RNA, 17 nt, Human
acaggacagugcuucag

SEQ ID NO: 2851670 - RNA, 19 nt, Human
acaggaaucaagagcugcc

SEQ ID NO: 2851671 - RNA, 15 nt, Human
acaggaauuuuaaaa

SEQ ID NO: 2851672 - RNA, 22 nt, Human
acaggacagugcuucagccuga

SEQ ID NO: 2851673 - RNA, 20 nt, Human
acaggacagugcuucagccu

SEQ ID NO: 2851674 - RNA, 19 nt, Human
acaggaggcaagcaagcuc

SEQ ID NO: 2851675 - RNA, 14 nt, Human
acaggacucugccu

SEQ ID NO: 2851676 - RNA, 13 nt, Human
acaggcaggucca

SEQ ID NO: 2851677 - RNA, 14 nt, Human
acaggaucagucug

SEQ ID NO: 2851678 - RNA, 16 nt, Human
acaggagugagcacua

SEQ ID NO: 2851679 - RNA, 16 nt, Human
acaggcagguccaggg

SEQ ID NO: 2851680 - RNA, 14 nt, Human
acaggcagguccag

SEQ ID NO: 2851681 - RNA, 14 nt, Human
acaggcauguucuc

SEQ ID NO: 2851682 - RNA, 21 nt, Human
acaggcauaaaauagaguaaa

SEQ ID NO: 2851683 - RNA, 18 nt, Human
acaggcagucucucucuu

SEQ ID NO: 2851684 - RNA, 20 nt, Human
acaggcagucucucucuucc

SEQ ID NO: 2851685 - RNA, 22 nt, Human
acaggcagucucucucuuccuc

SEQ ID NO: 2851686 - RNA, 21 nt, Human
uaugugugaggagcugcuggc

SEQ ID NO: 2851687 - RNA, 13 nt, Human
uaugugugcaugu

SEQ ID NO: 2851688 - RNA, 17 nt, Human
uaugugugcaugugugu

SEQ ID NO: 2851689 - RNA, 18 nt, Human
uaugugugcaugugugua

SEQ ID NO: 2851690 - RNA, 20 nt, Human
uaugugugcauguguguaua

SEQ ID NO: 2851691 - RNA, 21 nt, Human
uaugugugcauguguguauaa

SEQ ID NO: 2851692 - RNA, 16 nt, Human
uaugugugaggagcug

SEQ ID NO: 2851693 - RNA, 14 nt, Human
uauguguguagaca

SEQ ID NO: 2851694 - RNA, 16 nt, Human
uauguuuuuauaaaaa

SEQ ID NO: 2851695 - RNA, 13 nt, Human
uauguguauguac

SEQ ID NO: 2851696 - RNA, 12 nt, Human
uauguguaugua

SEQ ID NO: 2851697 - RNA, 15 nt, Human
uaugugugaggagcu

SEQ ID NO: 2851698 - RNA, 18 nt, Human
uauguguaugugccauuu

SEQ ID NO: 2851699 - RNA, 19 nt, Human
uaugugucaguucauuugu

SEQ ID NO: 2851700 - RNA, 13 nt, Human
uauguguaggcag

SEQ ID NO: 2851701 - RNA, 14 nt, Human
uauguguauauaua

SEQ ID NO: 2851702 - RNA, 17 nt, Human
uauguguauauauacau

SEQ ID NO: 2851703 - RNA, 21 nt, Human
uauguguauauauacauacac

SEQ ID NO: 2851704 - RNA, 22 nt, Human
uauguguauauauacauacacu

SEQ ID NO: 2851705 - RNA, 14 nt, Human
uauguguaaauaca

SEQ ID NO: 2851706 - RNA, 23 nt, Human
uaugugaguguguguuugugcug

SEQ ID NO: 2851707 - RNA, 14 nt, Human
uaugugaucugucu

SEQ ID NO: 2851708 - RNA, 15 nt, Human
uaugugcuguaauuu

SEQ ID NO: 2851709 - RNA, 18 nt, Human
uaugugcuuucaucacaa

SEQ ID NO: 2851710 - RNA, 14 nt, Human
uauuaaaagucaca

SEQ ID NO: 2851711 - RNA, 22 nt, Human
uauuaaaagucacaauguucuu

SEQ ID NO: 2851712 - RNA, 12 nt, Human
uauuaaaaauau

SEQ ID NO: 2851713 - RNA, 17 nt, Human
uauguuuuuuaaaauau

SEQ ID NO: 2851714 - RNA, 15 nt, Human
uauguuuuuuuucug

SEQ ID NO: 2851715 - RNA, 22 nt, Human
uauguuuuuuuucugcuggaaa

SEQ ID NO: 2851716 - RNA, 20 nt, Human
uaugugacaccaaagccacc

SEQ ID NO: 2851717 - RNA, 18 nt, Human
uaugugacauuuuacauu

SEQ ID NO: 2851718 - RNA, 14 nt, Human
uaugugacauuuua

SEQ ID NO: 2851719 - RNA, 18 nt, Human
uaugucuguuuaagaaaa

SEQ ID NO: 2851720 - RNA, 20 nt, Human
uaugucuguuuaagaaaagu

SEQ ID NO: 2851721 - RNA, 21 nt, Human
uaugugaauccucuucuuuau

SEQ ID NO: 2851722 - RNA, 22 nt, Human
uaugugaauauggacucaguuu

SEQ ID NO: 2851723 - RNA, 19 nt, Human
uaugugacauuuuacauua

SEQ ID NO: 2851724 - RNA, 21 nt, Human
uaugugacauuuuacauuaaa

SEQ ID NO: 2851725 - RNA, 22 nt, Human
uaugugagagauucugugaucu

SEQ ID NO: 2851726 - RNA, 19 nt, Human
uaugugagauuuuuuauug

SEQ ID NO: 2851727 - RNA, 21 nt, Human
uaugugagauuuuuuauugcu

SEQ ID NO: 2851728 - RNA, 22 nt, Human
uaugugagauuuuuuauugcua

SEQ ID NO: 2851729 - RNA, 16 nt, Human
uaugugagugccuuuu

SEQ ID NO: 2851730 - RNA, 23 nt, Human
uaugugagugccuuuugcagaag

SEQ ID NO: 2851731 - RNA, 20 nt, Human
acaggcauguucucugagga

SEQ ID NO: 2851732 - RNA, 19 nt, Human
acaggcauguucucugagg

SEQ ID NO: 2851733 - RNA, 18 nt, Human
acaggcauguucucugag

SEQ ID NO: 2851734 - RNA, 15 nt, Human
acaggcauguucucu

SEQ ID NO: 2851735 - RNA, 22 nt, Human
acaggcauguucucugaggaca

SEQ ID NO: 2851736 - RNA, 21 nt, Human
acaggcaugggugcaaggaaa

SEQ ID NO: 2851737 - RNA, 22 nt, Human
acaggcaugggugcaaggaaaa

SEQ ID NO: 2851738 - RNA, 17 nt, Human
acaggcauuuguucacu

SEQ ID NO: 2851739 - RNA, 18 nt, Human
acaggcauuuguucacug

SEQ ID NO: 2851740 - RNA, 14 nt, Human
uaugucuuggacac

SEQ ID NO: 2851741 - RNA, 17 nt, Human
uaugucuuggacacugu

SEQ ID NO: 2851742 - RNA, 19 nt, Human
uaugucuuggacacuguac

SEQ ID NO: 2851743 - RNA, 21 nt, Human
uaugucuuggacacuguacaa

SEQ ID NO: 2851744 - RNA, 17 nt, Human
uaugucuuuuauauuug

SEQ ID NO: 2851745 - RNA, 17 nt, Human
uacuguauagacaguuu

SEQ ID NO: 2851746 - RNA, 20 nt, Human
uacuguauagacaguuugua

SEQ ID NO: 2851747 - RNA, 22 nt, Human
uacuguauagacaguuuguaaa

SEQ ID NO: 2851748 - RNA, 15 nt, Human
uacuguacuaauucu

SEQ ID NO: 2851749 - RNA, 21 nt, Human
uacuguacuaauucuuacacu

SEQ ID NO: 2851750 - RNA, 14 nt, Human
uacuguaguauucu

SEQ ID NO: 2851751 - RNA, 14 nt, Human
aauugacugucacu

SEQ ID NO: 2851752 - RNA, 24 nt, Human
aauugacgguuuuuuauuauugug

SEQ ID NO: 2851753 - RNA, 11 nt, Human
aauugacuacc

SEQ ID NO: 2851754 - RNA, 13 nt, Human
uacuguaagacau

SEQ ID NO: 2851755 - RNA, 14 nt, Human
uacuguaagacauu

SEQ ID NO: 2851756 - RNA, 15 nt, Human
uacuguaagacauua

SEQ ID NO: 2851757 - RNA, 16 nt, Human
uacuguaauaauaccu

SEQ ID NO: 2851758 - RNA, 17 nt, Human
uacuguaauaauaccuc

SEQ ID NO: 2851759 - RNA, 18 nt, Human
uacuguaauaauaccuca

SEQ ID NO: 2851760 - RNA, 19 nt, Human
uacuguaauaauaccucaa

SEQ ID NO: 2851761 - RNA, 14 nt, Human
aauugauguguuua

SEQ ID NO: 2851762 - RNA, 12 nt, Human
aauugcauuucc

SEQ ID NO: 2851763 - RNA, 13 nt, Human
aauugauguguuu

SEQ ID NO: 2851764 - RNA, 21 nt, Human
aauugaucauagguauuucaa

SEQ ID NO: 2851765 - RNA, 22 nt, Human
aauugaucauagguauuucaaa

SEQ ID NO: 2851766 - RNA, 15 nt, Human
aauugacucaaaucu

SEQ ID NO: 2851767 - RNA, 22 nt, Human
aauugaucauuuuccccccacu

SEQ ID NO: 2851768 - RNA, 22 nt, Human
aauugccuauccugcuguucua

SEQ ID NO: 2851769 - RNA, 12 nt, Human
uacuggcgugga

SEQ ID NO: 2851770 - RNA, 15 nt, Human
uacuggcguggauua

SEQ ID NO: 2851771 - RNA, 21 nt, Human
uacuggcguggauuaaacuua

SEQ ID NO: 2851772 - RNA, 23 nt, Human
uacuggcguggauuaaacuuaug

SEQ ID NO: 2851773 - RNA, 18 nt, Human
uacuggcuccucuguggu

SEQ ID NO: 2851774 - RNA, 19 nt, Human
uacuggcuccucuguggug

SEQ ID NO: 2851775 - RNA, 17 nt, Human
uacuggcauaguuucau

SEQ ID NO: 2851776 - RNA, 19 nt, Human
uacuggagcuucauuuugg

SEQ ID NO: 2851777 - RNA, 12 nt, Human
uacucuguguca

SEQ ID NO: 2851778 - RNA, 19 nt, Human
uacucuguccauuuaucca

SEQ ID NO: 2851779 - RNA, 17 nt, Human
uacucuggggugcugcc

SEQ ID NO: 2851780 - RNA, 21 nt, Human
uacucuggggugcugccugaa

SEQ ID NO: 2851781 - RNA, 23 nt, Human
uacucuggggugcugccugaauc

SEQ ID NO: 2851782 - RNA, 13 nt, Human
uacucugaaacac

SEQ ID NO: 2851783 - RNA, 20 nt, Human
uacucugaaacacacugaaa

SEQ ID NO: 2851784 - RNA, 21 nt, Human
aauuccuauauccugugacug

SEQ ID NO: 2851785 - RNA, 14 nt, Human
aauucccuggggaa

SEQ ID NO: 2851786 - RNA, 13 nt, Human
aauuccuaacuuu

SEQ ID NO: 2851787 - RNA, 10 nt, Human
aauuccuaca

SEQ ID NO: 2851788 - RNA, 13 nt, Human
aauuccuacagca

SEQ ID NO: 2851789 - RNA, 14 nt, Human
aauuccuacagcac

SEQ ID NO: 2851790 - RNA, 15 nt, Human
aauuccuacagcacu

SEQ ID NO: 2851791 - RNA, 18 nt, Human
aauuccuacagcacuacu

SEQ ID NO: 2851792 - RNA, 19 nt, Human
aauuccuacagcacuacug

SEQ ID NO: 2851793 - RNA, 14 nt, Human
aauuccuagaauua

SEQ ID NO: 2851794 - RNA, 17 nt, Human
aauuccuagaauuaaac

SEQ ID NO: 2851795 - RNA, 13 nt, Human
uacgcacagacag

SEQ ID NO: 2851796 - RNA, 14 nt, Human
uacgcacagacagg

SEQ ID NO: 2851797 - RNA, 17 nt, Human
uacgcacagacagguuu

SEQ ID NO: 2851798 - RNA, 21 nt, Human
uacgcacagacagguuuucac

SEQ ID NO: 2851799 - RNA, 21 nt, Human
uacgagugcuaaguguaggau

SEQ ID NO: 2851800 - RNA, 14 nt, Human
uacgauaaggaaga

SEQ ID NO: 2851801 - RNA, 15 nt, Human
uacgauaaggaagaa

SEQ ID NO: 2851802 - RNA, 16 nt, Human
uacgauaaggaagaaa

SEQ ID NO: 2851803 - RNA, 21 nt, Human
uacgauaaggaagaaacagaa

SEQ ID NO: 2851804 - RNA, 14 nt, Human
uacgauacgcuacu

SEQ ID NO: 2851805 - RNA, 23 nt, Human
uacgauacgcuacuauaaagaga

SEQ ID NO: 2851806 - RNA, 14 nt, Human
uacgaucaggcaca

SEQ ID NO: 2851807 - RNA, 16 nt, Human
uacgaucaggcacagg

SEQ ID NO: 2851808 - RNA, 21 nt, Human
aauuccucauccucagaugcu

SEQ ID NO: 2851809 - RNA, 22 nt, Human
aauuccucauccucagaugcuc

SEQ ID NO: 2851810 - RNA, 17 nt, Human
uacgccugcauguaaac

SEQ ID NO: 2851811 - RNA, 17 nt, Human
uacgcaggcaucugauu

SEQ ID NO: 2851812 - RNA, 21 nt, Human
aauuccucucacuaaacuuua

SEQ ID NO: 2851813 - RNA, 23 nt, Human
uacgcacuacaugugguuuauag

SEQ ID NO: 2851814 - RNA, 16 nt, Human
uacuauggcugaguuc

SEQ ID NO: 2851815 - RNA, 14 nt, Human
uacuaugccugugu

SEQ ID NO: 2851816 - RNA, 13 nt, Human
uacuaugccugug

SEQ ID NO: 2851817 - RNA, 17 nt, Human
uacuauccaguuacugc

SEQ ID NO: 2851818 - RNA, 20 nt, Human
uacggucagguuuaacauuu

SEQ ID NO: 2851819 - RNA, 13 nt, Human
uacguuuguaugu

SEQ ID NO: 2851820 - RNA, 14 nt, Human
uacguuuguaugug

SEQ ID NO: 2851821 - RNA, 20 nt, Human
uacguuuguauguguguaga

SEQ ID NO: 2851822 - RNA, 15 nt, Human
uacuacugaaacaga

SEQ ID NO: 2851823 - RNA, 20 nt, Human
uacuacugaaacagauuuca

SEQ ID NO: 2851824 - RNA, 21 nt, Human
uacuacugaaacagauuucau

SEQ ID NO: 2851825 - RNA, 20 nt, Human
uacuaucaugucaaacguga

SEQ ID NO: 2851826 - RNA, 13 nt, Human
uacuauauuugcu

SEQ ID NO: 2851827 - RNA, 14 nt, Human
uacuauauuugcua

SEQ ID NO: 2851828 - RNA, 15 nt, Human
uacuauauuugcuag

SEQ ID NO: 2851829 - RNA, 21 nt, Human
uacuaucauacuacugaaaca

SEQ ID NO: 2851830 - RNA, 16 nt, Human
uacuauaguaccagua

SEQ ID NO: 2851831 - RNA, 13 nt, Human
uacuauaguacca

SEQ ID NO: 2851832 - RNA, 12 nt, Human
uacuauaguacc

SEQ ID NO: 2851833 - RNA, 21 nt, Human
aauuccacuggacuugagcuu

SEQ ID NO: 2851834 - RNA, 14 nt, Human
aauuccacugucaa

SEQ ID NO: 2851835 - RNA, 22 nt, Human
aauuccacugucaagaaagagc

SEQ ID NO: 2851836 - RNA, 14 nt, Human
aauuccacuggacu

SEQ ID NO: 2851837 - RNA, 13 nt, Human
aauuccacuggac

SEQ ID NO: 2851838 - RNA, 12 nt, Human
aauuccaaaguc

SEQ ID NO: 2851839 - RNA, 13 nt, Human
aauuccaaagucu

SEQ ID NO: 2851840 - RNA, 18 nt, Human
aauuccaaagucucuaau

SEQ ID NO: 2851841 - RNA, 12 nt, Human
aauuccccagau

SEQ ID NO: 2851842 - RNA, 21 nt, Human
aauuccauuugaggauuuaga

SEQ ID NO: 2851843 - RNA, 19 nt, Human
aauuccauauauccuuuuc

SEQ ID NO: 2851844 - RNA, 22 nt, Human
aauuccauauauccuuuucuuc

SEQ ID NO: 2851845 - RNA, 15 nt, Human
aauucauuucacauu

SEQ ID NO: 2851846 - RNA, 21 nt, Human
aauucacccccuuuccuggac

SEQ ID NO: 2851847 - RNA, 20 nt, Human
aauucacucaagcacugaua

SEQ ID NO: 2851848 - RNA, 13 nt, Human
aauucacaaacuu

SEQ ID NO: 2851849 - RNA, 14 nt, Human
aauucacaaacuuu

SEQ ID NO: 2851850 - RNA, 19 nt, Human
aauucacaaacuuuuauac

SEQ ID NO: 2851851 - RNA, 12 nt, Human
aauuauuauuug

SEQ ID NO: 2851852 - RNA, 18 nt, Human
aauuauuauuuguguuuu

SEQ ID NO: 2851853 - RNA, 15 nt, Human
aauuauuauuugugu

SEQ ID NO: 2851854 - RNA, 16 nt, Human
aauuauuauuuguguu

SEQ ID NO: 2851855 - RNA, 16 nt, Human
aauuaggguacauuua

SEQ ID NO: 2851856 - RNA, 17 nt, Human
aauuaggguacauuuau

SEQ ID NO: 2851857 - RNA, 19 nt, Human
aauuaggguacauuuauaa

SEQ ID NO: 2851858 - RNA, 20 nt, Human
aauuaggguacauuuauaau

SEQ ID NO: 2851859 - RNA, 21 nt, Human
aauuaggguacauuuauaauu

SEQ ID NO: 2851860 - RNA, 14 nt, Human
aauuagguuaacau

SEQ ID NO: 2851861 - RNA, 15 nt, Human
aauuagguuaacauu

SEQ ID NO: 2851862 - RNA, 16 nt, Human
aauuagguuaacauug

SEQ ID NO: 2851863 - RNA, 19 nt, Human
aauuacucagcagaauggu

SEQ ID NO: 2851864 - RNA, 17 nt, Human
aauuagguuuuuccuua

SEQ ID NO: 2851865 - RNA, 18 nt, Human
aauuagguuuuuccuuau

SEQ ID NO: 2851866 - RNA, 21 nt, Human
aauuagguuuuuccuuauuug

SEQ ID NO: 2851867 - RNA, 15 nt, Human
aauucaaaaaguguu

SEQ ID NO: 2851868 - RNA, 14 nt, Human
aauucaaaaagugu

SEQ ID NO: 2851869 - RNA, 20 nt, Human
aauucaaacuggggccucca

SEQ ID NO: 2851870 - RNA, 16 nt, Human
aauucaaaaaguguuu

SEQ ID NO: 2851871 - RNA, 16 nt, Human
aauucaaaaguuccaa

SEQ ID NO: 2851872 - RNA, 22 nt, Human
aauucaaaaguuccaagagucu

SEQ ID NO: 2851873 - RNA, 23 nt, Human
aauucaaaaguuccaagagucua

SEQ ID NO: 2851874 - RNA, 13 nt, Human
aauuauugauaua

SEQ ID NO: 2851875 - RNA, 14 nt, Human
aauuauugauauau

SEQ ID NO: 2851876 - RNA, 15 nt, Human
aauuauugauauaua

SEQ ID NO: 2851877 - RNA, 16 nt, Human
aauuauugauauauau

SEQ ID NO: 2851878 - RNA, 17 nt, Human
aauuauugauauauauu

SEQ ID NO: 2851879 - RNA, 18 nt, Human
aauuauugauauauauua

SEQ ID NO: 2851880 - RNA, 20 nt, Human
aauuauugauauauauuaua

SEQ ID NO: 2851881 - RNA, 23 nt, Human
aauuaggcaaggcuaugugauua

SEQ ID NO: 2851882 - RNA, 19 nt, Human
aauuaggaggcucaacaau

SEQ ID NO: 2851883 - RNA, 21 nt, Human
aauuaggaggcucaacaauaa

SEQ ID NO: 2851884 - RNA, 20 nt, Human
aauuaggcaaggcuauguga

SEQ ID NO: 2851885 - RNA, 17 nt, Human
aauuaggaagugauuau

SEQ ID NO: 2851886 - RNA, 17 nt, Human
aauuagcuuggggccag

SEQ ID NO: 2851887 - RNA, 22 nt, Human
aauuagcuuuuucauccccuua

SEQ ID NO: 2851888 - RNA, 13 nt, Human
aauuaggaaaaaa

SEQ ID NO: 2851889 - RNA, 17 nt, Human
aauuaggaaaaaaacua

SEQ ID NO: 2851890 - RNA, 12 nt, Human
aauuacuuaaaa

SEQ ID NO: 2851891 - RNA, 15 nt, Human
aauuacuuaaaaaaa

SEQ ID NO: 2851892 - RNA, 14 nt, Human
aauuagccgggcgu

SEQ ID NO: 2851893 - RNA, 12 nt, Human
aauuagcaauug

SEQ ID NO: 2851894 - RNA, 14 nt, Human
aauuagaugcaugu

SEQ ID NO: 2851895 - RNA, 17 nt, Human
aauuagaugcauguuga

SEQ ID NO: 2851896 - RNA, 21 nt, Human
aauuagaugcauguugaccau

SEQ ID NO: 2851897 - RNA, 22 nt, Human
aauuagaugcauguugaccaug

SEQ ID NO: 2851898 - RNA, 15 nt, Human
uaccuguauucccag

SEQ ID NO: 2851899 - RNA, 13 nt, Human
aauuaauuugauu

SEQ ID NO: 2851900 - RNA, 14 nt, Human
aauuaauuugauua

SEQ ID NO: 2851901 - RNA, 15 nt, Human
aauuaauuugauuaa

SEQ ID NO: 2851902 - RNA, 16 nt, Human
aauuaauuugauuaac

SEQ ID NO: 2851903 - RNA, 21 nt, Human
aauuaauuugauuaacaaaua

SEQ ID NO: 2851904 - RNA, 22 nt, Human
aauuaauuugauuaacaaauau

SEQ ID NO: 2851905 - RNA, 12 nt, Human
aauuaauuuuac

SEQ ID NO: 2851906 - RNA, 13 nt, Human
aauuaauuuuacu

SEQ ID NO: 2851907 - RNA, 13 nt, Human
aauuacuaauuuu

SEQ ID NO: 2851908 - RNA, 15 nt, Human
aauuacuaauuuuac

SEQ ID NO: 2851909 - RNA, 15 nt, Human
aauuacgauaaggaa

SEQ ID NO: 2851910 - RNA, 17 nt, Human
aauuacgauaaggaaga

SEQ ID NO: 2851911 - RNA, 18 nt, Human
aauuacgauaaggaagaa

SEQ ID NO: 2851912 - RNA, 20 nt, Human
aauuacgauaaggaagaaac

SEQ ID NO: 2851913 - RNA, 14 nt, Human
aauuacacccaaag

SEQ ID NO: 2851914 - RNA, 14 nt, Human
uaccugucacauug

SEQ ID NO: 2851915 - RNA, 17 nt, Human
uaccugucacauugcau

SEQ ID NO: 2851916 - RNA, 18 nt, Human
uaccugucacauugcauu

SEQ ID NO: 2851917 - RNA, 19 nt, Human
uaccugucacauugcauuc

SEQ ID NO: 2851918 - RNA, 21 nt, Human
uaccugucacauugcauucua

SEQ ID NO: 2851919 - RNA, 14 nt, Human
uaccuguacacuga

SEQ ID NO: 2851920 - RNA, 19 nt, Human
uaccuguacacugacuuga

SEQ ID NO: 2851921 - RNA, 23 nt, Human
uaccugcucuccaagucucagug

SEQ ID NO: 2851922 - RNA, 14 nt, Human
uaccugcucuccaa

SEQ ID NO: 2851923 - RNA, 13 nt, Human
uaccugcccugga

SEQ ID NO: 2851924 - RNA, 15 nt, Human
uaccugcccuggaac

SEQ ID NO: 2851925 - RNA, 16 nt, Human
uaccugcccuggaaca

SEQ ID NO: 2851926 - RNA, 19 nt, Human
uacauuggcugguaacagu

SEQ ID NO: 2851927 - RNA, 15 nt, Human
uaccacccaaugcug

SEQ ID NO: 2851928 - RNA, 15 nt, Human
uaccacuaacuccug

SEQ ID NO: 2851929 - RNA, 19 nt, Human
uaccacuaacuccugagaa

SEQ ID NO: 2851930 - RNA, 16 nt, Human
uaccacucacaugaca

SEQ ID NO: 2851931 - RNA, 14 nt, Human
uaccacucaggcca

SEQ ID NO: 2851932 - RNA, 13 nt, Human
uaccacuccugcc

SEQ ID NO: 2851933 - RNA, 22 nt, Human
aaugcuguauuagucacagaga

SEQ ID NO: 2851934 - RNA, 13 nt, Human
aaugcuguguuaa

SEQ ID NO: 2851935 - RNA, 23 nt, Human
aaugcuguacaucuauuuuggau

SEQ ID NO: 2851936 - RNA, 20 nt, Human
aaugcuuaucaucuaaagau

SEQ ID NO: 2851937 - RNA, 18 nt, Human
aaugcuucacuguacgua

SEQ ID NO: 2851938 - RNA, 11 nt, Human
aaugcuucaga

SEQ ID NO: 2851939 - RNA, 16 nt, Human
aaugcuucagauauua

SEQ ID NO: 2851940 - RNA, 18 nt, Human
aaugcuucagauauuauu

SEQ ID NO: 2851941 - RNA, 12 nt, Human
aaugcuuaagag

SEQ ID NO: 2851942 - RNA, 21 nt, Human
aaugcuuaagagggaaugaua

SEQ ID NO: 2851943 - RNA, 20 nt, Human
aaugccauuuauuuauugau

SEQ ID NO: 2851944 - RNA, 17 nt, Human
aaugcuguacaucuauu

SEQ ID NO: 2851945 - RNA, 15 nt, Human
aaugcuguacaucua

SEQ ID NO: 2851946 - RNA, 13 nt, Human
aaugcuguacauc

SEQ ID NO: 2851947 - RNA, 12 nt, Human
aaugcuguacau

SEQ ID NO: 2851948 - RNA, 15 nt, Human
aaugcuuaauuucua

SEQ ID NO: 2851949 - RNA, 16 nt, Human
aaugcuuaauuucuaa

SEQ ID NO: 2851950 - RNA, 17 nt, Human
aaugcuuaauuucuaaa

SEQ ID NO: 2851951 - RNA, 20 nt, Human
aaugcuuaauuucuaaagau

SEQ ID NO: 2851952 - RNA, 13 nt, Human
aaugcuucauuca

SEQ ID NO: 2851953 - RNA, 17 nt, Human
aaugcuucauucaauau

SEQ ID NO: 2851954 - RNA, 20 nt, Human
aaugcuucauucaauauuga

SEQ ID NO: 2851955 - RNA, 21 nt, Human
aaugcuucauucaauauugac

SEQ ID NO: 2851956 - RNA, 22 nt, Human
aaugcuucauucaauauugaca

SEQ ID NO: 2851957 - RNA, 19 nt, Human
aauggaaaguaacucauuu

SEQ ID NO: 2851958 - RNA, 22 nt, Human
aauggaaaucaucgaaaauuca

SEQ ID NO: 2851959 - RNA, 13 nt, Human
aaugccagugugc

SEQ ID NO: 2851960 - RNA, 13 nt, Human
aaugccauaauac

SEQ ID NO: 2851961 - RNA, 14 nt, Human
aaugccauaauaca

SEQ ID NO: 2851962 - RNA, 16 nt, Human
aaugccauaauacaaa

SEQ ID NO: 2851963 - RNA, 18 nt, Human
aaugccauaauacaaaag

SEQ ID NO: 2851964 - RNA, 23 nt, Human
aaugccauagucaaagagaguuu

SEQ ID NO: 2851965 - RNA, 17 nt, Human
aaugccauccucaaaca

SEQ ID NO: 2851966 - RNA, 21 nt, Human
aaugccauccucaaacacugc

SEQ ID NO: 2851967 - RNA, 22 nt, Human
aaugccauccucaaacacugca

SEQ ID NO: 2851968 - RNA, 19 nt, Human
aaugccauuuauuuauuga

SEQ ID NO: 2851969 - RNA, 16 nt, Human
aaugccauuaucccug

SEQ ID NO: 2851970 - RNA, 20 nt, Human
aaugcagcaaggcccugcug

SEQ ID NO: 2851971 - RNA, 23 nt, Human
aaugcagcaaggcccugcugccc

SEQ ID NO: 2851972 - RNA, 22 nt, Human
aaugcagggauugcugccacuu

SEQ ID NO: 2851973 - RNA, 23 nt, Human
aaugcagggauugcugccacuuu

SEQ ID NO: 2851974 - RNA, 12 nt, Human
aaugcagcccau

SEQ ID NO: 2851975 - RNA, 17 nt, Human
aaugcagcccauuucuc

SEQ ID NO: 2851976 - RNA, 18 nt, Human
aaugcagcccauuucucc

SEQ ID NO: 2851977 - RNA, 20 nt, Human
aaugcagcccauuucuccag

SEQ ID NO: 2851978 - RNA, 21 nt, Human
aaugcagcccauuucuccaga

SEQ ID NO: 2851979 - RNA, 14 nt, Human
aaugcagcgugaag

SEQ ID NO: 2851980 - RNA, 16 nt, Human
aaugcagcuugugugc

SEQ ID NO: 2851981 - RNA, 22 nt, Human
aaugcagcuugugugcaaaagc

SEQ ID NO: 2851982 - RNA, 22 nt, Human
uacaauguauuuauuuaaaaga

SEQ ID NO: 2851983 - RNA, 17 nt, Human
uacaaugucauauacug

SEQ ID NO: 2851984 - RNA, 12 nt, Human
aaugaaugucua

SEQ ID NO: 2851985 - RNA, 16 nt, Human
aaugacaacagaagcu

SEQ ID NO: 2851986 - RNA, 14 nt, Human
uacaauguauuuau

SEQ ID NO: 2851987 - RNA, 13 nt, Human
uacaauguagaug

SEQ ID NO: 2851988 - RNA, 17 nt, Human
uacaauguauuuauuua

SEQ ID NO: 2851989 - RNA, 18 nt, Human
uacaauguauuuauuuaa

SEQ ID NO: 2851990 - RNA, 19 nt, Human
uacaauguauuuauuuaaa

SEQ ID NO: 2851991 - RNA, 20 nt, Human
uacaauguauuuauuuaaaa

SEQ ID NO: 2851992 - RNA, 15 nt, Human
aauguaacuuuugua

SEQ ID NO: 2851993 - RNA, 15 nt, Human
aauguaacuuagaga

SEQ ID NO: 2851994 - RNA, 22 nt, Human
aauguaacuuuuguaagacaaa

SEQ ID NO: 2851995 - RNA, 16 nt, Human
aauguaacuuuuguaa

SEQ ID NO: 2851996 - RNA, 13 nt, Human
uacacguguccug

SEQ ID NO: 2851997 - RNA, 17 nt, Human
uacacguguccuguagu

SEQ ID NO: 2851998 - RNA, 22 nt, Human
uacagacagagaauaugucugc

SEQ ID NO: 2851999 - RNA, 13 nt, Human
uacagacauauuu

SEQ ID NO: 2852000 - RNA, 14 nt, Human
uacagacauauuua

SEQ ID NO: 2852001 - RNA, 15 nt, Human
uacagacauauuuaa

SEQ ID NO: 2852002 - RNA, 18 nt, Human
uacagacauauuuaacug

SEQ ID NO: 2852003 - RNA, 19 nt, Human
uacagacauauuuaacugg

SEQ ID NO: 2852004 - RNA, 19 nt, Human
uacagaguguggacucugg

SEQ ID NO: 2852005 - RNA, 14 nt, Human
uacagaccugcuuu

SEQ ID NO: 2852006 - RNA, 15 nt, Human
uacagaccugcuuuu

SEQ ID NO: 2852007 - RNA, 16 nt, Human
uacagaccugcuuuuu

SEQ ID NO: 2852008 - RNA, 18 nt, Human
uacagaccugcuuuuuga

SEQ ID NO: 2852009 - RNA, 20 nt, Human
uacagaccugcuuuuugaaa

SEQ ID NO: 2852010 - RNA, 21 nt, Human
uacagaccugcuuuuugaaau

SEQ ID NO: 2852011 - RNA, 22 nt, Human
uacagaccugcuuuuugaaaug

SEQ ID NO: 2852012 - RNA, 23 nt, Human
uacagaccugcuuuuugaaauga

SEQ ID NO: 2852013 - RNA, 12 nt, Human
uacagauaacau

SEQ ID NO: 2852014 - RNA, 13 nt, Human
uacagauaacauu

SEQ ID NO: 2852015 - RNA, 15 nt, Human
uacagauaacauuag

SEQ ID NO: 2852016 - RNA, 19 nt, Human
uacagauagagaguuguug

SEQ ID NO: 2852017 - RNA, 20 nt, Human
uacagauccccaagccuggc

SEQ ID NO: 2852018 - RNA, 12 nt, Human
uacagaugaaaa

SEQ ID NO: 2852019 - RNA, 13 nt, Human
uacagaugaaaau

SEQ ID NO: 2852020 - RNA, 14 nt, Human
uacagaugaaaauu

SEQ ID NO: 2852021 - RNA, 21 nt, Human
aauggauuggauuauuuaaua

SEQ ID NO: 2852022 - RNA, 23 nt, Human
aauggauuggauuauuuaauaac

SEQ ID NO: 2852023 - RNA, 12 nt, Human
aauggauuguua

SEQ ID NO: 2852024 - RNA, 14 nt, Human
aauggauuguuaau

SEQ ID NO: 2852025 - RNA, 18 nt, Human
aauggauuguuaauuuca

SEQ ID NO: 2852026 - RNA, 19 nt, Human
aauggauuguuaauuucag

SEQ ID NO: 2852027 - RNA, 22 nt, Human
aauggauuggauuauuuaauaa

SEQ ID NO: 2852028 - RNA, 21 nt, Human
aauggauuugaugcuguuuga

SEQ ID NO: 2852029 - RNA, 14 nt, Human
uacaauggaaacaa

SEQ ID NO: 2852030 - RNA, 17 nt, Human
aauggacuggaagggga

SEQ ID NO: 2852031 - RNA, 23 nt, Human
aauggacuggaaggggaagggac

SEQ ID NO: 2852032 - RNA, 17 nt, Human
aauggacugguuugaga

SEQ ID NO: 2852033 - RNA, 19 nt, Human
aauggacugguuugagauu

SEQ ID NO: 2852034 - RNA, 23 nt, Human
aauggcacaaucucggcucacug

SEQ ID NO: 2852035 - RNA, 16 nt, Human
aauggcagccuuggca

SEQ ID NO: 2852036 - RNA, 15 nt, Human
aauggcaugagauag

SEQ ID NO: 2852037 - RNA, 12 nt, Human
aauggcagccuu

SEQ ID NO: 2852038 - RNA, 16 nt, Human
aauggcaaguuuugau

SEQ ID NO: 2852039 - RNA, 12 nt, Human
aauggcacugau

SEQ ID NO: 2852040 - RNA, 19 nt, Human
aauggcacuguugcaaacu

SEQ ID NO: 2852041 - RNA, 12 nt, Human
aauggcagcaga

SEQ ID NO: 2852042 - RNA, 16 nt, Human
aauggcagcagaaaac

SEQ ID NO: 2852043 - RNA, 18 nt, Human
aauggcagcagaaaacuu

SEQ ID NO: 2852044 - RNA, 17 nt, Human
aauggccauuugcuuuu

SEQ ID NO: 2852045 - RNA, 20 nt, Human
aauggccugccuugaagcca

SEQ ID NO: 2852046 - RNA, 14 nt, Human
aauggccugccuug

SEQ ID NO: 2852047 - RNA, 19 nt, Human
aauggcgugaacccgggag

SEQ ID NO: 2852048 - RNA, 20 nt, Human
aauggcgucuggaaguccaa

SEQ ID NO: 2852049 - RNA, 23 nt, Human
aauggcguccguggguugcuaac

SEQ ID NO: 2852050 - RNA, 22 nt, Human
aauggccugccuugaagccacu

SEQ ID NO: 2852051 - RNA, 14 nt, Human
aauggccuuccuuc

SEQ ID NO: 2852052 - RNA, 17 nt, Human
uacauauguaaaauaaa

SEQ ID NO: 2852053 - RNA, 18 nt, Human
uacaucaguuauucauuc

SEQ ID NO: 2852054 - RNA, 20 nt, Human
uacaucaguuauucauucug

SEQ ID NO: 2852055 - RNA, 23 nt, Human
uacaucaguuauucauucuguga

SEQ ID NO: 2852056 - RNA, 22 nt, Human
uacaucaugcuggaaccugcaa

SEQ ID NO: 2852057 - RNA, 12 nt, Human
uacauauguaaa

SEQ ID NO: 2852058 - RNA, 20 nt, Human
uacauauguaaaauaaaauu

SEQ ID NO: 2852059 - RNA, 13 nt, Human
uacauauguaaac

SEQ ID NO: 2852060 - RNA, 14 nt, Human
uacauauguaaaca

SEQ ID NO: 2852061 - RNA, 17 nt, Human
uacauauguaaacauaa

SEQ ID NO: 2852062 - RNA, 15 nt, Human
uacauauguagacua

SEQ ID NO: 2852063 - RNA, 12 nt, Human
uacaucacugcu

SEQ ID NO: 2852064 - RNA, 13 nt, Human
uacaucacugcuu

SEQ ID NO: 2852065 - RNA, 15 nt, Human
uacaucacugcuuga

SEQ ID NO: 2852066 - RNA, 19 nt, Human
uacaucacugcuugaugaa

SEQ ID NO: 2852067 - RNA, 22 nt, Human
uacaucacugcuugaugaagca

SEQ ID NO: 2852068 - RNA, 23 nt, Human
uacaucacugcuugaugaagcaa

SEQ ID NO: 2852069 - RNA, 16 nt, Human
uacauauguaaaauaa

SEQ ID NO: 2852070 - RNA, 15 nt, Human
uacauauguaaaaua

SEQ ID NO: 2852071 - RNA, 15 nt, Human
uacauaucgcugacu

SEQ ID NO: 2852072 - RNA, 17 nt, Human
uacauaucgcugacuuc

SEQ ID NO: 2852073 - RNA, 20 nt, Human
uacauaucgcugacuucaug

SEQ ID NO: 2852074 - RNA, 22 nt, Human
uacauaucgcugacuucaugga

SEQ ID NO: 2852075 - RNA, 23 nt, Human
uacauaucgcugacuucauggaa

SEQ ID NO: 2852076 - RNA, 14 nt, Human
uacauauauuuuua

SEQ ID NO: 2852077 - RNA, 15 nt, Human
uacauauauuuuuaa

SEQ ID NO: 2852078 - RNA, 22 nt, Human
uacauauauuuuuaaaaaauga

SEQ ID NO: 2852079 - RNA, 22 nt, Human
uacauaauuuuuuauucaaguu

SEQ ID NO: 2852080 - RNA, 19 nt, Human
uacauaauuuuuuauucaa

SEQ ID NO: 2852081 - RNA, 13 nt, Human
uacauaaugcuua

SEQ ID NO: 2852082 - RNA, 20 nt, Human
uacauaaugcuuaauuucua

SEQ ID NO: 2852083 - RNA, 21 nt, Human
uacauaaugcuuaauuucuaa

SEQ ID NO: 2852084 - RNA, 22 nt, Human
uacauaaugcuuaauuucuaaa

SEQ ID NO: 2852085 - RNA, 19 nt, Human
uacauaaugggccacugaa

SEQ ID NO: 2852086 - RNA, 23 nt, Human
uacauaaugggccacugaaaucu

SEQ ID NO: 2852087 - RNA, 22 nt, Human
uacaggugugugccaccacacc

SEQ ID NO: 2852088 - RNA, 16 nt, Human
uacaggugugagucac

SEQ ID NO: 2852089 - RNA, 18 nt, Human
uacagaugaauguauuua

SEQ ID NO: 2852090 - RNA, 22 nt, Human
uacagaugaauguauuuauuug

SEQ ID NO: 2852091 - RNA, 14 nt, Human
uacagaugccuuuu

SEQ ID NO: 2852092 - RNA, 13 nt, Human
uacagauuuaaua

SEQ ID NO: 2852093 - RNA, 13 nt, Human
aauguauauacac

SEQ ID NO: 2852094 - RNA, 14 nt, Human
aauguauauacaca

SEQ ID NO: 2852095 - RNA, 15 nt, Human
aauguauauacacau

SEQ ID NO: 2852096 - RNA, 16 nt, Human
aauguauauacacaua

SEQ ID NO: 2852097 - RNA, 17 nt, Human
aauguauauacacauau

SEQ ID NO: 2852098 - RNA, 18 nt, Human
aauguauauacacauaua

SEQ ID NO: 2852099 - RNA, 19 nt, Human
aauguauauacacauauac

SEQ ID NO: 2852100 - RNA, 21 nt, Human
aauguauauacacauauaccu

SEQ ID NO: 2852101 - RNA, 12 nt, Human
aauguauauauu

SEQ ID NO: 2852102 - RNA, 13 nt, Human
aauguauauauuu

SEQ ID NO: 2852103 - RNA, 20 nt, Human
aauguauauauuuagugcug

SEQ ID NO: 2852104 - RNA, 19 nt, Human
aauguauacuauaguacca

SEQ ID NO: 2852105 - RNA, 15 nt, Human
aaugugauguucuaa

SEQ ID NO: 2852106 - RNA, 14 nt, Human
aaugugauguucua

SEQ ID NO: 2852107 - RNA, 16 nt, Human
aaugugauguucuaag

SEQ ID NO: 2852108 - RNA, 17 nt, Human
aaugugauguucuaagg

SEQ ID NO: 2852109 - RNA, 22 nt, Human
aaugugauucuaaugucuucau

SEQ ID NO: 2852110 - RNA, 20 nt, Human
aaugugcagaugcaauuguu

SEQ ID NO: 2852111 - RNA, 14 nt, Human
aaugugauucuaau

SEQ ID NO: 2852112 - RNA, 19 nt, Human
aaugugauucuaaugucuu

SEQ ID NO: 2852113 - RNA, 19 nt, Human
aaugugauguucuaaggcu

SEQ ID NO: 2852114 - RNA, 17 nt, Human
aaugugauuacugcucu

SEQ ID NO: 2852115 - RNA, 11 nt, Human
aaugugugugu

SEQ ID NO: 2852116 - RNA, 17 nt, Human
uacauuguaaauaguau

SEQ ID NO: 2852117 - RNA, 22 nt, Human
uacauugaguagacacauuuaa

SEQ ID NO: 2852118 - RNA, 16 nt, Human
uacauguguagccugu

SEQ ID NO: 2852119 - RNA, 14 nt, Human
uacaugugguuuau

SEQ ID NO: 2852120 - RNA, 14 nt, Human
uacauguguagccu

SEQ ID NO: 2852121 - RNA, 19 nt, Human
uacauguguagccugugca

SEQ ID NO: 2852122 - RNA, 12 nt, Human
uacaugugugua

SEQ ID NO: 2852123 - RNA, 13 nt, Human
uacauguguguau

SEQ ID NO: 2852124 - RNA, 14 nt, Human
uacauguguguaua

SEQ ID NO: 2852125 - RNA, 16 nt, Human
uacauguguguauaua

SEQ ID NO: 2852126 - RNA, 19 nt, Human
uacauguguguauauaugu

SEQ ID NO: 2852127 - RNA, 21 nt, Human
uacauguguguauauaugugu

SEQ ID NO: 2852128 - RNA, 18 nt, Human
uacauguguagccugugc

SEQ ID NO: 2852129 - RNA, 16 nt, Human
aauuaauugcuauugu

SEQ ID NO: 2852130 - RNA, 16 nt, Human
aauuaauggaaucuuc

SEQ ID NO: 2852131 - RNA, 12 nt, Human
aauuaagacaag

SEQ ID NO: 2852132 - RNA, 15 nt, Human
aauuaagacugaaaa

SEQ ID NO: 2852133 - RNA, 14 nt, Human
aauuaauagcuuuu

SEQ ID NO: 2852134 - RNA, 14 nt, Human
aauuaauaguuugu

SEQ ID NO: 2852135 - RNA, 20 nt, Human
aauuaauaguuugucuauuu

SEQ ID NO: 2852136 - RNA, 22 nt, Human
aauuaauaguuugucuauuuua

SEQ ID NO: 2852137 - RNA, 22 nt, Human
aauuaaucugggccagaauuuc

SEQ ID NO: 2852138 - RNA, 13 nt, Human
aauuaauagcuuu

SEQ ID NO: 2852139 - RNA, 13 nt, Human
aauuaagaaggca

SEQ ID NO: 2852140 - RNA, 16 nt, Human
aauuaagaaggcaaaa

SEQ ID NO: 2852141 - RNA, 14 nt, Human
aauuaagaaggcaa

SEQ ID NO: 2852142 - RNA, 23 nt, Human
aauuaagaaggcaaaaauguaaa

SEQ ID NO: 2852143 - RNA, 21 nt, Human
aauuaagaauauguuuccuug

SEQ ID NO: 2852144 - RNA, 19 nt, Human
aauuaagaaggcaaaaaug

SEQ ID NO: 2852145 - RNA, 17 nt, Human
aauguguuuuguacaug

SEQ ID NO: 2852146 - RNA, 12 nt, Human
aauguucuguga

SEQ ID NO: 2852147 - RNA, 21 nt, Human
aauguucugugauacagaacu

SEQ ID NO: 2852148 - RNA, 20 nt, Human
aauguucuuaugcaaaaugg

SEQ ID NO: 2852149 - RNA, 21 nt, Human
aauguucuuaugcaaaaugga

SEQ ID NO: 2852150 - RNA, 22 nt, Human
aauguucuuaugcaaaauggaa

SEQ ID NO: 2852151 - RNA, 12 nt, Human
aauguucuuuau

SEQ ID NO: 2852152 - RNA, 16 nt, Human
aauguucuuuauauac

SEQ ID NO: 2852153 - RNA, 23 nt, Human
aauguucuuuauauacaauaaug

SEQ ID NO: 2852154 - RNA, 13 nt, Human
aauguuaagcaga

SEQ ID NO: 2852155 - RNA, 22 nt, Human
aauguuaaauuuguaaguuuca

SEQ ID NO: 2852156 - RNA, 12 nt, Human
aauguuaagaau

SEQ ID NO: 2852157 - RNA, 14 nt, Human
aauguuaagaauug

SEQ ID NO: 2852158 - RNA, 15 nt, Human
aauguuaagaauuga

SEQ ID NO: 2852159 - RNA, 18 nt, Human
aauguuaaggaaacucuu

SEQ ID NO: 2852160 - RNA, 22 nt, Human
aauguuaaggaaacucuuaucu

SEQ ID NO: 2852161 - RNA, 13 nt, Human
aauguuaauuuuu

SEQ ID NO: 2852162 - RNA, 20 nt, Human
aauguuaauuuuuugguaca

SEQ ID NO: 2852163 - RNA, 21 nt, Human
aauguuaauuuuuugguacaa

SEQ ID NO: 2852164 - RNA, 12 nt, Human
aauguuaaauuu

SEQ ID NO: 2852165 - RNA, 13 nt, Human
aauguuaaauuug

SEQ ID NO: 2852166 - RNA, 16 nt, Human
aauguuaaauuuguaa

SEQ ID NO: 2852167 - RNA, 17 nt, Human
aauguuaaauuuguaag

SEQ ID NO: 2852168 - RNA, 18 nt, Human
aauguuaaauuuguaagu

SEQ ID NO: 2852169 - RNA, 21 nt, Human
aauguuaaauuuguaaguuuc

SEQ ID NO: 2852170 - RNA, 22 nt, Human
aauguguucucggaguguguau

SEQ ID NO: 2852171 - RNA, 15 nt, Human
aauguguugaaacug

SEQ ID NO: 2852172 - RNA, 16 nt, Human
aauguguugaaacugc

SEQ ID NO: 2852173 - RNA, 14 nt, Human
aauguguuggacaa

SEQ ID NO: 2852174 - RNA, 19 nt, Human
aauguguuggacaaaugug

SEQ ID NO: 2852175 - RNA, 21 nt, Human
aauguguuggacaaaugugaa

SEQ ID NO: 2852176 - RNA, 23 nt, Human
aauguguuggacaaaugugaaga

SEQ ID NO: 2852177 - RNA, 19 nt, Human
aauguguucucggagugug

SEQ ID NO: 2852178 - RNA, 12 nt, Human
aauguguucucg

SEQ ID NO: 2852179 - RNA, 13 nt, Human
aauguguuucaaa

SEQ ID NO: 2852180 - RNA, 18 nt, Human
aauguguuucaaacugua

SEQ ID NO: 2852181 - RNA, 22 nt, Human
aauguguuuuagaguaagaaau

SEQ ID NO: 2852182 - RNA, 16 nt, Human
aauguguuuuucucca

SEQ ID NO: 2852183 - RNA, 22 nt, Human
aauguguuuuucuccagugcug

SEQ ID NO: 2852184 - RNA, 14 nt, Human
aaucuuacagcugg

SEQ ID NO: 2852185 - RNA, 18 nt, Human
aaucuuacagcugggugg

SEQ ID NO: 2852186 - RNA, 23 nt, Human
aaucuuacagcuggguggcacug

SEQ ID NO: 2852187 - RNA, 14 nt, Human
aaucuuacucuaga

SEQ ID NO: 2852188 - RNA, 11 nt, Human
aaucuguugcc

SEQ ID NO: 2852189 - RNA, 17 nt, Human
aaucugugugugcccug

SEQ ID NO: 2852190 - RNA, 12 nt, Human
aaucuguuaucc

SEQ ID NO: 2852191 - RNA, 14 nt, Human
aaucuguuauccca

SEQ ID NO: 2852192 - RNA, 20 nt, Human
aaucuguuauguacuagugu

SEQ ID NO: 2852193 - RNA, 23 nt, Human
aaucuguuauguacuaguguucu

SEQ ID NO: 2852194 - RNA, 19 nt, Human
aaucuguucugggcucuuu

SEQ ID NO: 2852195 - RNA, 17 nt, Human
aaucuguguauauuauu

SEQ ID NO: 2852196 - RNA, 18 nt, Human
aaucuguguauauuauuu

SEQ ID NO: 2852197 - RNA, 20 nt, Human
aaucuguguauauuauuugg

SEQ ID NO: 2852198 - RNA, 21 nt, Human
aaucuguguauauuauuuggc

SEQ ID NO: 2852199 - RNA, 23 nt, Human
aaucuguuuuuguuuauuucauu

SEQ ID NO: 2852200 - RNA, 15 nt, Human
aaucuuaaaaaguug

SEQ ID NO: 2852201 - RNA, 17 nt, Human
aaucuuaaaaaguuguu

SEQ ID NO: 2852202 - RNA, 21 nt, Human
aaucuuaaaaaguuguucaac

SEQ ID NO: 2852203 - RNA, 20 nt, Human
aaucuaauauuaaaaauaug

SEQ ID NO: 2852204 - RNA, 14 nt, Human
aaucuaauuuuuuc

SEQ ID NO: 2852205 - RNA, 16 nt, Human
aaucuaauauuaaaaa

SEQ ID NO: 2852206 - RNA, 17 nt, Human
aaucuaauauuaaaaau

SEQ ID NO: 2852207 - RNA, 19 nt, Human
aaucuaauauuaaaaauau

SEQ ID NO: 2852208 - RNA, 15 nt, Human
aaucuggagaccagg

SEQ ID NO: 2852209 - RNA, 14 nt, Human
aaucuggagaccag

SEQ ID NO: 2852210 - RNA, 16 nt, Human
aaucugggaagggaag

SEQ ID NO: 2852211 - RNA, 17 nt, Human
aaucugggccagaauuu

SEQ ID NO: 2852212 - RNA, 16 nt, Human
aaucugggccagaauu

SEQ ID NO: 2852213 - RNA, 18 nt, Human
aaucuaauauccccaaau

SEQ ID NO: 2852214 - RNA, 17 nt, Human
aaucgagacugcaaugu

SEQ ID NO: 2852215 - RNA, 19 nt, Human
aaucgagugagacaaaauu

SEQ ID NO: 2852216 - RNA, 20 nt, Human
aaucgagugagacaaaauuu

SEQ ID NO: 2852217 - RNA, 15 nt, Human
aaucgaccugccucg

SEQ ID NO: 2852218 - RNA, 23 nt, Human
aauccuuuguuuucugacuaauu

SEQ ID NO: 2852219 - RNA, 18 nt, Human
aauccuuuuccuguucau

SEQ ID NO: 2852220 - RNA, 12 nt, Human
aauccuuuugua

SEQ ID NO: 2852221 - RNA, 13 nt, Human
aauccuuuuguag

SEQ ID NO: 2852222 - RNA, 22 nt, Human
aauccuuuguuuucugacuaau

SEQ ID NO: 2852223 - RNA, 18 nt, Human
aauccuugcuuaugacau

SEQ ID NO: 2852224 - RNA, 16 nt, Human
aauccuggcagcccag

SEQ ID NO: 2852225 - RNA, 18 nt, Human
aauccuuuauuauuauuu

SEQ ID NO: 2852226 - RNA, 14 nt, Human
aauccuuugccugc

SEQ ID NO: 2852227 - RNA, 12 nt, Human
aauccugucuuu

SEQ ID NO: 2852228 - RNA, 16 nt, Human
aaucaugaaauuacuu

SEQ ID NO: 2852229 - RNA, 23 nt, Human
aaucccuuuauuacccccuccuu

SEQ ID NO: 2852230 - RNA, 19 nt, Human
aaucccuuuauuacccccu

SEQ ID NO: 2852231 - RNA, 17 nt, Human
aaucccuguuuaauauu

SEQ ID NO: 2852232 - RNA, 23 nt, Human
aaucccuguuuaauauuuaaaca

SEQ ID NO: 2852233 - RNA, 21 nt, Human
aauccgaccacuaauugccaa

SEQ ID NO: 2852234 - RNA, 13 nt, Human
aauccgcucucuu

SEQ ID NO: 2852235 - RNA, 14 nt, Human
aauccgcucucuuc

SEQ ID NO: 2852236 - RNA, 15 nt, Human
aauccgcucucuucc

SEQ ID NO: 2852237 - RNA, 17 nt, Human
aauccgcucucuuccug

SEQ ID NO: 2852238 - RNA, 18 nt, Human
aauccgcucucuuccugc

SEQ ID NO: 2852239 - RNA, 19 nt, Human
aauccgcucucuuccugcc

SEQ ID NO: 2852240 - RNA, 20 nt, Human
aauccgcucucuuccugccc

SEQ ID NO: 2852241 - RNA, 23 nt, Human
aauccgcucucuuccugccccuc

SEQ ID NO: 2852242 - RNA, 18 nt, Human
aauccguaguuauuuugc

SEQ ID NO: 2852243 - RNA, 20 nt, Human
uaaguaacuucacauuaaaa

SEQ ID NO: 2852244 - RNA, 13 nt, Human
uaaguaaaugcua

SEQ ID NO: 2852245 - RNA, 17 nt, Human
uaaggaaaaaaagacaa

SEQ ID NO: 2852246 - RNA, 21 nt, Human
uaagcuuuggacccaaggaaa

SEQ ID NO: 2852247 - RNA, 14 nt, Human
uaaguaaucaauaa

SEQ ID NO: 2852248 - RNA, 18 nt, Human
uaaguaaucaauaaagaa

SEQ ID NO: 2852249 - RNA, 20 nt, Human
uaaguaaucaauaaagaaaa

SEQ ID NO: 2852250 - RNA, 18 nt, Human
uaaguaccacucaggcca

SEQ ID NO: 2852251 - RNA, 19 nt, Human
uaaguacuacacauuuuua

SEQ ID NO: 2852252 - RNA, 17 nt, Human
uaaguauuaaaacauug

SEQ ID NO: 2852253 - RNA, 22 nt, Human
uaaguucauauuccauauuuau

SEQ ID NO: 2852254 - RNA, 18 nt, Human
uaaguauuaaaacauugg

SEQ ID NO: 2852255 - RNA, 19 nt, Human
uaaguauuaaaacauugga

SEQ ID NO: 2852256 - RNA, 19 nt, Human
aaucaugaaucuuuguuuc

SEQ ID NO: 2852257 - RNA, 17 nt, Human
aaucaugaaauaugcau

SEQ ID NO: 2852258 - RNA, 18 nt, Human
aaucaucugugugaaaau

SEQ ID NO: 2852259 - RNA, 16 nt, Human
aaucaugaaauaugca

SEQ ID NO: 2852260 - RNA, 13 nt, Human
aaucauaugugau

SEQ ID NO: 2852261 - RNA, 14 nt, Human
aaucauaugugauc

SEQ ID NO: 2852262 - RNA, 17 nt, Human
aaucauaugugaucugu

SEQ ID NO: 2852263 - RNA, 23 nt, Human
aaucauaugugaucugucuugua

SEQ ID NO: 2852264 - RNA, 14 nt, Human
aaucauauugauga

SEQ ID NO: 2852265 - RNA, 16 nt, Human
aaucauauugaugaaa

SEQ ID NO: 2852266 - RNA, 18 nt, Human
aaucauauugaugaaaag

SEQ ID NO: 2852267 - RNA, 19 nt, Human
aaucauauugaugaaaaga

SEQ ID NO: 2852268 - RNA, 15 nt, Human
uaauaaacuguguuu

SEQ ID NO: 2852269 - RNA, 14 nt, Human
uaauaaacuguguu

SEQ ID NO: 2852270 - RNA, 22 nt, Human
uaauaaacauccuucaagaacu

SEQ ID NO: 2852271 - RNA, 22 nt, Human
uaauaaaauguguugaaacugc

SEQ ID NO: 2852272 - RNA, 15 nt, Human
uaauaaacauaauga

SEQ ID NO: 2852273 - RNA, 19 nt, Human
uaauaaacauaaugaaaau

SEQ ID NO: 2852274 - RNA, 17 nt, Human
uaaguugaauggccugc

SEQ ID NO: 2852275 - RNA, 13 nt, Human
uaaguuguuugca

SEQ ID NO: 2852276 - RNA, 15 nt, Human
uaaguuguuugcaug

SEQ ID NO: 2852277 - RNA, 12 nt, Human
uaaucuuugggu

SEQ ID NO: 2852278 - RNA, 22 nt, Human
uaaucuuuggguaacuucaaaa

SEQ ID NO: 2852279 - RNA, 20 nt, Human
uaaugaaucguaaugaaguu

SEQ ID NO: 2852280 - RNA, 18 nt, Human
uaaugaaaaugaauaucu

SEQ ID NO: 2852281 - RNA, 21 nt, Human
uaaucccagcauuuugggaag

SEQ ID NO: 2852282 - RNA, 16 nt, Human
uaaucccagcacuuug

SEQ ID NO: 2852283 - RNA, 13 nt, Human
uaaucagaaauuu

SEQ ID NO: 2852284 - RNA, 15 nt, Human
uaaucagaaauuuuu

SEQ ID NO: 2852285 - RNA, 18 nt, Human
uaaucagaaauuuuuauc

SEQ ID NO: 2852286 - RNA, 20 nt, Human
uaaucagaaauuuuuaucag

SEQ ID NO: 2852287 - RNA, 11 nt, Human
uaaucagccuc

SEQ ID NO: 2852288 - RNA, 18 nt, Human
uaauccaggcacagcuga

SEQ ID NO: 2852289 - RNA, 19 nt, Human
uaauccaggcacagcugag

SEQ ID NO: 2852290 - RNA, 19 nt, Human
uaaucacuuaacauuccua

SEQ ID NO: 2852291 - RNA, 21 nt, Human
uaaucaaaagggaaaagaaga

SEQ ID NO: 2852292 - RNA, 18 nt, Human
uaaucaaagccagggucu

SEQ ID NO: 2852293 - RNA, 13 nt, Human
uaauauuuugcac

SEQ ID NO: 2852294 - RNA, 15 nt, Human
uaauauuuuguauua

SEQ ID NO: 2852295 - RNA, 16 nt, Human
uaauauuuuguauuau

SEQ ID NO: 2852296 - RNA, 20 nt, Human
uaauauuuuguauuauugcu

SEQ ID NO: 2852297 - RNA, 14 nt, Human
aaucuuauaguucu

SEQ ID NO: 2852298 - RNA, 15 nt, Human
aaucuuauaguucua

SEQ ID NO: 2852299 - RNA, 18 nt, Human
aaucuuauaguucuaggc

SEQ ID NO: 2852300 - RNA, 19 nt, Human
aaucuuauaguucuaggca

SEQ ID NO: 2852301 - RNA, 21 nt, Human
uaauagagcaaaauugaugug

SEQ ID NO: 2852302 - RNA, 12 nt, Human
uaauagagcaaa

SEQ ID NO: 2852303 - RNA, 12 nt, Human
uaauagauucuc

SEQ ID NO: 2852304 - RNA, 16 nt, Human
uaauauuuauauauuu

SEQ ID NO: 2852305 - RNA, 21 nt, Human
uaauauuuaugucuauuuaag

SEQ ID NO: 2852306 - RNA, 23 nt, Human
uaauauuuaugucuauuuaagcc

SEQ ID NO: 2852307 - RNA, 14 nt, Human
uaauauuugcugac

SEQ ID NO: 2852308 - RNA, 13 nt, Human
uaauauuuaacau

SEQ ID NO: 2852309 - RNA, 21 nt, Human
uaauauuuaacauuauuuaua

SEQ ID NO: 2852310 - RNA, 22 nt, Human
uaauagcggguuacuuucacau

SEQ ID NO: 2852311 - RNA, 19 nt, Human
uaauagcggguuacuuuca

SEQ ID NO: 2852312 - RNA, 20 nt, Human
uaauagcaacuuuuguguaa

SEQ ID NO: 2852313 - RNA, 22 nt, Human
uaauagauuuuuucagacuugu

SEQ ID NO: 2852314 - RNA, 23 nt, Human
uaauagauuuuuucagacuuguc

SEQ ID NO: 2852315 - RNA, 21 nt, Human
uaauagcaacuuuuguguaau

SEQ ID NO: 2852316 - RNA, 17 nt, Human
aaugaaugcauaaaaug

SEQ ID NO: 2852317 - RNA, 16 nt, Human
aaugaaugaggucugg

SEQ ID NO: 2852318 - RNA, 19 nt, Human
aaugaaugaggucugggcu

SEQ ID NO: 2852319 - RNA, 17 nt, Human
aaugaauuaaauaaacc

SEQ ID NO: 2852320 - RNA, 16 nt, Human
aaugaauuccuagaau

SEQ ID NO: 2852321 - RNA, 17 nt, Human
aaugaauuccuagaauu

SEQ ID NO: 2852322 - RNA, 21 nt, Human
aaugaauuccuagaauuaaac

SEQ ID NO: 2852323 - RNA, 13 nt, Human
aaugacaacagaa

SEQ ID NO: 2852324 - RNA, 14 nt, Human
aaugacaacagaag

SEQ ID NO: 2852325 - RNA, 15 nt, Human
aaugacaacagaagc

SEQ ID NO: 2852326 - RNA, 19 nt, Human
aaugaaacacucaguuguu

SEQ ID NO: 2852327 - RNA, 19 nt, Human
aaugaaacaaauaaucaca

SEQ ID NO: 2852328 - RNA, 20 nt, Human
aaugaaacaaauaaucacau

SEQ ID NO: 2852329 - RNA, 18 nt, Human
uaaugucacaggcagguc

SEQ ID NO: 2852330 - RNA, 13 nt, Human
uaaugucuucauu

SEQ ID NO: 2852331 - RNA, 17 nt, Human
uaaugucuucauuucau

SEQ ID NO: 2852332 - RNA, 14 nt, Human
uaaugucuucauaa

SEQ ID NO: 2852333 - RNA, 15 nt, Human
uaaugucuucauaaa

SEQ ID NO: 2852334 - RNA, 20 nt, Human
uaauguagcguguuuacaug

SEQ ID NO: 2852335 - RNA, 22 nt, Human
uaauguagcguguuuacaugug

SEQ ID NO: 2852336 - RNA, 23 nt, Human
uaauguagcguguuuacaugugu

SEQ ID NO: 2852337 - RNA, 18 nt, Human
uaauguaauaacugugaa

SEQ ID NO: 2852338 - RNA, 15 nt, Human
uaaugaaugcauaaa

SEQ ID NO: 2852339 - RNA, 15 nt, Human
uaauguacaucuggc

SEQ ID NO: 2852340 - RNA, 18 nt, Human
uaaugugugguggccuca

SEQ ID NO: 2852341 - RNA, 19 nt, Human
uaaugugugguggccucag

SEQ ID NO: 2852342 - RNA, 12 nt, Human
uaauguguguau

SEQ ID NO: 2852343 - RNA, 13 nt, Human
uaauguguguaug

SEQ ID NO: 2852344 - RNA, 14 nt, Human
uaauguguguaugu

SEQ ID NO: 2852345 - RNA, 15 nt, Human
uaauguguguaugug

SEQ ID NO: 2852346 - RNA, 16 nt, Human
uaauguguguaugugu

SEQ ID NO: 2852347 - RNA, 17 nt, Human
uaauguguguaugugua

SEQ ID NO: 2852348 - RNA, 18 nt, Human
uaauguguguauguguau

SEQ ID NO: 2852349 - RNA, 19 nt, Human
uaauguguguauguguauu

SEQ ID NO: 2852350 - RNA, 17 nt, Human
uaauguguuuuagagua

SEQ ID NO: 2852351 - RNA, 23 nt, Human
uaauguguuuuagaguaagaaau

SEQ ID NO: 2852352 - RNA, 13 nt, Human
uaauguuaaauuu

SEQ ID NO: 2852353 - RNA, 16 nt, Human
uaauguuaaauuugua

SEQ ID NO: 2852354 - RNA, 17 nt, Human
uaauguuaaauuuguaa

SEQ ID NO: 2852355 - RNA, 18 nt, Human
uaauguuaaauuuguaag

SEQ ID NO: 2852356 - RNA, 20 nt, Human
uaauguuaaauuuguaaguu

SEQ ID NO: 2852357 - RNA, 22 nt, Human
uaauguuaaauuuguaaguuuc

SEQ ID NO: 2852358 - RNA, 14 nt, Human
uaauguuaaccaag

SEQ ID NO: 2852359 - RNA, 17 nt, Human
uaauguuaaccaaggaa

SEQ ID NO: 2852360 - RNA, 19 nt, Human
uaaugucuucauuucauug

SEQ ID NO: 2852361 - RNA, 21 nt, Human
uaaugucuucauuucauugua

SEQ ID NO: 2852362 - RNA, 18 nt, Human
uaaugucccuuucagaga

SEQ ID NO: 2852363 - RNA, 13 nt, Human
uaaugugugaaaa

SEQ ID NO: 2852364 - RNA, 22 nt, Human
aauauuuauaaagaauguuucu

SEQ ID NO: 2852365 - RNA, 19 nt, Human
aauauuuauaaaugagcaa

SEQ ID NO: 2852366 - RNA, 17 nt, Human
aauauuguguugugaau

SEQ ID NO: 2852367 - RNA, 23 nt, Human
aauauugugaagaaaaauaaagu

SEQ ID NO: 2852368 - RNA, 10 nt, Human
aauauugugu

SEQ ID NO: 2852369 - RNA, 16 nt, Human
aauauuguguuccuuu

SEQ ID NO: 2852370 - RNA, 21 nt, Human
aauauuuaacauuauuuauau

SEQ ID NO: 2852371 - RNA, 19 nt, Human
aauauuuaaacagcagugu

SEQ ID NO: 2852372 - RNA, 17 nt, Human
aauauuuaaacagcagu

SEQ ID NO: 2852373 - RNA, 14 nt, Human
aauauugaggcuuu

SEQ ID NO: 2852374 - RNA, 16 nt, Human
aauauugaggcuuugu

SEQ ID NO: 2852375 - RNA, 17 nt, Human
aauauugaggcuuugug

SEQ ID NO: 2852376 - RNA, 18 nt, Human
aauauugaggcuuugugu

SEQ ID NO: 2852377 - RNA, 20 nt, Human
aauauugaggcuuuguguug

SEQ ID NO: 2852378 - RNA, 22 nt, Human
aauauugaggcuuuguguugua

SEQ ID NO: 2852379 - RNA, 12 nt, Human
aauauugacauu

SEQ ID NO: 2852380 - RNA, 15 nt, Human
aauauugacauuugu

SEQ ID NO: 2852381 - RNA, 16 nt, Human
aauauugacauuugua

SEQ ID NO: 2852382 - RNA, 20 nt, Human
aauauugacauuuguaguug

SEQ ID NO: 2852383 - RNA, 15 nt, Human
aauauugaacuuuuu

SEQ ID NO: 2852384 - RNA, 14 nt, Human
aauauugaaguacu

SEQ ID NO: 2852385 - RNA, 22 nt, Human
aauaugcagugauauggcagaa

SEQ ID NO: 2852386 - RNA, 23 nt, Human
aauaugccugcaaucugagccag

SEQ ID NO: 2852387 - RNA, 21 nt, Human
aauaugccuguaauucagugu

SEQ ID NO: 2852388 - RNA, 18 nt, Human
aauauucauauuggaaaa

SEQ ID NO: 2852389 - RNA, 20 nt, Human
aauauucauauuggaaaaau

SEQ ID NO: 2852390 - RNA, 23 nt, Human
aauauucauauuggaaaaaucac

SEQ ID NO: 2852391 - RNA, 13 nt, Human
aauauucccaagc

SEQ ID NO: 2852392 - RNA, 16 nt, Human
aauauucuauaugaau

SEQ ID NO: 2852393 - RNA, 20 nt, Human
aauauucuauaugaauuuaa

SEQ ID NO: 2852394 - RNA, 15 nt, Human
aauauuccugcauuu

SEQ ID NO: 2852395 - RNA, 13 nt, Human
uaagagaaagaaa

SEQ ID NO: 2852396 - RNA, 18 nt, Human
uaagagaaagaaaaugaa

SEQ ID NO: 2852397 - RNA, 12 nt, Human
uaagagaaaugg

SEQ ID NO: 2852398 - RNA, 15 nt, Human
uaagagaaauggcaa

SEQ ID NO: 2852399 - RNA, 15 nt, Human
uaagacuugugcaug

SEQ ID NO: 2852400 - RNA, 13 nt, Human
uaagagaaacuuu

SEQ ID NO: 2852401 - RNA, 14 nt, Human
uaagagaaacuuua

SEQ ID NO: 2852402 - RNA, 15 nt, Human
uaagagaaacuuuau

SEQ ID NO: 2852403 - RNA, 16 nt, Human
uaagagaaacuuuaua

SEQ ID NO: 2852404 - RNA, 20 nt, Human
uaagagaaacuuuauacauu

SEQ ID NO: 2852405 - RNA, 21 nt, Human
uaagagaaacuuuauacauua

SEQ ID NO: 2852406 - RNA, 22 nt, Human
uaagagaaacuuuauacauuag

SEQ ID NO: 2852407 - RNA, 23 nt, Human
uaagagaaacuuuauacauuagu

SEQ ID NO: 2852408 - RNA, 17 nt, Human
uaagacaugauuuccuu

SEQ ID NO: 2852409 - RNA, 22 nt, Human
uaagacauaacguuuuuccuuu

SEQ ID NO: 2852410 - RNA, 20 nt, Human
uaagacuuacucuaagaucu

SEQ ID NO: 2852411 - RNA, 20 nt, Human
uaagagacagaauguaucug

SEQ ID NO: 2852412 - RNA, 23 nt, Human
uaagagacagaauguaucuguga

SEQ ID NO: 2852413 - RNA, 19 nt, Human
aauauuuuuuauauauaca

SEQ ID NO: 2852414 - RNA, 21 nt, Human
aauauuuuuuauauauacagu

SEQ ID NO: 2852415 - RNA, 18 nt, Human
uaagaugggcagcuaguu

SEQ ID NO: 2852416 - RNA, 12 nt, Human
uaagaugucugu

SEQ ID NO: 2852417 - RNA, 19 nt, Human
uaagaugucuguuugcuga

SEQ ID NO: 2852418 - RNA, 14 nt, Human
uaagaugugauauu

SEQ ID NO: 2852419 - RNA, 18 nt, Human
uaagaugugauauucuaa

SEQ ID NO: 2852420 - RNA, 19 nt, Human
uaagaugugauauucuaag

SEQ ID NO: 2852421 - RNA, 20 nt, Human
uaagaugugauauucuaaga

SEQ ID NO: 2852422 - RNA, 21 nt, Human
uaagaugugauauucuaagac

SEQ ID NO: 2852423 - RNA, 14 nt, Human
uaagauuccagaga

SEQ ID NO: 2852424 - RNA, 22 nt, Human
uaagaugugauauucuaagacu

SEQ ID NO: 2852425 - RNA, 23 nt, Human
uaagaugugauauucuaagacuu

SEQ ID NO: 2852426 - RNA, 21 nt, Human
uaagauuccagagaguggcuc

SEQ ID NO: 2852427 - RNA, 10 nt, Human
uaagauucua

SEQ ID NO: 2852428 - RNA, 11 nt, Human
uaagauucuaa

SEQ ID NO: 2852429 - RNA, 12 nt, Human
uaagauucuaaa

SEQ ID NO: 2852430 - RNA, 13 nt, Human
uaagauucuaaag

SEQ ID NO: 2852431 - RNA, 14 nt, Human
uaagauucuaaagg

SEQ ID NO: 2852432 - RNA, 16 nt, Human
uaagauucuaaagguc

SEQ ID NO: 2852433 - RNA, 17 nt, Human
uaagauucuaaaggucc

SEQ ID NO: 2852434 - RNA, 12 nt, Human
uaagauucuaac

SEQ ID NO: 2852435 - RNA, 13 nt, Human
uaagauucuaacg

SEQ ID NO: 2852436 - RNA, 17 nt, Human
uaagauucuaacggucu

SEQ ID NO: 2852437 - RNA, 12 nt, Human
uaagauucuaau

SEQ ID NO: 2852438 - RNA, 16 nt, Human
aauauuuuuauauaca

SEQ ID NO: 2852439 - RNA, 18 nt, Human
aauauuuuuauauacaga

SEQ ID NO: 2852440 - RNA, 23 nt, Human
aauauuuuuauauacagaggaaa

SEQ ID NO: 2852441 - RNA, 23 nt, Human
aauauuuuugaaaggcauguucc

SEQ ID NO: 2852442 - RNA, 17 nt, Human
aauauuuuuuauauaua

SEQ ID NO: 2852443 - RNA, 14 nt, Human
aauauuuuuagaua

SEQ ID NO: 2852444 - RNA, 15 nt, Human
aauauuuuuaaaaga

SEQ ID NO: 2852445 - RNA, 21 nt, Human
aauauuuggucucuauuucau

SEQ ID NO: 2852446 - RNA, 12 nt, Human
aauauuugcuga

SEQ ID NO: 2852447 - RNA, 18 nt, Human
aauauuugacuauucugu

SEQ ID NO: 2852448 - RNA, 16 nt, Human
aauauuugacuugcau

SEQ ID NO: 2852449 - RNA, 21 nt, Human
aauauuugacuugcaugaaga

SEQ ID NO: 2852450 - RNA, 22 nt, Human
aauauuugacuugcaugaagag

SEQ ID NO: 2852451 - RNA, 23 nt, Human
aauauuugacuugcaugaagaga

SEQ ID NO: 2852452 - RNA, 14 nt, Human
aauauuuguacaua

SEQ ID NO: 2852453 - RNA, 12 nt, Human
aauauuuguaca

SEQ ID NO: 2852454 - RNA, 12 nt, Human
aauauuuuguau

SEQ ID NO: 2852455 - RNA, 15 nt, Human
aauauuuuguauuau

SEQ ID NO: 2852456 - RNA, 16 nt, Human
aauauuuuguauuauu

SEQ ID NO: 2852457 - RNA, 19 nt, Human
aauauuuuguauuauugcu

SEQ ID NO: 2852458 - RNA, 20 nt, Human
aauauuuuguauuauugcug

SEQ ID NO: 2852459 - RNA, 21 nt, Human
aauauuuuguauuauugcugu

SEQ ID NO: 2852460 - RNA, 22 nt, Human
aauauuuugauaauaauauugu

SEQ ID NO: 2852461 - RNA, 13 nt, Human
uaagcaaauuuca

SEQ ID NO: 2852462 - RNA, 16 nt, Human
uaagcaaauuucaaaa

SEQ ID NO: 2852463 - RNA, 18 nt, Human
uaagcaaauuucaaaaga

SEQ ID NO: 2852464 - RNA, 20 nt, Human
uaagcaaauuucaaaagaca

SEQ ID NO: 2852465 - RNA, 21 nt, Human
uaagcaaauuucaaaagacau

SEQ ID NO: 2852466 - RNA, 23 nt, Human
uaagcaaauuucaaaagacaugu

SEQ ID NO: 2852467 - RNA, 23 nt, Human
uaagcaaagggagcacuggguug

SEQ ID NO: 2852468 - RNA, 12 nt, Human
uaagcaaauacu

SEQ ID NO: 2852469 - RNA, 14 nt, Human
uaagcaaauacuua

SEQ ID NO: 2852470 - RNA, 16 nt, Human
uaagcaaauacuuagc

SEQ ID NO: 2852471 - RNA, 22 nt, Human
uaagcaaauacuuagcaaaaag

SEQ ID NO: 2852472 - RNA, 16 nt, Human
uaagauuuuucucaaa

SEQ ID NO: 2852473 - RNA, 18 nt, Human
uaagauuuuucucaaagu

SEQ ID NO: 2852474 - RNA, 20 nt, Human
uaagauuuuucucaaaguuu

SEQ ID NO: 2852475 - RNA, 21 nt, Human
uaagauuuuucucaaaguuuu

SEQ ID NO: 2852476 - RNA, 23 nt, Human
uaagcaaaaacaaaaagaaaaga

SEQ ID NO: 2852477 - RNA, 13 nt, Human
uaagauucugauu

SEQ ID NO: 2852478 - RNA, 14 nt, Human
uaagauucugauuu

SEQ ID NO: 2852479 - RNA, 17 nt, Human
uaagauucugauuuuag

SEQ ID NO: 2852480 - RNA, 13 nt, Human
uaagauucuaaug

SEQ ID NO: 2852481 - RNA, 14 nt, Human
uaagauucuaauga

SEQ ID NO: 2852482 - RNA, 15 nt, Human
uaagauucuaaugau

SEQ ID NO: 2852483 - RNA, 11 nt, Human
uaagauucuag

SEQ ID NO: 2852484 - RNA, 12 nt, Human
uaagauucuaga

SEQ ID NO: 2852485 - RNA, 13 nt, Human
uaagauucuagau

SEQ ID NO: 2852486 - RNA, 14 nt, Human
uaagauucuagauc

SEQ ID NO: 2852487 - RNA, 21 nt, Human
uaagauucuagaucagaugcu

SEQ ID NO: 2852488 - RNA, 15 nt, Human
uaagauuuuucucaa

SEQ ID NO: 2852489 - RNA, 12 nt, Human
uaagauuuuaca

SEQ ID NO: 2852490 - RNA, 14 nt, Human
uaagauuuuacaaa

SEQ ID NO: 2852491 - RNA, 16 nt, Human
uaagauuuuacaaaag

SEQ ID NO: 2852492 - RNA, 12 nt, Human
uaagcugcagcu

SEQ ID NO: 2852493 - RNA, 14 nt, Human
uaagcugcagcuuc

SEQ ID NO: 2852494 - RNA, 15 nt, Human
uaagcugcagcuucc

SEQ ID NO: 2852495 - RNA, 16 nt, Human
uaagcugcagcuuccu

SEQ ID NO: 2852496 - RNA, 18 nt, Human
uaagcugcagcuuccugu

SEQ ID NO: 2852497 - RNA, 14 nt, Human
uaagcaacaucuuu

SEQ ID NO: 2852498 - RNA, 18 nt, Human
uaagcugauccugcggag

SEQ ID NO: 2852499 - RNA, 13 nt, Human
uaagcacucuuaa

SEQ ID NO: 2852500 - RNA, 17 nt, Human
uaagcacucuuaaagca

SEQ ID NO: 2852501 - RNA, 18 nt, Human
uaagcacucuuaaagcaa

SEQ ID NO: 2852502 - RNA, 14 nt, Human
uaagcacugaaaaa

SEQ ID NO: 2852503 - RNA, 20 nt, Human
uaagcacugaaaaacaacaa

SEQ ID NO: 2852504 - RNA, 16 nt, Human
uaagcacuguuuuucc

SEQ ID NO: 2852505 - RNA, 17 nt, Human
uaagcacuguuuuucca

SEQ ID NO: 2852506 - RNA, 13 nt, Human
uaagcagagaagg

SEQ ID NO: 2852507 - RNA, 24 nt, Human
uaagcagagaagggcauaaaacag

SEQ ID NO: 2852508 - RNA, 15 nt, Human
uaagcagaaauccug

SEQ ID NO: 2852509 - RNA, 19 nt, Human
aauauauuuguguauuuaa

SEQ ID NO: 2852510 - RNA, 21 nt, Human
aauauauuuguguauuuaaca

SEQ ID NO: 2852511 - RNA, 24 nt, Human
aauauauuuguguauuuaacaggg

SEQ ID NO: 2852512 - RNA, 18 nt, Human
uaacaguucauguuugcu

SEQ ID NO: 2852513 - RNA, 14 nt, Human
uaacaguucauguu

SEQ ID NO: 2852514 - RNA, 22 nt, Human
aauaucauaucaucacauugag

SEQ ID NO: 2852515 - RNA, 21 nt, Human
uaacagugcagggcaaaauau

SEQ ID NO: 2852516 - RNA, 13 nt, Human
uaacauauuuacu

SEQ ID NO: 2852517 - RNA, 17 nt, Human
uaacauauguacauaaa

SEQ ID NO: 2852518 - RNA, 20 nt, Human
uaacauauguacauaaauug

SEQ ID NO: 2852519 - RNA, 20 nt, Human
uaacauauucuguaugaacu

SEQ ID NO: 2852520 - RNA, 14 nt, Human
uaacauauuuacua

SEQ ID NO: 2852521 - RNA, 22 nt, Human
uaacauauuuacuaagccacaa

SEQ ID NO: 2852522 - RNA, 23 nt, Human
uaacauauuuacuaagccacaag

SEQ ID NO: 2852523 - RNA, 14 nt, Human
uaacaucaaagauu

SEQ ID NO: 2852524 - RNA, 19 nt, Human
uaacaucacuauccaugca

SEQ ID NO: 2852525 - RNA, 20 nt, Human
uaacaucacuauccaugcac

SEQ ID NO: 2852526 - RNA, 21 nt, Human
uaacaucacuauccaugcacc

SEQ ID NO: 2852527 - RNA, 20 nt, Human
uaacaucauuuuguuuucca

SEQ ID NO: 2852528 - RNA, 16 nt, Human
uaacaucuucaacaug

SEQ ID NO: 2852529 - RNA, 13 nt, Human
uaaccugugucug

SEQ ID NO: 2852530 - RNA, 14 nt, Human
uaaccugugucugc

SEQ ID NO: 2852531 - RNA, 22 nt, Human
uaaccugugucugcgaaguccu

SEQ ID NO: 2852532 - RNA, 23 nt, Human
uaaccugugucugcgaaguccua

SEQ ID NO: 2852533 - RNA, 19 nt, Human
uaacauaguaaguucagca

SEQ ID NO: 2852534 - RNA, 11 nt, Human
uaacaugaaau

SEQ ID NO: 2852535 - RNA, 13 nt, Human
uaacaugaaauga

SEQ ID NO: 2852536 - RNA, 14 nt, Human
uaacaugaaaugau

SEQ ID NO: 2852537 - RNA, 15 nt, Human
uaacaugaaaugaua

SEQ ID NO: 2852538 - RNA, 18 nt, Human
uaacaugaaaugauagau

SEQ ID NO: 2852539 - RNA, 19 nt, Human
uaacaugaaaugauagauu

SEQ ID NO: 2852540 - RNA, 21 nt, Human
uaacaugaacacccuuagaaa

SEQ ID NO: 2852541 - RNA, 22 nt, Human
aauaguauuugagaguucuaaa

SEQ ID NO: 2852542 - RNA, 20 nt, Human
aauaguauuugagaguucua

SEQ ID NO: 2852543 - RNA, 15 nt, Human
uaaaauuuauuucau

SEQ ID NO: 2852544 - RNA, 17 nt, Human
uaaaauuuaaguaucuu

SEQ ID NO: 2852545 - RNA, 9 nt, Human
uaaaauuug

SEQ ID NO: 2852546 - RNA, 23 nt, Human
aauaguauuugagaguucuaaau

SEQ ID NO: 2852547 - RNA, 14 nt, Human
aauaguguccuaug

SEQ ID NO: 2852548 - RNA, 19 nt, Human
aauaguguccuaugcaaua

SEQ ID NO: 2852549 - RNA, 20 nt, Human
aauaguguccuaugcaauaa

SEQ ID NO: 2852550 - RNA, 21 nt, Human
aauaguguccuaugcaauaaa

SEQ ID NO: 2852551 - RNA, 22 nt, Human
aauaguguccuaugcaauaaaa

SEQ ID NO: 2852552 - RNA, 23 nt, Human
aauaguguccuaugcaauaaaau

SEQ ID NO: 2852553 - RNA, 13 nt, Human
aauaguuggcuag

SEQ ID NO: 2852554 - RNA, 12 nt, Human
uaaaauuugugg

SEQ ID NO: 2852555 - RNA, 13 nt, Human
aauauauuugugu

SEQ ID NO: 2852556 - RNA, 14 nt, Human
aauauauuugugua

SEQ ID NO: 2852557 - RNA, 14 nt, Human
aauaguuguugauu

SEQ ID NO: 2852558 - RNA, 18 nt, Human
aauaguuguccauauuuu

SEQ ID NO: 2852559 - RNA, 21 nt, Human
aauaguuguccauauuuucac

SEQ ID NO: 2852560 - RNA, 22 nt, Human
uaacuuugcuuucaugaccauc

SEQ ID NO: 2852561 - RNA, 22 nt, Human
uaacuuuagaagugcauuucug

SEQ ID NO: 2852562 - RNA, 14 nt, Human
uaagaauacagcuu

SEQ ID NO: 2852563 - RNA, 16 nt, Human
uaagaauacagcuuuc

SEQ ID NO: 2852564 - RNA, 14 nt, Human
uaagacacaaaugc

SEQ ID NO: 2852565 - RNA, 23 nt, Human
uaagacacaaaugcaugaacaag

SEQ ID NO: 2852566 - RNA, 19 nt, Human
uaagaauauguuuccuugu

SEQ ID NO: 2852567 - RNA, 21 nt, Human
uaagaauauguuuccuuguuu

SEQ ID NO: 2852568 - RNA, 12 nt, Human
uaagacauaacg

SEQ ID NO: 2852569 - RNA, 19 nt, Human
uaagacagucccaucaaaa

SEQ ID NO: 2852570 - RNA, 16 nt, Human
uaagacauaucucuaa

SEQ ID NO: 2852571 - RNA, 16 nt, Human
uaagacaugauuuccu

SEQ ID NO: 2852572 - RNA, 16 nt, Human
uaagacauaacguuuu

SEQ ID NO: 2852573 - RNA, 17 nt, Human
uaagacauaacguuuuu

SEQ ID NO: 2852574 - RNA, 20 nt, Human
uaagacauaacguuuuuccu

SEQ ID NO: 2852575 - RNA, 21 nt, Human
uaagacauaacguuuuuccuu

SEQ ID NO: 2852576 - RNA, 12 nt, Human
uaacuucuuucu

SEQ ID NO: 2852577 - RNA, 13 nt, Human
uaacuucuuucua

SEQ ID NO: 2852578 - RNA, 23 nt, Human
uaacuucuuucuauuugacuugu

SEQ ID NO: 2852579 - RNA, 22 nt, Human
uaacuugaaccuaugaagcaau

SEQ ID NO: 2852580 - RNA, 23 nt, Human
uaacuucuuauggaauugauuug

SEQ ID NO: 2852581 - RNA, 13 nt, Human
uaacuucaguccu

SEQ ID NO: 2852582 - RNA, 15 nt, Human
uaacuugcgcagaaa

SEQ ID NO: 2852583 - RNA, 12 nt, Human
uaacuugaugca

SEQ ID NO: 2852584 - RNA, 13 nt, Human
uaacuugaugcau

SEQ ID NO: 2852585 - RNA, 15 nt, Human
uaacuugaugcaugu

SEQ ID NO: 2852586 - RNA, 16 nt, Human
uaacuugaugcaugug

SEQ ID NO: 2852587 - RNA, 22 nt, Human
uaacuuuaauucucuuucaaag

SEQ ID NO: 2852588 - RNA, 14 nt, Human
uaacuuuaugugua

SEQ ID NO: 2852589 - RNA, 15 nt, Human
uaacuuuauguguaa

SEQ ID NO: 2852590 - RNA, 16 nt, Human
uaacuuuauguguaaa

SEQ ID NO: 2852591 - RNA, 18 nt, Human
uaacuuuauguguaaaua

SEQ ID NO: 2852592 - RNA, 15 nt, Human
uaacuuuauucuuga

SEQ ID NO: 2852593 - RNA, 18 nt, Human
uaacuuuauucuugaaag

SEQ ID NO: 2852594 - RNA, 20 nt, Human
uaacuuuauucuugaaagaa

SEQ ID NO: 2852595 - RNA, 23 nt, Human
uaacuuuauucuugaaagaagaa

SEQ ID NO: 2852596 - RNA, 17 nt, Human
uaaccuuauccugcauu

SEQ ID NO: 2852597 - RNA, 18 nt, Human
uaaccuuauccugcauug

SEQ ID NO: 2852598 - RNA, 21 nt, Human
uaaccuuauccugcauuguua

SEQ ID NO: 2852599 - RNA, 15 nt, Human
uaaccuugaaugcug

SEQ ID NO: 2852600 - RNA, 17 nt, Human
uaaccuugaaugcugcc

SEQ ID NO: 2852601 - RNA, 18 nt, Human
uaaccuugaaugcugcca

SEQ ID NO: 2852602 - RNA, 19 nt, Human
uaaccuugaaugcugccag

SEQ ID NO: 2852603 - RNA, 20 nt, Human
uaaccuugaaugcugccagu

SEQ ID NO: 2852604 - RNA, 22 nt, Human
uaaccuugaaugcugccagugu

SEQ ID NO: 2852605 - RNA, 11 nt, Human
uaacaugggcu

SEQ ID NO: 2852606 - RNA, 18 nt, Human
uaacaugggcucuucacu

SEQ ID NO: 2852607 - RNA, 21 nt, Human
uaacaugggcucuucacuagu

SEQ ID NO: 2852608 - RNA, 21 nt, Human
uaacuagacacagauaauaau

SEQ ID NO: 2852609 - RNA, 17 nt, Human
uaacuagacaccaaagu

SEQ ID NO: 2852610 - RNA, 18 nt, Human
uaacuagacaccaaaguu

SEQ ID NO: 2852611 - RNA, 20 nt, Human
uaacuagacaccaaaguucu

SEQ ID NO: 2852612 - RNA, 21 nt, Human
uaacuagacaccaaaguucua

SEQ ID NO: 2852613 - RNA, 22 nt, Human
uaacuagacaccaaaguucuaa

SEQ ID NO: 2852614 - RNA, 17 nt, Human
uaacuuaaaaauguaaa

SEQ ID NO: 2852615 - RNA, 19 nt, Human
uaacuuaaaaauguaaaua

SEQ ID NO: 2852616 - RNA, 15 nt, Human
uaacuguuuauaugu

SEQ ID NO: 2852617 - RNA, 19 nt, Human
uaacuguuuauauguguug

SEQ ID NO: 2852618 - RNA, 22 nt, Human
uaacuguuuauauguguugaaa

SEQ ID NO: 2852619 - RNA, 23 nt, Human
uaacuuaaaaauguaaauauucu

SEQ ID NO: 2852620 - RNA, 20 nt, Human
uaacuuaaaaauguaaauau

SEQ ID NO: 2852621 - RNA, 21 nt, Human
uaacuuaaaaauguaaauauu

SEQ ID NO: 2852622 - RNA, 18 nt, Human
uaacuucacauuaaaaaa

SEQ ID NO: 2852623 - RNA, 22 nt, Human
uaacuucacauuaaaaaaugaa

SEQ ID NO: 2852624 - RNA, 14 nt, Human
accagucacaugac

SEQ ID NO: 2852625 - RNA, 19 nt, Human
accagucuuuaaaggccca

SEQ ID NO: 2852626 - RNA, 20 nt, Human
accagucuuuaaaggcccag

SEQ ID NO: 2852627 - RNA, 21 nt, Human
accagucuuuaaaggcccagc

SEQ ID NO: 2852628 - RNA, 22 nt, Human
accagucuuuaaaggcccagcc

SEQ ID NO: 2852629 - RNA, 23 nt, Human
accagucuuuaaaggcccagccc

SEQ ID NO: 2852630 - RNA, 13 nt, Human
accagucccuguc

SEQ ID NO: 2852631 - RNA, 12 nt, Human
accagucccugu

SEQ ID NO: 2852632 - RNA, 13 nt, Human
accaguguccccu

SEQ ID NO: 2852633 - RNA, 18 nt, Human
accaguguccccuccacu

SEQ ID NO: 2852634 - RNA, 14 nt, Human
ucacuugaugauac

SEQ ID NO: 2852635 - RNA, 20 nt, Human
ucacuugaugauacaaugaa

SEQ ID NO: 2852636 - RNA, 20 nt, Human
accaguaggggcuuauaaua

SEQ ID NO: 2852637 - RNA, 14 nt, Human
ucacugcagccuca

SEQ ID NO: 2852638 - RNA, 20 nt, Human
ucacuagugaccccuucccu

SEQ ID NO: 2852639 - RNA, 22 nt, Human
ucacuagugaccccuucccugu

SEQ ID NO: 2852640 - RNA, 19 nt, Human
ucacuaucccggcugcccu

SEQ ID NO: 2852641 - RNA, 14 nt, Human
ucacuauccaugca

SEQ ID NO: 2852642 - RNA, 20 nt, Human
ucacuaucccggcugcccuu

SEQ ID NO: 2852643 - RNA, 13 nt, Human
ucacugcagccuc

SEQ ID NO: 2852644 - RNA, 15 nt, Human
ucacugcagccucaa

SEQ ID NO: 2852645 - RNA, 19 nt, Human
ucacuguugcccaggcugg

SEQ ID NO: 2852646 - RNA, 17 nt, Human
ucacugugucacccagg

SEQ ID NO: 2852647 - RNA, 22 nt, Human
ucacuguuagcuuuuuaaaaca

SEQ ID NO: 2852648 - RNA, 23 nt, Human
ucacuguuagcuuuuuaaaacau

SEQ ID NO: 2852649 - RNA, 23 nt, Human
ucacuguugcccaggcuggcgug

SEQ ID NO: 2852650 - RNA, 15 nt, Human
ucacuguguacauaa

SEQ ID NO: 2852651 - RNA, 16 nt, Human
ucacuguguacauaau

SEQ ID NO: 2852652 - RNA, 17 nt, Human
ucacuguguacauaaug

SEQ ID NO: 2852653 - RNA, 20 nt, Human
ucacugugguaaaugccaca

SEQ ID NO: 2852654 - RNA, 21 nt, Human
ucacugugguaaaugccacac

SEQ ID NO: 2852655 - RNA, 22 nt, Human
ucacugugguaaaugccacaca

SEQ ID NO: 2852656 - RNA, 12 nt, Human
ucacuguggcug

SEQ ID NO: 2852657 - RNA, 15 nt, Human
ucacuguggcugucu

SEQ ID NO: 2852658 - RNA, 18 nt, Human
ucacuguggcugucugga

SEQ ID NO: 2852659 - RNA, 15 nt, Human
accaggacucccucc

SEQ ID NO: 2852660 - RNA, 14 nt, Human
accaggacucccuc

SEQ ID NO: 2852661 - RNA, 22 nt, Human
ucaccuggggcugcuggccuga

SEQ ID NO: 2852662 - RNA, 16 nt, Human
ucaccuggggcugcug

SEQ ID NO: 2852663 - RNA, 17 nt, Human
ucaccuggggcugcugg

SEQ ID NO: 2852664 - RNA, 18 nt, Human
ucaccuggggcugcuggc

SEQ ID NO: 2852665 - RNA, 20 nt, Human
ucaccuggggcugcuggccu

SEQ ID NO: 2852666 - RNA, 16 nt, Human
ucacguguacuggcuc

SEQ ID NO: 2852667 - RNA, 17 nt, Human
ucacguguacuggcucc

SEQ ID NO: 2852668 - RNA, 18 nt, Human
ucacguguacuggcuccu

SEQ ID NO: 2852669 - RNA, 17 nt, Human
ucacguguaguguccau

SEQ ID NO: 2852670 - RNA, 21 nt, Human
ucacguggaggagcagugcag

SEQ ID NO: 2852671 - RNA, 16 nt, Human
ucacguggaggagcag

SEQ ID NO: 2852672 - RNA, 17 nt, Human
ucacguacugucugauu

SEQ ID NO: 2852673 - RNA, 17 nt, Human
ucacgugcagcucaagg

SEQ ID NO: 2852674 - RNA, 16 nt, Human
ucacgugcgcugggca

SEQ ID NO: 2852675 - RNA, 17 nt, Human
ucacgugcgcugggcac

SEQ ID NO: 2852676 - RNA, 22 nt, Human
ucacgugcgcugggcacuuccc

SEQ ID NO: 2852677 - RNA, 23 nt, Human
ucacgugcgcugggcacuucccu

SEQ ID NO: 2852678 - RNA, 15 nt, Human
ucacuaauacacagu

SEQ ID NO: 2852679 - RNA, 19 nt, Human
ucacuaauacuaauucauu

SEQ ID NO: 2852680 - RNA, 13 nt, Human
ucacuaaacuuua

SEQ ID NO: 2852681 - RNA, 19 nt, Human
ucacuacccuauucucucu

SEQ ID NO: 2852682 - RNA, 16 nt, Human
ucacuaggcuucuggu

SEQ ID NO: 2852683 - RNA, 20 nt, Human
accacuagaacucuccaucu

SEQ ID NO: 2852684 - RNA, 13 nt, Human
accacuagaacuc

SEQ ID NO: 2852685 - RNA, 17 nt, Human
accacuaggacucugag

SEQ ID NO: 2852686 - RNA, 14 nt, Human
accacuauaaaaug

SEQ ID NO: 2852687 - RNA, 15 nt, Human
accacuauaaaaugu

SEQ ID NO: 2852688 - RNA, 16 nt, Human
accagcuacccugugu

SEQ ID NO: 2852689 - RNA, 19 nt, Human
accagcgcucuaaaagcac

SEQ ID NO: 2852690 - RNA, 21 nt, Human
accagcguauauauaagaaag

SEQ ID NO: 2852691 - RNA, 23 nt, Human
accagcguauauauaagaaagac

SEQ ID NO: 2852692 - RNA, 21 nt, Human
accaggaaaggauuuuauaau

SEQ ID NO: 2852693 - RNA, 13 nt, Human
accagcuuuuaac

SEQ ID NO: 2852694 - RNA, 15 nt, Human
accagcuuuuaacca

SEQ ID NO: 2852695 - RNA, 19 nt, Human
accagcuuuuaaccaucug

SEQ ID NO: 2852696 - RNA, 19 nt, Human
accaggaaaggauuuuaua

SEQ ID NO: 2852697 - RNA, 18 nt, Human
accagcuugcgaauaaca

SEQ ID NO: 2852698 - RNA, 21 nt, Human
accagcuuguaugcaauggau

SEQ ID NO: 2852699 - RNA, 22 nt, Human
accagcuuguaugcaauggauu

SEQ ID NO: 2852700 - RNA, 17 nt, Human
accagcugcugcucuga

SEQ ID NO: 2852701 - RNA, 16 nt, Human
accagcuuagauuuua

SEQ ID NO: 2852702 - RNA, 17 nt, Human
accagcuguaacacagc

SEQ ID NO: 2852703 - RNA, 22 nt, Human
accagcucugccgucucuggag

SEQ ID NO: 2852704 - RNA, 21 nt, Human
ucacaaacuuuuauacucuuu

SEQ ID NO: 2852705 - RNA, 18 nt, Human
ucacaaagaguucuggaa

SEQ ID NO: 2852706 - RNA, 22 nt, Human
ucacaaaauuuuauuccuauau

SEQ ID NO: 2852707 - RNA, 17 nt, Human
ucacaaacuuuuauacu

SEQ ID NO: 2852708 - RNA, 15 nt, Human
ucacaaacuuuuaua

SEQ ID NO: 2852709 - RNA, 14 nt, Human
ucacaaaauuuuau

SEQ ID NO: 2852710 - RNA, 16 nt, Human
ucacaaaaauuugaac

SEQ ID NO: 2852711 - RNA, 20 nt, Human
ucacaaaaauuugaacacug

SEQ ID NO: 2852712 - RNA, 21 nt, Human
ucacaaaaauuugaacacugg

SEQ ID NO: 2852713 - RNA, 23 nt, Human
ucacaaaaauuugaacacuggcu

SEQ ID NO: 2852714 - RNA, 16 nt, Human
ucacaaaacagccuuu

SEQ ID NO: 2852715 - RNA, 22 nt, Human
ucacaaaacagccuuugggaaa

SEQ ID NO: 2852716 - RNA, 13 nt, Human
ucaauuucaggcu

SEQ ID NO: 2852717 - RNA, 19 nt, Human
accaaagcugcccacuguu

SEQ ID NO: 2852718 - RNA, 21 nt, Human
accaaagggagaguuccagag

SEQ ID NO: 2852719 - RNA, 21 nt, Human
accaaaguccuuuuuuuccau

SEQ ID NO: 2852720 - RNA, 11 nt, Human
accaaaguucu

SEQ ID NO: 2852721 - RNA, 17 nt, Human
accaaaggacauuaugu

SEQ ID NO: 2852722 - RNA, 19 nt, Human
accaaaggacauuaugugu

SEQ ID NO: 2852723 - RNA, 20 nt, Human
accaaaggacauuaugugug

SEQ ID NO: 2852724 - RNA, 21 nt, Human
accaaaggacauuaugugugc

SEQ ID NO: 2852725 - RNA, 18 nt, Human
accaaagcugcccacugu

SEQ ID NO: 2852726 - RNA, 14 nt, Human
accaaagcugccca

SEQ ID NO: 2852727 - RNA, 13 nt, Human
accaaagcugccc

SEQ ID NO: 2852728 - RNA, 12 nt, Human
accaaagcugcc

SEQ ID NO: 2852729 - RNA, 14 nt, Human
accaaagccaccag

SEQ ID NO: 2852730 - RNA, 20 nt, Human
accaaagcaccuuagcuggc

SEQ ID NO: 2852731 - RNA, 12 nt, Human
accaaagccacc

SEQ ID NO: 2852732 - RNA, 20 nt, Human
ucacacugguucucaaugaa

SEQ ID NO: 2852733 - RNA, 19 nt, Human
ucacacugguucucaauga

SEQ ID NO: 2852734 - RNA, 20 nt, Human
ucacacuuacuguaagacau

SEQ ID NO: 2852735 - RNA, 21 nt, Human
ucacacuuacuguaagacauu

SEQ ID NO: 2852736 - RNA, 22 nt, Human
ucacacuuacuguaagacauua

SEQ ID NO: 2852737 - RNA, 23 nt, Human
ucacacuuacuguaagacauuag

SEQ ID NO: 2852738 - RNA, 16 nt, Human
ucacacuucugugaga

SEQ ID NO: 2852739 - RNA, 21 nt, Human
ucacacugguucucaaugaaa

SEQ ID NO: 2852740 - RNA, 17 nt, Human
ucacacugguucucaau

SEQ ID NO: 2852741 - RNA, 16 nt, Human
ucacacugguucucaa

SEQ ID NO: 2852742 - RNA, 15 nt, Human
ucacacugguucuca

SEQ ID NO: 2852743 - RNA, 16 nt, Human
ucacacuggcuaucaa

SEQ ID NO: 2852744 - RNA, 14 nt, Human
ucacaaccuucugu

SEQ ID NO: 2852745 - RNA, 13 nt, Human
ucaauuuuaaaga

SEQ ID NO: 2852746 - RNA, 19 nt, Human
ucacaaccaccguuacaag

SEQ ID NO: 2852747 - RNA, 13 nt, Human
ucacagccucuga

SEQ ID NO: 2852748 - RNA, 11 nt, Human
ucacagccucu

SEQ ID NO: 2852749 - RNA, 12 nt, Human
ucacagccucug

SEQ ID NO: 2852750 - RNA, 16 nt, Human
ucacagccucugaccc

SEQ ID NO: 2852751 - RNA, 17 nt, Human
ucacagccucugacccc

SEQ ID NO: 2852752 - RNA, 18 nt, Human
ucacagccucugaccccu

SEQ ID NO: 2852753 - RNA, 19 nt, Human
ucacagccucugaccccuc

SEQ ID NO: 2852754 - RNA, 20 nt, Human
ucacagccucugaccccucc

SEQ ID NO: 2852755 - RNA, 21 nt, Human
ucacagccucugaccccuccu

SEQ ID NO: 2852756 - RNA, 17 nt, Human
ucacagcacaugcuggc

SEQ ID NO: 2852757 - RNA, 19 nt, Human
ucacagcacaugcuggcca

SEQ ID NO: 2852758 - RNA, 20 nt, Human
ucacagcacaugcuggccag

SEQ ID NO: 2852759 - RNA, 21 nt, Human
ucacagcacaugcuggccagc

SEQ ID NO: 2852760 - RNA, 13 nt, Human
ucacagcagccuc

SEQ ID NO: 2852761 - RNA, 14 nt, Human
ucacagcagccucc

SEQ ID NO: 2852762 - RNA, 17 nt, Human
ucacagcagccuccaac

SEQ ID NO: 2852763 - RNA, 13 nt, Human
ucacagccuccuc

SEQ ID NO: 2852764 - RNA, 14 nt, Human
ucacagccuccucu

SEQ ID NO: 2852765 - RNA, 15 nt, Human
ucacagccuccucug

SEQ ID NO: 2852766 - RNA, 17 nt, Human
ucacagccuccucuguc

SEQ ID NO: 2852767 - RNA, 19 nt, Human
ucacagccuccucugucug

SEQ ID NO: 2852768 - RNA, 20 nt, Human
ucacagccuccucugucugc

SEQ ID NO: 2852769 - RNA, 22 nt, Human
ucacagccuccucugucugccc

SEQ ID NO: 2852770 - RNA, 23 nt, Human
ucacagaugugugauucacagug

SEQ ID NO: 2852771 - RNA, 23 nt, Human
ucacacuucugugagacccccac

SEQ ID NO: 2852772 - RNA, 22 nt, Human
ucacacuucugugagaccccca

SEQ ID NO: 2852773 - RNA, 21 nt, Human
ucacagaugugugauucacag

SEQ ID NO: 2852774 - RNA, 17 nt, Human
ucacauagagugaucuu

SEQ ID NO: 2852775 - RNA, 13 nt, Human
ucaccauguauuu

SEQ ID NO: 2852776 - RNA, 19 nt, Human
ucaccauguauuuuguaaa

SEQ ID NO: 2852777 - RNA, 15 nt, Human
ucaccauguuggcca

SEQ ID NO: 2852778 - RNA, 14 nt, Human
ucaccaucugugca

SEQ ID NO: 2852779 - RNA, 17 nt, Human
ucacauagcuacccaaa

SEQ ID NO: 2852780 - RNA, 21 nt, Human
ucacauagcuacccaaaagag

SEQ ID NO: 2852781 - RNA, 22 nt, Human
ucacagccucugaccccuccuc

SEQ ID NO: 2852782 - RNA, 13 nt, Human
ucacaguugacaa

SEQ ID NO: 2852783 - RNA, 17 nt, Human
ucacaguuggccuucag

SEQ ID NO: 2852784 - RNA, 22 nt, Human
ucacaguuggcuggaugaaauu

SEQ ID NO: 2852785 - RNA, 13 nt, Human
ucacauaaaugca

SEQ ID NO: 2852786 - RNA, 17 nt, Human
ucacauaaaugcagccc

SEQ ID NO: 2852787 - RNA, 18 nt, Human
ucacauaaaugcagccca

SEQ ID NO: 2852788 - RNA, 19 nt, Human
ucacauaaaugcagcccau

SEQ ID NO: 2852789 - RNA, 17 nt, Human
ucacauaaaaccucauu

SEQ ID NO: 2852790 - RNA, 13 nt, Human
ucaccccccacuc

SEQ ID NO: 2852791 - RNA, 14 nt, Human
ucaccccccacuca

SEQ ID NO: 2852792 - RNA, 18 nt, Human
ucaccccccacucaccag

SEQ ID NO: 2852793 - RNA, 14 nt, Human
ucacccccugagau

SEQ ID NO: 2852794 - RNA, 13 nt, Human
ucaccccauccca

SEQ ID NO: 2852795 - RNA, 13 nt, Human
ucacccccagcuu

SEQ ID NO: 2852796 - RNA, 18 nt, Human
ucacccccagcuuugcua

SEQ ID NO: 2852797 - RNA, 19 nt, Human
ucaccccaucccacacccu

SEQ ID NO: 2852798 - RNA, 22 nt, Human
ucaccauguuggccaggcuggu

SEQ ID NO: 2852799 - RNA, 21 nt, Human
ucaccauguuggccaggcugg

SEQ ID NO: 2852800 - RNA, 21 nt, Human
ucaccaugauggccaggcuga

SEQ ID NO: 2852801 - RNA, 14 nt, Human
ucaccaugaugggg

SEQ ID NO: 2852802 - RNA, 19 nt, Human
ucaccaugauggggcccua

SEQ ID NO: 2852803 - RNA, 16 nt, Human
ucaccaugcuuccagc

SEQ ID NO: 2852804 - RNA, 19 nt, Human
ucacccaagagauuguugu

SEQ ID NO: 2852805 - RNA, 20 nt, Human
accaccacacccagcccacu

SEQ ID NO: 2852806 - RNA, 15 nt, Human
accaccacacccagc

SEQ ID NO: 2852807 - RNA, 16 nt, Human
accaccacacccggcu

SEQ ID NO: 2852808 - RNA, 16 nt, Human
accacaucuugcucug

SEQ ID NO: 2852809 - RNA, 22 nt, Human
accacagguucaugccaccaug

SEQ ID NO: 2852810 - RNA, 20 nt, Human
accacaugccaagcacugug

SEQ ID NO: 2852811 - RNA, 22 nt, Human
accacaugccaagcacugugcu

SEQ ID NO: 2852812 - RNA, 18 nt, Human
accacaugugcacaugca

SEQ ID NO: 2852813 - RNA, 18 nt, Human
accacaugcggagaacaa

SEQ ID NO: 2852814 - RNA, 19 nt, Human
accacaucuugcucugcug

SEQ ID NO: 2852815 - RNA, 18 nt, Human
accacaucuugcucugcu

SEQ ID NO: 2852816 - RNA, 17 nt, Human
accacaucuugcucugc

SEQ ID NO: 2852817 - RNA, 16 nt, Human
accacaggugugagcc

SEQ ID NO: 2852818 - RNA, 16 nt, Human
ucaccccgaggcccug

SEQ ID NO: 2852819 - RNA, 17 nt, Human
ucaccccgaggcccugc

SEQ ID NO: 2852820 - RNA, 18 nt, Human
ucaccccgaggcccugca

SEQ ID NO: 2852821 - RNA, 19 nt, Human
ucaccccgaggcccugcau

SEQ ID NO: 2852822 - RNA, 20 nt, Human
ucaccccgaggcccugcaug

SEQ ID NO: 2852823 - RNA, 21 nt, Human
ucaccccgcuguaagcuccuu

SEQ ID NO: 2852824 - RNA, 23 nt, Human
ucaccccgcuguaagcuccuuug

SEQ ID NO: 2852825 - RNA, 15 nt, Human
ucaccccggcaggcc

SEQ ID NO: 2852826 - RNA, 16 nt, Human
ucaccccggcaggccc

SEQ ID NO: 2852827 - RNA, 12 nt, Human
accacagcugcu

SEQ ID NO: 2852828 - RNA, 13 nt, Human
accacagcugcug

SEQ ID NO: 2852829 - RNA, 14 nt, Human
accacagcugcugg

SEQ ID NO: 2852830 - RNA, 15 nt, Human
accacagcugcugga

SEQ ID NO: 2852831 - RNA, 16 nt, Human
accacagcugcuggag

SEQ ID NO: 2852832 - RNA, 22 nt, Human
accacaggaauuuuaaaaacaa

SEQ ID NO: 2852833 - RNA, 13 nt, Human
ucaauaugcuuac

SEQ ID NO: 2852834 - RNA, 13 nt, Human
ucaauauugacau

SEQ ID NO: 2852835 - RNA, 16 nt, Human
ucaauauugacauuug

SEQ ID NO: 2852836 - RNA, 17 nt, Human
ucaauauugacauuugu

SEQ ID NO: 2852837 - RNA, 18 nt, Human
ucaauauugacauuugua

SEQ ID NO: 2852838 - RNA, 19 nt, Human
ucaauauugacauuuguag

SEQ ID NO: 2852839 - RNA, 18 nt, Human
ucaauauccaaaccaaau

SEQ ID NO: 2852840 - RNA, 13 nt, Human
ucaauaucuaaua

SEQ ID NO: 2852841 - RNA, 15 nt, Human
ucaauaucuaauaua

SEQ ID NO: 2852842 - RNA, 19 nt, Human
ucaauaucuaauauauaug

SEQ ID NO: 2852843 - RNA, 21 nt, Human
ucaauaucuaauauauaugaa

SEQ ID NO: 2852844 - RNA, 13 nt, Human
ucaauaguguccu

SEQ ID NO: 2852845 - RNA, 19 nt, Human
ucaauaguguccuaugcaa

SEQ ID NO: 2852846 - RNA, 20 nt, Human
ucaauaguguccuaugcaau

SEQ ID NO: 2852847 - RNA, 21 nt, Human
ucaauaguguccuaugcaaua

SEQ ID NO: 2852848 - RNA, 14 nt, Human
ucaauaguucaagg

SEQ ID NO: 2852849 - RNA, 17 nt, Human
ucaauaguucaaggaac

SEQ ID NO: 2852850 - RNA, 18 nt, Human
ucaauaguucaaggaacu

SEQ ID NO: 2852851 - RNA, 17 nt, Human
ucaagaaaacaacuuca

SEQ ID NO: 2852852 - RNA, 22 nt, Human
ucaaguccucuuuucugagagg

SEQ ID NO: 2852853 - RNA, 19 nt, Human
ucaagucucugcuggccca

SEQ ID NO: 2852854 - RNA, 17 nt, Human
ucaagucucugcuggcc

SEQ ID NO: 2852855 - RNA, 16 nt, Human
ucaagucucugcuggc

SEQ ID NO: 2852856 - RNA, 14 nt, Human
ucaagucucugcug

SEQ ID NO: 2852857 - RNA, 12 nt, Human
ucaacuuaacau

SEQ ID NO: 2852858 - RNA, 13 nt, Human
ucaacuuaacaug

SEQ ID NO: 2852859 - RNA, 19 nt, Human
ucaacuugcauccaacucc

SEQ ID NO: 2852860 - RNA, 23 nt, Human
ucaacuuucuguuggauuccaug

SEQ ID NO: 2852861 - RNA, 16 nt, Human
ucaagaaaaaauaaau

SEQ ID NO: 2852862 - RNA, 18 nt, Human
ucaagaaaaaauaaaugg

SEQ ID NO: 2852863 - RNA, 23 nt, Human
ucaagaaaaaauaaauggaaauc

SEQ ID NO: 2852864 - RNA, 22 nt, Human
ucaaugaaaaauagugucuuug

SEQ ID NO: 2852865 - RNA, 15 nt, Human
ucaaugaagccagcu

SEQ ID NO: 2852866 - RNA, 16 nt, Human
ucaaugaagccagcuc

SEQ ID NO: 2852867 - RNA, 21 nt, Human
ucaaugaagccagcucacagu

SEQ ID NO: 2852868 - RNA, 15 nt, Human
ucaaugaauauugaa

SEQ ID NO: 2852869 - RNA, 19 nt, Human
acauucuuccaaaaagauu

SEQ ID NO: 2852870 - RNA, 11 nt, Human
acauucuugua

SEQ ID NO: 2852871 - RNA, 19 nt, Human
acauucuuuuaacuucuuu

SEQ ID NO: 2852872 - RNA, 20 nt, Human
acauucuuuuaacuucuuuc

SEQ ID NO: 2852873 - RNA, 21 nt, Human
acauucuuuuaacuucuuucu

SEQ ID NO: 2852874 - RNA, 14 nt, Human
ucaauccucuaagc

SEQ ID NO: 2852875 - RNA, 18 nt, Human
ucaaucucaauccugcag

SEQ ID NO: 2852876 - RNA, 20 nt, Human
ucaaucucccgcugcugcug

SEQ ID NO: 2852877 - RNA, 18 nt, Human
ucaaucucccgcugcugc

SEQ ID NO: 2852878 - RNA, 13 nt, Human
accaaagaugcag

SEQ ID NO: 2852879 - RNA, 16 nt, Human
accaaaaugacaucuu

SEQ ID NO: 2852880 - RNA, 22 nt, Human
accaaaaugacaucuuuuuaaa

SEQ ID NO: 2852881 - RNA, 21 nt, Human
accaaaaugauacuuacugaa

SEQ ID NO: 2852882 - RNA, 13 nt, Human
accaaacaauuau

SEQ ID NO: 2852883 - RNA, 14 nt, Human
accaaacaauuauu

SEQ ID NO: 2852884 - RNA, 16 nt, Human
accaaacaauuauuua

SEQ ID NO: 2852885 - RNA, 21 nt, Human
accaaacagcaaaccaagaga

SEQ ID NO: 2852886 - RNA, 12 nt, Human
accaaaacugug

SEQ ID NO: 2852887 - RNA, 15 nt, Human
accaaaagaacaaga

SEQ ID NO: 2852888 - RNA, 17 nt, Human
accaaaacugugcagag

SEQ ID NO: 2852889 - RNA, 18 nt, Human
accaaaacugugcagagu

SEQ ID NO: 2852890 - RNA, 17 nt, Human
accaaaagaauuugcac

SEQ ID NO: 2852891 - RNA, 12 nt, Human
acauuuuuuaaa

SEQ ID NO: 2852892 - RNA, 22 nt, Human
acauuuucagaaauauucauga

SEQ ID NO: 2852893 - RNA, 14 nt, Human
acauuuucagccaa

SEQ ID NO: 2852894 - RNA, 14 nt, Human
acauuguugagcua

SEQ ID NO: 2852895 - RNA, 12 nt, Human
acauuuugagaa

SEQ ID NO: 2852896 - RNA, 15 nt, Human
acauuuugagaacaa

SEQ ID NO: 2852897 - RNA, 19 nt, Human
acauuuugagaacaaagau

SEQ ID NO: 2852898 - RNA, 17 nt, Human
acauugacgauuccuuc

SEQ ID NO: 2852899 - RNA, 19 nt, Human
acauugacgauuccuucuc

SEQ ID NO: 2852900 - RNA, 20 nt, Human
acauugacgauuccuucucu

SEQ ID NO: 2852901 - RNA, 22 nt, Human
acauugacgauuccuucucuga

SEQ ID NO: 2852902 - RNA, 16 nt, Human
acauugagcugauaua

SEQ ID NO: 2852903 - RNA, 20 nt, Human
acauugagcugauauaaauu

SEQ ID NO: 2852904 - RNA, 23 nt, Human
acauugagcugauauaaauucug

SEQ ID NO: 2852905 - RNA, 14 nt, Human
acauugaguagaca

SEQ ID NO: 2852906 - RNA, 22 nt, Human
acauugaguagacacauuuaag

SEQ ID NO: 2852907 - RNA, 16 nt, Human
acauugauucagccug

SEQ ID NO: 2852908 - RNA, 11 nt, Human
acauugcauuc

SEQ ID NO: 2852909 - RNA, 14 nt, Human
acauugcauucuau

SEQ ID NO: 2852910 - RNA, 15 nt, Human
acauugcauucuauu

SEQ ID NO: 2852911 - RNA, 16 nt, Human
acauugcauucuauug

SEQ ID NO: 2852912 - RNA, 17 nt, Human
acauugcauucuauugc

SEQ ID NO: 2852913 - RNA, 19 nt, Human
acauugcauucuauugccu

SEQ ID NO: 2852914 - RNA, 22 nt, Human
acauugcauucuauugccuucu

SEQ ID NO: 2852915 - RNA, 14 nt, Human
acauugccaaaaag

SEQ ID NO: 2852916 - RNA, 17 nt, Human
acauugccaaaaaggau

SEQ ID NO: 2852917 - RNA, 23 nt, Human
acauugccaaaaaggauacauaa

SEQ ID NO: 2852918 - RNA, 12 nt, Human
acauugccuuug

SEQ ID NO: 2852919 - RNA, 16 nt, Human
acauugccuuugaaug

SEQ ID NO: 2852920 - RNA, 17 nt, Human
acauugccuuugaaugu

SEQ ID NO: 2852921 - RNA, 18 nt, Human
acauugccuuugaauguu

SEQ ID NO: 2852922 - RNA, 23 nt, Human
acauugccuuugaauguuaauuu

SEQ ID NO: 2852923 - RNA, 16 nt, Human
acauuguguugacauu

SEQ ID NO: 2852924 - RNA, 15 nt, Human
acauuguuauuuuca

SEQ ID NO: 2852925 - RNA, 17 nt, Human
acauuguuauuuucagu

SEQ ID NO: 2852926 - RNA, 12 nt, Human
acauugucugcg

SEQ ID NO: 2852927 - RNA, 22 nt, Human
acauugugauguauauuccuuu

SEQ ID NO: 2852928 - RNA, 13 nt, Human
acauuguucaccu

SEQ ID NO: 2852929 - RNA, 21 nt, Human
acauuguucaccuuuguagca

SEQ ID NO: 2852930 - RNA, 17 nt, Human
acauuguugagcuauug

SEQ ID NO: 2852931 - RNA, 15 nt, Human
acauuguugcucccu

SEQ ID NO: 2852932 - RNA, 21 nt, Human
acauuguugcucccugugaca

SEQ ID NO: 2852933 - RNA, 14 nt, Human
acauuguuguuuuu

SEQ ID NO: 2852934 - RNA, 20 nt, Human
acauuguuguuuuuuuaaua

SEQ ID NO: 2852935 - RNA, 15 nt, Human
acauucugaugagca

SEQ ID NO: 2852936 - RNA, 16 nt, Human
acauucugaugagcaa

SEQ ID NO: 2852937 - RNA, 16 nt, Human
acauucugauuuggaa

SEQ ID NO: 2852938 - RNA, 22 nt, Human
ucaaauuuagaaacuaauugac

SEQ ID NO: 2852939 - RNA, 23 nt, Human
ucaaauuuagaaacuaauugacu

SEQ ID NO: 2852940 - RNA, 14 nt, Human
acauucucuaauaa

SEQ ID NO: 2852941 - RNA, 16 nt, Human
acauucucuaauaaga

SEQ ID NO: 2852942 - RNA, 18 nt, Human
acauucucuaauaagaaa

SEQ ID NO: 2852943 - RNA, 19 nt, Human
acauucucuaauaagaaaa

SEQ ID NO: 2852944 - RNA, 20 nt, Human
acauucucuaauaagaaaac

SEQ ID NO: 2852945 - RNA, 17 nt, Human
acauuccuugccugcac

SEQ ID NO: 2852946 - RNA, 18 nt, Human
acauuccuugccugcaca

SEQ ID NO: 2852947 - RNA, 14 nt, Human
acauuccuaaaaug

SEQ ID NO: 2852948 - RNA, 17 nt, Human
acauucccaucugucac

SEQ ID NO: 2852949 - RNA, 17 nt, Human
acauuccccuggggacc

SEQ ID NO: 2852950 - RNA, 19 nt, Human
acauuccccuggggaccca

SEQ ID NO: 2852951 - RNA, 22 nt, Human
acauuccccuggggacccacgu

SEQ ID NO: 2852952 - RNA, 18 nt, Human
acauggugccccuagcuu

SEQ ID NO: 2852953 - RNA, 19 nt, Human
acauggugccccuagcuuu

SEQ ID NO: 2852954 - RNA, 18 nt, Human
acauguaauauaaagaug

SEQ ID NO: 2852955 - RNA, 12 nt, Human
ucaaauuucaca

SEQ ID NO: 2852956 - RNA, 14 nt, Human
ucaacaaagaaaua

SEQ ID NO: 2852957 - RNA, 15 nt, Human
ucaacaaagaaauau

SEQ ID NO: 2852958 - RNA, 16 nt, Human
ucaacaaagaaauauu

SEQ ID NO: 2852959 - RNA, 18 nt, Human
ucaacaaagaaauauuau

SEQ ID NO: 2852960 - RNA, 21 nt, Human
ucaacaaagaaauauuauuug

SEQ ID NO: 2852961 - RNA, 20 nt, Human
ucaaauuuuuuaaaagagac

SEQ ID NO: 2852962 - RNA, 21 nt, Human
ucaaauuuuuuaaaagagaca

SEQ ID NO: 2852963 - RNA, 20 nt, Human
ucaacaagauuuccuugugc

SEQ ID NO: 2852964 - RNA, 22 nt, Human
ucaacaagauuuccuugugcaa

SEQ ID NO: 2852965 - RNA, 13 nt, Human
ucaacaagccuga

SEQ ID NO: 2852966 - RNA, 14 nt, Human
ucaacauuuacaug

SEQ ID NO: 2852967 - RNA, 14 nt, Human
ucaacaaagcacag

SEQ ID NO: 2852968 - RNA, 15 nt, Human
ucaacaaagcacagu

SEQ ID NO: 2852969 - RNA, 18 nt, Human
ucaacaaagcacaguguu

SEQ ID NO: 2852970 - RNA, 23 nt, Human
ucaacaaagcacaguguuaaaug

SEQ ID NO: 2852971 - RNA, 17 nt, Human
ucaaccaaugccaaaaa

SEQ ID NO: 2852972 - RNA, 17 nt, Human
ucaacauuuacauguau

SEQ ID NO: 2852973 - RNA, 16 nt, Human
ucaacauuuacaugua

SEQ ID NO: 2852974 - RNA, 12 nt, Human
ucaaccagacag

SEQ ID NO: 2852975 - RNA, 13 nt, Human
ucaaccagacaga

SEQ ID NO: 2852976 - RNA, 14 nt, Human
ucaaccagacagag

SEQ ID NO: 2852977 - RNA, 19 nt, Human
ucaaccagacagaggguca

SEQ ID NO: 2852978 - RNA, 22 nt, Human
ucaaccagacagagggucacag

SEQ ID NO: 2852979 - RNA, 13 nt, Human
ucaaccagauaac

SEQ ID NO: 2852980 - RNA, 15 nt, Human
ucaaccauuccccau

SEQ ID NO: 2852981 - RNA, 13 nt, Human
ucaaccauccugg

SEQ ID NO: 2852982 - RNA, 15 nt, Human
ucaaccauggacuuu

SEQ ID NO: 2852983 - RNA, 18 nt, Human
ucaaccauuccccauggg

SEQ ID NO: 2852984 - RNA, 20 nt, Human
ucaaccccaccacuucuuuu

SEQ ID NO: 2852985 - RNA, 17 nt, Human
ucaaccauggacuuuau

SEQ ID NO: 2852986 - RNA, 13 nt, Human
ucaaccccacccu

SEQ ID NO: 2852987 - RNA, 18 nt, Human
ucaaccccacccuguuug

SEQ ID NO: 2852988 - RNA, 18 nt, Human
ucaacugggcucuguccc

SEQ ID NO: 2852989 - RNA, 24 nt, Human
ucaacugaccagccuccaugcugc

SEQ ID NO: 2852990 - RNA, 15 nt, Human
acaugcuucaauagu

SEQ ID NO: 2852991 - RNA, 23 nt, Human
acaugcuucaauaguucaaggaa

SEQ ID NO: 2852992 - RNA, 20 nt, Human
acaugaaucccacccacaug

SEQ ID NO: 2852993 - RNA, 21 nt, Human
acaugaaucccacccacaugu

SEQ ID NO: 2852994 - RNA, 23 nt, Human
acaugaaucccacccacauguga

SEQ ID NO: 2852995 - RNA, 14 nt, Human
acaguccagccugg

SEQ ID NO: 2852996 - RNA, 15 nt, Human
acaguccagccugga

SEQ ID NO: 2852997 - RNA, 21 nt, Human
acaugaaguguguuuccuuca

SEQ ID NO: 2852998 - RNA, 15 nt, Human
acaugaauacaaauu

SEQ ID NO: 2852999 - RNA, 19 nt, Human
acaugaaguguguuuccuu

SEQ ID NO: 2853000 - RNA, 18 nt, Human
acaguccagccuggagau

SEQ ID NO: 2853001 - RNA, 18 nt, Human
acaguccaggaacaagcu

SEQ ID NO: 2853002 - RNA, 15 nt, Human
acagucccacugugc

SEQ ID NO: 2853003 - RNA, 19 nt, Human
acagucccacugugcaggu

SEQ ID NO: 2853004 - RNA, 16 nt, Human
acaguccagccuggag

SEQ ID NO: 2853005 - RNA, 17 nt, Human
acagucccuaaagaaaa

SEQ ID NO: 2853006 - RNA, 18 nt, Human
acauggcuuucagaaaac

SEQ ID NO: 2853007 - RNA, 22 nt, Human
acaugggaaaggaggcaugccu

SEQ ID NO: 2853008 - RNA, 15 nt, Human
acauggaaacccaua

SEQ ID NO: 2853009 - RNA, 21 nt, Human
acauggaaacccauaggccca

SEQ ID NO: 2853010 - RNA, 21 nt, Human
acaugguaaacgcugucccua

SEQ ID NO: 2853011 - RNA, 14 nt, Human
acaugguacucuug

SEQ ID NO: 2853012 - RNA, 20 nt, Human
acaugguacucuuguugagu

SEQ ID NO: 2853013 - RNA, 23 nt, Human
acaugguacucuuguugaguucu

SEQ ID NO: 2853014 - RNA, 20 nt, Human
acauggggaguguuucaugg

SEQ ID NO: 2853015 - RNA, 18 nt, Human
acauggggaaaaaaauca

SEQ ID NO: 2853016 - RNA, 13 nt, Human
acaugggagcagu

SEQ ID NO: 2853017 - RNA, 20 nt, Human
acaugggagcaguccaugca

SEQ ID NO: 2853018 - RNA, 23 nt, Human
acaugggagcaguccaugcauga

SEQ ID NO: 2853019 - RNA, 22 nt, Human
ucauaaaaagccugcaauuuca

SEQ ID NO: 2853020 - RNA, 17 nt, Human
ucaguuuuuuguuuuac

SEQ ID NO: 2853021 - RNA, 18 nt, Human
ucaguuuuuuguuuuaca

SEQ ID NO: 2853022 - RNA, 20 nt, Human
ucaguuuuuuguuuuacaau

SEQ ID NO: 2853023 - RNA, 13 nt, Human
ucaguuuucauuu

SEQ ID NO: 2853024 - RNA, 12 nt, Human
ucaguuuucauu

SEQ ID NO: 2853025 - RNA, 17 nt, Human
ucagugggcaggauaaa

SEQ ID NO: 2853026 - RNA, 19 nt, Human
ucagugggcaggauaaacu

SEQ ID NO: 2853027 - RNA, 15 nt, Human
ucagugcuucgcaga

SEQ ID NO: 2853028 - RNA, 11 nt, Human
ucaguggcagc

SEQ ID NO: 2853029 - RNA, 12 nt, Human
ucaguggagcca

SEQ ID NO: 2853030 - RNA, 12 nt, Human
ucaguggcagcu

SEQ ID NO: 2853031 - RNA, 17 nt, Human
ucaguggcgagaaauaa

SEQ ID NO: 2853032 - RNA, 17 nt, Human
ucaguggcuucaucugu

SEQ ID NO: 2853033 - RNA, 20 nt, Human
ucaguggcuucaucugucaa

SEQ ID NO: 2853034 - RNA, 16 nt, Human
ucaguggggaggggcu

SEQ ID NO: 2853035 - RNA, 12 nt, Human
ucagugccacua

SEQ ID NO: 2853036 - RNA, 23 nt, Human
ucaguaugcugccccugucuugc

SEQ ID NO: 2853037 - RNA, 15 nt, Human
ucaguauguauucuu

SEQ ID NO: 2853038 - RNA, 16 nt, Human
ucaguauguauucuuu

SEQ ID NO: 2853039 - RNA, 13 nt, Human
ucaguauccaggc

SEQ ID NO: 2853040 - RNA, 17 nt, Human
ucaguauccaggcuuug

SEQ ID NO: 2853041 - RNA, 17 nt, Human
ucaguauccaugcucuu

SEQ ID NO: 2853042 - RNA, 20 nt, Human
ucaguauccaugcucuugac

SEQ ID NO: 2853043 - RNA, 20 nt, Human
ucagugcccuccaggauaga

SEQ ID NO: 2853044 - RNA, 18 nt, Human
ucagugccaacuguggcu

SEQ ID NO: 2853045 - RNA, 19 nt, Human
ucagugccaacuguggcug

SEQ ID NO: 2853046 - RNA, 20 nt, Human
ucagugccaacuguggcugg

SEQ ID NO: 2853047 - RNA, 21 nt, Human
ucagugccaacuguggcuggu

SEQ ID NO: 2853048 - RNA, 21 nt, Human
ucauaguaugguggcuggguu

SEQ ID NO: 2853049 - RNA, 13 nt, Human
ucauaguuaacau

SEQ ID NO: 2853050 - RNA, 14 nt, Human
ucauaguuaacaua

SEQ ID NO: 2853051 - RNA, 15 nt, Human
ucauauacugccaug

SEQ ID NO: 2853052 - RNA, 14 nt, Human
ucauaaccuagccu

SEQ ID NO: 2853053 - RNA, 20 nt, Human
acccugcccuugacaucugg

SEQ ID NO: 2853054 - RNA, 12 nt, Human
ucauaaaauaaa

SEQ ID NO: 2853055 - RNA, 15 nt, Human
ucauaaaaacugcuu

SEQ ID NO: 2853056 - RNA, 19 nt, Human
ucauaguaugguggcuggg

SEQ ID NO: 2853057 - RNA, 18 nt, Human
ucauaguaugguggcugg

SEQ ID NO: 2853058 - RNA, 15 nt, Human
ucauaguaugguggc

SEQ ID NO: 2853059 - RNA, 14 nt, Human
ucauaguaguuuuu

SEQ ID NO: 2853060 - RNA, 16 nt, Human
ucauaguaguuuuuac

SEQ ID NO: 2853061 - RNA, 18 nt, Human
ucauaguaguuuuuacag

SEQ ID NO: 2853062 - RNA, 22 nt, Human
ucauaguaguuuuuacagcugu

SEQ ID NO: 2853063 - RNA, 12 nt, Human
ucauauuuaaag

SEQ ID NO: 2853064 - RNA, 19 nt, Human
ucauauuuaaagacaggga

SEQ ID NO: 2853065 - RNA, 14 nt, Human
ucauauugugccaa

SEQ ID NO: 2853066 - RNA, 15 nt, Human
ucauauugugccaau

SEQ ID NO: 2853067 - RNA, 20 nt, Human
ucauauugugccaauaugua

SEQ ID NO: 2853068 - RNA, 22 nt, Human
ucauauugugccaauauguauu

SEQ ID NO: 2853069 - RNA, 19 nt, Human
ucauauugaauguuuccaa

SEQ ID NO: 2853070 - RNA, 13 nt, Human
ucauauugaugaa

SEQ ID NO: 2853071 - RNA, 14 nt, Human
ucauauugaugaaa

SEQ ID NO: 2853072 - RNA, 15 nt, Human
ucauauugaugaaaa

SEQ ID NO: 2853073 - RNA, 16 nt, Human
ucauauugaugaaaag

SEQ ID NO: 2853074 - RNA, 18 nt, Human
ucauauugaugaaaagau

SEQ ID NO: 2853075 - RNA, 19 nt, Human
ucauauugaugaaaagauu

SEQ ID NO: 2853076 - RNA, 21 nt, Human
ucauauugaugaaaagauuua

SEQ ID NO: 2853077 - RNA, 18 nt, Human
ucauauuggaaaaaucac

SEQ ID NO: 2853078 - RNA, 21 nt, Human
ucauaucaucacauugagcug

SEQ ID NO: 2853079 - RNA, 20 nt, Human
ucauaugacauucaugccug

SEQ ID NO: 2853080 - RNA, 16 nt, Human
ucauaaauuuacuuua

SEQ ID NO: 2853081 - RNA, 22 nt, Human
ucauauccuucuuacacgacua

SEQ ID NO: 2853082 - RNA, 14 nt, Human
ucauauugaauaua

SEQ ID NO: 2853083 - RNA, 12 nt, Human
ucauauugaaua

SEQ ID NO: 2853084 - RNA, 22 nt, Human
ucauauuuaguauugaauacuu

SEQ ID NO: 2853085 - RNA, 18 nt, Human
accgcacagcucaggagg

SEQ ID NO: 2853086 - RNA, 17 nt, Human
accgcacaugcacacac

SEQ ID NO: 2853087 - RNA, 14 nt, Human
accgcacagcucag

SEQ ID NO: 2853088 - RNA, 17 nt, Human
accgagucucuucucca

SEQ ID NO: 2853089 - RNA, 15 nt, Human
accgaggacaugaaa

SEQ ID NO: 2853090 - RNA, 16 nt, Human
accgagucucuucucc

SEQ ID NO: 2853091 - RNA, 14 nt, Human
ucaugcauaaauau

SEQ ID NO: 2853092 - RNA, 15 nt, Human
ucaugcauaaauaug

SEQ ID NO: 2853093 - RNA, 19 nt, Human
ucaugcauaaauaugcagu

SEQ ID NO: 2853094 - RNA, 19 nt, Human
ucaugcagcucaacuuucu

SEQ ID NO: 2853095 - RNA, 17 nt, Human
ucaugcaaaggcuggga

SEQ ID NO: 2853096 - RNA, 20 nt, Human
ucaugcauaaauaugcagug

SEQ ID NO: 2853097 - RNA, 22 nt, Human
ucaugaaaguagacaguuuuga

SEQ ID NO: 2853098 - RNA, 19 nt, Human
ucauguggaauauaaagau

SEQ ID NO: 2853099 - RNA, 18 nt, Human
ucauguggaauauaaaga

SEQ ID NO: 2853100 - RNA, 15 nt, Human
ucauguuuauaacua

SEQ ID NO: 2853101 - RNA, 23 nt, Human
ucauguuuauaacuauucaguug

SEQ ID NO: 2853102 - RNA, 14 nt, Human
ucauguuuaugaaa

SEQ ID NO: 2853103 - RNA, 15 nt, Human
ucauguuuaugaaaa

SEQ ID NO: 2853104 - RNA, 16 nt, Human
ucauguuuaugaaaau

SEQ ID NO: 2853105 - RNA, 17 nt, Human
ucauguuuaugaaaaua

SEQ ID NO: 2853106 - RNA, 22 nt, Human
ucauguuuaugaaaauaaauag

SEQ ID NO: 2853107 - RNA, 14 nt, Human
ucauguuugcuuca

SEQ ID NO: 2853108 - RNA, 20 nt, Human
ucauguuugcuucauaaaug

SEQ ID NO: 2853109 - RNA, 21 nt, Human
ucauguuuuaaagcuugcuca

SEQ ID NO: 2853110 - RNA, 22 nt, Human
ucauguuuuaaauguacaguuu

SEQ ID NO: 2853111 - RNA, 15 nt, Human
ucauguuugcuucau

SEQ ID NO: 2853112 - RNA, 17 nt, Human
ucauguuugcuucauaa

SEQ ID NO: 2853113 - RNA, 21 nt, Human
ucauguuugcuucauaaauga

SEQ ID NO: 2853114 - RNA, 11 nt, Human
ucauguuuggu

SEQ ID NO: 2853115 - RNA, 19 nt, Human
ucauguuuggugcauagaa

SEQ ID NO: 2853116 - RNA, 21 nt, Human
ucauguuuggugcauagaacu

SEQ ID NO: 2853117 - RNA, 22 nt, Human
ucauguuuggugcauagaacug

SEQ ID NO: 2853118 - RNA, 18 nt, Human
ucaucuagcgcaauugaa

SEQ ID NO: 2853119 - RNA, 14 nt, Human
ucaugaaauaugca

SEQ ID NO: 2853120 - RNA, 15 nt, Human
ucaugaaauaugcau

SEQ ID NO: 2853121 - RNA, 11 nt, Human
ucaugauuuuu

SEQ ID NO: 2853122 - RNA, 16 nt, Human
ucaugauuuauaaaug

SEQ ID NO: 2853123 - RNA, 13 nt, Human
ucaugauuuauaa

SEQ ID NO: 2853124 - RNA, 22 nt, Human
ucaugauucacccccaaacagu

SEQ ID NO: 2853125 - RNA, 20 nt, Human
ucauccaggcccaacuguga

SEQ ID NO: 2853126 - RNA, 11 nt, Human
accuccugccu

SEQ ID NO: 2853127 - RNA, 14 nt, Human
ucauccagggcucu

SEQ ID NO: 2853128 - RNA, 21 nt, Human
ucauccagggcucugaccagu

SEQ ID NO: 2853129 - RNA, 13 nt, Human
ucauccauccagg

SEQ ID NO: 2853130 - RNA, 17 nt, Human
ucaucgcucguguguuc

SEQ ID NO: 2853131 - RNA, 23 nt, Human
ucaucgcucguguguucuaucca

SEQ ID NO: 2853132 - RNA, 22 nt, Human
ucaucggagucagccaggagcu

SEQ ID NO: 2853133 - RNA, 15 nt, Human
ucaucggcuuucccc

SEQ ID NO: 2853134 - RNA, 14 nt, Human
ucaucgccagaggu

SEQ ID NO: 2853135 - RNA, 15 nt, Human
ucaucgccagaggug

SEQ ID NO: 2853136 - RNA, 21 nt, Human
ucaucgccagaggugcuucac

SEQ ID NO: 2853137 - RNA, 21 nt, Human
ucaucgaaucuacuaauucca

SEQ ID NO: 2853138 - RNA, 14 nt, Human
ucaucgaaucuacu

SEQ ID NO: 2853139 - RNA, 18 nt, Human
ucaucgaaaauucauuuc

SEQ ID NO: 2853140 - RNA, 19 nt, Human
ucaucgaaaauucauuuca

SEQ ID NO: 2853141 - RNA, 21 nt, Human
ucaucgaaaauucauuucaca

SEQ ID NO: 2853142 - RNA, 22 nt, Human
ucaucgaaaauucauuucacau

SEQ ID NO: 2853143 - RNA, 13 nt, Human
ucaucccagcccc

SEQ ID NO: 2853144 - RNA, 14 nt, Human
ucaucccagcccca

SEQ ID NO: 2853145 - RNA, 21 nt, Human
ucaucccaucuaagcugcagc

SEQ ID NO: 2853146 - RNA, 13 nt, Human
accuccaugacag

SEQ ID NO: 2853147 - RNA, 16 nt, Human
accuccauuaaagucu

SEQ ID NO: 2853148 - RNA, 18 nt, Human
accuccauuaaagucuga

SEQ ID NO: 2853149 - RNA, 19 nt, Human
accuccauuaaagucugaa

SEQ ID NO: 2853150 - RNA, 20 nt, Human
accuccauuaaagucugaau

SEQ ID NO: 2853151 - RNA, 21 nt, Human
accuccauucuauuuuagaau

SEQ ID NO: 2853152 - RNA, 12 nt, Human
accucccagagg

SEQ ID NO: 2853153 - RNA, 13 nt, Human
accucccagaggu

SEQ ID NO: 2853154 - RNA, 14 nt, Human
accucccagagguc

SEQ ID NO: 2853155 - RNA, 16 nt, Human
accucccagaggucca

SEQ ID NO: 2853156 - RNA, 17 nt, Human
accucccagagguccag

SEQ ID NO: 2853157 - RNA, 19 nt, Human
accucccagagguccagcc

SEQ ID NO: 2853158 - RNA, 20 nt, Human
accucccagagguccagccc

SEQ ID NO: 2853159 - RNA, 21 nt, Human
accucccagagguccagccca

SEQ ID NO: 2853160 - RNA, 22 nt, Human
accucccagagguccagcccau

SEQ ID NO: 2853161 - RNA, 23 nt, Human
accucccagagguccagcccauc

SEQ ID NO: 2853162 - RNA, 11 nt, Human
accuccccacg

SEQ ID NO: 2853163 - RNA, 14 nt, Human
accuccccacgccc

SEQ ID NO: 2853164 - RNA, 19 nt, Human
accuccccacgcccucccc

SEQ ID NO: 2853165 - RNA, 20 nt, Human
accuccccacgcccuccccu

SEQ ID NO: 2853166 - RNA, 21 nt, Human
accuccccacgcccuccccuc

SEQ ID NO: 2853167 - RNA, 22 nt, Human
accuccccacgcccuccccucc

SEQ ID NO: 2853168 - RNA, 18 nt, Human
accuccagucccccuauc

SEQ ID NO: 2853169 - RNA, 16 nt, Human
accuccagcccgggag

SEQ ID NO: 2853170 - RNA, 17 nt, Human
accuccagcccgggagc

SEQ ID NO: 2853171 - RNA, 19 nt, Human
accuccagcccgggagccu

SEQ ID NO: 2853172 - RNA, 21 nt, Human
accuccagcccgggagccuag

SEQ ID NO: 2853173 - RNA, 22 nt, Human
accuccagcccgggagccuagg

SEQ ID NO: 2853174 - RNA, 14 nt, Human
accucacucuuuau

SEQ ID NO: 2853175 - RNA, 16 nt, Human
accucacucuuuauag

SEQ ID NO: 2853176 - RNA, 17 nt, Human
accucacucuuuauagu

SEQ ID NO: 2853177 - RNA, 12 nt, Human
accuccccagcc

SEQ ID NO: 2853178 - RNA, 13 nt, Human
accuccccagccc

SEQ ID NO: 2853179 - RNA, 13 nt, Human
accuccccugccu

SEQ ID NO: 2853180 - RNA, 14 nt, Human
accuccccugccuu

SEQ ID NO: 2853181 - RNA, 15 nt, Human
accuccccugccuug

SEQ ID NO: 2853182 - RNA, 16 nt, Human
accuccccugccuugc

SEQ ID NO: 2853183 - RNA, 17 nt, Human
accuccccugccuugcu

SEQ ID NO: 2853184 - RNA, 20 nt, Human
accuccccugccuugcuguu

SEQ ID NO: 2853185 - RNA, 14 nt, Human
accuccucuucccc

SEQ ID NO: 2853186 - RNA, 15 nt, Human
accuccucuuccccc

SEQ ID NO: 2853187 - RNA, 12 nt, Human
accuccucucag

SEQ ID NO: 2853188 - RNA, 16 nt, Human
accuccucucaguguu

SEQ ID NO: 2853189 - RNA, 17 nt, Human
accuccucucaguguuu

SEQ ID NO: 2853190 - RNA, 22 nt, Human
accuagaaauugacacaagugg

SEQ ID NO: 2853191 - RNA, 20 nt, Human
accuagaagaagcuauguca

SEQ ID NO: 2853192 - RNA, 23 nt, Human
accuacuguucuaaagcucugac

SEQ ID NO: 2853193 - RNA, 15 nt, Human
accuacuguucuaaa

SEQ ID NO: 2853194 - RNA, 16 nt, Human
accuacuguucuaaag

SEQ ID NO: 2853195 - RNA, 17 nt, Human
accuacuguucuaaagc

SEQ ID NO: 2853196 - RNA, 18 nt, Human
accuacuguucuaaagcu

SEQ ID NO: 2853197 - RNA, 20 nt, Human
accuacuguucuaaagcucu

SEQ ID NO: 2853198 - RNA, 21 nt, Human
accuacuguucuaaagcucug

SEQ ID NO: 2853199 - RNA, 19 nt, Human
accuaggcaguaggccggu

SEQ ID NO: 2853200 - RNA, 22 nt, Human
accuagagaacaggugguuuuu

SEQ ID NO: 2853201 - RNA, 13 nt, Human
accuagagaagau

SEQ ID NO: 2853202 - RNA, 17 nt, Human
accuagagaagauaauu

SEQ ID NO: 2853203 - RNA, 20 nt, Human
accuagagacuucacccggg

SEQ ID NO: 2853204 - RNA, 13 nt, Human
accuagagccaga

SEQ ID NO: 2853205 - RNA, 15 nt, Human
accuagagccagacc

SEQ ID NO: 2853206 - RNA, 16 nt, Human
accucaaaaugucuaa

SEQ ID NO: 2853207 - RNA, 22 nt, Human
accucaccccgaggcccugcau

SEQ ID NO: 2853208 - RNA, 23 nt, Human
accucaccccgaggcccugcaug

SEQ ID NO: 2853209 - RNA, 20 nt, Human
accucaccccguuacagcuc

SEQ ID NO: 2853210 - RNA, 22 nt, Human
accucaccccguuacagcuccc

SEQ ID NO: 2853211 - RNA, 17 nt, Human
accuauuugacuuacca

SEQ ID NO: 2853212 - RNA, 12 nt, Human
accuauuuccau

SEQ ID NO: 2853213 - RNA, 14 nt, Human
accucaccuagaaa

SEQ ID NO: 2853214 - RNA, 15 nt, Human
accucaccuagaaau

SEQ ID NO: 2853215 - RNA, 12 nt, Human
accucacccugc

SEQ ID NO: 2853216 - RNA, 14 nt, Human
accucacccugcua

SEQ ID NO: 2853217 - RNA, 15 nt, Human
accuaggggcgccgc

SEQ ID NO: 2853218 - RNA, 20 nt, Human
accuaggcucauggacgaga

SEQ ID NO: 2853219 - RNA, 20 nt, Human
acccggccccugcugguuca

SEQ ID NO: 2853220 - RNA, 17 nt, Human
acccggccccugcuggu

SEQ ID NO: 2853221 - RNA, 22 nt, Human
acccggccccugcugguucagg

SEQ ID NO: 2853222 - RNA, 13 nt, Human
acccggcuaauuu

SEQ ID NO: 2853223 - RNA, 16 nt, Human
acccggccccugcugg

SEQ ID NO: 2853224 - RNA, 15 nt, Human
acccggccccugcug

SEQ ID NO: 2853225 - RNA, 14 nt, Human
acccggccccugcu

SEQ ID NO: 2853226 - RNA, 18 nt, Human
acccggaggggccuggca

SEQ ID NO: 2853227 - RNA, 21 nt, Human
acccggaggggccuggcagcc

SEQ ID NO: 2853228 - RNA, 22 nt, Human
ucagguaacaggcagauacagg

SEQ ID NO: 2853229 - RNA, 21 nt, Human
ucagguaacaggcagauacag

SEQ ID NO: 2853230 - RNA, 23 nt, Human
ucagguaacaggcagauacagga

SEQ ID NO: 2853231 - RNA, 15 nt, Human
acccggaggggccug

SEQ ID NO: 2853232 - RNA, 16 nt, Human
ucagggggaagaagca

SEQ ID NO: 2853233 - RNA, 17 nt, Human
ucagggggaagaagcag

SEQ ID NO: 2853234 - RNA, 19 nt, Human
ucagggggaagaagcagag

SEQ ID NO: 2853235 - RNA, 22 nt, Human
ucagggggaagaagcagagaga

SEQ ID NO: 2853236 - RNA, 16 nt, Human
ucaggguuggccccug

SEQ ID NO: 2853237 - RNA, 18 nt, Human
ucagggucucugcugccg

SEQ ID NO: 2853238 - RNA, 12 nt, Human
ucagggucucug

SEQ ID NO: 2853239 - RNA, 16 nt, Human
ucagggucucugcugc

SEQ ID NO: 2853240 - RNA, 17 nt, Human
ucagggucucugcugcc

SEQ ID NO: 2853241 - RNA, 16 nt, Human
ucaggggacucagccc

SEQ ID NO: 2853242 - RNA, 15 nt, Human
accccaucgccaacu

SEQ ID NO: 2853243 - RNA, 17 nt, Human
ucaggggaaaacuguua

SEQ ID NO: 2853244 - RNA, 18 nt, Human
ucaggggacucagcccug

SEQ ID NO: 2853245 - RNA, 12 nt, Human
ucaggggccaga

SEQ ID NO: 2853246 - RNA, 14 nt, Human
ucaggggccagagg

SEQ ID NO: 2853247 - RNA, 15 nt, Human
ucaggggccagagga

SEQ ID NO: 2853248 - RNA, 16 nt, Human
ucaggggccagaggaa

SEQ ID NO: 2853249 - RNA, 17 nt, Human
ucaggggcugacacuuc

SEQ ID NO: 2853250 - RNA, 22 nt, Human
ucagcuuguaaauagcucaggu

SEQ ID NO: 2853251 - RNA, 21 nt, Human
ucagcuuguaaauagcucagg

SEQ ID NO: 2853252 - RNA, 14 nt, Human
ucagcuccagcuca

SEQ ID NO: 2853253 - RNA, 15 nt, Human
ucagcuuugagaagc

SEQ ID NO: 2853254 - RNA, 22 nt, Human
ucagcuuugagaagccuucagc

SEQ ID NO: 2853255 - RNA, 15 nt, Human
ucagcuacugauuuu

SEQ ID NO: 2853256 - RNA, 12 nt, Human
ucagcuccagcc

SEQ ID NO: 2853257 - RNA, 13 nt, Human
ucagcuccagccc

SEQ ID NO: 2853258 - RNA, 16 nt, Human
ucagcuccagccccuu

SEQ ID NO: 2853259 - RNA, 21 nt, Human
ucagcuccagccccuuuccaa

SEQ ID NO: 2853260 - RNA, 22 nt, Human
ucagcuccagccccuuuccaaa

SEQ ID NO: 2853261 - RNA, 16 nt, Human
ucagcuugugcacaau

SEQ ID NO: 2853262 - RNA, 16 nt, Human
ucagcuuucaaagcau

SEQ ID NO: 2853263 - RNA, 17 nt, Human
ucagcuuucaaagcauu

SEQ ID NO: 2853264 - RNA, 15 nt, Human
ucagcuuucagggcc

SEQ ID NO: 2853265 - RNA, 23 nt, Human
acccuugaauguagcagccccgg

SEQ ID NO: 2853266 - RNA, 13 nt, Human
acccuugagcccu

SEQ ID NO: 2853267 - RNA, 15 nt, Human
acccuugagcccucc

SEQ ID NO: 2853268 - RNA, 13 nt, Human
acccuucuuuucu

SEQ ID NO: 2853269 - RNA, 14 nt, Human
acccuucuuuucuc

SEQ ID NO: 2853270 - RNA, 20 nt, Human
acccuucuuuucucaugugu

SEQ ID NO: 2853271 - RNA, 17 nt, Human
acccuuuuucuccagcu

SEQ ID NO: 2853272 - RNA, 20 nt, Human
acccuuuccuccuuuaucac

SEQ ID NO: 2853273 - RNA, 18 nt, Human
acccuucuggaaacugug

SEQ ID NO: 2853274 - RNA, 14 nt, Human
acccucugccacca

SEQ ID NO: 2853275 - RNA, 17 nt, Human
acccucugccaccagag

SEQ ID NO: 2853276 - RNA, 13 nt, Human
acccucugccacc

SEQ ID NO: 2853277 - RNA, 15 nt, Human
acccucugacccuag

SEQ ID NO: 2853278 - RNA, 15 nt, Human
acccucucagcucca

SEQ ID NO: 2853279 - RNA, 16 nt, Human
acccucucagcuccag

SEQ ID NO: 2853280 - RNA, 16 nt, Human
acccgguuucuuuuua

SEQ ID NO: 2853281 - RNA, 18 nt, Human
acccgguuucuuuuuaag

SEQ ID NO: 2853282 - RNA, 19 nt, Human
acccgguuucuuuuuaagu

SEQ ID NO: 2853283 - RNA, 21 nt, Human
acccgggaggcggagcuugca

SEQ ID NO: 2853284 - RNA, 12 nt, Human
ucagauuuugau

SEQ ID NO: 2853285 - RNA, 21 nt, Human
ucagauuuugauaacuguuua

SEQ ID NO: 2853286 - RNA, 15 nt, Human
ucagccacacccagg

SEQ ID NO: 2853287 - RNA, 17 nt, Human
ucagccacacccaggca

SEQ ID NO: 2853288 - RNA, 23 nt, Human
ucagccaccauccuauugcaaag

SEQ ID NO: 2853289 - RNA, 20 nt, Human
accaguguccccuccacugu

SEQ ID NO: 2853290 - RNA, 18 nt, Human
accauaaaugaaucauca

SEQ ID NO: 2853291 - RNA, 21 nt, Human
accaguuuaaccugaugcagu

SEQ ID NO: 2853292 - RNA, 21 nt, Human
accaguuuagauuucaagaaa

SEQ ID NO: 2853293 - RNA, 19 nt, Human
accaguuuaaccugaugca

SEQ ID NO: 2853294 - RNA, 20 nt, Human
accaguuuaaccugaugcag

SEQ ID NO: 2853295 - RNA, 22 nt, Human
accauaagguuucguuucugua

SEQ ID NO: 2853296 - RNA, 14 nt, Human
accauacauuuaaa

SEQ ID NO: 2853297 - RNA, 12 nt, Human
ucagccagcugc

SEQ ID NO: 2853298 - RNA, 22 nt, Human
ucagccagcugcccuaaauaac

SEQ ID NO: 2853299 - RNA, 13 nt, Human
ucagcccucccug

SEQ ID NO: 2853300 - RNA, 14 nt, Human
ucagcccucccugc

SEQ ID NO: 2853301 - RNA, 15 nt, Human
ucagcccucccugcc

SEQ ID NO: 2853302 - RNA, 16 nt, Human
ucagcccucccugccc

SEQ ID NO: 2853303 - RNA, 23 nt, Human
acccaggagccccgaggccuucu

SEQ ID NO: 2853304 - RNA, 19 nt, Human
acccaggagccccgaggcc

SEQ ID NO: 2853305 - RNA, 10 nt, Human
ucagccagac

SEQ ID NO: 2853306 - RNA, 23 nt, Human
acccaggaggcagagguugcagu

SEQ ID NO: 2853307 - RNA, 19 nt, Human
acccaggagggagggggcu

SEQ ID NO: 2853308 - RNA, 18 nt, Human
acccaggaggggaacacu

SEQ ID NO: 2853309 - RNA, 19 nt, Human
acccaggaggggaacacug

SEQ ID NO: 2853310 - RNA, 20 nt, Human
acccaggaggggaacacugc

SEQ ID NO: 2853311 - RNA, 21 nt, Human
acccaggaggggaacacugcc

SEQ ID NO: 2853312 - RNA, 17 nt, Human
accccagagauucccaa

SEQ ID NO: 2853313 - RNA, 10 nt, Human
accccagagc

SEQ ID NO: 2853314 - RNA, 13 nt, Human
accccagagccac

SEQ ID NO: 2853315 - RNA, 15 nt, Human
accccagagccacac

SEQ ID NO: 2853316 - RNA, 16 nt, Human
accccagagccacaca

SEQ ID NO: 2853317 - RNA, 17 nt, Human
accccagagccacacau

SEQ ID NO: 2853318 - RNA, 18 nt, Human
accccagagccacacaug

SEQ ID NO: 2853319 - RNA, 19 nt, Human
accccagagccacacaugg

SEQ ID NO: 2853320 - RNA, 13 nt, Human
accccagcauccu

SEQ ID NO: 2853321 - RNA, 22 nt, Human
accccagcauucucaggcacca

SEQ ID NO: 2853322 - RNA, 23 nt, Human
accccagcauucucaggcaccag

SEQ ID NO: 2853323 - RNA, 11 nt, Human
accccacacuu

SEQ ID NO: 2853324 - RNA, 21 nt, Human
accccacccuaguuucccuga

SEQ ID NO: 2853325 - RNA, 13 nt, Human
accccacccuccc

SEQ ID NO: 2853326 - RNA, 21 nt, Human
accccacacuuguuccagcuc

SEQ ID NO: 2853327 - RNA, 17 nt, Human
accccuggcuuuucacu

SEQ ID NO: 2853328 - RNA, 18 nt, Human
accccuggcuuuucacug

SEQ ID NO: 2853329 - RNA, 19 nt, Human
accccuggcuuuucacugc

SEQ ID NO: 2853330 - RNA, 20 nt, Human
accccuggcuuuucacugcu

SEQ ID NO: 2853331 - RNA, 21 nt, Human
accccuggcuuuucacugcug

SEQ ID NO: 2853332 - RNA, 15 nt, Human
ucagccuuacauuug

SEQ ID NO: 2853333 - RNA, 16 nt, Human
ucagccuuacauuugu

SEQ ID NO: 2853334 - RNA, 18 nt, Human
ucagccuuacauuuguga

SEQ ID NO: 2853335 - RNA, 22 nt, Human
ucagccuucccccucccagggc

SEQ ID NO: 2853336 - RNA, 21 nt, Human
ucagccuucccccucccaggg

SEQ ID NO: 2853337 - RNA, 24 nt, Human
ucagccuucccccucccagggcca

SEQ ID NO: 2853338 - RNA, 18 nt, Human
ucagcggggacagcuccu

SEQ ID NO: 2853339 - RNA, 23 nt, Human
ucagcggggacagcuccuucugu

SEQ ID NO: 2853340 - RNA, 21 nt, Human
ucagcggggacagcuccuucu

SEQ ID NO: 2853341 - RNA, 20 nt, Human
ucagcggggacagcuccuuc

SEQ ID NO: 2853342 - RNA, 19 nt, Human
ucagcggggacagcuccuu

SEQ ID NO: 2853343 - RNA, 12 nt, Human
ucagcuccagcu

SEQ ID NO: 2853344 - RNA, 14 nt, Human
ucagcuacugauuu

SEQ ID NO: 2853345 - RNA, 19 nt, Human
ucagcuaagggaagacauu

SEQ ID NO: 2853346 - RNA, 22 nt, Human
ucagcuaagggaagacauuucu

SEQ ID NO: 2853347 - RNA, 23 nt, Human
ucagcuaagggaagacauuucuu

SEQ ID NO: 2853348 - RNA, 19 nt, Human
ucagcuacccacuauccuu

SEQ ID NO: 2853349 - RNA, 15 nt, Human
ucagcguaaaauggu

SEQ ID NO: 2853350 - RNA, 16 nt, Human
ucagcguaaaauggug

SEQ ID NO: 2853351 - RNA, 15 nt, Human
accccaucccacacc

SEQ ID NO: 2853352 - RNA, 17 nt, Human
accccaucccuccccag

SEQ ID NO: 2853353 - RNA, 17 nt, Human
accccaucccugucuuu

SEQ ID NO: 2853354 - RNA, 15 nt, Human
accccaguuuuuuga

SEQ ID NO: 2853355 - RNA, 17 nt, Human
accccauccaguucaug

SEQ ID NO: 2853356 - RNA, 11 nt, Human
acccccuccuu

SEQ ID NO: 2853357 - RNA, 12 nt, Human
acccccuccuuc

SEQ ID NO: 2853358 - RNA, 15 nt, Human
acccccuccuucaga

SEQ ID NO: 2853359 - RNA, 16 nt, Human
acccccuccuucagac

SEQ ID NO: 2853360 - RNA, 17 nt, Human
acccccuccuucagaca

SEQ ID NO: 2853361 - RNA, 19 nt, Human
acccccuccuucagacacc

SEQ ID NO: 2853362 - RNA, 16 nt, Human
acccccucgcuuggac

SEQ ID NO: 2853363 - RNA, 20 nt, Human
acccccucuucugagcacag

SEQ ID NO: 2853364 - RNA, 14 nt, Human
accccugcuucuga

SEQ ID NO: 2853365 - RNA, 20 nt, Human
accccugccuuugggagcag

SEQ ID NO: 2853366 - RNA, 9 nt, Human
accccugcu

SEQ ID NO: 2853367 - RNA, 13 nt, Human
accccucuguagc

SEQ ID NO: 2853368 - RNA, 16 nt, Human
accccugacucaucau

SEQ ID NO: 2853369 - RNA, 15 nt, Human
accccugagcuugca

SEQ ID NO: 2853370 - RNA, 15 nt, Human
acuccagcaacuucu

SEQ ID NO: 2853371 - RNA, 20 nt, Human
acuccagcaacuucuucucc

SEQ ID NO: 2853372 - RNA, 13 nt, Human
acucacaugacac

SEQ ID NO: 2853373 - RNA, 21 nt, Human
acuccagaccccuggcuuuuc

SEQ ID NO: 2853374 - RNA, 18 nt, Human
acuccagaccccuggcuu

SEQ ID NO: 2853375 - RNA, 19 nt, Human
acuccagaccccuggcuuu

SEQ ID NO: 2853376 - RNA, 11 nt, Human
acuccaucucu

SEQ ID NO: 2853377 - RNA, 16 nt, Human
acuccaucucucaucc

SEQ ID NO: 2853378 - RNA, 21 nt, Human
acuccaucucucauccuccag

SEQ ID NO: 2853379 - RNA, 14 nt, Human
acuccagugccagc

SEQ ID NO: 2853380 - RNA, 15 nt, Human
acuccagugccagca

SEQ ID NO: 2853381 - RNA, 19 nt, Human
acuccagugccagcaauga

SEQ ID NO: 2853382 - RNA, 14 nt, Human
acuccaguguacau

SEQ ID NO: 2853383 - RNA, 21 nt, Human
acuccuaggcaggacaugcug

SEQ ID NO: 2853384 - RNA, 19 nt, Human
acuccaucaguuagagcug

SEQ ID NO: 2853385 - RNA, 13 nt, Human
acuccucacacuu

SEQ ID NO: 2853386 - RNA, 20 nt, Human
acuccucacacuuacuguaa

SEQ ID NO: 2853387 - RNA, 14 nt, Human
acuccuauuuuugu

SEQ ID NO: 2853388 - RNA, 16 nt, Human
acuccuauuuuuguaa

SEQ ID NO: 2853389 - RNA, 17 nt, Human
acuccuauuuuuguaaa

SEQ ID NO: 2853390 - RNA, 20 nt, Human
acuccuauuuuuguaaacug

SEQ ID NO: 2853391 - RNA, 13 nt, Human
acuccagaccccu

SEQ ID NO: 2853392 - RNA, 15 nt, Human
acuccagaccccugg

SEQ ID NO: 2853393 - RNA, 15 nt, Human
acucacaggaaggag

SEQ ID NO: 2853394 - RNA, 23 nt, Human
acucacagguuggaagagaauca

SEQ ID NO: 2853395 - RNA, 11 nt, Human
acuccuggccu

SEQ ID NO: 2853396 - RNA, 17 nt, Human
acuccugccaaggagga

SEQ ID NO: 2853397 - RNA, 21 nt, Human
acuccucccuuuccuuccuaa

SEQ ID NO: 2853398 - RNA, 18 nt, Human
acuccucagggcagccuc

SEQ ID NO: 2853399 - RNA, 12 nt, Human
acuccucccagg

SEQ ID NO: 2853400 - RNA, 15 nt, Human
acuccuccccacccu

SEQ ID NO: 2853401 - RNA, 18 nt, Human
acuccuccccacccuccu

SEQ ID NO: 2853402 - RNA, 19 nt, Human
acuccuccccacccuccug

SEQ ID NO: 2853403 - RNA, 20 nt, Human
acuccuccccacccuccugg

SEQ ID NO: 2853404 - RNA, 21 nt, Human
acuccuccccacccuccuggc

SEQ ID NO: 2853405 - RNA, 23 nt, Human
acuccuccccacccuccuggccu

SEQ ID NO: 2853406 - RNA, 11 nt, Human
acuccucccuc

SEQ ID NO: 2853407 - RNA, 12 nt, Human
acuccucccucc

SEQ ID NO: 2853408 - RNA, 13 nt, Human
acuccucccuccg

SEQ ID NO: 2853409 - RNA, 14 nt, Human
uccuacucuguguc

SEQ ID NO: 2853410 - RNA, 13 nt, Human
uccuacucugugu

SEQ ID NO: 2853411 - RNA, 22 nt, Human
uccguagguagauguguaaccu

SEQ ID NO: 2853412 - RNA, 20 nt, Human
uccguaauaacacccuuccu

SEQ ID NO: 2853413 - RNA, 12 nt, Human
uccuacucugug

SEQ ID NO: 2853414 - RNA, 14 nt, Human
uccgguguucuaag

SEQ ID NO: 2853415 - RNA, 15 nt, Human
uccgguguucuaaga

SEQ ID NO: 2853416 - RNA, 16 nt, Human
uccgguguucuaagau

SEQ ID NO: 2853417 - RNA, 14 nt, Human
uccgguugcauacu

SEQ ID NO: 2853418 - RNA, 18 nt, Human
uccgguugcauacuggac

SEQ ID NO: 2853419 - RNA, 19 nt, Human
uccgguugcauacuggacu

SEQ ID NO: 2853420 - RNA, 17 nt, Human
uccggugugccugcagc

SEQ ID NO: 2853421 - RNA, 15 nt, Human
uccggugugccugca

SEQ ID NO: 2853422 - RNA, 12 nt, Human
uccggugugccu

SEQ ID NO: 2853423 - RNA, 19 nt, Human
uccggugugccugcagccc

SEQ ID NO: 2853424 - RNA, 18 nt, Human
uccggugugccugcagcc

SEQ ID NO: 2853425 - RNA, 18 nt, Human
uccgguguuuaagacauu

SEQ ID NO: 2853426 - RNA, 15 nt, Human
uccuacucuguguca

SEQ ID NO: 2853427 - RNA, 21 nt, Human
uccuagcuugggaggcuuccc

SEQ ID NO: 2853428 - RNA, 22 nt, Human
uccuagcuugggaggcuucccc

SEQ ID NO: 2853429 - RNA, 14 nt, Human
acuccuggccucaa

SEQ ID NO: 2853430 - RNA, 13 nt, Human
acuccuggccuca

SEQ ID NO: 2853431 - RNA, 12 nt, Human
acuccuggccuc

SEQ ID NO: 2853432 - RNA, 14 nt, Human
ucccuuggccucag

SEQ ID NO: 2853433 - RNA, 13 nt, Human
ucccuuggccuca

SEQ ID NO: 2853434 - RNA, 12 nt, Human
ucccuuggccuc

SEQ ID NO: 2853435 - RNA, 16 nt, Human
ucccuuggccucagaa

SEQ ID NO: 2853436 - RNA, 14 nt, Human
acucuuagaaauga

SEQ ID NO: 2853437 - RNA, 22 nt, Human
acucuuacgaauauuuucagua

SEQ ID NO: 2853438 - RNA, 14 nt, Human
acucuugaccucag

SEQ ID NO: 2853439 - RNA, 10 nt, Human
acucuuaggc

SEQ ID NO: 2853440 - RNA, 19 nt, Human
acucuuaggcacuuugggg

SEQ ID NO: 2853441 - RNA, 21 nt, Human
acucuuaggcacuuugggggu

SEQ ID NO: 2853442 - RNA, 16 nt, Human
acucuugaccucaggu

SEQ ID NO: 2853443 - RNA, 15 nt, Human
acucuugaccucagg

SEQ ID NO: 2853444 - RNA, 16 nt, Human
acucuugauuauccau

SEQ ID NO: 2853445 - RNA, 22 nt, Human
uccucacccugauuucuugcuu

SEQ ID NO: 2853446 - RNA, 20 nt, Human
uccucaccccuguccucacu

SEQ ID NO: 2853447 - RNA, 21 nt, Human
uccucaccccuguccucacug

SEQ ID NO: 2853448 - RNA, 19 nt, Human
acucuugcuauugaauuga

SEQ ID NO: 2853449 - RNA, 22 nt, Human
uccucauaguaugguggcuggg

SEQ ID NO: 2853450 - RNA, 13 nt, Human
uccucccaggcgc

SEQ ID NO: 2853451 - RNA, 22 nt, Human
uccucccagcuuguaggagcug

SEQ ID NO: 2853452 - RNA, 14 nt, Human
uccucauccacccc

SEQ ID NO: 2853453 - RNA, 15 nt, Human
uccucauccacccca

SEQ ID NO: 2853454 - RNA, 17 nt, Human
uccucauccaccccauc

SEQ ID NO: 2853455 - RNA, 18 nt, Human
uccucauccaccccaucc

SEQ ID NO: 2853456 - RNA, 13 nt, Human
uccucccaucccc

SEQ ID NO: 2853457 - RNA, 15 nt, Human
uccucccauccccug

SEQ ID NO: 2853458 - RNA, 18 nt, Human
uccucccauccccuggac

SEQ ID NO: 2853459 - RNA, 19 nt, Human
uccucccaggcgccccuuc

SEQ ID NO: 2853460 - RNA, 21 nt, Human
uccucccaggcgccccuuccc

SEQ ID NO: 2853461 - RNA, 15 nt, Human
uccucccucagugcc

SEQ ID NO: 2853462 - RNA, 12 nt, Human
uccucccuccac

SEQ ID NO: 2853463 - RNA, 23 nt, Human
uccucccauccccuggacuggga

SEQ ID NO: 2853464 - RNA, 19 nt, Human
uccucccauccccuggacu

SEQ ID NO: 2853465 - RNA, 17 nt, Human
uccucagggcagccucc

SEQ ID NO: 2853466 - RNA, 12 nt, Human
uccucagggcag

SEQ ID NO: 2853467 - RNA, 21 nt, Human
uccucagggagcagggaaggc

SEQ ID NO: 2853468 - RNA, 14 nt, Human
uccucagcuuaucu

SEQ ID NO: 2853469 - RNA, 23 nt, Human
uccucaccucuggacuggcuaga

SEQ ID NO: 2853470 - RNA, 22 nt, Human
uccucaccucuggacuggcuag

SEQ ID NO: 2853471 - RNA, 21 nt, Human
uccucaccucuggacuggcua

SEQ ID NO: 2853472 - RNA, 20 nt, Human
uccucaccucuggacuggcu

SEQ ID NO: 2853473 - RNA, 16 nt, Human
uccucaccucuggacu

SEQ ID NO: 2853474 - RNA, 15 nt, Human
uccucaccucuggac

SEQ ID NO: 2853475 - RNA, 13 nt, Human
uccucaccucugg

SEQ ID NO: 2853476 - RNA, 12 nt, Human
uccucaccucug

SEQ ID NO: 2853477 - RNA, 14 nt, Human
uccucacucccagu

SEQ ID NO: 2853478 - RNA, 13 nt, Human
uccucacucccag

SEQ ID NO: 2853479 - RNA, 12 nt, Human
uccucacuccca

SEQ ID NO: 2853480 - RNA, 17 nt, Human
uccucacucccagucca

SEQ ID NO: 2853481 - RNA, 19 nt, Human
uccuaggcaggacaugcug

SEQ ID NO: 2853482 - RNA, 14 nt, Human
uccgguuugccaug

SEQ ID NO: 2853483 - RNA, 17 nt, Human
acuccuugagagaccag

SEQ ID NO: 2853484 - RNA, 18 nt, Human
acuccuugagagaccagg

SEQ ID NO: 2853485 - RNA, 21 nt, Human
acuccuugagagaccaggcaa

SEQ ID NO: 2853486 - RNA, 23 nt, Human
acuccuugagagaccaggcaaag

SEQ ID NO: 2853487 - RNA, 15 nt, Human
acucuccuaugccuu

SEQ ID NO: 2853488 - RNA, 16 nt, Human
acucuccuaugccuuu

SEQ ID NO: 2853489 - RNA, 21 nt, Human
acucucugaaccccucccucc

SEQ ID NO: 2853490 - RNA, 19 nt, Human
acucucugaaccccucccu

SEQ ID NO: 2853491 - RNA, 11 nt, Human
acucugagccc

SEQ ID NO: 2853492 - RNA, 12 nt, Human
acucugagccca

SEQ ID NO: 2853493 - RNA, 13 nt, Human
acucugagcccau

SEQ ID NO: 2853494 - RNA, 14 nt, Human
acucugagcccaug

SEQ ID NO: 2853495 - RNA, 18 nt, Human
acucugagcgggaggcag

SEQ ID NO: 2853496 - RNA, 21 nt, Human
acucugagcgggaggcagagu

SEQ ID NO: 2853497 - RNA, 22 nt, Human
acucugagcgggaggcagaguu

SEQ ID NO: 2853498 - RNA, 23 nt, Human
acucugaggcucuuucugggcca

SEQ ID NO: 2853499 - RNA, 21 nt, Human
acucugaggcucuuucugggc

SEQ ID NO: 2853500 - RNA, 18 nt, Human
acucucugaaccccuccc

SEQ ID NO: 2853501 - RNA, 21 nt, Human
acucucuccacccuauaugua

SEQ ID NO: 2853502 - RNA, 20 nt, Human
acucucuccacccuauaugu

SEQ ID NO: 2853503 - RNA, 13 nt, Human
acucucuccaccc

SEQ ID NO: 2853504 - RNA, 14 nt, Human
acucucuaccagau

SEQ ID NO: 2853505 - RNA, 17 nt, Human
acucucgcaucuuccca

SEQ ID NO: 2853506 - RNA, 18 nt, Human
acucucgcaucuucccaa

SEQ ID NO: 2853507 - RNA, 13 nt, Human
acucuccuugcag

SEQ ID NO: 2853508 - RNA, 15 nt, Human
acucuccuugcaguu

SEQ ID NO: 2853509 - RNA, 16 nt, Human
acucuccuugcaguuc

SEQ ID NO: 2853510 - RNA, 13 nt, Human
acucuccugcccc

SEQ ID NO: 2853511 - RNA, 16 nt, Human
acucugccagccacau

SEQ ID NO: 2853512 - RNA, 11 nt, Human
acucugccagg

SEQ ID NO: 2853513 - RNA, 18 nt, Human
acucugccagggcagugc

SEQ ID NO: 2853514 - RNA, 20 nt, Human
acucugccagggcagugcua

SEQ ID NO: 2853515 - RNA, 13 nt, Human
acucugccagcca

SEQ ID NO: 2853516 - RNA, 14 nt, Human
acucugauagaauu

SEQ ID NO: 2853517 - RNA, 22 nt, Human
acucugauagaauuauuucaca

SEQ ID NO: 2853518 - RNA, 12 nt, Human
acucugccuccu

SEQ ID NO: 2853519 - RNA, 19 nt, Human
acucugcccccugcuggcu

SEQ ID NO: 2853520 - RNA, 21 nt, Human
acucugcccccugcuggcucu

SEQ ID NO: 2853521 - RNA, 12 nt, Human
acucugcccccu

SEQ ID NO: 2853522 - RNA, 20 nt, Human
acucugccccccccccccau

SEQ ID NO: 2853523 - RNA, 13 nt, Human
acucugccccccc

SEQ ID NO: 2853524 - RNA, 14 nt, Human
acucugccagcaaa

SEQ ID NO: 2853525 - RNA, 16 nt, Human
acucugccagcaaaga

SEQ ID NO: 2853526 - RNA, 13 nt, Human
acucugcccccug

SEQ ID NO: 2853527 - RNA, 15 nt, Human
acucugcccccugcu

SEQ ID NO: 2853528 - RNA, 17 nt, Human
acucugcccccugcugg

SEQ ID NO: 2853529 - RNA, 18 nt, Human
acucugcccccugcuggc

SEQ ID NO: 2853530 - RNA, 17 nt, Human
uccuggaaccuugcugu

SEQ ID NO: 2853531 - RNA, 18 nt, Human
uccuggaaccuugcuguc

SEQ ID NO: 2853532 - RNA, 19 nt, Human
uccuggaaccuugcugucc

SEQ ID NO: 2853533 - RNA, 20 nt, Human
uccuggaaccuugcuguccu

SEQ ID NO: 2853534 - RNA, 21 nt, Human
uccuggaaccuugcuguccug

SEQ ID NO: 2853535 - RNA, 22 nt, Human
uccuggaaccuugcuguccuga

SEQ ID NO: 2853536 - RNA, 17 nt, Human
uccuggacacucagacc

SEQ ID NO: 2853537 - RNA, 19 nt, Human
uccuggaaaggcucagucu

SEQ ID NO: 2853538 - RNA, 16 nt, Human
uccuggaaaggcucag

SEQ ID NO: 2853539 - RNA, 22 nt, Human
uccuggaaaggcucagucucag

SEQ ID NO: 2853540 - RNA, 22 nt, Human
uccuggaagcgcgagggccuca

SEQ ID NO: 2853541 - RNA, 17 nt, Human
uccugggagugagcugg

SEQ ID NO: 2853542 - RNA, 14 nt, Human
uccugggagugagc

SEQ ID NO: 2853543 - RNA, 12 nt, Human
uccugggaguga

SEQ ID NO: 2853544 - RNA, 20 nt, Human
uccugggagaaccucaggcu

SEQ ID NO: 2853545 - RNA, 19 nt, Human
uccugggagaaccucaggc

SEQ ID NO: 2853546 - RNA, 19 nt, Human
uccuggacacucagaccug

SEQ ID NO: 2853547 - RNA, 16 nt, Human
uccuggcuccugaggg

SEQ ID NO: 2853548 - RNA, 13 nt, Human
uccuggcuccuga

SEQ ID NO: 2853549 - RNA, 23 nt, Human
uccuggcucuugauaccccccuc

SEQ ID NO: 2853550 - RNA, 12 nt, Human
uccuggcugcgg

SEQ ID NO: 2853551 - RNA, 22 nt, Human
uccuggcugcggcgucugucug

SEQ ID NO: 2853552 - RNA, 13 nt, Human
uccuggcuucagg

SEQ ID NO: 2853553 - RNA, 14 nt, Human
uccuggcuucaggc

SEQ ID NO: 2853554 - RNA, 23 nt, Human
uccuggcuuuuuaacuccccugu

SEQ ID NO: 2853555 - RNA, 18 nt, Human
uccugggagaaccucagg

SEQ ID NO: 2853556 - RNA, 17 nt, Human
uccugggagaaccucag

SEQ ID NO: 2853557 - RNA, 14 nt, Human
uccugccugugcug

SEQ ID NO: 2853558 - RNA, 19 nt, Human
uccugccuuggccucccaa

SEQ ID NO: 2853559 - RNA, 21 nt, Human
uccugccuuggccucccaagu

SEQ ID NO: 2853560 - RNA, 14 nt, Human
uccugccuuugccu

SEQ ID NO: 2853561 - RNA, 15 nt, Human
uccugccuuugccuc

SEQ ID NO: 2853562 - RNA, 18 nt, Human
uccugccuuugccuccag

SEQ ID NO: 2853563 - RNA, 12 nt, Human
uccugccuuuua

SEQ ID NO: 2853564 - RNA, 21 nt, Human
uccugccucgaacuggcugca

SEQ ID NO: 2853565 - RNA, 20 nt, Human
uccugccugccccucucccg

SEQ ID NO: 2853566 - RNA, 12 nt, Human
uccugccugugc

SEQ ID NO: 2853567 - RNA, 16 nt, Human
uccugccuggccaggc

SEQ ID NO: 2853568 - RNA, 14 nt, Human
uccugccuggccag

SEQ ID NO: 2853569 - RNA, 13 nt, Human
uccugccuggcca

SEQ ID NO: 2853570 - RNA, 12 nt, Human
uccugccuggcc

SEQ ID NO: 2853571 - RNA, 14 nt, Human
uccugccugccccu

SEQ ID NO: 2853572 - RNA, 14 nt, Human
acugagccccgcag

SEQ ID NO: 2853573 - RNA, 18 nt, Human
acugagccccgcagaccu

SEQ ID NO: 2853574 - RNA, 20 nt, Human
acugagccccgcagaccucc

SEQ ID NO: 2853575 - RNA, 16 nt, Human
acugcaacuucugccu

SEQ ID NO: 2853576 - RNA, 20 nt, Human
acugcaacuuguaaaugugg

SEQ ID NO: 2853577 - RNA, 14 nt, Human
acugcaacuucugc

SEQ ID NO: 2853578 - RNA, 23 nt, Human
acugcaaccuucgccaccugggu

SEQ ID NO: 2853579 - RNA, 21 nt, Human
acugagccccgcagaccuccc

SEQ ID NO: 2853580 - RNA, 23 nt, Human
acugagccccgcagaccucccca

SEQ ID NO: 2853581 - RNA, 16 nt, Human
acugauaguguccaaa

SEQ ID NO: 2853582 - RNA, 17 nt, Human
acugauaguguccaaau

SEQ ID NO: 2853583 - RNA, 20 nt, Human
acugcacuauagccuaggug

SEQ ID NO: 2853584 - RNA, 16 nt, Human
acugcaccgggccaca

SEQ ID NO: 2853585 - RNA, 14 nt, Human
acugcaccgggcca

SEQ ID NO: 2853586 - RNA, 12 nt, Human
acugcacccagg

SEQ ID NO: 2853587 - RNA, 13 nt, Human
acugcacccagga

SEQ ID NO: 2853588 - RNA, 14 nt, Human
acugcacccaggag

SEQ ID NO: 2853589 - RNA, 19 nt, Human
acugcaaguccuuuuguaa

SEQ ID NO: 2853590 - RNA, 20 nt, Human
acugcaaguccuuuuguaaa

SEQ ID NO: 2853591 - RNA, 22 nt, Human
acugcaaguccuuuuguaaagu

SEQ ID NO: 2853592 - RNA, 17 nt, Human
acugcaagaggcuccug

SEQ ID NO: 2853593 - RNA, 18 nt, Human
acugcaagaggcuccugu

SEQ ID NO: 2853594 - RNA, 16 nt, Human
acugcaauaacuucug

SEQ ID NO: 2853595 - RNA, 17 nt, Human
acugcaauaacuucuga

SEQ ID NO: 2853596 - RNA, 18 nt, Human
acugcaauaacuucugac

SEQ ID NO: 2853597 - RNA, 20 nt, Human
acugcaauaacuucugaccu

SEQ ID NO: 2853598 - RNA, 22 nt, Human
acugcacagugcaucucagccc

SEQ ID NO: 2853599 - RNA, 23 nt, Human
acugcacagugcaucucagccca

SEQ ID NO: 2853600 - RNA, 16 nt, Human
acugcacaugaagaaa

SEQ ID NO: 2853601 - RNA, 17 nt, Human
acugcacaugaagaaau

SEQ ID NO: 2853602 - RNA, 18 nt, Human
acugcacaugaagaaaua

SEQ ID NO: 2853603 - RNA, 18 nt, Human
acugcacuccagccuggg

SEQ ID NO: 2853604 - RNA, 21 nt, Human
acugcacuccagccugggcga

SEQ ID NO: 2853605 - RNA, 20 nt, Human
acugcacuccagccugggcg

SEQ ID NO: 2853606 - RNA, 20 nt, Human
acugcacuccagccugggca

SEQ ID NO: 2853607 - RNA, 19 nt, Human
acugcacuccagccugggc

SEQ ID NO: 2853608 - RNA, 17 nt, Human
acugcacuccagccugg

SEQ ID NO: 2853609 - RNA, 15 nt, Human
acugcacuccagccu

SEQ ID NO: 2853610 - RNA, 21 nt, Human
acugcacuauagccuagguga

SEQ ID NO: 2853611 - RNA, 14 nt, Human
uccugaucugugau

SEQ ID NO: 2853612 - RNA, 15 nt, Human
uccugcaauuuucua

SEQ ID NO: 2853613 - RNA, 16 nt, Human
uccugcaauuuucuaa

SEQ ID NO: 2853614 - RNA, 21 nt, Human
uccugcacacgcuccuuccuc

SEQ ID NO: 2853615 - RNA, 14 nt, Human
uccugcacacgcuc

SEQ ID NO: 2853616 - RNA, 22 nt, Human
uccugcacacgcuccuuccucu

SEQ ID NO: 2853617 - RNA, 17 nt, Human
acugagauuuugguauu

SEQ ID NO: 2853618 - RNA, 21 nt, Human
acugacuggauucauucucau

SEQ ID NO: 2853619 - RNA, 13 nt, Human
acugacuugagac

SEQ ID NO: 2853620 - RNA, 20 nt, Human
acugacuuguuugucuucca

SEQ ID NO: 2853621 - RNA, 24 nt, Human
acugacuuguuugucuuccauucc

SEQ ID NO: 2853622 - RNA, 23 nt, Human
acugaccauccacucuacccucc

SEQ ID NO: 2853623 - RNA, 13 nt, Human
acugacccugggg

SEQ ID NO: 2853624 - RNA, 15 nt, Human
acugacccuggggcu

SEQ ID NO: 2853625 - RNA, 17 nt, Human
acugacccuggggcugg

SEQ ID NO: 2853626 - RNA, 12 nt, Human
acugacccuucc

SEQ ID NO: 2853627 - RNA, 13 nt, Human
acugacccuucca

SEQ ID NO: 2853628 - RNA, 15 nt, Human
acugacccuuccaga

SEQ ID NO: 2853629 - RNA, 17 nt, Human
acugacccuuccagaca

SEQ ID NO: 2853630 - RNA, 19 nt, Human
acugacccuuccagacaua

SEQ ID NO: 2853631 - RNA, 18 nt, Human
acugacuaucauaaaauc

SEQ ID NO: 2853632 - RNA, 21 nt, Human
acugacuaucauaaaaucaaa

SEQ ID NO: 2853633 - RNA, 13 nt, Human
acugaacuucagg

SEQ ID NO: 2853634 - RNA, 20 nt, Human
acugaccuuggagagacaca

SEQ ID NO: 2853635 - RNA, 21 nt, Human
acugaccuuggagagacacag

SEQ ID NO: 2853636 - RNA, 22 nt, Human
acugaccuuggagagacacagc

SEQ ID NO: 2853637 - RNA, 12 nt, Human
uccugaaaucaa

SEQ ID NO: 2853638 - RNA, 16 nt, Human
uccugaaccgcacagc

SEQ ID NO: 2853639 - RNA, 14 nt, Human
uccugaaauuucag

SEQ ID NO: 2853640 - RNA, 15 nt, Human
uccugaaauuucaga

SEQ ID NO: 2853641 - RNA, 13 nt, Human
uccugaacagcau

SEQ ID NO: 2853642 - RNA, 15 nt, Human
uccugaacagcaugg

SEQ ID NO: 2853643 - RNA, 18 nt, Human
uccugaacagcauggcac

SEQ ID NO: 2853644 - RNA, 20 nt, Human
uccugaacagcauggcacuc

SEQ ID NO: 2853645 - RNA, 22 nt, Human
uccugaacagcauggcacuccc

SEQ ID NO: 2853646 - RNA, 23 nt, Human
uccugaacagcauggcacucccu

SEQ ID NO: 2853647 - RNA, 20 nt, Human
uccugaaccgcacagcucag

SEQ ID NO: 2853648 - RNA, 19 nt, Human
uccugaaccgcacagcuca

SEQ ID NO: 2853649 - RNA, 18 nt, Human
uccugaaccgcacagcuc

SEQ ID NO: 2853650 - RNA, 17 nt, Human
uccugaaccgcacagcu

SEQ ID NO: 2853651 - RNA, 22 nt, Human
uccugaaccgcacagcucagga

SEQ ID NO: 2853652 - RNA, 21 nt, Human
uccugaaccgcacagcucagg

SEQ ID NO: 2853653 - RNA, 21 nt, Human
uccugaauuuuauuuuuuggg

SEQ ID NO: 2853654 - RNA, 13 nt, Human
uccucuuucucuc

SEQ ID NO: 2853655 - RNA, 15 nt, Human
uccucuuucucuccc

SEQ ID NO: 2853656 - RNA, 16 nt, Human
uccucuuucucucccc

SEQ ID NO: 2853657 - RNA, 17 nt, Human
uccucuuucucucccca

SEQ ID NO: 2853658 - RNA, 17 nt, Human
uccugacagaaggugcc

SEQ ID NO: 2853659 - RNA, 16 nt, Human
uccugacaucacagca

SEQ ID NO: 2853660 - RNA, 18 nt, Human
uccugacaucacagcagc

SEQ ID NO: 2853661 - RNA, 19 nt, Human
uccugacaucacagcagcc

SEQ ID NO: 2853662 - RNA, 20 nt, Human
uccugacaucacagcagccu

SEQ ID NO: 2853663 - RNA, 21 nt, Human
uccugacaucacagcagccuc

SEQ ID NO: 2853664 - RNA, 16 nt, Human
uccugacagaaggugc

SEQ ID NO: 2853665 - RNA, 15 nt, Human
uccugacagaaggug

SEQ ID NO: 2853666 - RNA, 14 nt, Human
uccugacagaaggu

SEQ ID NO: 2853667 - RNA, 16 nt, Human
acucuuguugaguucu

SEQ ID NO: 2853668 - RNA, 21 nt, Human
acucuuguugaguucuguaga

SEQ ID NO: 2853669 - RNA, 16 nt, Human
acucuuucuaaugcug

SEQ ID NO: 2853670 - RNA, 17 nt, Human
acucuuucuaaugcuga

SEQ ID NO: 2853671 - RNA, 20 nt, Human
acucuuuugcuuuauuccag

SEQ ID NO: 2853672 - RNA, 14 nt, Human
acucuuuugcuuua

SEQ ID NO: 2853673 - RNA, 12 nt, Human
acucuuuugcuu

SEQ ID NO: 2853674 - RNA, 17 nt, Human
acucuuuacccuugagc

SEQ ID NO: 2853675 - RNA, 19 nt, Human
acucuuuacccuugagccc

SEQ ID NO: 2853676 - RNA, 18 nt, Human
acucuuuauagugcacaa

SEQ ID NO: 2853677 - RNA, 20 nt, Human
acugaacucugacaacagac

SEQ ID NO: 2853678 - RNA, 18 nt, Human
acugaacucacuuuccuc

SEQ ID NO: 2853679 - RNA, 21 nt, Human
acugaacuguguguaauuguu

SEQ ID NO: 2853680 - RNA, 22 nt, Human
acugaacuguguguaauuguuc

SEQ ID NO: 2853681 - RNA, 21 nt, Human
acugaacuucaggauaauaaa

SEQ ID NO: 2853682 - RNA, 13 nt, Human
acugaacuuucuu

SEQ ID NO: 2853683 - RNA, 16 nt, Human
acugaacuuucuuauc

SEQ ID NO: 2853684 - RNA, 13 nt, Human
acugaacuuugaa

SEQ ID NO: 2853685 - RNA, 15 nt, Human
acugaacuuugaaga

SEQ ID NO: 2853686 - RNA, 16 nt, Human
acugaacuuugaagac

SEQ ID NO: 2853687 - RNA, 19 nt, Human
acugaacuuugaagacccg

SEQ ID NO: 2853688 - RNA, 21 nt, Human
acucuuuugcuuuauuccaga

SEQ ID NO: 2853689 - RNA, 14 nt, Human
acucuuuuuagggc

SEQ ID NO: 2853690 - RNA, 19 nt, Human
acucuuuuuagggccaggc

SEQ ID NO: 2853691 - RNA, 20 nt, Human
acucuuuuuagggccaggca

SEQ ID NO: 2853692 - RNA, 20 nt, Human
accuugaaaauaagaauaga

SEQ ID NO: 2853693 - RNA, 20 nt, Human
accuugaacuggguacuugu

SEQ ID NO: 2853694 - RNA, 16 nt, Human
ucauuccguugucugu

SEQ ID NO: 2853695 - RNA, 17 nt, Human
ucauuccguugucugug

SEQ ID NO: 2853696 - RNA, 17 nt, Human
ucauucccucucaucuc

SEQ ID NO: 2853697 - RNA, 18 nt, Human
ucauucccucucaucuca

SEQ ID NO: 2853698 - RNA, 13 nt, Human
ucauuccauugcc

SEQ ID NO: 2853699 - RNA, 14 nt, Human
ucauuccauugccu

SEQ ID NO: 2853700 - RNA, 15 nt, Human
ucauuccauugccua

SEQ ID NO: 2853701 - RNA, 20 nt, Human
ucauuccauugccuagcucu

SEQ ID NO: 2853702 - RNA, 23 nt, Human
accuuugcacaggaugcuggccu

SEQ ID NO: 2853703 - RNA, 18 nt, Human
accuuuggagcaaagcug

SEQ ID NO: 2853704 - RNA, 15 nt, Human
accuuuguguauuuu

SEQ ID NO: 2853705 - RNA, 16 nt, Human
accuuuguguauuuuu

SEQ ID NO: 2853706 - RNA, 13 nt, Human
accuuuuaaagug

SEQ ID NO: 2853707 - RNA, 14 nt, Human
accuuuuaaagugu

SEQ ID NO: 2853708 - RNA, 19 nt, Human
accuuuuaaaguguuucag

SEQ ID NO: 2853709 - RNA, 21 nt, Human
accuuuuaaaguguuucagcu

SEQ ID NO: 2853710 - RNA, 22 nt, Human
accuuuuaaaguguuucagcua

SEQ ID NO: 2853711 - RNA, 18 nt, Human
uccacucuacccucccac

SEQ ID NO: 2853712 - RNA, 17 nt, Human
uccacucuacccuccca

SEQ ID NO: 2853713 - RNA, 21 nt, Human
uccacucuacccucccacccc

SEQ ID NO: 2853714 - RNA, 20 nt, Human
uccacucuacccucccaccc

SEQ ID NO: 2853715 - RNA, 23 nt, Human
uccacucuacccucccacccccu

SEQ ID NO: 2853716 - RNA, 21 nt, Human
uccacugugccaugugccagg

SEQ ID NO: 2853717 - RNA, 12 nt, Human
uccacugucacc

SEQ ID NO: 2853718 - RNA, 17 nt, Human
uccacugucacccucca

SEQ ID NO: 2853719 - RNA, 19 nt, Human
uccacugucacccuccacc

SEQ ID NO: 2853720 - RNA, 18 nt, Human
uccagaaugcuguacauc

SEQ ID NO: 2853721 - RNA, 17 nt, Human
uccagaaugcuguacau

SEQ ID NO: 2853722 - RNA, 21 nt, Human
uccagaaugcuguacaucuau

SEQ ID NO: 2853723 - RNA, 18 nt, Human
uccagaauggucuuucua

SEQ ID NO: 2853724 - RNA, 16 nt, Human
accuuuuauugacaca

SEQ ID NO: 2853725 - RNA, 12 nt, Human
accuuuucuugc

SEQ ID NO: 2853726 - RNA, 14 nt, Human
accuuuucuugccu

SEQ ID NO: 2853727 - RNA, 17 nt, Human
accuuuugaggagcccc

SEQ ID NO: 2853728 - RNA, 21 nt, Human
accuuuugaggagccccagcu

SEQ ID NO: 2853729 - RNA, 15 nt, Human
accuuuuaccagcuu

SEQ ID NO: 2853730 - RNA, 19 nt, Human
accuuuuaccagcuuuuaa

SEQ ID NO: 2853731 - RNA, 20 nt, Human
accuuuuaccagcuuuuaac

SEQ ID NO: 2853732 - RNA, 15 nt, Human
accuuuuauccacuu

SEQ ID NO: 2853733 - RNA, 15 nt, Human
accuuuuauguagca

SEQ ID NO: 2853734 - RNA, 15 nt, Human
accuuuuauguagua

SEQ ID NO: 2853735 - RNA, 14 nt, Human
accuuuuauuacau

SEQ ID NO: 2853736 - RNA, 20 nt, Human
accuuuuauguaguaauuga

SEQ ID NO: 2853737 - RNA, 20 nt, Human
accuuuuauugacacagaaa

SEQ ID NO: 2853738 - RNA, 19 nt, Human
accuuuugaaguaguuugu

SEQ ID NO: 2853739 - RNA, 20 nt, Human
accuuuuuuaagauuuuucu

SEQ ID NO: 2853740 - RNA, 22 nt, Human
accuuuuuuaagauuuuucuca

SEQ ID NO: 2853741 - RNA, 15 nt, Human
accuuuuuuaagauu

SEQ ID NO: 2853742 - RNA, 16 nt, Human
accuuuuuuaagauuu

SEQ ID NO: 2853743 - RNA, 22 nt, Human
uccaggcuccuuuagcgcccag

SEQ ID NO: 2853744 - RNA, 12 nt, Human
uccaggcuccuu

SEQ ID NO: 2853745 - RNA, 10 nt, Human
uccaggcucc

SEQ ID NO: 2853746 - RNA, 15 nt, Human
uccaggcacagcuga

SEQ ID NO: 2853747 - RNA, 16 nt, Human
uccaggcacagcugag

SEQ ID NO: 2853748 - RNA, 17 nt, Human
uccaggcacagcugagu

SEQ ID NO: 2853749 - RNA, 12 nt, Human
uccaggcacagg

SEQ ID NO: 2853750 - RNA, 13 nt, Human
uccaggcacagga

SEQ ID NO: 2853751 - RNA, 20 nt, Human
uccaggaugguguuacugca

SEQ ID NO: 2853752 - RNA, 22 nt, Human
uccaggaugguguuacugcagu

SEQ ID NO: 2853753 - RNA, 23 nt, Human
uccaggaugguguuacugcaguu

SEQ ID NO: 2853754 - RNA, 18 nt, Human
uccaggagccugugccuc

SEQ ID NO: 2853755 - RNA, 18 nt, Human
uccaggcugggugacaga

SEQ ID NO: 2853756 - RNA, 13 nt, Human
uccaggcuagucc

SEQ ID NO: 2853757 - RNA, 19 nt, Human
uccaggcuaguccggaccc

SEQ ID NO: 2853758 - RNA, 20 nt, Human
uccaggcuaguccggaccca

SEQ ID NO: 2853759 - RNA, 18 nt, Human
acgaaacuuguuauugug

SEQ ID NO: 2853760 - RNA, 19 nt, Human
acgaaacuuguuauuguga

SEQ ID NO: 2853761 - RNA, 21 nt, Human
acgaaacuuguuauugugaau

SEQ ID NO: 2853762 - RNA, 14 nt, Human
acgaaagaaaugua

SEQ ID NO: 2853763 - RNA, 19 nt, Human
acgaaacacaaaccacaac

SEQ ID NO: 2853764 - RNA, 12 nt, Human
acgaaagagaga

SEQ ID NO: 2853765 - RNA, 14 nt, Human
acgaaagagagaga

SEQ ID NO: 2853766 - RNA, 20 nt, Human
accuuuuuuguuuuuucaaa

SEQ ID NO: 2853767 - RNA, 23 nt, Human
acgaaagagagagaaacaaacuu

SEQ ID NO: 2853768 - RNA, 13 nt, Human
acgaacaaaacac

SEQ ID NO: 2853769 - RNA, 12 nt, Human
acgaacaaaaca

SEQ ID NO: 2853770 - RNA, 22 nt, Human
uccagacagugugcuguuugaa

SEQ ID NO: 2853771 - RNA, 19 nt, Human
uccagacauacgaaacaca

SEQ ID NO: 2853772 - RNA, 20 nt, Human
uccagacauacgaaacacaa

SEQ ID NO: 2853773 - RNA, 13 nt, Human
uccagacaucaug

SEQ ID NO: 2853774 - RNA, 21 nt, Human
uccagacaucaugaauuuuac

SEQ ID NO: 2853775 - RNA, 16 nt, Human
uccagccgccauugcc

SEQ ID NO: 2853776 - RNA, 15 nt, Human
uccagcccgggagcc

SEQ ID NO: 2853777 - RNA, 18 nt, Human
uccagcccgggagccuag

SEQ ID NO: 2853778 - RNA, 20 nt, Human
uccagcccgggagccuagga

SEQ ID NO: 2853779 - RNA, 21 nt, Human
uccagcccgggagccuaggac

SEQ ID NO: 2853780 - RNA, 23 nt, Human
uccagcccgggagccuaggacca

SEQ ID NO: 2853781 - RNA, 19 nt, Human
uccagcccuauucugccac

SEQ ID NO: 2853782 - RNA, 11 nt, Human
uccagccucac

SEQ ID NO: 2853783 - RNA, 23 nt, Human
uccagccgccauugccaccagga

SEQ ID NO: 2853784 - RNA, 22 nt, Human
uccagccgccauugccaccagg

SEQ ID NO: 2853785 - RNA, 21 nt, Human
uccagccgccauugccaccag

SEQ ID NO: 2853786 - RNA, 20 nt, Human
uccagccgccauugccacca

SEQ ID NO: 2853787 - RNA, 19 nt, Human
uccagccgccauugccacc

SEQ ID NO: 2853788 - RNA, 18 nt, Human
uccagccgccauugccac

SEQ ID NO: 2853789 - RNA, 20 nt, Human
uccagccugcccaagcccag

SEQ ID NO: 2853790 - RNA, 14 nt, Human
uccagccuggagau

SEQ ID NO: 2853791 - RNA, 15 nt, Human
uccaggagccugugc

SEQ ID NO: 2853792 - RNA, 23 nt, Human
uccaggagccuggcuccguccag

SEQ ID NO: 2853793 - RNA, 14 nt, Human
uccaggagccuggc

SEQ ID NO: 2853794 - RNA, 13 nt, Human
uccaggagccugg

SEQ ID NO: 2853795 - RNA, 13 nt, Human
acgcuggaccuug

SEQ ID NO: 2853796 - RNA, 22 nt, Human
acgcucuccuuucuuucuaacu

SEQ ID NO: 2853797 - RNA, 13 nt, Human
acgcuccgcugcc

SEQ ID NO: 2853798 - RNA, 20 nt, Human
acgcuccgcugccgugccgc

SEQ ID NO: 2853799 - RNA, 14 nt, Human
acgcuccuuccucu

SEQ ID NO: 2853800 - RNA, 15 nt, Human
acgcuccuuccucug

SEQ ID NO: 2853801 - RNA, 15 nt, Human
acgcgucuccuguuu

SEQ ID NO: 2853802 - RNA, 16 nt, Human
acgcuggagugcagug

SEQ ID NO: 2853803 - RNA, 15 nt, Human
acgcuggagugcagu

SEQ ID NO: 2853804 - RNA, 23 nt, Human
acgcuggaccuugaacuggguac

SEQ ID NO: 2853805 - RNA, 20 nt, Human
acgcuggaccuugaacuggg

SEQ ID NO: 2853806 - RNA, 17 nt, Human
acgcuggagugcaguga

SEQ ID NO: 2853807 - RNA, 23 nt, Human
acggagucccaccuuggcugcag

SEQ ID NO: 2853808 - RNA, 17 nt, Human
acgccugcaaacgcugc

SEQ ID NO: 2853809 - RNA, 14 nt, Human
acgccugcaaacgc

SEQ ID NO: 2853810 - RNA, 21 nt, Human
acgccugcaaacgcugccugc

SEQ ID NO: 2853811 - RNA, 20 nt, Human
acgccugcaaacgcugccug

SEQ ID NO: 2853812 - RNA, 19 nt, Human
acgccugcaaacgcugccu

SEQ ID NO: 2853813 - RNA, 18 nt, Human
acgccugcaaacgcugcc

SEQ ID NO: 2853814 - RNA, 14 nt, Human
acgaauauuuucag

SEQ ID NO: 2853815 - RNA, 23 nt, Human
acgccggggacagaggccugccc

SEQ ID NO: 2853816 - RNA, 18 nt, Human
acgccgucuccauggcau

SEQ ID NO: 2853817 - RNA, 16 nt, Human
acgccuaugaucccag

SEQ ID NO: 2853818 - RNA, 18 nt, Human
acgccuaugaucccagca

SEQ ID NO: 2853819 - RNA, 17 nt, Human
acgccuaugaucccagc

SEQ ID NO: 2853820 - RNA, 15 nt, Human
acgccucccacuggg

SEQ ID NO: 2853821 - RNA, 23 nt, Human
acgccucucccuaggagaagagu

SEQ ID NO: 2853822 - RNA, 14 nt, Human
acgccucccacugg

SEQ ID NO: 2853823 - RNA, 15 nt, Human
acgcuaccucucugu

SEQ ID NO: 2853824 - RNA, 20 nt, Human
acgcuaccucucugucccuu

SEQ ID NO: 2853825 - RNA, 18 nt, Human
acgcuacuauaaagagaa

SEQ ID NO: 2853826 - RNA, 19 nt, Human
acgcuacuauaaagagaag

SEQ ID NO: 2853827 - RNA, 20 nt, Human
acgcgccuugucuccuacuc

SEQ ID NO: 2853828 - RNA, 14 nt, Human
acgcgcgcacacac

SEQ ID NO: 2853829 - RNA, 18 nt, Human
acgcgcuucgacuuuucu

SEQ ID NO: 2853830 - RNA, 16 nt, Human
acgcgcgcgcacacac

SEQ ID NO: 2853831 - RNA, 15 nt, Human
acgcgcgcacacaca

SEQ ID NO: 2853832 - RNA, 12 nt, Human
acgcguauuuac

SEQ ID NO: 2853833 - RNA, 12 nt, Human
acgcgucuccug

SEQ ID NO: 2853834 - RNA, 21 nt, Human
acgccuguaaucccagcacuu

SEQ ID NO: 2853835 - RNA, 16 nt, Human
acgccuguaguccuag

SEQ ID NO: 2853836 - RNA, 14 nt, Human
acgccuuccccuca

SEQ ID NO: 2853837 - RNA, 17 nt, Human
acgccuuccccucagcc

SEQ ID NO: 2853838 - RNA, 13 nt, Human
acgcgaaaccaau

SEQ ID NO: 2853839 - RNA, 19 nt, Human
acgcgaaaccaauuccuca

SEQ ID NO: 2853840 - RNA, 20 nt, Human
acgcgaaaccaauuccucau

SEQ ID NO: 2853841 - RNA, 13 nt, Human
acgcgcagaugug

SEQ ID NO: 2853842 - RNA, 19 nt, Human
acgcgcagaugugcagcag

SEQ ID NO: 2853843 - RNA, 20 nt, Human
acgcgcagaugugcagcaga

SEQ ID NO: 2853844 - RNA, 21 nt, Human
acgcgcagaugugcagcagau

SEQ ID NO: 2853845 - RNA, 22 nt, Human
acgcgcagaugugcagcagauu

SEQ ID NO: 2853846 - RNA, 15 nt, Human
acgcgccccccuccc

SEQ ID NO: 2853847 - RNA, 17 nt, Human
acgcgccccccucccag

SEQ ID NO: 2853848 - RNA, 18 nt, Human
acgcgccccccucccaga

SEQ ID NO: 2853849 - RNA, 20 nt, Human
acgcgccccccucccagagg

SEQ ID NO: 2853850 - RNA, 11 nt, Human
acgccuggcua

SEQ ID NO: 2853851 - RNA, 23 nt, Human
acgccugcaaacgcugccugccc

SEQ ID NO: 2853852 - RNA, 22 nt, Human
acgccugcaaacgcugccugcc

SEQ ID NO: 2853853 - RNA, 14 nt, Human
uccagucucuugua

SEQ ID NO: 2853854 - RNA, 16 nt, Human
uccagucucuuguaca

SEQ ID NO: 2853855 - RNA, 22 nt, Human
uccagucucuuguacagcguuu

SEQ ID NO: 2853856 - RNA, 15 nt, Human
uccagugcaaccaca

SEQ ID NO: 2853857 - RNA, 17 nt, Human
uccagugcaaccacaca

SEQ ID NO: 2853858 - RNA, 14 nt, Human
uccagugccagcaa

SEQ ID NO: 2853859 - RNA, 17 nt, Human
uccagugccagcaauga

SEQ ID NO: 2853860 - RNA, 17 nt, Human
uccaguggagguuuguc

SEQ ID NO: 2853861 - RNA, 22 nt, Human
uccaguggagguuugucgggca

SEQ ID NO: 2853862 - RNA, 13 nt, Human
uccaguauucuug

SEQ ID NO: 2853863 - RNA, 19 nt, Human
uccaguauucuugucaaaa

SEQ ID NO: 2853864 - RNA, 17 nt, Human
uccagucccccuauccu

SEQ ID NO: 2853865 - RNA, 18 nt, Human
uccagucccccuauccuu

SEQ ID NO: 2853866 - RNA, 21 nt, Human
uccagucccccuauccuuggc

SEQ ID NO: 2853867 - RNA, 22 nt, Human
uccagucccccuauccuuggca

SEQ ID NO: 2853868 - RNA, 23 nt, Human
uccagucccccuauccuuggcac

SEQ ID NO: 2853869 - RNA, 16 nt, Human
uccaguccaaggaaac

SEQ ID NO: 2853870 - RNA, 23 nt, Human
uccaguccaaggaaaccacagcu

SEQ ID NO: 2853871 - RNA, 12 nt, Human
acggccaggcca

SEQ ID NO: 2853872 - RNA, 21 nt, Human
acggcauuagcuuccugcccc

SEQ ID NO: 2853873 - RNA, 18 nt, Human
acggcucacugcagccuc

SEQ ID NO: 2853874 - RNA, 17 nt, Human
acggcucacugcagccu

SEQ ID NO: 2853875 - RNA, 16 nt, Human
acggcucacugcagcc

SEQ ID NO: 2853876 - RNA, 11 nt, Human
acggcugggca

SEQ ID NO: 2853877 - RNA, 22 nt, Human
acggcugggcacacgccuccca

SEQ ID NO: 2853878 - RNA, 15 nt, Human
acgggaagcaaccuc

SEQ ID NO: 2853879 - RNA, 19 nt, Human
acgggaagcaaccucccaa

SEQ ID NO: 2853880 - RNA, 21 nt, Human
acgggaagcgcucagaacagu

SEQ ID NO: 2853881 - RNA, 15 nt, Human
uccaguaaucuaaua

SEQ ID NO: 2853882 - RNA, 19 nt, Human
uccaguaaucuaauauggc

SEQ ID NO: 2853883 - RNA, 15 nt, Human
uccaguaccuugcuu

SEQ ID NO: 2853884 - RNA, 22 nt, Human
uccaguaccuugcuucuuacug

SEQ ID NO: 2853885 - RNA, 13 nt, Human
uccagugguucug

SEQ ID NO: 2853886 - RNA, 13 nt, Human
uccaguguacaua

SEQ ID NO: 2853887 - RNA, 20 nt, Human
uccaguguacauaguguaau

SEQ ID NO: 2853888 - RNA, 17 nt, Human
uccaguguucuaugaac

SEQ ID NO: 2853889 - RNA, 16 nt, Human
acggugaaggugacag

SEQ ID NO: 2853890 - RNA, 19 nt, Human
acggugaaggugacagcag

SEQ ID NO: 2853891 - RNA, 22 nt, Human
acggugcuccaggcaggcuaag

SEQ ID NO: 2853892 - RNA, 15 nt, Human
acggugcuccaggca

SEQ ID NO: 2853893 - RNA, 18 nt, Human
acggugcuccaggcaggc

SEQ ID NO: 2853894 - RNA, 14 nt, Human
acguauuuuaaaag

SEQ ID NO: 2853895 - RNA, 21 nt, Human
acgucacguguaguguccauu

SEQ ID NO: 2853896 - RNA, 17 nt, Human
acgucaaacaugaagug

SEQ ID NO: 2853897 - RNA, 16 nt, Human
acgucaaacaugaagu

SEQ ID NO: 2853898 - RNA, 14 nt, Human
acgucaaacaugaa

SEQ ID NO: 2853899 - RNA, 18 nt, Human
acguaaccacggaaaaga

SEQ ID NO: 2853900 - RNA, 13 nt, Human
acguaagcacugu

SEQ ID NO: 2853901 - RNA, 15 nt, Human
acguaagcacuguuu

SEQ ID NO: 2853902 - RNA, 17 nt, Human
acguaagcacuguuuuu

SEQ ID NO: 2853903 - RNA, 21 nt, Human
acgguuuuuuauuauuguggu

SEQ ID NO: 2853904 - RNA, 12 nt, Human
acguaaagaacu

SEQ ID NO: 2853905 - RNA, 15 nt, Human
acguaaagaacuuuu

SEQ ID NO: 2853906 - RNA, 17 nt, Human
acggugacaaagauggc

SEQ ID NO: 2853907 - RNA, 22 nt, Human
acguguuuuauuccuguauguu

SEQ ID NO: 2853908 - RNA, 11 nt, Human
acguguuuaaa

SEQ ID NO: 2853909 - RNA, 18 nt, Human
acgucagacuuggcucag

SEQ ID NO: 2853910 - RNA, 17 nt, Human
acgucagacuuggcuca

SEQ ID NO: 2853911 - RNA, 21 nt, Human
acgucacuggaccacugggca

SEQ ID NO: 2853912 - RNA, 21 nt, Human
acguccagguucaacccacag

SEQ ID NO: 2853913 - RNA, 18 nt, Human
acguucacccaucuuauc

SEQ ID NO: 2853914 - RNA, 21 nt, Human
acguucacccaucuuaucaag

SEQ ID NO: 2853915 - RNA, 15 nt, Human
acguuaccaggcagg

SEQ ID NO: 2853916 - RNA, 15 nt, Human
acguuacucagggcu

SEQ ID NO: 2853917 - RNA, 19 nt, Human
acguuacucagggcuccuc

SEQ ID NO: 2853918 - RNA, 23 nt, Human
acguuacucagggcuccucccag

SEQ ID NO: 2853919 - RNA, 14 nt, Human
acuaacacaaggac

SEQ ID NO: 2853920 - RNA, 15 nt, Human
acuaacacaaggaca

SEQ ID NO: 2853921 - RNA, 13 nt, Human
acuaaauguucua

SEQ ID NO: 2853922 - RNA, 14 nt, Human
acuaaauguucuau

SEQ ID NO: 2853923 - RNA, 20 nt, Human
acuaaauucgugauuuucaa

SEQ ID NO: 2853924 - RNA, 12 nt, Human
acuaaauuuaaa

SEQ ID NO: 2853925 - RNA, 19 nt, Human
acuaaauuuaaauuuaaag

SEQ ID NO: 2853926 - RNA, 22 nt, Human
acuaaauuuaaauuuaaagaua

SEQ ID NO: 2853927 - RNA, 13 nt, Human
acuaaauuugaua

SEQ ID NO: 2853928 - RNA, 15 nt, Human
acuaaauuugauacu

SEQ ID NO: 2853929 - RNA, 17 nt, Human
acuaaauuugauacuua

SEQ ID NO: 2853930 - RNA, 18 nt, Human
acuaaauuugauacuuau

SEQ ID NO: 2853931 - RNA, 20 nt, Human
acuaaauuugauacuuauau

SEQ ID NO: 2853932 - RNA, 21 nt, Human
acuaaauuugauacuuauauu

SEQ ID NO: 2853933 - RNA, 22 nt, Human
acuaaauuugauacuuauauuu

SEQ ID NO: 2853934 - RNA, 14 nt, Human
acuaaauuugggga

SEQ ID NO: 2853935 - RNA, 19 nt, Human
acuaaauuuggggacagau

SEQ ID NO: 2853936 - RNA, 20 nt, Human
acuaaauuuggggacagauu

SEQ ID NO: 2853937 - RNA, 21 nt, Human
acuaaauuuggggacagauuc

SEQ ID NO: 2853938 - RNA, 24 nt, Human
acuaaauuuggggacagauucagu

SEQ ID NO: 2853939 - RNA, 21 nt, Human
acuaauuuuaguauucauucu

SEQ ID NO: 2853940 - RNA, 17 nt, Human
acuaauuugauguuuac

SEQ ID NO: 2853941 - RNA, 13 nt, Human
acuacacauuuuu

SEQ ID NO: 2853942 - RNA, 15 nt, Human
acuacacauuuuuaa

SEQ ID NO: 2853943 - RNA, 16 nt, Human
acuacacauuuuuaaa

SEQ ID NO: 2853944 - RNA, 18 nt, Human
acuacacauuuuuaaauu

SEQ ID NO: 2853945 - RNA, 20 nt, Human
acuacacauuuuuaaauugu

SEQ ID NO: 2853946 - RNA, 21 nt, Human
acuacacauuuuuaaauuguu

SEQ ID NO: 2853947 - RNA, 22 nt, Human
acuacacauuuuuaaauuguua

SEQ ID NO: 2853948 - RNA, 13 nt, Human
acuacaccacaca

SEQ ID NO: 2853949 - RNA, 14 nt, Human
acuacaccacacac

SEQ ID NO: 2853950 - RNA, 15 nt, Human
acuacaccacacaca

SEQ ID NO: 2853951 - RNA, 16 nt, Human
acuacaccacacacaa

SEQ ID NO: 2853952 - RNA, 23 nt, Human
acuacaccacacacaacagccaa

SEQ ID NO: 2853953 - RNA, 20 nt, Human
acuacacaucccuaaugugu

SEQ ID NO: 2853954 - RNA, 23 nt, Human
acuacacaucccuaaugugugcc

SEQ ID NO: 2853955 - RNA, 13 nt, Human
acuaaacuuuacc

SEQ ID NO: 2853956 - RNA, 21 nt, Human
acuaaagaaaauaucugaaau

SEQ ID NO: 2853957 - RNA, 16 nt, Human
acuaaagauccaagaa

SEQ ID NO: 2853958 - RNA, 18 nt, Human
acuaaagaagaucuguaa

SEQ ID NO: 2853959 - RNA, 20 nt, Human
acuaaagaagaucuguaauu

SEQ ID NO: 2853960 - RNA, 15 nt, Human
acuaaaugccuaguu

SEQ ID NO: 2853961 - RNA, 17 nt, Human
acuaaaugccuaguuuu

SEQ ID NO: 2853962 - RNA, 19 nt, Human
acuaaaugccuaguuuuua

SEQ ID NO: 2853963 - RNA, 20 nt, Human
acuaaaugccuaguuuuuag

SEQ ID NO: 2853964 - RNA, 13 nt, Human
acguuuguaugug

SEQ ID NO: 2853965 - RNA, 20 nt, Human
acguuuggaagauccuguga

SEQ ID NO: 2853966 - RNA, 23 nt, Human
acguuuggaagauccugugagga

SEQ ID NO: 2853967 - RNA, 12 nt, Human
acguuggugacg

SEQ ID NO: 2853968 - RNA, 10 nt, Human
acguuucuca

SEQ ID NO: 2853969 - RNA, 12 nt, Human
acguuucucauu

SEQ ID NO: 2853970 - RNA, 12 nt, Human
acguuucuucac

SEQ ID NO: 2853971 - RNA, 22 nt, Human
ucccagagcugguggacccagg

SEQ ID NO: 2853972 - RNA, 21 nt, Human
ucccagagcugguggacccag

SEQ ID NO: 2853973 - RNA, 19 nt, Human
ucccagagcugguggaccc

SEQ ID NO: 2853974 - RNA, 13 nt, Human
ucccagaggucca

SEQ ID NO: 2853975 - RNA, 14 nt, Human
ucccagagguccag

SEQ ID NO: 2853976 - RNA, 16 nt, Human
ucccagagguccagcc

SEQ ID NO: 2853977 - RNA, 17 nt, Human
ucccagagguccagccc

SEQ ID NO: 2853978 - RNA, 18 nt, Human
ucccagagguccagccca

SEQ ID NO: 2853979 - RNA, 19 nt, Human
ucccagagguccagcccau

SEQ ID NO: 2853980 - RNA, 22 nt, Human
ucccagagguccagcccaucuc

SEQ ID NO: 2853981 - RNA, 23 nt, Human
ucccagagguccagcccaucucg

SEQ ID NO: 2853982 - RNA, 15 nt, Human
ucccagagugcuggg

SEQ ID NO: 2853983 - RNA, 12 nt, Human
ucccagaguuug

SEQ ID NO: 2853984 - RNA, 23 nt, Human
acuaauuuuacacauuagauuuu

SEQ ID NO: 2853985 - RNA, 12 nt, Human
ucccagaaauua

SEQ ID NO: 2853986 - RNA, 16 nt, Human
ucccagacuacuauuu

SEQ ID NO: 2853987 - RNA, 20 nt, Human
ucccagacuacuauuuucuu

SEQ ID NO: 2853988 - RNA, 23 nt, Human
ucccagacuacuauuuucuuuuu

SEQ ID NO: 2853989 - RNA, 14 nt, Human
ucccagaaucccag

SEQ ID NO: 2853990 - RNA, 16 nt, Human
ucccagaaucccagcc

SEQ ID NO: 2853991 - RNA, 18 nt, Human
ucccagaaucccagccgg

SEQ ID NO: 2853992 - RNA, 19 nt, Human
ucccagaaucccagccggc

SEQ ID NO: 2853993 - RNA, 16 nt, Human
ucccagagcaaaauaa

SEQ ID NO: 2853994 - RNA, 15 nt, Human
acuacacuccagccu

SEQ ID NO: 2853995 - RNA, 21 nt, Human
ucccacuuggcaucagcuggc

SEQ ID NO: 2853996 - RNA, 23 nt, Human
ucccacuuggcaucagcuggcgu

SEQ ID NO: 2853997 - RNA, 12 nt, Human
ucccacuuguca

SEQ ID NO: 2853998 - RNA, 20 nt, Human
acuacacuccagccugagca

SEQ ID NO: 2853999 - RNA, 14 nt, Human
acuacacugaggag

SEQ ID NO: 2854000 - RNA, 16 nt, Human
acuacacugaggagag

SEQ ID NO: 2854001 - RNA, 19 nt, Human
acuacacuccagccugagc

SEQ ID NO: 2854002 - RNA, 18 nt, Human
acuacacuccagccugag

SEQ ID NO: 2854003 - RNA, 17 nt, Human
acuacacuccagccuga

SEQ ID NO: 2854004 - RNA, 16 nt, Human
acuaugccugugucuu

SEQ ID NO: 2854005 - RNA, 13 nt, Human
acuaucucagaga

SEQ ID NO: 2854006 - RNA, 13 nt, Human
acuauauuugcua

SEQ ID NO: 2854007 - RNA, 18 nt, Human
acuauagccuaggugaca

SEQ ID NO: 2854008 - RNA, 22 nt, Human
acuauagccuaggugacagagu

SEQ ID NO: 2854009 - RNA, 20 nt, Human
acuauagccuaggugacaga

SEQ ID NO: 2854010 - RNA, 18 nt, Human
acuagagggaccucuccc

SEQ ID NO: 2854011 - RNA, 11 nt, Human
acuagacucuu

SEQ ID NO: 2854012 - RNA, 17 nt, Human
acuagacucuucacugu

SEQ ID NO: 2854013 - RNA, 19 nt, Human
acuagacucuucacuguua

SEQ ID NO: 2854014 - RNA, 16 nt, Human
acuagacguucauuug

SEQ ID NO: 2854015 - RNA, 16 nt, Human
acuagagaugugcaau

SEQ ID NO: 2854016 - RNA, 16 nt, Human
acucaauggauuugau

SEQ ID NO: 2854017 - RNA, 16 nt, Human
acuauggcugaguucu

SEQ ID NO: 2854018 - RNA, 13 nt, Human
acucacaaaugau

SEQ ID NO: 2854019 - RNA, 22 nt, Human
acucacaagugcucaucuguug

SEQ ID NO: 2854020 - RNA, 16 nt, Human
acucaaugcacugaca

SEQ ID NO: 2854021 - RNA, 19 nt, Human
acucaauggaguaugucug

SEQ ID NO: 2854022 - RNA, 23 nt, Human
acucaauggaguaugucugaugg

SEQ ID NO: 2854023 - RNA, 24 nt, Human
acucaauggaguaugucugaugga

SEQ ID NO: 2854024 - RNA, 14 nt, Human
acucaagcccgcgg

SEQ ID NO: 2854025 - RNA, 12 nt, Human
acucaagcacug

SEQ ID NO: 2854026 - RNA, 15 nt, Human
acucaagcacugaua

SEQ ID NO: 2854027 - RNA, 16 nt, Human
acuauguugcccaggc

SEQ ID NO: 2854028 - RNA, 15 nt, Human
acuauguugcccagg

SEQ ID NO: 2854029 - RNA, 14 nt, Human
acuauguugcccag

SEQ ID NO: 2854030 - RNA, 12 nt, Human
acuaugccugug

SEQ ID NO: 2854031 - RNA, 19 nt, Human
acuaugccugugucuucuc

SEQ ID NO: 2854032 - RNA, 18 nt, Human
acuaugccugugucuucu

SEQ ID NO: 2854033 - RNA, 13 nt, Human
acuauggaaaauc

SEQ ID NO: 2854034 - RNA, 14 nt, Human
acuauggaaaauca

SEQ ID NO: 2854035 - RNA, 17 nt, Human
acuauggaaaaucagcu

SEQ ID NO: 2854036 - RNA, 20 nt, Human
acuauggaaaaucagcugcu

SEQ ID NO: 2854037 - RNA, 21 nt, Human
acuauggaaaaucagcugcuc

SEQ ID NO: 2854038 - RNA, 22 nt, Human
acuauggaaaaucagcugcuca

SEQ ID NO: 2854039 - RNA, 19 nt, Human
acuauggagccuggcacag

SEQ ID NO: 2854040 - RNA, 23 nt, Human
acuauggagccuggcacaggacu

SEQ ID NO: 2854041 - RNA, 14 nt, Human
acuacucuuugauu

SEQ ID NO: 2854042 - RNA, 15 nt, Human
acuacucuuugauuu

SEQ ID NO: 2854043 - RNA, 17 nt, Human
acuacugaaacagauuu

SEQ ID NO: 2854044 - RNA, 19 nt, Human
acuagacucccaagcugga

SEQ ID NO: 2854045 - RNA, 12 nt, Human
acuagagaaugc

SEQ ID NO: 2854046 - RNA, 16 nt, Human
acuagagaaugcacag

SEQ ID NO: 2854047 - RNA, 20 nt, Human
acuagagaaugcacagauau

SEQ ID NO: 2854048 - RNA, 23 nt, Human
acuagagaaugcacagauauacu

SEQ ID NO: 2854049 - RNA, 15 nt, Human
acuacuuaccauuug

SEQ ID NO: 2854050 - RNA, 20 nt, Human
acuagacaccaaaguucuaa

SEQ ID NO: 2854051 - RNA, 12 nt, Human
acuacugggugu

SEQ ID NO: 2854052 - RNA, 13 nt, Human
acuacuggguguc

SEQ ID NO: 2854053 - RNA, 14 nt, Human
acuacuggguguca

SEQ ID NO: 2854054 - RNA, 16 nt, Human
acuacugggugucauu

SEQ ID NO: 2854055 - RNA, 17 nt, Human
acuacugggugucauuu

SEQ ID NO: 2854056 - RNA, 18 nt, Human
acuacugggugucauuuc

SEQ ID NO: 2854057 - RNA, 19 nt, Human
acuacugggugucauuuca

SEQ ID NO: 2854058 - RNA, 20 nt, Human
acuacugggugucauuucau

SEQ ID NO: 2854059 - RNA, 21 nt, Human
acuacugggugucauuucauu

SEQ ID NO: 2854060 - RNA, 23 nt, Human
acuacugggugucauuucauucc

SEQ ID NO: 2854061 - RNA, 15 nt, Human
uccccaggggaguug

SEQ ID NO: 2854062 - RNA, 17 nt, Human
uccccaggggucccagc

SEQ ID NO: 2854063 - RNA, 20 nt, Human
uccccaggggucccagccac

SEQ ID NO: 2854064 - RNA, 18 nt, Human
uccccaggggucccagcc

SEQ ID NO: 2854065 - RNA, 23 nt, Human
uccccaggggucccagccacccc

SEQ ID NO: 2854066 - RNA, 22 nt, Human
uccccaggggucccagccaccc

SEQ ID NO: 2854067 - RNA, 19 nt, Human
ucccauuugugccagagga

SEQ ID NO: 2854068 - RNA, 17 nt, Human
ucccauuugugccagag

SEQ ID NO: 2854069 - RNA, 16 nt, Human
ucccauuugugccaga

SEQ ID NO: 2854070 - RNA, 14 nt, Human
ucccauuuguaauu

SEQ ID NO: 2854071 - RNA, 15 nt, Human
ucccauuuguaauuu

SEQ ID NO: 2854072 - RNA, 23 nt, Human
ucccauuucuaccuaagucagcu

SEQ ID NO: 2854073 - RNA, 16 nt, Human
ucccagcuacucggga

SEQ ID NO: 2854074 - RNA, 10 nt, Human
ucccagccug

SEQ ID NO: 2854075 - RNA, 13 nt, Human
ucccagccggcca

SEQ ID NO: 2854076 - RNA, 19 nt, Human
ucccagccggccaauggaa

SEQ ID NO: 2854077 - RNA, 21 nt, Human
ucccagccggccaauggaaac

SEQ ID NO: 2854078 - RNA, 22 nt, Human
ucccagccggccaauggaaacc

SEQ ID NO: 2854079 - RNA, 23 nt, Human
ucccagccggccaauggaaaccu

SEQ ID NO: 2854080 - RNA, 16 nt, Human
ucccagcuaccucaac

SEQ ID NO: 2854081 - RNA, 23 nt, Human
ucccagcuacucagaagccugag

SEQ ID NO: 2854082 - RNA, 21 nt, Human
ucccagcuacucagaagccug

SEQ ID NO: 2854083 - RNA, 19 nt, Human
ucccagcuacucagaagcc

SEQ ID NO: 2854084 - RNA, 16 nt, Human
ucccagcuacucagaa

SEQ ID NO: 2854085 - RNA, 11 nt, Human
ucucagccucc

SEQ ID NO: 2854086 - RNA, 21 nt, Human
ucucagccgcuucugacugcu

SEQ ID NO: 2854087 - RNA, 13 nt, Human
ucucagcccagaa

SEQ ID NO: 2854088 - RNA, 14 nt, Human
ucucagcccagaag

SEQ ID NO: 2854089 - RNA, 15 nt, Human
ucucagcccagaaga

SEQ ID NO: 2854090 - RNA, 16 nt, Human
ucucagcccagaagaa

SEQ ID NO: 2854091 - RNA, 18 nt, Human
ucucagcccagaagaaaa

SEQ ID NO: 2854092 - RNA, 20 nt, Human
ucucagcccagaagaaaauu

SEQ ID NO: 2854093 - RNA, 22 nt, Human
ucucagcccagaagaaaauucu

SEQ ID NO: 2854094 - RNA, 20 nt, Human
ucucaggcaccagucccugu

SEQ ID NO: 2854095 - RNA, 23 nt, Human
ucucaggauauccuuaucagagc

SEQ ID NO: 2854096 - RNA, 13 nt, Human
ucucaggauccaa

SEQ ID NO: 2854097 - RNA, 14 nt, Human
ucucaggauccaag

SEQ ID NO: 2854098 - RNA, 13 nt, Human
ucucaggcaccag

SEQ ID NO: 2854099 - RNA, 15 nt, Human
ucucaggauccaagc

SEQ ID NO: 2854100 - RNA, 16 nt, Human
ucucaggauccaagcu

SEQ ID NO: 2854101 - RNA, 16 nt, Human
ucucaggagauuucau

SEQ ID NO: 2854102 - RNA, 15 nt, Human
ucucaggagcauggg

SEQ ID NO: 2854103 - RNA, 13 nt, Human
ucucaggagccau

SEQ ID NO: 2854104 - RNA, 18 nt, Human
ucucauuuagaacuugca

SEQ ID NO: 2854105 - RNA, 14 nt, Human
ucucauuugucaca

SEQ ID NO: 2854106 - RNA, 19 nt, Human
ucucauuugccaauaauaa

SEQ ID NO: 2854107 - RNA, 16 nt, Human
ucucauuugucacaca

SEQ ID NO: 2854108 - RNA, 14 nt, Human
ucucagcaagagaa

SEQ ID NO: 2854109 - RNA, 23 nt, Human
ucucauuugguuugauuuucccu

SEQ ID NO: 2854110 - RNA, 16 nt, Human
ucucauuuuaauguaa

SEQ ID NO: 2854111 - RNA, 18 nt, Human
ucucauuuuaauguaaag

SEQ ID NO: 2854112 - RNA, 19 nt, Human
ucucauuuuaauguaaaga

SEQ ID NO: 2854113 - RNA, 20 nt, Human
ucucauuuuaauguaaagau

SEQ ID NO: 2854114 - RNA, 22 nt, Human
ucucauuuuaauguaaagauuu

SEQ ID NO: 2854115 - RNA, 18 nt, Human
ucucauguaucaucugga

SEQ ID NO: 2854116 - RNA, 21 nt, Human
ucucaugccucagccuccuga

SEQ ID NO: 2854117 - RNA, 15 nt, Human
ucucauguguuugca

SEQ ID NO: 2854118 - RNA, 17 nt, Human
ucucauguguuugcaua

SEQ ID NO: 2854119 - RNA, 16 nt, Human
ucucaggccaucauca

SEQ ID NO: 2854120 - RNA, 20 nt, Human
ucucaugccucagccuccug

SEQ ID NO: 2854121 - RNA, 22 nt, Human
acuugcuuuaugccuucuuauu

SEQ ID NO: 2854122 - RNA, 19 nt, Human
acuugcugucccuuggaac

SEQ ID NO: 2854123 - RNA, 23 nt, Human
acuugcugccugaagaacaguaa

SEQ ID NO: 2854124 - RNA, 17 nt, Human
acuugcugccugaagaa

SEQ ID NO: 2854125 - RNA, 16 nt, Human
acuugugguugaauua

SEQ ID NO: 2854126 - RNA, 16 nt, Human
acuugugguuuucaaa

SEQ ID NO: 2854127 - RNA, 17 nt, Human
acuugugguuuucaaau

SEQ ID NO: 2854128 - RNA, 11 nt, Human
acuugugaaug

SEQ ID NO: 2854129 - RNA, 22 nt, Human
acuuguggacacagcucuucuc

SEQ ID NO: 2854130 - RNA, 19 nt, Human
acuuguggacacagcucuu

SEQ ID NO: 2854131 - RNA, 17 nt, Human
acuugugaaacacagcu

SEQ ID NO: 2854132 - RNA, 18 nt, Human
acuugugaaacacagcug

SEQ ID NO: 2854133 - RNA, 19 nt, Human
acuugugaaacacagcugu

SEQ ID NO: 2854134 - RNA, 20 nt, Human
acuugugaaacacagcuguu

SEQ ID NO: 2854135 - RNA, 10 nt, Human
acuugugaau

SEQ ID NO: 2854136 - RNA, 18 nt, Human
acuugucaagccugugca

SEQ ID NO: 2854137 - RNA, 20 nt, Human
acuugucaagccugugcaaa

SEQ ID NO: 2854138 - RNA, 22 nt, Human
acuugcagacucuacagaggcc

SEQ ID NO: 2854139 - RNA, 19 nt, Human
acuugcagacucuacagag

SEQ ID NO: 2854140 - RNA, 23 nt, Human
acuugcagacucuacagaggcca

SEQ ID NO: 2854141 - RNA, 23 nt, Human
acuugcagcugauguuggaagag

SEQ ID NO: 2854142 - RNA, 20 nt, Human
acuugcagcugauguuggaa

SEQ ID NO: 2854143 - RNA, 23 nt, Human
ucucacuauguugcccaggcagg

SEQ ID NO: 2854144 - RNA, 22 nt, Human
ucucacuauguugcccaggcag

SEQ ID NO: 2854145 - RNA, 21 nt, Human
ucucacuauguugcccaggca

SEQ ID NO: 2854146 - RNA, 20 nt, Human
ucucacuauguugcccaggc

SEQ ID NO: 2854147 - RNA, 13 nt, Human
ucucaccucagcc

SEQ ID NO: 2854148 - RNA, 13 nt, Human
acuugaugcaugu

SEQ ID NO: 2854149 - RNA, 14 nt, Human
acuugaugcaugug

SEQ ID NO: 2854150 - RNA, 14 nt, Human
acuugauuaagauu

SEQ ID NO: 2854151 - RNA, 16 nt, Human
acuugauuaagauuuu

SEQ ID NO: 2854152 - RNA, 17 nt, Human
acuugauuaagauuuua

SEQ ID NO: 2854153 - RNA, 19 nt, Human
acuugauuaagauuuuaca

SEQ ID NO: 2854154 - RNA, 21 nt, Human
acuugauuaagauuuuacaaa

SEQ ID NO: 2854155 - RNA, 23 nt, Human
acuugauuaagauuuuacaaaag

SEQ ID NO: 2854156 - RNA, 18 nt, Human
acuuuggaguccccucac

SEQ ID NO: 2854157 - RNA, 22 nt, Human
acuuuggaguccccucaccucc

SEQ ID NO: 2854158 - RNA, 23 nt, Human
acuuuggagagugagcuacagag

SEQ ID NO: 2854159 - RNA, 23 nt, Human
acuuuggaguccccucaccuccu

SEQ ID NO: 2854160 - RNA, 12 nt, Human
acuuuguagugu

SEQ ID NO: 2854161 - RNA, 15 nt, Human
acuuuguaguguuug

SEQ ID NO: 2854162 - RNA, 20 nt, Human
acuuuguaguguuuggugcu

SEQ ID NO: 2854163 - RNA, 12 nt, Human
acuuuguaaauu

SEQ ID NO: 2854164 - RNA, 13 nt, Human
acuuuguaaauuc

SEQ ID NO: 2854165 - RNA, 18 nt, Human
acuuugguuucugucugu

SEQ ID NO: 2854166 - RNA, 11 nt, Human
acuuuuuacaa

SEQ ID NO: 2854167 - RNA, 19 nt, Human
acuuuuuaacuauuaagag

SEQ ID NO: 2854168 - RNA, 19 nt, Human
acuuuuguguaaugaaaau

SEQ ID NO: 2854169 - RNA, 13 nt, Human
agaaaaaauaaau

SEQ ID NO: 2854170 - RNA, 14 nt, Human
agaaaaaauaaaug

SEQ ID NO: 2854171 - RNA, 15 nt, Human
agaaaaaauaaaugg

SEQ ID NO: 2854172 - RNA, 16 nt, Human
agaaaaaauaaaugga

SEQ ID NO: 2854173 - RNA, 19 nt, Human
ucuccuuguggccugggcc

SEQ ID NO: 2854174 - RNA, 18 nt, Human
agaaaaaauaacacacau

SEQ ID NO: 2854175 - RNA, 16 nt, Human
ucuccucauguucugc

SEQ ID NO: 2854176 - RNA, 23 nt, Human
ucuccgaccagacaccuugacag

SEQ ID NO: 2854177 - RNA, 17 nt, Human
ucuccgaccagacaccu

SEQ ID NO: 2854178 - RNA, 12 nt, Human
ucuccccagagu

SEQ ID NO: 2854179 - RNA, 23 nt, Human
ucuccccagcaagugagagcugg

SEQ ID NO: 2854180 - RNA, 22 nt, Human
ucuccccacacuaaccuggguu

SEQ ID NO: 2854181 - RNA, 14 nt, Human
ucuccccaccccua

SEQ ID NO: 2854182 - RNA, 17 nt, Human
ucuccccaccccuaccc

SEQ ID NO: 2854183 - RNA, 12 nt, Human
ucuccccagaau

SEQ ID NO: 2854184 - RNA, 12 nt, Human
ucuccacccugc

SEQ ID NO: 2854185 - RNA, 17 nt, Human
ucuccaagucucagugg

SEQ ID NO: 2854186 - RNA, 17 nt, Human
acuuuacccaaaaacua

SEQ ID NO: 2854187 - RNA, 17 nt, Human
acuuuacccaccuagaa

SEQ ID NO: 2854188 - RNA, 13 nt, Human
acuuuacccaccu

SEQ ID NO: 2854189 - RNA, 14 nt, Human
acuuucuguaaacu

SEQ ID NO: 2854190 - RNA, 18 nt, Human
acuuucuguaaacucaaa

SEQ ID NO: 2854191 - RNA, 18 nt, Human
acuuuacccaccuagaac

SEQ ID NO: 2854192 - RNA, 19 nt, Human
acuuucuguaaacucaaaa

SEQ ID NO: 2854193 - RNA, 22 nt, Human
acuuucuguuggauuccaugcu

SEQ ID NO: 2854194 - RNA, 23 nt, Human
acuuucuguuggauuccaugcua

SEQ ID NO: 2854195 - RNA, 14 nt, Human
acuuucuuauccua

SEQ ID NO: 2854196 - RNA, 15 nt, Human
acuuuacacucggcu

SEQ ID NO: 2854197 - RNA, 18 nt, Human
acuuuacacucggcuuug

SEQ ID NO: 2854198 - RNA, 20 nt, Human
acuuuacacucggcuuugga

SEQ ID NO: 2854199 - RNA, 10 nt, Human
acuuuaauuu

SEQ ID NO: 2854200 - RNA, 14 nt, Human
acuuuaauuuaugu

SEQ ID NO: 2854201 - RNA, 22 nt, Human
acuuuaauuuauguaacuugaa

SEQ ID NO: 2854202 - RNA, 15 nt, Human
ucuaggaagacauuu

SEQ ID NO: 2854203 - RNA, 14 nt, Human
ucuaguuucuugug

SEQ ID NO: 2854204 - RNA, 14 nt, Human
ucuaguuuacagaa

SEQ ID NO: 2854205 - RNA, 15 nt, Human
ucuaguuuacagaaa

SEQ ID NO: 2854206 - RNA, 21 nt, Human
ucuaguuuacagaaaaaucuu

SEQ ID NO: 2854207 - RNA, 21 nt, Human
ucuaguugccaaaucuggcuc

SEQ ID NO: 2854208 - RNA, 20 nt, Human
ucuauaaagaagaacuugca

SEQ ID NO: 2854209 - RNA, 20 nt, Human
ucuauaaagcgauauacaga

SEQ ID NO: 2854210 - RNA, 22 nt, Human
ucuauaaagcgauauacagaug

SEQ ID NO: 2854211 - RNA, 16 nt, Human
ucuauaaauuguccgu

SEQ ID NO: 2854212 - RNA, 16 nt, Human
ucuauaaggccauaaa

SEQ ID NO: 2854213 - RNA, 18 nt, Human
ucuauacaucucucccca

SEQ ID NO: 2854214 - RNA, 14 nt, Human
ucuauaaggccaua

SEQ ID NO: 2854215 - RNA, 13 nt, Human
ucuauaaggccau

SEQ ID NO: 2854216 - RNA, 14 nt, Human
acuuccccuaugga

SEQ ID NO: 2854217 - RNA, 18 nt, Human
acuucauauaugaggacu

SEQ ID NO: 2854218 - RNA, 19 nt, Human
acuuccccuuccuaauucc

SEQ ID NO: 2854219 - RNA, 13 nt, Human
acuuccccuuccu

SEQ ID NO: 2854220 - RNA, 17 nt, Human
acuucccuaacacuuac

SEQ ID NO: 2854221 - RNA, 13 nt, Human
ucuagacaagaua

SEQ ID NO: 2854222 - RNA, 14 nt, Human
ucuagacaagauau

SEQ ID NO: 2854223 - RNA, 17 nt, Human
ucuagacaagauauugu

SEQ ID NO: 2854224 - RNA, 18 nt, Human
ucuagacaagauauugua

SEQ ID NO: 2854225 - RNA, 20 nt, Human
ucuagacaagauauuguaca

SEQ ID NO: 2854226 - RNA, 21 nt, Human
ucuagacaagauauuguacau

SEQ ID NO: 2854227 - RNA, 23 nt, Human
ucuagacaagauauuguacauaa

SEQ ID NO: 2854228 - RNA, 23 nt, Human
ucuagacaauauacaagccaaag

SEQ ID NO: 2854229 - RNA, 14 nt, Human
ucuagacacugcca

SEQ ID NO: 2854230 - RNA, 22 nt, Human
ucuagacauggagguucuaagg

SEQ ID NO: 2854231 - RNA, 18 nt, Human
ucuagacauggagguucu

SEQ ID NO: 2854232 - RNA, 19 nt, Human
ucuagacauggagguucua

SEQ ID NO: 2854233 - RNA, 20 nt, Human
ucuagacauggagguucuaa

SEQ ID NO: 2854234 - RNA, 21 nt, Human
acuucccugauugaccugcuc

SEQ ID NO: 2854235 - RNA, 22 nt, Human
acuucccugauugaccugcucc

SEQ ID NO: 2854236 - RNA, 11 nt, Human
acuucccugcu

SEQ ID NO: 2854237 - RNA, 14 nt, Human
acuucccugcugcc

SEQ ID NO: 2854238 - RNA, 16 nt, Human
acuucccugcugccug

SEQ ID NO: 2854239 - RNA, 15 nt, Human
ucuagauaccuaaaa

SEQ ID NO: 2854240 - RNA, 17 nt, Human
ucuagauaccuaaaaca

SEQ ID NO: 2854241 - RNA, 18 nt, Human
ucuagauaccuaaaacau

SEQ ID NO: 2854242 - RNA, 19 nt, Human
ucuagauaccuaaaacaua

SEQ ID NO: 2854243 - RNA, 22 nt, Human
ucuagauaccuaaaacauaaga

SEQ ID NO: 2854244 - RNA, 13 nt, Human
ucuagaguccaag

SEQ ID NO: 2854245 - RNA, 15 nt, Human
ucuagaguccaaggu

SEQ ID NO: 2854246 - RNA, 20 nt, Human
ucuagaguccaagguuuaaa

SEQ ID NO: 2854247 - RNA, 14 nt, Human
ucuagaguucagag

SEQ ID NO: 2854248 - RNA, 18 nt, Human
ucuagaguucagaguccu

SEQ ID NO: 2854249 - RNA, 16 nt, Human
ucuagagauauauaua

SEQ ID NO: 2854250 - RNA, 18 nt, Human
ucuagagauauauauacu

SEQ ID NO: 2854251 - RNA, 13 nt, Human
ucuagacuuucug

SEQ ID NO: 2854252 - RNA, 14 nt, Human
ucuagacuuucugu

SEQ ID NO: 2854253 - RNA, 15 nt, Human
ucuagacuuucuguu

SEQ ID NO: 2854254 - RNA, 16 nt, Human
ucucacuauguugccc

SEQ ID NO: 2854255 - RNA, 19 nt, Human
ucucacuauguugcccagg

SEQ ID NO: 2854256 - RNA, 17 nt, Human
ucucacuauguugccca

SEQ ID NO: 2854257 - RNA, 15 nt, Human
ucucaccccauccca

SEQ ID NO: 2854258 - RNA, 18 nt, Human
ucuauuuuggauuguaua

SEQ ID NO: 2854259 - RNA, 17 nt, Human
ucuauuuuguaaacuca

SEQ ID NO: 2854260 - RNA, 19 nt, Human
ucucaccccaucccacacc

SEQ ID NO: 2854261 - RNA, 17 nt, Human
ucucaccccaucccaca

SEQ ID NO: 2854262 - RNA, 21 nt, Human
ucucaccccaucccacacccu

SEQ ID NO: 2854263 - RNA, 19 nt, Human
ucucaccuaaaaaaagaga

SEQ ID NO: 2854264 - RNA, 13 nt, Human
ucuauugccuucu

SEQ ID NO: 2854265 - RNA, 16 nt, Human
ucuauugccuucuuug

SEQ ID NO: 2854266 - RNA, 17 nt, Human
ucuauugccuucuuuga

SEQ ID NO: 2854267 - RNA, 18 nt, Human
ucuauugccuucuuugaa

SEQ ID NO: 2854268 - RNA, 19 nt, Human
ucuauugccuucuuugaag

SEQ ID NO: 2854269 - RNA, 20 nt, Human
ucuauugccuucuuugaaga

SEQ ID NO: 2854270 - RNA, 21 nt, Human
ucuauugccuucuuugaagaa

SEQ ID NO: 2854271 - RNA, 15 nt, Human
ucuauuuaaguaaaa

SEQ ID NO: 2854272 - RNA, 12 nt, Human
ucuauuuaagcc

SEQ ID NO: 2854273 - RNA, 12 nt, Human
ucuauuuaauau

SEQ ID NO: 2854274 - RNA, 13 nt, Human
ucuauuuaauauu

SEQ ID NO: 2854275 - RNA, 18 nt, Human
ucuauuuaauuaggaaaa

SEQ ID NO: 2854276 - RNA, 20 nt, Human
ucuauuuaauuaggaaaaaa

SEQ ID NO: 2854277 - RNA, 13 nt, Human
ucuauuuauguuu

SEQ ID NO: 2854278 - RNA, 15 nt, Human
ucuauuuauguuugc

SEQ ID NO: 2854279 - RNA, 14 nt, Human
ucuauuuauuaagu

SEQ ID NO: 2854280 - RNA, 18 nt, Human
ucuauuuauauguacaug

SEQ ID NO: 2854281 - RNA, 14 nt, Human
ucuauuuaugccuu

SEQ ID NO: 2854282 - RNA, 13 nt, Human
ucuauuuauaugu

SEQ ID NO: 2854283 - RNA, 15 nt, Human
ucuauuuuaaaauaa

SEQ ID NO: 2854284 - RNA, 16 nt, Human
ucuauuuauuaauauu

SEQ ID NO: 2854285 - RNA, 14 nt, Human
ucuauuugacuugu

SEQ ID NO: 2854286 - RNA, 18 nt, Human
ucuauuugacuugugguu

SEQ ID NO: 2854287 - RNA, 15 nt, Human
ucuauuuuggauugu

SEQ ID NO: 2854288 - RNA, 13 nt, Human
ucuauuuugaugc

SEQ ID NO: 2854289 - RNA, 15 nt, Human
ucuauuuugaugcag

SEQ ID NO: 2854290 - RNA, 20 nt, Human
ucuauuuugaugcagcauuu

SEQ ID NO: 2854291 - RNA, 21 nt, Human
ucuauuuugaugcagcauuug

SEQ ID NO: 2854292 - RNA, 23 nt, Human
ucuauuuugaugcagcauuugau

SEQ ID NO: 2854293 - RNA, 14 nt, Human
ucuauuuuagaaua

SEQ ID NO: 2854294 - RNA, 11 nt, Human
ucuauuuucua

SEQ ID NO: 2854295 - RNA, 14 nt, Human
ucuauuuucuaugu

SEQ ID NO: 2854296 - RNA, 15 nt, Human
ucuauuuucuaugua

SEQ ID NO: 2854297 - RNA, 16 nt, Human
ucuauuuucuauguac

SEQ ID NO: 2854298 - RNA, 18 nt, Human
ucuauuuucuauguacua

SEQ ID NO: 2854299 - RNA, 23 nt, Human
ucuaugggacucaaugcacugac

SEQ ID NO: 2854300 - RNA, 14 nt, Human
ucuaugguuaugaa

SEQ ID NO: 2854301 - RNA, 16 nt, Human
ucuaugguuaugaaag

SEQ ID NO: 2854302 - RNA, 18 nt, Human
ucuaugguuaugaaagaa

SEQ ID NO: 2854303 - RNA, 20 nt, Human
ucuaugguuaugaaagaaua

SEQ ID NO: 2854304 - RNA, 22 nt, Human
ucuaugguuaugaaagaauaua

SEQ ID NO: 2854305 - RNA, 13 nt, Human
ucuauaacagaua

SEQ ID NO: 2854306 - RNA, 19 nt, Human
ucuauggggagaggaacuc

SEQ ID NO: 2854307 - RNA, 12 nt, Human
ucuauguacuag

SEQ ID NO: 2854308 - RNA, 18 nt, Human
ucuauguacuaguacugu

SEQ ID NO: 2854309 - RNA, 20 nt, Human
ucuauguacuaguacugugu

SEQ ID NO: 2854310 - RNA, 21 nt, Human
ucuauguacuaguacugugua

SEQ ID NO: 2854311 - RNA, 22 nt, Human
ucuauguacuaguacuguguac

SEQ ID NO: 2854312 - RNA, 14 nt, Human
ucuauguaggaaaa

SEQ ID NO: 2854313 - RNA, 15 nt, Human
ucuauguaggaaaaa

SEQ ID NO: 2854314 - RNA, 18 nt, Human
ucuauguaggaaaaaaau

SEQ ID NO: 2854315 - RNA, 19 nt, Human
ucuauguaggaaaaaaaua

SEQ ID NO: 2854316 - RNA, 12 nt, Human
ucuauguuuacu

SEQ ID NO: 2854317 - RNA, 20 nt, Human
ucuauaccugucuccuuucu

SEQ ID NO: 2854318 - RNA, 12 nt, Human
ucuauuccagcu

SEQ ID NO: 2854319 - RNA, 13 nt, Human
ucuauuccagcuc

SEQ ID NO: 2854320 - RNA, 14 nt, Human
ucuauuccagcuca

SEQ ID NO: 2854321 - RNA, 15 nt, Human
ucuauuccagcucau

SEQ ID NO: 2854322 - RNA, 18 nt, Human
ucuauuccagcucauuca

SEQ ID NO: 2854323 - RNA, 19 nt, Human
ucuauuccagcucauucau

SEQ ID NO: 2854324 - RNA, 20 nt, Human
ucuauuccagcucauucauu

SEQ ID NO: 2854325 - RNA, 23 nt, Human
ucuauuccagcucauucauuuua

SEQ ID NO: 2854326 - RNA, 16 nt, Human
ucuauuccuucuggcc

SEQ ID NO: 2854327 - RNA, 17 nt, Human
ucuauuccuucuggccu

SEQ ID NO: 2854328 - RNA, 18 nt, Human
ucuauuccuucuggccuu

SEQ ID NO: 2854329 - RNA, 19 nt, Human
ucuauucugagaaaacaag

SEQ ID NO: 2854330 - RNA, 12 nt, Human
ucuauucugugu

SEQ ID NO: 2854331 - RNA, 17 nt, Human
ucuauucuguguugcau

SEQ ID NO: 2854332 - RNA, 18 nt, Human
ucuauucugagaaaacaa

SEQ ID NO: 2854333 - RNA, 17 nt, Human
ucuauucucaaaguuuc

SEQ ID NO: 2854334 - RNA, 22 nt, Human
ucuauugacuucaaugauagua

SEQ ID NO: 2854335 - RNA, 22 nt, Human
ucuauuaauauauguauuauuu

SEQ ID NO: 2854336 - RNA, 10 nt, Human
ucuauuaaua

SEQ ID NO: 2854337 - RNA, 12 nt, Human
ucuauuaauaua

SEQ ID NO: 2854338 - RNA, 13 nt, Human
ucuauuaauauau

SEQ ID NO: 2854339 - RNA, 16 nt, Human
ucuauuaauauaugua

SEQ ID NO: 2854340 - RNA, 21 nt, Human
ucuauuaauauauguauuauu

SEQ ID NO: 2854341 - RNA, 22 nt, Human
ucuauuaaagugcuaagguucu

SEQ ID NO: 2854342 - RNA, 23 nt, Human
ucuauuaaagugcuaagguucua

SEQ ID NO: 2854343 - RNA, 23 nt, Human
ucuauuaaauaguuauauaauuc

SEQ ID NO: 2854344 - RNA, 15 nt, Human
ucuaaggucuaucaa

SEQ ID NO: 2854345 - RNA, 18 nt, Human
uccugggagugagcuggu

SEQ ID NO: 2854346 - RNA, 23 nt, Human
uccugggagaaccucaggcuucc

SEQ ID NO: 2854347 - RNA, 15 nt, Human
uccugggagacccau

SEQ ID NO: 2854348 - RNA, 13 nt, Human
ucuaaguuucuaa

SEQ ID NO: 2854349 - RNA, 19 nt, Human
ucuacccagcgagcccugg

SEQ ID NO: 2854350 - RNA, 23 nt, Human
ucuacagcuaaucagcauucuca

SEQ ID NO: 2854351 - RNA, 20 nt, Human
ucuaauaccucugugugcuc

SEQ ID NO: 2854352 - RNA, 18 nt, Human
ucuaauaauuucuaaugu

SEQ ID NO: 2854353 - RNA, 22 nt, Human
ucuaauaaaacagcugucucua

SEQ ID NO: 2854354 - RNA, 21 nt, Human
ucuacagauagagaguuguug

SEQ ID NO: 2854355 - RNA, 20 nt, Human
ucuacagcuaaucagcauuc

SEQ ID NO: 2854356 - RNA, 21 nt, Human
ucuacagaggccaugggccuc

SEQ ID NO: 2854357 - RNA, 14 nt, Human
ucuaauaccucugu

SEQ ID NO: 2854358 - RNA, 16 nt, Human
ucuaauaauuucuaau

SEQ ID NO: 2854359 - RNA, 17 nt, Human
ucuaauaauuucuaaug

SEQ ID NO: 2854360 - RNA, 16 nt, Human
ucuaauaccucugugu

SEQ ID NO: 2854361 - RNA, 17 nt, Human
ucuaauaccucugugug

SEQ ID NO: 2854362 - RNA, 15 nt, Human
ucuaauaauuucuaa

SEQ ID NO: 2854363 - RNA, 13 nt, Human
ucuaauaaauuau

SEQ ID NO: 2854364 - RNA, 14 nt, Human
ucuaauaaauuaua

SEQ ID NO: 2854365 - RNA, 14 nt, Human
ucuaaguuucuaag

SEQ ID NO: 2854366 - RNA, 15 nt, Human
ucuaaguuucuaaga

SEQ ID NO: 2854367 - RNA, 16 nt, Human
ucuaaguuucuaagau

SEQ ID NO: 2854368 - RNA, 17 nt, Human
ucuaaguuucuaagauu

SEQ ID NO: 2854369 - RNA, 18 nt, Human
ucuaaguuucuaagauuc

SEQ ID NO: 2854370 - RNA, 20 nt, Human
ucuaaguuucuaagauucua

SEQ ID NO: 2854371 - RNA, 22 nt, Human
ucuaaguuucuaagauucuaaa

SEQ ID NO: 2854372 - RNA, 23 nt, Human
ucuaaguuucuaagauucuaaag

SEQ ID NO: 2854373 - RNA, 20 nt, Human
ucuacccagcgagcccuggu

SEQ ID NO: 2854374 - RNA, 16 nt, Human
ucuacccagggccugc

SEQ ID NO: 2854375 - RNA, 13 nt, Human
ucuacccagggcc

SEQ ID NO: 2854376 - RNA, 17 nt, Human
acuguucagcuguccuc

SEQ ID NO: 2854377 - RNA, 22 nt, Human
acuguucagcuguccucccucc

SEQ ID NO: 2854378 - RNA, 18 nt, Human
acuguucccaccugcugg

SEQ ID NO: 2854379 - RNA, 13 nt, Human
acuguucaagagc

SEQ ID NO: 2854380 - RNA, 15 nt, Human
acuguucaagagcac

SEQ ID NO: 2854381 - RNA, 16 nt, Human
acuguucaagagcaca

SEQ ID NO: 2854382 - RNA, 20 nt, Human
acuguucaaugguucugaaa

SEQ ID NO: 2854383 - RNA, 23 nt, Human
acuguucaaugguucugaaauaa

SEQ ID NO: 2854384 - RNA, 18 nt, Human
acuguucuucauuuuauu

SEQ ID NO: 2854385 - RNA, 10 nt, Human
acuguucuug

SEQ ID NO: 2854386 - RNA, 11 nt, Human
acuguucuugc

SEQ ID NO: 2854387 - RNA, 12 nt, Human
acuguucuugcu

SEQ ID NO: 2854388 - RNA, 13 nt, Human
acuguucuugcug

SEQ ID NO: 2854389 - RNA, 14 nt, Human
acuguucuugcugc

SEQ ID NO: 2854390 - RNA, 15 nt, Human
acuguucuugcugcu

SEQ ID NO: 2854391 - RNA, 16 nt, Human
acuguucuugcugcua

SEQ ID NO: 2854392 - RNA, 17 nt, Human
acuguucuugcugcuag

SEQ ID NO: 2854393 - RNA, 18 nt, Human
acuguucuugcugcuaga

SEQ ID NO: 2854394 - RNA, 19 nt, Human
acuguucuugcugcuagaa

SEQ ID NO: 2854395 - RNA, 20 nt, Human
acuguucuugcugcuagaac

SEQ ID NO: 2854396 - RNA, 21 nt, Human
acuguucuugcugcuagaacu

SEQ ID NO: 2854397 - RNA, 22 nt, Human
acuguucuugcugcuagaacuu

SEQ ID NO: 2854398 - RNA, 23 nt, Human
acuguucuugcugcuagaacuuu

SEQ ID NO: 2854399 - RNA, 13 nt, Human
acuuaaugaauga

SEQ ID NO: 2854400 - RNA, 14 nt, Human
acuuaagcaaaaga

SEQ ID NO: 2854401 - RNA, 15 nt, Human
acuuaagcaaaagaa

SEQ ID NO: 2854402 - RNA, 16 nt, Human
acuuaagcaaaagaaa

SEQ ID NO: 2854403 - RNA, 19 nt, Human
acuuaagcaaaagaaaaag

SEQ ID NO: 2854404 - RNA, 20 nt, Human
acuuaagcaaaagaaaaaga

SEQ ID NO: 2854405 - RNA, 15 nt, Human
acuuaagcacaagca

SEQ ID NO: 2854406 - RNA, 19 nt, Human
acuuaaauggaaaaaauga

SEQ ID NO: 2854407 - RNA, 14 nt, Human
acuguugauaauuc

SEQ ID NO: 2854408 - RNA, 16 nt, Human
acuguugauaauucuu

SEQ ID NO: 2854409 - RNA, 17 nt, Human
acuguugauaauucuua

SEQ ID NO: 2854410 - RNA, 18 nt, Human
acuguugauaauucuuau

SEQ ID NO: 2854411 - RNA, 19 nt, Human
acuguugauaauucuuauu

SEQ ID NO: 2854412 - RNA, 20 nt, Human
acuguugauaauucuuauuu

SEQ ID NO: 2854413 - RNA, 22 nt, Human
acuguugauaauucuuauuuug

SEQ ID NO: 2854414 - RNA, 23 nt, Human
acuguugauaauucuuauuuugu

SEQ ID NO: 2854415 - RNA, 15 nt, Human
acuguugauguacug

SEQ ID NO: 2854416 - RNA, 13 nt, Human
acuguugauguau

SEQ ID NO: 2854417 - RNA, 15 nt, Human
acuguugauguaucu

SEQ ID NO: 2854418 - RNA, 16 nt, Human
acuguugauguaucug

SEQ ID NO: 2854419 - RNA, 17 nt, Human
acuguugauguaucuga

SEQ ID NO: 2854420 - RNA, 20 nt, Human
acuguugauguaucugaguu

SEQ ID NO: 2854421 - RNA, 13 nt, Human
acuguugaaaauu

SEQ ID NO: 2854422 - RNA, 14 nt, Human
acuguugaaaauua

SEQ ID NO: 2854423 - RNA, 21 nt, Human
acuguugaaaauuauuuuaaa

SEQ ID NO: 2854424 - RNA, 23 nt, Human
acuguugaaaauuauuuuaaaca

SEQ ID NO: 2854425 - RNA, 23 nt, Human
acuuaacuauucaggagaguaga

SEQ ID NO: 2854426 - RNA, 15 nt, Human
acuuaacauuccuaa

SEQ ID NO: 2854427 - RNA, 21 nt, Human
acuuaacauuccuaaaaugcu

SEQ ID NO: 2854428 - RNA, 16 nt, Human
acuuaacuuuaacuga

SEQ ID NO: 2854429 - RNA, 19 nt, Human
acuuaacuuuaacugaaca

SEQ ID NO: 2854430 - RNA, 12 nt, Human
acuuaagagaaa

SEQ ID NO: 2854431 - RNA, 13 nt, Human
acuuaagagaaau

SEQ ID NO: 2854432 - RNA, 14 nt, Human
acuuaagagaaaug

SEQ ID NO: 2854433 - RNA, 15 nt, Human
acuuaagagaaaugg

SEQ ID NO: 2854434 - RNA, 17 nt, Human
acuuaagagaaauggca

SEQ ID NO: 2854435 - RNA, 14 nt, Human
acuuaacauauuua

SEQ ID NO: 2854436 - RNA, 17 nt, Human
acuuaaauuuuaauuua

SEQ ID NO: 2854437 - RNA, 17 nt, Human
acuuacagcucuggcca

SEQ ID NO: 2854438 - RNA, 19 nt, Human
acuuacauauauuuuuaaa

SEQ ID NO: 2854439 - RNA, 22 nt, Human
acuuacagagcguggcugugcu

SEQ ID NO: 2854440 - RNA, 16 nt, Human
acuuagcuaucagaag

SEQ ID NO: 2854441 - RNA, 14 nt, Human
acuuagcugggaga

SEQ ID NO: 2854442 - RNA, 18 nt, Human
acuuaggcccuagcggca

SEQ ID NO: 2854443 - RNA, 14 nt, Human
acuuaggcuuugua

SEQ ID NO: 2854444 - RNA, 16 nt, Human
acuuaggcuuuguagc

SEQ ID NO: 2854445 - RNA, 12 nt, Human
acuuaugaaugu

SEQ ID NO: 2854446 - RNA, 13 nt, Human
acuuaugaauguu

SEQ ID NO: 2854447 - RNA, 14 nt, Human
acuuaugaauguuu

SEQ ID NO: 2854448 - RNA, 15 nt, Human
acuuaugaauguuuc

SEQ ID NO: 2854449 - RNA, 17 nt, Human
acuuaugaauguuuccg

SEQ ID NO: 2854450 - RNA, 14 nt, Human
acuuauguuuuuaa

SEQ ID NO: 2854451 - RNA, 15 nt, Human
acuuauguuuuuaaa

SEQ ID NO: 2854452 - RNA, 16 nt, Human
acuuauguuuuuaaau

SEQ ID NO: 2854453 - RNA, 13 nt, Human
acuuauguagaua

SEQ ID NO: 2854454 - RNA, 15 nt, Human
acuuauguagauauu

SEQ ID NO: 2854455 - RNA, 19 nt, Human
acuuauguagauauuuggc

SEQ ID NO: 2854456 - RNA, 20 nt, Human
acuuauguagauauuuggcu

SEQ ID NO: 2854457 - RNA, 21 nt, Human
acuuauguagauauuuggcuu

SEQ ID NO: 2854458 - RNA, 15 nt, Human
acuuauugcugauuu

SEQ ID NO: 2854459 - RNA, 18 nt, Human
acuuauugcugauuuuaa

SEQ ID NO: 2854460 - RNA, 19 nt, Human
acuuauugcugauuuuaau

SEQ ID NO: 2854461 - RNA, 20 nt, Human
acuuauugcugauuuuaaug

SEQ ID NO: 2854462 - RNA, 21 nt, Human
acuuauugcugauuuuaaugg

SEQ ID NO: 2854463 - RNA, 13 nt, Human
acuuauuacaauu

SEQ ID NO: 2854464 - RNA, 16 nt, Human
acuuauuacaauuugu

SEQ ID NO: 2854465 - RNA, 20 nt, Human
acuuauuacaauuuguucau

SEQ ID NO: 2854466 - RNA, 15 nt, Human
acuucaguccugcuc

SEQ ID NO: 2854467 - RNA, 19 nt, Human
acuucaguccugcuccaga

SEQ ID NO: 2854468 - RNA, 15 nt, Human
acuucaguccuggga

SEQ ID NO: 2854469 - RNA, 16 nt, Human
acuucaguccugggag

SEQ ID NO: 2854470 - RNA, 13 nt, Human
agaauuauauagg

SEQ ID NO: 2854471 - RNA, 22 nt, Human
agaauuauauagguugugcaaa

SEQ ID NO: 2854472 - RNA, 15 nt, Human
agaauguaucuguga

SEQ ID NO: 2854473 - RNA, 16 nt, Human
agaauguaucugugaa

SEQ ID NO: 2854474 - RNA, 17 nt, Human
agaauguaucugugaag

SEQ ID NO: 2854475 - RNA, 22 nt, Human
agaauguaucugugaaguaguu

SEQ ID NO: 2854476 - RNA, 23 nt, Human
ucugggaggaauggacagacaga

SEQ ID NO: 2854477 - RNA, 19 nt, Human
ucugggaggaauggacaga

SEQ ID NO: 2854478 - RNA, 18 nt, Human
agaauuauuuuuaaaaag

SEQ ID NO: 2854479 - RNA, 19 nt, Human
agaauuauuuuuaaaaaga

SEQ ID NO: 2854480 - RNA, 23 nt, Human
agaauuauuuuuaaaaagaaauc

SEQ ID NO: 2854481 - RNA, 20 nt, Human
agaauucaaacuggggccuc

SEQ ID NO: 2854482 - RNA, 18 nt, Human
agaauucagaagaccccu

SEQ ID NO: 2854483 - RNA, 11 nt, Human
agaauuauuua

SEQ ID NO: 2854484 - RNA, 21 nt, Human
agaauuauuucacaaauaaua

SEQ ID NO: 2854485 - RNA, 18 nt, Human
ucugggcacacucugcca

SEQ ID NO: 2854486 - RNA, 20 nt, Human
ucugggcacacucugccagc

SEQ ID NO: 2854487 - RNA, 19 nt, Human
ucugggccaaguuccucua

SEQ ID NO: 2854488 - RNA, 16 nt, Human
ucugggccaaguuccu

SEQ ID NO: 2854489 - RNA, 12 nt, Human
ucugggccaagu

SEQ ID NO: 2854490 - RNA, 14 nt, Human
ucugggcaggacuc

SEQ ID NO: 2854491 - RNA, 20 nt, Human
ucugggcaggacucagcucc

SEQ ID NO: 2854492 - RNA, 21 nt, Human
ucugggcaggacucagcuccc

SEQ ID NO: 2854493 - RNA, 13 nt, Human
agaaugguggcuu

SEQ ID NO: 2854494 - RNA, 17 nt, Human
agaaugguggcuucuuu

SEQ ID NO: 2854495 - RNA, 21 nt, Human
agaaugguugccuuaaagaaa

SEQ ID NO: 2854496 - RNA, 23 nt, Human
agaaugguugccuuaaagaaagu

SEQ ID NO: 2854497 - RNA, 16 nt, Human
agaauguaaaagaacu

SEQ ID NO: 2854498 - RNA, 17 nt, Human
agaauguaaaagaacuu

SEQ ID NO: 2854499 - RNA, 23 nt, Human
agaaucccagccggccaauggaa

SEQ ID NO: 2854500 - RNA, 16 nt, Human
agaaucccuagacuuu

SEQ ID NO: 2854501 - RNA, 19 nt, Human
agaaucccuagacuuuagg

SEQ ID NO: 2854502 - RNA, 16 nt, Human
agaaucccucuacaug

SEQ ID NO: 2854503 - RNA, 19 nt, Human
agaaucccucuacauggac

SEQ ID NO: 2854504 - RNA, 19 nt, Human
agaaucccaaauuugauug

SEQ ID NO: 2854505 - RNA, 20 nt, Human
agaauccacguauuccccuu

SEQ ID NO: 2854506 - RNA, 12 nt, Human
agaaucccagcc

SEQ ID NO: 2854507 - RNA, 18 nt, Human
agaaucccaaauuugauu

SEQ ID NO: 2854508 - RNA, 17 nt, Human
agaaucccaaauuugau

SEQ ID NO: 2854509 - RNA, 15 nt, Human
agaaucccaaauuug

SEQ ID NO: 2854510 - RNA, 18 nt, Human
agaauccacauuucuaaa

SEQ ID NO: 2854511 - RNA, 19 nt, Human
agaauccacauuucuaaaa

SEQ ID NO: 2854512 - RNA, 20 nt, Human
agaauccacauuucuaaaau

SEQ ID NO: 2854513 - RNA, 22 nt, Human
agaauccacauuucuaaaaucu

SEQ ID NO: 2854514 - RNA, 18 nt, Human
agaauauucagagaauau

SEQ ID NO: 2854515 - RNA, 21 nt, Human
agaauauugaaguacuugcca

SEQ ID NO: 2854516 - RNA, 22 nt, Human
agaauauugaaguacuugccag

SEQ ID NO: 2854517 - RNA, 12 nt, Human
agaauauugucc

SEQ ID NO: 2854518 - RNA, 14 nt, Human
agaaucauacuuag

SEQ ID NO: 2854519 - RNA, 16 nt, Human
agaauccacauuucua

SEQ ID NO: 2854520 - RNA, 17 nt, Human
agaauccacauuucuaa

SEQ ID NO: 2854521 - RNA, 22 nt, Human
agaaucagcacagauaaaaagu

SEQ ID NO: 2854522 - RNA, 13 nt, Human
agaaucauuaccu

SEQ ID NO: 2854523 - RNA, 13 nt, Human
agaauaugucugc

SEQ ID NO: 2854524 - RNA, 13 nt, Human
agaauauguuucc

SEQ ID NO: 2854525 - RNA, 15 nt, Human
agaauauguuuccuu

SEQ ID NO: 2854526 - RNA, 18 nt, Human
agaauauguuuccuuguu

SEQ ID NO: 2854527 - RNA, 18 nt, Human
agaauauauuuauuuaaa

SEQ ID NO: 2854528 - RNA, 20 nt, Human
agaauauauuuauuuaaagc

SEQ ID NO: 2854529 - RNA, 21 nt, Human
agaauauauuuauuuaaagca

SEQ ID NO: 2854530 - RNA, 23 nt, Human
agaauauauuuauuuaaagcauu

SEQ ID NO: 2854531 - RNA, 20 nt, Human
agaauaucaagaugauucug

SEQ ID NO: 2854532 - RNA, 16 nt, Human
agaauagaugcugacu

SEQ ID NO: 2854533 - RNA, 17 nt, Human
agaauagccacauuugg

SEQ ID NO: 2854534 - RNA, 13 nt, Human
agaauagcaucug

SEQ ID NO: 2854535 - RNA, 18 nt, Human
agaauagcaucuguacaa

SEQ ID NO: 2854536 - RNA, 19 nt, Human
agaauagcaucuguacaaa

SEQ ID NO: 2854537 - RNA, 21 nt, Human
agaauagcaucuguacaaagg

SEQ ID NO: 2854538 - RNA, 22 nt, Human
agaauagcaucuguacaaaggg

SEQ ID NO: 2854539 - RNA, 13 nt, Human
agaauagaaagaa

SEQ ID NO: 2854540 - RNA, 14 nt, Human
agaauagaaagaaa

SEQ ID NO: 2854541 - RNA, 14 nt, Human
agaauacuuuuuaa

SEQ ID NO: 2854542 - RNA, 22 nt, Human
agaauagaaauaaaggauguga

SEQ ID NO: 2854543 - RNA, 14 nt, Human
agaauaagagaaag

SEQ ID NO: 2854544 - RNA, 15 nt, Human
agaauaagaaaacaa

SEQ ID NO: 2854545 - RNA, 20 nt, Human
agaauaagaaaacaaucaca

SEQ ID NO: 2854546 - RNA, 16 nt, Human
agaauaagagaaagaa

SEQ ID NO: 2854547 - RNA, 21 nt, Human
agaauaagagaaagaaaauga

SEQ ID NO: 2854548 - RNA, 15 nt, Human
agaauaaggcaggca

SEQ ID NO: 2854549 - RNA, 16 nt, Human
agaauaaggcaggcau

SEQ ID NO: 2854550 - RNA, 15 nt, Human
agaauaaaagaaauu

SEQ ID NO: 2854551 - RNA, 15 nt, Human
agaauaaaagguagu

SEQ ID NO: 2854552 - RNA, 17 nt, Human
agaaguuuauucucauu

SEQ ID NO: 2854553 - RNA, 14 nt, Human
agaaguuucccuuc

SEQ ID NO: 2854554 - RNA, 16 nt, Human
agaaguuucccuuccu

SEQ ID NO: 2854555 - RNA, 18 nt, Human
agaaguuucccuuccucc

SEQ ID NO: 2854556 - RNA, 14 nt, Human
agaagugucauguu

SEQ ID NO: 2854557 - RNA, 15 nt, Human
agaagugucauguuu

SEQ ID NO: 2854558 - RNA, 18 nt, Human
agaagugucauguuuaua

SEQ ID NO: 2854559 - RNA, 20 nt, Human
agaaguggggacagagcaga

SEQ ID NO: 2854560 - RNA, 14 nt, Human
ucugcuuguguuaa

SEQ ID NO: 2854561 - RNA, 18 nt, Human
ucugcuuuaaagggccug

SEQ ID NO: 2854562 - RNA, 21 nt, Human
ucugcuuuaaagggccugccu

SEQ ID NO: 2854563 - RNA, 22 nt, Human
ucugcuuuaaagggccugccug

SEQ ID NO: 2854564 - RNA, 19 nt, Human
ucugcuuucuuugauucuc

SEQ ID NO: 2854565 - RNA, 22 nt, Human
ucugcuuucuuugauucuccuu

SEQ ID NO: 2854566 - RNA, 18 nt, Human
ucugcuuuccucuuccug

SEQ ID NO: 2854567 - RNA, 13 nt, Human
ucugcuuuccucu

SEQ ID NO: 2854568 - RNA, 12 nt, Human
ucugcuuuccuc

SEQ ID NO: 2854569 - RNA, 13 nt, Human
agaaggcagccac

SEQ ID NO: 2854570 - RNA, 15 nt, Human
agaaggcaaaaaugu

SEQ ID NO: 2854571 - RNA, 23 nt, Human
agaaggccuucauggccccagca

SEQ ID NO: 2854572 - RNA, 16 nt, Human
agaagggaauccuccu

SEQ ID NO: 2854573 - RNA, 18 nt, Human
agaagggaauccuccucc

SEQ ID NO: 2854574 - RNA, 23 nt, Human
ucugugaccucaggcacuagccu

SEQ ID NO: 2854575 - RNA, 16 nt, Human
ucugugaccugcaucu

SEQ ID NO: 2854576 - RNA, 20 nt, Human
ucugugaaaugcuggcauuu

SEQ ID NO: 2854577 - RNA, 17 nt, Human
ucugugaaaugcuggca

SEQ ID NO: 2854578 - RNA, 18 nt, Human
ucugucagaaugcuauug

SEQ ID NO: 2854579 - RNA, 15 nt, Human
ucugucagaugagaa

SEQ ID NO: 2854580 - RNA, 18 nt, Human
ucugucagaugagaacaa

SEQ ID NO: 2854581 - RNA, 19 nt, Human
ucugucagaugagaacaaa

SEQ ID NO: 2854582 - RNA, 20 nt, Human
ucugucagaugagaacaaag

SEQ ID NO: 2854583 - RNA, 21 nt, Human
ucugucagaugagaacaaagc

SEQ ID NO: 2854584 - RNA, 22 nt, Human
ucugucagaugagaacaaagcu

SEQ ID NO: 2854585 - RNA, 23 nt, Human
ucugucagaugagaacaaagcug

SEQ ID NO: 2854586 - RNA, 24 nt, Human
ucugucagaugagaacaaagcugu

SEQ ID NO: 2854587 - RNA, 16 nt, Human
ucugugaaaguacauu

SEQ ID NO: 2854588 - RNA, 13 nt, Human
ucugucaagaaga

SEQ ID NO: 2854589 - RNA, 17 nt, Human
ucugucaagaguaguua

SEQ ID NO: 2854590 - RNA, 20 nt, Human
ucugucaagaguaguuauau

SEQ ID NO: 2854591 - RNA, 22 nt, Human
ucugucaagaguaguuauauaa

SEQ ID NO: 2854592 - RNA, 14 nt, Human
ucugucaaugaaaa

SEQ ID NO: 2854593 - RNA, 15 nt, Human
ucugucacaccagcc

SEQ ID NO: 2854594 - RNA, 19 nt, Human
ucugucaccaauugguuaa

SEQ ID NO: 2854595 - RNA, 12 nt, Human
ucugucacucag

SEQ ID NO: 2854596 - RNA, 14 nt, Human
ucugucacucaggc

SEQ ID NO: 2854597 - RNA, 21 nt, Human
ucuguauuuuuucuugcauug

SEQ ID NO: 2854598 - RNA, 22 nt, Human
ucuguauuuuuucuugcauuga

SEQ ID NO: 2854599 - RNA, 23 nt, Human
ucuguauuuuuucuugcauugac

SEQ ID NO: 2854600 - RNA, 15 nt, Human
ucugucaaaacacug

SEQ ID NO: 2854601 - RNA, 16 nt, Human
ucugucaaaacacugu

SEQ ID NO: 2854602 - RNA, 17 nt, Human
ucugucaaaacacugug

SEQ ID NO: 2854603 - RNA, 18 nt, Human
ucugucaaaacacugugg

SEQ ID NO: 2854604 - RNA, 19 nt, Human
ucugucaaaacacugugga

SEQ ID NO: 2854605 - RNA, 20 nt, Human
ucugucaaaacacuguggaa

SEQ ID NO: 2854606 - RNA, 20 nt, Human
ucugggcggcgggcggcugg

SEQ ID NO: 2854607 - RNA, 17 nt, Human
ucugggcuagguagaaa

SEQ ID NO: 2854608 - RNA, 18 nt, Human
ucugggcccccuccuccc

SEQ ID NO: 2854609 - RNA, 12 nt, Human
ucugggccuggg

SEQ ID NO: 2854610 - RNA, 13 nt, Human
ucugggccugggc

SEQ ID NO: 2854611 - RNA, 17 nt, Human
ucugggccugggcuagg

SEQ ID NO: 2854612 - RNA, 18 nt, Human
ucugggccugggcuaggg

SEQ ID NO: 2854613 - RNA, 23 nt, Human
ucugggccaaguuccucuagugc

SEQ ID NO: 2854614 - RNA, 19 nt, Human
ucugggccaccaggaucag

SEQ ID NO: 2854615 - RNA, 15 nt, Human
ucugggccagaauuu

SEQ ID NO: 2854616 - RNA, 14 nt, Human
ucugggccagaauu

SEQ ID NO: 2854617 - RNA, 14 nt, Human
agaauugaaacacu

SEQ ID NO: 2854618 - RNA, 15 nt, Human
agaauugaaacacuu

SEQ ID NO: 2854619 - RNA, 17 nt, Human
agaauugaaacacuuuu

SEQ ID NO: 2854620 - RNA, 14 nt, Human
ucuguuguguguca

SEQ ID NO: 2854621 - RNA, 18 nt, Human
ucuguugugugucaugcc

SEQ ID NO: 2854622 - RNA, 13 nt, Human
ucuguuuaaagug

SEQ ID NO: 2854623 - RNA, 14 nt, Human
ucuguuuaaagugg

SEQ ID NO: 2854624 - RNA, 13 nt, Human
ucuguuuaagaaa

SEQ ID NO: 2854625 - RNA, 14 nt, Human
ucuguuuaagaaaa

SEQ ID NO: 2854626 - RNA, 19 nt, Human
ucuguuuaagaaaaguauu

SEQ ID NO: 2854627 - RNA, 20 nt, Human
ucuguuuaagaaaaguauuu

SEQ ID NO: 2854628 - RNA, 19 nt, Human
ucuguuuaaagcauauaga

SEQ ID NO: 2854629 - RNA, 22 nt, Human
ucuguuuaaagcauauagagau

SEQ ID NO: 2854630 - RNA, 15 nt, Human
ucuguuguaagaaua

SEQ ID NO: 2854631 - RNA, 17 nt, Human
ucuguuguacuauggaa

SEQ ID NO: 2854632 - RNA, 17 nt, Human
ucuguuggccaguguga

SEQ ID NO: 2854633 - RNA, 12 nt, Human
ucuguuggccag

SEQ ID NO: 2854634 - RNA, 22 nt, Human
ucuguuggaagcuuguuuucca

SEQ ID NO: 2854635 - RNA, 16 nt, Human
ucuguuggauuccaug

SEQ ID NO: 2854636 - RNA, 18 nt, Human
ucuguuggauuccaugcu

SEQ ID NO: 2854637 - RNA, 15 nt, Human
ucuguugcugccuca

SEQ ID NO: 2854638 - RNA, 16 nt, Human
ucuguugcccaggcug

SEQ ID NO: 2854639 - RNA, 22 nt, Human
ucuguugccacccaggugaugu

SEQ ID NO: 2854640 - RNA, 17 nt, Human
ucuguucuuuugacuua

SEQ ID NO: 2854641 - RNA, 17 nt, Human
ucugugaggaaagcaca

SEQ ID NO: 2854642 - RNA, 20 nt, Human
ucugugaggaaagcacacag

SEQ ID NO: 2854643 - RNA, 17 nt, Human
ucugugauacagaacuc

SEQ ID NO: 2854644 - RNA, 14 nt, Human
ucugugaucauuua

SEQ ID NO: 2854645 - RNA, 15 nt, Human
ucugugaucuuuuaa

SEQ ID NO: 2854646 - RNA, 20 nt, Human
ucugugaucuuuuaaagugu

SEQ ID NO: 2854647 - RNA, 19 nt, Human
ucugugagauggcuggcug

SEQ ID NO: 2854648 - RNA, 15 nt, Human
ucuguugcaauuagg

SEQ ID NO: 2854649 - RNA, 16 nt, Human
ucuguugcaauuagga

SEQ ID NO: 2854650 - RNA, 19 nt, Human
ucuguugcaauuaggauuu

SEQ ID NO: 2854651 - RNA, 22 nt, Human
ucuguugcaauuaggauuuuga

SEQ ID NO: 2854652 - RNA, 12 nt, Human
agacacacacac

SEQ ID NO: 2854653 - RNA, 13 nt, Human
agacacacacaca

SEQ ID NO: 2854654 - RNA, 14 nt, Human
agacacacacacgc

SEQ ID NO: 2854655 - RNA, 15 nt, Human
agacacacacacgca

SEQ ID NO: 2854656 - RNA, 12 nt, Human
agacacagacug

SEQ ID NO: 2854657 - RNA, 14 nt, Human
agacacagauaaua

SEQ ID NO: 2854658 - RNA, 15 nt, Human
agacacagauaauaa

SEQ ID NO: 2854659 - RNA, 12 nt, Human
agacacagaugu

SEQ ID NO: 2854660 - RNA, 13 nt, Human
agacacagauguu

SEQ ID NO: 2854661 - RNA, 14 nt, Human
agacacagauguuc

SEQ ID NO: 2854662 - RNA, 18 nt, Human
agacacagcgucccuagc

SEQ ID NO: 2854663 - RNA, 16 nt, Human
agacacacacacgcac

SEQ ID NO: 2854664 - RNA, 18 nt, Human
agacacacacacgcacgc

SEQ ID NO: 2854665 - RNA, 20 nt, Human
agacacacacacgcacgcac

SEQ ID NO: 2854666 - RNA, 21 nt, Human
agacacacacacgcacgcaca

SEQ ID NO: 2854667 - RNA, 13 nt, Human
agacacaggcccg

SEQ ID NO: 2854668 - RNA, 12 nt, Human
agacacaggccc

SEQ ID NO: 2854669 - RNA, 16 nt, Human
agacacaggcccggcu

SEQ ID NO: 2854670 - RNA, 22 nt, Human
agacacacacacgcacgcacac

SEQ ID NO: 2854671 - RNA, 23 nt, Human
agacacacacacgcacgcacaca

SEQ ID NO: 2854672 - RNA, 15 nt, Human
agaauuuggaaaucc

SEQ ID NO: 2854673 - RNA, 16 nt, Human
agaauuuggaaauccu

SEQ ID NO: 2854674 - RNA, 22 nt, Human
agaauuuggaaauccuaguuuc

SEQ ID NO: 2854675 - RNA, 21 nt, Human
agaauugaucauuuucccccc

SEQ ID NO: 2854676 - RNA, 18 nt, Human
agaauucuguauuggaua

SEQ ID NO: 2854677 - RNA, 21 nt, Human
agaauugaccaucugcuuuua

SEQ ID NO: 2854678 - RNA, 22 nt, Human
agaauugaucauuuucccccca

SEQ ID NO: 2854679 - RNA, 19 nt, Human
agacagagaccuccugccu

SEQ ID NO: 2854680 - RNA, 16 nt, Human
agacagagccucgcuc

SEQ ID NO: 2854681 - RNA, 16 nt, Human
agacacugccugggcu

SEQ ID NO: 2854682 - RNA, 15 nt, Human
agacacugccugggc

SEQ ID NO: 2854683 - RNA, 14 nt, Human
agacacugccuggg

SEQ ID NO: 2854684 - RNA, 13 nt, Human
agacacugccugg

SEQ ID NO: 2854685 - RNA, 12 nt, Human
agacacugccug

SEQ ID NO: 2854686 - RNA, 11 nt, Human
agacacugccu

SEQ ID NO: 2854687 - RNA, 20 nt, Human
agacacugccacacaggguc

SEQ ID NO: 2854688 - RNA, 13 nt, Human
agacacuggcccc

SEQ ID NO: 2854689 - RNA, 15 nt, Human
agacacuggccccuc

SEQ ID NO: 2854690 - RNA, 16 nt, Human
agacacuggccccuca

SEQ ID NO: 2854691 - RNA, 16 nt, Human
agacagagaccuccug

SEQ ID NO: 2854692 - RNA, 21 nt, Human
agacagagaccuccugccucc

SEQ ID NO: 2854693 - RNA, 20 nt, Human
agacacuucuaaaugaagug

SEQ ID NO: 2854694 - RNA, 18 nt, Human
agacaccuugacagggca

SEQ ID NO: 2854695 - RNA, 19 nt, Human
agacacugaccauccacuc

SEQ ID NO: 2854696 - RNA, 17 nt, Human
agacaccuugacagggc

SEQ ID NO: 2854697 - RNA, 12 nt, Human
agacaccuucau

SEQ ID NO: 2854698 - RNA, 21 nt, Human
agacaccuucauuuugagggg

SEQ ID NO: 2854699 - RNA, 14 nt, Human
ucugcaggcuuaau

SEQ ID NO: 2854700 - RNA, 19 nt, Human
ucugcaggcuuaauaaaaa

SEQ ID NO: 2854701 - RNA, 19 nt, Human
ucugcagauagaaagcauu

SEQ ID NO: 2854702 - RNA, 20 nt, Human
ucugcagauagaaagcauua

SEQ ID NO: 2854703 - RNA, 21 nt, Human
ucugaugcaagcaagaaacac

SEQ ID NO: 2854704 - RNA, 13 nt, Human
agaaauguaaacu

SEQ ID NO: 2854705 - RNA, 15 nt, Human
agaaauguaaacugc

SEQ ID NO: 2854706 - RNA, 16 nt, Human
agaaauguaaacugcc

SEQ ID NO: 2854707 - RNA, 17 nt, Human
agaaauguaaacugcca

SEQ ID NO: 2854708 - RNA, 18 nt, Human
agaaauguaaacugccau

SEQ ID NO: 2854709 - RNA, 12 nt, Human
agaaauguaaug

SEQ ID NO: 2854710 - RNA, 13 nt, Human
agaaauguaaugc

SEQ ID NO: 2854711 - RNA, 21 nt, Human
agaaauguaaugcgauuuuau

SEQ ID NO: 2854712 - RNA, 22 nt, Human
agaaauguaaugcgauuuuauu

SEQ ID NO: 2854713 - RNA, 19 nt, Human
ucugcagggggugugucug

SEQ ID NO: 2854714 - RNA, 16 nt, Human
ucugaugaugugccug

SEQ ID NO: 2854715 - RNA, 16 nt, Human
ucugaugcaagcaaga

SEQ ID NO: 2854716 - RNA, 21 nt, Human
ucugaucauccacugugccau

SEQ ID NO: 2854717 - RNA, 17 nt, Human
ucugaucauccacugug

SEQ ID NO: 2854718 - RNA, 16 nt, Human
ucugaguccuggccca

SEQ ID NO: 2854719 - RNA, 21 nt, Human
ucugaggugccugucccaccc

SEQ ID NO: 2854720 - RNA, 13 nt, Human
ucugaguacagag

SEQ ID NO: 2854721 - RNA, 13 nt, Human
ucugagacucaca

SEQ ID NO: 2854722 - RNA, 14 nt, Human
ucugagacucacag

SEQ ID NO: 2854723 - RNA, 13 nt, Human
ucugagaacucau

SEQ ID NO: 2854724 - RNA, 14 nt, Human
ucugagaagaggag

SEQ ID NO: 2854725 - RNA, 15 nt, Human
ucugagaagaggagc

SEQ ID NO: 2854726 - RNA, 16 nt, Human
ucugagaagaggagcc

SEQ ID NO: 2854727 - RNA, 19 nt, Human
ucugagaagaggagcccuc

SEQ ID NO: 2854728 - RNA, 23 nt, Human
ucugagaagaggagcccucaucu

SEQ ID NO: 2854729 - RNA, 18 nt, Human
agaaauauuccaaauguc

SEQ ID NO: 2854730 - RNA, 13 nt, Human
agaaauaugugag

SEQ ID NO: 2854731 - RNA, 14 nt, Human
agaaauaugugaga

SEQ ID NO: 2854732 - RNA, 15 nt, Human
agaaauaugugagau

SEQ ID NO: 2854733 - RNA, 16 nt, Human
agaaauaugugagauu

SEQ ID NO: 2854734 - RNA, 18 nt, Human
agaaaugauguuggagaa

SEQ ID NO: 2854735 - RNA, 14 nt, Human
agaaaugacuaauu

SEQ ID NO: 2854736 - RNA, 17 nt, Human
agaaaugacuaauuagg

SEQ ID NO: 2854737 - RNA, 13 nt, Human
agaaaugaacauu

SEQ ID NO: 2854738 - RNA, 15 nt, Human
agaaaugaacauucc

SEQ ID NO: 2854739 - RNA, 16 nt, Human
agaaaugaacauucca

SEQ ID NO: 2854740 - RNA, 17 nt, Human
agaaauauggacacuua

SEQ ID NO: 2854741 - RNA, 14 nt, Human
agaaauauggacac

SEQ ID NO: 2854742 - RNA, 23 nt, Human
ucuccuuucaccccagggccuga

SEQ ID NO: 2854743 - RNA, 15 nt, Human
ucuccuuucuuucua

SEQ ID NO: 2854744 - RNA, 14 nt, Human
ucuccuuucaggga

SEQ ID NO: 2854745 - RNA, 14 nt, Human
ucuccuuucagggc

SEQ ID NO: 2854746 - RNA, 12 nt, Human
ucuccuuugaaa

SEQ ID NO: 2854747 - RNA, 16 nt, Human
ucuccuuucacaaccu

SEQ ID NO: 2854748 - RNA, 20 nt, Human
ucuccuuguggccugggccu

SEQ ID NO: 2854749 - RNA, 22 nt, Human
ucuccuuugcugaggccuccag

SEQ ID NO: 2854750 - RNA, 22 nt, Human
ucuccuuuuacuucacuucaaa

SEQ ID NO: 2854751 - RNA, 17 nt, Human
ucuccuuuuccucucuc

SEQ ID NO: 2854752 - RNA, 15 nt, Human
agaaagccaggcagg

SEQ ID NO: 2854753 - RNA, 21 nt, Human
ucugaaggacauugcggacag

SEQ ID NO: 2854754 - RNA, 20 nt, Human
ucugaagcuucacucacugu

SEQ ID NO: 2854755 - RNA, 14 nt, Human
ucugaagcuugacu

SEQ ID NO: 2854756 - RNA, 16 nt, Human
ucugaagcuugacucc

SEQ ID NO: 2854757 - RNA, 17 nt, Human
ucugaagcuugacuccc

SEQ ID NO: 2854758 - RNA, 18 nt, Human
ucugaagcuugacuccca

SEQ ID NO: 2854759 - RNA, 22 nt, Human
ucugaagcuugacucccaaguu

SEQ ID NO: 2854760 - RNA, 18 nt, Human
ucugaagcccucccaggu

SEQ ID NO: 2854761 - RNA, 12 nt, Human
agaaaugcagaa

SEQ ID NO: 2854762 - RNA, 23 nt, Human
agaaaugcauaugucacuagaau

SEQ ID NO: 2854763 - RNA, 16 nt, Human
ucugaagccucuggga

SEQ ID NO: 2854764 - RNA, 21 nt, Human
ucugaagcgugauuuuaaaau

SEQ ID NO: 2854765 - RNA, 17 nt, Human
ucugaagcccucccagg

SEQ ID NO: 2854766 - RNA, 14 nt, Human
ucugacacacagcu

SEQ ID NO: 2854767 - RNA, 13 nt, Human
ucugacacacagc

SEQ ID NO: 2854768 - RNA, 12 nt, Human
ucugacacacag

SEQ ID NO: 2854769 - RNA, 15 nt, Human
ucugacacacagcuc

SEQ ID NO: 2854770 - RNA, 12 nt, Human
agaagaacagua

SEQ ID NO: 2854771 - RNA, 14 nt, Human
agaagaaaugaaua

SEQ ID NO: 2854772 - RNA, 19 nt, Human
agaagaacuauaugugaau

SEQ ID NO: 2854773 - RNA, 13 nt, Human
agaagacaaaaag

SEQ ID NO: 2854774 - RNA, 15 nt, Human
agaagacaaaaagac

SEQ ID NO: 2854775 - RNA, 19 nt, Human
agaagaauguguuucaaac

SEQ ID NO: 2854776 - RNA, 20 nt, Human
agaagaauguguuucaaacu

SEQ ID NO: 2854777 - RNA, 23 nt, Human
agaaauuccuugauucacaauga

SEQ ID NO: 2854778 - RNA, 13 nt, Human
agaaauucuguua

SEQ ID NO: 2854779 - RNA, 14 nt, Human
agaaauucuguuaa

SEQ ID NO: 2854780 - RNA, 15 nt, Human
agaaauucuguuaaa

SEQ ID NO: 2854781 - RNA, 18 nt, Human
agaaauucuguuaaaauc

SEQ ID NO: 2854782 - RNA, 19 nt, Human
agaaauucuguuaaaaucu

SEQ ID NO: 2854783 - RNA, 20 nt, Human
agaaauucuguuaaaaucua

SEQ ID NO: 2854784 - RNA, 21 nt, Human
agaaauucuguuaaaaucuau

SEQ ID NO: 2854785 - RNA, 22 nt, Human
agaaauucuguuaaaaucuauu

SEQ ID NO: 2854786 - RNA, 11 nt, Human
agaaauucugu

SEQ ID NO: 2854787 - RNA, 17 nt, Human
agaaauugcauuuccug

SEQ ID NO: 2854788 - RNA, 20 nt, Human
agaaauugcauuuccugaca

SEQ ID NO: 2854789 - RNA, 11 nt, Human
agaacugccau

SEQ ID NO: 2854790 - RNA, 14 nt, Human
agaacugccauuau

SEQ ID NO: 2854791 - RNA, 17 nt, Human
agaacugccauuauuuu

SEQ ID NO: 2854792 - RNA, 20 nt, Human
agaacugccauuauuuucug

SEQ ID NO: 2854793 - RNA, 23 nt, Human
agaacugccauuauuuucuguca

SEQ ID NO: 2854794 - RNA, 14 nt, Human
agaaauugccuauc

SEQ ID NO: 2854795 - RNA, 19 nt, Human
agaacuguaugucagacau

SEQ ID NO: 2854796 - RNA, 22 nt, Human
agaacugucauguaaacauacc

SEQ ID NO: 2854797 - RNA, 16 nt, Human
agaacugucggaggaa

SEQ ID NO: 2854798 - RNA, 19 nt, Human
agaacugucggaggaaaga

SEQ ID NO: 2854799 - RNA, 21 nt, Human
agaacugucggaggaaagaca

SEQ ID NO: 2854800 - RNA, 23 nt, Human
agaacugucggaggaaagacaac

SEQ ID NO: 2854801 - RNA, 21 nt, Human
agaacuuacugauuauuuucu

SEQ ID NO: 2854802 - RNA, 12 nt, Human
agaacuggguaa

SEQ ID NO: 2854803 - RNA, 15 nt, Human
agaacuggguaaaug

SEQ ID NO: 2854804 - RNA, 18 nt, Human
agaacuggguaaaugcaa

SEQ ID NO: 2854805 - RNA, 19 nt, Human
agaacuggguaaaugcaaa

SEQ ID NO: 2854806 - RNA, 20 nt, Human
agaacuggguaaaugcaaag

SEQ ID NO: 2854807 - RNA, 13 nt, Human
agaacuucccuga

SEQ ID NO: 2854808 - RNA, 21 nt, Human
agaacuucccugauugaccug

SEQ ID NO: 2854809 - RNA, 23 nt, Human
agaacuucccugauugaccugcu

SEQ ID NO: 2854810 - RNA, 15 nt, Human
agaagaaagacucua

SEQ ID NO: 2854811 - RNA, 24 nt, Human
agaagcauuccuucuuugauaaug

SEQ ID NO: 2854812 - RNA, 22 nt, Human
agaagauguugaagaauacagu

SEQ ID NO: 2854813 - RNA, 23 nt, Human
agaagauguugaagaauacaguu

SEQ ID NO: 2854814 - RNA, 14 nt, Human
agaagcauuccuuc

SEQ ID NO: 2854815 - RNA, 15 nt, Human
agaagcauuccuucu

SEQ ID NO: 2854816 - RNA, 17 nt, Human
agaagcauuccuucuuu

SEQ ID NO: 2854817 - RNA, 19 nt, Human
agaagcauuccuucuuuga

SEQ ID NO: 2854818 - RNA, 20 nt, Human
agaagcauuccuucuuugau

SEQ ID NO: 2854819 - RNA, 22 nt, Human
agaagcauuccuucuuugauaa

SEQ ID NO: 2854820 - RNA, 23 nt, Human
agaagcauuccuucuuugauaau

SEQ ID NO: 2854821 - RNA, 10 nt, Human
agaagcauuu

SEQ ID NO: 2854822 - RNA, 13 nt, Human
agaagcauuugua

SEQ ID NO: 2854823 - RNA, 15 nt, Human
agaagcauuuguauu

SEQ ID NO: 2854824 - RNA, 16 nt, Human
agaagcauuuguauuu

SEQ ID NO: 2854825 - RNA, 19 nt, Human
agaagcauuuguauuuugu

SEQ ID NO: 2854826 - RNA, 23 nt, Human
agaagcauuuguauuuuguguga

SEQ ID NO: 2854827 - RNA, 14 nt, Human
ucugcuucagugga

SEQ ID NO: 2854828 - RNA, 12 nt, Human
ucugcuucccag

SEQ ID NO: 2854829 - RNA, 13 nt, Human
ucugcuucccagg

SEQ ID NO: 2854830 - RNA, 14 nt, Human
ucugcuucccaggu

SEQ ID NO: 2854831 - RNA, 22 nt, Human
ucugcuucccagguucaagcga

SEQ ID NO: 2854832 - RNA, 13 nt, Human
ucugcuucucuca

SEQ ID NO: 2854833 - RNA, 14 nt, Human
ucugcuucucucac

SEQ ID NO: 2854834 - RNA, 16 nt, Human
ucugcuucucucaccu

SEQ ID NO: 2854835 - RNA, 13 nt, Human
ucugcuucagugg

SEQ ID NO: 2854836 - RNA, 18 nt, Human
ucugcuugcucuuguccu

SEQ ID NO: 2854837 - RNA, 15 nt, Human
ucugcuucagccucc

SEQ ID NO: 2854838 - RNA, 14 nt, Human
ucugcuucagccuc

SEQ ID NO: 2854839 - RNA, 13 nt, Human
ucugcuucagccu

SEQ ID NO: 2854840 - RNA, 23 nt, Human
ucugcuccacccuuggccugucu

SEQ ID NO: 2854841 - RNA, 21 nt, Human
ucugcuccaccuuucagccca

SEQ ID NO: 2854842 - RNA, 23 nt, Human
ucugcuccaccuuucagcccacg

SEQ ID NO: 2854843 - RNA, 21 nt, Human
ucugcuccacccuuggccugu

SEQ ID NO: 2854844 - RNA, 20 nt, Human
ucugcuccacccuuggccug

SEQ ID NO: 2854845 - RNA, 20 nt, Human
ucugcucacauaucugucau

SEQ ID NO: 2854846 - RNA, 19 nt, Human
ucugcucacauaucuguca

SEQ ID NO: 2854847 - RNA, 17 nt, Human
ucugcucacauaucugu

SEQ ID NO: 2854848 - RNA, 13 nt, Human
ucugcucacuuua

SEQ ID NO: 2854849 - RNA, 19 nt, Human
ucugcucacuuuaaaccug

SEQ ID NO: 2854850 - RNA, 22 nt, Human
ucugcucagacagaaccccuac

SEQ ID NO: 2854851 - RNA, 14 nt, Human
ucugcuccaccaca

SEQ ID NO: 2854852 - RNA, 12 nt, Human
ucugcuccacca

SEQ ID NO: 2854853 - RNA, 10 nt, Human
ucugcuccac

SEQ ID NO: 2854854 - RNA, 19 nt, Human
ucugcuccacccuuggccu

SEQ ID NO: 2854855 - RNA, 18 nt, Human
ucugcuccacccuuggcc

SEQ ID NO: 2854856 - RNA, 17 nt, Human
ucugcuccacccuuggc

SEQ ID NO: 2854857 - RNA, 16 nt, Human
ucugcuccacccuugg

SEQ ID NO: 2854858 - RNA, 15 nt, Human
ucugcuccacccuug

SEQ ID NO: 2854859 - RNA, 14 nt, Human
ucugcuccacccuu

SEQ ID NO: 2854860 - RNA, 12 nt, Human
ucugcuccaccc

SEQ ID NO: 2854861 - RNA, 20 nt, Human
ucugcuccaccacauccucc

SEQ ID NO: 2854862 - RNA, 22 nt, Human
ucugccugcccaggccccugcc

SEQ ID NO: 2854863 - RNA, 21 nt, Human
ucugccugcccaggccccugc

SEQ ID NO: 2854864 - RNA, 17 nt, Human
ucugcggaucucagcuu

SEQ ID NO: 2854865 - RNA, 19 nt, Human
ucugcggaucucagcuuug

SEQ ID NO: 2854866 - RNA, 22 nt, Human
ucugcgugguuccuuucucagc

SEQ ID NO: 2854867 - RNA, 16 nt, Human
ucugcgugggucagaa

SEQ ID NO: 2854868 - RNA, 17 nt, Human
ucugcgugggucagaag

SEQ ID NO: 2854869 - RNA, 15 nt, Human
ucugcgucuguguug

SEQ ID NO: 2854870 - RNA, 10 nt, Human
ucugcccugc

SEQ ID NO: 2854871 - RNA, 12 nt, Human
ucugcccugcgg

SEQ ID NO: 2854872 - RNA, 11 nt, Human
ucugcccugcg

SEQ ID NO: 2854873 - RNA, 20 nt, Human
agauccugaucuuaagaggc

SEQ ID NO: 2854874 - RNA, 21 nt, Human
agauccugaucuuaagaggcu

SEQ ID NO: 2854875 - RNA, 22 nt, Human
agauccugaucuuaagaggcug

SEQ ID NO: 2854876 - RNA, 14 nt, Human
agaucguguauuga

SEQ ID NO: 2854877 - RNA, 23 nt, Human
agaucguguauugagauuucuua

SEQ ID NO: 2854878 - RNA, 16 nt, Human
agaucguucucugccu

SEQ ID NO: 2854879 - RNA, 15 nt, Human
agaugcaaggaccag

SEQ ID NO: 2854880 - RNA, 16 nt, Human
agaucucacucugccc

SEQ ID NO: 2854881 - RNA, 14 nt, Human
agaucuauaaagcg

SEQ ID NO: 2854882 - RNA, 16 nt, Human
agaucuauaaagcgau

SEQ ID NO: 2854883 - RNA, 22 nt, Human
agaucuaaggaugucacagggc

SEQ ID NO: 2854884 - RNA, 11 nt, Human
agaucuacaug

SEQ ID NO: 2854885 - RNA, 14 nt, Human
agaucuacaugaau

SEQ ID NO: 2854886 - RNA, 23 nt, Human
agaucccauggguuguguguuua

SEQ ID NO: 2854887 - RNA, 18 nt, Human
agauccccaagccuggca

SEQ ID NO: 2854888 - RNA, 11 nt, Human
agauccccuca

SEQ ID NO: 2854889 - RNA, 17 nt, Human
agauccccguuccugac

SEQ ID NO: 2854890 - RNA, 13 nt, Human
agauccuaaaaca

SEQ ID NO: 2854891 - RNA, 22 nt, Human
agauccuaaaacaaaagcucau

SEQ ID NO: 2854892 - RNA, 15 nt, Human
agauccccucaggac

SEQ ID NO: 2854893 - RNA, 14 nt, Human
agauccccugagcc

SEQ ID NO: 2854894 - RNA, 16 nt, Human
agauccuagauccuaa

SEQ ID NO: 2854895 - RNA, 18 nt, Human
agauccuagauccuaagg

SEQ ID NO: 2854896 - RNA, 16 nt, Human
agauccuaaaacaaaa

SEQ ID NO: 2854897 - RNA, 14 nt, Human
agauccuaaggguc

SEQ ID NO: 2854898 - RNA, 21 nt, Human
agauccuaagggucgaaagcu

SEQ ID NO: 2854899 - RNA, 23 nt, Human
agauccuaagggucgaaagcucu

SEQ ID NO: 2854900 - RNA, 12 nt, Human
ugaccaacugug

SEQ ID NO: 2854901 - RNA, 13 nt, Human
ugaccaacugugu

SEQ ID NO: 2854902 - RNA, 15 nt, Human
ugaccaacuguguug

SEQ ID NO: 2854903 - RNA, 18 nt, Human
ugaccaacuguguuguau

SEQ ID NO: 2854904 - RNA, 23 nt, Human
ugaccaacuguguuguauuaaca

SEQ ID NO: 2854905 - RNA, 19 nt, Human
agaugcugcagagucacaa

SEQ ID NO: 2854906 - RNA, 11 nt, Human
agaugcuggag

SEQ ID NO: 2854907 - RNA, 13 nt, Human
agaugcuggagaa

SEQ ID NO: 2854908 - RNA, 16 nt, Human
agaugcuggagaagag

SEQ ID NO: 2854909 - RNA, 17 nt, Human
agaugcuggagaagaga

SEQ ID NO: 2854910 - RNA, 18 nt, Human
agaugcuggagaagagag

SEQ ID NO: 2854911 - RNA, 19 nt, Human
agaugcuggagaagagagg

SEQ ID NO: 2854912 - RNA, 20 nt, Human
agaugcuggagaagagagga

SEQ ID NO: 2854913 - RNA, 21 nt, Human
agaugcuggagaagagaggag

SEQ ID NO: 2854914 - RNA, 22 nt, Human
agaugcuggagaagagaggaga

SEQ ID NO: 2854915 - RNA, 15 nt, Human
agauguaugaaggcu

SEQ ID NO: 2854916 - RNA, 17 nt, Human
agauguaugaaggcuuu

SEQ ID NO: 2854917 - RNA, 21 nt, Human
agaugcuggaugucugccaau

SEQ ID NO: 2854918 - RNA, 15 nt, Human
agaugccacccuagc

SEQ ID NO: 2854919 - RNA, 17 nt, Human
agaugccacccuagcca

SEQ ID NO: 2854920 - RNA, 19 nt, Human
agaugccauccucuuucuc

SEQ ID NO: 2854921 - RNA, 22 nt, Human
agaugcauucuugguuggcugg

SEQ ID NO: 2854922 - RNA, 15 nt, Human
agaugcauuguaguu

SEQ ID NO: 2854923 - RNA, 16 nt, Human
agaugcauuguaguuu

SEQ ID NO: 2854924 - RNA, 15 nt, Human
agaugcaguuuggag

SEQ ID NO: 2854925 - RNA, 17 nt, Human
agaugcauguugaccau

SEQ ID NO: 2854926 - RNA, 14 nt, Human
agaugcaauuguuu

SEQ ID NO: 2854927 - RNA, 20 nt, Human
agaugcaaggaccaggacuc

SEQ ID NO: 2854928 - RNA, 20 nt, Human
agaugcaaugacucaggaca

SEQ ID NO: 2854929 - RNA, 18 nt, Human
agaugcaaggaccaggac

SEQ ID NO: 2854930 - RNA, 17 nt, Human
agaugcaaggaccagga

SEQ ID NO: 2854931 - RNA, 22 nt, Human
ugacagagugagacucugucuc

SEQ ID NO: 2854932 - RNA, 20 nt, Human
ugacacugguauuccugccu

SEQ ID NO: 2854933 - RNA, 21 nt, Human
ugacacugguauuccugccuc

SEQ ID NO: 2854934 - RNA, 19 nt, Human
ugacacugguauuccugcc

SEQ ID NO: 2854935 - RNA, 11 nt, Human
ugacacugacc

SEQ ID NO: 2854936 - RNA, 23 nt, Human
ugacacugaccuuggagagacac

SEQ ID NO: 2854937 - RNA, 21 nt, Human
ugacaccgggguggugggaac

SEQ ID NO: 2854938 - RNA, 19 nt, Human
ugaaugcuuauagguggcc

SEQ ID NO: 2854939 - RNA, 13 nt, Human
ugaaugccuccug

SEQ ID NO: 2854940 - RNA, 16 nt, Human
ugaaugccuccugugg

SEQ ID NO: 2854941 - RNA, 17 nt, Human
ugaaugccuccuguggg

SEQ ID NO: 2854942 - RNA, 18 nt, Human
ugaaugccuccugugggg

SEQ ID NO: 2854943 - RNA, 11 nt, Human
ugaaugcugcc

SEQ ID NO: 2854944 - RNA, 12 nt, Human
ugaaugcugcca

SEQ ID NO: 2854945 - RNA, 13 nt, Human
ugaaugcugccac

SEQ ID NO: 2854946 - RNA, 18 nt, Human
ugaaugcugccacaacca

SEQ ID NO: 2854947 - RNA, 13 nt, Human
ugaaugcugccag

SEQ ID NO: 2854948 - RNA, 14 nt, Human
ugaaugcugccagu

SEQ ID NO: 2854949 - RNA, 18 nt, Human
ugaaugcugccagugugg

SEQ ID NO: 2854950 - RNA, 22 nt, Human
ugaaugcugccaguguggagug

SEQ ID NO: 2854951 - RNA, 17 nt, Human
ugacagguaaauuaaga

SEQ ID NO: 2854952 - RNA, 15 nt, Human
ugacauuaagaaugu

SEQ ID NO: 2854953 - RNA, 19 nt, Human
ugacauuaagaauguuggu

SEQ ID NO: 2854954 - RNA, 21 nt, Human
ugacauuaagaauguugguuu

SEQ ID NO: 2854955 - RNA, 15 nt, Human
ugacauuauagacau

SEQ ID NO: 2854956 - RNA, 20 nt, Human
ugacauuaugugguuuuaga

SEQ ID NO: 2854957 - RNA, 17 nt, Human
ugacauucaugccuggc

SEQ ID NO: 2854958 - RNA, 15 nt, Human
ugacauucaugccug

SEQ ID NO: 2854959 - RNA, 21 nt, Human
ugacauuuauuuuucucauga

SEQ ID NO: 2854960 - RNA, 22 nt, Human
ugacauuuauuuuucucaugaa

SEQ ID NO: 2854961 - RNA, 14 nt, Human
ugacauuuguaguu

SEQ ID NO: 2854962 - RNA, 17 nt, Human
ugacauuuguaguugag

SEQ ID NO: 2854963 - RNA, 16 nt, Human
ugacauuuguaguugg

SEQ ID NO: 2854964 - RNA, 19 nt, Human
ugacaggcaaugcuggcug

SEQ ID NO: 2854965 - RNA, 17 nt, Human
ugacaggcaaugcuggc

SEQ ID NO: 2854966 - RNA, 12 nt, Human
ugacagccuccc

SEQ ID NO: 2854967 - RNA, 11 nt, Human
ugacagccucc

SEQ ID NO: 2854968 - RNA, 20 nt, Human
ugacagcagucgguuggagc

SEQ ID NO: 2854969 - RNA, 18 nt, Human
ugacagcaugugcccucc

SEQ ID NO: 2854970 - RNA, 20 nt, Human
ugacagcaugugcccuccug

SEQ ID NO: 2854971 - RNA, 21 nt, Human
ugacagcaugugcccuccuga

SEQ ID NO: 2854972 - RNA, 23 nt, Human
ugacagcaugugcccuccugagg

SEQ ID NO: 2854973 - RNA, 22 nt, Human
ugacagggcacaccgggcacuc

SEQ ID NO: 2854974 - RNA, 21 nt, Human
ugacagggcacaccgggcacu

SEQ ID NO: 2854975 - RNA, 11 nt, Human
ugacagggcca

SEQ ID NO: 2854976 - RNA, 12 nt, Human
ugacagggccag

SEQ ID NO: 2854977 - RNA, 13 nt, Human
ugacagggccagu

SEQ ID NO: 2854978 - RNA, 17 nt, Human
ugacagggccagugggg

SEQ ID NO: 2854979 - RNA, 18 nt, Human
ugacagggccaguggggc

SEQ ID NO: 2854980 - RNA, 20 nt, Human
ugacagggccaguggggccu

SEQ ID NO: 2854981 - RNA, 21 nt, Human
ugacagggccaguggggccug

SEQ ID NO: 2854982 - RNA, 22 nt, Human
ugacagggccaguggggccugu

SEQ ID NO: 2854983 - RNA, 23 nt, Human
ugacagggccaguggggccugug

SEQ ID NO: 2854984 - RNA, 15 nt, Human
ugacagguaaacuau

SEQ ID NO: 2854985 - RNA, 21 nt, Human
agaugugaaaauaucugcuca

SEQ ID NO: 2854986 - RNA, 13 nt, Human
agaugucuuuuau

SEQ ID NO: 2854987 - RNA, 17 nt, Human
agaugucuuuuauagug

SEQ ID NO: 2854988 - RNA, 17 nt, Human
ugaccugcaucuaagcc

SEQ ID NO: 2854989 - RNA, 19 nt, Human
ugaccugccccgcccagcu

SEQ ID NO: 2854990 - RNA, 13 nt, Human
ugaccugccccgc

SEQ ID NO: 2854991 - RNA, 20 nt, Human
ugaccugccccgcccagcug

SEQ ID NO: 2854992 - RNA, 17 nt, Human
ugaccuuggagagacac

SEQ ID NO: 2854993 - RNA, 19 nt, Human
ugaccuuggagagacacag

SEQ ID NO: 2854994 - RNA, 20 nt, Human
ugaccuuggagagacacagc

SEQ ID NO: 2854995 - RNA, 22 nt, Human
ugaccuggauaacuuagguggc

SEQ ID NO: 2854996 - RNA, 20 nt, Human
ugaccugguuaaacaaacca

SEQ ID NO: 2854997 - RNA, 12 nt, Human
ugaccugcuccg

SEQ ID NO: 2854998 - RNA, 15 nt, Human
ugaccugcuccgcug

SEQ ID NO: 2854999 - RNA, 17 nt, Human
ugaccugcuccgcugcu

SEQ ID NO: 2855000 - RNA, 18 nt, Human
ugaccugcuccgcugcuc

SEQ ID NO: 2855001 - RNA, 19 nt, Human
ugaccugcuccgcugcucc

SEQ ID NO: 2855002 - RNA, 23 nt, Human
ugaccugcuccgcugcuccuugg

SEQ ID NO: 2855003 - RNA, 15 nt, Human
ugaccugccucucac

SEQ ID NO: 2855004 - RNA, 18 nt, Human
ugaccugccucucacaca

SEQ ID NO: 2855005 - RNA, 20 nt, Human
ugaccugccucucacacaca

SEQ ID NO: 2855006 - RNA, 21 nt, Human
ugaccugccucucacacacau

SEQ ID NO: 2855007 - RNA, 21 nt, Human
ugaccugcuggguaaacugug

SEQ ID NO: 2855008 - RNA, 13 nt, Human
ugacuauucugua

SEQ ID NO: 2855009 - RNA, 18 nt, Human
ugacuauucuguaucuuu

SEQ ID NO: 2855010 - RNA, 20 nt, Human
ugacuauucuguaucuuuca

SEQ ID NO: 2855011 - RNA, 14 nt, Human
ugacuaucauaaaa

SEQ ID NO: 2855012 - RNA, 21 nt, Human
ugacuaucccaacagucaugu

SEQ ID NO: 2855013 - RNA, 23 nt, Human
ugacuaucccaacagucauguuu

SEQ ID NO: 2855014 - RNA, 12 nt, Human
ugacuauguaaa

SEQ ID NO: 2855015 - RNA, 13 nt, Human
ugacuauguaaac

SEQ ID NO: 2855016 - RNA, 12 nt, Human
ugacuauuaugu

SEQ ID NO: 2855017 - RNA, 16 nt, Human
ugacuauuauguuguu

SEQ ID NO: 2855018 - RNA, 17 nt, Human
ugacuauuauguuguua

SEQ ID NO: 2855019 - RNA, 22 nt, Human
ugacuauuauguuguuagagaa

SEQ ID NO: 2855020 - RNA, 14 nt, Human
ugacuauauagaga

SEQ ID NO: 2855021 - RNA, 16 nt, Human
ugacuauauagagaug

SEQ ID NO: 2855022 - RNA, 17 nt, Human
ugacuauauagagaugu

SEQ ID NO: 2855023 - RNA, 18 nt, Human
ugacuauauagagauguu

SEQ ID NO: 2855024 - RNA, 19 nt, Human
ugacuauauagagauguuu

SEQ ID NO: 2855025 - RNA, 21 nt, Human
ugacuauauagagauguuuuu

SEQ ID NO: 2855026 - RNA, 15 nt, Human
ugacucucugugacc

SEQ ID NO: 2855027 - RNA, 13 nt, Human
ugacucucuguga

SEQ ID NO: 2855028 - RNA, 17 nt, Human
ugacuauuuucguucau

SEQ ID NO: 2855029 - RNA, 21 nt, Human
ugacucguauaugucucaggu

SEQ ID NO: 2855030 - RNA, 15 nt, Human
ugacucgugcugcau

SEQ ID NO: 2855031 - RNA, 12 nt, Human
ugacucuaaauu

SEQ ID NO: 2855032 - RNA, 13 nt, Human
agauucccagagc

SEQ ID NO: 2855033 - RNA, 20 nt, Human
agauuccauugguccaagau

SEQ ID NO: 2855034 - RNA, 21 nt, Human
agauuccauugguccaagauu

SEQ ID NO: 2855035 - RNA, 22 nt, Human
agauuccauugguccaagauuc

SEQ ID NO: 2855036 - RNA, 23 nt, Human
agauuccauugguccaagauucc

SEQ ID NO: 2855037 - RNA, 21 nt, Human
agauuccagagaguggcuccu

SEQ ID NO: 2855038 - RNA, 22 nt, Human
agauuccagagaguggcuccuc

SEQ ID NO: 2855039 - RNA, 19 nt, Human
agauuccagagaguggcuc

SEQ ID NO: 2855040 - RNA, 19 nt, Human
agauucagguauguugccu

SEQ ID NO: 2855041 - RNA, 19 nt, Human
agauuccauugguccaaga

SEQ ID NO: 2855042 - RNA, 15 nt, Human
agauuguuaaaauaa

SEQ ID NO: 2855043 - RNA, 14 nt, Human
agauuguuaaaaua

SEQ ID NO: 2855044 - RNA, 16 nt, Human
agauucccagagcaaa

SEQ ID NO: 2855045 - RNA, 18 nt, Human
agauugugggggaaaaau

SEQ ID NO: 2855046 - RNA, 20 nt, Human
agauugugggggaaaaauaa

SEQ ID NO: 2855047 - RNA, 15 nt, Human
agauuguuguuugcc

SEQ ID NO: 2855048 - RNA, 16 nt, Human
agauuguuguuugcca

SEQ ID NO: 2855049 - RNA, 22 nt, Human
agauuguuguuugccauacuuu

SEQ ID NO: 2855050 - RNA, 23 nt, Human
agauuguuguuugccauacuuug

SEQ ID NO: 2855051 - RNA, 23 nt, Human
agauuguuuuaucaugacauguu

SEQ ID NO: 2855052 - RNA, 19 nt, Human
agauuguuuccucuuccaa

SEQ ID NO: 2855053 - RNA, 14 nt, Human
agauuguuucuaua

SEQ ID NO: 2855054 - RNA, 18 nt, Human
agauuguuucuauacaaa

SEQ ID NO: 2855055 - RNA, 22 nt, Human
agauuguuuuaucaugacaugu

SEQ ID NO: 2855056 - RNA, 22 nt, Human
agauuacccaaaaacugucuuu

SEQ ID NO: 2855057 - RNA, 11 nt, Human
agauuuaagca

SEQ ID NO: 2855058 - RNA, 14 nt, Human
agauuuuaauuguc

SEQ ID NO: 2855059 - RNA, 16 nt, Human
agauuuuaauugucau

SEQ ID NO: 2855060 - RNA, 17 nt, Human
agauuuuaauugucaug

SEQ ID NO: 2855061 - RNA, 13 nt, Human
agauuagaaaaau

SEQ ID NO: 2855062 - RNA, 19 nt, Human
agauuagaaaaauuccuaa

SEQ ID NO: 2855063 - RNA, 16 nt, Human
agauuaagagccauau

SEQ ID NO: 2855064 - RNA, 18 nt, Human
agauuaaggugaugugau

SEQ ID NO: 2855065 - RNA, 14 nt, Human
agauuaauggcacu

SEQ ID NO: 2855066 - RNA, 15 nt, Human
agauuaauggcacug

SEQ ID NO: 2855067 - RNA, 17 nt, Human
agauuaauggcacugau

SEQ ID NO: 2855068 - RNA, 14 nt, Human
ugacuuaugggccc

SEQ ID NO: 2855069 - RNA, 18 nt, Human
ugacuuauuguggauaac

SEQ ID NO: 2855070 - RNA, 19 nt, Human
ugacuuauaguacaugaua

SEQ ID NO: 2855071 - RNA, 17 nt, Human
ugacuuauaguacauga

SEQ ID NO: 2855072 - RNA, 15 nt, Human
ugacuuauaguacau

SEQ ID NO: 2855073 - RNA, 19 nt, Human
ugacuuaagcaaaagaaaa

SEQ ID NO: 2855074 - RNA, 13 nt, Human
ugacuuaauguga

SEQ ID NO: 2855075 - RNA, 16 nt, Human
ugacuuaaugugauua

SEQ ID NO: 2855076 - RNA, 14 nt, Human
ugacuuauaguaca

SEQ ID NO: 2855077 - RNA, 13 nt, Human
ugacuuauaguac

SEQ ID NO: 2855078 - RNA, 15 nt, Human
agauuagaagcugaa

SEQ ID NO: 2855079 - RNA, 21 nt, Human
agauuagcaaggucauuucuu

SEQ ID NO: 2855080 - RNA, 18 nt, Human
agauucagguauguugcc

SEQ ID NO: 2855081 - RNA, 20 nt, Human
agauucagguauguugccuu

SEQ ID NO: 2855082 - RNA, 13 nt, Human
agauucagucuug

SEQ ID NO: 2855083 - RNA, 15 nt, Human
agauucagucuugcc

SEQ ID NO: 2855084 - RNA, 17 nt, Human
agauucagucuugccuu

SEQ ID NO: 2855085 - RNA, 18 nt, Human
agauucagucuugccuua

SEQ ID NO: 2855086 - RNA, 14 nt, Human
agauuauagauucu

SEQ ID NO: 2855087 - RNA, 15 nt, Human
agauuauagauucua

SEQ ID NO: 2855088 - RNA, 16 nt, Human
agauuauagauucuaa

SEQ ID NO: 2855089 - RNA, 17 nt, Human
agauuauagauucuaaa

SEQ ID NO: 2855090 - RNA, 18 nt, Human
agauuauagauucuaaag

SEQ ID NO: 2855091 - RNA, 19 nt, Human
agauuauagauucuaaaga

SEQ ID NO: 2855092 - RNA, 20 nt, Human
agauuauagauucuaaagau

SEQ ID NO: 2855093 - RNA, 12 nt, Human
agcaaggcccug

SEQ ID NO: 2855094 - RNA, 15 nt, Human
agcaaggcccugcug

SEQ ID NO: 2855095 - RNA, 16 nt, Human
agcaaggcccugcugc

SEQ ID NO: 2855096 - RNA, 17 nt, Human
agcaaggcccugcugcc

SEQ ID NO: 2855097 - RNA, 18 nt, Human
agcaaggcccugcugccc

SEQ ID NO: 2855098 - RNA, 19 nt, Human
agcaaggcccugcugccca

SEQ ID NO: 2855099 - RNA, 20 nt, Human
agcaagcucccaagggaugg

SEQ ID NO: 2855100 - RNA, 16 nt, Human
agcaaggaaaacuuau

SEQ ID NO: 2855101 - RNA, 21 nt, Human
agcaaggaagauauacaugaa

SEQ ID NO: 2855102 - RNA, 16 nt, Human
agcaaggucauuucuu

SEQ ID NO: 2855103 - RNA, 20 nt, Human
agcaaggucauuucuucagu

SEQ ID NO: 2855104 - RNA, 18 nt, Human
agcaagggggugauguag

SEQ ID NO: 2855105 - RNA, 16 nt, Human
agcaagugagagcugg

SEQ ID NO: 2855106 - RNA, 15 nt, Human
agcaagugagagcug

SEQ ID NO: 2855107 - RNA, 15 nt, Human
agcaaguagauaaau

SEQ ID NO: 2855108 - RNA, 20 nt, Human
agcaaguagauaaauauuug

SEQ ID NO: 2855109 - RNA, 14 nt, Human
ugagccacugcacc

SEQ ID NO: 2855110 - RNA, 16 nt, Human
ugagccacagcagcau

SEQ ID NO: 2855111 - RNA, 17 nt, Human
ugagccacagcagcauu

SEQ ID NO: 2855112 - RNA, 18 nt, Human
ugagccacagcagcauuu

SEQ ID NO: 2855113 - RNA, 19 nt, Human
ugagccacagcagcauuuu

SEQ ID NO: 2855114 - RNA, 20 nt, Human
ugagccacagcagcauuuuu

SEQ ID NO: 2855115 - RNA, 16 nt, Human
ugagccacucucuucc

SEQ ID NO: 2855116 - RNA, 18 nt, Human
agcaagcaguagcauuug

SEQ ID NO: 2855117 - RNA, 11 nt, Human
ugagccacugc

SEQ ID NO: 2855118 - RNA, 16 nt, Human
agcaagcaacacagag

SEQ ID NO: 2855119 - RNA, 19 nt, Human
agcaagcccuacagagcug

SEQ ID NO: 2855120 - RNA, 20 nt, Human
agcaagcccuacagagcugu

SEQ ID NO: 2855121 - RNA, 11 nt, Human
agcaagcuccc

SEQ ID NO: 2855122 - RNA, 15 nt, Human
agcaagcucccaagg

SEQ ID NO: 2855123 - RNA, 12 nt, Human
agcaagcuggcc

SEQ ID NO: 2855124 - RNA, 13 nt, Human
agcaagcuggccu

SEQ ID NO: 2855125 - RNA, 14 nt, Human
agcaagcuggccuc

SEQ ID NO: 2855126 - RNA, 15 nt, Human
agcaagcuggccucu

SEQ ID NO: 2855127 - RNA, 16 nt, Human
agcaagcuggccucua

SEQ ID NO: 2855128 - RNA, 13 nt, Human
ugagccacugcac

SEQ ID NO: 2855129 - RNA, 12 nt, Human
ugagccacugca

SEQ ID NO: 2855130 - RNA, 19 nt, Human
ugagcauuggauacagcag

SEQ ID NO: 2855131 - RNA, 20 nt, Human
ugagcauuggauacagcagu

SEQ ID NO: 2855132 - RNA, 16 nt, Human
ugagcauuagauuucu

SEQ ID NO: 2855133 - RNA, 14 nt, Human
ugagcauuagauuu

SEQ ID NO: 2855134 - RNA, 15 nt, Human
ugagauuuccuccug

SEQ ID NO: 2855135 - RNA, 17 nt, Human
ugagauuuccuccuggc

SEQ ID NO: 2855136 - RNA, 17 nt, Human
ugagauuucuuaaauaa

SEQ ID NO: 2855137 - RNA, 14 nt, Human
ugagauuuugguau

SEQ ID NO: 2855138 - RNA, 16 nt, Human
ugagauuuuuuauugc

SEQ ID NO: 2855139 - RNA, 17 nt, Human
ugagauuuuuuauugcu

SEQ ID NO: 2855140 - RNA, 18 nt, Human
ugagauuuuuuauugcua

SEQ ID NO: 2855141 - RNA, 19 nt, Human
ugagauuuuuuauugcuag

SEQ ID NO: 2855142 - RNA, 23 nt, Human
ugagauuuuuuauugcuaguauu

SEQ ID NO: 2855143 - RNA, 15 nt, Human
ugagcauggagcugg

SEQ ID NO: 2855144 - RNA, 14 nt, Human
ugagcauggagcug

SEQ ID NO: 2855145 - RNA, 16 nt, Human
ugagcauggagcuggc

SEQ ID NO: 2855146 - RNA, 18 nt, Human
ugagcauggagcuggccg

SEQ ID NO: 2855147 - RNA, 18 nt, Human
ugagcauguaaaagcgga

SEQ ID NO: 2855148 - RNA, 16 nt, Human
agcaccuccugccucg

SEQ ID NO: 2855149 - RNA, 14 nt, Human
agcaccuccugccu

SEQ ID NO: 2855150 - RNA, 13 nt, Human
agcaccuccugcc

SEQ ID NO: 2855151 - RNA, 21 nt, Human
agcaccuccauuaaagucuga

SEQ ID NO: 2855152 - RNA, 16 nt, Human
agcaccucagccugca

SEQ ID NO: 2855153 - RNA, 14 nt, Human
agcaccucagccug

SEQ ID NO: 2855154 - RNA, 18 nt, Human
agcaccuaguccagugac

SEQ ID NO: 2855155 - RNA, 17 nt, Human
agcaccuagccucgcuc

SEQ ID NO: 2855156 - RNA, 15 nt, Human
agcacaugcuggcca

SEQ ID NO: 2855157 - RNA, 16 nt, Human
agcacaugcuggccag

SEQ ID NO: 2855158 - RNA, 19 nt, Human
agcacaugcuggccagccu

SEQ ID NO: 2855159 - RNA, 20 nt, Human
agcacaugcuggccagccug

SEQ ID NO: 2855160 - RNA, 21 nt, Human
agcacaugcuggccagccugg

SEQ ID NO: 2855161 - RNA, 21 nt, Human
agcaccgcuuuuguucucgca

SEQ ID NO: 2855162 - RNA, 19 nt, Human
agcaccccaugccaaagcu

SEQ ID NO: 2855163 - RNA, 21 nt, Human
agcacagcuucauuuccugug

SEQ ID NO: 2855164 - RNA, 21 nt, Human
agcaaggcgguggacuugaac

SEQ ID NO: 2855165 - RNA, 15 nt, Human
agcaauauuuaugga

SEQ ID NO: 2855166 - RNA, 16 nt, Human
agcaauauuuauggau

SEQ ID NO: 2855167 - RNA, 22 nt, Human
agcaauauuuauggaugcaaca

SEQ ID NO: 2855168 - RNA, 15 nt, Human
agcaauauguaaaua

SEQ ID NO: 2855169 - RNA, 17 nt, Human
agcaagugagagcuggg

SEQ ID NO: 2855170 - RNA, 20 nt, Human
agcaagguggguggaaacua

SEQ ID NO: 2855171 - RNA, 16 nt, Human
agcaauauauuaccag

SEQ ID NO: 2855172 - RNA, 22 nt, Human
agcaauauauuaccagcaagaa

SEQ ID NO: 2855173 - RNA, 23 nt, Human
agcaauauauuaccagcaagaau

SEQ ID NO: 2855174 - RNA, 24 nt, Human
agcaauauauuaccagcaagaaua

SEQ ID NO: 2855175 - RNA, 15 nt, Human
agcacaggugggcuu

SEQ ID NO: 2855176 - RNA, 15 nt, Human
agcacaggucccacc

SEQ ID NO: 2855177 - RNA, 16 nt, Human
agcacaggucccaccu

SEQ ID NO: 2855178 - RNA, 20 nt, Human
agcacaggucccaccuccag

SEQ ID NO: 2855179 - RNA, 21 nt, Human
agcacaggucccaccuccagc

SEQ ID NO: 2855180 - RNA, 23 nt, Human
agcacaggucccaccuccagccc

SEQ ID NO: 2855181 - RNA, 13 nt, Human
agcacaggagaca

SEQ ID NO: 2855182 - RNA, 20 nt, Human
ugagaagccuucagcuccag

SEQ ID NO: 2855183 - RNA, 19 nt, Human
ugagaagccuucagcucca

SEQ ID NO: 2855184 - RNA, 13 nt, Human
ugagaagcugcuc

SEQ ID NO: 2855185 - RNA, 15 nt, Human
ugagaagccuucagc

SEQ ID NO: 2855186 - RNA, 14 nt, Human
ugagaagccuucag

SEQ ID NO: 2855187 - RNA, 13 nt, Human
ugagaagccuuca

SEQ ID NO: 2855188 - RNA, 12 nt, Human
ugagaaggagag

SEQ ID NO: 2855189 - RNA, 13 nt, Human
ugagaaggagaga

SEQ ID NO: 2855190 - RNA, 14 nt, Human
ugagaaggagagaa

SEQ ID NO: 2855191 - RNA, 15 nt, Human
ugagaagcugcucca

SEQ ID NO: 2855192 - RNA, 20 nt, Human
ugagaagcugcuccaggccu

SEQ ID NO: 2855193 - RNA, 21 nt, Human
ugagaagcugcuccaggccug

SEQ ID NO: 2855194 - RNA, 22 nt, Human
ugagaagcugcuccaggccugc

SEQ ID NO: 2855195 - RNA, 14 nt, Human
ugagaaggcagcca

SEQ ID NO: 2855196 - RNA, 15 nt, Human
ugagaaggagagaaa

SEQ ID NO: 2855197 - RNA, 16 nt, Human
ugagaaggagagaaag

SEQ ID NO: 2855198 - RNA, 22 nt, Human
ugagaaggagucagaaacuguu

SEQ ID NO: 2855199 - RNA, 13 nt, Human
ugagaaggcagcc

SEQ ID NO: 2855200 - RNA, 21 nt, Human
ugagacagaguuuucacucuu

SEQ ID NO: 2855201 - RNA, 11 nt, Human
ugagacagagu

SEQ ID NO: 2855202 - RNA, 22 nt, Human
ugagacacggagcccagcccuc

SEQ ID NO: 2855203 - RNA, 13 nt, Human
ugagacagaaucu

SEQ ID NO: 2855204 - RNA, 20 nt, Human
ugagacagaaucucgcucug

SEQ ID NO: 2855205 - RNA, 21 nt, Human
ugagacacggagcccagcccu

SEQ ID NO: 2855206 - RNA, 17 nt, Human
ugagacacggagcccag

SEQ ID NO: 2855207 - RNA, 22 nt, Human
ugagaaucccaaauuugauuga

SEQ ID NO: 2855208 - RNA, 21 nt, Human
ugagaaucccaaauuugauug

SEQ ID NO: 2855209 - RNA, 20 nt, Human
ugagaaucccaaauuugauu

SEQ ID NO: 2855210 - RNA, 13 nt, Human
ugagaaucccaaa

SEQ ID NO: 2855211 - RNA, 21 nt, Human
ugagaaucuacccccagaucc

SEQ ID NO: 2855212 - RNA, 12 nt, Human
ugagaaucuacc

SEQ ID NO: 2855213 - RNA, 23 nt, Human
ugagaaucuauauuuaacaagau

SEQ ID NO: 2855214 - RNA, 18 nt, Human
ugagaaucuauauuuaac

SEQ ID NO: 2855215 - RNA, 20 nt, Human
ugagacucugucucaaaaaa

SEQ ID NO: 2855216 - RNA, 13 nt, Human
ugagacuugccuu

SEQ ID NO: 2855217 - RNA, 15 nt, Human
ugagacuugccuucc

SEQ ID NO: 2855218 - RNA, 17 nt, Human
ugagacuugccuuccua

SEQ ID NO: 2855219 - RNA, 19 nt, Human
ugagacuugccuuccuaag

SEQ ID NO: 2855220 - RNA, 18 nt, Human
ugagacugggucucgcuu

SEQ ID NO: 2855221 - RNA, 23 nt, Human
ugagacugcgggaugguccuggg

SEQ ID NO: 2855222 - RNA, 22 nt, Human
ugagacugcgggaugguccugg

SEQ ID NO: 2855223 - RNA, 14 nt, Human
ugagacagaaucuc

SEQ ID NO: 2855224 - RNA, 14 nt, Human
ugagacagagccuc

SEQ ID NO: 2855225 - RNA, 14 nt, Human
ugagacuuucuuuc

SEQ ID NO: 2855226 - RNA, 16 nt, Human
ugagagagaugggagc

SEQ ID NO: 2855227 - RNA, 17 nt, Human
ugagagagaugggagcu

SEQ ID NO: 2855228 - RNA, 21 nt, Human
ugagagagaugggagcuccuc

SEQ ID NO: 2855229 - RNA, 12 nt, Human
ugagagacuuuu

SEQ ID NO: 2855230 - RNA, 18 nt, Human
ugagagacggugucuugu

SEQ ID NO: 2855231 - RNA, 21 nt, Human
ugagagacggugucuuguucu

SEQ ID NO: 2855232 - RNA, 14 nt, Human
ugagagaauuggcu

SEQ ID NO: 2855233 - RNA, 16 nt, Human
ugagagaauuggcuca

SEQ ID NO: 2855234 - RNA, 24 nt, Human
ugagagaccaggcaaagcaaguga

SEQ ID NO: 2855235 - RNA, 14 nt, Human
ugagagaccaggca

SEQ ID NO: 2855236 - RNA, 14 nt, Human
ugagagauucugug

SEQ ID NO: 2855237 - RNA, 21 nt, Human
ugagagauucugugaucuuuu

SEQ ID NO: 2855238 - RNA, 15 nt, Human
ugagagcccagaggu

SEQ ID NO: 2855239 - RNA, 16 nt, Human
ugagagcccagaggua

SEQ ID NO: 2855240 - RNA, 22 nt, Human
ugagagagaugggagcuccucu

SEQ ID NO: 2855241 - RNA, 23 nt, Human
ugagagagaugggagcuccucuc

SEQ ID NO: 2855242 - RNA, 14 nt, Human
ugagagcugggugu

SEQ ID NO: 2855243 - RNA, 19 nt, Human
ugagagcccagagguaaca

SEQ ID NO: 2855244 - RNA, 20 nt, Human
ugagagcccagagguaacag

SEQ ID NO: 2855245 - RNA, 13 nt, Human
ugagaugcugguu

SEQ ID NO: 2855246 - RNA, 17 nt, Human
ugagaugcugguuuucu

SEQ ID NO: 2855247 - RNA, 12 nt, Human
ugagaugcugua

SEQ ID NO: 2855248 - RNA, 23 nt, Human
ugagaggacuuuucuuuguggcu

SEQ ID NO: 2855249 - RNA, 13 nt, Human
ugagaugcuggag

SEQ ID NO: 2855250 - RNA, 15 nt, Human
ugagaugcuggagaa

SEQ ID NO: 2855251 - RNA, 16 nt, Human
ugagaugcuggagaag

SEQ ID NO: 2855252 - RNA, 17 nt, Human
ugagaugcuggagaaga

SEQ ID NO: 2855253 - RNA, 18 nt, Human
ugagaugcuggagaagag

SEQ ID NO: 2855254 - RNA, 19 nt, Human
ugagaugcuggagaagaga

SEQ ID NO: 2855255 - RNA, 20 nt, Human
ugagaugcuggagaagagag

SEQ ID NO: 2855256 - RNA, 23 nt, Human
ugagaugcuggagaagagaggag

SEQ ID NO: 2855257 - RNA, 23 nt, Human
ugagauguaagucucaacucugu

SEQ ID NO: 2855258 - RNA, 12 nt, Human
ugagauguauga

SEQ ID NO: 2855259 - RNA, 17 nt, Human
ugagauguaugaaggcu

SEQ ID NO: 2855260 - RNA, 17 nt, Human
ugagauggggauaaaau

SEQ ID NO: 2855261 - RNA, 21 nt, Human
ugagauggggauaaaaugacu

SEQ ID NO: 2855262 - RNA, 20 nt, Human
ugagauuccucuguauugug

SEQ ID NO: 2855263 - RNA, 18 nt, Human
ugagauugccccaggucu

SEQ ID NO: 2855264 - RNA, 19 nt, Human
ugagauugccccaggucug

SEQ ID NO: 2855265 - RNA, 16 nt, Human
ugagauuggcauggcu

SEQ ID NO: 2855266 - RNA, 17 nt, Human
ugagauuggcauggcuu

SEQ ID NO: 2855267 - RNA, 12 nt, Human
ugagauuguccu

SEQ ID NO: 2855268 - RNA, 16 nt, Human
ugagauuguccucauu

SEQ ID NO: 2855269 - RNA, 22 nt, Human
ugagauuguccucauuucucca

SEQ ID NO: 2855270 - RNA, 23 nt, Human
ugagauuuaccagggauguagau

SEQ ID NO: 2855271 - RNA, 20 nt, Human
ugagauguguggacuguggc

SEQ ID NO: 2855272 - RNA, 15 nt, Human
ugagauuacagagga

SEQ ID NO: 2855273 - RNA, 19 nt, Human
ugagauuacagaggaaguu

SEQ ID NO: 2855274 - RNA, 16 nt, Human
ugagauuacaggcaug

SEQ ID NO: 2855275 - RNA, 13 nt, Human
ugaaaauguuuuu

SEQ ID NO: 2855276 - RNA, 13 nt, Human
ugaaaauguucau

SEQ ID NO: 2855277 - RNA, 16 nt, Human
ugaaaauguuguuaug

SEQ ID NO: 2855278 - RNA, 21 nt, Human
ugaaaauauuuuuuauauaua

SEQ ID NO: 2855279 - RNA, 23 nt, Human
ugaaaauauuuuuuauauauaca

SEQ ID NO: 2855280 - RNA, 18 nt, Human
ugaaaauaccaucaggcc

SEQ ID NO: 2855281 - RNA, 21 nt, Human
ugaaaauggguuggugcuucu

SEQ ID NO: 2855282 - RNA, 21 nt, Human
ugaaaaugaauaucuauuaau

SEQ ID NO: 2855283 - RNA, 23 nt, Human
ugaaaaugaauaucuauuaauau

SEQ ID NO: 2855284 - RNA, 17 nt, Human
ugaaaaugaguugugaa

SEQ ID NO: 2855285 - RNA, 18 nt, Human
ugaaaaugaguugugaaa

SEQ ID NO: 2855286 - RNA, 14 nt, Human
ugaaaaucuuggag

SEQ ID NO: 2855287 - RNA, 19 nt, Human
ugaaaaugaauaucuauua

SEQ ID NO: 2855288 - RNA, 12 nt, Human
ugaaaaucaaau

SEQ ID NO: 2855289 - RNA, 16 nt, Human
ugaaaauaagaauaga

SEQ ID NO: 2855290 - RNA, 14 nt, Human
ucuuuuuuugugau

SEQ ID NO: 2855291 - RNA, 16 nt, Human
ucuuuuuuugugaugu

SEQ ID NO: 2855292 - RNA, 23 nt, Human
ucuuuuuuuuuuuuuaaagacag

SEQ ID NO: 2855293 - RNA, 15 nt, Human
ugaaagacuuccaaa

SEQ ID NO: 2855294 - RNA, 17 nt, Human
ugaaagacuuccaaaga

SEQ ID NO: 2855295 - RNA, 18 nt, Human
ugaaagacuuccaaagaa

SEQ ID NO: 2855296 - RNA, 21 nt, Human
ugaaagacuuccaaagaaugu

SEQ ID NO: 2855297 - RNA, 22 nt, Human
agagaccguccucaccccuguc

SEQ ID NO: 2855298 - RNA, 15 nt, Human
agagaccguccucac

SEQ ID NO: 2855299 - RNA, 19 nt, Human
agagacccucugccaccag

SEQ ID NO: 2855300 - RNA, 21 nt, Human
agagacccucugccaccagag

SEQ ID NO: 2855301 - RNA, 23 nt, Human
agagacccucugccaccagagac

SEQ ID NO: 2855302 - RNA, 19 nt, Human
agagacccuucaaacuugg

SEQ ID NO: 2855303 - RNA, 18 nt, Human
agagaguuguuguguaca

SEQ ID NO: 2855304 - RNA, 22 nt, Human
agagauaccaagaugccaucug

SEQ ID NO: 2855305 - RNA, 20 nt, Human
agagauaccaagaugccauc

SEQ ID NO: 2855306 - RNA, 19 nt, Human
agagauaccaagaugccau

SEQ ID NO: 2855307 - RNA, 14 nt, Human
agagauagccugug

SEQ ID NO: 2855308 - RNA, 15 nt, Human
agagauagccugugg

SEQ ID NO: 2855309 - RNA, 16 nt, Human
agagauagccuguggc

SEQ ID NO: 2855310 - RNA, 17 nt, Human
agagauagccuguggcc

SEQ ID NO: 2855311 - RNA, 17 nt, Human
agagaguggcuccuccc

SEQ ID NO: 2855312 - RNA, 16 nt, Human
agagauccaggaagca

SEQ ID NO: 2855313 - RNA, 13 nt, Human
agagauauauaua

SEQ ID NO: 2855314 - RNA, 14 nt, Human
agagauauaucuga

SEQ ID NO: 2855315 - RNA, 15 nt, Human
agagauauaucugaa

SEQ ID NO: 2855316 - RNA, 16 nt, Human
agagauauaucugaaa

SEQ ID NO: 2855317 - RNA, 19 nt, Human
agagauauaucugaaaacu

SEQ ID NO: 2855318 - RNA, 23 nt, Human
agagauauaucugaaaacuggaa

SEQ ID NO: 2855319 - RNA, 17 nt, Human
agagaugacugaguccu

SEQ ID NO: 2855320 - RNA, 21 nt, Human
agagaugcuguaacuuaaaau

SEQ ID NO: 2855321 - RNA, 23 nt, Human
agagaugcuguaacuuaaaauag

SEQ ID NO: 2855322 - RNA, 22 nt, Human
agagauggacaguucacacccu

SEQ ID NO: 2855323 - RNA, 18 nt, Human
agagaugacugaguccuc

SEQ ID NO: 2855324 - RNA, 23 nt, Human
agagaccguccucaccccugucc

SEQ ID NO: 2855325 - RNA, 15 nt, Human
agagacugcguucug

SEQ ID NO: 2855326 - RNA, 17 nt, Human
agagacugcguucugca

SEQ ID NO: 2855327 - RNA, 18 nt, Human
agagacugcguucugcaa

SEQ ID NO: 2855328 - RNA, 22 nt, Human
agagacugcguucugcaagcau

SEQ ID NO: 2855329 - RNA, 21 nt, Human
agagacuccuugagagaccag

SEQ ID NO: 2855330 - RNA, 22 nt, Human
agagacuccuugagagaccagg

SEQ ID NO: 2855331 - RNA, 17 nt, Human
agagacuuuuaaucaga

SEQ ID NO: 2855332 - RNA, 16 nt, Human
agagacuuuuaaucag

SEQ ID NO: 2855333 - RNA, 19 nt, Human
agagacuuuuaaucagaca

SEQ ID NO: 2855334 - RNA, 17 nt, Human
agagacuuuuuucuagu

SEQ ID NO: 2855335 - RNA, 13 nt, Human
agagagaaaaaaa

SEQ ID NO: 2855336 - RNA, 19 nt, Human
agagagaaaaaaaaaauag

SEQ ID NO: 2855337 - RNA, 13 nt, Human
agagagaaaaaca

SEQ ID NO: 2855338 - RNA, 14 nt, Human
agagagaaaaacaa

SEQ ID NO: 2855339 - RNA, 20 nt, Human
ucuuugucuuaucuggcccu

SEQ ID NO: 2855340 - RNA, 17 nt, Human
ucuuuguaucauucauc

SEQ ID NO: 2855341 - RNA, 12 nt, Human
ucuuuguaucuu

SEQ ID NO: 2855342 - RNA, 16 nt, Human
ucuuuguaucuuccau

SEQ ID NO: 2855343 - RNA, 14 nt, Human
ucuuuguggcuucc

SEQ ID NO: 2855344 - RNA, 14 nt, Human
ucuuugugauaauu

SEQ ID NO: 2855345 - RNA, 16 nt, Human
ucuuugugauaauuua

SEQ ID NO: 2855346 - RNA, 22 nt, Human
ucuuugugauaauuuaagagcu

SEQ ID NO: 2855347 - RNA, 23 nt, Human
ucuuugugauaauuuaagagcua

SEQ ID NO: 2855348 - RNA, 14 nt, Human
ucuuuuuucacaaa

SEQ ID NO: 2855349 - RNA, 22 nt, Human
ucuuuuuuguuuguuucuuugu

SEQ ID NO: 2855350 - RNA, 23 nt, Human
ucuuuuuuguuuguuucuuugug

SEQ ID NO: 2855351 - RNA, 17 nt, Human
ucuuuuuuucccccccu

SEQ ID NO: 2855352 - RNA, 22 nt, Human
ucuuuuuuuggugauucaaaug

SEQ ID NO: 2855353 - RNA, 15 nt, Human
ucuuuuuuucuuggc

SEQ ID NO: 2855354 - RNA, 18 nt, Human
agacuggggggcuugaaa

SEQ ID NO: 2855355 - RNA, 18 nt, Human
agacuuuuaaucagacaa

SEQ ID NO: 2855356 - RNA, 18 nt, Human
agacuuuguuuuuaaaau

SEQ ID NO: 2855357 - RNA, 19 nt, Human
agacuuuguuuuuaaaaug

SEQ ID NO: 2855358 - RNA, 23 nt, Human
ucuuucuacaaagcacuagagaa

SEQ ID NO: 2855359 - RNA, 15 nt, Human
ucuuucuauuccaaa

SEQ ID NO: 2855360 - RNA, 17 nt, Human
ucuuucuccaaaguuau

SEQ ID NO: 2855361 - RNA, 21 nt, Human
ucuuucuccaaaguuauccag

SEQ ID NO: 2855362 - RNA, 21 nt, Human
ucuuucuccuugaauaucuuu

SEQ ID NO: 2855363 - RNA, 24 nt, Human
ucuuucuccuugaauaucuuucga

SEQ ID NO: 2855364 - RNA, 14 nt, Human
ucuuucucucuucc

SEQ ID NO: 2855365 - RNA, 17 nt, Human
ucuuucucucuucccuc

SEQ ID NO: 2855366 - RNA, 10 nt, Human
ucuuucucuc

SEQ ID NO: 2855367 - RNA, 12 nt, Human
ucuuucucucag

SEQ ID NO: 2855368 - RNA, 14 nt, Human
ucuuucucucagcc

SEQ ID NO: 2855369 - RNA, 21 nt, Human
ucuuucucucagccuuacauu

SEQ ID NO: 2855370 - RNA, 12 nt, Human
ucuuucucuccc

SEQ ID NO: 2855371 - RNA, 14 nt, Human
ucuuucucucccca

SEQ ID NO: 2855372 - RNA, 17 nt, Human
ucuuuccuaagaccugg

SEQ ID NO: 2855373 - RNA, 19 nt, Human
ucuuucuaaugugugaauc

SEQ ID NO: 2855374 - RNA, 15 nt, Human
ucuuucuaguggucu

SEQ ID NO: 2855375 - RNA, 16 nt, Human
ucuuucuaguggucuu

SEQ ID NO: 2855376 - RNA, 17 nt, Human
ucuuucuaguggucuuu

SEQ ID NO: 2855377 - RNA, 20 nt, Human
ucuuucuaguggucuuugua

SEQ ID NO: 2855378 - RNA, 21 nt, Human
ucuuucuaguggucuuuguaa

SEQ ID NO: 2855379 - RNA, 22 nt, Human
ucuuucuaguggucuuuguaag

SEQ ID NO: 2855380 - RNA, 15 nt, Human
ucuuucuaugcugcu

SEQ ID NO: 2855381 - RNA, 18 nt, Human
ucuuucuaugcugcuuuu

SEQ ID NO: 2855382 - RNA, 21 nt, Human
ucuuucuaugcugcuuuuaua

SEQ ID NO: 2855383 - RNA, 20 nt, Human
agacaggcaagcaccuccug

SEQ ID NO: 2855384 - RNA, 15 nt, Human
ucuuuaaugucacag

SEQ ID NO: 2855385 - RNA, 19 nt, Human
ucuuuaaugucacaggcag

SEQ ID NO: 2855386 - RNA, 18 nt, Human
ucuuuaaugucacaggca

SEQ ID NO: 2855387 - RNA, 17 nt, Human
agacucuguaacaucac

SEQ ID NO: 2855388 - RNA, 15 nt, Human
agacucuagggucca

SEQ ID NO: 2855389 - RNA, 21 nt, Human
agacucuagaguccaagguuu

SEQ ID NO: 2855390 - RNA, 22 nt, Human
agacuccaucucuauauaaaaa

SEQ ID NO: 2855391 - RNA, 20 nt, Human
agacuggcuggcugcaguga

SEQ ID NO: 2855392 - RNA, 14 nt, Human
agacuggcuggcug

SEQ ID NO: 2855393 - RNA, 23 nt, Human
agacuccuccuccaaaggccccc

SEQ ID NO: 2855394 - RNA, 23 nt, Human
agacuccugacugucucccggga

SEQ ID NO: 2855395 - RNA, 19 nt, Human
agacucuagaguccaaggu

SEQ ID NO: 2855396 - RNA, 20 nt, Human
agacucuagaguccaagguu

SEQ ID NO: 2855397 - RNA, 15 nt, Human
agacucuauucucaa

SEQ ID NO: 2855398 - RNA, 11 nt, Human
agacucucagc

SEQ ID NO: 2855399 - RNA, 16 nt, Human
agacucucagcccaga

SEQ ID NO: 2855400 - RNA, 17 nt, Human
agacucucagcccagaa

SEQ ID NO: 2855401 - RNA, 18 nt, Human
agacucucagcccagaag

SEQ ID NO: 2855402 - RNA, 20 nt, Human
agacucucagcccagaagaa

SEQ ID NO: 2855403 - RNA, 19 nt, Human
agacucucgcaucuuccca

SEQ ID NO: 2855404 - RNA, 20 nt, Human
agacucucgcaucuucccaa

SEQ ID NO: 2855405 - RNA, 23 nt, Human
agacucucgcaucuucccaaccc

SEQ ID NO: 2855406 - RNA, 18 nt, Human
agacucuagacaagauau

SEQ ID NO: 2855407 - RNA, 23 nt, Human
agacucuagacaagauauuguac

SEQ ID NO: 2855408 - RNA, 16 nt, Human
agacucuagaguccaa

SEQ ID NO: 2855409 - RNA, 17 nt, Human
agacucuagaguccaag

SEQ ID NO: 2855410 - RNA, 14 nt, Human
agacuccuccucca

SEQ ID NO: 2855411 - RNA, 14 nt, Human
agacuccuaggcag

SEQ ID NO: 2855412 - RNA, 22 nt, Human
agacuccuaggcaggacaugcu

SEQ ID NO: 2855413 - RNA, 11 nt, Human
agacuccuagg

SEQ ID NO: 2855414 - RNA, 16 nt, Human
agacucccaagcugga

SEQ ID NO: 2855415 - RNA, 15 nt, Human
agacucccaugaagc

SEQ ID NO: 2855416 - RNA, 16 nt, Human
agacucccaugaagcc

SEQ ID NO: 2855417 - RNA, 17 nt, Human
agacucccaugaagccu

SEQ ID NO: 2855418 - RNA, 18 nt, Human
agacucccaugaagccuu

SEQ ID NO: 2855419 - RNA, 19 nt, Human
agacucccaugaagccuuu

SEQ ID NO: 2855420 - RNA, 21 nt, Human
agacucccaugaagccuuuug

SEQ ID NO: 2855421 - RNA, 23 nt, Human
agacucccaugaagccuuuugaa

SEQ ID NO: 2855422 - RNA, 21 nt, Human
agacuccagcuggguuggaaa

SEQ ID NO: 2855423 - RNA, 14 nt, Human
agagcuguggagga

SEQ ID NO: 2855424 - RNA, 20 nt, Human
agagcuguggaggauugcua

SEQ ID NO: 2855425 - RNA, 13 nt, Human
ugaacccuccagg

SEQ ID NO: 2855426 - RNA, 22 nt, Human
agagcuguucaacaucacugaa

SEQ ID NO: 2855427 - RNA, 23 nt, Human
agaggcagccccauucugccugc

SEQ ID NO: 2855428 - RNA, 21 nt, Human
agaggcagggucucacucugu

SEQ ID NO: 2855429 - RNA, 22 nt, Human
agaggcagccccauucugccug

SEQ ID NO: 2855430 - RNA, 21 nt, Human
agaggcagccccauucugccu

SEQ ID NO: 2855431 - RNA, 12 nt, Human
agaggccugccc

SEQ ID NO: 2855432 - RNA, 13 nt, Human
agaggccugcccg

SEQ ID NO: 2855433 - RNA, 18 nt, Human
agaggccaaaggcuggug

SEQ ID NO: 2855434 - RNA, 19 nt, Human
agaggccaacacugugggu

SEQ ID NO: 2855435 - RNA, 21 nt, Human
agaggccagccccacccagga

SEQ ID NO: 2855436 - RNA, 18 nt, Human
agaggccagccccaccca

SEQ ID NO: 2855437 - RNA, 17 nt, Human
agaggccagccccaccc

SEQ ID NO: 2855438 - RNA, 16 nt, Human
agaggccagccccacc

SEQ ID NO: 2855439 - RNA, 23 nt, Human
agaggccagccccacccaggagg

SEQ ID NO: 2855440 - RNA, 19 nt, Human
agaggcugccccucucacc

SEQ ID NO: 2855441 - RNA, 18 nt, Human
agaggcugccccucucac

SEQ ID NO: 2855442 - RNA, 16 nt, Human
agaggcugccccucuc

SEQ ID NO: 2855443 - RNA, 14 nt, Human
agaggcugccccuc

SEQ ID NO: 2855444 - RNA, 12 nt, Human
agaggcugcccc

SEQ ID NO: 2855445 - RNA, 20 nt, Human
agagggagugacagaggcag

SEQ ID NO: 2855446 - RNA, 15 nt, Human
agagggagugacaga

SEQ ID NO: 2855447 - RNA, 20 nt, Human
agaggcugccccucucacca

SEQ ID NO: 2855448 - RNA, 16 nt, Human
agagguuuuguuguuu

SEQ ID NO: 2855449 - RNA, 19 nt, Human
agagguuuuguuguuuuau

SEQ ID NO: 2855450 - RNA, 16 nt, Human
agaguaagaaauuuca

SEQ ID NO: 2855451 - RNA, 20 nt, Human
agaguaagaaauuucagguu

SEQ ID NO: 2855452 - RNA, 13 nt, Human
agaguaagacauu

SEQ ID NO: 2855453 - RNA, 14 nt, Human
agaguaagacauug

SEQ ID NO: 2855454 - RNA, 9 nt, Human
ugaagggag

SEQ ID NO: 2855455 - RNA, 12 nt, Human
agagguuuuguu

SEQ ID NO: 2855456 - RNA, 20 nt, Human
ugaaggcuuuuggucucccu

SEQ ID NO: 2855457 - RNA, 18 nt, Human
ugaagguuuuaagugguu

SEQ ID NO: 2855458 - RNA, 24 nt, Human
ugaagggauuuuagucacacgugg

SEQ ID NO: 2855459 - RNA, 17 nt, Human
ugaagggcauucuuucc

SEQ ID NO: 2855460 - RNA, 13 nt, Human
ugaaguaagcaaa

SEQ ID NO: 2855461 - RNA, 14 nt, Human
ugaaguaagcaaag

SEQ ID NO: 2855462 - RNA, 19 nt, Human
ugaaguaaagccauuaaau

SEQ ID NO: 2855463 - RNA, 15 nt, Human
ugaaguaagcaaaga

SEQ ID NO: 2855464 - RNA, 15 nt, Human
ugaaguaaacugcag

SEQ ID NO: 2855465 - RNA, 21 nt, Human
ugaaguacuugccagaaguug

SEQ ID NO: 2855466 - RNA, 14 nt, Human
ugaaguaguuugua

SEQ ID NO: 2855467 - RNA, 15 nt, Human
ugaaguaguuuguau

SEQ ID NO: 2855468 - RNA, 17 nt, Human
ugaaguaucuaaaagug

SEQ ID NO: 2855469 - RNA, 20 nt, Human
ugaaguaucuaaaaguguca

SEQ ID NO: 2855470 - RNA, 13 nt, Human
ugaagucacacag

SEQ ID NO: 2855471 - RNA, 16 nt, Human
ugaauaauaagcagga

SEQ ID NO: 2855472 - RNA, 20 nt, Human
ugaauaauaagcaggauguu

SEQ ID NO: 2855473 - RNA, 14 nt, Human
ugaauacagcagca

SEQ ID NO: 2855474 - RNA, 16 nt, Human
ugaauacagcagcaag

SEQ ID NO: 2855475 - RNA, 17 nt, Human
ugaauacagcagcaaga

SEQ ID NO: 2855476 - RNA, 18 nt, Human
ugaauacagcagcaagaa

SEQ ID NO: 2855477 - RNA, 20 nt, Human
ugaauacagcagcaagaaaa

SEQ ID NO: 2855478 - RNA, 21 nt, Human
ugaauacagcagcaagaaaaa

SEQ ID NO: 2855479 - RNA, 15 nt, Human
ugaauauuuugauaa

SEQ ID NO: 2855480 - RNA, 16 nt, Human
ugaauauuuugauaau

SEQ ID NO: 2855481 - RNA, 20 nt, Human
ugaauauuuuaucuuuccuu

SEQ ID NO: 2855482 - RNA, 20 nt, Human
ugaagaacaguaacugccau

SEQ ID NO: 2855483 - RNA, 15 nt, Human
ugaagaacaguaacu

SEQ ID NO: 2855484 - RNA, 14 nt, Human
ugaagaacauguga

SEQ ID NO: 2855485 - RNA, 13 nt, Human
ugaagaacaugug

SEQ ID NO: 2855486 - RNA, 17 nt, Human
ugaagaacuagcauaua

SEQ ID NO: 2855487 - RNA, 19 nt, Human
ugaagaacuauuuuauucu

SEQ ID NO: 2855488 - RNA, 19 nt, Human
ugaagaaauacugcacuua

SEQ ID NO: 2855489 - RNA, 20 nt, Human
ugaagaaauacugcacuuac

SEQ ID NO: 2855490 - RNA, 17 nt, Human
ugaagaaauuauaaaga

SEQ ID NO: 2855491 - RNA, 20 nt, Human
ugaagaaauuauaaagauaa

SEQ ID NO: 2855492 - RNA, 13 nt, Human
ugaagaacaguaa

SEQ ID NO: 2855493 - RNA, 15 nt, Human
ugaacuccugaccuc

SEQ ID NO: 2855494 - RNA, 20 nt, Human
ugaacucacuuuccuccuga

SEQ ID NO: 2855495 - RNA, 21 nt, Human
ugaacuacgcuugcucauuuu

SEQ ID NO: 2855496 - RNA, 18 nt, Human
ugaacucagaucugucug

SEQ ID NO: 2855497 - RNA, 22 nt, Human
ugaacucagaucugucugauag

SEQ ID NO: 2855498 - RNA, 11 nt, Human
ugaagaauuaa

SEQ ID NO: 2855499 - RNA, 14 nt, Human
ugaagaauuaagau

SEQ ID NO: 2855500 - RNA, 17 nt, Human
ugaagaauuaagauaca

SEQ ID NO: 2855501 - RNA, 15 nt, Human
ugaagaauggcgcca

SEQ ID NO: 2855502 - RNA, 21 nt, Human
ugaagaaucuguuucccagca

SEQ ID NO: 2855503 - RNA, 18 nt, Human
ugaagaagguggaccuuu

SEQ ID NO: 2855504 - RNA, 19 nt, Human
ugaagaagguggaccuuuu

SEQ ID NO: 2855505 - RNA, 21 nt, Human
ugaagaagguggaccuuuuaa

SEQ ID NO: 2855506 - RNA, 23 nt, Human
ugaagaagguggaccuuuuaaag

SEQ ID NO: 2855507 - RNA, 14 nt, Human
ugaagaauacaguu

SEQ ID NO: 2855508 - RNA, 15 nt, Human
ugaagaauacaguua

SEQ ID NO: 2855509 - RNA, 20 nt, Human
ugaagaauacaguuaggcac

SEQ ID NO: 2855510 - RNA, 16 nt, Human
ugaagaauccuuuugu

SEQ ID NO: 2855511 - RNA, 21 nt, Human
ugaagaauccuuuuguagaau

SEQ ID NO: 2855512 - RNA, 11 nt, Human
ugaagaaggug

SEQ ID NO: 2855513 - RNA, 13 nt, Human
ugaagacaauuug

SEQ ID NO: 2855514 - RNA, 20 nt, Human
ugaagacaauuugauacaua

SEQ ID NO: 2855515 - RNA, 21 nt, Human
ugaagacaauuugauacauaa

SEQ ID NO: 2855516 - RNA, 22 nt, Human
ugaagacaauuugauacauaau

SEQ ID NO: 2855517 - RNA, 23 nt, Human
ugaagacaauuugauacauaaua

SEQ ID NO: 2855518 - RNA, 16 nt, Human
agagcuggugcccgga

SEQ ID NO: 2855519 - RNA, 15 nt, Human
ugaacccuugcuugc

SEQ ID NO: 2855520 - RNA, 13 nt, Human
ugaacccuuuguu

SEQ ID NO: 2855521 - RNA, 17 nt, Human
ugaacccuuuguuucuu

SEQ ID NO: 2855522 - RNA, 21 nt, Human
ugaacccuuccugagcuuuau

SEQ ID NO: 2855523 - RNA, 13 nt, Human
ugaacccuugcuu

SEQ ID NO: 2855524 - RNA, 17 nt, Human
ugaacccgggaggcaga

SEQ ID NO: 2855525 - RNA, 14 nt, Human
ugaacuaagaaacu

SEQ ID NO: 2855526 - RNA, 18 nt, Human
ugaacuaagaaacuuuug

SEQ ID NO: 2855527 - RNA, 22 nt, Human
ugaacuaagaaacuuuuguaaa

SEQ ID NO: 2855528 - RNA, 18 nt, Human
ugaacucacuuuccuccu

SEQ ID NO: 2855529 - RNA, 16 nt, Human
ugaacguccacaugaa

SEQ ID NO: 2855530 - RNA, 21 nt, Human
ugaaccaccacacccagccca

SEQ ID NO: 2855531 - RNA, 22 nt, Human
ugaaccaccacacccagcccac

SEQ ID NO: 2855532 - RNA, 16 nt, Human
ugaaccacgcgggggc

SEQ ID NO: 2855533 - RNA, 15 nt, Human
ugaaccacuucauuc

SEQ ID NO: 2855534 - RNA, 16 nt, Human
ugaaccacuucauucu

SEQ ID NO: 2855535 - RNA, 22 nt, Human
ugaaccauccacuuacauauau

SEQ ID NO: 2855536 - RNA, 22 nt, Human
agagauguuuuuaaaaguuuca

SEQ ID NO: 2855537 - RNA, 20 nt, Human
agagauuggaaugggcagcu

SEQ ID NO: 2855538 - RNA, 22 nt, Human
agagauuggaaugggcagcuca

SEQ ID NO: 2855539 - RNA, 21 nt, Human
agagauuggaaugggcagcuc

SEQ ID NO: 2855540 - RNA, 12 nt, Human
agagauucugau

SEQ ID NO: 2855541 - RNA, 19 nt, Human
agagauucugauuugccac

SEQ ID NO: 2855542 - RNA, 20 nt, Human
agagauucugugaucuuuua

SEQ ID NO: 2855543 - RNA, 23 nt, Human
agagauucugugaucuuuuaaag

SEQ ID NO: 2855544 - RNA, 13 nt, Human
agagauugcuaau

SEQ ID NO: 2855545 - RNA, 14 nt, Human
agagauugcuaauu

SEQ ID NO: 2855546 - RNA, 15 nt, Human
agagauugcuucuca

SEQ ID NO: 2855547 - RNA, 12 nt, Human
agagauguuuuu

SEQ ID NO: 2855548 - RNA, 20 nt, Human
agagauguuuuuaaaaguuu

SEQ ID NO: 2855549 - RNA, 21 nt, Human
agagauguuuuuaaaaguuuc

SEQ ID NO: 2855550 - RNA, 20 nt, Human
ugaaauaaagaaauugcaau

SEQ ID NO: 2855551 - RNA, 21 nt, Human
ugaaauaaagacccaggggga

SEQ ID NO: 2855552 - RNA, 16 nt, Human
ugaaauaacaaaaugg

SEQ ID NO: 2855553 - RNA, 17 nt, Human
ugaaauaacaaaaugga

SEQ ID NO: 2855554 - RNA, 18 nt, Human
ugaaauaacaaaauggac

SEQ ID NO: 2855555 - RNA, 20 nt, Human
ugaaauaacaaaauggacau

SEQ ID NO: 2855556 - RNA, 21 nt, Human
ugaaauaaagaaauugcaaua

SEQ ID NO: 2855557 - RNA, 11 nt, Human
ugaaauaccuc

SEQ ID NO: 2855558 - RNA, 12 nt, Human
ugaaauaccuca

SEQ ID NO: 2855559 - RNA, 13 nt, Human
ugaaauaccucau

SEQ ID NO: 2855560 - RNA, 17 nt, Human
ugaaauaccucauguuu

SEQ ID NO: 2855561 - RNA, 19 nt, Human
ugaaauaccucauguuuau

SEQ ID NO: 2855562 - RNA, 21 nt, Human
ugaaauaccucauguuuauga

SEQ ID NO: 2855563 - RNA, 22 nt, Human
ugaaauaccucauguuuaugaa

SEQ ID NO: 2855564 - RNA, 18 nt, Human
ugaaauaggaaacaagug

SEQ ID NO: 2855565 - RNA, 17 nt, Human
ugaaauaggaaacaagu

SEQ ID NO: 2855566 - RNA, 15 nt, Human
ugaaauaggaaacaa

SEQ ID NO: 2855567 - RNA, 23 nt, Human
ugaaauagacccacaagaggcag

SEQ ID NO: 2855568 - RNA, 18 nt, Human
ugaaauagucugugugaa

SEQ ID NO: 2855569 - RNA, 17 nt, Human
ugaaauagucuguguga

SEQ ID NO: 2855570 - RNA, 16 nt, Human
ugaaauagucugugug

SEQ ID NO: 2855571 - RNA, 13 nt, Human
ugaaauagucugu

SEQ ID NO: 2855572 - RNA, 22 nt, Human
ugaaauugauaaugcuuucaca

SEQ ID NO: 2855573 - RNA, 12 nt, Human
ugaaauuguaaa

SEQ ID NO: 2855574 - RNA, 20 nt, Human
ugaaauuuauuaguuaauau

SEQ ID NO: 2855575 - RNA, 21 nt, Human
ugaaauuuauuaguuaauaua

SEQ ID NO: 2855576 - RNA, 22 nt, Human
ugaaauuuauuaguuaauauau

SEQ ID NO: 2855577 - RNA, 12 nt, Human
ugaaauuucaga

SEQ ID NO: 2855578 - RNA, 14 nt, Human
ugaaauuuauuuaa

SEQ ID NO: 2855579 - RNA, 17 nt, Human
ugaaauuuauuuaaugu

SEQ ID NO: 2855580 - RNA, 21 nt, Human
ugaaauuuauuuaaugugagu

SEQ ID NO: 2855581 - RNA, 22 nt, Human
ugaaauuucagauucccagagc

SEQ ID NO: 2855582 - RNA, 18 nt, Human
ugaacaaaaaauaaaaau

SEQ ID NO: 2855583 - RNA, 13 nt, Human
ugaacaaaagggu

SEQ ID NO: 2855584 - RNA, 14 nt, Human
ugaacaaaaggguc

SEQ ID NO: 2855585 - RNA, 15 nt, Human
ugaacaaaaggguca

SEQ ID NO: 2855586 - RNA, 15 nt, Human
ugaaauuuuuguaaa

SEQ ID NO: 2855587 - RNA, 18 nt, Human
ugaaauuuuuguaaauca

SEQ ID NO: 2855588 - RNA, 13 nt, Human
ugaacaaacuaaa

SEQ ID NO: 2855589 - RNA, 14 nt, Human
ugaacaaaaucugu

SEQ ID NO: 2855590 - RNA, 15 nt, Human
ugaacaaaaucuguu

SEQ ID NO: 2855591 - RNA, 18 nt, Human
ugaacaaaaucuguugcc

SEQ ID NO: 2855592 - RNA, 15 nt, Human
uguaagaacuaaaga

SEQ ID NO: 2855593 - RNA, 22 nt, Human
uguaagaacuaaagaagaucug

SEQ ID NO: 2855594 - RNA, 21 nt, Human
agguguugaagaaauuauaaa

SEQ ID NO: 2855595 - RNA, 22 nt, Human
agguguugaagaaauuauaaag

SEQ ID NO: 2855596 - RNA, 15 nt, Human
agguguuggugacaa

SEQ ID NO: 2855597 - RNA, 16 nt, Human
agguguuggugacaau

SEQ ID NO: 2855598 - RNA, 18 nt, Human
agguguuggugacaauug

SEQ ID NO: 2855599 - RNA, 18 nt, Human
agguguugguuuuggggg

SEQ ID NO: 2855600 - RNA, 16 nt, Human
agguguuacuguaauu

SEQ ID NO: 2855601 - RNA, 14 nt, Human
agguguuagagagg

SEQ ID NO: 2855602 - RNA, 15 nt, Human
agguguuacuguaau

SEQ ID NO: 2855603 - RNA, 18 nt, Human
agguguuaacauuccaag

SEQ ID NO: 2855604 - RNA, 23 nt, Human
agguguuaacauuccaagacucu

SEQ ID NO: 2855605 - RNA, 13 nt, Human
aggugugaggagg

SEQ ID NO: 2855606 - RNA, 17 nt, Human
aggugugaggaggaggc

SEQ ID NO: 2855607 - RNA, 16 nt, Human
agguugucugaaguca

SEQ ID NO: 2855608 - RNA, 20 nt, Human
agguugucugaagucacugc

SEQ ID NO: 2855609 - RNA, 17 nt, Human
agguuguagugagccca

SEQ ID NO: 2855610 - RNA, 16 nt, Human
agguuguuccuaaaau

SEQ ID NO: 2855611 - RNA, 13 nt, Human
agguuuaaagagu

SEQ ID NO: 2855612 - RNA, 14 nt, Human
agguuuaaagaguc

SEQ ID NO: 2855613 - RNA, 15 nt, Human
agguuuaacauuugc

SEQ ID NO: 2855614 - RNA, 16 nt, Human
agguuuaacauuugcc

SEQ ID NO: 2855615 - RNA, 15 nt, Human
agguuuaaagagucu

SEQ ID NO: 2855616 - RNA, 16 nt, Human
agguuuaaagagucua

SEQ ID NO: 2855617 - RNA, 20 nt, Human
agguuuaaagagucuagauu

SEQ ID NO: 2855618 - RNA, 20 nt, Human
aggugugagucaccaagccc

SEQ ID NO: 2855619 - RNA, 14 nt, Human
aggugugagucacc

SEQ ID NO: 2855620 - RNA, 20 nt, Human
aggugugagccaccacgccc

SEQ ID NO: 2855621 - RNA, 22 nt, Human
aggugugaaccaccacacccag

SEQ ID NO: 2855622 - RNA, 15 nt, Human
agguggucaguaaau

SEQ ID NO: 2855623 - RNA, 23 nt, Human
aggugugaaccaccacacccagc

SEQ ID NO: 2855624 - RNA, 13 nt, Human
agguggggcagcu

SEQ ID NO: 2855625 - RNA, 22 nt, Human
aggugauccacucgccuucauc

SEQ ID NO: 2855626 - RNA, 14 nt, Human
agguggggcagcuu

SEQ ID NO: 2855627 - RNA, 16 nt, Human
aggugguaggaggagg

SEQ ID NO: 2855628 - RNA, 20 nt, Human
aggugguaguaaaacacaga

SEQ ID NO: 2855629 - RNA, 21 nt, Human
aggugguaguaaaacacagag

SEQ ID NO: 2855630 - RNA, 22 nt, Human
aggugguaguaaaacacagagg

SEQ ID NO: 2855631 - RNA, 23 nt, Human
agguggguuuucaucaagacugg

SEQ ID NO: 2855632 - RNA, 15 nt, Human
agguggggugagaau

SEQ ID NO: 2855633 - RNA, 17 nt, Human
agguguuaacauuccaa

SEQ ID NO: 2855634 - RNA, 14 nt, Human
uguacaaaggggaa

SEQ ID NO: 2855635 - RNA, 22 nt, Human
uguacaaaggggaaagaacaua

SEQ ID NO: 2855636 - RNA, 18 nt, Human
uguacauauguaaaauaa

SEQ ID NO: 2855637 - RNA, 16 nt, Human
uguacauauguaaaau

SEQ ID NO: 2855638 - RNA, 15 nt, Human
uguacauauguaaaa

SEQ ID NO: 2855639 - RNA, 13 nt, Human
uguacauauguaa

SEQ ID NO: 2855640 - RNA, 21 nt, Human
uguacauauguaaaauaaaau

SEQ ID NO: 2855641 - RNA, 19 nt, Human
uguacauauguaaaauaaa

SEQ ID NO: 2855642 - RNA, 20 nt, Human
uguacauauuugagacuagu

SEQ ID NO: 2855643 - RNA, 18 nt, Human
uguacauauuuguggaau

SEQ ID NO: 2855644 - RNA, 19 nt, Human
uguacauauuuguggaaua

SEQ ID NO: 2855645 - RNA, 14 nt, Human
uguacaucuauuuu

SEQ ID NO: 2855646 - RNA, 22 nt, Human
uguacaaaauaaacaaauaaca

SEQ ID NO: 2855647 - RNA, 13 nt, Human
uguagaaggcaca

SEQ ID NO: 2855648 - RNA, 16 nt, Human
uguagaaugauuucau

SEQ ID NO: 2855649 - RNA, 13 nt, Human
uguagaagcauuc

SEQ ID NO: 2855650 - RNA, 15 nt, Human
uguagaagcauuccu

SEQ ID NO: 2855651 - RNA, 16 nt, Human
uguagaagcauuccuu

SEQ ID NO: 2855652 - RNA, 17 nt, Human
uguagaagcauuccuuc

SEQ ID NO: 2855653 - RNA, 22 nt, Human
uguagaagcauuccuucuuuga

SEQ ID NO: 2855654 - RNA, 12 nt, Human
uguagacuauau

SEQ ID NO: 2855655 - RNA, 15 nt, Human
uguagacuauauaca

SEQ ID NO: 2855656 - RNA, 16 nt, Human
uguagacuauauacau

SEQ ID NO: 2855657 - RNA, 17 nt, Human
uguagacuauauacaug

SEQ ID NO: 2855658 - RNA, 18 nt, Human
uguagacuauauacaugu

SEQ ID NO: 2855659 - RNA, 19 nt, Human
uguagacuauauacaugug

SEQ ID NO: 2855660 - RNA, 20 nt, Human
uguagacuauauacaugugu

SEQ ID NO: 2855661 - RNA, 21 nt, Human
uguagacuauauacaugugug

SEQ ID NO: 2855662 - RNA, 22 nt, Human
uguagacuauauacaugugugu

SEQ ID NO: 2855663 - RNA, 23 nt, Human
uguagacuauauacaugugugua

SEQ ID NO: 2855664 - RNA, 18 nt, Human
uguagaauagccuguggc

SEQ ID NO: 2855665 - RNA, 14 nt, Human
uguagaauuguuau

SEQ ID NO: 2855666 - RNA, 16 nt, Human
uguagaauuguuauag

SEQ ID NO: 2855667 - RNA, 18 nt, Human
uguagaaugauuucaugc

SEQ ID NO: 2855668 - RNA, 17 nt, Human
uguagaaugauuucaug

SEQ ID NO: 2855669 - RNA, 16 nt, Human
uguacuugaugacaga

SEQ ID NO: 2855670 - RNA, 23 nt, Human
uguacuugaagucuaaaagcaga

SEQ ID NO: 2855671 - RNA, 21 nt, Human
uguacuucgucuucuaauuuc

SEQ ID NO: 2855672 - RNA, 11 nt, Human
uguacuuccug

SEQ ID NO: 2855673 - RNA, 12 nt, Human
uguacuuccuga

SEQ ID NO: 2855674 - RNA, 17 nt, Human
uguacuuccugaguggc

SEQ ID NO: 2855675 - RNA, 17 nt, Human
uguacauguguagccug

SEQ ID NO: 2855676 - RNA, 20 nt, Human
uguacauguguagccugugc

SEQ ID NO: 2855677 - RNA, 15 nt, Human
uguacuuaacuauuc

SEQ ID NO: 2855678 - RNA, 16 nt, Human
uguacauuuuguugua

SEQ ID NO: 2855679 - RNA, 17 nt, Human
uguacauuuuguuguaa

SEQ ID NO: 2855680 - RNA, 20 nt, Human
uguacauuucacaggcuaau

SEQ ID NO: 2855681 - RNA, 14 nt, Human
uguacauuuaaaau

SEQ ID NO: 2855682 - RNA, 15 nt, Human
uguacauuuaaaauu

SEQ ID NO: 2855683 - RNA, 20 nt, Human
uguacauuuaaaauugcuau

SEQ ID NO: 2855684 - RNA, 20 nt, Human
uguacauuuaugauuuaaua

SEQ ID NO: 2855685 - RNA, 21 nt, Human
uguacauuuaugauuuaauaa

SEQ ID NO: 2855686 - RNA, 21 nt, Human
uguacauguguagccugugca

SEQ ID NO: 2855687 - RNA, 15 nt, Human
uguacauguguagcc

SEQ ID NO: 2855688 - RNA, 18 nt, Human
uguaaagccaacacccug

SEQ ID NO: 2855689 - RNA, 15 nt, Human
uguaaagcaauaaaa

SEQ ID NO: 2855690 - RNA, 19 nt, Human
uguaaagaucuacaugaau

SEQ ID NO: 2855691 - RNA, 13 nt, Human
uguaaagaaaugu

SEQ ID NO: 2855692 - RNA, 13 nt, Human
uguaaauacauaa

SEQ ID NO: 2855693 - RNA, 11 nt, Human
uguaaauacca

SEQ ID NO: 2855694 - RNA, 20 nt, Human
uguaaauaccagacugcagg

SEQ ID NO: 2855695 - RNA, 14 nt, Human
uguaaauaccagga

SEQ ID NO: 2855696 - RNA, 15 nt, Human
uguaaauaccaggau

SEQ ID NO: 2855697 - RNA, 19 nt, Human
uguaaauaccaggauuuuu

SEQ ID NO: 2855698 - RNA, 15 nt, Human
uguaaauaccauuga

SEQ ID NO: 2855699 - RNA, 19 nt, Human
uguaaauaccauugacaca

SEQ ID NO: 2855700 - RNA, 20 nt, Human
uguaaauaccauugacacau

SEQ ID NO: 2855701 - RNA, 15 nt, Human
uguaaauacuguugg

SEQ ID NO: 2855702 - RNA, 17 nt, Human
uguaaauacuguuggug

SEQ ID NO: 2855703 - RNA, 12 nt, Human
uguaaauacaua

SEQ ID NO: 2855704 - RNA, 14 nt, Human
uguaaauauucuau

SEQ ID NO: 2855705 - RNA, 15 nt, Human
uguaaauauucuaua

SEQ ID NO: 2855706 - RNA, 16 nt, Human
uguaaauauucuauau

SEQ ID NO: 2855707 - RNA, 16 nt, Human
uguaaaucacauccuu

SEQ ID NO: 2855708 - RNA, 20 nt, Human
uguaaauauucuauaugaau

SEQ ID NO: 2855709 - RNA, 23 nt, Human
aggugauccacccaccucagccu

SEQ ID NO: 2855710 - RNA, 21 nt, Human
aggugauccacccaccucagc

SEQ ID NO: 2855711 - RNA, 18 nt, Human
ugguuuccagucaugagc

SEQ ID NO: 2855712 - RNA, 18 nt, Human
ugguuuccacaugcucug

SEQ ID NO: 2855713 - RNA, 18 nt, Human
ugguuucacuggcccaag

SEQ ID NO: 2855714 - RNA, 22 nt, Human
ugguuucauaacuuccuguacu

SEQ ID NO: 2855715 - RNA, 15 nt, Human
ugguuucgaacuccu

SEQ ID NO: 2855716 - RNA, 21 nt, Human
ugguuucucucuacagugcca

SEQ ID NO: 2855717 - RNA, 15 nt, Human
ugguuucucauucuu

SEQ ID NO: 2855718 - RNA, 16 nt, Human
ugguuucucauucuug

SEQ ID NO: 2855719 - RNA, 23 nt, Human
ugguuuaaugcaauagaagugcu

SEQ ID NO: 2855720 - RNA, 11 nt, Human
ugguuuauaga

SEQ ID NO: 2855721 - RNA, 13 nt, Human
ugguuuauauuuu

SEQ ID NO: 2855722 - RNA, 20 nt, Human
ugguuuauauuuuuucaguu

SEQ ID NO: 2855723 - RNA, 18 nt, Human
ugguuuaucagcaaaaaa

SEQ ID NO: 2855724 - RNA, 19 nt, Human
ugguuuaucagcaaaaaag

SEQ ID NO: 2855725 - RNA, 16 nt, Human
ugguuucacuggccca

SEQ ID NO: 2855726 - RNA, 16 nt, Human
ugguuuauuuuguauu

SEQ ID NO: 2855727 - RNA, 22 nt, Human
ugguuuauuuuguauuguggua

SEQ ID NO: 2855728 - RNA, 21 nt, Human
ugguuuauagagggccaagac

SEQ ID NO: 2855729 - RNA, 20 nt, Human
ugguuugauggugacuuccu

SEQ ID NO: 2855730 - RNA, 13 nt, Human
ugguuugagauug

SEQ ID NO: 2855731 - RNA, 18 nt, Human
ugguuuuaacaauuuccu

SEQ ID NO: 2855732 - RNA, 12 nt, Human
ugguuuuaacaa

SEQ ID NO: 2855733 - RNA, 13 nt, Human
ugguuuguccuga

SEQ ID NO: 2855734 - RNA, 14 nt, Human
ugguuuuccugaaa

SEQ ID NO: 2855735 - RNA, 13 nt, Human
ugguuuuagauuu

SEQ ID NO: 2855736 - RNA, 14 nt, Human
ugguuuuagauuuu

SEQ ID NO: 2855737 - RNA, 12 nt, Human
ugguggcagcug

SEQ ID NO: 2855738 - RNA, 16 nt, Human
uggugugaccugaggg

SEQ ID NO: 2855739 - RNA, 17 nt, Human
uggugugaccugagggc

SEQ ID NO: 2855740 - RNA, 17 nt, Human
uggugugaguaucagaa

SEQ ID NO: 2855741 - RNA, 19 nt, Human
uggugugaguaucagaauu

SEQ ID NO: 2855742 - RNA, 12 nt, Human
uggugugaucuu

SEQ ID NO: 2855743 - RNA, 22 nt, Human
uggugugaucuuaauauauuug

SEQ ID NO: 2855744 - RNA, 14 nt, Human
uggugugcugaggu

SEQ ID NO: 2855745 - RNA, 17 nt, Human
ugguguuacugcaguug

SEQ ID NO: 2855746 - RNA, 18 nt, Human
ugguguuacugcaguuga

SEQ ID NO: 2855747 - RNA, 19 nt, Human
ugguguuagggugcagcca

SEQ ID NO: 2855748 - RNA, 19 nt, Human
ugguguuauuugaaacuuu

SEQ ID NO: 2855749 - RNA, 15 nt, Human
ugguguguguaugcg

SEQ ID NO: 2855750 - RNA, 14 nt, Human
ugguguguuggaca

SEQ ID NO: 2855751 - RNA, 16 nt, Human
ugguguguuggacaga

SEQ ID NO: 2855752 - RNA, 21 nt, Human
ugguguguuggacagagaagg

SEQ ID NO: 2855753 - RNA, 14 nt, Human
ugguguuaaaacac

SEQ ID NO: 2855754 - RNA, 22 nt, Human
ugguguuaaaacacuucugucc

SEQ ID NO: 2855755 - RNA, 22 nt, Human
uggugugucccauugguguugu

SEQ ID NO: 2855756 - RNA, 15 nt, Human
ugguuuacaggcccu

SEQ ID NO: 2855757 - RNA, 19 nt, Human
ugguuuacaggcccugcuc

SEQ ID NO: 2855758 - RNA, 20 nt, Human
ugguuuacaggcccugcucc

SEQ ID NO: 2855759 - RNA, 22 nt, Human
ugguuuacaggcccugcuccug

SEQ ID NO: 2855760 - RNA, 11 nt, Human
ugguuuacauu

SEQ ID NO: 2855761 - RNA, 13 nt, Human
ugguuuacauuua

SEQ ID NO: 2855762 - RNA, 14 nt, Human
ugguuuacauuuaa

SEQ ID NO: 2855763 - RNA, 15 nt, Human
ugguuuacauuuaaa

SEQ ID NO: 2855764 - RNA, 20 nt, Human
ugguuuacauuuaaagcauu

SEQ ID NO: 2855765 - RNA, 23 nt, Human
ugguuuacauuuaaagcauugcu

SEQ ID NO: 2855766 - RNA, 14 nt, Human
ugguuuacuuucaa

SEQ ID NO: 2855767 - RNA, 15 nt, Human
ugguuuacuuucaaa

SEQ ID NO: 2855768 - RNA, 16 nt, Human
ugguuuacuuucaaau

SEQ ID NO: 2855769 - RNA, 23 nt, Human
ugguucaggguuggccccugccc

SEQ ID NO: 2855770 - RNA, 16 nt, Human
ugguucagcuaagcua

SEQ ID NO: 2855771 - RNA, 20 nt, Human
ugguuuaaaaauacauguuc

SEQ ID NO: 2855772 - RNA, 22 nt, Human
ugguucaggguuggccccugcc

SEQ ID NO: 2855773 - RNA, 20 nt, Human
ugguucaggguuggccccug

SEQ ID NO: 2855774 - RNA, 16 nt, Human
ugguguuuuucuugua

SEQ ID NO: 2855775 - RNA, 18 nt, Human
ugguguuuuucuuguaaa

SEQ ID NO: 2855776 - RNA, 23 nt, Human
ugguguuuuucuuguaaaugugu

SEQ ID NO: 2855777 - RNA, 22 nt, Human
ugguuaaaacuguacauuuaaa

SEQ ID NO: 2855778 - RNA, 17 nt, Human
ugguuaaucuuuccuga

SEQ ID NO: 2855779 - RNA, 16 nt, Human
ugguuaagaguccaag

SEQ ID NO: 2855780 - RNA, 17 nt, Human
ugguuaagaguccaaga

SEQ ID NO: 2855781 - RNA, 13 nt, Human
ugguuaagagucc

SEQ ID NO: 2855782 - RNA, 14 nt, Human
ugguuaagagucca

SEQ ID NO: 2855783 - RNA, 17 nt, Human
agggugcgucugggagg

SEQ ID NO: 2855784 - RNA, 19 nt, Human
agggugcuaguggugggca

SEQ ID NO: 2855785 - RNA, 14 nt, Human
agggugcccagaac

SEQ ID NO: 2855786 - RNA, 23 nt, Human
agggugauuuuaugaucaguguu

SEQ ID NO: 2855787 - RNA, 15 nt, Human
agggugcagccacac

SEQ ID NO: 2855788 - RNA, 23 nt, Human
aggguggacuuagaaagcagggg

SEQ ID NO: 2855789 - RNA, 16 nt, Human
aggguggacuuagaaa

SEQ ID NO: 2855790 - RNA, 20 nt, Human
aggguggacuuagaaagcag

SEQ ID NO: 2855791 - RNA, 21 nt, Human
aggguggacuuagaaagcagg

SEQ ID NO: 2855792 - RNA, 22 nt, Human
aggguggacuuagaaagcaggg

SEQ ID NO: 2855793 - RNA, 14 nt, Human
uggguggaugccug

SEQ ID NO: 2855794 - RNA, 11 nt, Human
ugggucuucca

SEQ ID NO: 2855795 - RNA, 14 nt, Human
ugggucuuccaggg

SEQ ID NO: 2855796 - RNA, 22 nt, Human
ugggucuuguuuuuuuuuucca

SEQ ID NO: 2855797 - RNA, 23 nt, Human
uggguggaugccugguggcagcu

SEQ ID NO: 2855798 - RNA, 17 nt, Human
uggguggaaacuaagac

SEQ ID NO: 2855799 - RNA, 21 nt, Human
uggguuuuuuuuuuuaaaaaa

SEQ ID NO: 2855800 - RNA, 17 nt, Human
ugguccagggaagcugg

SEQ ID NO: 2855801 - RNA, 19 nt, Human
ugguccagggaagcuggcc

SEQ ID NO: 2855802 - RNA, 19 nt, Human
uggucaugugggucuucca

SEQ ID NO: 2855803 - RNA, 20 nt, Human
uggucaugugggucuuccag

SEQ ID NO: 2855804 - RNA, 22 nt, Human
uggucaugugggucuuccaggg

SEQ ID NO: 2855805 - RNA, 15 nt, Human
ugguccaacugcaac

SEQ ID NO: 2855806 - RNA, 16 nt, Human
ugguccaacugcaacu

SEQ ID NO: 2855807 - RNA, 15 nt, Human
ugguccaagauuccg

SEQ ID NO: 2855808 - RNA, 15 nt, Human
ugguacauggccagu

SEQ ID NO: 2855809 - RNA, 16 nt, Human
ugguacauggccagug

SEQ ID NO: 2855810 - RNA, 15 nt, Human
ugguacagguauauu

SEQ ID NO: 2855811 - RNA, 13 nt, Human
ugguacaugucuu

SEQ ID NO: 2855812 - RNA, 14 nt, Human
ugguacaaaaauaa

SEQ ID NO: 2855813 - RNA, 15 nt, Human
ugguacaaaaauaaa

SEQ ID NO: 2855814 - RNA, 18 nt, Human
ugguacaaaaauaaauuu

SEQ ID NO: 2855815 - RNA, 19 nt, Human
ugguacaaaaauaaauuua

SEQ ID NO: 2855816 - RNA, 21 nt, Human
ugguacaaaaauaaauuuaua

SEQ ID NO: 2855817 - RNA, 13 nt, Human
ugguaauuguugc

SEQ ID NO: 2855818 - RNA, 13 nt, Human
ugguaaacuauuu

SEQ ID NO: 2855819 - RNA, 21 nt, Human
ugguaaacuauuugucuuuca

SEQ ID NO: 2855820 - RNA, 19 nt, Human
ugguaaacgcugucccuag

SEQ ID NO: 2855821 - RNA, 22 nt, Human
ugguaauuuaagauuccagaga

SEQ ID NO: 2855822 - RNA, 13 nt, Human
aggggacaggccu

SEQ ID NO: 2855823 - RNA, 14 nt, Human
aggggacaggccuc

SEQ ID NO: 2855824 - RNA, 15 nt, Human
aggggacaggccuca

SEQ ID NO: 2855825 - RNA, 17 nt, Human
aggggacaggccucacc

SEQ ID NO: 2855826 - RNA, 18 nt, Human
aggggacaggccucaccu

SEQ ID NO: 2855827 - RNA, 19 nt, Human
aggggacaggccucaccuc

SEQ ID NO: 2855828 - RNA, 21 nt, Human
aggggacaggccucaccucua

SEQ ID NO: 2855829 - RNA, 15 nt, Human
ugggaauaauugcuu

SEQ ID NO: 2855830 - RNA, 16 nt, Human
ugggaauaauugcuuu

SEQ ID NO: 2855831 - RNA, 15 nt, Human
aggggacccccgccc

SEQ ID NO: 2855832 - RNA, 18 nt, Human
aggggacccccgcccccu

SEQ ID NO: 2855833 - RNA, 19 nt, Human
aggggacccccgcccccug

SEQ ID NO: 2855834 - RNA, 14 nt, Human
aggggacccccgcc

SEQ ID NO: 2855835 - RNA, 22 nt, Human
aggggacccccgcccccugccc

SEQ ID NO: 2855836 - RNA, 19 nt, Human
aggggaggaucacuggagc

SEQ ID NO: 2855837 - RNA, 20 nt, Human
aggggcuuucuggagaggag

SEQ ID NO: 2855838 - RNA, 17 nt, Human
aggggcuuucuggagag

SEQ ID NO: 2855839 - RNA, 16 nt, Human
aggggcuuucuggaga

SEQ ID NO: 2855840 - RNA, 14 nt, Human
aggggcuuucugga

SEQ ID NO: 2855841 - RNA, 23 nt, Human
aggggcuugguguuuguaagaaa

SEQ ID NO: 2855842 - RNA, 21 nt, Human
aggggcuuauaauaaaggacu

SEQ ID NO: 2855843 - RNA, 16 nt, Human
aggggaguugugucug

SEQ ID NO: 2855844 - RNA, 15 nt, Human
aggggaggccuucca

SEQ ID NO: 2855845 - RNA, 16 nt, Human
aggggagucaccuucc

SEQ ID NO: 2855846 - RNA, 18 nt, Human
aggggagucaccuucccu

SEQ ID NO: 2855847 - RNA, 22 nt, Human
aggggagucaccuucccuugcc

SEQ ID NO: 2855848 - RNA, 13 nt, Human
aggguacauuuau

SEQ ID NO: 2855849 - RNA, 18 nt, Human
aggguacauuuauaauug

SEQ ID NO: 2855850 - RNA, 13 nt, Human
aggguacagcugg

SEQ ID NO: 2855851 - RNA, 14 nt, Human
aggguacagcuggg

SEQ ID NO: 2855852 - RNA, 15 nt, Human
aggguacagcugggc

SEQ ID NO: 2855853 - RNA, 13 nt, Human
aggguacuaaauu

SEQ ID NO: 2855854 - RNA, 15 nt, Human
aggguacuaaauuua

SEQ ID NO: 2855855 - RNA, 17 nt, Human
aggguacuaaauuuaaa

SEQ ID NO: 2855856 - RNA, 16 nt, Human
aggguaucaggugcug

SEQ ID NO: 2855857 - RNA, 12 nt, Human
aggguagggugg

SEQ ID NO: 2855858 - RNA, 18 nt, Human
aggguaucaaauaaaauu

SEQ ID NO: 2855859 - RNA, 15 nt, Human
agggggaagaagcag

SEQ ID NO: 2855860 - RNA, 18 nt, Human
agggggaagaagcagaga

SEQ ID NO: 2855861 - RNA, 19 nt, Human
agggggaagaagcagagag

SEQ ID NO: 2855862 - RNA, 18 nt, Human
agggggggcuacauuaua

SEQ ID NO: 2855863 - RNA, 13 nt, Human
aggggguaaggcc

SEQ ID NO: 2855864 - RNA, 15 nt, Human
aggggguccguggaa

SEQ ID NO: 2855865 - RNA, 14 nt, Human
aggggugacacaga

SEQ ID NO: 2855866 - RNA, 15 nt, Human
aggggugacacagac

SEQ ID NO: 2855867 - RNA, 16 nt, Human
aggggugacacagacu

SEQ ID NO: 2855868 - RNA, 18 nt, Human
aggggugacacagacuca

SEQ ID NO: 2855869 - RNA, 19 nt, Human
aggggucccagccaccccg

SEQ ID NO: 2855870 - RNA, 18 nt, Human
aggggucccagccacccc

SEQ ID NO: 2855871 - RNA, 15 nt, Human
aggggucccagccac

SEQ ID NO: 2855872 - RNA, 14 nt, Human
ugguccaugcaggg

SEQ ID NO: 2855873 - RNA, 15 nt, Human
ugguccaugcagggg

SEQ ID NO: 2855874 - RNA, 18 nt, Human
ugguccaugcagggggcu

SEQ ID NO: 2855875 - RNA, 19 nt, Human
uggucucgaacuccugacc

SEQ ID NO: 2855876 - RNA, 15 nt, Human
uggucucgaacuccu

SEQ ID NO: 2855877 - RNA, 21 nt, Human
uggucucgaacuccugaccuu

SEQ ID NO: 2855878 - RNA, 20 nt, Human
uggucucgaacuccugaccu

SEQ ID NO: 2855879 - RNA, 14 nt, Human
uggucucuaggcug

SEQ ID NO: 2855880 - RNA, 12 nt, Human
ugguccagagcg

SEQ ID NO: 2855881 - RNA, 16 nt, Human
uggucucuaggcuggg

SEQ ID NO: 2855882 - RNA, 17 nt, Human
uggucucuaggcugggg

SEQ ID NO: 2855883 - RNA, 18 nt, Human
uggucucuaggcugggga

SEQ ID NO: 2855884 - RNA, 19 nt, Human
uggucucuaggcuggggaa

SEQ ID NO: 2855885 - RNA, 12 nt, Human
uggucuguguga

SEQ ID NO: 2855886 - RNA, 18 nt, Human
uggucugacccacugcuu

SEQ ID NO: 2855887 - RNA, 15 nt, Human
uggucucugcauuuu

SEQ ID NO: 2855888 - RNA, 19 nt, Human
uggucucugcauuuuucug

SEQ ID NO: 2855889 - RNA, 15 nt, Human
uggucugccaggccc

SEQ ID NO: 2855890 - RNA, 18 nt, Human
uggucugccaggccccca

SEQ ID NO: 2855891 - RNA, 16 nt, Human
uggucuggacugacag

SEQ ID NO: 2855892 - RNA, 19 nt, Human
aggguggugaccucugccu

SEQ ID NO: 2855893 - RNA, 18 nt, Human
aggguggugaccucugcc

SEQ ID NO: 2855894 - RNA, 17 nt, Human
aggguggugaccucugc

SEQ ID NO: 2855895 - RNA, 13 nt, Human
uggugaagaguag

SEQ ID NO: 2855896 - RNA, 19 nt, Human
uggucuucaaauugucuuu

SEQ ID NO: 2855897 - RNA, 23 nt, Human
uggucuuuguaagaguguagaag

SEQ ID NO: 2855898 - RNA, 15 nt, Human
uggugaaaauguacu

SEQ ID NO: 2855899 - RNA, 18 nt, Human
uggugaaauuuauuaguu

SEQ ID NO: 2855900 - RNA, 23 nt, Human
uggugaaagcugagaacuccuga

SEQ ID NO: 2855901 - RNA, 17 nt, Human
uggugaauggccuuccu

SEQ ID NO: 2855902 - RNA, 19 nt, Human
uggugaauggccuuccuuc

SEQ ID NO: 2855903 - RNA, 19 nt, Human
uggugaaauuuauuaguua

SEQ ID NO: 2855904 - RNA, 14 nt, Human
aggguucuggcugc

SEQ ID NO: 2855905 - RNA, 15 nt, Human
aggguugggcuggug

SEQ ID NO: 2855906 - RNA, 13 nt, Human
aggguugggcugg

SEQ ID NO: 2855907 - RNA, 14 nt, Human
aggguuggccccug

SEQ ID NO: 2855908 - RNA, 13 nt, Human
aggguuggccccu

SEQ ID NO: 2855909 - RNA, 14 nt, Human
aggguugugauuuu

SEQ ID NO: 2855910 - RNA, 19 nt, Human
aggguugugauuuugucug

SEQ ID NO: 2855911 - RNA, 22 nt, Human
aggguugugauuuugucugcuu

SEQ ID NO: 2855912 - RNA, 17 nt, Human
aggguugggcugguguc

SEQ ID NO: 2855913 - RNA, 15 nt, Human
aggguugauuaaggc

SEQ ID NO: 2855914 - RNA, 18 nt, Human
aggguugauuaaggcagu

SEQ ID NO: 2855915 - RNA, 15 nt, Human
aggguugcuggagcc

SEQ ID NO: 2855916 - RNA, 16 nt, Human
aggguugcuggagccu

SEQ ID NO: 2855917 - RNA, 17 nt, Human
aggguugcuggagccug

SEQ ID NO: 2855918 - RNA, 22 nt, Human
aggguuugaauuguuuucuuua

SEQ ID NO: 2855919 - RNA, 23 nt, Human
aggguuugaauuguuuucuuuaa

SEQ ID NO: 2855920 - RNA, 20 nt, Human
agguagaccaggauuucuaa

SEQ ID NO: 2855921 - RNA, 14 nt, Human
agguauuucaaaac

SEQ ID NO: 2855922 - RNA, 23 nt, Human
agguauuugggaaacuugucacu

SEQ ID NO: 2855923 - RNA, 14 nt, Human
agguauuuugaaua

SEQ ID NO: 2855924 - RNA, 17 nt, Human
agguauuuugaauacca

SEQ ID NO: 2855925 - RNA, 17 nt, Human
agguauuuuguuucuuu

SEQ ID NO: 2855926 - RNA, 19 nt, Human
agguauuuuguuucuuuua

SEQ ID NO: 2855927 - RNA, 20 nt, Human
agguauuuuguuucuuuuaa

SEQ ID NO: 2855928 - RNA, 14 nt, Human
agguauuuaucuuu

SEQ ID NO: 2855929 - RNA, 13 nt, Human
aggucaacagaau

SEQ ID NO: 2855930 - RNA, 14 nt, Human
aggucaacagaaug

SEQ ID NO: 2855931 - RNA, 15 nt, Human
aggucaacagaauga

SEQ ID NO: 2855932 - RNA, 17 nt, Human
aggucaacagaaugaaa

SEQ ID NO: 2855933 - RNA, 19 nt, Human
aggucaacagaaugaaaaa

SEQ ID NO: 2855934 - RNA, 22 nt, Human
aggucaacagaaugaaaaauga

SEQ ID NO: 2855935 - RNA, 18 nt, Human
agguagagccacaaaaga

SEQ ID NO: 2855936 - RNA, 18 nt, Human
agguagcuuaccugacac

SEQ ID NO: 2855937 - RNA, 19 nt, Human
agguagcuuaccugacaca

SEQ ID NO: 2855938 - RNA, 13 nt, Human
agguagcuucagc

SEQ ID NO: 2855939 - RNA, 17 nt, Human
agguauauuggaagagg

SEQ ID NO: 2855940 - RNA, 15 nt, Human
agguagggagauauu

SEQ ID NO: 2855941 - RNA, 15 nt, Human
aggucaggaguucga

SEQ ID NO: 2855942 - RNA, 12 nt, Human
aggucaggcccu

SEQ ID NO: 2855943 - RNA, 13 nt, Human
aggucaggcccug

SEQ ID NO: 2855944 - RNA, 14 nt, Human
aggucaggcccugg

SEQ ID NO: 2855945 - RNA, 15 nt, Human
aggucaggcccugga

SEQ ID NO: 2855946 - RNA, 16 nt, Human
aggucaggcccuggaa

SEQ ID NO: 2855947 - RNA, 16 nt, Human
aggucagggagugcug

SEQ ID NO: 2855948 - RNA, 20 nt, Human
aggucagggagugcuggcuc

SEQ ID NO: 2855949 - RNA, 17 nt, Human
aggucaggggugacaca

SEQ ID NO: 2855950 - RNA, 18 nt, Human
aggucaggggugacacag

SEQ ID NO: 2855951 - RNA, 19 nt, Human
aggucaggggugacacaga

SEQ ID NO: 2855952 - RNA, 20 nt, Human
aggucaggggugacacagac

SEQ ID NO: 2855953 - RNA, 21 nt, Human
aggucaggggugacacagacu

SEQ ID NO: 2855954 - RNA, 22 nt, Human
aggucaggggugacacagacuc

SEQ ID NO: 2855955 - RNA, 20 nt, Human
aggucaagggcuuacuauuu

SEQ ID NO: 2855956 - RNA, 17 nt, Human
agguccacaacacacag

SEQ ID NO: 2855957 - RNA, 14 nt, Human
agguccaauucucg

SEQ ID NO: 2855958 - RNA, 24 nt, Human
agguccaauucucgagcuuggggc

SEQ ID NO: 2855959 - RNA, 21 nt, Human
aggucuugaacuccuggccuc

SEQ ID NO: 2855960 - RNA, 20 nt, Human
aggucuugaacuccuggccu

SEQ ID NO: 2855961 - RNA, 22 nt, Human
aggucuugaacuccuggccuca

SEQ ID NO: 2855962 - RNA, 18 nt, Human
aggucuugaacuccuggc

SEQ ID NO: 2855963 - RNA, 13 nt, Human
aggugaaaauguu

SEQ ID NO: 2855964 - RNA, 21 nt, Human
aggugaaagggagcuaucagg

SEQ ID NO: 2855965 - RNA, 16 nt, Human
aggugaaagggagcua

SEQ ID NO: 2855966 - RNA, 14 nt, Human
aggugaaagggagc

SEQ ID NO: 2855967 - RNA, 15 nt, Human
ugugaagcauuuaca

SEQ ID NO: 2855968 - RNA, 14 nt, Human
ugugaagcccuguu

SEQ ID NO: 2855969 - RNA, 18 nt, Human
ugugagauuuuuuauugc

SEQ ID NO: 2855970 - RNA, 20 nt, Human
ugugagauuuuuuauugcua

SEQ ID NO: 2855971 - RNA, 22 nt, Human
ugugagauuuuuuauugcuagu

SEQ ID NO: 2855972 - RNA, 14 nt, Human
ugugagcaagaagu

SEQ ID NO: 2855973 - RNA, 22 nt, Human
ugugaagaugauauacuauuuu

SEQ ID NO: 2855974 - RNA, 20 nt, Human
ugugaagaugcauuguaguu

SEQ ID NO: 2855975 - RNA, 12 nt, Human
ugugaacucauu

SEQ ID NO: 2855976 - RNA, 14 nt, Human
ugugaacugaaauu

SEQ ID NO: 2855977 - RNA, 18 nt, Human
ugugaacugaaauuaaaa

SEQ ID NO: 2855978 - RNA, 23 nt, Human
ugugaacugaacucugacaacag

SEQ ID NO: 2855979 - RNA, 14 nt, Human
ugugaacugaacuc

SEQ ID NO: 2855980 - RNA, 14 nt, Human
agucucccucccuu

SEQ ID NO: 2855981 - RNA, 13 nt, Human
agucucugccuug

SEQ ID NO: 2855982 - RNA, 17 nt, Human
agucucugccuugccuu

SEQ ID NO: 2855983 - RNA, 12 nt, Human
agucucugcucc

SEQ ID NO: 2855984 - RNA, 13 nt, Human
agucucugcucca

SEQ ID NO: 2855985 - RNA, 15 nt, Human
agucucugcuccacc

SEQ ID NO: 2855986 - RNA, 22 nt, Human
agucuuuuguucgcauggucac

SEQ ID NO: 2855987 - RNA, 13 nt, Human
agucuuuuucugu

SEQ ID NO: 2855988 - RNA, 14 nt, Human
agucuuuuucuguu

SEQ ID NO: 2855989 - RNA, 17 nt, Human
agucuuuuucuguugua

SEQ ID NO: 2855990 - RNA, 18 nt, Human
agucuuuuucuguuguaa

SEQ ID NO: 2855991 - RNA, 19 nt, Human
agucuuuuucuguuguaac

SEQ ID NO: 2855992 - RNA, 20 nt, Human
agucuuuuucuguuguaacu

SEQ ID NO: 2855993 - RNA, 21 nt, Human
agucuuuuucuguuguaacuu

SEQ ID NO: 2855994 - RNA, 17 nt, Human
agucucugcuggcccag

SEQ ID NO: 2855995 - RNA, 16 nt, Human
agucucuggggcaggc

SEQ ID NO: 2855996 - RNA, 18 nt, Human
agucucuggggcaggcug

SEQ ID NO: 2855997 - RNA, 21 nt, Human
agucucuggggcaggcugcuu

SEQ ID NO: 2855998 - RNA, 16 nt, Human
agucucugcuggccca

SEQ ID NO: 2855999 - RNA, 11 nt, Human
agucucuguga

SEQ ID NO: 2856000 - RNA, 12 nt, Human
agucucugugaa

SEQ ID NO: 2856001 - RNA, 22 nt, Human
agugaaaaucuuggagacccug

SEQ ID NO: 2856002 - RNA, 17 nt, Human
agucuuuuguucgcaug

SEQ ID NO: 2856003 - RNA, 17 nt, Human
agugagacucugucuca

SEQ ID NO: 2856004 - RNA, 16 nt, Human
agugagacucugucuc

SEQ ID NO: 2856005 - RNA, 22 nt, Human
agugagacucugucucaaaaaa

SEQ ID NO: 2856006 - RNA, 17 nt, Human
agugagacccugucucu

SEQ ID NO: 2856007 - RNA, 16 nt, Human
agugagacccugucuc

SEQ ID NO: 2856008 - RNA, 21 nt, Human
agugagacaguccagccugga

SEQ ID NO: 2856009 - RNA, 13 nt, Human
agugagacucugu

SEQ ID NO: 2856010 - RNA, 14 nt, Human
agugagagcugggu

SEQ ID NO: 2856011 - RNA, 22 nt, Human
agugagagagaugggagcuccu

SEQ ID NO: 2856012 - RNA, 19 nt, Human
agugagcccagauugugcc

SEQ ID NO: 2856013 - RNA, 21 nt, Human
agugagcccagauugugccac

SEQ ID NO: 2856014 - RNA, 16 nt, Human
ugugauguauucuagc

SEQ ID NO: 2856015 - RNA, 13 nt, Human
ugugauguucuaa

SEQ ID NO: 2856016 - RNA, 14 nt, Human
ugugauguucuaag

SEQ ID NO: 2856017 - RNA, 15 nt, Human
ugugauguucuaagg

SEQ ID NO: 2856018 - RNA, 16 nt, Human
ugugauguucuaaggc

SEQ ID NO: 2856019 - RNA, 17 nt, Human
ugugauguucuaaggcu

SEQ ID NO: 2856020 - RNA, 18 nt, Human
ugugauguucuaaggcuc

SEQ ID NO: 2856021 - RNA, 14 nt, Human
ugugauuaacuuau

SEQ ID NO: 2856022 - RNA, 17 nt, Human
ugugcaaaaaaauuaaa

SEQ ID NO: 2856023 - RNA, 20 nt, Human
ugugcaaaaaaauuaaaaug

SEQ ID NO: 2856024 - RNA, 23 nt, Human
ugugcaaaaaaauuaaaauggau

SEQ ID NO: 2856025 - RNA, 15 nt, Human
ugugauucaaaagau

SEQ ID NO: 2856026 - RNA, 19 nt, Human
ugucuucacagcucugugu

SEQ ID NO: 2856027 - RNA, 22 nt, Human
ugucuucagccucuccaggcac

SEQ ID NO: 2856028 - RNA, 15 nt, Human
ugucuucauaaagua

SEQ ID NO: 2856029 - RNA, 17 nt, Human
ugucuucauaaaguacu

SEQ ID NO: 2856030 - RNA, 16 nt, Human
ugucuuccauguaucu

SEQ ID NO: 2856031 - RNA, 18 nt, Human
ugucuuccauuccauugu

SEQ ID NO: 2856032 - RNA, 21 nt, Human
ugucuucauuucauuguauga

SEQ ID NO: 2856033 - RNA, 23 nt, Human
ugucuucauuucauuguaugaug

SEQ ID NO: 2856034 - RNA, 15 nt, Human
ugucuuccacuuugc

SEQ ID NO: 2856035 - RNA, 12 nt, Human
ugucuucaugua

SEQ ID NO: 2856036 - RNA, 15 nt, Human
ugucuucauguacau

SEQ ID NO: 2856037 - RNA, 16 nt, Human
ugucuucauuucauug

SEQ ID NO: 2856038 - RNA, 17 nt, Human
ugucuucauuucauugu

SEQ ID NO: 2856039 - RNA, 19 nt, Human
ugucuucauuucauuguau

SEQ ID NO: 2856040 - RNA, 20 nt, Human
ugucuucucuaacaccuugu

SEQ ID NO: 2856041 - RNA, 14 nt, Human
ugucuucucugucu

SEQ ID NO: 2856042 - RNA, 16 nt, Human
ugucuucucugucuca

SEQ ID NO: 2856043 - RNA, 22 nt, Human
ugucuucucugucucagacuuu

SEQ ID NO: 2856044 - RNA, 21 nt, Human
ugucuugcaauggcagccuug

SEQ ID NO: 2856045 - RNA, 20 nt, Human
ugucuugcaauggcagccuu

SEQ ID NO: 2856046 - RNA, 18 nt, Human
ugucuugcaauggcagcc

SEQ ID NO: 2856047 - RNA, 17 nt, Human
ugucuugcaauggcagc

SEQ ID NO: 2856048 - RNA, 15 nt, Human
ugucuugcaauggca

SEQ ID NO: 2856049 - RNA, 19 nt, Human
ugucuugaaagauucaggu

SEQ ID NO: 2856050 - RNA, 17 nt, Human
ugucuugaaugucuuuu

SEQ ID NO: 2856051 - RNA, 20 nt, Human
ugucuugaaugucuuuugaa

SEQ ID NO: 2856052 - RNA, 23 nt, Human
ugucuucuggacaggcucugcuu

SEQ ID NO: 2856053 - RNA, 12 nt, Human
ugucuucuguau

SEQ ID NO: 2856054 - RNA, 13 nt, Human
ugucuucuguaua

SEQ ID NO: 2856055 - RNA, 17 nt, Human
ugucuucuguauauaaa

SEQ ID NO: 2856056 - RNA, 22 nt, Human
ugucuucuguauauaaauggga

SEQ ID NO: 2856057 - RNA, 15 nt, Human
ugucuuuaaaagaga

SEQ ID NO: 2856058 - RNA, 16 nt, Human
ugucuuuaaaagagag

SEQ ID NO: 2856059 - RNA, 14 nt, Human
ugucuuuaaauaga

SEQ ID NO: 2856060 - RNA, 19 nt, Human
ugucuuuaaauagauacaa

SEQ ID NO: 2856061 - RNA, 13 nt, Human
ugucuuguucugu

SEQ ID NO: 2856062 - RNA, 14 nt, Human
ugucuuguucuguc

SEQ ID NO: 2856063 - RNA, 15 nt, Human
ugucuuguucuguca

SEQ ID NO: 2856064 - RNA, 18 nt, Human
ugucuuguucugucacuc

SEQ ID NO: 2856065 - RNA, 19 nt, Human
ugucuuguucugucacuca

SEQ ID NO: 2856066 - RNA, 13 nt, Human
ugucuuggacacu

SEQ ID NO: 2856067 - RNA, 15 nt, Human
ugugaaccaccacac

SEQ ID NO: 2856068 - RNA, 11 nt, Human
ugucuuucaaa

SEQ ID NO: 2856069 - RNA, 13 nt, Human
ugucuuucaaacu

SEQ ID NO: 2856070 - RNA, 20 nt, Human
ugucuuucaaacuccaaggu

SEQ ID NO: 2856071 - RNA, 22 nt, Human
ugucuuuaauuucugucagaau

SEQ ID NO: 2856072 - RNA, 12 nt, Human
ugucuuuacucc

SEQ ID NO: 2856073 - RNA, 15 nt, Human
ugucuuuacuccuca

SEQ ID NO: 2856074 - RNA, 15 nt, Human
ugucuuuaaggaaaa

SEQ ID NO: 2856075 - RNA, 19 nt, Human
ugucuugcuguugacauau

SEQ ID NO: 2856076 - RNA, 20 nt, Human
ugucuugcuguugacauauu

SEQ ID NO: 2856077 - RNA, 14 nt, Human
ugucuuuaaggaaa

SEQ ID NO: 2856078 - RNA, 23 nt, Human
ugugaaccaccacacccagccca

SEQ ID NO: 2856079 - RNA, 22 nt, Human
ugugaaccaccacacccagccc

SEQ ID NO: 2856080 - RNA, 16 nt, Human
ugugaaccaccacacc

SEQ ID NO: 2856081 - RNA, 14 nt, Human
ugugaacauuugug

SEQ ID NO: 2856082 - RNA, 16 nt, Human
ugugaaccaagaucua

SEQ ID NO: 2856083 - RNA, 20 nt, Human
ugugaacuagggaagcucag

SEQ ID NO: 2856084 - RNA, 14 nt, Human
ugucucguuuguga

SEQ ID NO: 2856085 - RNA, 18 nt, Human
ugucucguuugugauucu

SEQ ID NO: 2856086 - RNA, 15 nt, Human
ugucucuaacuuauu

SEQ ID NO: 2856087 - RNA, 16 nt, Human
ugucucuaacuuauuu

SEQ ID NO: 2856088 - RNA, 12 nt, Human
ugucucuccuuu

SEQ ID NO: 2856089 - RNA, 13 nt, Human
ugucucuccuuuu

SEQ ID NO: 2856090 - RNA, 15 nt, Human
ugucucuccuuuucu

SEQ ID NO: 2856091 - RNA, 16 nt, Human
ugucucuccuuuucuu

SEQ ID NO: 2856092 - RNA, 20 nt, Human
ugucucuccuuuucuuuugu

SEQ ID NO: 2856093 - RNA, 21 nt, Human
ugucucuccuuuucuuuuguu

SEQ ID NO: 2856094 - RNA, 22 nt, Human
ugucucuccuuuucuuuuguua

SEQ ID NO: 2856095 - RNA, 18 nt, Human
ugucucucuucagacucu

SEQ ID NO: 2856096 - RNA, 19 nt, Human
ugucucucuucagacucuc

SEQ ID NO: 2856097 - RNA, 21 nt, Human
ugucucucuucagacucucag

SEQ ID NO: 2856098 - RNA, 16 nt, Human
ugucucugaagcguga

SEQ ID NO: 2856099 - RNA, 17 nt, Human
ugucuccuuuaagagcu

SEQ ID NO: 2856100 - RNA, 21 nt, Human
ugucuccuuucaccccagggc

SEQ ID NO: 2856101 - RNA, 22 nt, Human
ugucuccuuucaccccagggcc

SEQ ID NO: 2856102 - RNA, 17 nt, Human
ugucuccuuaacacuga

SEQ ID NO: 2856103 - RNA, 18 nt, Human
ugucuccuuaacacugag

SEQ ID NO: 2856104 - RNA, 22 nt, Human
ugucugaaaaauuccuuugugu

SEQ ID NO: 2856105 - RNA, 13 nt, Human
ugucuucaaggcu

SEQ ID NO: 2856106 - RNA, 20 nt, Human
ugucuucaaggcuucagucu

SEQ ID NO: 2856107 - RNA, 16 nt, Human
ugucuucaaacuguga

SEQ ID NO: 2856108 - RNA, 13 nt, Human
ugucuuauauaua

SEQ ID NO: 2856109 - RNA, 22 nt, Human
ugucuuauauauauuucuuugu

SEQ ID NO: 2856110 - RNA, 16 nt, Human
ugucuuaucuggcccu

SEQ ID NO: 2856111 - RNA, 17 nt, Human
ugucuuauggauucauu

SEQ ID NO: 2856112 - RNA, 19 nt, Human
ugucuuauggauucauuua

SEQ ID NO: 2856113 - RNA, 12 nt, Human
ugucugaaaaau

SEQ ID NO: 2856114 - RNA, 19 nt, Human
ugucuuaauuuuugaaaaa

SEQ ID NO: 2856115 - RNA, 14 nt, Human
ugucuuauauagca

SEQ ID NO: 2856116 - RNA, 14 nt, Human
ugucuuaauuauua

SEQ ID NO: 2856117 - RNA, 15 nt, Human
ugucuuaauuauuau

SEQ ID NO: 2856118 - RNA, 20 nt, Human
ugucuuaauuucuaucuugu

SEQ ID NO: 2856119 - RNA, 21 nt, Human
ugucucuuuaaugucacaggc

SEQ ID NO: 2856120 - RNA, 22 nt, Human
ugucucuuuaaugucacaggca

SEQ ID NO: 2856121 - RNA, 17 nt, Human
ugucucuuuaagggcau

SEQ ID NO: 2856122 - RNA, 22 nt, Human
ugucucuuuaagggcaugccuu

SEQ ID NO: 2856123 - RNA, 13 nt, Human
ugucucuugaaaa

SEQ ID NO: 2856124 - RNA, 15 nt, Human
ugucucuugaaaaau

SEQ ID NO: 2856125 - RNA, 13 nt, Human
ugucucuggccug

SEQ ID NO: 2856126 - RNA, 11 nt, Human
ugucucugcuc

SEQ ID NO: 2856127 - RNA, 22 nt, Human
ugucucugcucgcccuccuuuc

SEQ ID NO: 2856128 - RNA, 15 nt, Human
ugucucugauaaaag

SEQ ID NO: 2856129 - RNA, 21 nt, Human
aguagcugggacuacaggcac

SEQ ID NO: 2856130 - RNA, 19 nt, Human
aguagcugggacuacaggc

SEQ ID NO: 2856131 - RNA, 22 nt, Human
aguagcugggacuacaggcacc

SEQ ID NO: 2856132 - RNA, 14 nt, Human
aguauguguaaaau

SEQ ID NO: 2856133 - RNA, 17 nt, Human
aguagcuggauuacagg

SEQ ID NO: 2856134 - RNA, 18 nt, Human
aguauuggggucugaccc

SEQ ID NO: 2856135 - RNA, 12 nt, Human
aguauuguaaau

SEQ ID NO: 2856136 - RNA, 13 nt, Human
aguauuguaaauu

SEQ ID NO: 2856137 - RNA, 14 nt, Human
aguauuguaaauua

SEQ ID NO: 2856138 - RNA, 15 nt, Human
aguauuguaaauuau

SEQ ID NO: 2856139 - RNA, 16 nt, Human
aguauuguaaauuaua

SEQ ID NO: 2856140 - RNA, 17 nt, Human
aguauuguaaauuauau

SEQ ID NO: 2856141 - RNA, 18 nt, Human
aguauuguaaauuauauu

SEQ ID NO: 2856142 - RNA, 22 nt, Human
aguauuguaaauuauauuugug

SEQ ID NO: 2856143 - RNA, 16 nt, Human
aguauugauucugcuu

SEQ ID NO: 2856144 - RNA, 23 nt, Human
aguauugauucugcuugagaaua

SEQ ID NO: 2856145 - RNA, 14 nt, Human
agucacaucacagg

SEQ ID NO: 2856146 - RNA, 15 nt, Human
agucacaucacagga

SEQ ID NO: 2856147 - RNA, 20 nt, Human
aguauuagacuggaaguuca

SEQ ID NO: 2856148 - RNA, 23 nt, Human
agucacauggccuaugcacauau

SEQ ID NO: 2856149 - RNA, 22 nt, Human
agucacagagauaauucuagcu

SEQ ID NO: 2856150 - RNA, 17 nt, Human
uguauguuuuuuuucug

SEQ ID NO: 2856151 - RNA, 12 nt, Human
uguauuaacaaa

SEQ ID NO: 2856152 - RNA, 13 nt, Human
uguauuaacaaaa

SEQ ID NO: 2856153 - RNA, 14 nt, Human
uguauuaacaaaag

SEQ ID NO: 2856154 - RNA, 15 nt, Human
uguauuaacaaaagu

SEQ ID NO: 2856155 - RNA, 19 nt, Human
uguauuaacaaaaguuccc

SEQ ID NO: 2856156 - RNA, 15 nt, Human
uguaucccaugagcc

SEQ ID NO: 2856157 - RNA, 15 nt, Human
uguagagccaggguc

SEQ ID NO: 2856158 - RNA, 12 nt, Human
uguagagccagg

SEQ ID NO: 2856159 - RNA, 22 nt, Human
agguuucuggucucuaggcugg

SEQ ID NO: 2856160 - RNA, 23 nt, Human
uguagagaacacgcguauuuaca

SEQ ID NO: 2856161 - RNA, 23 nt, Human
agguuucuggucucuaggcuggg

SEQ ID NO: 2856162 - RNA, 16 nt, Human
agguuugucaucagau

SEQ ID NO: 2856163 - RNA, 14 nt, Human
aguagcugggacua

SEQ ID NO: 2856164 - RNA, 13 nt, Human
aguagcugggacu

SEQ ID NO: 2856165 - RNA, 20 nt, Human
aguagcguuuuuuaaaugua

SEQ ID NO: 2856166 - RNA, 15 nt, Human
ugucaacuucaacau

SEQ ID NO: 2856167 - RNA, 22 nt, Human
aguagcguuuuuuaaauguaua

SEQ ID NO: 2856168 - RNA, 15 nt, Human
aguagcucuccugac

SEQ ID NO: 2856169 - RNA, 21 nt, Human
aguagcguuuuuuaaauguau

SEQ ID NO: 2856170 - RNA, 22 nt, Human
ugucaacaaaccaagcaucagg

SEQ ID NO: 2856171 - RNA, 23 nt, Human
ugucaacaaaccaagcaucaggg

SEQ ID NO: 2856172 - RNA, 22 nt, Human
ugucaacaccccuguguggaug

SEQ ID NO: 2856173 - RNA, 17 nt, Human
ugucaacaugaaacacc

SEQ ID NO: 2856174 - RNA, 13 nt, Human
ugucaacauugug

SEQ ID NO: 2856175 - RNA, 14 nt, Human
ugucaacauuguga

SEQ ID NO: 2856176 - RNA, 15 nt, Human
ugucaacauugugau

SEQ ID NO: 2856177 - RNA, 14 nt, Human
ugucaaccagacag

SEQ ID NO: 2856178 - RNA, 15 nt, Human
ugucaaccagacaga

SEQ ID NO: 2856179 - RNA, 17 nt, Human
ugucaaccagacagagg

SEQ ID NO: 2856180 - RNA, 20 nt, Human
ugucaaccagacagaggguc

SEQ ID NO: 2856181 - RNA, 22 nt, Human
ugucaaccagacagagggucac

SEQ ID NO: 2856182 - RNA, 23 nt, Human
ugucaaccagacagagggucaca

SEQ ID NO: 2856183 - RNA, 18 nt, Human
uguauuagugauauuucu

SEQ ID NO: 2856184 - RNA, 19 nt, Human
uguauuagugauauuucuc

SEQ ID NO: 2856185 - RNA, 20 nt, Human
uguauuagugauauuucucu

SEQ ID NO: 2856186 - RNA, 22 nt, Human
uguauuagugauauuucucuag

SEQ ID NO: 2856187 - RNA, 16 nt, Human
uguauuaauaaauaga

SEQ ID NO: 2856188 - RNA, 12 nt, Human
uguauguguauu

SEQ ID NO: 2856189 - RNA, 14 nt, Human
uguauuacagaugc

SEQ ID NO: 2856190 - RNA, 18 nt, Human
uguauuaagggauuuagu

SEQ ID NO: 2856191 - RNA, 19 nt, Human
uguauuaagggauuuagua

SEQ ID NO: 2856192 - RNA, 15 nt, Human
uguauuagucacaga

SEQ ID NO: 2856193 - RNA, 23 nt, Human
ugucagcuacugcggaaaaggaa

SEQ ID NO: 2856194 - RNA, 21 nt, Human
uguccacccaccuaugugcca

SEQ ID NO: 2856195 - RNA, 20 nt, Human
ugucagccauugcacccagc

SEQ ID NO: 2856196 - RNA, 23 nt, Human
ugucagcgcagguuuaguuuacu

SEQ ID NO: 2856197 - RNA, 21 nt, Human
ugucagcgccuggccuaccca

SEQ ID NO: 2856198 - RNA, 20 nt, Human
ugucccuaccgagucucuuc

SEQ ID NO: 2856199 - RNA, 21 nt, Human
ugucccuaccgagucucuucu

SEQ ID NO: 2856200 - RNA, 22 nt, Human
ugucccuaccgagucucuucuc

SEQ ID NO: 2856201 - RNA, 19 nt, Human
uguccaggcacugcugccc

SEQ ID NO: 2856202 - RNA, 20 nt, Human
uguccaggcacugcugccca

SEQ ID NO: 2856203 - RNA, 21 nt, Human
uguccaggcacugcugcccag

SEQ ID NO: 2856204 - RNA, 13 nt, Human
uguccacugugua

SEQ ID NO: 2856205 - RNA, 14 nt, Human
uguccaccuguggg

SEQ ID NO: 2856206 - RNA, 15 nt, Human
uguccaccugugggu

SEQ ID NO: 2856207 - RNA, 14 nt, Human
ugucccugcacuug

SEQ ID NO: 2856208 - RNA, 15 nt, Human
ugucccugaaaccua

SEQ ID NO: 2856209 - RNA, 18 nt, Human
ugucccuucugucccuca

SEQ ID NO: 2856210 - RNA, 14 nt, Human
ugucccucuucacu

SEQ ID NO: 2856211 - RNA, 16 nt, Human
ugucccucuucacucc

SEQ ID NO: 2856212 - RNA, 15 nt, Human
ugucccuuucagaga

SEQ ID NO: 2856213 - RNA, 20 nt, Human
ugucccuucugucccucaca

SEQ ID NO: 2856214 - RNA, 17 nt, Human
ugucccuugaugcacag

SEQ ID NO: 2856215 - RNA, 18 nt, Human
ugucccuugaugcacaga

SEQ ID NO: 2856216 - RNA, 19 nt, Human
ugucccuugaugcacagag

SEQ ID NO: 2856217 - RNA, 20 nt, Human
ugucccuugaugcacagaga

SEQ ID NO: 2856218 - RNA, 12 nt, Human
ugucccuugcug

SEQ ID NO: 2856219 - RNA, 14 nt, Human
ugucccuugcugua

SEQ ID NO: 2856220 - RNA, 21 nt, Human
ugucccuaguaaaaauacaaa

SEQ ID NO: 2856221 - RNA, 21 nt, Human
ugucccucacuguugaauuuu

SEQ ID NO: 2856222 - RNA, 12 nt, Human
ugucccucccac

SEQ ID NO: 2856223 - RNA, 13 nt, Human
ugucccucccacc

SEQ ID NO: 2856224 - RNA, 14 nt, Human
ugucccucccaccu

SEQ ID NO: 2856225 - RNA, 15 nt, Human
ugucccucccaccuc

SEQ ID NO: 2856226 - RNA, 16 nt, Human
ugucccucccaccucu

SEQ ID NO: 2856227 - RNA, 21 nt, Human
ugucccucucggaaggcuggc

SEQ ID NO: 2856228 - RNA, 20 nt, Human
ugucccucccaccucuguga

SEQ ID NO: 2856229 - RNA, 13 nt, Human
ugucccuccuggu

SEQ ID NO: 2856230 - RNA, 16 nt, Human
ugucccuccugguguc

SEQ ID NO: 2856231 - RNA, 22 nt, Human
ugucccuccuggugucacccca

SEQ ID NO: 2856232 - RNA, 14 nt, Human
ugucccucccccuu

SEQ ID NO: 2856233 - RNA, 17 nt, Human
ugucccucccaccucug

SEQ ID NO: 2856234 - RNA, 18 nt, Human
ugucccucccaccucugu

SEQ ID NO: 2856235 - RNA, 15 nt, Human
uguccugguucccgu

SEQ ID NO: 2856236 - RNA, 20 nt, Human
uguccuguagagguuuuguu

SEQ ID NO: 2856237 - RNA, 17 nt, Human
uguccugguuagcagag

SEQ ID NO: 2856238 - RNA, 24 nt, Human
uguccuguaguugcguggacucug

SEQ ID NO: 2856239 - RNA, 13 nt, Human
uguccugugaggu

SEQ ID NO: 2856240 - RNA, 19 nt, Human
uguccugugagguuuccca

SEQ ID NO: 2856241 - RNA, 20 nt, Human
uguccugugagguuucccaa

SEQ ID NO: 2856242 - RNA, 21 nt, Human
uguccugugagguuucccaau

SEQ ID NO: 2856243 - RNA, 14 nt, Human
uguccuucccugca

SEQ ID NO: 2856244 - RNA, 16 nt, Human
uguccuucccugcauu

SEQ ID NO: 2856245 - RNA, 22 nt, Human
uguccuucccugcauuucugag

SEQ ID NO: 2856246 - RNA, 14 nt, Human
agucagaugcccag

SEQ ID NO: 2856247 - RNA, 14 nt, Human
ugucuaagauucua

SEQ ID NO: 2856248 - RNA, 15 nt, Human
ugucuaagauucuag

SEQ ID NO: 2856249 - RNA, 23 nt, Human
agucagaugcccagagggcccag

SEQ ID NO: 2856250 - RNA, 16 nt, Human
ugucuaagauucuaga

SEQ ID NO: 2856251 - RNA, 16 nt, Human
agucagugcaaauguc

SEQ ID NO: 2856252 - RNA, 23 nt, Human
agucagugcaaaugucagauaca

SEQ ID NO: 2856253 - RNA, 21 nt, Human
agucagucaugauggcaccac

SEQ ID NO: 2856254 - RNA, 13 nt, Human
agucaucaucagg

SEQ ID NO: 2856255 - RNA, 14 nt, Human
agucaucaucaggg

SEQ ID NO: 2856256 - RNA, 15 nt, Human
agucaucaucagggc

SEQ ID NO: 2856257 - RNA, 16 nt, Human
agucaucaucagggcc

SEQ ID NO: 2856258 - RNA, 17 nt, Human
agucaucaucagggccu

SEQ ID NO: 2856259 - RNA, 18 nt, Human
agucaucaucagggccug

SEQ ID NO: 2856260 - RNA, 19 nt, Human
agucaucaucagggccugg

SEQ ID NO: 2856261 - RNA, 21 nt, Human
agucaucaucagggccugggg

SEQ ID NO: 2856262 - RNA, 22 nt, Human
agucaucaucagggccuggggc

SEQ ID NO: 2856263 - RNA, 14 nt, Human
agucaucuauaguu

SEQ ID NO: 2856264 - RNA, 22 nt, Human
agucaucuauaguugauauguu

SEQ ID NO: 2856265 - RNA, 14 nt, Human
ugucuaagauagua

SEQ ID NO: 2856266 - RNA, 15 nt, Human
ugucuaagauaguaa

SEQ ID NO: 2856267 - RNA, 13 nt, Human
ugucuaagauucu

SEQ ID NO: 2856268 - RNA, 18 nt, Human
ugucuaaauuugaauguu

SEQ ID NO: 2856269 - RNA, 22 nt, Human
ugucuaaacaaugcugauuugg

SEQ ID NO: 2856270 - RNA, 18 nt, Human
ugucuaacucagaauuau

SEQ ID NO: 2856271 - RNA, 20 nt, Human
ugucuaacucagaauuauuu

SEQ ID NO: 2856272 - RNA, 22 nt, Human
ugucuaacuuuagaagugcauu

SEQ ID NO: 2856273 - RNA, 21 nt, Human
ugucuaacuuuugugaagaac

SEQ ID NO: 2856274 - RNA, 16 nt, Human
uguccuugaaugccau

SEQ ID NO: 2856275 - RNA, 17 nt, Human
uguccuugaaugccaua

SEQ ID NO: 2856276 - RNA, 18 nt, Human
uguccuuggaaguuucau

SEQ ID NO: 2856277 - RNA, 16 nt, Human
uguccuuuaaaaaaga

SEQ ID NO: 2856278 - RNA, 18 nt, Human
uguccuuuaaaaaagaaa

SEQ ID NO: 2856279 - RNA, 19 nt, Human
uguccuuuaaaaaagaaaa

SEQ ID NO: 2856280 - RNA, 13 nt, Human
agucaugaagccc

SEQ ID NO: 2856281 - RNA, 21 nt, Human
agucaugaagcccaagugaaa

SEQ ID NO: 2856282 - RNA, 14 nt, Human
agucaugaagccca

SEQ ID NO: 2856283 - RNA, 17 nt, Human
aguccagugaccugcug

SEQ ID NO: 2856284 - RNA, 20 nt, Human
agucccaccuuggcugcagg

SEQ ID NO: 2856285 - RNA, 23 nt, Human
agucccaccuuggcugcagggag

SEQ ID NO: 2856286 - RNA, 21 nt, Human
agucccaccuuggcugcaggg

SEQ ID NO: 2856287 - RNA, 23 nt, Human
aguccccagcccuucacauuuuu

SEQ ID NO: 2856288 - RNA, 19 nt, Human
agucaucuuguaauuucca

SEQ ID NO: 2856289 - RNA, 20 nt, Human
agucccaggcugagccucag

SEQ ID NO: 2856290 - RNA, 22 nt, Human
auaauuccuauauccugugacu

SEQ ID NO: 2856291 - RNA, 13 nt, Human
auaauuccuacag

SEQ ID NO: 2856292 - RNA, 16 nt, Human
auaauuccuacagcac

SEQ ID NO: 2856293 - RNA, 18 nt, Human
auaauuccuacagcacua

SEQ ID NO: 2856294 - RNA, 19 nt, Human
auaauuccuacagcacuac

SEQ ID NO: 2856295 - RNA, 12 nt, Human
auaauucuaaag

SEQ ID NO: 2856296 - RNA, 12 nt, Human
auaauucuaaau

SEQ ID NO: 2856297 - RNA, 16 nt, Human
auaauucuaaaucccu

SEQ ID NO: 2856298 - RNA, 15 nt, Human
auaauucuggagaua

SEQ ID NO: 2856299 - RNA, 13 nt, Human
auaauugcaucua

SEQ ID NO: 2856300 - RNA, 19 nt, Human
auaauugcaucuagguaau

SEQ ID NO: 2856301 - RNA, 13 nt, Human
auaauugcauuca

SEQ ID NO: 2856302 - RNA, 14 nt, Human
auaauugcauucau

SEQ ID NO: 2856303 - RNA, 16 nt, Human
auaauugcuauuuauu

SEQ ID NO: 2856304 - RNA, 20 nt, Human
auaauugcuauuuauuuuua

SEQ ID NO: 2856305 - RNA, 19 nt, Human
auaauugcucauaagcaau

SEQ ID NO: 2856306 - RNA, 21 nt, Human
uuagcacuugggugacggcag

SEQ ID NO: 2856307 - RNA, 17 nt, Human
uuagcagaagaaaggaa

SEQ ID NO: 2856308 - RNA, 12 nt, Human
uuagcacuguug

SEQ ID NO: 2856309 - RNA, 14 nt, Human
uuagcacuguugau

SEQ ID NO: 2856310 - RNA, 18 nt, Human
uuagcacuguugauguau

SEQ ID NO: 2856311 - RNA, 21 nt, Human
uuagcacuguugauguaucug

SEQ ID NO: 2856312 - RNA, 21 nt, Human
uuagauuuucugguucuaaca

SEQ ID NO: 2856313 - RNA, 12 nt, Human
uuagcaccaggg

SEQ ID NO: 2856314 - RNA, 19 nt, Human
uuagauuuucugguucuaa

SEQ ID NO: 2856315 - RNA, 20 nt, Human
uuagauuuucugguucuaac

SEQ ID NO: 2856316 - RNA, 21 nt, Human
uuagauuuuauuuuacuauug

SEQ ID NO: 2856317 - RNA, 18 nt, Human
uuagauuuucugguucua

SEQ ID NO: 2856318 - RNA, 13 nt, Human
uuagauuguaaac

SEQ ID NO: 2856319 - RNA, 22 nt, Human
uuagauucucugugucuaagau

SEQ ID NO: 2856320 - RNA, 19 nt, Human
uuagauuucaagaaaaaau

SEQ ID NO: 2856321 - RNA, 23 nt, Human
uuagauugaaaacuuuucucaga

SEQ ID NO: 2856322 - RNA, 19 nt, Human
uuagauucucugugucuaa

SEQ ID NO: 2856323 - RNA, 20 nt, Human
uuagauucucugugucuaag

SEQ ID NO: 2856324 - RNA, 20 nt, Human
auaauucaggaagcagcuuu

SEQ ID NO: 2856325 - RNA, 17 nt, Human
auaauucaguauguuuu

SEQ ID NO: 2856326 - RNA, 18 nt, Human
auaauucaguauguuuua

SEQ ID NO: 2856327 - RNA, 20 nt, Human
auaauucaguauguuuuaca

SEQ ID NO: 2856328 - RNA, 21 nt, Human
auaauucaguauguuuuacac

SEQ ID NO: 2856329 - RNA, 23 nt, Human
auaauucaguauguuuuacacug

SEQ ID NO: 2856330 - RNA, 13 nt, Human
auaauucauauuc

SEQ ID NO: 2856331 - RNA, 13 nt, Human
auaaucuuugggu

SEQ ID NO: 2856332 - RNA, 17 nt, Human
auaaugaaaauauuuuu

SEQ ID NO: 2856333 - RNA, 13 nt, Human
auaaugaacccau

SEQ ID NO: 2856334 - RNA, 20 nt, Human
auaaucagugugucuaaauu

SEQ ID NO: 2856335 - RNA, 17 nt, Human
auaaucagccucuuaaa

SEQ ID NO: 2856336 - RNA, 16 nt, Human
auaaucagccucuuaa

SEQ ID NO: 2856337 - RNA, 15 nt, Human
auaaucagccucuua

SEQ ID NO: 2856338 - RNA, 14 nt, Human
auaaucagccucuu

SEQ ID NO: 2856339 - RNA, 22 nt, Human
auaauaauuagguuaacauugu

SEQ ID NO: 2856340 - RNA, 15 nt, Human
auaauaauauuguuu

SEQ ID NO: 2856341 - RNA, 18 nt, Human
auaauaauauuguuuuuc

SEQ ID NO: 2856342 - RNA, 19 nt, Human
auaauaaucuaggcaugaa

SEQ ID NO: 2856343 - RNA, 22 nt, Human
auaauacacuaauuccuuucua

SEQ ID NO: 2856344 - RNA, 13 nt, Human
auaauacacuugc

SEQ ID NO: 2856345 - RNA, 16 nt, Human
auaauacacuugcccu

SEQ ID NO: 2856346 - RNA, 19 nt, Human
auaauacacuugcccugcu

SEQ ID NO: 2856347 - RNA, 12 nt, Human
auaauaccucaa

SEQ ID NO: 2856348 - RNA, 21 nt, Human
auaauacacuaauuccuuucu

SEQ ID NO: 2856349 - RNA, 13 nt, Human
auaaucagccucu

SEQ ID NO: 2856350 - RNA, 23 nt, Human
auaauaaauuguuuggcuuccuc

SEQ ID NO: 2856351 - RNA, 17 nt, Human
auaauaagcaggauguu

SEQ ID NO: 2856352 - RNA, 19 nt, Human
auaauaaaaaauuaugaca

SEQ ID NO: 2856353 - RNA, 12 nt, Human
auaauaaauuga

SEQ ID NO: 2856354 - RNA, 15 nt, Human
auaauaaauugaaau

SEQ ID NO: 2856355 - RNA, 20 nt, Human
auaaguuugaaggaaacagu

SEQ ID NO: 2856356 - RNA, 21 nt, Human
auaaguuugaaggaaacaguu

SEQ ID NO: 2856357 - RNA, 13 nt, Human
auaaguuugaagg

SEQ ID NO: 2856358 - RNA, 15 nt, Human
auaaguuugaaggaa

SEQ ID NO: 2856359 - RNA, 19 nt, Human
auaaguuugaaggaaacag

SEQ ID NO: 2856360 - RNA, 16 nt, Human
auaaguuccuuuccuu

SEQ ID NO: 2856361 - RNA, 20 nt, Human
auaaguucuuaugccauguu

SEQ ID NO: 2856362 - RNA, 13 nt, Human
auaaguucacaaa

SEQ ID NO: 2856363 - RNA, 15 nt, Human
auaaguucacaaaau

SEQ ID NO: 2856364 - RNA, 16 nt, Human
auaaguucacaaaaug

SEQ ID NO: 2856365 - RNA, 15 nt, Human
uuaccuaaaguauuu

SEQ ID NO: 2856366 - RNA, 16 nt, Human
uuaccuaaaguauuuu

SEQ ID NO: 2856367 - RNA, 18 nt, Human
uuaccuaagugacauuug

SEQ ID NO: 2856368 - RNA, 20 nt, Human
uuaccuaagugacauuugua

SEQ ID NO: 2856369 - RNA, 21 nt, Human
uuaccuaagugacauuuguag

SEQ ID NO: 2856370 - RNA, 12 nt, Human
uuaccucuuuaa

SEQ ID NO: 2856371 - RNA, 14 nt, Human
uuaccugcaggcug

SEQ ID NO: 2856372 - RNA, 12 nt, Human
uuaccugacaca

SEQ ID NO: 2856373 - RNA, 13 nt, Human
uuaccugacacaa

SEQ ID NO: 2856374 - RNA, 16 nt, Human
uuaccugaccucuugc

SEQ ID NO: 2856375 - RNA, 17 nt, Human
uuaccugaccucuugcu

SEQ ID NO: 2856376 - RNA, 18 nt, Human
uuaccugaccucuugcug

SEQ ID NO: 2856377 - RNA, 19 nt, Human
uuaccugaccucuugcugu

SEQ ID NO: 2856378 - RNA, 20 nt, Human
uuaccugaccucuugcuguc

SEQ ID NO: 2856379 - RNA, 21 nt, Human
uuaccugaccucuugcugucu

SEQ ID NO: 2856380 - RNA, 23 nt, Human
uuaccugaccucuugcugucucu

SEQ ID NO: 2856381 - RNA, 20 nt, Human
auaagcacugaaaaacaaca

SEQ ID NO: 2856382 - RNA, 17 nt, Human
auaagauucuaacgguc

SEQ ID NO: 2856383 - RNA, 17 nt, Human
auaagaaaugcauaugu

SEQ ID NO: 2856384 - RNA, 22 nt, Human
auaagaacaauagguaaagcua

SEQ ID NO: 2856385 - RNA, 15 nt, Human
auaagaaaguuucac

SEQ ID NO: 2856386 - RNA, 23 nt, Human
auaagcaaagggagcacuggguu

SEQ ID NO: 2856387 - RNA, 14 nt, Human
auaagcaaauuuca

SEQ ID NO: 2856388 - RNA, 15 nt, Human
auaagcaaauuucaa

SEQ ID NO: 2856389 - RNA, 19 nt, Human
auaagcaaauuucaaaaga

SEQ ID NO: 2856390 - RNA, 21 nt, Human
auaagcaaauuucaaaagaca

SEQ ID NO: 2856391 - RNA, 22 nt, Human
auaagcaaauuucaaaagacau

SEQ ID NO: 2856392 - RNA, 20 nt, Human
auaagcaaaaacaaaaagaa

SEQ ID NO: 2856393 - RNA, 14 nt, Human
auaagcaaaauccu

SEQ ID NO: 2856394 - RNA, 21 nt, Human
auaagcaaaauccugacuauu

SEQ ID NO: 2856395 - RNA, 14 nt, Human
auaagaagcaaaua

SEQ ID NO: 2856396 - RNA, 12 nt, Human
auaagauucuaa

SEQ ID NO: 2856397 - RNA, 13 nt, Human
auaagauucuaac

SEQ ID NO: 2856398 - RNA, 12 nt, Human
auaacugaggag

SEQ ID NO: 2856399 - RNA, 17 nt, Human
auaacugccuugaaccu

SEQ ID NO: 2856400 - RNA, 23 nt, Human
auaacugccuugaaccugugagu

SEQ ID NO: 2856401 - RNA, 23 nt, Human
auaaccacaaagcacaguuugaa

SEQ ID NO: 2856402 - RNA, 14 nt, Human
auaaccacugaagg

SEQ ID NO: 2856403 - RNA, 19 nt, Human
auaaccagcuguaacacag

SEQ ID NO: 2856404 - RNA, 22 nt, Human
auaacucuguggcauuauugca

SEQ ID NO: 2856405 - RNA, 14 nt, Human
auaaccagcuguaa

SEQ ID NO: 2856406 - RNA, 14 nt, Human
auaaauuaguuguu

SEQ ID NO: 2856407 - RNA, 15 nt, Human
auaaauuauacaaau

SEQ ID NO: 2856408 - RNA, 14 nt, Human
auaacauuaccuua

SEQ ID NO: 2856409 - RNA, 19 nt, Human
auaacauuaccuuacugug

SEQ ID NO: 2856410 - RNA, 20 nt, Human
auaacauuaccuuacugugg

SEQ ID NO: 2856411 - RNA, 19 nt, Human
auaacauuuguguguuaua

SEQ ID NO: 2856412 - RNA, 12 nt, Human
auaaaugucugu

SEQ ID NO: 2856413 - RNA, 15 nt, Human
auaaaugucuguuga

SEQ ID NO: 2856414 - RNA, 23 nt, Human
uuaccauuuugggguacccacug

SEQ ID NO: 2856415 - RNA, 13 nt, Human
uuaccauucacaa

SEQ ID NO: 2856416 - RNA, 14 nt, Human
uuaccauucacaau

SEQ ID NO: 2856417 - RNA, 15 nt, Human
uuaccauucacaaua

SEQ ID NO: 2856418 - RNA, 17 nt, Human
uuaccauucacaauaaa

SEQ ID NO: 2856419 - RNA, 23 nt, Human
uuacaugcaauuuauuaaaauga

SEQ ID NO: 2856420 - RNA, 22 nt, Human
uuacaugcaauuuauuaaaaug

SEQ ID NO: 2856421 - RNA, 22 nt, Human
uuacccaccuagaacacuaacu

SEQ ID NO: 2856422 - RNA, 22 nt, Human
uuacccugcgauuuugccugug

SEQ ID NO: 2856423 - RNA, 12 nt, Human
uuacccugggaa

SEQ ID NO: 2856424 - RNA, 23 nt, Human
uuacccuguacauauguaaacau

SEQ ID NO: 2856425 - RNA, 12 nt, Human
uuacccuuagaa

SEQ ID NO: 2856426 - RNA, 13 nt, Human
uuacccuuagaau

SEQ ID NO: 2856427 - RNA, 13 nt, Human
uuacccuucccug

SEQ ID NO: 2856428 - RNA, 17 nt, Human
uuacccuucccugcacu

SEQ ID NO: 2856429 - RNA, 16 nt, Human
uuacccuuuagacugu

SEQ ID NO: 2856430 - RNA, 13 nt, Human
uuacccuuuagac

SEQ ID NO: 2856431 - RNA, 20 nt, Human
uuacccuugagcccucccca

SEQ ID NO: 2856432 - RNA, 16 nt, Human
uuacccaccuagaaca

SEQ ID NO: 2856433 - RNA, 15 nt, Human
uuacccaccuagaac

SEQ ID NO: 2856434 - RNA, 16 nt, Human
uuacccacacacagau

SEQ ID NO: 2856435 - RNA, 14 nt, Human
uuacccaauuuccc

SEQ ID NO: 2856436 - RNA, 24 nt, Human
uuacccaaaaacuaaaucucuaau

SEQ ID NO: 2856437 - RNA, 21 nt, Human
auaacucuguaaaaacacuga

SEQ ID NO: 2856438 - RNA, 14 nt, Human
uuaccauuuuucau

SEQ ID NO: 2856439 - RNA, 21 nt, Human
uuaccauuugcuacuguacau

SEQ ID NO: 2856440 - RNA, 12 nt, Human
auaacugugaag

SEQ ID NO: 2856441 - RNA, 17 nt, Human
aguuuucuccucccagg

SEQ ID NO: 2856442 - RNA, 13 nt, Human
aguuuucuccuuu

SEQ ID NO: 2856443 - RNA, 17 nt, Human
aguuuucuccuuuuacu

SEQ ID NO: 2856444 - RNA, 12 nt, Human
aguuuucucuua

SEQ ID NO: 2856445 - RNA, 21 nt, Human
aguuuucucuuuguggggcuu

SEQ ID NO: 2856446 - RNA, 22 nt, Human
aguuuuccucuauacaucucuc

SEQ ID NO: 2856447 - RNA, 16 nt, Human
auaaaccucaaaaugu

SEQ ID NO: 2856448 - RNA, 14 nt, Human
auaaaccuccgcca

SEQ ID NO: 2856449 - RNA, 17 nt, Human
auaaaccuccgccaaug

SEQ ID NO: 2856450 - RNA, 14 nt, Human
auaaacagacaaua

SEQ ID NO: 2856451 - RNA, 19 nt, Human
auaaacagacaauauguga

SEQ ID NO: 2856452 - RNA, 20 nt, Human
auaaacagacuguuaauuau

SEQ ID NO: 2856453 - RNA, 15 nt, Human
auaaacagaugaaua

SEQ ID NO: 2856454 - RNA, 17 nt, Human
auaaacagaugaauaaa

SEQ ID NO: 2856455 - RNA, 16 nt, Human
auaaacaucacacaca

SEQ ID NO: 2856456 - RNA, 11 nt, Human
aguuuuccuga

SEQ ID NO: 2856457 - RNA, 15 nt, Human
auaaacauuaaaugu

SEQ ID NO: 2856458 - RNA, 16 nt, Human
auaaacauuaaauguc

SEQ ID NO: 2856459 - RNA, 17 nt, Human
auaaacauuaaaugucu

SEQ ID NO: 2856460 - RNA, 21 nt, Human
auaaacauuaaaugucuuaua

SEQ ID NO: 2856461 - RNA, 21 nt, Human
auaaacauccuucaagaacuc

SEQ ID NO: 2856462 - RNA, 17 nt, Human
auaaacaucacacacac

SEQ ID NO: 2856463 - RNA, 13 nt, Human
auaaaccaaagga

SEQ ID NO: 2856464 - RNA, 15 nt, Human
auaaaccaaaggaca

SEQ ID NO: 2856465 - RNA, 16 nt, Human
auaaaccaaaggacau

SEQ ID NO: 2856466 - RNA, 20 nt, Human
auaaaccaaaggacauuaug

SEQ ID NO: 2856467 - RNA, 21 nt, Human
auaaaccaaaggacauuaugu

SEQ ID NO: 2856468 - RNA, 22 nt, Human
auaaacuaaugguccacaccca

SEQ ID NO: 2856469 - RNA, 16 nt, Human
auaaacuacucuuuga

SEQ ID NO: 2856470 - RNA, 17 nt, Human
auaaacuacucuuugau

SEQ ID NO: 2856471 - RNA, 19 nt, Human
auaaacuacucuuugauuu

SEQ ID NO: 2856472 - RNA, 15 nt, Human
auaaacgcaagcuga

SEQ ID NO: 2856473 - RNA, 14 nt, Human
auaaacuaucaguu

SEQ ID NO: 2856474 - RNA, 15 nt, Human
auaaacucuaaacau

SEQ ID NO: 2856475 - RNA, 12 nt, Human
auaaacugaaaa

SEQ ID NO: 2856476 - RNA, 22 nt, Human
auaaacugacuaucauaaaauc

SEQ ID NO: 2856477 - RNA, 11 nt, Human
auaaacuucag

SEQ ID NO: 2856478 - RNA, 12 nt, Human
auaaacuucagc

SEQ ID NO: 2856479 - RNA, 13 nt, Human
auaaacuucagca

SEQ ID NO: 2856480 - RNA, 15 nt, Human
auaaacuucagcacc

SEQ ID NO: 2856481 - RNA, 16 nt, Human
auaaacuucagcacca

SEQ ID NO: 2856482 - RNA, 16 nt, Human
auaaacuguguuuacu

SEQ ID NO: 2856483 - RNA, 21 nt, Human
auaaacuguuucagauuuuuu

SEQ ID NO: 2856484 - RNA, 16 nt, Human
auaaacuuaacuuuaa

SEQ ID NO: 2856485 - RNA, 11 nt, Human
auaaaguauag

SEQ ID NO: 2856486 - RNA, 20 nt, Human
auaaaguauagagagaaguu

SEQ ID NO: 2856487 - RNA, 12 nt, Human
auaaauaaaagc

SEQ ID NO: 2856488 - RNA, 14 nt, Human
auaaauaaaagccu

SEQ ID NO: 2856489 - RNA, 15 nt, Human
auaaauaaaagccuc

SEQ ID NO: 2856490 - RNA, 15 nt, Human
uuauaguuuguacau

SEQ ID NO: 2856491 - RNA, 16 nt, Human
uuauaguuuguacaug

SEQ ID NO: 2856492 - RNA, 12 nt, Human
uuauaguuugua

SEQ ID NO: 2856493 - RNA, 13 nt, Human
uuauaguuucuga

SEQ ID NO: 2856494 - RNA, 15 nt, Human
uuauaguuucugagg

SEQ ID NO: 2856495 - RNA, 16 nt, Human
uuauaguuugggcuuc

SEQ ID NO: 2856496 - RNA, 12 nt, Human
uuauaguuucug

SEQ ID NO: 2856497 - RNA, 14 nt, Human
uuauaguuucaagc

SEQ ID NO: 2856498 - RNA, 13 nt, Human
uuauauaaaugua

SEQ ID NO: 2856499 - RNA, 18 nt, Human
uuauauaaauguaaaaau

SEQ ID NO: 2856500 - RNA, 23 nt, Human
uuauauaaauguaaaaauaauaa

SEQ ID NO: 2856501 - RNA, 18 nt, Human
uuauauaauaucuaaagu

SEQ ID NO: 2856502 - RNA, 20 nt, Human
uuauauaauaucuaaaguua

SEQ ID NO: 2856503 - RNA, 21 nt, Human
uuauauaauaucuaaaguuau

SEQ ID NO: 2856504 - RNA, 22 nt, Human
uuauauaauucacucaagcacu

SEQ ID NO: 2856505 - RNA, 12 nt, Human
uuauauaauugu

SEQ ID NO: 2856506 - RNA, 16 nt, Human
uuauauaauuguugaa

SEQ ID NO: 2856507 - RNA, 14 nt, Human
uuauauacaauaau

SEQ ID NO: 2856508 - RNA, 17 nt, Human
uuauauacaauaaugga

SEQ ID NO: 2856509 - RNA, 19 nt, Human
uuauauacaauaauggaaa

SEQ ID NO: 2856510 - RNA, 20 nt, Human
uuauauacaauaauggaaaa

SEQ ID NO: 2856511 - RNA, 22 nt, Human
uuauauacaauaauggaaaaaa

SEQ ID NO: 2856512 - RNA, 14 nt, Human
uuauauacagagga

SEQ ID NO: 2856513 - RNA, 21 nt, Human
uuauauacagaggaaaucugu

SEQ ID NO: 2856514 - RNA, 23 nt, Human
uuauauacagaggaaaucuguaa

SEQ ID NO: 2856515 - RNA, 21 nt, Human
auaauuuuaagaaaucaaaga

SEQ ID NO: 2856516 - RNA, 15 nt, Human
auaauuuuaagaaau

SEQ ID NO: 2856517 - RNA, 14 nt, Human
auaauuuuaagaaa

SEQ ID NO: 2856518 - RNA, 21 nt, Human
auaauuuuagugucauuucca

SEQ ID NO: 2856519 - RNA, 13 nt, Human
auaauuuugcugg

SEQ ID NO: 2856520 - RNA, 22 nt, Human
auaauuuugcuggaauuccuaa

SEQ ID NO: 2856521 - RNA, 14 nt, Human
auaauuuucugaaa

SEQ ID NO: 2856522 - RNA, 15 nt, Human
auaauuuucugaaag

SEQ ID NO: 2856523 - RNA, 15 nt, Human
uuauauaugaaaacu

SEQ ID NO: 2856524 - RNA, 16 nt, Human
uuauauaugaaaacua

SEQ ID NO: 2856525 - RNA, 18 nt, Human
uuauauaugaaaacuaua

SEQ ID NO: 2856526 - RNA, 14 nt, Human
uuauauauggacau

SEQ ID NO: 2856527 - RNA, 17 nt, Human
uuauauauggacauggc

SEQ ID NO: 2856528 - RNA, 18 nt, Human
uuauauagguugugcaaa

SEQ ID NO: 2856529 - RNA, 15 nt, Human
uuauauauacaguaa

SEQ ID NO: 2856530 - RNA, 12 nt, Human
uuauauauauaa

SEQ ID NO: 2856531 - RNA, 17 nt, Human
auaauuuuuuauucaag

SEQ ID NO: 2856532 - RNA, 13 nt, Human
auaauuuuuugua

SEQ ID NO: 2856533 - RNA, 22 nt, Human
auaauuuuuuguaaugugugaa

SEQ ID NO: 2856534 - RNA, 15 nt, Human
auaauuuuuuauuca

SEQ ID NO: 2856535 - RNA, 16 nt, Human
auaauuuuuuauucaa

SEQ ID NO: 2856536 - RNA, 17 nt, Human
auaauuuuuauauuuaa

SEQ ID NO: 2856537 - RNA, 19 nt, Human
auaauuuuuauauuuaauu

SEQ ID NO: 2856538 - RNA, 23 nt, Human
auaauuuuuauauuuaauuauua

SEQ ID NO: 2856539 - RNA, 17 nt, Human
uuagccgcccaugcacu

SEQ ID NO: 2856540 - RNA, 13 nt, Human
uuagccgggcgug

SEQ ID NO: 2856541 - RNA, 19 nt, Human
uuagcaggccaaggucuga

SEQ ID NO: 2856542 - RNA, 23 nt, Human
uuagcaggccaaggucugagcca

SEQ ID NO: 2856543 - RNA, 14 nt, Human
uuagccccauaauu

SEQ ID NO: 2856544 - RNA, 15 nt, Human
uuauaaaugagcaaa

SEQ ID NO: 2856545 - RNA, 12 nt, Human
uuauaaaucaua

SEQ ID NO: 2856546 - RNA, 17 nt, Human
uuauaaaucauauugau

SEQ ID NO: 2856547 - RNA, 19 nt, Human
uuauaaaucauauugauga

SEQ ID NO: 2856548 - RNA, 21 nt, Human
uuauaaaucauauugaugaaa

SEQ ID NO: 2856549 - RNA, 23 nt, Human
uuauaaaucauauugaugaaaag

SEQ ID NO: 2856550 - RNA, 15 nt, Human
uuagccucccugaaa

SEQ ID NO: 2856551 - RNA, 16 nt, Human
uuauaacucaucauaa

SEQ ID NO: 2856552 - RNA, 18 nt, Human
uuauaacucaucauaaaa

SEQ ID NO: 2856553 - RNA, 17 nt, Human
uuauaacucaucauaaa

SEQ ID NO: 2856554 - RNA, 16 nt, Human
uuauaacuauucaguu

SEQ ID NO: 2856555 - RNA, 22 nt, Human
uuauaacucaucauaaaauaaa

SEQ ID NO: 2856556 - RNA, 21 nt, Human
uuauaacucaucauaaaauaa

SEQ ID NO: 2856557 - RNA, 20 nt, Human
uuauaacucaucauaaaaua

SEQ ID NO: 2856558 - RNA, 19 nt, Human
uuauaacucaucauaaaau

SEQ ID NO: 2856559 - RNA, 18 nt, Human
uuauacccccugcaaagc

SEQ ID NO: 2856560 - RNA, 14 nt, Human
uuauacauuaguaa

SEQ ID NO: 2856561 - RNA, 16 nt, Human
uuauacauuaguaaau

SEQ ID NO: 2856562 - RNA, 21 nt, Human
uuauacauuaguaaaugucuu

SEQ ID NO: 2856563 - RNA, 23 nt, Human
uuauacauuaguaaaugucuuug

SEQ ID NO: 2856564 - RNA, 23 nt, Human
uuauagaguguacuuaacuauuc

SEQ ID NO: 2856565 - RNA, 19 nt, Human
uuauagagggccaagacuu

SEQ ID NO: 2856566 - RNA, 15 nt, Human
uuauagacaaauaau

SEQ ID NO: 2856567 - RNA, 17 nt, Human
uuauagacacccuggca

SEQ ID NO: 2856568 - RNA, 14 nt, Human
uuauagagaaugau

SEQ ID NO: 2856569 - RNA, 21 nt, Human
uuauagagaaugaugauaaca

SEQ ID NO: 2856570 - RNA, 14 nt, Human
uuauagaaaguuca

SEQ ID NO: 2856571 - RNA, 18 nt, Human
uuauacuccaguguacau

SEQ ID NO: 2856572 - RNA, 19 nt, Human
uuauacucuuccuauuuuu

SEQ ID NO: 2856573 - RNA, 16 nt, Human
uuauacucuuucugua

SEQ ID NO: 2856574 - RNA, 13 nt, Human
uuauacugauuau

SEQ ID NO: 2856575 - RNA, 13 nt, Human
uuauacuguacaa

SEQ ID NO: 2856576 - RNA, 14 nt, Human
uuauacuguacaau

SEQ ID NO: 2856577 - RNA, 15 nt, Human
uuauacuguacaaua

SEQ ID NO: 2856578 - RNA, 17 nt, Human
uuauacuguacaauaaa

SEQ ID NO: 2856579 - RNA, 18 nt, Human
uuauacuguacaauaaaa

SEQ ID NO: 2856580 - RNA, 11 nt, Human
uuauacuaacu

SEQ ID NO: 2856581 - RNA, 18 nt, Human
uuauacuaacuuauuuau

SEQ ID NO: 2856582 - RNA, 14 nt, Human
uuauacgcuuuucu

SEQ ID NO: 2856583 - RNA, 16 nt, Human
uuauaccugcuaucag

SEQ ID NO: 2856584 - RNA, 18 nt, Human
uuauaccccaauaaucaa

SEQ ID NO: 2856585 - RNA, 16 nt, Human
uuauaccauucagauc

SEQ ID NO: 2856586 - RNA, 15 nt, Human
uuauaccuaccugug

SEQ ID NO: 2856587 - RNA, 16 nt, Human
uuauaccuaccugugu

SEQ ID NO: 2856588 - RNA, 19 nt, Human
uuauaccucaaacuaucug

SEQ ID NO: 2856589 - RNA, 22 nt, Human
uuauagucauuuauuuuaaaaa

SEQ ID NO: 2856590 - RNA, 13 nt, Human
uuauaguggaaaa

SEQ ID NO: 2856591 - RNA, 16 nt, Human
uuauaguggaaaaaca

SEQ ID NO: 2856592 - RNA, 17 nt, Human
uuauaguggaaaaacac

SEQ ID NO: 2856593 - RNA, 22 nt, Human
uuauagguaaucaaugaauauu

SEQ ID NO: 2856594 - RNA, 19 nt, Human
uuauagguggccucuccuu

SEQ ID NO: 2856595 - RNA, 22 nt, Human
uuauagguguugguuuuggggg

SEQ ID NO: 2856596 - RNA, 14 nt, Human
uuauaggugagaaa

SEQ ID NO: 2856597 - RNA, 18 nt, Human
uuauaggugagaaaaaaa

SEQ ID NO: 2856598 - RNA, 17 nt, Human
uuauaguacaugauaaa

SEQ ID NO: 2856599 - RNA, 16 nt, Human
uuauaguacaugauaa

SEQ ID NO: 2856600 - RNA, 13 nt, Human
uuauaguacauga

SEQ ID NO: 2856601 - RNA, 17 nt, Human
uuauagcuauuacuguc

SEQ ID NO: 2856602 - RNA, 16 nt, Human
uuauaggaucauuugu

SEQ ID NO: 2856603 - RNA, 14 nt, Human
uuauagcacuuuga

SEQ ID NO: 2856604 - RNA, 22 nt, Human
uuauagcacuuugaaauaccuc

SEQ ID NO: 2856605 - RNA, 23 nt, Human
uuauagcacuuugaaauaccuca

SEQ ID NO: 2856606 - RNA, 21 nt, Human
uuauagauucuaaagauucua

SEQ ID NO: 2856607 - RNA, 19 nt, Human
uuauagauucuaaagauuc

SEQ ID NO: 2856608 - RNA, 20 nt, Human
uuauagauucuaaagauucu

SEQ ID NO: 2856609 - RNA, 15 nt, Human
uuauagaugucuagg

SEQ ID NO: 2856610 - RNA, 12 nt, Human
uuauagauucua

SEQ ID NO: 2856611 - RNA, 13 nt, Human
uuauagauucuaa

SEQ ID NO: 2856612 - RNA, 14 nt, Human
uuauagauucuaaa

SEQ ID NO: 2856613 - RNA, 15 nt, Human
uuauagauucuaaag

SEQ ID NO: 2856614 - RNA, 16 nt, Human
uuauagauucuaaaga

SEQ ID NO: 2856615 - RNA, 12 nt, Human
auacaucacugc

SEQ ID NO: 2856616 - RNA, 13 nt, Human
auacaucacugcu

SEQ ID NO: 2856617 - RNA, 15 nt, Human
auacaucacugcuug

SEQ ID NO: 2856618 - RNA, 18 nt, Human
auacaucacugcuugaug

SEQ ID NO: 2856619 - RNA, 19 nt, Human
auacaucacugcuugauga

SEQ ID NO: 2856620 - RNA, 22 nt, Human
auacaucacugcuugaugaagc

SEQ ID NO: 2856621 - RNA, 14 nt, Human
auacaucaguuauu

SEQ ID NO: 2856622 - RNA, 14 nt, Human
auacauccugggua

SEQ ID NO: 2856623 - RNA, 15 nt, Human
auacauccuggguaa

SEQ ID NO: 2856624 - RNA, 16 nt, Human
auacauccuggguaau

SEQ ID NO: 2856625 - RNA, 18 nt, Human
auacauccuggguaauga

SEQ ID NO: 2856626 - RNA, 15 nt, Human
auacaucucucccca

SEQ ID NO: 2856627 - RNA, 16 nt, Human
auacaucucuccccaa

SEQ ID NO: 2856628 - RNA, 17 nt, Human
auacaugaaaauuuuaa

SEQ ID NO: 2856629 - RNA, 18 nt, Human
auacauuaguaaaugucu

SEQ ID NO: 2856630 - RNA, 19 nt, Human
auacauuaguaaaugucuu

SEQ ID NO: 2856631 - RNA, 21 nt, Human
auacauuaguaaaugucuuug

SEQ ID NO: 2856632 - RNA, 22 nt, Human
auacauuaguaaaugucuuugu

SEQ ID NO: 2856633 - RNA, 23 nt, Human
auacauuaguaaaugucuuugua

SEQ ID NO: 2856634 - RNA, 18 nt, Human
auacauauguagacuaua

SEQ ID NO: 2856635 - RNA, 21 nt, Human
auacauauguagacuauauac

SEQ ID NO: 2856636 - RNA, 22 nt, Human
auacauauguagacuauauaca

SEQ ID NO: 2856637 - RNA, 23 nt, Human
auacauauguagacuauauacau

SEQ ID NO: 2856638 - RNA, 21 nt, Human
auacaguuuauuuuuaaagau

SEQ ID NO: 2856639 - RNA, 22 nt, Human
auacaguuugucacaugaaaca

SEQ ID NO: 2856640 - RNA, 12 nt, Human
auacaguuuuau

SEQ ID NO: 2856641 - RNA, 13 nt, Human
auacaguuuuaug

SEQ ID NO: 2856642 - RNA, 14 nt, Human
auacaguuuuaugc

SEQ ID NO: 2856643 - RNA, 15 nt, Human
auacaguuuuaugcu

SEQ ID NO: 2856644 - RNA, 18 nt, Human
auacaguuuuaugcucuu

SEQ ID NO: 2856645 - RNA, 19 nt, Human
auacaguuuuaugcucuuu

SEQ ID NO: 2856646 - RNA, 20 nt, Human
auacaguuuuaugcucuuuu

SEQ ID NO: 2856647 - RNA, 21 nt, Human
auacaguuuuaugcucuuuuu

SEQ ID NO: 2856648 - RNA, 18 nt, Human
auacaguauaaaaauaga

SEQ ID NO: 2856649 - RNA, 19 nt, Human
auacaguaacuuuaugugu

SEQ ID NO: 2856650 - RNA, 20 nt, Human
auacaguaacuuuaugugua

SEQ ID NO: 2856651 - RNA, 17 nt, Human
auacagucccuaaagaa

SEQ ID NO: 2856652 - RNA, 15 nt, Human
auacagucaacaagc

SEQ ID NO: 2856653 - RNA, 18 nt, Human
auacagucccuaaagaaa

SEQ ID NO: 2856654 - RNA, 20 nt, Human
auacagucccuaaagaaaaa

SEQ ID NO: 2856655 - RNA, 22 nt, Human
auacagucccuaaagaaaaaaa

SEQ ID NO: 2856656 - RNA, 19 nt, Human
auacauuugaggggaaaac

SEQ ID NO: 2856657 - RNA, 14 nt, Human
auaccaaguauuua

SEQ ID NO: 2856658 - RNA, 14 nt, Human
auacauuuaaaacu

SEQ ID NO: 2856659 - RNA, 15 nt, Human
auacauuuaaaacuu

SEQ ID NO: 2856660 - RNA, 12 nt, Human
auacagcuuucu

SEQ ID NO: 2856661 - RNA, 13 nt, Human
auacagcuuucug

SEQ ID NO: 2856662 - RNA, 19 nt, Human
auacagcuuucugaccuuc

SEQ ID NO: 2856663 - RNA, 17 nt, Human
auacaguaacuuuaugu

SEQ ID NO: 2856664 - RNA, 18 nt, Human
auacaguaacuuuaugug

SEQ ID NO: 2856665 - RNA, 20 nt, Human
auacaggaaaagcugcugac

SEQ ID NO: 2856666 - RNA, 19 nt, Human
auacaggaaaagcugcuga

SEQ ID NO: 2856667 - RNA, 14 nt, Human
auacaggaaaagcu

SEQ ID NO: 2856668 - RNA, 16 nt, Human
auacaaauuaaaaaga

SEQ ID NO: 2856669 - RNA, 17 nt, Human
auacaaauuaaaaagau

SEQ ID NO: 2856670 - RNA, 18 nt, Human
auacaaauuaauuuuacu

SEQ ID NO: 2856671 - RNA, 12 nt, Human
auacaacaaagg

SEQ ID NO: 2856672 - RNA, 19 nt, Human
auacaacaaaggcaaguua

SEQ ID NO: 2856673 - RNA, 22 nt, Human
auacaacaaaggcaaguuaaga

SEQ ID NO: 2856674 - RNA, 23 nt, Human
auacaacaaaggcaaguuaagag

SEQ ID NO: 2856675 - RNA, 23 nt, Human
auacaaaaaucagccagacaugg

SEQ ID NO: 2856676 - RNA, 15 nt, Human
auacaaaaauuugcc

SEQ ID NO: 2856677 - RNA, 13 nt, Human
auacaaaaggcuc

SEQ ID NO: 2856678 - RNA, 16 nt, Human
auacaaacaaucucuu

SEQ ID NO: 2856679 - RNA, 17 nt, Human
auacaaauauaaaucuu

SEQ ID NO: 2856680 - RNA, 14 nt, Human
auacaaauauauug

SEQ ID NO: 2856681 - RNA, 16 nt, Human
auacaaauauauuguu

SEQ ID NO: 2856682 - RNA, 18 nt, Human
auacaaaccuaccaaaau

SEQ ID NO: 2856683 - RNA, 18 nt, Human
auacaaagcgugcacaag

SEQ ID NO: 2856684 - RNA, 20 nt, Human
auacagcccucccccagcag

SEQ ID NO: 2856685 - RNA, 13 nt, Human
auacagcagcaag

SEQ ID NO: 2856686 - RNA, 14 nt, Human
auacagcagcaaga

SEQ ID NO: 2856687 - RNA, 15 nt, Human
auacagcagcaagaa

SEQ ID NO: 2856688 - RNA, 16 nt, Human
auacagcagcaagaaa

SEQ ID NO: 2856689 - RNA, 17 nt, Human
auacagcagcaagaaaa

SEQ ID NO: 2856690 - RNA, 19 nt, Human
auacagcagcaagaaaaaa

SEQ ID NO: 2856691 - RNA, 20 nt, Human
auacagcagcaagaaaaaaa

SEQ ID NO: 2856692 - RNA, 15 nt, Human
auacagcaguagaca

SEQ ID NO: 2856693 - RNA, 17 nt, Human
auacagcaguagacauu

SEQ ID NO: 2856694 - RNA, 14 nt, Human
auacagaugaaaau

SEQ ID NO: 2856695 - RNA, 15 nt, Human
auacagaugaaaauu

SEQ ID NO: 2856696 - RNA, 16 nt, Human
auacagaugaaaauuu

SEQ ID NO: 2856697 - RNA, 20 nt, Human
auacagaugaaaauuugaga

SEQ ID NO: 2856698 - RNA, 22 nt, Human
auacagaugaaaauuugagacu

SEQ ID NO: 2856699 - RNA, 17 nt, Human
auaccaaguauuuauua

SEQ ID NO: 2856700 - RNA, 20 nt, Human
auaccaaugcuuuuaucaaa

SEQ ID NO: 2856701 - RNA, 15 nt, Human
auacuaacuuauuua

SEQ ID NO: 2856702 - RNA, 17 nt, Human
auaccauuaaaacugcu

SEQ ID NO: 2856703 - RNA, 18 nt, Human
auaccauuaaaacugcuu

SEQ ID NO: 2856704 - RNA, 17 nt, Human
auaccauacucauuucu

SEQ ID NO: 2856705 - RNA, 19 nt, Human
auaccauacucauuucuaa

SEQ ID NO: 2856706 - RNA, 21 nt, Human
auaccauacucauuucuaaaa

SEQ ID NO: 2856707 - RNA, 18 nt, Human
auaccagcuuagauuuua

SEQ ID NO: 2856708 - RNA, 19 nt, Human
auaccagcuuguaugcaau

SEQ ID NO: 2856709 - RNA, 16 nt, Human
auaccaggauuuuuuu

SEQ ID NO: 2856710 - RNA, 20 nt, Human
auacuauuuaguuuuuguaa

SEQ ID NO: 2856711 - RNA, 21 nt, Human
auacuauuuaaagccuccuca

SEQ ID NO: 2856712 - RNA, 22 nt, Human
auacuauuuaaagccuccucau

SEQ ID NO: 2856713 - RNA, 23 nt, Human
auacuauuuaguuuuuguaauuu

SEQ ID NO: 2856714 - RNA, 14 nt, Human
auacuacugaaaca

SEQ ID NO: 2856715 - RNA, 18 nt, Human
auacuacugaaacagauu

SEQ ID NO: 2856716 - RNA, 19 nt, Human
auacuacugaaacagauuu

SEQ ID NO: 2856717 - RNA, 21 nt, Human
auacuacugaaacagauuuca

SEQ ID NO: 2856718 - RNA, 17 nt, Human
auacuaccuugaaaaua

SEQ ID NO: 2856719 - RNA, 15 nt, Human
auacuaccuugaaaa

SEQ ID NO: 2856720 - RNA, 14 nt, Human
auacuaccuugaaa

SEQ ID NO: 2856721 - RNA, 12 nt, Human
auacuacaucuu

SEQ ID NO: 2856722 - RNA, 14 nt, Human
auacuacaucuuua

SEQ ID NO: 2856723 - RNA, 15 nt, Human
auacuacaucuuuaa

SEQ ID NO: 2856724 - RNA, 16 nt, Human
auacuacaucuuuaaa

SEQ ID NO: 2856725 - RNA, 13 nt, Human
uuaucaaaucagu

SEQ ID NO: 2856726 - RNA, 13 nt, Human
uuaucaaagcaua

SEQ ID NO: 2856727 - RNA, 15 nt, Human
uuaucaaagcauaga

SEQ ID NO: 2856728 - RNA, 12 nt, Human
auacucagccug

SEQ ID NO: 2856729 - RNA, 13 nt, Human
auacucagccugc

SEQ ID NO: 2856730 - RNA, 15 nt, Human
auacucagccugcug

SEQ ID NO: 2856731 - RNA, 16 nt, Human
auacucagccugcugc

SEQ ID NO: 2856732 - RNA, 17 nt, Human
auacucagccugcugcc

SEQ ID NO: 2856733 - RNA, 20 nt, Human
auacucagccugcugcccag

SEQ ID NO: 2856734 - RNA, 20 nt, Human
uuaucaaaucagucagugca

SEQ ID NO: 2856735 - RNA, 17 nt, Human
uuaucaaggacucuggu

SEQ ID NO: 2856736 - RNA, 18 nt, Human
uuaucaccuggcuuguuu

SEQ ID NO: 2856737 - RNA, 19 nt, Human
uuaucaccuggcuuguuua

SEQ ID NO: 2856738 - RNA, 16 nt, Human
uuaucacuuuuugaac

SEQ ID NO: 2856739 - RNA, 17 nt, Human
uuaucacuuuuugaacu

SEQ ID NO: 2856740 - RNA, 20 nt, Human
uuaucacuuuuugaacuaag

SEQ ID NO: 2856741 - RNA, 21 nt, Human
uuaucacuuuuugaacuaaga

SEQ ID NO: 2856742 - RNA, 22 nt, Human
uuaucacuuuuugaacuaagaa

SEQ ID NO: 2856743 - RNA, 20 nt, Human
uuaucaguaagaaaaagaag

SEQ ID NO: 2856744 - RNA, 14 nt, Human
uuaucagcaaaaaa

SEQ ID NO: 2856745 - RNA, 16 nt, Human
uuaucaacucaagaau

SEQ ID NO: 2856746 - RNA, 22 nt, Human
uuaucagcuacuuaagagaaau

SEQ ID NO: 2856747 - RNA, 14 nt, Human
uuaucagauacauc

SEQ ID NO: 2856748 - RNA, 17 nt, Human
uuaucagauacaucacu

SEQ ID NO: 2856749 - RNA, 20 nt, Human
uuaucagauacaucacugcu

SEQ ID NO: 2856750 - RNA, 16 nt, Human
uuaucauccacauugu

SEQ ID NO: 2856751 - RNA, 13 nt, Human
uuaucaguuucca

SEQ ID NO: 2856752 - RNA, 21 nt, Human
uuaucaguuuccagucucaaa

SEQ ID NO: 2856753 - RNA, 21 nt, Human
uuaucaguaagaaaaagaaga

SEQ ID NO: 2856754 - RNA, 15 nt, Human
uuaucagucaauauu

SEQ ID NO: 2856755 - RNA, 14 nt, Human
uuaucagucaauau

SEQ ID NO: 2856756 - RNA, 23 nt, Human
uuaucagucaauauuuuuagaua

SEQ ID NO: 2856757 - RNA, 18 nt, Human
uuaucauccacauuguuu

SEQ ID NO: 2856758 - RNA, 19 nt, Human
uuaucaugacauguuauau

SEQ ID NO: 2856759 - RNA, 20 nt, Human
uuaucauccacauuguuuua

SEQ ID NO: 2856760 - RNA, 12 nt, Human
uuaucaugaagc

SEQ ID NO: 2856761 - RNA, 13 nt, Human
uuaucaugaagcc

SEQ ID NO: 2856762 - RNA, 14 nt, Human
uuaucaugaagccu

SEQ ID NO: 2856763 - RNA, 16 nt, Human
uuaucaugaagccugu

SEQ ID NO: 2856764 - RNA, 22 nt, Human
uuaucaugaagccuguggauga

SEQ ID NO: 2856765 - RNA, 17 nt, Human
aguucgagaccagccug

SEQ ID NO: 2856766 - RNA, 14 nt, Human
aguucgagaccagc

SEQ ID NO: 2856767 - RNA, 19 nt, Human
aguuccuuuccuuuucuuu

SEQ ID NO: 2856768 - RNA, 16 nt, Human
aguuccuuugugugua

SEQ ID NO: 2856769 - RNA, 18 nt, Human
aguuccuuuguguguacu

SEQ ID NO: 2856770 - RNA, 20 nt, Human
aguuccuugaucuguauaua

SEQ ID NO: 2856771 - RNA, 20 nt, Human
aguuccuucagcuuccauuu

SEQ ID NO: 2856772 - RNA, 13 nt, Human
aguucccuuggcc

SEQ ID NO: 2856773 - RNA, 15 nt, Human
aguucccugaaacac

SEQ ID NO: 2856774 - RNA, 17 nt, Human
aguucccugaaacacga

SEQ ID NO: 2856775 - RNA, 20 nt, Human
aguucccugucucuugaaaa

SEQ ID NO: 2856776 - RNA, 21 nt, Human
aguucccugucucuugaaaaa

SEQ ID NO: 2856777 - RNA, 15 nt, Human
aguucccuacuuccu

SEQ ID NO: 2856778 - RNA, 14 nt, Human
aguucccucugcuc

SEQ ID NO: 2856779 - RNA, 17 nt, Human
aguucccucugcucagc

SEQ ID NO: 2856780 - RNA, 18 nt, Human
aguucccucugcucagcc

SEQ ID NO: 2856781 - RNA, 19 nt, Human
aguucccucugcucagcca

SEQ ID NO: 2856782 - RNA, 20 nt, Human
aguucccucugcucagccaa

SEQ ID NO: 2856783 - RNA, 22 nt, Human
aguucccucugcucagccaagc

SEQ ID NO: 2856784 - RNA, 17 nt, Human
aguucccuacuuccugu

SEQ ID NO: 2856785 - RNA, 18 nt, Human
aguucccuuggccucaga

SEQ ID NO: 2856786 - RNA, 17 nt, Human
aguucccuuggccucag

SEQ ID NO: 2856787 - RNA, 16 nt, Human
aguucccuuggccuca

SEQ ID NO: 2856788 - RNA, 15 nt, Human
aguucccuuggccuc

SEQ ID NO: 2856789 - RNA, 16 nt, Human
aguuccuguaugaaag

SEQ ID NO: 2856790 - RNA, 13 nt, Human
aguuccuaagaag

SEQ ID NO: 2856791 - RNA, 15 nt, Human
aguuccuaagaagcu

SEQ ID NO: 2856792 - RNA, 16 nt, Human
aguuccuaagaagcuu

SEQ ID NO: 2856793 - RNA, 20 nt, Human
aguuccuaagaagcuucuaa

SEQ ID NO: 2856794 - RNA, 22 nt, Human
aguuccuaagaagcuucuaaua

SEQ ID NO: 2856795 - RNA, 13 nt, Human
aguucaaacaaga

SEQ ID NO: 2856796 - RNA, 18 nt, Human
aguucaaacauaaggaaa

SEQ ID NO: 2856797 - RNA, 23 nt, Human
aguuauuuugcacccacugaaag

SEQ ID NO: 2856798 - RNA, 21 nt, Human
aguuauuuauuuauuggagau

SEQ ID NO: 2856799 - RNA, 18 nt, Human
aguuauuguacagcuguu

SEQ ID NO: 2856800 - RNA, 19 nt, Human
aguuauuguacagcuguuu

SEQ ID NO: 2856801 - RNA, 21 nt, Human
aguuauuguacagcuguuuaa

SEQ ID NO: 2856802 - RNA, 22 nt, Human
aguuauuguacagcuguuuaag

SEQ ID NO: 2856803 - RNA, 23 nt, Human
uguuguacauuuaugauuuaaua

SEQ ID NO: 2856804 - RNA, 13 nt, Human
uguuguacauuua

SEQ ID NO: 2856805 - RNA, 14 nt, Human
uguuguacauuuau

SEQ ID NO: 2856806 - RNA, 15 nt, Human
uguuguacauuuaug

SEQ ID NO: 2856807 - RNA, 16 nt, Human
uguuguacauuuauga

SEQ ID NO: 2856808 - RNA, 17 nt, Human
uguuguacauuuaugau

SEQ ID NO: 2856809 - RNA, 18 nt, Human
uguuguacauuuaugauu

SEQ ID NO: 2856810 - RNA, 20 nt, Human
uguuguacauuuaugauuua

SEQ ID NO: 2856811 - RNA, 22 nt, Human
uguuguacauuuaugauuuaau

SEQ ID NO: 2856812 - RNA, 13 nt, Human
uguuguaaugcug

SEQ ID NO: 2856813 - RNA, 15 nt, Human
uguuguaaugcugca

SEQ ID NO: 2856814 - RNA, 16 nt, Human
uguuguaaugcugcac

SEQ ID NO: 2856815 - RNA, 22 nt, Human
uguuguaaugcugcacuuccug

SEQ ID NO: 2856816 - RNA, 13 nt, Human
uguuguaauucuu

SEQ ID NO: 2856817 - RNA, 15 nt, Human
uguuguaauucuuca

SEQ ID NO: 2856818 - RNA, 18 nt, Human
uguuguaauucuucaguu

SEQ ID NO: 2856819 - RNA, 19 nt, Human
uguuguaauucuucaguug

SEQ ID NO: 2856820 - RNA, 13 nt, Human
uguuguaaauuag

SEQ ID NO: 2856821 - RNA, 15 nt, Human
uguuguaaauuagga

SEQ ID NO: 2856822 - RNA, 12 nt, Human
uguuguaacuua

SEQ ID NO: 2856823 - RNA, 13 nt, Human
uguuguaacuuau

SEQ ID NO: 2856824 - RNA, 19 nt, Human
uguuguaacuuauguagau

SEQ ID NO: 2856825 - RNA, 24 nt, Human
uguuguaacuuauguagauauuug

SEQ ID NO: 2856826 - RNA, 13 nt, Human
uguuguaaagcaa

SEQ ID NO: 2856827 - RNA, 13 nt, Human
uguuguauuaaca

SEQ ID NO: 2856828 - RNA, 14 nt, Human
uguuguauuaacaa

SEQ ID NO: 2856829 - RNA, 15 nt, Human
uguuguauuaacaaa

SEQ ID NO: 2856830 - RNA, 16 nt, Human
uguuguauuaacaaaa

SEQ ID NO: 2856831 - RNA, 18 nt, Human
uguugggauacugcaggg

SEQ ID NO: 2856832 - RNA, 18 nt, Human
uguugggaucgcauugca

SEQ ID NO: 2856833 - RNA, 14 nt, Human
uguuguaaaaagaa

SEQ ID NO: 2856834 - RNA, 15 nt, Human
uguuguaaaaagaaa

SEQ ID NO: 2856835 - RNA, 17 nt, Human
uguuguaaaaagaaaaa

SEQ ID NO: 2856836 - RNA, 15 nt, Human
aguucuaaauuuugu

SEQ ID NO: 2856837 - RNA, 18 nt, Human
aguucuaagacucaaaug

SEQ ID NO: 2856838 - RNA, 21 nt, Human
aguucgagaccagccuggcca

SEQ ID NO: 2856839 - RNA, 19 nt, Human
aguucgagaccagccuggc

SEQ ID NO: 2856840 - RNA, 18 nt, Human
aguucgagaccagccugg

SEQ ID NO: 2856841 - RNA, 19 nt, Human
aguucuaauaauuucuaau

SEQ ID NO: 2856842 - RNA, 17 nt, Human
aguucuaauaauuucua

SEQ ID NO: 2856843 - RNA, 18 nt, Human
aguucuaauaauuucuaa

SEQ ID NO: 2856844 - RNA, 15 nt, Human
aguucuaagauucug

SEQ ID NO: 2856845 - RNA, 16 nt, Human
aguucuaagauucuga

SEQ ID NO: 2856846 - RNA, 17 nt, Human
aguucuaagauucugau

SEQ ID NO: 2856847 - RNA, 16 nt, Human
aguucuaauaauuucu

SEQ ID NO: 2856848 - RNA, 23 nt, Human
aguucuaagacucaaauguucua

SEQ ID NO: 2856849 - RNA, 13 nt, Human
aguucuaagauuc

SEQ ID NO: 2856850 - RNA, 14 nt, Human
aguucuaagauucu

SEQ ID NO: 2856851 - RNA, 15 nt, Human
aguucuaagauucua

SEQ ID NO: 2856852 - RNA, 16 nt, Human
aguucuaagauucuaa

SEQ ID NO: 2856853 - RNA, 17 nt, Human
aguucuaagauucuaau

SEQ ID NO: 2856854 - RNA, 18 nt, Human
aguucuaagauucuaaug

SEQ ID NO: 2856855 - RNA, 19 nt, Human
aguucuaagauucuaauga

SEQ ID NO: 2856856 - RNA, 12 nt, Human
aguuaugaauca

SEQ ID NO: 2856857 - RNA, 12 nt, Human
aguuaugaugua

SEQ ID NO: 2856858 - RNA, 14 nt, Human
aguuaugauguaau

SEQ ID NO: 2856859 - RNA, 18 nt, Human
aguuaucuguucuuuuga

SEQ ID NO: 2856860 - RNA, 21 nt, Human
aguuaucuguucuuuugacuu

SEQ ID NO: 2856861 - RNA, 21 nt, Human
aguuauaaguagcaggccaag

SEQ ID NO: 2856862 - RNA, 15 nt, Human
aguuauagaugucua

SEQ ID NO: 2856863 - RNA, 17 nt, Human
aguuauagaugucuagg

SEQ ID NO: 2856864 - RNA, 19 nt, Human
aguuauagaugucuaggua

SEQ ID NO: 2856865 - RNA, 14 nt, Human
aguuaucuaagaau

SEQ ID NO: 2856866 - RNA, 17 nt, Human
aguuaucuaagaauaca

SEQ ID NO: 2856867 - RNA, 21 nt, Human
aguuaucuaagaauacagcuu

SEQ ID NO: 2856868 - RNA, 18 nt, Human
aguuauggccuauacacu

SEQ ID NO: 2856869 - RNA, 21 nt, Human
aguuauggccuauacacuauu

SEQ ID NO: 2856870 - RNA, 12 nt, Human
aguuauuggugg

SEQ ID NO: 2856871 - RNA, 19 nt, Human
aguuauugguggaaucuuu

SEQ ID NO: 2856872 - RNA, 12 nt, Human
aguuauuguaca

SEQ ID NO: 2856873 - RNA, 13 nt, Human
aguuauuguacag

SEQ ID NO: 2856874 - RNA, 14 nt, Human
aguuauguuaaaau

SEQ ID NO: 2856875 - RNA, 19 nt, Human
aguuauucauauucuguug

SEQ ID NO: 2856876 - RNA, 22 nt, Human
aguuauucauucugugaucauu

SEQ ID NO: 2856877 - RNA, 18 nt, Human
aguuauuccuugaucauu

SEQ ID NO: 2856878 - RNA, 19 nt, Human
aguuauugagauuguccuc

SEQ ID NO: 2856879 - RNA, 17 nt, Human
aguuaggaaauaaaacc

SEQ ID NO: 2856880 - RNA, 15 nt, Human
aguuaggaaauaaaa

SEQ ID NO: 2856881 - RNA, 16 nt, Human
aguuaggauagcauuu

SEQ ID NO: 2856882 - RNA, 18 nt, Human
aguuaggauagcauuuuu

SEQ ID NO: 2856883 - RNA, 16 nt, Human
aguuaggaugcucagu

SEQ ID NO: 2856884 - RNA, 22 nt, Human
aguuaggaaauaaaaccuuuca

SEQ ID NO: 2856885 - RNA, 15 nt, Human
aguuaggaaugagaa

SEQ ID NO: 2856886 - RNA, 16 nt, Human
aguuaggaaugagaag

SEQ ID NO: 2856887 - RNA, 21 nt, Human
aguuaggaaauaaaaccuuuc

SEQ ID NO: 2856888 - RNA, 20 nt, Human
aguuaggaaauaaaaccuuu

SEQ ID NO: 2856889 - RNA, 18 nt, Human
aguuaggaaauaaaaccu

SEQ ID NO: 2856890 - RNA, 17 nt, Human
aguuaguuuuuagguca

SEQ ID NO: 2856891 - RNA, 17 nt, Human
aguuaguuucuuuggga

SEQ ID NO: 2856892 - RNA, 16 nt, Human
aguuaguuucuuuggg

SEQ ID NO: 2856893 - RNA, 14 nt, Human
aguguuucaugggu

SEQ ID NO: 2856894 - RNA, 22 nt, Human
aguguuuauuuuucauauugug

SEQ ID NO: 2856895 - RNA, 13 nt, Human
aguguuucagcua

SEQ ID NO: 2856896 - RNA, 18 nt, Human
aguguuucagcuaaggga

SEQ ID NO: 2856897 - RNA, 20 nt, Human
aguguuucagcuaagggaag

SEQ ID NO: 2856898 - RNA, 21 nt, Human
aguguuucagcuaagggaaga

SEQ ID NO: 2856899 - RNA, 15 nt, Human
aguguuuauuuuuca

SEQ ID NO: 2856900 - RNA, 17 nt, Human
aguguuuauuuuucaua

SEQ ID NO: 2856901 - RNA, 19 nt, Human
aguguuuauuuuucauauu

SEQ ID NO: 2856902 - RNA, 21 nt, Human
aguguuuauuuuucauauugu

SEQ ID NO: 2856903 - RNA, 13 nt, Human
aguuacccacuga

SEQ ID NO: 2856904 - RNA, 13 nt, Human
aguguuucuauga

SEQ ID NO: 2856905 - RNA, 20 nt, Human
aguguuucuaugaguggaaa

SEQ ID NO: 2856906 - RNA, 17 nt, Human
aguuaccacacaucuau

SEQ ID NO: 2856907 - RNA, 13 nt, Human
aguguuucuguua

SEQ ID NO: 2856908 - RNA, 12 nt, Human
aguguuucuguu

SEQ ID NO: 2856909 - RNA, 20 nt, Human
aguggcagcugcuuuugucu

SEQ ID NO: 2856910 - RNA, 14 nt, Human
aguggcagcugcuu

SEQ ID NO: 2856911 - RNA, 13 nt, Human
aguggcagcugcu

SEQ ID NO: 2856912 - RNA, 12 nt, Human
aguggcagcugc

SEQ ID NO: 2856913 - RNA, 11 nt, Human
aguggcagcug

SEQ ID NO: 2856914 - RNA, 15 nt, Human
ugugcaacagacaag

SEQ ID NO: 2856915 - RNA, 19 nt, Human
ugugcaacgccgugggcug

SEQ ID NO: 2856916 - RNA, 15 nt, Human
ugugcaaauuaacag

SEQ ID NO: 2856917 - RNA, 14 nt, Human
ugugcaacagacaa

SEQ ID NO: 2856918 - RNA, 12 nt, Human
ugugcaaauccu

SEQ ID NO: 2856919 - RNA, 12 nt, Human
aguggggccugu

SEQ ID NO: 2856920 - RNA, 13 nt, Human
aguggggccugug

SEQ ID NO: 2856921 - RNA, 14 nt, Human
aguggggccugugg

SEQ ID NO: 2856922 - RNA, 15 nt, Human
aguggggccugugga

SEQ ID NO: 2856923 - RNA, 13 nt, Human
aguggggcucucu

SEQ ID NO: 2856924 - RNA, 15 nt, Human
aguggggcucucuga

SEQ ID NO: 2856925 - RNA, 20 nt, Human
aguggggcucucugaguccu

SEQ ID NO: 2856926 - RNA, 21 nt, Human
agugggguuaucucuguguua

SEQ ID NO: 2856927 - RNA, 21 nt, Human
agugggguuucgcagccugag

SEQ ID NO: 2856928 - RNA, 15 nt, Human
aguggguaaaauuag

SEQ ID NO: 2856929 - RNA, 19 nt, Human
aguggguaaaauuagaugc

SEQ ID NO: 2856930 - RNA, 20 nt, Human
agugggguuaucucuguguu

SEQ ID NO: 2856931 - RNA, 14 nt, Human
aguggugcagacag

SEQ ID NO: 2856932 - RNA, 23 nt, Human
aguggugccaucauugcugucug

SEQ ID NO: 2856933 - RNA, 21 nt, Human
aguggugcgaucucggcucag

SEQ ID NO: 2856934 - RNA, 19 nt, Human
agugguuguuaguuauaga

SEQ ID NO: 2856935 - RNA, 20 nt, Human
agugguuuccacaugcucug

SEQ ID NO: 2856936 - RNA, 22 nt, Human
agugguuuccacaugcucugag

SEQ ID NO: 2856937 - RNA, 22 nt, Human
agugguuugauggugacuuccu

SEQ ID NO: 2856938 - RNA, 17 nt, Human
aguguaagcuagaagaa

SEQ ID NO: 2856939 - RNA, 13 nt, Human
aguguaauaagac

SEQ ID NO: 2856940 - RNA, 15 nt, Human
aguguaauaauauga

SEQ ID NO: 2856941 - RNA, 19 nt, Human
aguguaaucccccaggaga

SEQ ID NO: 2856942 - RNA, 19 nt, Human
aguguaauguagcguguuu

SEQ ID NO: 2856943 - RNA, 13 nt, Human
aguguaaaauaag

SEQ ID NO: 2856944 - RNA, 11 nt, Human
aguguaaaaua

SEQ ID NO: 2856945 - RNA, 16 nt, Human
agugggugacaagagc

SEQ ID NO: 2856946 - RNA, 18 nt, Human
agugggugacaagagccu

SEQ ID NO: 2856947 - RNA, 19 nt, Human
agugggugacaagagccug

SEQ ID NO: 2856948 - RNA, 21 nt, Human
agugggugacaagagccugau

SEQ ID NO: 2856949 - RNA, 18 nt, Human
aguggguuauucuggagu

SEQ ID NO: 2856950 - RNA, 19 nt, Human
aguggguuauucuggaguu

SEQ ID NO: 2856951 - RNA, 15 nt, Human
aguggguuauucugg

SEQ ID NO: 2856952 - RNA, 16 nt, Human
aguggguuauucugga

SEQ ID NO: 2856953 - RNA, 22 nt, Human
agugggugagaugcuggagaag

SEQ ID NO: 2856954 - RNA, 18 nt, Human
agugggugagaugcugga

SEQ ID NO: 2856955 - RNA, 19 nt, Human
agugggugagaugcuggag

SEQ ID NO: 2856956 - RNA, 20 nt, Human
aguggucuuuguaagagugu

SEQ ID NO: 2856957 - RNA, 21 nt, Human
aguggucuuuguaagagugua

SEQ ID NO: 2856958 - RNA, 22 nt, Human
aguggucuuuguaagaguguag

SEQ ID NO: 2856959 - RNA, 24 nt, Human
aguggucuuuguaagaguguagaa

SEQ ID NO: 2856960 - RNA, 13 nt, Human
aguggucuuugua

SEQ ID NO: 2856961 - RNA, 14 nt, Human
aguggucuuuguaa

SEQ ID NO: 2856962 - RNA, 15 nt, Human
aguggucuuuguaag

SEQ ID NO: 2856963 - RNA, 16 nt, Human
aguggucuuuguaaga

SEQ ID NO: 2856964 - RNA, 17 nt, Human
aguggucuuuguaagag

SEQ ID NO: 2856965 - RNA, 18 nt, Human
aguggucuuuguaagagu

SEQ ID NO: 2856966 - RNA, 19 nt, Human
aguggucuuuguaagagug

SEQ ID NO: 2856967 - RNA, 14 nt, Human
aguguacauagugu

SEQ ID NO: 2856968 - RNA, 16 nt, Human
aguguacauaguguaa

SEQ ID NO: 2856969 - RNA, 15 nt, Human
aguguagccaggucc

SEQ ID NO: 2856970 - RNA, 16 nt, Human
aguguagccagguccc

SEQ ID NO: 2856971 - RNA, 17 nt, Human
aguguagccaggucccc

SEQ ID NO: 2856972 - RNA, 23 nt, Human
aguguagccaggucccccugcag

SEQ ID NO: 2856973 - RNA, 13 nt, Human
aguguagccuugc

SEQ ID NO: 2856974 - RNA, 22 nt, Human
aguguagaagcauuccuucuuu

SEQ ID NO: 2856975 - RNA, 19 nt, Human
aguguaguuuacagaaaaa

SEQ ID NO: 2856976 - RNA, 17 nt, Human
aguguaguuuacagaaa

SEQ ID NO: 2856977 - RNA, 16 nt, Human
aguguaguuuacagaa

SEQ ID NO: 2856978 - RNA, 15 nt, Human
aguguaguuaauuua

SEQ ID NO: 2856979 - RNA, 16 nt, Human
aguguaguuaauuuau

SEQ ID NO: 2856980 - RNA, 17 nt, Human
aguguaguuaauuuauc

SEQ ID NO: 2856981 - RNA, 18 nt, Human
aguguagccuugcccgga

SEQ ID NO: 2856982 - RNA, 17 nt, Human
aguguagccuugcccgg

SEQ ID NO: 2856983 - RNA, 15 nt, Human
aguguagccuugccc

SEQ ID NO: 2856984 - RNA, 14 nt, Human
uguuauuuucagua

SEQ ID NO: 2856985 - RNA, 18 nt, Human
uguuauuuucaaguagcu

SEQ ID NO: 2856986 - RNA, 18 nt, Human
uguuauuuucaguauuuu

SEQ ID NO: 2856987 - RNA, 15 nt, Human
uguuauuuucaguga

SEQ ID NO: 2856988 - RNA, 16 nt, Human
uguuauuuucagugau

SEQ ID NO: 2856989 - RNA, 12 nt, Human
uguuauguauuu

SEQ ID NO: 2856990 - RNA, 13 nt, Human
uguuauguauuuc

SEQ ID NO: 2856991 - RNA, 14 nt, Human
uguuauguauuucc

SEQ ID NO: 2856992 - RNA, 21 nt, Human
uguuaugucuguuuaagaaaa

SEQ ID NO: 2856993 - RNA, 12 nt, Human
uguuaugcuauu

SEQ ID NO: 2856994 - RNA, 20 nt, Human
uguuauguacuaguguucug

SEQ ID NO: 2856995 - RNA, 13 nt, Human
uguuauguacugu

SEQ ID NO: 2856996 - RNA, 14 nt, Human
uguuauguacugua

SEQ ID NO: 2856997 - RNA, 15 nt, Human
uguuauguacuguac

SEQ ID NO: 2856998 - RNA, 16 nt, Human
uguuauguacuguacu

SEQ ID NO: 2856999 - RNA, 20 nt, Human
uguucccauguagcccccug

SEQ ID NO: 2857000 - RNA, 16 nt, Human
uguucccauucuugca

SEQ ID NO: 2857001 - RNA, 17 nt, Human
uguuauuuucuucuaag

SEQ ID NO: 2857002 - RNA, 17 nt, Human
uguuauuuuucaaggaa

SEQ ID NO: 2857003 - RNA, 18 nt, Human
uguuauuuuucaaggaag

SEQ ID NO: 2857004 - RNA, 19 nt, Human
uguuauuuuucaaggaagg

SEQ ID NO: 2857005 - RNA, 13 nt, Human
uguucaaacaaua

SEQ ID NO: 2857006 - RNA, 19 nt, Human
uguucaaacaauaucauau

SEQ ID NO: 2857007 - RNA, 20 nt, Human
uguucaaacaauaucauauc

SEQ ID NO: 2857008 - RNA, 22 nt, Human
uguucaaacaauaucauaucau

SEQ ID NO: 2857009 - RNA, 18 nt, Human
uguucaaagccacauuau

SEQ ID NO: 2857010 - RNA, 20 nt, Human
uguucaaagccacauuauuu

SEQ ID NO: 2857011 - RNA, 22 nt, Human
uguucaaagccacauuauuucu

SEQ ID NO: 2857012 - RNA, 13 nt, Human
uguucugggacac

SEQ ID NO: 2857013 - RNA, 12 nt, Human
uguucugggaca

SEQ ID NO: 2857014 - RNA, 22 nt, Human
uguuccccacugacagccuccc

SEQ ID NO: 2857015 - RNA, 13 nt, Human
uguuccccaucug

SEQ ID NO: 2857016 - RNA, 15 nt, Human
uguucugggacacag

SEQ ID NO: 2857017 - RNA, 14 nt, Human
uguucugggacaca

SEQ ID NO: 2857018 - RNA, 22 nt, Human
uguucuuaccuguaugucucca

SEQ ID NO: 2857019 - RNA, 17 nt, Human
uguucuuaccuguaugu

SEQ ID NO: 2857020 - RNA, 13 nt, Human
uguucuuacacau

SEQ ID NO: 2857021 - RNA, 14 nt, Human
uguucuuacacaua

SEQ ID NO: 2857022 - RNA, 16 nt, Human
uguucuuacacauaca

SEQ ID NO: 2857023 - RNA, 22 nt, Human
uguucuuacacauacaguuuua

SEQ ID NO: 2857024 - RNA, 18 nt, Human
uguucuugcugcuagaac

SEQ ID NO: 2857025 - RNA, 19 nt, Human
uguucuugcugcuagaacu

SEQ ID NO: 2857026 - RNA, 20 nt, Human
uguucuugcugcuagaacuu

SEQ ID NO: 2857027 - RNA, 21 nt, Human
uguucuugcugcuagaacuuu

SEQ ID NO: 2857028 - RNA, 22 nt, Human
uguucuugcugcuagaacuuuu

SEQ ID NO: 2857029 - RNA, 23 nt, Human
uguucuugcugcuagaacuuuuu

SEQ ID NO: 2857030 - RNA, 15 nt, Human
uuaaaccugucucca

SEQ ID NO: 2857031 - RNA, 19 nt, Human
uuaaaccugucuccacugu

SEQ ID NO: 2857032 - RNA, 20 nt, Human
uuaaaccugucuccacugug

SEQ ID NO: 2857033 - RNA, 21 nt, Human
uuaaaccugucuccacugugc

SEQ ID NO: 2857034 - RNA, 21 nt, Human
uuaaaccuguuuuuuuuucau

SEQ ID NO: 2857035 - RNA, 22 nt, Human
uuaaaccuguuuuuuuuucauu

SEQ ID NO: 2857036 - RNA, 19 nt, Human
uuaaaaauugucuucaugu

SEQ ID NO: 2857037 - RNA, 20 nt, Human
uuaaaaauugucuucaugua

SEQ ID NO: 2857038 - RNA, 18 nt, Human
uuaaaauaggggauauuu

SEQ ID NO: 2857039 - RNA, 22 nt, Human
uuaaaauaggggauauuuaagg

SEQ ID NO: 2857040 - RNA, 23 nt, Human
uuaaaauaggggauauuuaaggu

SEQ ID NO: 2857041 - RNA, 12 nt, Human
uuaaaacaaaac

SEQ ID NO: 2857042 - RNA, 18 nt, Human
uuaaaacaaaacaaaaca

SEQ ID NO: 2857043 - RNA, 16 nt, Human
uuaaaauauuccugca

SEQ ID NO: 2857044 - RNA, 19 nt, Human
uuaaaauauuccugcauuu

SEQ ID NO: 2857045 - RNA, 17 nt, Human
uuaaaauauuuauuuau

SEQ ID NO: 2857046 - RNA, 16 nt, Human
uuaaauuauguuuuua

SEQ ID NO: 2857047 - RNA, 21 nt, Human
uuaaauuauguuuuuauuaag

SEQ ID NO: 2857048 - RNA, 12 nt, Human
uuaaauaaacuu

SEQ ID NO: 2857049 - RNA, 13 nt, Human
uuaaauaaacuuu

SEQ ID NO: 2857050 - RNA, 14 nt, Human
uuaaauaaacuuuu

SEQ ID NO: 2857051 - RNA, 15 nt, Human
uuaaauaaacuuuuu

SEQ ID NO: 2857052 - RNA, 19 nt, Human
uuaaauaaacuuuuuuuca

SEQ ID NO: 2857053 - RNA, 20 nt, Human
uuaaauaaacuuuuuuucaa

SEQ ID NO: 2857054 - RNA, 21 nt, Human
uuaaauaaacuuuuuuucaau

SEQ ID NO: 2857055 - RNA, 22 nt, Human
uuaaauaaacuuuuuuucaaug

SEQ ID NO: 2857056 - RNA, 23 nt, Human
uuaaauaaacuuuuuuucaaugu

SEQ ID NO: 2857057 - RNA, 13 nt, Human
uuaaauaaaauca

SEQ ID NO: 2857058 - RNA, 15 nt, Human
uuaaauaaaaucaau

SEQ ID NO: 2857059 - RNA, 13 nt, Human
uuaaauaaaagcu

SEQ ID NO: 2857060 - RNA, 13 nt, Human
aguugccaagaca

SEQ ID NO: 2857061 - RNA, 14 nt, Human
aguugccaagacaa

SEQ ID NO: 2857062 - RNA, 16 nt, Human
aguugccaagacaaau

SEQ ID NO: 2857063 - RNA, 17 nt, Human
aguugccaagacaaauc

SEQ ID NO: 2857064 - RNA, 18 nt, Human
aguugccaagacaaauca

SEQ ID NO: 2857065 - RNA, 19 nt, Human
aguugccaagacaaaucaa

SEQ ID NO: 2857066 - RNA, 14 nt, Human
aguugccaccaccu

SEQ ID NO: 2857067 - RNA, 19 nt, Human
aguugccaccaccucugug

SEQ ID NO: 2857068 - RNA, 20 nt, Human
aguugccaccaccucugugg

SEQ ID NO: 2857069 - RNA, 21 nt, Human
aguugccaccaccucuguggc

SEQ ID NO: 2857070 - RNA, 22 nt, Human
aguugccaccaccucuguggca

SEQ ID NO: 2857071 - RNA, 16 nt, Human
uuaaaaaaauuuaagu

SEQ ID NO: 2857072 - RNA, 20 nt, Human
aguugcauggcaucaccucc

SEQ ID NO: 2857073 - RNA, 21 nt, Human
aguugcauggcaucaccucca

SEQ ID NO: 2857074 - RNA, 14 nt, Human
aguugauugagaag

SEQ ID NO: 2857075 - RNA, 20 nt, Human
uuaaaaauauggaacuucua

SEQ ID NO: 2857076 - RNA, 22 nt, Human
uuaaaaauauggaacuucuaau

SEQ ID NO: 2857077 - RNA, 17 nt, Human
uuaaaacaacacucaca

SEQ ID NO: 2857078 - RNA, 19 nt, Human
uuaaaaauguaaauauucu

SEQ ID NO: 2857079 - RNA, 20 nt, Human
uuaaaaauucuugaaagaau

SEQ ID NO: 2857080 - RNA, 20 nt, Human
uuaaaaauguuuuuucaugu

SEQ ID NO: 2857081 - RNA, 24 nt, Human
uuaaaaauguuuuuucauguguuu

SEQ ID NO: 2857082 - RNA, 13 nt, Human
uuaaaaauguaaa

SEQ ID NO: 2857083 - RNA, 14 nt, Human
uuaaaaauguaaau

SEQ ID NO: 2857084 - RNA, 16 nt, Human
uuaaaaauguaaauau

SEQ ID NO: 2857085 - RNA, 17 nt, Human
uuaaaaauguaaauauu

SEQ ID NO: 2857086 - RNA, 16 nt, Human
uuaaaaaguuguucaa

SEQ ID NO: 2857087 - RNA, 17 nt, Human
uuaaaaaguuguucaac

SEQ ID NO: 2857088 - RNA, 11 nt, Human
uuaaaaauaaa

SEQ ID NO: 2857089 - RNA, 12 nt, Human
uuaaaaauacau

SEQ ID NO: 2857090 - RNA, 14 nt, Human
uuaaaaauacauau

SEQ ID NO: 2857091 - RNA, 20 nt, Human
uuaaaaaguuaaucuucaug

SEQ ID NO: 2857092 - RNA, 16 nt, Human
uuaaaaauaaauccca

SEQ ID NO: 2857093 - RNA, 19 nt, Human
aguuugggaucccugucuu

SEQ ID NO: 2857094 - RNA, 20 nt, Human
aguuugggaucccugucuuu

SEQ ID NO: 2857095 - RNA, 21 nt, Human
aguuugggaucccugucuuuc

SEQ ID NO: 2857096 - RNA, 23 nt, Human
aguuugggaucccugucuuuccu

SEQ ID NO: 2857097 - RNA, 12 nt, Human
aguuugggcuuc

SEQ ID NO: 2857098 - RNA, 14 nt, Human
aguuugggcuucag

SEQ ID NO: 2857099 - RNA, 15 nt, Human
aguuugggcuucagc

SEQ ID NO: 2857100 - RNA, 17 nt, Human
aguuugggcuucagccu

SEQ ID NO: 2857101 - RNA, 20 nt, Human
aguuuggggcaagucaugua

SEQ ID NO: 2857102 - RNA, 21 nt, Human
aguuuggggcaagucauguaa

SEQ ID NO: 2857103 - RNA, 22 nt, Human
aguuuggggcaagucauguaaa

SEQ ID NO: 2857104 - RNA, 20 nt, Human
aguuuggggguuuugcuguu

SEQ ID NO: 2857105 - RNA, 14 nt, Human
aguuuguaaauguu

SEQ ID NO: 2857106 - RNA, 15 nt, Human
aguuuguaaauguua

SEQ ID NO: 2857107 - RNA, 17 nt, Human
aguuuguaaauguuauu

SEQ ID NO: 2857108 - RNA, 20 nt, Human
aguuuguaaauguuauuucu

SEQ ID NO: 2857109 - RNA, 22 nt, Human
aguuuguaaauguuauuucugc

SEQ ID NO: 2857110 - RNA, 23 nt, Human
aguuuguaaauguuauuucugca

SEQ ID NO: 2857111 - RNA, 15 nt, Human
aguuugguauuugcg

SEQ ID NO: 2857112 - RNA, 14 nt, Human
aguuuggucuggac

SEQ ID NO: 2857113 - RNA, 15 nt, Human
aguuuggucuggacu

SEQ ID NO: 2857114 - RNA, 16 nt, Human
aguuuggucuggacug

SEQ ID NO: 2857115 - RNA, 13 nt, Human
aguuugucuauuu

SEQ ID NO: 2857116 - RNA, 14 nt, Human
aguuugucuauuuu

SEQ ID NO: 2857117 - RNA, 15 nt, Human
aguuugucuauuuua

SEQ ID NO: 2857118 - RNA, 16 nt, Human
aguuugucuauuuuaa

SEQ ID NO: 2857119 - RNA, 19 nt, Human
aguuugucuauuuuaaaau

SEQ ID NO: 2857120 - RNA, 21 nt, Human
aguuugucuauuuuaaaauaa

SEQ ID NO: 2857121 - RNA, 14 nt, Human
aguuuuaugcucuu

SEQ ID NO: 2857122 - RNA, 15 nt, Human
aguuuuaugcucuuu

SEQ ID NO: 2857123 - RNA, 21 nt, Human
aguuuuaugcucuuuuuuacu

SEQ ID NO: 2857124 - RNA, 23 nt, Human
aguuuuaugcucuuuuuuacuca

SEQ ID NO: 2857125 - RNA, 24 nt, Human
aguuuuaugcucuuuuuuacucau

SEQ ID NO: 2857126 - RNA, 23 nt, Human
aguuuguauuuuaauuaugggaa

SEQ ID NO: 2857127 - RNA, 14 nt, Human
aguuuguauaacuu

SEQ ID NO: 2857128 - RNA, 15 nt, Human
aguuuguccauuugu

SEQ ID NO: 2857129 - RNA, 16 nt, Human
aguuuguccauuugua

SEQ ID NO: 2857130 - RNA, 18 nt, Human
aguuugucacaugaaaca

SEQ ID NO: 2857131 - RNA, 16 nt, Human
aguuuguccuguagag

SEQ ID NO: 2857132 - RNA, 15 nt, Human
aguuuguacaugcau

SEQ ID NO: 2857133 - RNA, 17 nt, Human
aguuuguauaacuucuu

SEQ ID NO: 2857134 - RNA, 21 nt, Human
aguuuguauagaguucauccc

SEQ ID NO: 2857135 - RNA, 18 nt, Human
aguuuguacaugcauuca

SEQ ID NO: 2857136 - RNA, 14 nt, Human
aguuuguagguaaa

SEQ ID NO: 2857137 - RNA, 17 nt, Human
aguuuguagguaaaaug

SEQ ID NO: 2857138 - RNA, 19 nt, Human
aguuuguagguaaaaugua

SEQ ID NO: 2857139 - RNA, 20 nt, Human
aguuuguagguaaaauguau

SEQ ID NO: 2857140 - RNA, 21 nt, Human
aguuuguagguaaaauguauu

SEQ ID NO: 2857141 - RNA, 22 nt, Human
aguuuguagguaaaauguauuu

SEQ ID NO: 2857142 - RNA, 17 nt, Human
aguuuguaguuguuuua

SEQ ID NO: 2857143 - RNA, 22 nt, Human
aguuuucacucuuauugcccac

SEQ ID NO: 2857144 - RNA, 16 nt, Human
aguuuucagaaccucu

SEQ ID NO: 2857145 - RNA, 16 nt, Human
aguuuuauuuuauguu

SEQ ID NO: 2857146 - RNA, 19 nt, Human
aguuuuauuuuauguuuag

SEQ ID NO: 2857147 - RNA, 22 nt, Human
aguuuucagaaccucuucccca

SEQ ID NO: 2857148 - RNA, 21 nt, Human
aguuuucagaaccucuucccc

SEQ ID NO: 2857149 - RNA, 20 nt, Human
aguuuucagaaccucuuccc

SEQ ID NO: 2857150 - RNA, 18 nt, Human
aguuuucagaaccucuuc

SEQ ID NO: 2857151 - RNA, 17 nt, Human
aguuuucagaaccucuu

SEQ ID NO: 2857152 - RNA, 21 nt, Human
aguuuucauuuagaaaauaga

SEQ ID NO: 2857153 - RNA, 20 nt, Human
aguuuucccuugaggaaaca

SEQ ID NO: 2857154 - RNA, 18 nt, Human
aguuuucccuugaggaaa

SEQ ID NO: 2857155 - RNA, 12 nt, Human
uuaaauucugag

SEQ ID NO: 2857156 - RNA, 14 nt, Human
uuaaauucugagac

SEQ ID NO: 2857157 - RNA, 18 nt, Human
uuaaauucugagacaugu

SEQ ID NO: 2857158 - RNA, 15 nt, Human
aguuuauuuuaagac

SEQ ID NO: 2857159 - RNA, 16 nt, Human
aguuuauuuuuaaaga

SEQ ID NO: 2857160 - RNA, 20 nt, Human
aguuuauuuuuaaagauaga

SEQ ID NO: 2857161 - RNA, 19 nt, Human
aguuucaaacuuacuauuu

SEQ ID NO: 2857162 - RNA, 21 nt, Human
aguuucaaacuuacuauuuug

SEQ ID NO: 2857163 - RNA, 16 nt, Human
aguuucaaugugauuc

SEQ ID NO: 2857164 - RNA, 22 nt, Human
aguuucaaugugauucuaaugu

SEQ ID NO: 2857165 - RNA, 12 nt, Human
aguuucaaugug

SEQ ID NO: 2857166 - RNA, 14 nt, Human
aguuucaaugugau

SEQ ID NO: 2857167 - RNA, 15 nt, Human
aguuucaaugugauu

SEQ ID NO: 2857168 - RNA, 16 nt, Human
aguuucucagcuccca

SEQ ID NO: 2857169 - RNA, 15 nt, Human
aguuuccuuggcugg

SEQ ID NO: 2857170 - RNA, 17 nt, Human
aguuuccuuggcuggug

SEQ ID NO: 2857171 - RNA, 18 nt, Human
aguuuccuuggcuggugc

SEQ ID NO: 2857172 - RNA, 15 nt, Human
aguuucucagcuccc

SEQ ID NO: 2857173 - RNA, 20 nt, Human
aguuucguuucuguuuuuua

SEQ ID NO: 2857174 - RNA, 19 nt, Human
aguuuccuuggcuggugca

SEQ ID NO: 2857175 - RNA, 19 nt, Human
aguuuccuuuucugucucu

SEQ ID NO: 2857176 - RNA, 23 nt, Human
aguuuccuuuucugucucucucu

SEQ ID NO: 2857177 - RNA, 20 nt, Human
aguucucuugguguuaaaac

SEQ ID NO: 2857178 - RNA, 13 nt, Human
aguucuguguuua

SEQ ID NO: 2857179 - RNA, 15 nt, Human
aguucuguguuuaau

SEQ ID NO: 2857180 - RNA, 18 nt, Human
aguucuguguuuaauuuc

SEQ ID NO: 2857181 - RNA, 19 nt, Human
aguucuguguuuaauuucu

SEQ ID NO: 2857182 - RNA, 21 nt, Human
aguucuguagagccuucugau

SEQ ID NO: 2857183 - RNA, 23 nt, Human
aguucuuggucccuccagaacca

SEQ ID NO: 2857184 - RNA, 12 nt, Human
aguucuugugcc

SEQ ID NO: 2857185 - RNA, 13 nt, Human
aguucuugugcca

SEQ ID NO: 2857186 - RNA, 14 nt, Human
aguucuugugccau

SEQ ID NO: 2857187 - RNA, 13 nt, Human
aguucuucuccaa

SEQ ID NO: 2857188 - RNA, 15 nt, Human
aguugauauagaaca

SEQ ID NO: 2857189 - RNA, 17 nt, Human
aguugauauagaacagu

SEQ ID NO: 2857190 - RNA, 19 nt, Human
aguugauauagaacagugc

SEQ ID NO: 2857191 - RNA, 16 nt, Human
aguugauguugcauuu

SEQ ID NO: 2857192 - RNA, 14 nt, Human
aguugauguaucca

SEQ ID NO: 2857193 - RNA, 15 nt, Human
aguugauguugcauu

SEQ ID NO: 2857194 - RNA, 21 nt, Human
aguugauauguuuuauuucau

SEQ ID NO: 2857195 - RNA, 22 nt, Human
aguugauauguuuuauuucauu

SEQ ID NO: 2857196 - RNA, 15 nt, Human
aguugcaauagaaca

SEQ ID NO: 2857197 - RNA, 17 nt, Human
aguugcaauagaacaga

SEQ ID NO: 2857198 - RNA, 18 nt, Human
uguuuuacugugaaacug

SEQ ID NO: 2857199 - RNA, 15 nt, Human
uguuuuacugugaaa

SEQ ID NO: 2857200 - RNA, 13 nt, Human
uguuuuauaaaau

SEQ ID NO: 2857201 - RNA, 19 nt, Human
uguuuuauaaaauuuugcu

SEQ ID NO: 2857202 - RNA, 15 nt, Human
uguuuuauaaguuca

SEQ ID NO: 2857203 - RNA, 22 nt, Human
uguuuuauaaguucacaaaaug

SEQ ID NO: 2857204 - RNA, 23 nt, Human
uguuuuagguuaaaaaaaggcau

SEQ ID NO: 2857205 - RNA, 23 nt, Human
uguuuuauuuuuuauuguuuuca

SEQ ID NO: 2857206 - RNA, 18 nt, Human
uguuuuauuuuuuauugu

SEQ ID NO: 2857207 - RNA, 16 nt, Human
uguuuuccgugaaaac

SEQ ID NO: 2857208 - RNA, 19 nt, Human
uguuuuccgugaaaacgga

SEQ ID NO: 2857209 - RNA, 18 nt, Human
uguuuuagaguaagaaau

SEQ ID NO: 2857210 - RNA, 16 nt, Human
uguuugccucugccuc

SEQ ID NO: 2857211 - RNA, 14 nt, Human
uguuugccucugcc

SEQ ID NO: 2857212 - RNA, 13 nt, Human
uguugucauugua

SEQ ID NO: 2857213 - RNA, 19 nt, Human
uguugucauuguaaacaaa

SEQ ID NO: 2857214 - RNA, 21 nt, Human
uguugucauuguaaacaaacu

SEQ ID NO: 2857215 - RNA, 22 nt, Human
uguuugcauaaacauucuuuua

SEQ ID NO: 2857216 - RNA, 17 nt, Human
uguuguccuuuugucuu

SEQ ID NO: 2857217 - RNA, 22 nt, Human
uguuugcaugugaaaaucaaau

SEQ ID NO: 2857218 - RNA, 15 nt, Human
uguuugccauacuuu

SEQ ID NO: 2857219 - RNA, 22 nt, Human
uguuugccauacuuugucugaa

SEQ ID NO: 2857220 - RNA, 12 nt, Human
uguuuggagagc

SEQ ID NO: 2857221 - RNA, 15 nt, Human
uguuuggaggagcaa

SEQ ID NO: 2857222 - RNA, 17 nt, Human
uguuuggauguaauuua

SEQ ID NO: 2857223 - RNA, 19 nt, Human
uguuuggauguaauuuagg

SEQ ID NO: 2857224 - RNA, 21 nt, Human
uguuuggauguaauuuagggu

SEQ ID NO: 2857225 - RNA, 22 nt, Human
uguuuggauuuuuaauuaaaaa

SEQ ID NO: 2857226 - RNA, 15 nt, Human
uguuuggcaaggaaa

SEQ ID NO: 2857227 - RNA, 16 nt, Human
uguuuggcaaggaaag

SEQ ID NO: 2857228 - RNA, 17 nt, Human
uguuuggcaaggaaagg

SEQ ID NO: 2857229 - RNA, 13 nt, Human
uguuuggagacag

SEQ ID NO: 2857230 - RNA, 15 nt, Human
uguuuggggaugaga

SEQ ID NO: 2857231 - RNA, 13 nt, Human
uguuuuacaaugu

SEQ ID NO: 2857232 - RNA, 15 nt, Human
uguuuuacacuguac

SEQ ID NO: 2857233 - RNA, 17 nt, Human
ugccucagccuccugag

SEQ ID NO: 2857234 - RNA, 15 nt, Human
ugccucagccuccug

SEQ ID NO: 2857235 - RNA, 18 nt, Human
ugccucagccucccgagu

SEQ ID NO: 2857236 - RNA, 16 nt, Human
ugccucagccucccga

SEQ ID NO: 2857237 - RNA, 17 nt, Human
ugccucagccucccgag

SEQ ID NO: 2857238 - RNA, 15 nt, Human
ugccucagccucccg

SEQ ID NO: 2857239 - RNA, 17 nt, Human
ugccucccauucugacc

SEQ ID NO: 2857240 - RNA, 14 nt, Human
ugccucagccuccg

SEQ ID NO: 2857241 - RNA, 18 nt, Human
ugccuccccggcucgagc

SEQ ID NO: 2857242 - RNA, 15 nt, Human
ugccucaccgcuucc

SEQ ID NO: 2857243 - RNA, 16 nt, Human
ugccucaccgcuuccc

SEQ ID NO: 2857244 - RNA, 22 nt, Human
ugccucaccgcuucccuccugc

SEQ ID NO: 2857245 - RNA, 14 nt, Human
ugccgccucccagc

SEQ ID NO: 2857246 - RNA, 13 nt, Human
ugccgccucccag

SEQ ID NO: 2857247 - RNA, 19 nt, Human
ugccgcccccuccugaacc

SEQ ID NO: 2857248 - RNA, 18 nt, Human
ugccgcccccuccugaac

SEQ ID NO: 2857249 - RNA, 17 nt, Human
ugccgcccccuccugaa

SEQ ID NO: 2857250 - RNA, 16 nt, Human
ugccgccccacccaga

SEQ ID NO: 2857251 - RNA, 14 nt, Human
ugccgccccaccca

SEQ ID NO: 2857252 - RNA, 15 nt, Human
ugccgccccacccag

SEQ ID NO: 2857253 - RNA, 14 nt, Human
ugcccuucacccca

SEQ ID NO: 2857254 - RNA, 13 nt, Human
ugcccuuaggcca

SEQ ID NO: 2857255 - RNA, 15 nt, Human
ugcccuucaccccag

SEQ ID NO: 2857256 - RNA, 20 nt, Human
ugcccuucaccccaguggcc

SEQ ID NO: 2857257 - RNA, 16 nt, Human
agcucuucuccaggcu

SEQ ID NO: 2857258 - RNA, 15 nt, Human
agcucuucuccaggc

SEQ ID NO: 2857259 - RNA, 13 nt, Human
ugcccugugggac

SEQ ID NO: 2857260 - RNA, 14 nt, Human
ugcccugugggacc

SEQ ID NO: 2857261 - RNA, 18 nt, Human
ugcccugugggaccccag

SEQ ID NO: 2857262 - RNA, 19 nt, Human
ugcccugugggaccccagg

SEQ ID NO: 2857263 - RNA, 22 nt, Human
ugcccugugggaccccaggccc

SEQ ID NO: 2857264 - RNA, 23 nt, Human
ugcccugugggaccccaggccca

SEQ ID NO: 2857265 - RNA, 10 nt, Human
agcugccugu

SEQ ID NO: 2857266 - RNA, 14 nt, Human
agcugccuguaguu

SEQ ID NO: 2857267 - RNA, 18 nt, Human
agcugccuguaguuagga

SEQ ID NO: 2857268 - RNA, 15 nt, Human
agcugccuguaguua

SEQ ID NO: 2857269 - RNA, 23 nt, Human
agcugccuguaguuaggaaauaa

SEQ ID NO: 2857270 - RNA, 22 nt, Human
agcugccuguaguuaggaaaua

SEQ ID NO: 2857271 - RNA, 20 nt, Human
agcugccuguaguuaggaaa

SEQ ID NO: 2857272 - RNA, 19 nt, Human
agcugccuguaguuaggaa

SEQ ID NO: 2857273 - RNA, 22 nt, Human
agcugcuuuugucuaugggacu

SEQ ID NO: 2857274 - RNA, 13 nt, Human
agcugccuguuca

SEQ ID NO: 2857275 - RNA, 24 nt, Human
agcugcuuuugucuaugggacuca

SEQ ID NO: 2857276 - RNA, 23 nt, Human
agcugcuuuugucuaugggacuc

SEQ ID NO: 2857277 - RNA, 15 nt, Human
agcugggacuacagg

SEQ ID NO: 2857278 - RNA, 14 nt, Human
agcuggagccuggu

SEQ ID NO: 2857279 - RNA, 15 nt, Human
agcuggagccuggug

SEQ ID NO: 2857280 - RNA, 17 nt, Human
agcuggagccuggugcc

SEQ ID NO: 2857281 - RNA, 19 nt, Human
agcuggagccuggugcccu

SEQ ID NO: 2857282 - RNA, 11 nt, Human
ugccucugccu

SEQ ID NO: 2857283 - RNA, 12 nt, Human
ugccucugccac

SEQ ID NO: 2857284 - RNA, 16 nt, Human
ugccucugccacacuc

SEQ ID NO: 2857285 - RNA, 18 nt, Human
ugccucugauaugggacu

SEQ ID NO: 2857286 - RNA, 19 nt, Human
ugccucugauaugggacug

SEQ ID NO: 2857287 - RNA, 20 nt, Human
ugccucugauaugggacuga

SEQ ID NO: 2857288 - RNA, 21 nt, Human
ugccucugauaugggacugag

SEQ ID NO: 2857289 - RNA, 16 nt, Human
ugccucugacacacag

SEQ ID NO: 2857290 - RNA, 14 nt, Human
ugccucugacacac

SEQ ID NO: 2857291 - RNA, 19 nt, Human
ugccugcccaggccccugc

SEQ ID NO: 2857292 - RNA, 18 nt, Human
ugccugcccaggccccug

SEQ ID NO: 2857293 - RNA, 17 nt, Human
ugccugcccaggccccu

SEQ ID NO: 2857294 - RNA, 13 nt, Human
ugccugcgucuuc

SEQ ID NO: 2857295 - RNA, 15 nt, Human
ugccugcgucuuccg

SEQ ID NO: 2857296 - RNA, 16 nt, Human
ugccugcgucuuccgc

SEQ ID NO: 2857297 - RNA, 17 nt, Human
ugccugcgucuuccgcc

SEQ ID NO: 2857298 - RNA, 18 nt, Human
ugccugcgucuuccgccc

SEQ ID NO: 2857299 - RNA, 19 nt, Human
ugccugcgucuuccgcccc

SEQ ID NO: 2857300 - RNA, 21 nt, Human
agcucugcagagcaggaaaca

SEQ ID NO: 2857301 - RNA, 12 nt, Human
agcucugcaggc

SEQ ID NO: 2857302 - RNA, 20 nt, Human
agcucugcaggcuuaauaaa

SEQ ID NO: 2857303 - RNA, 23 nt, Human
agcucugcaggcuuaauaaaaau

SEQ ID NO: 2857304 - RNA, 16 nt, Human
agcucugcaucuccug

SEQ ID NO: 2857305 - RNA, 19 nt, Human
agcucugcaucuccugucu

SEQ ID NO: 2857306 - RNA, 21 nt, Human
agcucuacccagggccugcag

SEQ ID NO: 2857307 - RNA, 13 nt, Human
agcucuagaaucu

SEQ ID NO: 2857308 - RNA, 14 nt, Human
agcucuagaaucug

SEQ ID NO: 2857309 - RNA, 15 nt, Human
agcucuagaaucugc

SEQ ID NO: 2857310 - RNA, 20 nt, Human
agcucuacccagggccugca

SEQ ID NO: 2857311 - RNA, 19 nt, Human
agcucuacccagggccugc

SEQ ID NO: 2857312 - RNA, 17 nt, Human
agcucuacccagggccu

SEQ ID NO: 2857313 - RNA, 15 nt, Human
agcucuacccagggc

SEQ ID NO: 2857314 - RNA, 13 nt, Human
agcucuacccagg

SEQ ID NO: 2857315 - RNA, 22 nt, Human
agcucuaauaaaacagcugucu

SEQ ID NO: 2857316 - RNA, 22 nt, Human
agcucuggccacaacagggcau

SEQ ID NO: 2857317 - RNA, 16 nt, Human
agcucuguguugccau

SEQ ID NO: 2857318 - RNA, 15 nt, Human
agcucuguguugcca

SEQ ID NO: 2857319 - RNA, 23 nt, Human
agcucuguguugccaugugugcu

SEQ ID NO: 2857320 - RNA, 18 nt, Human
agcucuguguugccaugu

SEQ ID NO: 2857321 - RNA, 16 nt, Human
agcucuguggccacau

SEQ ID NO: 2857322 - RNA, 16 nt, Human
agcucuguugcaauua

SEQ ID NO: 2857323 - RNA, 21 nt, Human
agcucuguugcaauuaggauu

SEQ ID NO: 2857324 - RNA, 18 nt, Human
agcucuucaggccucccu

SEQ ID NO: 2857325 - RNA, 14 nt, Human
agcucuucaucugc

SEQ ID NO: 2857326 - RNA, 17 nt, Human
agcucuucaucugccca

SEQ ID NO: 2857327 - RNA, 18 nt, Human
agcucuucaucugcccaa

SEQ ID NO: 2857328 - RNA, 19 nt, Human
agcucuucaucugcccaac

SEQ ID NO: 2857329 - RNA, 23 nt, Human
agcucuucaucugcccaacugug

SEQ ID NO: 2857330 - RNA, 17 nt, Human
agcucuucaggccuccc

SEQ ID NO: 2857331 - RNA, 16 nt, Human
agcucuucaggccucc

SEQ ID NO: 2857332 - RNA, 15 nt, Human
agcucuucaggccuc

SEQ ID NO: 2857333 - RNA, 13 nt, Human
agcucuucaggcc

SEQ ID NO: 2857334 - RNA, 19 nt, Human
agcuccagcucaccagccc

SEQ ID NO: 2857335 - RNA, 18 nt, Human
agcuccagcucaccagcc

SEQ ID NO: 2857336 - RNA, 21 nt, Human
agcuccagcucaccagcccca

SEQ ID NO: 2857337 - RNA, 21 nt, Human
agcuccagggaauccaagccu

SEQ ID NO: 2857338 - RNA, 21 nt, Human
agcuccaucuccacuccagau

SEQ ID NO: 2857339 - RNA, 19 nt, Human
agcuccaugugccucuuug

SEQ ID NO: 2857340 - RNA, 18 nt, Human
agcucccaagggauggug

SEQ ID NO: 2857341 - RNA, 20 nt, Human
agcucccaagggauggugcc

SEQ ID NO: 2857342 - RNA, 13 nt, Human
agcuccauuuucu

SEQ ID NO: 2857343 - RNA, 22 nt, Human
agcucccaagggauggugcccu

SEQ ID NO: 2857344 - RNA, 23 nt, Human
agcucccaagggauggugcccug

SEQ ID NO: 2857345 - RNA, 23 nt, Human
agcuccuucuguccuacucugug

SEQ ID NO: 2857346 - RNA, 22 nt, Human
agcuccuucuguccuacucugu

SEQ ID NO: 2857347 - RNA, 13 nt, Human
agcuccccagagu

SEQ ID NO: 2857348 - RNA, 18 nt, Human
agcuccccagaguccucu

SEQ ID NO: 2857349 - RNA, 15 nt, Human
ugcccucuccuuccu

SEQ ID NO: 2857350 - RNA, 16 nt, Human
ugcccucuccuuccuu

SEQ ID NO: 2857351 - RNA, 17 nt, Human
ugcccucuccuuccuua

SEQ ID NO: 2857352 - RNA, 21 nt, Human
ugcccucuccuuccuuaccca

SEQ ID NO: 2857353 - RNA, 19 nt, Human
ugcccuccuuguccaccca

SEQ ID NO: 2857354 - RNA, 22 nt, Human
ugcccuccuuguccacccaccu

SEQ ID NO: 2857355 - RNA, 13 nt, Human
ugcccucgcugcu

SEQ ID NO: 2857356 - RNA, 14 nt, Human
ugcccucgcugcuu

SEQ ID NO: 2857357 - RNA, 15 nt, Human
ugcccucgcugcuuc

SEQ ID NO: 2857358 - RNA, 17 nt, Human
ugcccucgcugcuucug

SEQ ID NO: 2857359 - RNA, 14 nt, Human
ugcccuccccucuc

SEQ ID NO: 2857360 - RNA, 17 nt, Human
ugcccuccccucucugc

SEQ ID NO: 2857361 - RNA, 21 nt, Human
ugcccuccccucucugcaccg

SEQ ID NO: 2857362 - RNA, 20 nt, Human
ugcccuaaugcgcaggcugg

SEQ ID NO: 2857363 - RNA, 19 nt, Human
ugcccuaaauaacccuuca

SEQ ID NO: 2857364 - RNA, 22 nt, Human
ugcccuaaccucugagucacca

SEQ ID NO: 2857365 - RNA, 23 nt, Human
ugcccuaacuguacauuucacag

SEQ ID NO: 2857366 - RNA, 19 nt, Human
ugcccuacucauugggguu

SEQ ID NO: 2857367 - RNA, 23 nt, Human
ugcccuaaugcgcaggcuggccc

SEQ ID NO: 2857368 - RNA, 14 nt, Human
ugcccugaggaagg

SEQ ID NO: 2857369 - RNA, 11 nt, Human
ugcccugagaa

SEQ ID NO: 2857370 - RNA, 15 nt, Human
ugcccugagaagcug

SEQ ID NO: 2857371 - RNA, 20 nt, Human
ugcccugagaagcugcucca

SEQ ID NO: 2857372 - RNA, 17 nt, Human
agcuccagcucaccagc

SEQ ID NO: 2857373 - RNA, 13 nt, Human
agcuccagcucac

SEQ ID NO: 2857374 - RNA, 18 nt, Human
agcuccacugucacccuc

SEQ ID NO: 2857375 - RNA, 21 nt, Human
agcuccacugucacccuccac

SEQ ID NO: 2857376 - RNA, 23 nt, Human
agcuccacugucacccuccaccu

SEQ ID NO: 2857377 - RNA, 13 nt, Human
agcuccagagcaa

SEQ ID NO: 2857378 - RNA, 11 nt, Human
agcuccagccc

SEQ ID NO: 2857379 - RNA, 14 nt, Human
agcuccagccccuu

SEQ ID NO: 2857380 - RNA, 16 nt, Human
agcuccagccccuuuc

SEQ ID NO: 2857381 - RNA, 18 nt, Human
agcuccagccccuuucca

SEQ ID NO: 2857382 - RNA, 19 nt, Human
agcuccagccccuuuccaa

SEQ ID NO: 2857383 - RNA, 20 nt, Human
agcuccagccccuuuccaaa

SEQ ID NO: 2857384 - RNA, 21 nt, Human
agcuccagccccuuuccaaaa

SEQ ID NO: 2857385 - RNA, 14 nt, Human
ugccauuuaaaaag

SEQ ID NO: 2857386 - RNA, 17 nt, Human
ugccauuuaaaaaguug

SEQ ID NO: 2857387 - RNA, 14 nt, Human
ugccauuuauuuau

SEQ ID NO: 2857388 - RNA, 22 nt, Human
ugccauuugcacccuccgccuu

SEQ ID NO: 2857389 - RNA, 21 nt, Human
ugccauuugcacccuccgccu

SEQ ID NO: 2857390 - RNA, 19 nt, Human
ugccauuugcacccuccgc

SEQ ID NO: 2857391 - RNA, 12 nt, Human
ugccauuuauuu

SEQ ID NO: 2857392 - RNA, 13 nt, Human
ugccauuugauac

SEQ ID NO: 2857393 - RNA, 14 nt, Human
ugccauuugauacc

SEQ ID NO: 2857394 - RNA, 17 nt, Human
ugccauuugauaccccu

SEQ ID NO: 2857395 - RNA, 20 nt, Human
ugccauuugauaccccuggg

SEQ ID NO: 2857396 - RNA, 18 nt, Human
ugccauuugauuuuucua

SEQ ID NO: 2857397 - RNA, 17 nt, Human
ugccauuugcacccucc

SEQ ID NO: 2857398 - RNA, 16 nt, Human
ugccauuugcacccuc

SEQ ID NO: 2857399 - RNA, 17 nt, Human
agcucaggugucccugc

SEQ ID NO: 2857400 - RNA, 14 nt, Human
agcucaggggcagc

SEQ ID NO: 2857401 - RNA, 16 nt, Human
agcucaggggcagcuc

SEQ ID NO: 2857402 - RNA, 17 nt, Human
agcucaggggcagcuca

SEQ ID NO: 2857403 - RNA, 17 nt, Human
agcucaggaggcuugga

SEQ ID NO: 2857404 - RNA, 17 nt, Human
agcucaggaggcgcccu

SEQ ID NO: 2857405 - RNA, 18 nt, Human
agcucaggaccaggcaau

SEQ ID NO: 2857406 - RNA, 15 nt, Human
agcucaggaggcgcc

SEQ ID NO: 2857407 - RNA, 14 nt, Human
agcucaggaccagg

SEQ ID NO: 2857408 - RNA, 13 nt, Human
agcuauuccuuuc

SEQ ID NO: 2857409 - RNA, 20 nt, Human
agcuauuagccaggaucaug

SEQ ID NO: 2857410 - RNA, 22 nt, Human
agcuauuagccaggaucauggu

SEQ ID NO: 2857411 - RNA, 16 nt, Human
agcuauccuggcucuu

SEQ ID NO: 2857412 - RNA, 17 nt, Human
agcuaucgaacuucaca

SEQ ID NO: 2857413 - RNA, 15 nt, Human
agcuauuacugucug

SEQ ID NO: 2857414 - RNA, 20 nt, Human
agcuauuacugucugguuuu

SEQ ID NO: 2857415 - RNA, 21 nt, Human
agcuauuacugucugguuuua

SEQ ID NO: 2857416 - RNA, 14 nt, Human
agcuauuagccagg

SEQ ID NO: 2857417 - RNA, 18 nt, Human
agcuauuagccaggauca

SEQ ID NO: 2857418 - RNA, 13 nt, Human
agcuauuaaaacu

SEQ ID NO: 2857419 - RNA, 14 nt, Human
agcuauuaaaacuc

SEQ ID NO: 2857420 - RNA, 15 nt, Human
agcuaucuaaaguuu

SEQ ID NO: 2857421 - RNA, 16 nt, Human
agcuaucuaaaguuug

SEQ ID NO: 2857422 - RNA, 18 nt, Human
agcuaucuaaaguuuguu

SEQ ID NO: 2857423 - RNA, 17 nt, Human
agcuaugucaagaggcu

SEQ ID NO: 2857424 - RNA, 18 nt, Human
agcuaugucaagaggcug

SEQ ID NO: 2857425 - RNA, 18 nt, Human
agcuaguucguagcuuuc

SEQ ID NO: 2857426 - RNA, 17 nt, Human
agcuaguucguagcuuu

SEQ ID NO: 2857427 - RNA, 16 nt, Human
agcuaguguaccuccu

SEQ ID NO: 2857428 - RNA, 18 nt, Human
agcuaguguaccuccucu

SEQ ID NO: 2857429 - RNA, 19 nt, Human
agcuaguguaccuccucuc

SEQ ID NO: 2857430 - RNA, 21 nt, Human
agcuaguguaccuccucucag

SEQ ID NO: 2857431 - RNA, 22 nt, Human
agcuaguguaccuccucucagu

SEQ ID NO: 2857432 - RNA, 23 nt, Human
agcuaguguaccuccucucagug

SEQ ID NO: 2857433 - RNA, 15 nt, Human
agcuaucaagaggcu

SEQ ID NO: 2857434 - RNA, 16 nt, Human
agcuaucaagaggcug

SEQ ID NO: 2857435 - RNA, 19 nt, Human
agcuaucaagaggcugaga

SEQ ID NO: 2857436 - RNA, 21 nt, Human
agcuaucaagaggcugagaca

SEQ ID NO: 2857437 - RNA, 14 nt, Human
agcuaucaggaaca

SEQ ID NO: 2857438 - RNA, 18 nt, Human
agcuaucaguaggcuaau

SEQ ID NO: 2857439 - RNA, 15 nt, Human
agcuauccuggcucu

SEQ ID NO: 2857440 - RNA, 20 nt, Human
agcuaucagaagaccacaaa

SEQ ID NO: 2857441 - RNA, 20 nt, Human
agcuaucauugcuuccuccu

SEQ ID NO: 2857442 - RNA, 21 nt, Human
agcuaggccuggccagaugca

SEQ ID NO: 2857443 - RNA, 19 nt, Human
agcuaguaauauauucuga

SEQ ID NO: 2857444 - RNA, 18 nt, Human
agcuaguccuagugaacc

SEQ ID NO: 2857445 - RNA, 15 nt, Human
agcuacccuguguau

SEQ ID NO: 2857446 - RNA, 15 nt, Human
agcuacccuuuuccu

SEQ ID NO: 2857447 - RNA, 19 nt, Human
agcuacccuuuuccuuugu

SEQ ID NO: 2857448 - RNA, 21 nt, Human
agcuacccuuuuccuuugugg

SEQ ID NO: 2857449 - RNA, 22 nt, Human
agcuacccuuuuccuuuguggu

SEQ ID NO: 2857450 - RNA, 16 nt, Human
agcuacccaaaagaga

SEQ ID NO: 2857451 - RNA, 17 nt, Human
agcuacccaaaagagaa

SEQ ID NO: 2857452 - RNA, 19 nt, Human
agcuacccaaaagagaaaa

SEQ ID NO: 2857453 - RNA, 20 nt, Human
agcuacccaaaagagaaaaa

SEQ ID NO: 2857454 - RNA, 17 nt, Human
agcuacccacuauccuu

SEQ ID NO: 2857455 - RNA, 21 nt, Human
agcguauauauaagaaagaca

SEQ ID NO: 2857456 - RNA, 22 nt, Human
agcuacaggaagcaccccaugc

SEQ ID NO: 2857457 - RNA, 14 nt, Human
agcuacaggaagca

SEQ ID NO: 2857458 - RNA, 23 nt, Human
agcuacagagccgagcaauauuu

SEQ ID NO: 2857459 - RNA, 20 nt, Human
agcuacagcuuucuugcucc

SEQ ID NO: 2857460 - RNA, 22 nt, Human
agcuacagcuuucuugcucccu

SEQ ID NO: 2857461 - RNA, 12 nt, Human
ugccccaugccu

SEQ ID NO: 2857462 - RNA, 23 nt, Human
ugccccaugccuguccagccugg

SEQ ID NO: 2857463 - RNA, 15 nt, Human
ugccccaugccuguc

SEQ ID NO: 2857464 - RNA, 14 nt, Human
ugcccccggccccc

SEQ ID NO: 2857465 - RNA, 23 nt, Human
ugccccccaugaggaaggaacag

SEQ ID NO: 2857466 - RNA, 15 nt, Human
ugcccccggcccccu

SEQ ID NO: 2857467 - RNA, 17 nt, Human
ugcccccggcccccugg

SEQ ID NO: 2857468 - RNA, 18 nt, Human
ugcccccggcccccuggu

SEQ ID NO: 2857469 - RNA, 21 nt, Human
ugcccccggcccccuggucuc

SEQ ID NO: 2857470 - RNA, 15 nt, Human
ugccccggccaccuc

SEQ ID NO: 2857471 - RNA, 16 nt, Human
ugccccggccaccucu

SEQ ID NO: 2857472 - RNA, 17 nt, Human
ugccccggccaccucug

SEQ ID NO: 2857473 - RNA, 18 nt, Human
ugccccggccaccucugc

SEQ ID NO: 2857474 - RNA, 23 nt, Human
ugccccggccaccucugcggacc

SEQ ID NO: 2857475 - RNA, 13 nt, Human
ugccccgcccagc

SEQ ID NO: 2857476 - RNA, 13 nt, Human
ugccccggccacc

SEQ ID NO: 2857477 - RNA, 14 nt, Human
ugccccggccaccu

SEQ ID NO: 2857478 - RNA, 18 nt, Human
ugcccccucugcccugcg

SEQ ID NO: 2857479 - RNA, 17 nt, Human
ugcccccucugcccugc

SEQ ID NO: 2857480 - RNA, 16 nt, Human
ugcccccucugcccug

SEQ ID NO: 2857481 - RNA, 15 nt, Human
ugcccccucugcccu

SEQ ID NO: 2857482 - RNA, 14 nt, Human
ugcccccucugccc

SEQ ID NO: 2857483 - RNA, 18 nt, Human
ugcccaggccccugccac

SEQ ID NO: 2857484 - RNA, 17 nt, Human
ugcccaggccccugcca

SEQ ID NO: 2857485 - RNA, 15 nt, Human
ugcccaggccccugc

SEQ ID NO: 2857486 - RNA, 14 nt, Human
ugcccaggccccug

SEQ ID NO: 2857487 - RNA, 22 nt, Human
ugcccagcuauaccugugccuc

SEQ ID NO: 2857488 - RNA, 21 nt, Human
ugcccagcuauaccugugccu

SEQ ID NO: 2857489 - RNA, 20 nt, Human
ugcccagcuauaccugugcc

SEQ ID NO: 2857490 - RNA, 18 nt, Human
ugcccagcuauaccugug

SEQ ID NO: 2857491 - RNA, 18 nt, Human
ugcccaaagucuguguga

SEQ ID NO: 2857492 - RNA, 19 nt, Human
ugcccaaaaauaugguuga

SEQ ID NO: 2857493 - RNA, 16 nt, Human
ugcccaaagagcacaa

SEQ ID NO: 2857494 - RNA, 19 nt, Human
ugcccaaagagcacaaaca

SEQ ID NO: 2857495 - RNA, 23 nt, Human
ugcccaaagagcacaaacauuuu

SEQ ID NO: 2857496 - RNA, 19 nt, Human
agccuucccccucccaggg

SEQ ID NO: 2857497 - RNA, 14 nt, Human
agccucacccuugc

SEQ ID NO: 2857498 - RNA, 22 nt, Human
agcgauucuucugcuucagccu

SEQ ID NO: 2857499 - RNA, 21 nt, Human
agccuugcccggauucuggga

SEQ ID NO: 2857500 - RNA, 14 nt, Human
ugcauucugccucu

SEQ ID NO: 2857501 - RNA, 15 nt, Human
ugcauucugccucuc

SEQ ID NO: 2857502 - RNA, 19 nt, Human
ugcauucugccucucuagg

SEQ ID NO: 2857503 - RNA, 20 nt, Human
ugcauucugccucucuagga

SEQ ID NO: 2857504 - RNA, 23 nt, Human
ugcauuccugauaugauuuaaaa

SEQ ID NO: 2857505 - RNA, 15 nt, Human
ugcauuccuuugucu

SEQ ID NO: 2857506 - RNA, 16 nt, Human
ugcauuccuuugucuu

SEQ ID NO: 2857507 - RNA, 18 nt, Human
ugcauuccuuugucuuca

SEQ ID NO: 2857508 - RNA, 20 nt, Human
ugcauuccuuugucuucaaa

SEQ ID NO: 2857509 - RNA, 13 nt, Human
ugcauucuauugc

SEQ ID NO: 2857510 - RNA, 14 nt, Human
ugcauucuauugcc

SEQ ID NO: 2857511 - RNA, 15 nt, Human
ugcauucuauugccu

SEQ ID NO: 2857512 - RNA, 16 nt, Human
ugcauucuauugccuu

SEQ ID NO: 2857513 - RNA, 17 nt, Human
ugcauucuauugccuuc

SEQ ID NO: 2857514 - RNA, 18 nt, Human
ugcauucuauugccuucu

SEQ ID NO: 2857515 - RNA, 19 nt, Human
ugcauucuauugccuucuu

SEQ ID NO: 2857516 - RNA, 20 nt, Human
ugcauucuauugccuucuuu

SEQ ID NO: 2857517 - RNA, 22 nt, Human
ugcauucuauugccuucuuuga

SEQ ID NO: 2857518 - RNA, 16 nt, Human
ugcauuuauauguacc

SEQ ID NO: 2857519 - RNA, 14 nt, Human
ugcauuuauaugua

SEQ ID NO: 2857520 - RNA, 13 nt, Human
ugcauuuauaugu

SEQ ID NO: 2857521 - RNA, 21 nt, Human
agcgcuuugggaggccgaggc

SEQ ID NO: 2857522 - RNA, 17 nt, Human
agcggaacaaggaguca

SEQ ID NO: 2857523 - RNA, 22 nt, Human
agcggaacaaggagucagacau

SEQ ID NO: 2857524 - RNA, 23 nt, Human
ugcauuauucauuuagugaguua

SEQ ID NO: 2857525 - RNA, 15 nt, Human
ugcauuauucucuuu

SEQ ID NO: 2857526 - RNA, 21 nt, Human
agcgcagcuggacucugcauc

SEQ ID NO: 2857527 - RNA, 19 nt, Human
agcgcagguuuaguuuacu

SEQ ID NO: 2857528 - RNA, 15 nt, Human
agcgccaagugcgug

SEQ ID NO: 2857529 - RNA, 20 nt, Human
agcgccaagugcgugccgug

SEQ ID NO: 2857530 - RNA, 19 nt, Human
agcgcaccugcccccuggu

SEQ ID NO: 2857531 - RNA, 18 nt, Human
agcgcaccugcccccugg

SEQ ID NO: 2857532 - RNA, 21 nt, Human
agcgcaccugcccccuggugg

SEQ ID NO: 2857533 - RNA, 19 nt, Human
agcgcagcagcccuccccg

SEQ ID NO: 2857534 - RNA, 17 nt, Human
agcgcaccugcccccug

SEQ ID NO: 2857535 - RNA, 14 nt, Human
agcgcaccugcccc

SEQ ID NO: 2857536 - RNA, 12 nt, Human
agcgcaccugcc

SEQ ID NO: 2857537 - RNA, 11 nt, Human
ugccagccaca

SEQ ID NO: 2857538 - RNA, 18 nt, Human
ugccagcagcagcaggug

SEQ ID NO: 2857539 - RNA, 17 nt, Human
ugccagcagcagcaggu

SEQ ID NO: 2857540 - RNA, 16 nt, Human
ugccagcagcagcagg

SEQ ID NO: 2857541 - RNA, 15 nt, Human
ugccagcagcagcag

SEQ ID NO: 2857542 - RNA, 10 nt, Human
ugccagcagc

SEQ ID NO: 2857543 - RNA, 14 nt, Human
ugccagcagcagca

SEQ ID NO: 2857544 - RNA, 23 nt, Human
ugccagcaaugacaucucagggg

SEQ ID NO: 2857545 - RNA, 15 nt, Human
ugccagaugcugcag

SEQ ID NO: 2857546 - RNA, 22 nt, Human
ugccagcaaugacaucucaggg

SEQ ID NO: 2857547 - RNA, 23 nt, Human
ugccagaggaauccuggcagccc

SEQ ID NO: 2857548 - RNA, 14 nt, Human
ugccagaggggaag

SEQ ID NO: 2857549 - RNA, 13 nt, Human
ugccacugccucu

SEQ ID NO: 2857550 - RNA, 17 nt, Human
ugccacugccucuuccu

SEQ ID NO: 2857551 - RNA, 22 nt, Human
ugccagaggaauccuggcagcc

SEQ ID NO: 2857552 - RNA, 21 nt, Human
ugccagaggaauccuggcagc

SEQ ID NO: 2857553 - RNA, 20 nt, Human
ugccagaggaauccuggcag

SEQ ID NO: 2857554 - RNA, 12 nt, Human
ugccagagccgg

SEQ ID NO: 2857555 - RNA, 20 nt, Human
ugccacugccucuuccuccc

SEQ ID NO: 2857556 - RNA, 18 nt, Human
ugccacugccucuuccuc

SEQ ID NO: 2857557 - RNA, 19 nt, Human
ugccacugccucuuccucc

SEQ ID NO: 2857558 - RNA, 20 nt, Human
agcggggacagcuccuucug

SEQ ID NO: 2857559 - RNA, 19 nt, Human
agcggggacagcuccuucu

SEQ ID NO: 2857560 - RNA, 20 nt, Human
agcgggaauggcagcugcca

SEQ ID NO: 2857561 - RNA, 22 nt, Human
agcggggacagcuccuucuguc

SEQ ID NO: 2857562 - RNA, 12 nt, Human
agcgggaggcag

SEQ ID NO: 2857563 - RNA, 21 nt, Human
agcggggccccagggcuaccc

SEQ ID NO: 2857564 - RNA, 21 nt, Human
agcgucaggguuggugugcug

SEQ ID NO: 2857565 - RNA, 23 nt, Human
agcgucaggguuggugugcugag

SEQ ID NO: 2857566 - RNA, 15 nt, Human
agcguccagaaaugg

SEQ ID NO: 2857567 - RNA, 13 nt, Human
agcgucccagucu

SEQ ID NO: 2857568 - RNA, 16 nt, Human
agcgucccagucucug

SEQ ID NO: 2857569 - RNA, 18 nt, Human
agcgucccagucucuggc

SEQ ID NO: 2857570 - RNA, 19 nt, Human
agcgucccagucucuggca

SEQ ID NO: 2857571 - RNA, 16 nt, Human
agcgucccuagcagug

SEQ ID NO: 2857572 - RNA, 17 nt, Human
agcgucccuagcaguga

SEQ ID NO: 2857573 - RNA, 18 nt, Human
agcgucccuagcagugaa

SEQ ID NO: 2857574 - RNA, 19 nt, Human
ugccaggaaacucuugcua

SEQ ID NO: 2857575 - RNA, 20 nt, Human
ugccaggaaacucuugcuau

SEQ ID NO: 2857576 - RNA, 14 nt, Human
ugccaggaaccugu

SEQ ID NO: 2857577 - RNA, 20 nt, Human
ugccagucccccugccccag

SEQ ID NO: 2857578 - RNA, 22 nt, Human
ugccaggaaccuguccuaagga

SEQ ID NO: 2857579 - RNA, 21 nt, Human
ugccaggaaccuguccuaagg

SEQ ID NO: 2857580 - RNA, 12 nt, Human
ugcagaacugcc

SEQ ID NO: 2857581 - RNA, 13 nt, Human
ugcagaacugcca

SEQ ID NO: 2857582 - RNA, 14 nt, Human
ugcagaacugccau

SEQ ID NO: 2857583 - RNA, 20 nt, Human
ugcagaacugccauuauuuu

SEQ ID NO: 2857584 - RNA, 21 nt, Human
ugcagaacugccauuauuuuc

SEQ ID NO: 2857585 - RNA, 23 nt, Human
ugcagaacugccauuauuuucug

SEQ ID NO: 2857586 - RNA, 22 nt, Human
ugcagacaggcaagcaccuccu

SEQ ID NO: 2857587 - RNA, 15 nt, Human
ugcagacaugagugc

SEQ ID NO: 2857588 - RNA, 16 nt, Human
ugcacuccucagggca

SEQ ID NO: 2857589 - RNA, 12 nt, Human
ugcacuccucag

SEQ ID NO: 2857590 - RNA, 14 nt, Human
agcccugucgggcu

SEQ ID NO: 2857591 - RNA, 18 nt, Human
agcccugucgggcuuugu

SEQ ID NO: 2857592 - RNA, 22 nt, Human
agcccugucgggcuuuguguga

SEQ ID NO: 2857593 - RNA, 16 nt, Human
agcccuuagcagggaa

SEQ ID NO: 2857594 - RNA, 23 nt, Human
agcccuguggaugagcccucaga

SEQ ID NO: 2857595 - RNA, 22 nt, Human
agcccuguggaugagcccucag

SEQ ID NO: 2857596 - RNA, 19 nt, Human
agcccuguggaugagcccu

SEQ ID NO: 2857597 - RNA, 18 nt, Human
agcccuguggaugagccc

SEQ ID NO: 2857598 - RNA, 17 nt, Human
ugcagacucuacagagg

SEQ ID NO: 2857599 - RNA, 16 nt, Human
ugcagacucuacagag

SEQ ID NO: 2857600 - RNA, 12 nt, Human
agcccuuucugu

SEQ ID NO: 2857601 - RNA, 13 nt, Human
agcccuuucugug

SEQ ID NO: 2857602 - RNA, 16 nt, Human
agcccuuucugugugc

SEQ ID NO: 2857603 - RNA, 17 nt, Human
agcccuuucugugugca

SEQ ID NO: 2857604 - RNA, 18 nt, Human
agcccuuucugugugcac

SEQ ID NO: 2857605 - RNA, 17 nt, Human
agccgagaucacgccac

SEQ ID NO: 2857606 - RNA, 21 nt, Human
agcccuuagcagggaaacagc

SEQ ID NO: 2857607 - RNA, 14 nt, Human
agcccuguugugcc

SEQ ID NO: 2857608 - RNA, 17 nt, Human
agcccuguugugccaca

SEQ ID NO: 2857609 - RNA, 19 nt, Human
agcccuguugugccacaga

SEQ ID NO: 2857610 - RNA, 21 nt, Human
agcccuguugugccacagagu

SEQ ID NO: 2857611 - RNA, 15 nt, Human
agcccuuaucugugc

SEQ ID NO: 2857612 - RNA, 12 nt, Human
agcccuuggguu

SEQ ID NO: 2857613 - RNA, 17 nt, Human
agccucauauuuaaaga

SEQ ID NO: 2857614 - RNA, 19 nt, Human
agccucauauuuaaagaca

SEQ ID NO: 2857615 - RNA, 14 nt, Human
agccucauauuuaa

SEQ ID NO: 2857616 - RNA, 20 nt, Human
agccucauaguuauuaucca

SEQ ID NO: 2857617 - RNA, 15 nt, Human
agccucauauuuaaa

SEQ ID NO: 2857618 - RNA, 16 nt, Human
agccucauauuuaaag

SEQ ID NO: 2857619 - RNA, 22 nt, Human
agccucagucucccucccuugg

SEQ ID NO: 2857620 - RNA, 20 nt, Human
agccucaguccuccccucac

SEQ ID NO: 2857621 - RNA, 18 nt, Human
agccucaguccuccccuc

SEQ ID NO: 2857622 - RNA, 19 nt, Human
agccucaguccuccccuca

SEQ ID NO: 2857623 - RNA, 20 nt, Human
agccucagucucccucccuu

SEQ ID NO: 2857624 - RNA, 19 nt, Human
agccucagucucccucccu

SEQ ID NO: 2857625 - RNA, 16 nt, Human
agccucagucucccuc

SEQ ID NO: 2857626 - RNA, 13 nt, Human
agccucagucucc

SEQ ID NO: 2857627 - RNA, 16 nt, Human
agccucagcuacccac

SEQ ID NO: 2857628 - RNA, 11 nt, Human
agccucagucc

SEQ ID NO: 2857629 - RNA, 15 nt, Human
agccucaguccuccc

SEQ ID NO: 2857630 - RNA, 16 nt, Human
agccucaguccucccc

SEQ ID NO: 2857631 - RNA, 17 nt, Human
agccucaguccuccccu

SEQ ID NO: 2857632 - RNA, 20 nt, Human
agccucacuuggucugccag

SEQ ID NO: 2857633 - RNA, 21 nt, Human
agccucacuuggucugccagg

SEQ ID NO: 2857634 - RNA, 22 nt, Human
agccucacuuggucugccaggc

SEQ ID NO: 2857635 - RNA, 18 nt, Human
agccgagaucacgccacu

SEQ ID NO: 2857636 - RNA, 19 nt, Human
agccucaaccuccugggcu

SEQ ID NO: 2857637 - RNA, 20 nt, Human
agccucaaccuccugggcua

SEQ ID NO: 2857638 - RNA, 23 nt, Human
agcccuuuuguugagccaggccu

SEQ ID NO: 2857639 - RNA, 23 nt, Human
agccucaagguuuuagguucuaa

SEQ ID NO: 2857640 - RNA, 21 nt, Human
agccucaagguuuuagguucu

SEQ ID NO: 2857641 - RNA, 22 nt, Human
agccucaagguuuuagguucua

SEQ ID NO: 2857642 - RNA, 21 nt, Human
agccucacuucuaggguaugg

SEQ ID NO: 2857643 - RNA, 13 nt, Human
agccucacugaua

SEQ ID NO: 2857644 - RNA, 17 nt, Human
agccucacugauauauu

SEQ ID NO: 2857645 - RNA, 21 nt, Human
agccuccaagcuccaucucca

SEQ ID NO: 2857646 - RNA, 21 nt, Human
agccuccacagcgagggcagc

SEQ ID NO: 2857647 - RNA, 15 nt, Human
agccuccacagcgag

SEQ ID NO: 2857648 - RNA, 14 nt, Human
agccuccacagcga

SEQ ID NO: 2857649 - RNA, 13 nt, Human
agccuccacagcg

SEQ ID NO: 2857650 - RNA, 12 nt, Human
agccuccacagc

SEQ ID NO: 2857651 - RNA, 20 nt, Human
agccucauauuuaaagacag

SEQ ID NO: 2857652 - RNA, 23 nt, Human
agccuccacagcgagggcagcug

SEQ ID NO: 2857653 - RNA, 22 nt, Human
agccuccacagcgagggcagcu

SEQ ID NO: 2857654 - RNA, 20 nt, Human
agccuccacugccucuggaa

SEQ ID NO: 2857655 - RNA, 12 nt, Human
agccuccagccu

SEQ ID NO: 2857656 - RNA, 17 nt, Human
agccuccaugcugccuc

SEQ ID NO: 2857657 - RNA, 16 nt, Human
agccuccaguccaagg

SEQ ID NO: 2857658 - RNA, 22 nt, Human
agccuccaguccaaggaaacca

SEQ ID NO: 2857659 - RNA, 13 nt, Human
agccucugcuccc

SEQ ID NO: 2857660 - RNA, 22 nt, Human
agccucugaccccuccucacug

SEQ ID NO: 2857661 - RNA, 12 nt, Human
agccucugaccc

SEQ ID NO: 2857662 - RNA, 15 nt, Human
agccucugaccccuc

SEQ ID NO: 2857663 - RNA, 17 nt, Human
agccucugaccccuccu

SEQ ID NO: 2857664 - RNA, 18 nt, Human
agccucugaccccuccuc

SEQ ID NO: 2857665 - RNA, 19 nt, Human
agccucugaccccuccuca

SEQ ID NO: 2857666 - RNA, 20 nt, Human
agccucugaccccuccucac

SEQ ID NO: 2857667 - RNA, 21 nt, Human
agccucugaccccuccucacu

SEQ ID NO: 2857668 - RNA, 21 nt, Human
ugcagccucaaccuccugggc

SEQ ID NO: 2857669 - RNA, 20 nt, Human
ugcagccucaaccuccuggg

SEQ ID NO: 2857670 - RNA, 22 nt, Human
ugcagccucaaccuccugggcu

SEQ ID NO: 2857671 - RNA, 16 nt, Human
ugcagcucacuacccu

SEQ ID NO: 2857672 - RNA, 22 nt, Human
ugcagcucaaggaaaggccuga

SEQ ID NO: 2857673 - RNA, 21 nt, Human
ugcagcucaaggaaaggccug

SEQ ID NO: 2857674 - RNA, 15 nt, Human
agccucugcucccca

SEQ ID NO: 2857675 - RNA, 16 nt, Human
agccucugcuccccag

SEQ ID NO: 2857676 - RNA, 13 nt, Human
agccucugcugcc

SEQ ID NO: 2857677 - RNA, 12 nt, Human
agccucugcugc

SEQ ID NO: 2857678 - RNA, 18 nt, Human
agccucugcugccauggc

SEQ ID NO: 2857679 - RNA, 14 nt, Human
agccucugcugcca

SEQ ID NO: 2857680 - RNA, 22 nt, Human
agccucuggcauuagaauuauu

SEQ ID NO: 2857681 - RNA, 23 nt, Human
agccucuggcauuagaauuauuu

SEQ ID NO: 2857682 - RNA, 15 nt, Human
agccucuggcuagag

SEQ ID NO: 2857683 - RNA, 14 nt, Human
agccucuggcuaga

SEQ ID NO: 2857684 - RNA, 13 nt, Human
agccucuggcuag

SEQ ID NO: 2857685 - RNA, 12 nt, Human
agccucuggcua

SEQ ID NO: 2857686 - RNA, 20 nt, Human
agccucuggcuagaggccag

SEQ ID NO: 2857687 - RNA, 18 nt, Human
ugauuuguacugaaaaau

SEQ ID NO: 2857688 - RNA, 18 nt, Human
ugauuuguaguggaaaca

SEQ ID NO: 2857689 - RNA, 15 nt, Human
ugauuuguacugaaa

SEQ ID NO: 2857690 - RNA, 16 nt, Human
ugcaaacgcugccugc

SEQ ID NO: 2857691 - RNA, 15 nt, Human
ugcaaacgcugccug

SEQ ID NO: 2857692 - RNA, 14 nt, Human
ugcaaacgcugccu

SEQ ID NO: 2857693 - RNA, 21 nt, Human
ugcaaacgcugccugccggua

SEQ ID NO: 2857694 - RNA, 21 nt, Human
ugcaaacgcugccugcccgua

SEQ ID NO: 2857695 - RNA, 19 nt, Human
ugcaaacgcugccugccca

SEQ ID NO: 2857696 - RNA, 17 nt, Human
ugcaaacgcugccugcc

SEQ ID NO: 2857697 - RNA, 14 nt, Human
ugcaauaacuucug

SEQ ID NO: 2857698 - RNA, 15 nt, Human
ugcaauaacuucuga

SEQ ID NO: 2857699 - RNA, 16 nt, Human
ugcaauaacuucugac

SEQ ID NO: 2857700 - RNA, 17 nt, Human
ugcaauaacuucugacc

SEQ ID NO: 2857701 - RNA, 18 nt, Human
ugcaauaacuucugaccu

SEQ ID NO: 2857702 - RNA, 19 nt, Human
ugcaauaacuucugaccuu

SEQ ID NO: 2857703 - RNA, 16 nt, Human
ugcaagugacaucucu

SEQ ID NO: 2857704 - RNA, 16 nt, Human
ugcaaguccuuuugua

SEQ ID NO: 2857705 - RNA, 17 nt, Human
ugcaaguccuuuuguaa

SEQ ID NO: 2857706 - RNA, 18 nt, Human
ugcaaguccuuuuguaaa

SEQ ID NO: 2857707 - RNA, 19 nt, Human
ugcaaguccuuuuguaaag

SEQ ID NO: 2857708 - RNA, 20 nt, Human
ugcaaguccuuuuguaaagu

SEQ ID NO: 2857709 - RNA, 22 nt, Human
agcccaggagagagaaagccag

SEQ ID NO: 2857710 - RNA, 21 nt, Human
ugcaauagaagugcuccccuc

SEQ ID NO: 2857711 - RNA, 20 nt, Human
ugcaauagaacagagaaaga

SEQ ID NO: 2857712 - RNA, 17 nt, Human
agcccaggagagagaaa

SEQ ID NO: 2857713 - RNA, 18 nt, Human
agcccaggagagagaaag

SEQ ID NO: 2857714 - RNA, 19 nt, Human
agcccaggagagagaaagc

SEQ ID NO: 2857715 - RNA, 22 nt, Human
agccccauucugccugcccagg

SEQ ID NO: 2857716 - RNA, 21 nt, Human
agccccauucugccugcccag

SEQ ID NO: 2857717 - RNA, 20 nt, Human
agccccauucugccugccca

SEQ ID NO: 2857718 - RNA, 13 nt, Human
agcccauuucaau

SEQ ID NO: 2857719 - RNA, 14 nt, Human
agcccauuucucca

SEQ ID NO: 2857720 - RNA, 15 nt, Human
agcccauuucuccag

SEQ ID NO: 2857721 - RNA, 16 nt, Human
agcccauuucuccaga

SEQ ID NO: 2857722 - RNA, 17 nt, Human
agcccauuucuccagaa

SEQ ID NO: 2857723 - RNA, 19 nt, Human
agcccauuucuccagaacc

SEQ ID NO: 2857724 - RNA, 21 nt, Human
agcccauuucuccagaaccca

SEQ ID NO: 2857725 - RNA, 21 nt, Human
agcccaggcgggagcgguggc

SEQ ID NO: 2857726 - RNA, 13 nt, Human
agcccaggcugga

SEQ ID NO: 2857727 - RNA, 20 nt, Human
agcccaggcuggagugcaau

SEQ ID NO: 2857728 - RNA, 19 nt, Human
agcccaggaguuugaggcu

SEQ ID NO: 2857729 - RNA, 11 nt, Human
agcccaggagu

SEQ ID NO: 2857730 - RNA, 22 nt, Human
agcccaggagggcauccauacc

SEQ ID NO: 2857731 - RNA, 23 nt, Human
agcccaggagggcauccauacca

SEQ ID NO: 2857732 - RNA, 18 nt, Human
ugauuuggguuggggaag

SEQ ID NO: 2857733 - RNA, 12 nt, Human
agcccaggccac

SEQ ID NO: 2857734 - RNA, 19 nt, Human
agcccauggcccucccagu

SEQ ID NO: 2857735 - RNA, 16 nt, Human
agcccauggcccugug

SEQ ID NO: 2857736 - RNA, 16 nt, Human
agcccauguucugccc

SEQ ID NO: 2857737 - RNA, 17 nt, Human
agcccauguucugcccc

SEQ ID NO: 2857738 - RNA, 19 nt, Human
agcccauguucugccccca

SEQ ID NO: 2857739 - RNA, 20 nt, Human
agcccauguucugcccccag

SEQ ID NO: 2857740 - RNA, 21 nt, Human
agcccauguucugcccccagc

SEQ ID NO: 2857741 - RNA, 22 nt, Human
agcccauguucugcccccagcc

SEQ ID NO: 2857742 - RNA, 23 nt, Human
agcccauguucugcccccagccc

SEQ ID NO: 2857743 - RNA, 18 nt, Human
ugcacacaccagagccca

SEQ ID NO: 2857744 - RNA, 17 nt, Human
ugcacacaccagagccc

SEQ ID NO: 2857745 - RNA, 21 nt, Human
ugcacacaccagagcccaccu

SEQ ID NO: 2857746 - RNA, 16 nt, Human
agcccugguggcagug

SEQ ID NO: 2857747 - RNA, 15 nt, Human
agcccugguggcagu

SEQ ID NO: 2857748 - RNA, 14 nt, Human
agcccugguggcag

SEQ ID NO: 2857749 - RNA, 12 nt, Human
agcccuggcagg

SEQ ID NO: 2857750 - RNA, 17 nt, Human
agcccuggcaggaugac

SEQ ID NO: 2857751 - RNA, 13 nt, Human
agcccuggcagga

SEQ ID NO: 2857752 - RNA, 19 nt, Human
agcccugcuuugggcugcc

SEQ ID NO: 2857753 - RNA, 14 nt, Human
agcccuggcucugc

SEQ ID NO: 2857754 - RNA, 12 nt, Human
agcccuggcccc

SEQ ID NO: 2857755 - RNA, 15 nt, Human
agcccuggcccccug

SEQ ID NO: 2857756 - RNA, 16 nt, Human
agcccuggcccccuga

SEQ ID NO: 2857757 - RNA, 15 nt, Human
agcccuggcucugca

SEQ ID NO: 2857758 - RNA, 21 nt, Human
agcccuggcaggaugacccug

SEQ ID NO: 2857759 - RNA, 17 nt, Human
agcccugcuuugggcug

SEQ ID NO: 2857760 - RNA, 14 nt, Human
agcccgggagccua

SEQ ID NO: 2857761 - RNA, 15 nt, Human
agcccgggagccuag

SEQ ID NO: 2857762 - RNA, 16 nt, Human
agcccgggagccuagg

SEQ ID NO: 2857763 - RNA, 17 nt, Human
agcccgggagccuagga

SEQ ID NO: 2857764 - RNA, 18 nt, Human
agcccgggagccuaggac

SEQ ID NO: 2857765 - RNA, 20 nt, Human
agcccgggagccuaggacca

SEQ ID NO: 2857766 - RNA, 21 nt, Human
agcccgggagccuaggaccac

SEQ ID NO: 2857767 - RNA, 14 nt, Human
agcccggccgcucc

SEQ ID NO: 2857768 - RNA, 20 nt, Human
agcccggaccuuggcagccc

SEQ ID NO: 2857769 - RNA, 16 nt, Human
agcccggcgccccugc

SEQ ID NO: 2857770 - RNA, 18 nt, Human
agcccggcgccccugcca

SEQ ID NO: 2857771 - RNA, 21 nt, Human
agcccggcgccccugccaccu

SEQ ID NO: 2857772 - RNA, 22 nt, Human
agcccggcgccccugccaccuc

SEQ ID NO: 2857773 - RNA, 15 nt, Human
agcccgcggggacau

SEQ ID NO: 2857774 - RNA, 20 nt, Human
agcccgcggggacauuggga

SEQ ID NO: 2857775 - RNA, 23 nt, Human
agccccuugcucuccccugcccu

SEQ ID NO: 2857776 - RNA, 12 nt, Human
agccccuuucca

SEQ ID NO: 2857777 - RNA, 14 nt, Human
agccccuuuccaaa

SEQ ID NO: 2857778 - RNA, 16 nt, Human
agccccuuuccaaaau

SEQ ID NO: 2857779 - RNA, 13 nt, Human
agcccgccugaca

SEQ ID NO: 2857780 - RNA, 18 nt, Human
agcccgccugacagaaac

SEQ ID NO: 2857781 - RNA, 14 nt, Human
agcccccuggccuc

SEQ ID NO: 2857782 - RNA, 20 nt, Human
agccccugauccugugaagu

SEQ ID NO: 2857783 - RNA, 13 nt, Human
agcccccccuucc

SEQ ID NO: 2857784 - RNA, 15 nt, Human
agcccccccuuccac

SEQ ID NO: 2857785 - RNA, 12 nt, Human
agcccccaggaa

SEQ ID NO: 2857786 - RNA, 13 nt, Human
agcccccaggaag

SEQ ID NO: 2857787 - RNA, 21 nt, Human
agcccccaggaagcccaggag

SEQ ID NO: 2857788 - RNA, 13 nt, Human
ugauuucuauuca

SEQ ID NO: 2857789 - RNA, 14 nt, Human
ugauuucuauucaa

SEQ ID NO: 2857790 - RNA, 20 nt, Human
ugauuucuauucaagguggc

SEQ ID NO: 2857791 - RNA, 23 nt, Human
ugauuuccuugaauguggcuuga

SEQ ID NO: 2857792 - RNA, 19 nt, Human
ugauuuccuugaauguggc

SEQ ID NO: 2857793 - RNA, 17 nt, Human
ugauuuccuugaaugug

SEQ ID NO: 2857794 - RNA, 16 nt, Human
ugauuuccuugaaugu

SEQ ID NO: 2857795 - RNA, 15 nt, Human
ugauuuccuugaaug

SEQ ID NO: 2857796 - RNA, 14 nt, Human
ugauuuccuugaau

SEQ ID NO: 2857797 - RNA, 13 nt, Human
ugauuuccuugaa

SEQ ID NO: 2857798 - RNA, 20 nt, Human
ugauuucuuuucuuccuggc

SEQ ID NO: 2857799 - RNA, 21 nt, Human
ugauuucuuuucuuccuggcu

SEQ ID NO: 2857800 - RNA, 13 nt, Human
ugauuuggugacc

SEQ ID NO: 2857801 - RNA, 19 nt, Human
ugauuuggugaccaacugu

SEQ ID NO: 2857802 - RNA, 20 nt, Human
ugauuuggugaccaacuguc

SEQ ID NO: 2857803 - RNA, 23 nt, Human
ugauuccuaagccacuugaaaug

SEQ ID NO: 2857804 - RNA, 17 nt, Human
ugauuugaagaacaugu

SEQ ID NO: 2857805 - RNA, 21 nt, Human
ugauuuagaacuguaugucag

SEQ ID NO: 2857806 - RNA, 17 nt, Human
ugauuucagcucacugc

SEQ ID NO: 2857807 - RNA, 15 nt, Human
ugauuuauaaacaga

SEQ ID NO: 2857808 - RNA, 17 nt, Human
ugauuuauaaacagaca

SEQ ID NO: 2857809 - RNA, 23 nt, Human
ugauuuauaaacagacaauaugu

SEQ ID NO: 2857810 - RNA, 14 nt, Human
ugauuuccuguguc

SEQ ID NO: 2857811 - RNA, 15 nt, Human
ugauuuccuguguca

SEQ ID NO: 2857812 - RNA, 19 nt, Human
ugauuuccugugucaaucc

SEQ ID NO: 2857813 - RNA, 23 nt, Human
agcccagcuugaaaccuucacuu

SEQ ID NO: 2857814 - RNA, 21 nt, Human
agcccagcuuggcccuuuccu

SEQ ID NO: 2857815 - RNA, 23 nt, Human
agcccagcuuggcccuuuccuuc

SEQ ID NO: 2857816 - RNA, 18 nt, Human
ugauucauaguaacuucu

SEQ ID NO: 2857817 - RNA, 16 nt, Human
ugauucauaguaacuu

SEQ ID NO: 2857818 - RNA, 13 nt, Human
ugauucuccugcc

SEQ ID NO: 2857819 - RNA, 16 nt, Human
ugauucucaugccuca

SEQ ID NO: 2857820 - RNA, 16 nt, Human
ugauuuacagcaagua

SEQ ID NO: 2857821 - RNA, 19 nt, Human
ugauuuacagcaaguagau

SEQ ID NO: 2857822 - RNA, 20 nt, Human
ugauuuacagcaaguagaua

SEQ ID NO: 2857823 - RNA, 22 nt, Human
ugauuuacauauauuauuuauu

SEQ ID NO: 2857824 - RNA, 15 nt, Human
ugauucucaugccuc

SEQ ID NO: 2857825 - RNA, 14 nt, Human
ugauucucaugccu

SEQ ID NO: 2857826 - RNA, 13 nt, Human
ugauucucaugcc

SEQ ID NO: 2857827 - RNA, 21 nt, Human
ugauucucagggucucugcug

SEQ ID NO: 2857828 - RNA, 22 nt, Human
ugauucucagggucucugcugc

SEQ ID NO: 2857829 - RNA, 23 nt, Human
ugauucucagggucucugcugcc

SEQ ID NO: 2857830 - RNA, 23 nt, Human
ugauucccaagcucugcuccucu

SEQ ID NO: 2857831 - RNA, 22 nt, Human
ugauucccaagcucugcuccuc

SEQ ID NO: 2857832 - RNA, 20 nt, Human
ugauucucagggucucugcu

SEQ ID NO: 2857833 - RNA, 19 nt, Human
ugauucauaguaacuucuu

SEQ ID NO: 2857834 - RNA, 19 nt, Human
ugauucaugccaauuagca

SEQ ID NO: 2857835 - RNA, 15 nt, Human
agccaggcucaggcc

SEQ ID NO: 2857836 - RNA, 18 nt, Human
agccaggcucaggccaug

SEQ ID NO: 2857837 - RNA, 20 nt, Human
agccaggcugccaaggccag

SEQ ID NO: 2857838 - RNA, 22 nt, Human
agccagcucccucuauuuaugu

SEQ ID NO: 2857839 - RNA, 21 nt, Human
agccaggcugccaaggccaga

SEQ ID NO: 2857840 - RNA, 14 nt, Human
agccagcucccucu

SEQ ID NO: 2857841 - RNA, 15 nt, Human
agccagcucccucua

SEQ ID NO: 2857842 - RNA, 17 nt, Human
agccagcucccucuauu

SEQ ID NO: 2857843 - RNA, 19 nt, Human
agccagcucccucuauuua

SEQ ID NO: 2857844 - RNA, 23 nt, Human
agccagccuucuuccaucccagg

SEQ ID NO: 2857845 - RNA, 15 nt, Human
agccagcucacagug

SEQ ID NO: 2857846 - RNA, 21 nt, Human
agccagcucacagugcugugu

SEQ ID NO: 2857847 - RNA, 23 nt, Human
agccagcucacagugcugugugc

SEQ ID NO: 2857848 - RNA, 22 nt, Human
agccagcgggaauggcagcugc

SEQ ID NO: 2857849 - RNA, 18 nt, Human
agccaucaaaaugcuuuu

SEQ ID NO: 2857850 - RNA, 18 nt, Human
agccaguaaacagaggag

SEQ ID NO: 2857851 - RNA, 16 nt, Human
agccaucaaaaugcuu

SEQ ID NO: 2857852 - RNA, 16 nt, Human
agccaguaaacagagg

SEQ ID NO: 2857853 - RNA, 11 nt, Human
agccagggcug

SEQ ID NO: 2857854 - RNA, 12 nt, Human
agccagggcugc

SEQ ID NO: 2857855 - RNA, 14 nt, Human
agccagggcugcua

SEQ ID NO: 2857856 - RNA, 21 nt, Human
agccagggcugcuagacggag

SEQ ID NO: 2857857 - RNA, 15 nt, Human
agcccacuucugcca

SEQ ID NO: 2857858 - RNA, 14 nt, Human
agcccacuucugcc

SEQ ID NO: 2857859 - RNA, 13 nt, Human
agcccacuucugc

SEQ ID NO: 2857860 - RNA, 13 nt, Human
agcccagagguaa

SEQ ID NO: 2857861 - RNA, 20 nt, Human
agcccagagguaacagaaca

SEQ ID NO: 2857862 - RNA, 21 nt, Human
agcccagagguaacagaacag

SEQ ID NO: 2857863 - RNA, 15 nt, Human
agcccagagguaaca

SEQ ID NO: 2857864 - RNA, 16 nt, Human
agcccagagguaacag

SEQ ID NO: 2857865 - RNA, 17 nt, Human
agcccagagguaacaga

SEQ ID NO: 2857866 - RNA, 18 nt, Human
agcccagagguaacagaa

SEQ ID NO: 2857867 - RNA, 20 nt, Human
agcccagauugugccacugc

SEQ ID NO: 2857868 - RNA, 21 nt, Human
agcccagauugugccacugcu

SEQ ID NO: 2857869 - RNA, 19 nt, Human
agccaugcugggaagacgc

SEQ ID NO: 2857870 - RNA, 15 nt, Human
agccaugcugggaag

SEQ ID NO: 2857871 - RNA, 15 nt, Human
agccaugcccgcauu

SEQ ID NO: 2857872 - RNA, 22 nt, Human
agccaucucucuacuccuaccu

SEQ ID NO: 2857873 - RNA, 23 nt, Human
ugauggaccagugguuuccaguc

SEQ ID NO: 2857874 - RNA, 19 nt, Human
ugaugggagaguagauggu

SEQ ID NO: 2857875 - RNA, 22 nt, Human
ugauggaaguaaagccucaacc

SEQ ID NO: 2857876 - RNA, 20 nt, Human
ugauggaccuucuagaauua

SEQ ID NO: 2857877 - RNA, 23 nt, Human
ugauggaccuucuagaauuauaa

SEQ ID NO: 2857878 - RNA, 23 nt, Human
ugaugaacuuucucuucauacuu

SEQ ID NO: 2857879 - RNA, 14 nt, Human
ugaugaacuuucuc

SEQ ID NO: 2857880 - RNA, 15 nt, Human
ugaugaacuuucucu

SEQ ID NO: 2857881 - RNA, 17 nt, Human
ugaugaacuuauucugu

SEQ ID NO: 2857882 - RNA, 13 nt, Human
ugaugaacuuucu

SEQ ID NO: 2857883 - RNA, 18 nt, Human
ugaugaaauguaaauacu

SEQ ID NO: 2857884 - RNA, 15 nt, Human
ugaugagaauuucua

SEQ ID NO: 2857885 - RNA, 16 nt, Human
ugaugagaauuucuaa

SEQ ID NO: 2857886 - RNA, 23 nt, Human
ugaugagaauuucuaaaaagauu

SEQ ID NO: 2857887 - RNA, 15 nt, Human
ugaugacuggcauuu

SEQ ID NO: 2857888 - RNA, 17 nt, Human
ugaugacuggcauuuua

SEQ ID NO: 2857889 - RNA, 18 nt, Human
ugaugacuggcauuuuau

SEQ ID NO: 2857890 - RNA, 19 nt, Human
agcaccuccuugucacuuu

SEQ ID NO: 2857891 - RNA, 14 nt, Human
ugaugacagacacu

SEQ ID NO: 2857892 - RNA, 14 nt, Human
ugaugaccaaaguc

SEQ ID NO: 2857893 - RNA, 15 nt, Human
agcaccugccaggga

SEQ ID NO: 2857894 - RNA, 15 nt, Human
ugauccucccaccuc

SEQ ID NO: 2857895 - RNA, 13 nt, Human
ugauccuccaaca

SEQ ID NO: 2857896 - RNA, 14 nt, Human
agcaccugccuccu

SEQ ID NO: 2857897 - RNA, 22 nt, Human
ugauccuaaugaaugcauaaaa

SEQ ID NO: 2857898 - RNA, 21 nt, Human
ugauccucccaccucagccuc

SEQ ID NO: 2857899 - RNA, 16 nt, Human
ugauccucccaccuca

SEQ ID NO: 2857900 - RNA, 22 nt, Human
ugauccucccaccucagccucc

SEQ ID NO: 2857901 - RNA, 13 nt, Human
ugauccugcggag

SEQ ID NO: 2857902 - RNA, 21 nt, Human
ugauccugcggagaacacccu

SEQ ID NO: 2857903 - RNA, 12 nt, Human
ugauccucccac

SEQ ID NO: 2857904 - RNA, 19 nt, Human
ugaugcuugauauuuucua

SEQ ID NO: 2857905 - RNA, 17 nt, Human
ugauuaauggaaauguu

SEQ ID NO: 2857906 - RNA, 16 nt, Human
agccacugcaccgggc

SEQ ID NO: 2857907 - RNA, 19 nt, Human
agccacuccccuccacucu

SEQ ID NO: 2857908 - RNA, 15 nt, Human
agccacuccccucca

SEQ ID NO: 2857909 - RNA, 14 nt, Human
agccacuccccucc

SEQ ID NO: 2857910 - RNA, 14 nt, Human
agccacuagacucu

SEQ ID NO: 2857911 - RNA, 22 nt, Human
agccacuagacucuucacuguu

SEQ ID NO: 2857912 - RNA, 22 nt, Human
agccacucaggaggcugaggca

SEQ ID NO: 2857913 - RNA, 15 nt, Human
agccacucaggaggc

SEQ ID NO: 2857914 - RNA, 16 nt, Human
ugauggucuucagccu

SEQ ID NO: 2857915 - RNA, 15 nt, Human
ugauggugacuuccu

SEQ ID NO: 2857916 - RNA, 14 nt, Human
ugauuaacaaauau

SEQ ID NO: 2857917 - RNA, 15 nt, Human
ugauuaacaaauaug

SEQ ID NO: 2857918 - RNA, 17 nt, Human
ugauuaacaaauaugcu

SEQ ID NO: 2857919 - RNA, 14 nt, Human
ugauuaacagagag

SEQ ID NO: 2857920 - RNA, 17 nt, Human
ugauggugaugaaaugu

SEQ ID NO: 2857921 - RNA, 15 nt, Human
ugauggugaugaaau

SEQ ID NO: 2857922 - RNA, 16 nt, Human
ugauggugaugaaaug

SEQ ID NO: 2857923 - RNA, 19 nt, Human
agccacugcaccgggccac

SEQ ID NO: 2857924 - RNA, 18 nt, Human
agccacugcaccgggcca

SEQ ID NO: 2857925 - RNA, 11 nt, Human
agccagccacu

SEQ ID NO: 2857926 - RNA, 12 nt, Human
agccagccacuc

SEQ ID NO: 2857927 - RNA, 13 nt, Human
agccagccacucu

SEQ ID NO: 2857928 - RNA, 14 nt, Human
agccagccacucua

SEQ ID NO: 2857929 - RNA, 16 nt, Human
agccagccacucuacc

SEQ ID NO: 2857930 - RNA, 21 nt, Human
agccagccacucuaccagugc

SEQ ID NO: 2857931 - RNA, 18 nt, Human
agccagccuucuuccauc

SEQ ID NO: 2857932 - RNA, 21 nt, Human
agccagccuucuuccauccca

SEQ ID NO: 2857933 - RNA, 12 nt, Human
agccagccuggu

SEQ ID NO: 2857934 - RNA, 13 nt, Human
agccagccugguc

SEQ ID NO: 2857935 - RNA, 11 nt, Human
agccagccuga

SEQ ID NO: 2857936 - RNA, 14 nt, Human
agccagccugaccu

SEQ ID NO: 2857937 - RNA, 15 nt, Human
agccagccugaccuu

SEQ ID NO: 2857938 - RNA, 18 nt, Human
agccagccugaccuuccu

SEQ ID NO: 2857939 - RNA, 23 nt, Human
agccagccugaccuuccuuccug

SEQ ID NO: 2857940 - RNA, 23 nt, Human
uggaauugauuugcauugaacac

SEQ ID NO: 2857941 - RNA, 17 nt, Human
uggaauugggagcuugg

SEQ ID NO: 2857942 - RNA, 16 nt, Human
aggcaacauccaaaau

SEQ ID NO: 2857943 - RNA, 15 nt, Human
aggcaaccugauugu

SEQ ID NO: 2857944 - RNA, 19 nt, Human
aggcaaccugauuguaaac

SEQ ID NO: 2857945 - RNA, 17 nt, Human
aggcaaauguguacaug

SEQ ID NO: 2857946 - RNA, 19 nt, Human
aggcaaauguuuaaacauu

SEQ ID NO: 2857947 - RNA, 14 nt, Human
aggcaaauguguac

SEQ ID NO: 2857948 - RNA, 13 nt, Human
aggcaaaauugca

SEQ ID NO: 2857949 - RNA, 19 nt, Human
aggcaaaauccuugcuuau

SEQ ID NO: 2857950 - RNA, 17 nt, Human
aggcaaaauccuugcuu

SEQ ID NO: 2857951 - RNA, 18 nt, Human
aggaugauaaguuccuuu

SEQ ID NO: 2857952 - RNA, 19 nt, Human
aggauuuugauccaagcug

SEQ ID NO: 2857953 - RNA, 17 nt, Human
aggaugccccguccccc

SEQ ID NO: 2857954 - RNA, 15 nt, Human
aggauuuuuaucuuu

SEQ ID NO: 2857955 - RNA, 15 nt, Human
aggcaaaaauguaaa

SEQ ID NO: 2857956 - RNA, 21 nt, Human
aggauuuuuuuuuuuuuuuga

SEQ ID NO: 2857957 - RNA, 13 nt, Human
uggaccccagaga

SEQ ID NO: 2857958 - RNA, 16 nt, Human
uggacccagggaacag

SEQ ID NO: 2857959 - RNA, 17 nt, Human
uggaccaguggugccuu

SEQ ID NO: 2857960 - RNA, 19 nt, Human
uggaccagugguuuccagu

SEQ ID NO: 2857961 - RNA, 14 nt, Human
uggacccaaggaaa

SEQ ID NO: 2857962 - RNA, 15 nt, Human
uggacccaaggaaaa

SEQ ID NO: 2857963 - RNA, 20 nt, Human
uggacccaaggaaaacugca

SEQ ID NO: 2857964 - RNA, 21 nt, Human
uggacccaaggaaaacugcau

SEQ ID NO: 2857965 - RNA, 18 nt, Human
uggaccaguggucucaca

SEQ ID NO: 2857966 - RNA, 13 nt, Human
uggaccagugguc

SEQ ID NO: 2857967 - RNA, 16 nt, Human
uggacacagcucuucu

SEQ ID NO: 2857968 - RNA, 15 nt, Human
uggacacagcucuuc

SEQ ID NO: 2857969 - RNA, 18 nt, Human
uggacacagcucuucucc

SEQ ID NO: 2857970 - RNA, 19 nt, Human
uggaauuuaccaguuaauu

SEQ ID NO: 2857971 - RNA, 18 nt, Human
uggaauuuauaauucagu

SEQ ID NO: 2857972 - RNA, 20 nt, Human
uggaauuuauaauucaguau

SEQ ID NO: 2857973 - RNA, 20 nt, Human
uggaccucuacuuuccaggc

SEQ ID NO: 2857974 - RNA, 21 nt, Human
aggagggagcaucagugcccu

SEQ ID NO: 2857975 - RNA, 13 nt, Human
aggauaagugaaa

SEQ ID NO: 2857976 - RNA, 19 nt, Human
aggaugagcucuacccagg

SEQ ID NO: 2857977 - RNA, 20 nt, Human
aggaugagcucuacccaggg

SEQ ID NO: 2857978 - RNA, 23 nt, Human
uggaaauauucaugcuucuuccu

SEQ ID NO: 2857979 - RNA, 18 nt, Human
aggagcugccuuggcuca

SEQ ID NO: 2857980 - RNA, 19 nt, Human
aggagcugccuuggcucag

SEQ ID NO: 2857981 - RNA, 23 nt, Human
aggagcugccuuggcucagacau

SEQ ID NO: 2857982 - RNA, 21 nt, Human
aggagcugccuuggcucagac

SEQ ID NO: 2857983 - RNA, 22 nt, Human
aggagcugccuuggcucagaca

SEQ ID NO: 2857984 - RNA, 21 nt, Human
uggaaauucaggugaaaaugu

SEQ ID NO: 2857985 - RNA, 23 nt, Human
aggagggagacacuggccccuca

SEQ ID NO: 2857986 - RNA, 16 nt, Human
aggagggagacacugg

SEQ ID NO: 2857987 - RNA, 17 nt, Human
aggaggcaugccucuga

SEQ ID NO: 2857988 - RNA, 20 nt, Human
aggaggcagagguugcagug

SEQ ID NO: 2857989 - RNA, 20 nt, Human
aggaggcuuggaaagcauca

SEQ ID NO: 2857990 - RNA, 23 nt, Human
aggaggauugcuugagcccagga

SEQ ID NO: 2857991 - RNA, 22 nt, Human
aggaggcagaauaagaaaacaa

SEQ ID NO: 2857992 - RNA, 21 nt, Human
aggaggauugcuugagcccag

SEQ ID NO: 2857993 - RNA, 20 nt, Human
aggaggauugcuugagccca

SEQ ID NO: 2857994 - RNA, 15 nt, Human
aggaggaugucccug

SEQ ID NO: 2857995 - RNA, 17 nt, Human
aggaggaugucccuggg

SEQ ID NO: 2857996 - RNA, 20 nt, Human
aggaggaugucccugggcca

SEQ ID NO: 2857997 - RNA, 21 nt, Human
aggaggaugucccugggccag

SEQ ID NO: 2857998 - RNA, 16 nt, Human
aggagcugcuggcuug

SEQ ID NO: 2857999 - RNA, 14 nt, Human
aggagcugcuggcu

SEQ ID NO: 2858000 - RNA, 16 nt, Human
aggaggagcuucuggg

SEQ ID NO: 2858001 - RNA, 13 nt, Human
aggagcugcuggc

SEQ ID NO: 2858002 - RNA, 12 nt, Human
aggagcugcugg

SEQ ID NO: 2858003 - RNA, 17 nt, Human
ugcuugccacagagcgg

SEQ ID NO: 2858004 - RNA, 13 nt, Human
aggagcgcaagau

SEQ ID NO: 2858005 - RNA, 17 nt, Human
aggagcgcaagauagau

SEQ ID NO: 2858006 - RNA, 19 nt, Human
aggagccuuuuuaaaacac

SEQ ID NO: 2858007 - RNA, 16 nt, Human
aggagccuuuuuaaaa

SEQ ID NO: 2858008 - RNA, 12 nt, Human
aggagcuaaggc

SEQ ID NO: 2858009 - RNA, 13 nt, Human
aggagcuaaggcu

SEQ ID NO: 2858010 - RNA, 14 nt, Human
aggagcuaaggcuc

SEQ ID NO: 2858011 - RNA, 15 nt, Human
aggagcuaaggcucu

SEQ ID NO: 2858012 - RNA, 14 nt, Human
aggagccugcuggu

SEQ ID NO: 2858013 - RNA, 11 nt, Human
aggagccuggc

SEQ ID NO: 2858014 - RNA, 22 nt, Human
aggagccugcuggucacagccu

SEQ ID NO: 2858015 - RNA, 13 nt, Human
aggagcccucauc

SEQ ID NO: 2858016 - RNA, 18 nt, Human
ugcuugcucauaugcaug

SEQ ID NO: 2858017 - RNA, 19 nt, Human
ugcuugccugcguuuugga

SEQ ID NO: 2858018 - RNA, 17 nt, Human
ugcuuugggcugcccug

SEQ ID NO: 2858019 - RNA, 18 nt, Human
ugcuuugggcugcccugg

SEQ ID NO: 2858020 - RNA, 19 nt, Human
ugcuuugggcugcccuggu

SEQ ID NO: 2858021 - RNA, 20 nt, Human
ugcuuugggcugcccuggug

SEQ ID NO: 2858022 - RNA, 21 nt, Human
ugcuuugggcugcccuggugc

SEQ ID NO: 2858023 - RNA, 12 nt, Human
ugcuuuuaauua

SEQ ID NO: 2858024 - RNA, 13 nt, Human
ugcuuuuaauuaa

SEQ ID NO: 2858025 - RNA, 16 nt, Human
ugcuuuuaauuaaaua

SEQ ID NO: 2858026 - RNA, 12 nt, Human
ugcuuuuauauc

SEQ ID NO: 2858027 - RNA, 15 nt, Human
ugcuuuuauaucugu

SEQ ID NO: 2858028 - RNA, 20 nt, Human
ugcuuuuauaucuguaugua

SEQ ID NO: 2858029 - RNA, 14 nt, Human
ugcuuuuauuuuga

SEQ ID NO: 2858030 - RNA, 15 nt, Human
ugcuuuuauuuugaa

SEQ ID NO: 2858031 - RNA, 16 nt, Human
ugcuuuuauuuugaaa

SEQ ID NO: 2858032 - RNA, 21 nt, Human
ugcuuuuauuuugaaaagcuu

SEQ ID NO: 2858033 - RNA, 18 nt, Human
uggaaagccucugcugcc

SEQ ID NO: 2858034 - RNA, 16 nt, Human
uggaaagccucugcug

SEQ ID NO: 2858035 - RNA, 15 nt, Human
uggaaagccucugcu

SEQ ID NO: 2858036 - RNA, 14 nt, Human
uggaaagccucugc

SEQ ID NO: 2858037 - RNA, 12 nt, Human
uggaaagccucu

SEQ ID NO: 2858038 - RNA, 13 nt, Human
ugcuuuucccucu

SEQ ID NO: 2858039 - RNA, 14 nt, Human
ugcuuuucccucuu

SEQ ID NO: 2858040 - RNA, 19 nt, Human
ugcuuuucccucuuuucuu

SEQ ID NO: 2858041 - RNA, 18 nt, Human
aggacuuugaggcaagug

SEQ ID NO: 2858042 - RNA, 23 nt, Human
aggacuuugaggcaagugugggc

SEQ ID NO: 2858043 - RNA, 22 nt, Human
aggacuuugauugcacauuguu

SEQ ID NO: 2858044 - RNA, 23 nt, Human
aggacuuuucuuuguggcuuccu

SEQ ID NO: 2858045 - RNA, 15 nt, Human
aggagauugagaagg

SEQ ID NO: 2858046 - RNA, 16 nt, Human
aggagauugagaagga

SEQ ID NO: 2858047 - RNA, 17 nt, Human
aggagauugagaaggag

SEQ ID NO: 2858048 - RNA, 19 nt, Human
aggagauugagaaggagag

SEQ ID NO: 2858049 - RNA, 21 nt, Human
aggagauugagaaggagagaa

SEQ ID NO: 2858050 - RNA, 22 nt, Human
aggagauugagaaggagagaaa

SEQ ID NO: 2858051 - RNA, 13 nt, Human
aggagauugagaa

SEQ ID NO: 2858052 - RNA, 17 nt, Human
aggagaaacacuugaac

SEQ ID NO: 2858053 - RNA, 20 nt, Human
aggagaaacacuugaaccug

SEQ ID NO: 2858054 - RNA, 22 nt, Human
aggagccccgaggccuucucug

SEQ ID NO: 2858055 - RNA, 14 nt, Human
aggagccagacaga

SEQ ID NO: 2858056 - RNA, 15 nt, Human
aggagccagacagac

SEQ ID NO: 2858057 - RNA, 16 nt, Human
aggagccagacagacc

SEQ ID NO: 2858058 - RNA, 12 nt, Human
aggagccaggca

SEQ ID NO: 2858059 - RNA, 13 nt, Human
aggagccaggcaa

SEQ ID NO: 2858060 - RNA, 19 nt, Human
aggagccaggcaacuucag

SEQ ID NO: 2858061 - RNA, 15 nt, Human
aggagcaaaggcuga

SEQ ID NO: 2858062 - RNA, 16 nt, Human
aggagcaaaggcugag

SEQ ID NO: 2858063 - RNA, 16 nt, Human
aggagcagccucagaa

SEQ ID NO: 2858064 - RNA, 19 nt, Human
aggagcagccucagaacaa

SEQ ID NO: 2858065 - RNA, 19 nt, Human
aggagcaggagccugagcc

SEQ ID NO: 2858066 - RNA, 19 nt, Human
aggagcagugcaggcacag

SEQ ID NO: 2858067 - RNA, 14 nt, Human
aggagcagugcagg

SEQ ID NO: 2858068 - RNA, 16 nt, Human
aggagcagugcaggca

SEQ ID NO: 2858069 - RNA, 16 nt, Human
aggacuugugucucug

SEQ ID NO: 2858070 - RNA, 13 nt, Human
aggacuugugucu

SEQ ID NO: 2858071 - RNA, 13 nt, Human
aggacugagcccc

SEQ ID NO: 2858072 - RNA, 16 nt, Human
aggacugagccccgca

SEQ ID NO: 2858073 - RNA, 24 nt, Human
aggacugagccccgcagaccuccc

SEQ ID NO: 2858074 - RNA, 12 nt, Human
aggacugaggga

SEQ ID NO: 2858075 - RNA, 18 nt, Human
aggacugagggacucuga

SEQ ID NO: 2858076 - RNA, 18 nt, Human
aggacauugcggacagcc

SEQ ID NO: 2858077 - RNA, 17 nt, Human
aggacauugcggacagc

SEQ ID NO: 2858078 - RNA, 15 nt, Human
aggacauugcggaca

SEQ ID NO: 2858079 - RNA, 15 nt, Human
aggacauguuuuugu

SEQ ID NO: 2858080 - RNA, 16 nt, Human
aggacauguuuuuguu

SEQ ID NO: 2858081 - RNA, 21 nt, Human
aggacauguuuuuguuuucuu

SEQ ID NO: 2858082 - RNA, 23 nt, Human
aggacauguuuuuguuuucuuug

SEQ ID NO: 2858083 - RNA, 15 nt, Human
aggacauuaugugug

SEQ ID NO: 2858084 - RNA, 16 nt, Human
aggacauuaugugugc

SEQ ID NO: 2858085 - RNA, 17 nt, Human
aggacauuaugugugca

SEQ ID NO: 2858086 - RNA, 23 nt, Human
aggacauugcggacagccacggc

SEQ ID NO: 2858087 - RNA, 19 nt, Human
aggacauugcggacagcca

SEQ ID NO: 2858088 - RNA, 19 nt, Human
aggacucugccuccucuuc

SEQ ID NO: 2858089 - RNA, 14 nt, Human
aggacauucuugua

SEQ ID NO: 2858090 - RNA, 18 nt, Human
ugcuucauaaaugaagca

SEQ ID NO: 2858091 - RNA, 20 nt, Human
ugcuucauaaaugaagcagc

SEQ ID NO: 2858092 - RNA, 17 nt, Human
ugcuucaucauucccuc

SEQ ID NO: 2858093 - RNA, 23 nt, Human
ugcuucaucauucccucucaucu

SEQ ID NO: 2858094 - RNA, 19 nt, Human
aggacacuaaccacgcugg

SEQ ID NO: 2858095 - RNA, 23 nt, Human
aggacacuaaccacgcuggaccu

SEQ ID NO: 2858096 - RNA, 22 nt, Human
ugcuucacaguagagccagcuu

SEQ ID NO: 2858097 - RNA, 18 nt, Human
ugcuucaguggagaauua

SEQ ID NO: 2858098 - RNA, 16 nt, Human
ugcuucaguggagaau

SEQ ID NO: 2858099 - RNA, 23 nt, Human
ugcuucagccugaggcugagacu

SEQ ID NO: 2858100 - RNA, 22 nt, Human
ugcuucagccugaggcugagac

SEQ ID NO: 2858101 - RNA, 17 nt, Human
ugcuucagccugaggcu

SEQ ID NO: 2858102 - RNA, 15 nt, Human
ugcuucagccugagg

SEQ ID NO: 2858103 - RNA, 14 nt, Human
ugcuucagccugag

SEQ ID NO: 2858104 - RNA, 12 nt, Human
ugcuucagccug

SEQ ID NO: 2858105 - RNA, 22 nt, Human
aggacagggaggugaccccagg

SEQ ID NO: 2858106 - RNA, 20 nt, Human
aggacaggcgggaggaggug

SEQ ID NO: 2858107 - RNA, 21 nt, Human
aggacaugauggagcgcaccu

SEQ ID NO: 2858108 - RNA, 13 nt, Human
aggacaugaaacu

SEQ ID NO: 2858109 - RNA, 18 nt, Human
aggacaugaaacuccacc

SEQ ID NO: 2858110 - RNA, 17 nt, Human
aggacaugaugcuuuua

SEQ ID NO: 2858111 - RNA, 17 nt, Human
aggacaugcugaagcca

SEQ ID NO: 2858112 - RNA, 20 nt, Human
aggacauccccccgccaaaa

SEQ ID NO: 2858113 - RNA, 22 nt, Human
aggacaucagcaaacaggauca

SEQ ID NO: 2858114 - RNA, 16 nt, Human
aggacaucagcaaaca

SEQ ID NO: 2858115 - RNA, 15 nt, Human
aggacaucagcaaac

SEQ ID NO: 2858116 - RNA, 21 nt, Human
aggacauagagguauauugga

SEQ ID NO: 2858117 - RNA, 22 nt, Human
aggacauagagguauauuggaa

SEQ ID NO: 2858118 - RNA, 12 nt, Human
aggacaucagca

SEQ ID NO: 2858119 - RNA, 14 nt, Human
aggacaucagcaaa

SEQ ID NO: 2858120 - RNA, 13 nt, Human
aggacaucagcaa

SEQ ID NO: 2858121 - RNA, 14 nt, Human
ugcuucagccuccc

SEQ ID NO: 2858122 - RNA, 13 nt, Human
ugcuucagccucc

SEQ ID NO: 2858123 - RNA, 14 nt, Human
ugcuuauugcuuag

SEQ ID NO: 2858124 - RNA, 23 nt, Human
ugcuucaauuaauaaaaaaugga

SEQ ID NO: 2858125 - RNA, 21 nt, Human
ugcuucacaguagagccagcu

SEQ ID NO: 2858126 - RNA, 20 nt, Human
ugcuucacaguagagccagc

SEQ ID NO: 2858127 - RNA, 20 nt, Human
ugcuucagauauuauugcuu

SEQ ID NO: 2858128 - RNA, 19 nt, Human
ugcuucagauguggagcca

SEQ ID NO: 2858129 - RNA, 20 nt, Human
ugcuucagauguggagccag

SEQ ID NO: 2858130 - RNA, 21 nt, Human
ugcuucagauguggagccagg

SEQ ID NO: 2858131 - RNA, 22 nt, Human
ugcuucagauguggagccaggc

SEQ ID NO: 2858132 - RNA, 16 nt, Human
ugcuucacaguagagc

SEQ ID NO: 2858133 - RNA, 13 nt, Human
ugcuucacaguag

SEQ ID NO: 2858134 - RNA, 18 nt, Human
ugcuuauagguggccucu

SEQ ID NO: 2858135 - RNA, 21 nt, Human
ugcuuaugacaucacuuguac

SEQ ID NO: 2858136 - RNA, 17 nt, Human
ugcuuauagguggccuc

SEQ ID NO: 2858137 - RNA, 22 nt, Human
ugcugucaugaaaucagcaaga

SEQ ID NO: 2858138 - RNA, 23 nt, Human
ugcugugagucuuugguucuaag

SEQ ID NO: 2858139 - RNA, 20 nt, Human
ugcuuaguguacuuggagua

SEQ ID NO: 2858140 - RNA, 15 nt, Human
ugcugucuucuggac

SEQ ID NO: 2858141 - RNA, 19 nt, Human
ugcugccgccccacccaga

SEQ ID NO: 2858142 - RNA, 13 nt, Human
aggaauuugggac

SEQ ID NO: 2858143 - RNA, 20 nt, Human
aggaauuugggacccugcuu

SEQ ID NO: 2858144 - RNA, 14 nt, Human
aggaauuuuaaaaa

SEQ ID NO: 2858145 - RNA, 18 nt, Human
ugcuggcuguuggcuggg

SEQ ID NO: 2858146 - RNA, 15 nt, Human
ugcuggcugccuuag

SEQ ID NO: 2858147 - RNA, 14 nt, Human
ugcuggcugccuua

SEQ ID NO: 2858148 - RNA, 21 nt, Human
ugcuggcugccuuagaaccuu

SEQ ID NO: 2858149 - RNA, 14 nt, Human
ugcuggagguggga

SEQ ID NO: 2858150 - RNA, 15 nt, Human
ugcuggaggugggag

SEQ ID NO: 2858151 - RNA, 18 nt, Human
ugcuggccagccuggggc

SEQ ID NO: 2858152 - RNA, 21 nt, Human
ugcuggccagccuggggccug

SEQ ID NO: 2858153 - RNA, 22 nt, Human
ugcuggccagccuggggccugg

SEQ ID NO: 2858154 - RNA, 23 nt, Human
ugcuggccagccuggggccuggc

SEQ ID NO: 2858155 - RNA, 21 nt, Human
ugcuguacaucuauuuuggau

SEQ ID NO: 2858156 - RNA, 17 nt, Human
ugcuguacaucuauuuu

SEQ ID NO: 2858157 - RNA, 16 nt, Human
ugcuguacaucuauuu

SEQ ID NO: 2858158 - RNA, 15 nt, Human
ugcuguacaucuauu

SEQ ID NO: 2858159 - RNA, 16 nt, Human
ugcugggauggugggc

SEQ ID NO: 2858160 - RNA, 19 nt, Human
ugcugggauggugggcuuc

SEQ ID NO: 2858161 - RNA, 17 nt, Human
ugcugggacuggccagg

SEQ ID NO: 2858162 - RNA, 15 nt, Human
ugcugggacuggcca

SEQ ID NO: 2858163 - RNA, 17 nt, Human
ugcuguccaugcuucuc

SEQ ID NO: 2858164 - RNA, 12 nt, Human
ugcugucccucc

SEQ ID NO: 2858165 - RNA, 13 nt, Human
ugcugucccuccc

SEQ ID NO: 2858166 - RNA, 16 nt, Human
ugcugucccucccccu

SEQ ID NO: 2858167 - RNA, 17 nt, Human
ugcugucccucccccuu

SEQ ID NO: 2858168 - RNA, 20 nt, Human
ugcugucaaguuccuuuggg

SEQ ID NO: 2858169 - RNA, 15 nt, Human
ugcugucaccucucc

SEQ ID NO: 2858170 - RNA, 21 nt, Human
ugcugucaccucucccacggg

SEQ ID NO: 2858171 - RNA, 15 nt, Human
ugcuguaagaugucu

SEQ ID NO: 2858172 - RNA, 17 nt, Human
ugcuguaagaugucugu

SEQ ID NO: 2858173 - RNA, 22 nt, Human
ugcuguaagaugucuguuugcu

SEQ ID NO: 2858174 - RNA, 14 nt, Human
ugcuguccugaucu

SEQ ID NO: 2858175 - RNA, 16 nt, Human
ugcuguccugaucugu

SEQ ID NO: 2858176 - RNA, 19 nt, Human
ugcuguccugaucugugau

SEQ ID NO: 2858177 - RNA, 14 nt, Human
ugcuguccuugaau

SEQ ID NO: 2858178 - RNA, 19 nt, Human
ugcuguccuugaaugccau

SEQ ID NO: 2858179 - RNA, 14 nt, Human
ugcugucucugcuc

SEQ ID NO: 2858180 - RNA, 15 nt, Human
ugcugucucugcucg

SEQ ID NO: 2858181 - RNA, 16 nt, Human
ugcugucucugcucgc

SEQ ID NO: 2858182 - RNA, 19 nt, Human
ugcugucucugcucgcccu

SEQ ID NO: 2858183 - RNA, 12 nt, Human
ugcugucugcag

SEQ ID NO: 2858184 - RNA, 13 nt, Human
ugcugucugcagc

SEQ ID NO: 2858185 - RNA, 14 nt, Human
ugcugucugcagcc

SEQ ID NO: 2858186 - RNA, 15 nt, Human
ugcugucugcagccu

SEQ ID NO: 2858187 - RNA, 17 nt, Human
ugcugucugcagccuug

SEQ ID NO: 2858188 - RNA, 23 nt, Human
ugcuguccuaggccacaccaucu

SEQ ID NO: 2858189 - RNA, 16 nt, Human
ugcuguccuaggccac

SEQ ID NO: 2858190 - RNA, 20 nt, Human
ugcuguccccuuggcagguc

SEQ ID NO: 2858191 - RNA, 14 nt, Human
ugcuguccuaggcc

SEQ ID NO: 2858192 - RNA, 14 nt, Human
aggaauuuauaccu

SEQ ID NO: 2858193 - RNA, 15 nt, Human
aggaauuuauaccuc

SEQ ID NO: 2858194 - RNA, 17 nt, Human
aggaaggagagccugcu

SEQ ID NO: 2858195 - RNA, 15 nt, Human
aggaaggagagccug

SEQ ID NO: 2858196 - RNA, 18 nt, Human
aggaaggagagccugcug

SEQ ID NO: 2858197 - RNA, 18 nt, Human
aggaagcaccccaugcca

SEQ ID NO: 2858198 - RNA, 19 nt, Human
ugcuauuuauuuuccuaaa

SEQ ID NO: 2858199 - RNA, 20 nt, Human
ugcuauuuauuuuuacaaga

SEQ ID NO: 2858200 - RNA, 18 nt, Human
ugcuauuuauuuuccuaa

SEQ ID NO: 2858201 - RNA, 15 nt, Human
ugcuccaccacaucc

SEQ ID NO: 2858202 - RNA, 14 nt, Human
ugcuccaccacauc

SEQ ID NO: 2858203 - RNA, 16 nt, Human
ugcuauuuauuuuccu

SEQ ID NO: 2858204 - RNA, 11 nt, Human
ugccucugcca

SEQ ID NO: 2858205 - RNA, 20 nt, Human
ugcuauuguuacucuuacga

SEQ ID NO: 2858206 - RNA, 18 nt, Human
agcugggacuacaggcac

SEQ ID NO: 2858207 - RNA, 16 nt, Human
agcugggacuacaggc

SEQ ID NO: 2858208 - RNA, 19 nt, Human
agcugggacuacaggcacc

SEQ ID NO: 2858209 - RNA, 23 nt, Human
ugcuccagcaacacagccugggc

SEQ ID NO: 2858210 - RNA, 19 nt, Human
ugcuccagcaacacagccu

SEQ ID NO: 2858211 - RNA, 15 nt, Human
ugcuccagcaacaca

SEQ ID NO: 2858212 - RNA, 19 nt, Human
ugcuccacccuuggccugu

SEQ ID NO: 2858213 - RNA, 18 nt, Human
ugcuccacccuuggccug

SEQ ID NO: 2858214 - RNA, 17 nt, Human
ugcuccacccuuggccu

SEQ ID NO: 2858215 - RNA, 16 nt, Human
ugcuccacccuuggcc

SEQ ID NO: 2858216 - RNA, 23 nt, Human
ugcuccacccuuggccugucuca

SEQ ID NO: 2858217 - RNA, 21 nt, Human
ugcuccaccuuucagcccacg

SEQ ID NO: 2858218 - RNA, 22 nt, Human
ugcuccaccuuucagcccacgu

SEQ ID NO: 2858219 - RNA, 18 nt, Human
ugcuccacgcgcuucgac

SEQ ID NO: 2858220 - RNA, 14 nt, Human
ugcuccagaauuug

SEQ ID NO: 2858221 - RNA, 19 nt, Human
ugcuccagaauuuggaaau

SEQ ID NO: 2858222 - RNA, 20 nt, Human
ugcuccagaauuuggaaauc

SEQ ID NO: 2858223 - RNA, 21 nt, Human
ugcuccagaauuuggaaaucc

SEQ ID NO: 2858224 - RNA, 22 nt, Human
ugcuccagaauuuggaaauccu

SEQ ID NO: 2858225 - RNA, 22 nt, Human
ugcuccacccuuggccugucuc

SEQ ID NO: 2858226 - RNA, 23 nt, Human
ugcugacuccacgauccugccac

SEQ ID NO: 2858227 - RNA, 16 nt, Human
ugcucugcugacagac

SEQ ID NO: 2858228 - RNA, 15 nt, Human
ugcuccgcugcuccu

SEQ ID NO: 2858229 - RNA, 18 nt, Human
ugcuccgcugcuccuugg

SEQ ID NO: 2858230 - RNA, 20 nt, Human
ugcuccgcugcuccuuggcu

SEQ ID NO: 2858231 - RNA, 21 nt, Human
ugcuccgcugcuccuuggcuu

SEQ ID NO: 2858232 - RNA, 23 nt, Human
ugcuccgcugcuccuuggcuuac

SEQ ID NO: 2858233 - RNA, 15 nt, Human
ugcucccucuccccc

SEQ ID NO: 2858234 - RNA, 16 nt, Human
ugcugaccaauugugc

SEQ ID NO: 2858235 - RNA, 18 nt, Human
ugcugaccaauugugcug

SEQ ID NO: 2858236 - RNA, 20 nt, Human
ugcugaccaauugugcugcc

SEQ ID NO: 2858237 - RNA, 21 nt, Human
ugcugaccaauugugcugcca

SEQ ID NO: 2858238 - RNA, 22 nt, Human
ugcugaccaauugugcugccau

SEQ ID NO: 2858239 - RNA, 23 nt, Human
ugcugaccaauugugcugccauu

SEQ ID NO: 2858240 - RNA, 21 nt, Human
ugcugaccucagcgguugcca

SEQ ID NO: 2858241 - RNA, 22 nt, Human
ugcucugcugacagacacaggc

SEQ ID NO: 2858242 - RNA, 21 nt, Human
ugcucugcugacagacacagg

SEQ ID NO: 2858243 - RNA, 12 nt, Human
ugcucccugugu

SEQ ID NO: 2858244 - RNA, 17 nt, Human
ugcucccuguguccacc

SEQ ID NO: 2858245 - RNA, 23 nt, Human
ugcucccuguguccaccuguggg

SEQ ID NO: 2858246 - RNA, 15 nt, Human
ugcucccuucagccc

SEQ ID NO: 2858247 - RNA, 16 nt, Human
ugcucccuucagcccc

SEQ ID NO: 2858248 - RNA, 18 nt, Human
ugcucccugguucugaug

SEQ ID NO: 2858249 - RNA, 22 nt, Human
ugcucccugaagccagccuucu

SEQ ID NO: 2858250 - RNA, 18 nt, Human
ugcucccugaagccagcc

SEQ ID NO: 2858251 - RNA, 19 nt, Human
ugcucccugaagccagccu

SEQ ID NO: 2858252 - RNA, 20 nt, Human
ugcucccugaagccagccuu

SEQ ID NO: 2858253 - RNA, 21 nt, Human
ugcucccugaagccagccuuc

SEQ ID NO: 2858254 - RNA, 16 nt, Human
ugcuccccagcccugg

SEQ ID NO: 2858255 - RNA, 17 nt, Human
ugcuccccagcccuggc

SEQ ID NO: 2858256 - RNA, 18 nt, Human
ugcuccccagcccuggcu

SEQ ID NO: 2858257 - RNA, 22 nt, Human
ugcuccccagcccuggcucugc

SEQ ID NO: 2858258 - RNA, 23 nt, Human
ugcuccccagcccuggcucugca

SEQ ID NO: 2858259 - RNA, 19 nt, Human
ugcucccuccccugcccug

SEQ ID NO: 2858260 - RNA, 18 nt, Human
ugcucccuccccugcccu

SEQ ID NO: 2858261 - RNA, 20 nt, Human
ugcucccuccccugcccugg

SEQ ID NO: 2858262 - RNA, 13 nt, Human
ugcucccugaagc

SEQ ID NO: 2858263 - RNA, 14 nt, Human
ugcucccugaagcc

SEQ ID NO: 2858264 - RNA, 15 nt, Human
ugcucccugaagcca

SEQ ID NO: 2858265 - RNA, 17 nt, Human
ugcucccugaagccagc

SEQ ID NO: 2858266 - RNA, 17 nt, Human
uggcuucccgcucagcc

SEQ ID NO: 2858267 - RNA, 15 nt, Human
uggcuucccaugucu

SEQ ID NO: 2858268 - RNA, 17 nt, Human
uggcuucccaugucuuu

SEQ ID NO: 2858269 - RNA, 15 nt, Human
uggcuucccgcucag

SEQ ID NO: 2858270 - RNA, 16 nt, Human
uggcuucccgcucagc

SEQ ID NO: 2858271 - RNA, 16 nt, Human
uggcuuccaugauggu

SEQ ID NO: 2858272 - RNA, 21 nt, Human
ugggaacgcagaugauccaug

SEQ ID NO: 2858273 - RNA, 14 nt, Human
ugggaaccucccag

SEQ ID NO: 2858274 - RNA, 15 nt, Human
ugggaaccucccaga

SEQ ID NO: 2858275 - RNA, 17 nt, Human
ugggaaccucccagagg

SEQ ID NO: 2858276 - RNA, 19 nt, Human
ugggaaccucccagagguc

SEQ ID NO: 2858277 - RNA, 21 nt, Human
ugggaaccucccagaggucca

SEQ ID NO: 2858278 - RNA, 22 nt, Human
ugggaaccucccagagguccag

SEQ ID NO: 2858279 - RNA, 21 nt, Human
ugggaaaggaggcaugccucu

SEQ ID NO: 2858280 - RNA, 21 nt, Human
ugggaagccuuuacugacccu

SEQ ID NO: 2858281 - RNA, 15 nt, Human
ugggaagcugagggc

SEQ ID NO: 2858282 - RNA, 20 nt, Human
ugggaagcugagggcaaauc

SEQ ID NO: 2858283 - RNA, 19 nt, Human
ugggaaggggacccccgcc

SEQ ID NO: 2858284 - RNA, 22 nt, Human
ugggaaggccucuuggagaccu

SEQ ID NO: 2858285 - RNA, 23 nt, Human
ugggaaguugcauuccuuugucu

SEQ ID NO: 2858286 - RNA, 22 nt, Human
ugggaaggggacccccgccccc

SEQ ID NO: 2858287 - RNA, 20 nt, Human
ugggaagggucauagaaagg

SEQ ID NO: 2858288 - RNA, 15 nt, Human
ugggaagugaagacu

SEQ ID NO: 2858289 - RNA, 21 nt, Human
ugggaagacgccugagcucac

SEQ ID NO: 2858290 - RNA, 18 nt, Human
ugggaagacgccugagcu

SEQ ID NO: 2858291 - RNA, 19 nt, Human
ugggaagacgccugagcuc

SEQ ID NO: 2858292 - RNA, 13 nt, Human
ugggaacucugac

SEQ ID NO: 2858293 - RNA, 16 nt, Human
ugggaacucugacaag

SEQ ID NO: 2858294 - RNA, 22 nt, Human
ugggaacucugacaagggcuga

SEQ ID NO: 2858295 - RNA, 15 nt, Human
ugggaacucaccugg

SEQ ID NO: 2858296 - RNA, 17 nt, Human
ugggaacucaccugggg

SEQ ID NO: 2858297 - RNA, 18 nt, Human
ugggaacucaccuggggc

SEQ ID NO: 2858298 - RNA, 24 nt, Human
ugggaacgcagaugauccaugagu

SEQ ID NO: 2858299 - RNA, 13 nt, Human
ugggaacuagacu

SEQ ID NO: 2858300 - RNA, 17 nt, Human
uggcuuaaaacaacacu

SEQ ID NO: 2858301 - RNA, 15 nt, Human
uggcuguuggcuggg

SEQ ID NO: 2858302 - RNA, 13 nt, Human
uggcuguuggcug

SEQ ID NO: 2858303 - RNA, 15 nt, Human
uggcuuauccagcug

SEQ ID NO: 2858304 - RNA, 19 nt, Human
uggcuuaccugaccucuug

SEQ ID NO: 2858305 - RNA, 21 nt, Human
uggcuuaccugaccucuugcu

SEQ ID NO: 2858306 - RNA, 22 nt, Human
uggcuuaccugaccucuugcug

SEQ ID NO: 2858307 - RNA, 18 nt, Human
uggcuguuggcagugagu

SEQ ID NO: 2858308 - RNA, 19 nt, Human
uggcugcaguccgugugga

SEQ ID NO: 2858309 - RNA, 13 nt, Human
uggcuuaaauaua

SEQ ID NO: 2858310 - RNA, 19 nt, Human
uggcuuaaauauaguuccu

SEQ ID NO: 2858311 - RNA, 22 nt, Human
uggcuuaaauauaguuccuaag

SEQ ID NO: 2858312 - RNA, 16 nt, Human
uggcuuauagguguug

SEQ ID NO: 2858313 - RNA, 14 nt, Human
uggcuuauuuuaau

SEQ ID NO: 2858314 - RNA, 18 nt, Human
uggcuuauuuuaauguga

SEQ ID NO: 2858315 - RNA, 19 nt, Human
uggcuuauuuuaaugugau

SEQ ID NO: 2858316 - RNA, 12 nt, Human
uggcuucagcuc

SEQ ID NO: 2858317 - RNA, 13 nt, Human
uggcuucagcucc

SEQ ID NO: 2858318 - RNA, 14 nt, Human
uggcuucagcucca

SEQ ID NO: 2858319 - RNA, 16 nt, Human
uggcuucagcuccagc

SEQ ID NO: 2858320 - RNA, 17 nt, Human
uggcuucagcuccagcc

SEQ ID NO: 2858321 - RNA, 18 nt, Human
uggcuucagcuccagccc

SEQ ID NO: 2858322 - RNA, 19 nt, Human
uggcuucagcuccagcccc

SEQ ID NO: 2858323 - RNA, 20 nt, Human
uggcuucagcuccagccccu

SEQ ID NO: 2858324 - RNA, 21 nt, Human
uggcuucagcuccagccccuu

SEQ ID NO: 2858325 - RNA, 22 nt, Human
uggcuuccagaaaaccccagca

SEQ ID NO: 2858326 - RNA, 16 nt, Human
uggcuucaucugucaa

SEQ ID NO: 2858327 - RNA, 18 nt, Human
uggcuucauuagagcagg

SEQ ID NO: 2858328 - RNA, 23 nt, Human
uggcuuccagaaaaccccagcau

SEQ ID NO: 2858329 - RNA, 20 nt, Human
uggcuucauuagagcaggcg

SEQ ID NO: 2858330 - RNA, 20 nt, Human
aggcuggcgugcaguggugc

SEQ ID NO: 2858331 - RNA, 18 nt, Human
aggcuggcgugcaguggu

SEQ ID NO: 2858332 - RNA, 17 nt, Human
aggcugggaccacguga

SEQ ID NO: 2858333 - RNA, 21 nt, Human
uggcuagaguccucacuccca

SEQ ID NO: 2858334 - RNA, 18 nt, Human
uggcuagaguccucacuc

SEQ ID NO: 2858335 - RNA, 16 nt, Human
uggcuagaguccucac

SEQ ID NO: 2858336 - RNA, 15 nt, Human
uggcuagaguccuca

SEQ ID NO: 2858337 - RNA, 22 nt, Human
uggcuauuagagaucaaccccu

SEQ ID NO: 2858338 - RNA, 17 nt, Human
uggcugccccaaccugc

SEQ ID NO: 2858339 - RNA, 20 nt, Human
uggcugccccaaccugcuga

SEQ ID NO: 2858340 - RNA, 14 nt, Human
uggcugcagggagu

SEQ ID NO: 2858341 - RNA, 13 nt, Human
uggcugcagggag

SEQ ID NO: 2858342 - RNA, 15 nt, Human
uggcugcagggaguc

SEQ ID NO: 2858343 - RNA, 18 nt, Human
uggcucaaguccucuuuu

SEQ ID NO: 2858344 - RNA, 12 nt, Human
uggcugcaaagg

SEQ ID NO: 2858345 - RNA, 23 nt, Human
uggcugaggaggccuccaucuca

SEQ ID NO: 2858346 - RNA, 17 nt, Human
uggcugaggaggccucc

SEQ ID NO: 2858347 - RNA, 15 nt, Human
uggcucuucugccca

SEQ ID NO: 2858348 - RNA, 13 nt, Human
uggcugagggcag

SEQ ID NO: 2858349 - RNA, 14 nt, Human
uggcugagggcagc

SEQ ID NO: 2858350 - RNA, 15 nt, Human
uggcugagggcagcu

SEQ ID NO: 2858351 - RNA, 23 nt, Human
uggcugagggcagcugcgcgggc

SEQ ID NO: 2858352 - RNA, 19 nt, Human
aggcuccuuuagcgcccag

SEQ ID NO: 2858353 - RNA, 12 nt, Human
aggcuccugucc

SEQ ID NO: 2858354 - RNA, 12 nt, Human
aggcuccuguua

SEQ ID NO: 2858355 - RNA, 21 nt, Human
aggcuccuguuagcuccucac

SEQ ID NO: 2858356 - RNA, 21 nt, Human
aggcuccugccaguguggaac

SEQ ID NO: 2858357 - RNA, 13 nt, Human
aggcuccugccac

SEQ ID NO: 2858358 - RNA, 20 nt, Human
aggcuccugccaccacgccc

SEQ ID NO: 2858359 - RNA, 12 nt, Human
aggccugggugg

SEQ ID NO: 2858360 - RNA, 23 nt, Human
aggccuggguggaucggccuccu

SEQ ID NO: 2858361 - RNA, 13 nt, Human
aggccugucugug

SEQ ID NO: 2858362 - RNA, 14 nt, Human
aggccugucuguga

SEQ ID NO: 2858363 - RNA, 17 nt, Human
aggccugucugugaccu

SEQ ID NO: 2858364 - RNA, 22 nt, Human
aggccugucugugaccugcauc

SEQ ID NO: 2858365 - RNA, 14 nt, Human
aggcuccugccacc

SEQ ID NO: 2858366 - RNA, 17 nt, Human
aggcucuagaucauaag

SEQ ID NO: 2858367 - RNA, 19 nt, Human
aggcucuaugagucuagau

SEQ ID NO: 2858368 - RNA, 20 nt, Human
aggcucucaacaggggagag

SEQ ID NO: 2858369 - RNA, 20 nt, Human
aggcucuaugagucuagaug

SEQ ID NO: 2858370 - RNA, 21 nt, Human
aggcucuaugagucuagaugu

SEQ ID NO: 2858371 - RNA, 20 nt, Human
aggcucugagagucuagauu

SEQ ID NO: 2858372 - RNA, 21 nt, Human
aggcucugagagucuagauuc

SEQ ID NO: 2858373 - RNA, 22 nt, Human
aggcucugagagucuagauucu

SEQ ID NO: 2858374 - RNA, 23 nt, Human
aggcucugagagucuagauucuc

SEQ ID NO: 2858375 - RNA, 23 nt, Human
aggcucuccuugcuccuggccuu

SEQ ID NO: 2858376 - RNA, 19 nt, Human
aggcucugacccagugaga

SEQ ID NO: 2858377 - RNA, 13 nt, Human
aggcucugagagu

SEQ ID NO: 2858378 - RNA, 16 nt, Human
aggcucugagagucua

SEQ ID NO: 2858379 - RNA, 19 nt, Human
aggcucugagagucuagau

SEQ ID NO: 2858380 - RNA, 11 nt, Human
aggcucugccu

SEQ ID NO: 2858381 - RNA, 13 nt, Human
aggcucugccuuc

SEQ ID NO: 2858382 - RNA, 14 nt, Human
aggcucugccuucg

SEQ ID NO: 2858383 - RNA, 22 nt, Human
aggcucugccuucgaggucaga

SEQ ID NO: 2858384 - RNA, 16 nt, Human
aggcucugcuucucca

SEQ ID NO: 2858385 - RNA, 22 nt, Human
aggcucugcuucuccaaggaaa

SEQ ID NO: 2858386 - RNA, 13 nt, Human
aggcugcuuggga

SEQ ID NO: 2858387 - RNA, 23 nt, Human
aggcugcucuugaacuccugacc

SEQ ID NO: 2858388 - RNA, 22 nt, Human
aggcugcugggauggugggcuu

SEQ ID NO: 2858389 - RNA, 18 nt, Human
aggcugcuggggccucag

SEQ ID NO: 2858390 - RNA, 20 nt, Human
aggcugcuggggccucagac

SEQ ID NO: 2858391 - RNA, 22 nt, Human
aggcugcuggggccucagacga

SEQ ID NO: 2858392 - RNA, 17 nt, Human
aggcuggcgugcagugg

SEQ ID NO: 2858393 - RNA, 13 nt, Human
aggcuggcgugca

SEQ ID NO: 2858394 - RNA, 19 nt, Human
aggcuggcccugcccuggu

SEQ ID NO: 2858395 - RNA, 14 nt, Human
aggcuggcccugcc

SEQ ID NO: 2858396 - RNA, 12 nt, Human
aggcuggcccug

SEQ ID NO: 2858397 - RNA, 18 nt, Human
aggcuggcccugcccugg

SEQ ID NO: 2858398 - RNA, 17 nt, Human
aggcuggcccugcccug

SEQ ID NO: 2858399 - RNA, 16 nt, Human
aggcuggcccugcccu

SEQ ID NO: 2858400 - RNA, 15 nt, Human
aggcuggcccugccc

SEQ ID NO: 2858401 - RNA, 20 nt, Human
aggcuggaguggaguggcgu

SEQ ID NO: 2858402 - RNA, 18 nt, Human
aggcuggaguugucacug

SEQ ID NO: 2858403 - RNA, 23 nt, Human
aggcuggaguugucacugcuuuu

SEQ ID NO: 2858404 - RNA, 18 nt, Human
aggcuggaguacaguggu

SEQ ID NO: 2858405 - RNA, 20 nt, Human
aggcuggagugcaguggcgu

SEQ ID NO: 2858406 - RNA, 16 nt, Human
aggcuggacaugcuga

SEQ ID NO: 2858407 - RNA, 17 nt, Human
aggcuggacaugcugac

SEQ ID NO: 2858408 - RNA, 18 nt, Human
aggcuggacaugcugacu

SEQ ID NO: 2858409 - RNA, 14 nt, Human
aggcuggccagccg

SEQ ID NO: 2858410 - RNA, 15 nt, Human
aggcuggccagccgc

SEQ ID NO: 2858411 - RNA, 16 nt, Human
aggcuggccagccgcu

SEQ ID NO: 2858412 - RNA, 17 nt, Human
aggcuggccagccgcuc

SEQ ID NO: 2858413 - RNA, 18 nt, Human
aggcuggccagccgcucu

SEQ ID NO: 2858414 - RNA, 12 nt, Human
aggcuggccagc

SEQ ID NO: 2858415 - RNA, 15 nt, Human
aggcuggcagguaug

SEQ ID NO: 2858416 - RNA, 13 nt, Human
uggaccuuuuaaa

SEQ ID NO: 2858417 - RNA, 15 nt, Human
uggaccuuuuaaagu

SEQ ID NO: 2858418 - RNA, 21 nt, Human
uggaccuuuuaaaguguuuca

SEQ ID NO: 2858419 - RNA, 13 nt, Human
aggccaaaaaaau

SEQ ID NO: 2858420 - RNA, 11 nt, Human
aggcauuuguu

SEQ ID NO: 2858421 - RNA, 12 nt, Human
aggccaaacugc

SEQ ID NO: 2858422 - RNA, 13 nt, Human
aggccaaacugcu

SEQ ID NO: 2858423 - RNA, 14 nt, Human
aggccaaacugcug

SEQ ID NO: 2858424 - RNA, 17 nt, Human
aggccaaacugcuggac

SEQ ID NO: 2858425 - RNA, 16 nt, Human
aggccaaaggcuggug

SEQ ID NO: 2858426 - RNA, 17 nt, Human
aggccaaaggcuggugg

SEQ ID NO: 2858427 - RNA, 17 nt, Human
aggccaacacugugggu

SEQ ID NO: 2858428 - RNA, 23 nt, Human
aggccaacacuguggguguguga

SEQ ID NO: 2858429 - RNA, 17 nt, Human
aggccaagaaacgucuu

SEQ ID NO: 2858430 - RNA, 14 nt, Human
aggccaagaaacgu

SEQ ID NO: 2858431 - RNA, 19 nt, Human
uggaugccugguggcagcu

SEQ ID NO: 2858432 - RNA, 18 nt, Human
uggaugccugguggcagc

SEQ ID NO: 2858433 - RNA, 20 nt, Human
uggaugccugguggcagcug

SEQ ID NO: 2858434 - RNA, 15 nt, Human
uggaugccugguggc

SEQ ID NO: 2858435 - RNA, 21 nt, Human
aggccaagaaacgucuucuaa

SEQ ID NO: 2858436 - RNA, 23 nt, Human
aggccaaguccgcagaagcccug

SEQ ID NO: 2858437 - RNA, 18 nt, Human
aggccaagucaggcccuu

SEQ ID NO: 2858438 - RNA, 21 nt, Human
uggaguccccucaccuccucu

SEQ ID NO: 2858439 - RNA, 14 nt, Human
uggaguccccucac

SEQ ID NO: 2858440 - RNA, 15 nt, Human
uggaguccccucacc

SEQ ID NO: 2858441 - RNA, 19 nt, Human
uggaguccccucaccuccu

SEQ ID NO: 2858442 - RNA, 20 nt, Human
uggaguccccucaccuccuc

SEQ ID NO: 2858443 - RNA, 14 nt, Human
uggaguaugucuga

SEQ ID NO: 2858444 - RNA, 18 nt, Human
uggaguaugucugaugga

SEQ ID NO: 2858445 - RNA, 21 nt, Human
uggaguaugucugauggaucc

SEQ ID NO: 2858446 - RNA, 19 nt, Human
uggagucagacagaugugg

SEQ ID NO: 2858447 - RNA, 17 nt, Human
uggaugucugccaauuu

SEQ ID NO: 2858448 - RNA, 20 nt, Human
uggaugucugccaauuuuug

SEQ ID NO: 2858449 - RNA, 15 nt, Human
uggaugucugaacuu

SEQ ID NO: 2858450 - RNA, 16 nt, Human
uggaugucugaacuuu

SEQ ID NO: 2858451 - RNA, 18 nt, Human
uggauggucauugcaguu

SEQ ID NO: 2858452 - RNA, 16 nt, Human
uggcacccggccccug

SEQ ID NO: 2858453 - RNA, 15 nt, Human
uggcacccggccccu

SEQ ID NO: 2858454 - RNA, 11 nt, Human
uggcagcccag

SEQ ID NO: 2858455 - RNA, 20 nt, Human
uggcagauaaucagccucuu

SEQ ID NO: 2858456 - RNA, 19 nt, Human
uggcagauaaucagccucu

SEQ ID NO: 2858457 - RNA, 18 nt, Human
uggcagaguuuguguguu

SEQ ID NO: 2858458 - RNA, 22 nt, Human
uggcagaguuuguguguugucu

SEQ ID NO: 2858459 - RNA, 17 nt, Human
uggcagaguuugugugu

SEQ ID NO: 2858460 - RNA, 19 nt, Human
aggccacgugauguggagg

SEQ ID NO: 2858461 - RNA, 23 nt, Human
aggccacgugauguggagggcac

SEQ ID NO: 2858462 - RNA, 22 nt, Human
aggccacaccaucuccuuucag

SEQ ID NO: 2858463 - RNA, 21 nt, Human
aggccacaccaucuccuuuca

SEQ ID NO: 2858464 - RNA, 22 nt, Human
aggccaccauauucagugcugu

SEQ ID NO: 2858465 - RNA, 14 nt, Human
aggccacaugggag

SEQ ID NO: 2858466 - RNA, 21 nt, Human
aggccacaugggagcagucca

SEQ ID NO: 2858467 - RNA, 16 nt, Human
uggcagccucuucaaa

SEQ ID NO: 2858468 - RNA, 15 nt, Human
uggcagccucuucaa

SEQ ID NO: 2858469 - RNA, 15 nt, Human
uggauguugugugua

SEQ ID NO: 2858470 - RNA, 22 nt, Human
uggcagccgugccuucagcucu

SEQ ID NO: 2858471 - RNA, 23 nt, Human
uggcagccgugccuucagcucua

SEQ ID NO: 2858472 - RNA, 12 nt, Human
uggcagcccaga

SEQ ID NO: 2858473 - RNA, 17 nt, Human
uggcagcccuguaggga

SEQ ID NO: 2858474 - RNA, 14 nt, Human
uggcagcccuguag

SEQ ID NO: 2858475 - RNA, 12 nt, Human
uggcagcccugu

SEQ ID NO: 2858476 - RNA, 11 nt, Human
uggcagcccug

SEQ ID NO: 2858477 - RNA, 17 nt, Human
aggccucaccucuaccc

SEQ ID NO: 2858478 - RNA, 18 nt, Human
aggccucaccucuaccca

SEQ ID NO: 2858479 - RNA, 19 nt, Human
aggccucaccucuacccaa

SEQ ID NO: 2858480 - RNA, 18 nt, Human
aggccuauguugauccau

SEQ ID NO: 2858481 - RNA, 12 nt, Human
aggccucucuca

SEQ ID NO: 2858482 - RNA, 20 nt, Human
aggccucucaccucugugcc

SEQ ID NO: 2858483 - RNA, 13 nt, Human
aggccucuguguc

SEQ ID NO: 2858484 - RNA, 17 nt, Human
aggccuccaucucaugu

SEQ ID NO: 2858485 - RNA, 13 nt, Human
aggccucccucaa

SEQ ID NO: 2858486 - RNA, 22 nt, Human
aggccucccucucucuucugcu

SEQ ID NO: 2858487 - RNA, 15 nt, Human
aggccucccucucuc

SEQ ID NO: 2858488 - RNA, 15 nt, Human
aggccucccuagcca

SEQ ID NO: 2858489 - RNA, 16 nt, Human
uggccaaauuauuugu

SEQ ID NO: 2858490 - RNA, 18 nt, Human
uggccaaauuauuugugu

SEQ ID NO: 2858491 - RNA, 20 nt, Human
uggccaaauuauuuguguaa

SEQ ID NO: 2858492 - RNA, 16 nt, Human
uggcauggauuucugu

SEQ ID NO: 2858493 - RNA, 12 nt, Human
aggccugcacac

SEQ ID NO: 2858494 - RNA, 13 nt, Human
aggccugcacaca

SEQ ID NO: 2858495 - RNA, 14 nt, Human
aggccugcacacaa

SEQ ID NO: 2858496 - RNA, 24 nt, Human
aggccugcacacaagcccacagca

SEQ ID NO: 2858497 - RNA, 13 nt, Human
aggccugccuguu

SEQ ID NO: 2858498 - RNA, 15 nt, Human
uggcaugcaccugca

SEQ ID NO: 2858499 - RNA, 17 nt, Human
uggccaggcuggucuca

SEQ ID NO: 2858500 - RNA, 15 nt, Human
uggccaggcuggucu

SEQ ID NO: 2858501 - RNA, 20 nt, Human
uggccaggcuggucucgaac

SEQ ID NO: 2858502 - RNA, 23 nt, Human
uggccagggccuggaagacagag

SEQ ID NO: 2858503 - RNA, 17 nt, Human
uggccuggccaggagcu

SEQ ID NO: 2858504 - RNA, 16 nt, Human
uggccuggccaggagc

SEQ ID NO: 2858505 - RNA, 15 nt, Human
uggccuggccaggag

SEQ ID NO: 2858506 - RNA, 13 nt, Human
uggccuggccagg

SEQ ID NO: 2858507 - RNA, 21 nt, Human
uggccuggccaggagcucuuc

SEQ ID NO: 2858508 - RNA, 18 nt, Human
uggccuggccaggagcuc

SEQ ID NO: 2858509 - RNA, 12 nt, Human
uggccuggccag

SEQ ID NO: 2858510 - RNA, 18 nt, Human
uggccuggcacacaucag

SEQ ID NO: 2858511 - RNA, 10 nt, Human
uggccuggcc

SEQ ID NO: 2858512 - RNA, 12 nt, Human
uggccuggcaca

SEQ ID NO: 2858513 - RNA, 16 nt, Human
uggccuggcacacauc

SEQ ID NO: 2858514 - RNA, 21 nt, Human
aggccuggccagaugcaccag

SEQ ID NO: 2858515 - RNA, 17 nt, Human
aggccuggccagaugca

SEQ ID NO: 2858516 - RNA, 16 nt, Human
aggccuggccagaugc

SEQ ID NO: 2858517 - RNA, 15 nt, Human
aggccuggccagaug

SEQ ID NO: 2858518 - RNA, 23 nt, Human
aggccuggccagaugcaccagcc

SEQ ID NO: 2858519 - RNA, 22 nt, Human
aggccuggccagaugcaccagc

SEQ ID NO: 2858520 - RNA, 21 nt, Human
uggccccugcccggcugcgga

SEQ ID NO: 2858521 - RNA, 16 nt, Human
uggccccuuugggccc

SEQ ID NO: 2858522 - RNA, 19 nt, Human
uggccccuuugggcccugc

SEQ ID NO: 2858523 - RNA, 20 nt, Human
uggccccuuugggcccugca

SEQ ID NO: 2858524 - RNA, 21 nt, Human
uggccccuuugggcccugcau

SEQ ID NO: 2858525 - RNA, 23 nt, Human
uggccccuuugggcccugcaugu

SEQ ID NO: 2858526 - RNA, 12 nt, Human
uggccccugggu

SEQ ID NO: 2858527 - RNA, 14 nt, Human
uggcccggaugcug

SEQ ID NO: 2858528 - RNA, 17 nt, Human
uggcccggaugcugcuu

SEQ ID NO: 2858529 - RNA, 18 nt, Human
uggcccgacagccuggca

SEQ ID NO: 2858530 - RNA, 19 nt, Human
uggcccgacagccuggcac

SEQ ID NO: 2858531 - RNA, 14 nt, Human
uggcccgacagccu

SEQ ID NO: 2858532 - RNA, 15 nt, Human
uggcccgacagccug

SEQ ID NO: 2858533 - RNA, 16 nt, Human
uggcccgacagccugg

SEQ ID NO: 2858534 - RNA, 17 nt, Human
uggcccgacagccuggc

SEQ ID NO: 2858535 - RNA, 19 nt, Human
uggccgcguuuagaccaag

SEQ ID NO: 2858536 - RNA, 21 nt, Human
uggccgcccccugccccccag

SEQ ID NO: 2858537 - RNA, 23 nt, Human
uggccgcccccugccccccagcc

SEQ ID NO: 2858538 - RNA, 13 nt, Human
uggccgcccccug

SEQ ID NO: 2858539 - RNA, 15 nt, Human
uggccgcccccugcc

SEQ ID NO: 2858540 - RNA, 17 nt, Human
uggccgcccccugcccc

SEQ ID NO: 2858541 - RNA, 12 nt, Human
uggccggccagc

SEQ ID NO: 2858542 - RNA, 13 nt, Human
uggccggccagcc

SEQ ID NO: 2858543 - RNA, 14 nt, Human
uggccggccagcca

SEQ ID NO: 2858544 - RNA, 17 nt, Human
uggccggccagccagcc

SEQ ID NO: 2858545 - RNA, 19 nt, Human
uggccggccagccagccac

SEQ ID NO: 2858546 - RNA, 20 nt, Human
uggccggccagccagccacu

SEQ ID NO: 2858547 - RNA, 21 nt, Human
uggccggccagccagccacuc

SEQ ID NO: 2858548 - RNA, 22 nt, Human
uggccggccagccagccacucu

SEQ ID NO: 2858549 - RNA, 23 nt, Human
uggccggccagccagccacucua

SEQ ID NO: 2858550 - RNA, 13 nt, Human
uggccggcugugc

SEQ ID NO: 2858551 - RNA, 15 nt, Human
uggccggcugugcuc

SEQ ID NO: 2858552 - RNA, 17 nt, Human
uggccggcugugcucag

SEQ ID NO: 2858553 - RNA, 20 nt, Human
uggccggcugugcucagaga

SEQ ID NO: 2858554 - RNA, 15 nt, Human
uggccgggagccuga

SEQ ID NO: 2858555 - RNA, 17 nt, Human
auccugcaaugaaaggu

SEQ ID NO: 2858556 - RNA, 12 nt, Human
auccugagcccc

SEQ ID NO: 2858557 - RNA, 13 nt, Human
auccugagccccg

SEQ ID NO: 2858558 - RNA, 14 nt, Human
auccugagccccgc

SEQ ID NO: 2858559 - RNA, 20 nt, Human
auccugagccccgcccucuu

SEQ ID NO: 2858560 - RNA, 22 nt, Human
auccugagccccgcccucuucc

SEQ ID NO: 2858561 - RNA, 23 nt, Human
auccugagccccgcccucuuccu

SEQ ID NO: 2858562 - RNA, 19 nt, Human
auccugacucugcccccug

SEQ ID NO: 2858563 - RNA, 23 nt, Human
auccugacuucuaauaucauuca

SEQ ID NO: 2858564 - RNA, 19 nt, Human
auccugagguguaccagga

SEQ ID NO: 2858565 - RNA, 16 nt, Human
auccugcauuguuagc

SEQ ID NO: 2858566 - RNA, 14 nt, Human
auccugccacccug

SEQ ID NO: 2858567 - RNA, 16 nt, Human
auccugccacccugua

SEQ ID NO: 2858568 - RNA, 18 nt, Human
auccugccacccuguagc

SEQ ID NO: 2858569 - RNA, 13 nt, Human
auccugccagccc

SEQ ID NO: 2858570 - RNA, 17 nt, Human
auccugccagccccaca

SEQ ID NO: 2858571 - RNA, 21 nt, Human
auccugccagccccacacagc

SEQ ID NO: 2858572 - RNA, 22 nt, Human
auccugccagccccacacagcu

SEQ ID NO: 2858573 - RNA, 23 nt, Human
auccugccagccccacacagcua

SEQ ID NO: 2858574 - RNA, 13 nt, Human
auccugccauuua

SEQ ID NO: 2858575 - RNA, 16 nt, Human
auccugccauuuaaaa

SEQ ID NO: 2858576 - RNA, 17 nt, Human
auccugccuucauggaa

SEQ ID NO: 2858577 - RNA, 21 nt, Human
auccugccuucauggaacuca

SEQ ID NO: 2858578 - RNA, 14 nt, Human
auccugcuguucua

SEQ ID NO: 2858579 - RNA, 15 nt, Human
auccugcuguucuag

SEQ ID NO: 2858580 - RNA, 14 nt, Human
uucuuuuggcuucc

SEQ ID NO: 2858581 - RNA, 12 nt, Human
uucuuuuguaaa

SEQ ID NO: 2858582 - RNA, 12 nt, Human
uucuuuuguaag

SEQ ID NO: 2858583 - RNA, 14 nt, Human
uucuuuuguaagug

SEQ ID NO: 2858584 - RNA, 12 nt, Human
uucuuuucucau

SEQ ID NO: 2858585 - RNA, 22 nt, Human
uucuuuucucauguguuugcau

SEQ ID NO: 2858586 - RNA, 14 nt, Human
uucuuuucuuugua

SEQ ID NO: 2858587 - RNA, 15 nt, Human
uucuuuucuuuguau

SEQ ID NO: 2858588 - RNA, 14 nt, Human
uucuuuucuuuuua

SEQ ID NO: 2858589 - RNA, 12 nt, Human
uucuuuugaauu

SEQ ID NO: 2858590 - RNA, 15 nt, Human
uucuuuugaauuguu

SEQ ID NO: 2858591 - RNA, 15 nt, Human
uucuuuucuggccaa

SEQ ID NO: 2858592 - RNA, 20 nt, Human
auccucuuucucuuuucuag

SEQ ID NO: 2858593 - RNA, 17 nt, Human
auccugaaauuucagau

SEQ ID NO: 2858594 - RNA, 14 nt, Human
auccugaacagcau

SEQ ID NO: 2858595 - RNA, 15 nt, Human
auccugaacagcaug

SEQ ID NO: 2858596 - RNA, 19 nt, Human
auccugaacugcuucucca

SEQ ID NO: 2858597 - RNA, 16 nt, Human
auccugaaauuucaga

SEQ ID NO: 2858598 - RNA, 14 nt, Human
auccugaaauuuca

SEQ ID NO: 2858599 - RNA, 21 nt, Human
auccugacuauuauguuguua

SEQ ID NO: 2858600 - RNA, 14 nt, Human
auccugacucugcc

SEQ ID NO: 2858601 - RNA, 15 nt, Human
auccugacucugccc

SEQ ID NO: 2858602 - RNA, 17 nt, Human
auccugacucugccccc

SEQ ID NO: 2858603 - RNA, 18 nt, Human
auccugacucugcccccu

SEQ ID NO: 2858604 - RNA, 21 nt, Human
auccuggcacccggccccugc

SEQ ID NO: 2858605 - RNA, 20 nt, Human
auccuggcacccggccccug

SEQ ID NO: 2858606 - RNA, 19 nt, Human
auccuggcacccggccccu

SEQ ID NO: 2858607 - RNA, 17 nt, Human
auccuggcacccggccc

SEQ ID NO: 2858608 - RNA, 14 nt, Human
auccugcuucagug

SEQ ID NO: 2858609 - RNA, 19 nt, Human
auccugcuucugauaugca

SEQ ID NO: 2858610 - RNA, 21 nt, Human
auccugcuucugauaugcagu

SEQ ID NO: 2858611 - RNA, 23 nt, Human
auccuggcacccggccccugcug

SEQ ID NO: 2858612 - RNA, 22 nt, Human
auccuggcacccggccccugcu

SEQ ID NO: 2858613 - RNA, 19 nt, Human
auccuggcagcccagagac

SEQ ID NO: 2858614 - RNA, 18 nt, Human
auccuggcagcccagaga

SEQ ID NO: 2858615 - RNA, 16 nt, Human
auccuggcagcccaga

SEQ ID NO: 2858616 - RNA, 15 nt, Human
auccuggcagcccag

SEQ ID NO: 2858617 - RNA, 24 nt, Human
auccuggcagcccagagacuuugu

SEQ ID NO: 2858618 - RNA, 20 nt, Human
auccuggcagcccagagacu

SEQ ID NO: 2858619 - RNA, 13 nt, Human
auccuggcagccc

SEQ ID NO: 2858620 - RNA, 12 nt, Human
auccuggcagcc

SEQ ID NO: 2858621 - RNA, 11 nt, Human
auccuggcagc

SEQ ID NO: 2858622 - RNA, 21 nt, Human
auccugggggacccaauguag

SEQ ID NO: 2858623 - RNA, 20 nt, Human
auccuggggcauuaaaaaaa

SEQ ID NO: 2858624 - RNA, 11 nt, Human
auccuggguaa

SEQ ID NO: 2858625 - RNA, 12 nt, Human
auccuggguaau

SEQ ID NO: 2858626 - RNA, 14 nt, Human
auccugguuucaua

SEQ ID NO: 2858627 - RNA, 23 nt, Human
auccugguuucauaacuuccugu

SEQ ID NO: 2858628 - RNA, 18 nt, Human
auccuggcucuguggcuu

SEQ ID NO: 2858629 - RNA, 24 nt, Human
auccuggcucuuuggagaucaagg

SEQ ID NO: 2858630 - RNA, 15 nt, Human
auccuggcuggagaa

SEQ ID NO: 2858631 - RNA, 23 nt, Human
auccuggcuggagaauguggaga

SEQ ID NO: 2858632 - RNA, 22 nt, Human
auccuggcucuguggcuugcua

SEQ ID NO: 2858633 - RNA, 19 nt, Human
auccuggcucuguggcuug

SEQ ID NO: 2858634 - RNA, 13 nt, Human
aucggccuccucu

SEQ ID NO: 2858635 - RNA, 14 nt, Human
aucggccuccucuu

SEQ ID NO: 2858636 - RNA, 21 nt, Human
aucggccuccucuucaccccg

SEQ ID NO: 2858637 - RNA, 15 nt, Human
aucguaaccagccag

SEQ ID NO: 2858638 - RNA, 14 nt, Human
auccuguauaagca

SEQ ID NO: 2858639 - RNA, 16 nt, Human
auccuguauaagcacu

SEQ ID NO: 2858640 - RNA, 17 nt, Human
auccuguauaagcacug

SEQ ID NO: 2858641 - RNA, 23 nt, Human
auccuguauaagcacugaaaaac

SEQ ID NO: 2858642 - RNA, 19 nt, Human
auccugucuuuaaggaaaa

SEQ ID NO: 2858643 - RNA, 23 nt, Human
auccugucuuuaaggaaaaaaag

SEQ ID NO: 2858644 - RNA, 21 nt, Human
auccugucuuuaaggaaaaaa

SEQ ID NO: 2858645 - RNA, 15 nt, Human
auccugucuuucuga

SEQ ID NO: 2858646 - RNA, 18 nt, Human
auccugucuuucugagca

SEQ ID NO: 2858647 - RNA, 23 nt, Human
auccugucuuucugagcacacuu

SEQ ID NO: 2858648 - RNA, 13 nt, Human
auccuuaacagau

SEQ ID NO: 2858649 - RNA, 16 nt, Human
auccuggagaagccuc

SEQ ID NO: 2858650 - RNA, 11 nt, Human
auccugugacu

SEQ ID NO: 2858651 - RNA, 21 nt, Human
auccugugacugucucacuua

SEQ ID NO: 2858652 - RNA, 11 nt, Human
auccugugagg

SEQ ID NO: 2858653 - RNA, 21 nt, Human
auccugugaggagccccaucu

SEQ ID NO: 2858654 - RNA, 16 nt, Human
auccugugaaguaagg

SEQ ID NO: 2858655 - RNA, 15 nt, Human
uugaauauggacaag

SEQ ID NO: 2858656 - RNA, 17 nt, Human
uugaauauggacaagag

SEQ ID NO: 2858657 - RNA, 22 nt, Human
uugaauaucuuucgauaaacaa

SEQ ID NO: 2858658 - RNA, 15 nt, Human
uugaaguaaacugca

SEQ ID NO: 2858659 - RNA, 22 nt, Human
uugaauauaauauauuugugua

SEQ ID NO: 2858660 - RNA, 20 nt, Human
uugaauauaauauauuugug

SEQ ID NO: 2858661 - RNA, 21 nt, Human
uugaauauaauauauuugugu

SEQ ID NO: 2858662 - RNA, 13 nt, Human
uugaaguuuacau

SEQ ID NO: 2858663 - RNA, 14 nt, Human
uugaaguuuacauu

SEQ ID NO: 2858664 - RNA, 15 nt, Human
uugaaguuuacauuu

SEQ ID NO: 2858665 - RNA, 16 nt, Human
uugaaguuuacauuuu

SEQ ID NO: 2858666 - RNA, 19 nt, Human
uugaaguuuacauuuuuau

SEQ ID NO: 2858667 - RNA, 13 nt, Human
uugaauacuuuuu

SEQ ID NO: 2858668 - RNA, 12 nt, Human
uugaauacuuuu

SEQ ID NO: 2858669 - RNA, 19 nt, Human
uugaaggaagccaaauuua

SEQ ID NO: 2858670 - RNA, 20 nt, Human
uugaaggaagccaaauuuau

SEQ ID NO: 2858671 - RNA, 16 nt, Human
uugaaggaauacaaua

SEQ ID NO: 2858672 - RNA, 18 nt, Human
uugaaggaauacaauaua

SEQ ID NO: 2858673 - RNA, 23 nt, Human
uugaaggaauacaauauauagcu

SEQ ID NO: 2858674 - RNA, 11 nt, Human
uugaaggaaac

SEQ ID NO: 2858675 - RNA, 13 nt, Human
uugaaggaaacag

SEQ ID NO: 2858676 - RNA, 14 nt, Human
uugaaggaaacagu

SEQ ID NO: 2858677 - RNA, 15 nt, Human
uugaagggcccagga

SEQ ID NO: 2858678 - RNA, 11 nt, Human
uugaagucuug

SEQ ID NO: 2858679 - RNA, 13 nt, Human
uugaagucuugua

SEQ ID NO: 2858680 - RNA, 14 nt, Human
uugaagucuuguau

SEQ ID NO: 2858681 - RNA, 16 nt, Human
uugaagucuuguauaa

SEQ ID NO: 2858682 - RNA, 15 nt, Human
uugaagucaccuugu

SEQ ID NO: 2858683 - RNA, 19 nt, Human
uugaagucaccuugugugu

SEQ ID NO: 2858684 - RNA, 15 nt, Human
uugaaguacuugcca

SEQ ID NO: 2858685 - RNA, 21 nt, Human
uugaaguacuugccagaaguu

SEQ ID NO: 2858686 - RNA, 17 nt, Human
uugaaggaaaaugauac

SEQ ID NO: 2858687 - RNA, 14 nt, Human
uugaagcugaaaau

SEQ ID NO: 2858688 - RNA, 18 nt, Human
uugaagcugaaaauauaa

SEQ ID NO: 2858689 - RNA, 16 nt, Human
aucuaaaucuauuuau

SEQ ID NO: 2858690 - RNA, 13 nt, Human
aucuaaaucuauu

SEQ ID NO: 2858691 - RNA, 15 nt, Human
aucuaaaucuauuua

SEQ ID NO: 2858692 - RNA, 12 nt, Human
aucuaaaguuau

SEQ ID NO: 2858693 - RNA, 13 nt, Human
aucuaaaguuaua

SEQ ID NO: 2858694 - RNA, 14 nt, Human
aucuaaaguuauau

SEQ ID NO: 2858695 - RNA, 15 nt, Human
aucuaaaguuauauu

SEQ ID NO: 2858696 - RNA, 16 nt, Human
aucuaaaguuauauuu

SEQ ID NO: 2858697 - RNA, 17 nt, Human
aucuaaaguuauauuuc

SEQ ID NO: 2858698 - RNA, 18 nt, Human
aucuaaaguuauauuuca

SEQ ID NO: 2858699 - RNA, 13 nt, Human
aucuaaaguuugu

SEQ ID NO: 2858700 - RNA, 15 nt, Human
aucuaaacugccccc

SEQ ID NO: 2858701 - RNA, 16 nt, Human
aucguaaccagccaga

SEQ ID NO: 2858702 - RNA, 19 nt, Human
aucguccagcgaccuuccu

SEQ ID NO: 2858703 - RNA, 15 nt, Human
aucgugacaacacuu

SEQ ID NO: 2858704 - RNA, 14 nt, Human
aucgugacaacacu

SEQ ID NO: 2858705 - RNA, 15 nt, Human
aucguccccuccccc

SEQ ID NO: 2858706 - RNA, 20 nt, Human
aucguccccucccccacccc

SEQ ID NO: 2858707 - RNA, 19 nt, Human
uugacagggcacaccgggc

SEQ ID NO: 2858708 - RNA, 18 nt, Human
uugacaguucugaagaau

SEQ ID NO: 2858709 - RNA, 15 nt, Human
uugacaguucugaag

SEQ ID NO: 2858710 - RNA, 17 nt, Human
uugacaguucugaagaa

SEQ ID NO: 2858711 - RNA, 19 nt, Human
uugacaguguugaaaaugu

SEQ ID NO: 2858712 - RNA, 13 nt, Human
uugacauauuuaa

SEQ ID NO: 2858713 - RNA, 16 nt, Human
uugacauauuuaaugu

SEQ ID NO: 2858714 - RNA, 17 nt, Human
uugacauauuuaauguu

SEQ ID NO: 2858715 - RNA, 18 nt, Human
uugacauauuuaauguuu

SEQ ID NO: 2858716 - RNA, 21 nt, Human
uugagaaauauggacacuuaa

SEQ ID NO: 2858717 - RNA, 21 nt, Human
uugagaagccuucagcuccag

SEQ ID NO: 2858718 - RNA, 19 nt, Human
uugagaagccuucagcucc

SEQ ID NO: 2858719 - RNA, 22 nt, Human
uugagaagaccucaccuagaaa

SEQ ID NO: 2858720 - RNA, 16 nt, Human
uugagaagaggacauu

SEQ ID NO: 2858721 - RNA, 15 nt, Human
uugagaacuuuccau

SEQ ID NO: 2858722 - RNA, 15 nt, Human
uugagaacguaaaga

SEQ ID NO: 2858723 - RNA, 14 nt, Human
uugagaguucuaaa

SEQ ID NO: 2858724 - RNA, 19 nt, Human
uugagaggcccugggguuc

SEQ ID NO: 2858725 - RNA, 23 nt, Human
uugagaagccuucagcuccaggg

SEQ ID NO: 2858726 - RNA, 14 nt, Human
uugagaaggagaga

SEQ ID NO: 2858727 - RNA, 17 nt, Human
uugagagaccaggcaaa

SEQ ID NO: 2858728 - RNA, 16 nt, Human
uugagagaccaggcaa

SEQ ID NO: 2858729 - RNA, 17 nt, Human
uugagagaagagacaaa

SEQ ID NO: 2858730 - RNA, 16 nt, Human
uugagaaggagagaaa

SEQ ID NO: 2858731 - RNA, 18 nt, Human
uugagaguuuugucuuga

SEQ ID NO: 2858732 - RNA, 18 nt, Human
uugagauacuuuuucuuu

SEQ ID NO: 2858733 - RNA, 20 nt, Human
uugagauacuuuuucuuuug

SEQ ID NO: 2858734 - RNA, 22 nt, Human
uugagauacuuuuucuuuugua

SEQ ID NO: 2858735 - RNA, 23 nt, Human
uugagauacuuuuucuuuuguaa

SEQ ID NO: 2858736 - RNA, 12 nt, Human
uugauaaaguuu

SEQ ID NO: 2858737 - RNA, 13 nt, Human
uugauaaaguuuc

SEQ ID NO: 2858738 - RNA, 14 nt, Human
uugauaaaguuucu

SEQ ID NO: 2858739 - RNA, 17 nt, Human
uugauaaaguuucucag

SEQ ID NO: 2858740 - RNA, 15 nt, Human
uugaguagacacauu

SEQ ID NO: 2858741 - RNA, 20 nt, Human
uugaguagacacauuuaagg

SEQ ID NO: 2858742 - RNA, 19 nt, Human
uugaguuuucuucugugau

SEQ ID NO: 2858743 - RNA, 13 nt, Human
uugauaaugauaa

SEQ ID NO: 2858744 - RNA, 21 nt, Human
aucuaagcccaugggacaaau

SEQ ID NO: 2858745 - RNA, 17 nt, Human
uugauaauaaauugaaa

SEQ ID NO: 2858746 - RNA, 19 nt, Human
uugauaauaaauugaaauu

SEQ ID NO: 2858747 - RNA, 18 nt, Human
uugauaauaauauuguuu

SEQ ID NO: 2858748 - RNA, 19 nt, Human
aucuaagaauacagcuuuc

SEQ ID NO: 2858749 - RNA, 20 nt, Human
aucuaagaauacagcuuucu

SEQ ID NO: 2858750 - RNA, 18 nt, Human
aucuaaggaugucacagg

SEQ ID NO: 2858751 - RNA, 14 nt, Human
aucuaagcugcagc

SEQ ID NO: 2858752 - RNA, 15 nt, Human
aucuaagcugcagcu

SEQ ID NO: 2858753 - RNA, 16 nt, Human
aucuaagcugcagcuu

SEQ ID NO: 2858754 - RNA, 18 nt, Human
aucuaagcugcagcuucc

SEQ ID NO: 2858755 - RNA, 20 nt, Human
aucuaaggaugucacagggc

SEQ ID NO: 2858756 - RNA, 17 nt, Human
aucuaaggcuguuugcu

SEQ ID NO: 2858757 - RNA, 16 nt, Human
uugauaagagggcaca

SEQ ID NO: 2858758 - RNA, 22 nt, Human
uugauaagagggcacacacugu

SEQ ID NO: 2858759 - RNA, 18 nt, Human
uugauaaauuccacugga

SEQ ID NO: 2858760 - RNA, 21 nt, Human
uugauaaauuccacuggacuu

SEQ ID NO: 2858761 - RNA, 22 nt, Human
uugauaacaaugacacuagaaa

SEQ ID NO: 2858762 - RNA, 19 nt, Human
uugauaaauuccacuggac

SEQ ID NO: 2858763 - RNA, 18 nt, Human
aucccaugagccucagca

SEQ ID NO: 2858764 - RNA, 17 nt, Human
aucccaugagccucagc

SEQ ID NO: 2858765 - RNA, 20 nt, Human
aucccugaaucccccuugcc

SEQ ID NO: 2858766 - RNA, 22 nt, Human
aucccugaaucccccuugccac

SEQ ID NO: 2858767 - RNA, 16 nt, Human
aucccaugagccucag

SEQ ID NO: 2858768 - RNA, 13 nt, Human
aucccaugagccu

SEQ ID NO: 2858769 - RNA, 17 nt, Human
aucccagaaauuagaaa

SEQ ID NO: 2858770 - RNA, 12 nt, Human
aucccagcccaa

SEQ ID NO: 2858771 - RNA, 19 nt, Human
aucccagcacuuugggaga

SEQ ID NO: 2858772 - RNA, 14 nt, Human
aucccagcaccugc

SEQ ID NO: 2858773 - RNA, 16 nt, Human
aucccagcaccugccu

SEQ ID NO: 2858774 - RNA, 21 nt, Human
aucccagcaccugccuccucg

SEQ ID NO: 2858775 - RNA, 13 nt, Human
aucccagaaauua

SEQ ID NO: 2858776 - RNA, 19 nt, Human
auccaugaguuugcccugg

SEQ ID NO: 2858777 - RNA, 15 nt, Human
auccaugcaccaaac

SEQ ID NO: 2858778 - RNA, 12 nt, Human
auccauccaauc

SEQ ID NO: 2858779 - RNA, 22 nt, Human
auccaugacaggccugaagaua

SEQ ID NO: 2858780 - RNA, 24 nt, Human
auccaugacaggccugaagauauu

SEQ ID NO: 2858781 - RNA, 20 nt, Human
uucucucagccuuacauuug

SEQ ID NO: 2858782 - RNA, 17 nt, Human
auccauccagcuugcca

SEQ ID NO: 2858783 - RNA, 17 nt, Human
auccagguucagcuugu

SEQ ID NO: 2858784 - RNA, 20 nt, Human
auccacaggaaaguguuauu

SEQ ID NO: 2858785 - RNA, 13 nt, Human
auccacauuguuu

SEQ ID NO: 2858786 - RNA, 15 nt, Human
auccacauuguuuua

SEQ ID NO: 2858787 - RNA, 18 nt, Human
auccacaccaaagggaga

SEQ ID NO: 2858788 - RNA, 16 nt, Human
uucugccugcccaggc

SEQ ID NO: 2858789 - RNA, 15 nt, Human
uucugccugcccagg

SEQ ID NO: 2858790 - RNA, 20 nt, Human
auccaaccccccaccugcca

SEQ ID NO: 2858791 - RNA, 18 nt, Human
auccaaccccccaccugc

SEQ ID NO: 2858792 - RNA, 20 nt, Human
auccaaauugugcuucuccc

SEQ ID NO: 2858793 - RNA, 23 nt, Human
auccaaauugugcuucuccccag

SEQ ID NO: 2858794 - RNA, 12 nt, Human
auccaauguuag

SEQ ID NO: 2858795 - RNA, 21 nt, Human
auccaauguuagagacuuuuu

SEQ ID NO: 2858796 - RNA, 22 nt, Human
auccaauguuagagacuuuuuu

SEQ ID NO: 2858797 - RNA, 23 nt, Human
auccaauguuagagacuuuuuuc

SEQ ID NO: 2858798 - RNA, 16 nt, Human
auccaacuccagcaac

SEQ ID NO: 2858799 - RNA, 14 nt, Human
auccaacuccagga

SEQ ID NO: 2858800 - RNA, 15 nt, Human
auccaacuccagcaa

SEQ ID NO: 2858801 - RNA, 14 nt, Human
auccaacuccagca

SEQ ID NO: 2858802 - RNA, 12 nt, Human
uucuguuucuca

SEQ ID NO: 2858803 - RNA, 12 nt, Human
uucuguuucaag

SEQ ID NO: 2858804 - RNA, 23 nt, Human
uucuguuucaaggcacucuagau

SEQ ID NO: 2858805 - RNA, 13 nt, Human
uucuguuuccugu

SEQ ID NO: 2858806 - RNA, 18 nt, Human
uucuguuuccuguaccag

SEQ ID NO: 2858807 - RNA, 16 nt, Human
uucuguuuggaggagc

SEQ ID NO: 2858808 - RNA, 12 nt, Human
uucuguuuguua

SEQ ID NO: 2858809 - RNA, 18 nt, Human
uucuguuuauggccacau

SEQ ID NO: 2858810 - RNA, 12 nt, Human
uucuguuucuuc

SEQ ID NO: 2858811 - RNA, 14 nt, Human
uucuguuugauucu

SEQ ID NO: 2858812 - RNA, 15 nt, Human
uucuguuugauucuu

SEQ ID NO: 2858813 - RNA, 21 nt, Human
uucuguuggccagugugacaa

SEQ ID NO: 2858814 - RNA, 19 nt, Human
aucccugauccuaacugaa

SEQ ID NO: 2858815 - RNA, 14 nt, Human
aucccugccugguc

SEQ ID NO: 2858816 - RNA, 12 nt, Human
aucccugcccau

SEQ ID NO: 2858817 - RNA, 11 nt, Human
uucuguuguaa

SEQ ID NO: 2858818 - RNA, 12 nt, Human
uucuguuguaac

SEQ ID NO: 2858819 - RNA, 13 nt, Human
uucuguuguaacu

SEQ ID NO: 2858820 - RNA, 14 nt, Human
uucuguuguaacuu

SEQ ID NO: 2858821 - RNA, 15 nt, Human
uucuguuguaacuua

SEQ ID NO: 2858822 - RNA, 17 nt, Human
uucuguuguaacuuaug

SEQ ID NO: 2858823 - RNA, 22 nt, Human
uucuguuguaacuuauguagau

SEQ ID NO: 2858824 - RNA, 16 nt, Human
uucuuaaauaaugcuu

SEQ ID NO: 2858825 - RNA, 12 nt, Human
uucuuaaauauc

SEQ ID NO: 2858826 - RNA, 14 nt, Human
uucuuaaauaucuu

SEQ ID NO: 2858827 - RNA, 15 nt, Human
uucuuaaauaucuuu

SEQ ID NO: 2858828 - RNA, 16 nt, Human
uucuuaaauaucuuuu

SEQ ID NO: 2858829 - RNA, 17 nt, Human
uucuuaaauaucuuuua

SEQ ID NO: 2858830 - RNA, 19 nt, Human
uucuuaaauaucuuuuaug

SEQ ID NO: 2858831 - RNA, 21 nt, Human
uucuuaaauaucuuuuauguu

SEQ ID NO: 2858832 - RNA, 13 nt, Human
uucuuaacaaccg

SEQ ID NO: 2858833 - RNA, 14 nt, Human
uucuuaacaaccga

SEQ ID NO: 2858834 - RNA, 13 nt, Human
uucuuaacaaccu

SEQ ID NO: 2858835 - RNA, 16 nt, Human
uucuuaacaaccuggc

SEQ ID NO: 2858836 - RNA, 16 nt, Human
uucuuacauaauuuuu

SEQ ID NO: 2858837 - RNA, 15 nt, Human
uucuuaccuguaugu

SEQ ID NO: 2858838 - RNA, 12 nt, Human
uucuuacuccuc

SEQ ID NO: 2858839 - RNA, 15 nt, Human
uucuuacuccuccuc

SEQ ID NO: 2858840 - RNA, 16 nt, Human
uucuuacuccuccucu

SEQ ID NO: 2858841 - RNA, 17 nt, Human
uucuuacuccuccucuu

SEQ ID NO: 2858842 - RNA, 19 nt, Human
uucuuacuccuccucuuuc

SEQ ID NO: 2858843 - RNA, 16 nt, Human
uucuuacugauaauuu

SEQ ID NO: 2858844 - RNA, 20 nt, Human
uucuuacugauaauuuugcu

SEQ ID NO: 2858845 - RNA, 17 nt, Human
uucuuacccaauuuccc

SEQ ID NO: 2858846 - RNA, 22 nt, Human
uucuuacccuguacauauguaa

SEQ ID NO: 2858847 - RNA, 21 nt, Human
uucuuagacuacauuuagaga

SEQ ID NO: 2858848 - RNA, 18 nt, Human
uucuuucuaguggucuuu

SEQ ID NO: 2858849 - RNA, 21 nt, Human
uucuuucuaguggucuuugua

SEQ ID NO: 2858850 - RNA, 22 nt, Human
uucuuucuaguggucuuuguaa

SEQ ID NO: 2858851 - RNA, 16 nt, Human
uucuuucuauuugacu

SEQ ID NO: 2858852 - RNA, 13 nt, Human
uucuuucucucag

SEQ ID NO: 2858853 - RNA, 23 nt, Human
uucuuucucucagccuuacauuu

SEQ ID NO: 2858854 - RNA, 17 nt, Human
uucuuugagacuggguc

SEQ ID NO: 2858855 - RNA, 21 nt, Human
uucuuugagggacugccucug

SEQ ID NO: 2858856 - RNA, 22 nt, Human
uucuuugagggacugccucugc

SEQ ID NO: 2858857 - RNA, 16 nt, Human
uucuuugauaauguua

SEQ ID NO: 2858858 - RNA, 17 nt, Human
uucuuugauaauguuaa

SEQ ID NO: 2858859 - RNA, 18 nt, Human
uucuuugauaauguuaaa

SEQ ID NO: 2858860 - RNA, 11 nt, Human
uucuuugaaug

SEQ ID NO: 2858861 - RNA, 13 nt, Human
uucuuugaauuua

SEQ ID NO: 2858862 - RNA, 15 nt, Human
uucuuugaauuuacu

SEQ ID NO: 2858863 - RNA, 13 nt, Human
uucuuugauucuc

SEQ ID NO: 2858864 - RNA, 23 nt, Human
uucuuugauucuccuuuuaugug

SEQ ID NO: 2858865 - RNA, 12 nt, Human
uucuuugcaaag

SEQ ID NO: 2858866 - RNA, 16 nt, Human
uucuuugcaaaguauu

SEQ ID NO: 2858867 - RNA, 22 nt, Human
uucuuugauaauguuaaauuug

SEQ ID NO: 2858868 - RNA, 18 nt, Human
uucuucguucuuuuuaag

SEQ ID NO: 2858869 - RNA, 23 nt, Human
uucuucuauguaggaaaaaaaua

SEQ ID NO: 2858870 - RNA, 15 nt, Human
uucuucuagaguuca

SEQ ID NO: 2858871 - RNA, 11 nt, Human
uucuucuagag

SEQ ID NO: 2858872 - RNA, 14 nt, Human
uucuucuagaguuc

SEQ ID NO: 2858873 - RNA, 17 nt, Human
uucuugcucccuucagc

SEQ ID NO: 2858874 - RNA, 22 nt, Human
uucuugcucccuucagccccca

SEQ ID NO: 2858875 - RNA, 22 nt, Human
uucuugcucgggucccuucacc

SEQ ID NO: 2858876 - RNA, 20 nt, Human
uucuugcucuaucucucaaa

SEQ ID NO: 2858877 - RNA, 12 nt, Human
uucuugcugcua

SEQ ID NO: 2858878 - RNA, 13 nt, Human
uucuugcugcuag

SEQ ID NO: 2858879 - RNA, 14 nt, Human
uucuugcugcuaga

SEQ ID NO: 2858880 - RNA, 15 nt, Human
uucuugcugcuagaa

SEQ ID NO: 2858881 - RNA, 16 nt, Human
uucuugcugcuagaac

SEQ ID NO: 2858882 - RNA, 17 nt, Human
uucuugcugcuagaacu

SEQ ID NO: 2858883 - RNA, 18 nt, Human
uucuugcugcuagaacuu

SEQ ID NO: 2858884 - RNA, 19 nt, Human
uucuugcugcuagaacuuu

SEQ ID NO: 2858885 - RNA, 20 nt, Human
uucuugcugcuagaacuuuu

SEQ ID NO: 2858886 - RNA, 21 nt, Human
uucuugcugcuagaacuuuuu

SEQ ID NO: 2858887 - RNA, 15 nt, Human
uucuugcaagcaugc

SEQ ID NO: 2858888 - RNA, 18 nt, Human
uucuugcagucaucagaa

SEQ ID NO: 2858889 - RNA, 19 nt, Human
uucuugcagucaucagaag

SEQ ID NO: 2858890 - RNA, 16 nt, Human
uucuugcauccuuccu

SEQ ID NO: 2858891 - RNA, 20 nt, Human
uucuugcauccuuccuauaa

SEQ ID NO: 2858892 - RNA, 12 nt, Human
uucuugcauuga

SEQ ID NO: 2858893 - RNA, 16 nt, Human
uucuugcauugacauu

SEQ ID NO: 2858894 - RNA, 23 nt, Human
aucacuugaacccgggaggcaga

SEQ ID NO: 2858895 - RNA, 15 nt, Human
aucaggugcugccau

SEQ ID NO: 2858896 - RNA, 19 nt, Human
aucaggugcugccauccag

SEQ ID NO: 2858897 - RNA, 17 nt, Human
aucaggugcugccaucc

SEQ ID NO: 2858898 - RNA, 14 nt, Human
aucacuguuuuuag

SEQ ID NO: 2858899 - RNA, 15 nt, Human
aucacuguuuuuaga

SEQ ID NO: 2858900 - RNA, 18 nt, Human
aucacuucugagaacuca

SEQ ID NO: 2858901 - RNA, 14 nt, Human
aucacuuaaaguca

SEQ ID NO: 2858902 - RNA, 15 nt, Human
aucacuuaacauucc

SEQ ID NO: 2858903 - RNA, 23 nt, Human
aucacuuaacauuccuaaaaugc

SEQ ID NO: 2858904 - RNA, 17 nt, Human
aucacugaacaaacuaa

SEQ ID NO: 2858905 - RNA, 20 nt, Human
aucacugaacaaacuaaagg

SEQ ID NO: 2858906 - RNA, 22 nt, Human
aucacugaaaccuuuaagaaaa

SEQ ID NO: 2858907 - RNA, 19 nt, Human
aucagucugauucccaagc

SEQ ID NO: 2858908 - RNA, 14 nt, Human
aucaggugcugcca

SEQ ID NO: 2858909 - RNA, 15 nt, Human
aucagugcccuccag

SEQ ID NO: 2858910 - RNA, 13 nt, Human
aucagugcccucc

SEQ ID NO: 2858911 - RNA, 17 nt, Human
aucagugcccuccagga

SEQ ID NO: 2858912 - RNA, 16 nt, Human
aucaguggacagucug

SEQ ID NO: 2858913 - RNA, 21 nt, Human
aucaguggacagucugcucua

SEQ ID NO: 2858914 - RNA, 23 nt, Human
aucagugugucuaaauuugaaug

SEQ ID NO: 2858915 - RNA, 21 nt, Human
aucaguguuguugcucuagga

SEQ ID NO: 2858916 - RNA, 10 nt, Human
aucaguguug

SEQ ID NO: 2858917 - RNA, 18 nt, Human
aucaguuaacuauugcau

SEQ ID NO: 2858918 - RNA, 12 nt, Human
aucaguuaacua

SEQ ID NO: 2858919 - RNA, 17 nt, Human
aucaguguuuuaaauuc

SEQ ID NO: 2858920 - RNA, 18 nt, Human
aucaguguuuuaaauucu

SEQ ID NO: 2858921 - RNA, 19 nt, Human
aucaguguuuuaaauucug

SEQ ID NO: 2858922 - RNA, 20 nt, Human
aucaguguuuuaaauucuga

SEQ ID NO: 2858923 - RNA, 15 nt, Human
aucaguuagagcuga

SEQ ID NO: 2858924 - RNA, 14 nt, Human
aucaguuauucauu

SEQ ID NO: 2858925 - RNA, 16 nt, Human
aucaguuauucauucu

SEQ ID NO: 2858926 - RNA, 23 nt, Human
aucauccacugugccaugugcca

SEQ ID NO: 2858927 - RNA, 11 nt, Human
aucauuaauac

SEQ ID NO: 2858928 - RNA, 17 nt, Human
aucauuacccuucccug

SEQ ID NO: 2858929 - RNA, 20 nt, Human
aucauuacccuucccugcac

SEQ ID NO: 2858930 - RNA, 22 nt, Human
aucauuacccuucccugcacua

SEQ ID NO: 2858931 - RNA, 23 nt, Human
aucauuaccuuuuaccagcuuuu

SEQ ID NO: 2858932 - RNA, 16 nt, Human
aucauccacauuguuu

SEQ ID NO: 2858933 - RNA, 21 nt, Human
aucauccacugugccaugugc

SEQ ID NO: 2858934 - RNA, 11 nt, Human
aucauuagaac

SEQ ID NO: 2858935 - RNA, 14 nt, Human
aucaguuccuuugu

SEQ ID NO: 2858936 - RNA, 17 nt, Human
aucaguuccuuugugug

SEQ ID NO: 2858937 - RNA, 23 nt, Human
aucauaguggcuuaaaacaacac

SEQ ID NO: 2858938 - RNA, 13 nt, Human
aucauaaaauaaa

SEQ ID NO: 2858939 - RNA, 14 nt, Human
aucauaaaaucaaa

SEQ ID NO: 2858940 - RNA, 12 nt, Human
aucauaaaauaa

SEQ ID NO: 2858941 - RNA, 10 nt, Human
aucaguuuga

SEQ ID NO: 2858942 - RNA, 22 nt, Human
aucaguuugaucacacuauuuu

SEQ ID NO: 2858943 - RNA, 14 nt, Human
aucauaguuaacau

SEQ ID NO: 2858944 - RNA, 14 nt, Human
aucauaaaguuaga

SEQ ID NO: 2858945 - RNA, 15 nt, Human
aucauaaaguuagaa

SEQ ID NO: 2858946 - RNA, 16 nt, Human
aucauaaaguuagaau

SEQ ID NO: 2858947 - RNA, 18 nt, Human
aucaucaguggagccaug

SEQ ID NO: 2858948 - RNA, 19 nt, Human
aucaucauaguaaaagaaa

SEQ ID NO: 2858949 - RNA, 18 nt, Human
aucaucaugcagcucaac

SEQ ID NO: 2858950 - RNA, 20 nt, Human
aucaucaugcagcucaacuu

SEQ ID NO: 2858951 - RNA, 17 nt, Human
uucuccuuucacaaccu

SEQ ID NO: 2858952 - RNA, 19 nt, Human
uucuccguccucgauggga

SEQ ID NO: 2858953 - RNA, 13 nt, Human
uucucccuucggu

SEQ ID NO: 2858954 - RNA, 21 nt, Human
uucucccuucgguggaagagc

SEQ ID NO: 2858955 - RNA, 21 nt, Human
uucucccguucacguugccua

SEQ ID NO: 2858956 - RNA, 20 nt, Human
uucucccucauuucaggagc

SEQ ID NO: 2858957 - RNA, 18 nt, Human
uucucccucccaccuuaa

SEQ ID NO: 2858958 - RNA, 15 nt, Human
aucauuguuuugaau

SEQ ID NO: 2858959 - RNA, 14 nt, Human
aucauuguugccuc

SEQ ID NO: 2858960 - RNA, 22 nt, Human
uucugaauauuuuaucuuuccu

SEQ ID NO: 2858961 - RNA, 22 nt, Human
uucugcaguaaaucuuuuacaa

SEQ ID NO: 2858962 - RNA, 18 nt, Human
uucugcaguaaaucuuuu

SEQ ID NO: 2858963 - RNA, 15 nt, Human
uucugcaguaaaucu

SEQ ID NO: 2858964 - RNA, 19 nt, Human
uucugaaugugcugaucau

SEQ ID NO: 2858965 - RNA, 23 nt, Human
uucugcauauguugaauacuuuu

SEQ ID NO: 2858966 - RNA, 22 nt, Human
uucugcauauguugaauacuuu

SEQ ID NO: 2858967 - RNA, 21 nt, Human
uucugcauauguugaauacuu

SEQ ID NO: 2858968 - RNA, 17 nt, Human
uucugcauauguugaau

SEQ ID NO: 2858969 - RNA, 23 nt, Human
uucucgcaaaaacguaucuccua

SEQ ID NO: 2858970 - RNA, 13 nt, Human
uucuccuuuuccu

SEQ ID NO: 2858971 - RNA, 18 nt, Human
uucuccuuuuccucucuc

SEQ ID NO: 2858972 - RNA, 18 nt, Human
uucuccuuucacaaccuu

SEQ ID NO: 2858973 - RNA, 22 nt, Human
uucuccuuucacaaccuucugu

SEQ ID NO: 2858974 - RNA, 17 nt, Human
aucacgccacugcacua

SEQ ID NO: 2858975 - RNA, 15 nt, Human
aucacgccacugcac

SEQ ID NO: 2858976 - RNA, 14 nt, Human
aucacgccacugca

SEQ ID NO: 2858977 - RNA, 23 nt, Human
aucacgccacugcacuccagccu

SEQ ID NO: 2858978 - RNA, 14 nt, Human
aucacgccuggcua

SEQ ID NO: 2858979 - RNA, 22 nt, Human
aucaauuuugacuuaaugugau

SEQ ID NO: 2858980 - RNA, 15 nt, Human
aucaauuuuuaggaa

SEQ ID NO: 2858981 - RNA, 15 nt, Human
aucacuauccaugca

SEQ ID NO: 2858982 - RNA, 21 nt, Human
aucacuauccaugcaccaaac

SEQ ID NO: 2858983 - RNA, 14 nt, Human
aucacucugcugcu

SEQ ID NO: 2858984 - RNA, 21 nt, Human
aucacucugcugcuuagacau

SEQ ID NO: 2858985 - RNA, 13 nt, Human
aucacucuguccu

SEQ ID NO: 2858986 - RNA, 18 nt, Human
aucacuccccaaggaaga

SEQ ID NO: 2858987 - RNA, 20 nt, Human
aucacuccccaaggaagagc

SEQ ID NO: 2858988 - RNA, 16 nt, Human
aucaauucauaucuau

SEQ ID NO: 2858989 - RNA, 18 nt, Human
aucaauuauaguuucuga

SEQ ID NO: 2858990 - RNA, 20 nt, Human
aucaauuaacugaguagcuc

SEQ ID NO: 2858991 - RNA, 16 nt, Human
aucaauuauaguuucu

SEQ ID NO: 2858992 - RNA, 17 nt, Human
aucaauuauaguuucug

SEQ ID NO: 2858993 - RNA, 19 nt, Human
aucaagggugcgucuggga

SEQ ID NO: 2858994 - RNA, 21 nt, Human
aucaauguucacgcaacuuga

SEQ ID NO: 2858995 - RNA, 22 nt, Human
aucaauguucacgcaacuugaa

SEQ ID NO: 2858996 - RNA, 23 nt, Human
aucaauguucacgcaacuugaaa

SEQ ID NO: 2858997 - RNA, 15 nt, Human
aucaacuacuauuca

SEQ ID NO: 2858998 - RNA, 17 nt, Human
aucaacuacuauucaaa

SEQ ID NO: 2858999 - RNA, 14 nt, Human
aucaacuuuaauca

SEQ ID NO: 2859000 - RNA, 15 nt, Human
aucaacuuuaaucaa

SEQ ID NO: 2859001 - RNA, 21 nt, Human
aucaacuuuaaucaaguugua

SEQ ID NO: 2859002 - RNA, 12 nt, Human
aucaacuuaaca

SEQ ID NO: 2859003 - RNA, 11 nt, Human
aucaacccuuc

SEQ ID NO: 2859004 - RNA, 14 nt, Human
aucaacucaagaau

SEQ ID NO: 2859005 - RNA, 15 nt, Human
uuccuuacccaaacu

SEQ ID NO: 2859006 - RNA, 16 nt, Human
uuccuuaccuuuaccc

SEQ ID NO: 2859007 - RNA, 23 nt, Human
uuccuuaccuuuaccccaucccu

SEQ ID NO: 2859008 - RNA, 12 nt, Human
uuccuuaaguau

SEQ ID NO: 2859009 - RNA, 19 nt, Human
uuccuuaaguauaucaugu

SEQ ID NO: 2859010 - RNA, 20 nt, Human
uuccuuaaguauaucaugua

SEQ ID NO: 2859011 - RNA, 15 nt, Human
uuccugaaaugcagu

SEQ ID NO: 2859012 - RNA, 14 nt, Human
uuccuggcuucuua

SEQ ID NO: 2859013 - RNA, 18 nt, Human
uuccuggcuuuuuaacuc

SEQ ID NO: 2859014 - RNA, 14 nt, Human
uuccuguuuguaca

SEQ ID NO: 2859015 - RNA, 22 nt, Human
uuccuguuuuguacauagauuu

SEQ ID NO: 2859016 - RNA, 15 nt, Human
uuccuguuucugaaa

SEQ ID NO: 2859017 - RNA, 16 nt, Human
uuccuguuucugaaaa

SEQ ID NO: 2859018 - RNA, 18 nt, Human
uuccuguuucugaaaaga

SEQ ID NO: 2859019 - RNA, 20 nt, Human
uuccuguuucugaaaagaaa

SEQ ID NO: 2859020 - RNA, 15 nt, Human
uuccucucuccagau

SEQ ID NO: 2859021 - RNA, 11 nt, Human
uuccucucugg

SEQ ID NO: 2859022 - RNA, 18 nt, Human
uuccucucugguggcucu

SEQ ID NO: 2859023 - RNA, 14 nt, Human
uuccucucuccaga

SEQ ID NO: 2859024 - RNA, 13 nt, Human
uuccucugagccu

SEQ ID NO: 2859025 - RNA, 19 nt, Human
uuccucuccacugccuucg

SEQ ID NO: 2859026 - RNA, 15 nt, Human
uuccucuccuuccuu

SEQ ID NO: 2859027 - RNA, 19 nt, Human
uuccucuccuucguauccc

SEQ ID NO: 2859028 - RNA, 22 nt, Human
uuccucuccuucguaucccgag

SEQ ID NO: 2859029 - RNA, 16 nt, Human
uuccucuccacugccu

SEQ ID NO: 2859030 - RNA, 18 nt, Human
uuccucuccacugccuuc

SEQ ID NO: 2859031 - RNA, 22 nt, Human
uucccgcggguuccgcaggcag

SEQ ID NO: 2859032 - RNA, 14 nt, Human
uuccuaacuuuuca

SEQ ID NO: 2859033 - RNA, 22 nt, Human
uuccuaacuuuucaaugacauu

SEQ ID NO: 2859034 - RNA, 16 nt, Human
uuccuaagaagcuucu

SEQ ID NO: 2859035 - RNA, 18 nt, Human
uuccuaagaagcuucuaa

SEQ ID NO: 2859036 - RNA, 18 nt, Human
uuccuaagaccugggguu

SEQ ID NO: 2859037 - RNA, 13 nt, Human
uuccuaagccacu

SEQ ID NO: 2859038 - RNA, 21 nt, Human
uuccuaagccacuugaaaugu

SEQ ID NO: 2859039 - RNA, 22 nt, Human
uuccuaagccacuugaaauguu

SEQ ID NO: 2859040 - RNA, 17 nt, Human
uuccuaagccuguggcu

SEQ ID NO: 2859041 - RNA, 19 nt, Human
uuccuaagccuguggcugu

SEQ ID NO: 2859042 - RNA, 22 nt, Human
uuccgaagaagaugcuccagca

SEQ ID NO: 2859043 - RNA, 15 nt, Human
uucccuaccucaggc

SEQ ID NO: 2859044 - RNA, 16 nt, Human
uuccgacccucuggga

SEQ ID NO: 2859045 - RNA, 17 nt, Human
uuccgacccucugggaa

SEQ ID NO: 2859046 - RNA, 18 nt, Human
uuccgacccucugggaac

SEQ ID NO: 2859047 - RNA, 21 nt, Human
uuccgcacuucagaauuccau

SEQ ID NO: 2859048 - RNA, 13 nt, Human
uuccgcacuuucc

SEQ ID NO: 2859049 - RNA, 15 nt, Human
uuccgcacuuuccac

SEQ ID NO: 2859050 - RNA, 22 nt, Human
uuccgcacuuuccacuucuucc

SEQ ID NO: 2859051 - RNA, 17 nt, Human
uuccgcaggcagacuac

SEQ ID NO: 2859052 - RNA, 14 nt, Human
uuccgccccugccu

SEQ ID NO: 2859053 - RNA, 16 nt, Human
uuccgccccugccugc

SEQ ID NO: 2859054 - RNA, 18 nt, Human
uuccgccccugccugcca

SEQ ID NO: 2859055 - RNA, 14 nt, Human
uuccgccccuuccc

SEQ ID NO: 2859056 - RNA, 15 nt, Human
uuccgccccuucccu

SEQ ID NO: 2859057 - RNA, 17 nt, Human
uuccgccccuucccuuc

SEQ ID NO: 2859058 - RNA, 14 nt, Human
uucccuaccucagg

SEQ ID NO: 2859059 - RNA, 13 nt, Human
uucccuaccucag

SEQ ID NO: 2859060 - RNA, 15 nt, Human
uucccuaaagugaug

SEQ ID NO: 2859061 - RNA, 14 nt, Human
uucccuaacacuua

SEQ ID NO: 2859062 - RNA, 17 nt, Human
uucccguuucuccaccu

SEQ ID NO: 2859063 - RNA, 19 nt, Human
uucccuaaaauacauuuaa

SEQ ID NO: 2859064 - RNA, 22 nt, Human
uucccuaaaauacauuuaaaac

SEQ ID NO: 2859065 - RNA, 14 nt, Human
uucccguuucucca

SEQ ID NO: 2859066 - RNA, 15 nt, Human
uucccguuucuccac

SEQ ID NO: 2859067 - RNA, 21 nt, Human
auauuugcuagacucuagaca

SEQ ID NO: 2859068 - RNA, 13 nt, Human
auauuugcuuuuu

SEQ ID NO: 2859069 - RNA, 21 nt, Human
auauuuggaagaaaaaaaucu

SEQ ID NO: 2859070 - RNA, 23 nt, Human
auauuuggaagaaaaaaaucuuc

SEQ ID NO: 2859071 - RNA, 13 nt, Human
auauuugaauuuu

SEQ ID NO: 2859072 - RNA, 20 nt, Human
auauuugaauuuuaaaucua

SEQ ID NO: 2859073 - RNA, 15 nt, Human
auauuugacuauucu

SEQ ID NO: 2859074 - RNA, 15 nt, Human
auauuugacuugcau

SEQ ID NO: 2859075 - RNA, 16 nt, Human
auauuugacuugcaug

SEQ ID NO: 2859076 - RNA, 20 nt, Human
auauuugacuugcaugaaga

SEQ ID NO: 2859077 - RNA, 22 nt, Human
auauuugacuugcaugaagaga

SEQ ID NO: 2859078 - RNA, 16 nt, Human
uuccccuuuugccaau

SEQ ID NO: 2859079 - RNA, 15 nt, Human
auauuuggcuuaaau

SEQ ID NO: 2859080 - RNA, 18 nt, Human
auauuuggcuuaaauaua

SEQ ID NO: 2859081 - RNA, 21 nt, Human
auauuuggcuuaaauauaguu

SEQ ID NO: 2859082 - RNA, 14 nt, Human
uucccgcucagccc

SEQ ID NO: 2859083 - RNA, 15 nt, Human
uucccgcucagcccu

SEQ ID NO: 2859084 - RNA, 12 nt, Human
uucccgcucagc

SEQ ID NO: 2859085 - RNA, 21 nt, Human
uucccgccagagggcuuguga

SEQ ID NO: 2859086 - RNA, 22 nt, Human
auauuuaacauuauuuauaugg

SEQ ID NO: 2859087 - RNA, 21 nt, Human
auauuuaaguauaaaauacaa

SEQ ID NO: 2859088 - RNA, 14 nt, Human
auauuuaaugcauu

SEQ ID NO: 2859089 - RNA, 19 nt, Human
auauuuaaugcauuaaacc

SEQ ID NO: 2859090 - RNA, 21 nt, Human
auauuuaaugcauuaaaccug

SEQ ID NO: 2859091 - RNA, 22 nt, Human
auauuuaaugcauuaaaccugu

SEQ ID NO: 2859092 - RNA, 23 nt, Human
auauuuaaugcauuaaaccuguc

SEQ ID NO: 2859093 - RNA, 13 nt, Human
auauuuaauguuu

SEQ ID NO: 2859094 - RNA, 14 nt, Human
auauuuaauguuuu

SEQ ID NO: 2859095 - RNA, 15 nt, Human
auauuuaauguuuua

SEQ ID NO: 2859096 - RNA, 20 nt, Human
auauuuaauguuuuaaaugu

SEQ ID NO: 2859097 - RNA, 21 nt, Human
auauuuaauguuuuaaaugua

SEQ ID NO: 2859098 - RNA, 22 nt, Human
auauuuaauguuuuaaauguac

SEQ ID NO: 2859099 - RNA, 14 nt, Human
auauuuaauuauua

SEQ ID NO: 2859100 - RNA, 15 nt, Human
auauuuaauuauuaa

SEQ ID NO: 2859101 - RNA, 17 nt, Human
auauuuaauuauuaacu

SEQ ID NO: 2859102 - RNA, 23 nt, Human
auauuuaaugauaaguaaaugcu

SEQ ID NO: 2859103 - RNA, 13 nt, Human
auauuuaaugaua

SEQ ID NO: 2859104 - RNA, 12 nt, Human
auauuuaaugau

SEQ ID NO: 2859105 - RNA, 18 nt, Human
auauuguuucuuuaucac

SEQ ID NO: 2859106 - RNA, 19 nt, Human
auauuuaacauuauuuaua

SEQ ID NO: 2859107 - RNA, 13 nt, Human
auauuuaacuggu

SEQ ID NO: 2859108 - RNA, 16 nt, Human
auauuuaacuggugca

SEQ ID NO: 2859109 - RNA, 18 nt, Human
auauuuaagcaacaucuu

SEQ ID NO: 2859110 - RNA, 20 nt, Human
auauugugccaauauguauu

SEQ ID NO: 2859111 - RNA, 21 nt, Human
auauugugccaauauguauug

SEQ ID NO: 2859112 - RNA, 16 nt, Human
auauuguuguauaauu

SEQ ID NO: 2859113 - RNA, 18 nt, Human
auauuguuguauaauuuc

SEQ ID NO: 2859114 - RNA, 22 nt, Human
auauuguuguauaauuucgaga

SEQ ID NO: 2859115 - RNA, 14 nt, Human
auauugugaacauu

SEQ ID NO: 2859116 - RNA, 12 nt, Human
auauugugccaa

SEQ ID NO: 2859117 - RNA, 18 nt, Human
auauugugccaauaugua

SEQ ID NO: 2859118 - RNA, 19 nt, Human
auauugugccaauauguau

SEQ ID NO: 2859119 - RNA, 13 nt, Human
auauuguacauaa

SEQ ID NO: 2859120 - RNA, 14 nt, Human
auauuguacauaaa

SEQ ID NO: 2859121 - RNA, 16 nt, Human
auauuguacauaaaag

SEQ ID NO: 2859122 - RNA, 17 nt, Human
auauuguacauaaaaga

SEQ ID NO: 2859123 - RNA, 21 nt, Human
auauuguacauaaaagaauuu

SEQ ID NO: 2859124 - RNA, 16 nt, Human
auauugucauaucagc

SEQ ID NO: 2859125 - RNA, 17 nt, Human
auauugagucaaauggu

SEQ ID NO: 2859126 - RNA, 17 nt, Human
auauugcuguauagcuc

SEQ ID NO: 2859127 - RNA, 15 nt, Human
auauugguauucacu

SEQ ID NO: 2859128 - RNA, 17 nt, Human
auauuggcauggauuuc

SEQ ID NO: 2859129 - RNA, 15 nt, Human
auauuggaaaaauca

SEQ ID NO: 2859130 - RNA, 13 nt, Human
auauugguauuca

SEQ ID NO: 2859131 - RNA, 15 nt, Human
auauucuauuuuuau

SEQ ID NO: 2859132 - RNA, 20 nt, Human
auauucuauaugaauuuaaa

SEQ ID NO: 2859133 - RNA, 18 nt, Human
auauucuauaugaauuua

SEQ ID NO: 2859134 - RNA, 23 nt, Human
auauucuaagacuuacucuaaga

SEQ ID NO: 2859135 - RNA, 13 nt, Human
auauucuaagacu

SEQ ID NO: 2859136 - RNA, 14 nt, Human
auauucuaagacuu

SEQ ID NO: 2859137 - RNA, 16 nt, Human
auauucuaaaaccauu

SEQ ID NO: 2859138 - RNA, 12 nt, Human
auauuccuuuga

SEQ ID NO: 2859139 - RNA, 16 nt, Human
auauuccuuugaagau

SEQ ID NO: 2859140 - RNA, 21 nt, Human
auauuccugcauuugugaaau

SEQ ID NO: 2859141 - RNA, 16 nt, Human
auauugaggcuuugug

SEQ ID NO: 2859142 - RNA, 17 nt, Human
auauugaggcuuugugu

SEQ ID NO: 2859143 - RNA, 18 nt, Human
auauugaggcuuuguguu

SEQ ID NO: 2859144 - RNA, 19 nt, Human
auauugaggcuuuguguug

SEQ ID NO: 2859145 - RNA, 22 nt, Human
auauugaggcuuuguguuguaa

SEQ ID NO: 2859146 - RNA, 18 nt, Human
auauugaauguuuccaac

SEQ ID NO: 2859147 - RNA, 21 nt, Human
auauugaauauaauauauuug

SEQ ID NO: 2859148 - RNA, 12 nt, Human
auauugacauuu

SEQ ID NO: 2859149 - RNA, 13 nt, Human
auauugacauuug

SEQ ID NO: 2859150 - RNA, 14 nt, Human
auauugacauuugu

SEQ ID NO: 2859151 - RNA, 15 nt, Human
auauugacauuugua

SEQ ID NO: 2859152 - RNA, 16 nt, Human
auauugacauuuguag

SEQ ID NO: 2859153 - RNA, 20 nt, Human
auauugacauuuguaguuga

SEQ ID NO: 2859154 - RNA, 12 nt, Human
auauuaauguac

SEQ ID NO: 2859155 - RNA, 18 nt, Human
auauuaauguacuuguuu

SEQ ID NO: 2859156 - RNA, 15 nt, Human
auauuaauuuucuac

SEQ ID NO: 2859157 - RNA, 21 nt, Human
auauuaauuuucuacaaauaa

SEQ ID NO: 2859158 - RNA, 15 nt, Human
auauuacacauuugu

SEQ ID NO: 2859159 - RNA, 16 nt, Human
auauuacacauuugua

SEQ ID NO: 2859160 - RNA, 18 nt, Human
auauguugaauacuuuuu

SEQ ID NO: 2859161 - RNA, 17 nt, Human
auauguugaauacuuuu

SEQ ID NO: 2859162 - RNA, 16 nt, Human
auauguugaauacuuu

SEQ ID NO: 2859163 - RNA, 15 nt, Human
auauguugaauacuu

SEQ ID NO: 2859164 - RNA, 15 nt, Human
auauuaaaagucaca

SEQ ID NO: 2859165 - RNA, 18 nt, Human
auauuaaaagucacaaug

SEQ ID NO: 2859166 - RNA, 23 nt, Human
auauuaaaagucacaauguucuu

SEQ ID NO: 2859167 - RNA, 23 nt, Human
auauuaaaaauauggaacuucua

SEQ ID NO: 2859168 - RNA, 22 nt, Human
uuccagugaaaucaguuacucu

SEQ ID NO: 2859169 - RNA, 14 nt, Human
uuccagucucaaaa

SEQ ID NO: 2859170 - RNA, 19 nt, Human
uuccagucucaaaaauaca

SEQ ID NO: 2859171 - RNA, 20 nt, Human
uucccaggaugagcauccca

SEQ ID NO: 2859172 - RNA, 22 nt, Human
uucccagcaguggacucaaaac

SEQ ID NO: 2859173 - RNA, 17 nt, Human
uucccagugaauucuug

SEQ ID NO: 2859174 - RNA, 20 nt, Human
uucccagucuucugacaaac

SEQ ID NO: 2859175 - RNA, 14 nt, Human
uucccaguggcugc

SEQ ID NO: 2859176 - RNA, 15 nt, Human
uucccaguggcugcu

SEQ ID NO: 2859177 - RNA, 20 nt, Human
uucccaguggcugcugccca

SEQ ID NO: 2859178 - RNA, 21 nt, Human
uucccaguggcugcugcccag

SEQ ID NO: 2859179 - RNA, 16 nt, Human
uucccaguggcugcug

SEQ ID NO: 2859180 - RNA, 17 nt, Human
uucccaguggcugcugc

SEQ ID NO: 2859181 - RNA, 18 nt, Human
uucccaguggcugcugcc

SEQ ID NO: 2859182 - RNA, 19 nt, Human
uucccaguggcugcugccc

SEQ ID NO: 2859183 - RNA, 18 nt, Human
uucccagguucuguuuau

SEQ ID NO: 2859184 - RNA, 15 nt, Human
auauguucaacugga

SEQ ID NO: 2859185 - RNA, 12 nt, Human
auauguucaacu

SEQ ID NO: 2859186 - RNA, 23 nt, Human
auauguuaagcagcuaaauuuuc

SEQ ID NO: 2859187 - RNA, 14 nt, Human
auauguguugaaaa

SEQ ID NO: 2859188 - RNA, 18 nt, Human
auauguguugaaaaccaa

SEQ ID NO: 2859189 - RNA, 20 nt, Human
auauguguugaaaaccaaaa

SEQ ID NO: 2859190 - RNA, 14 nt, Human
auauguugaauacu

SEQ ID NO: 2859191 - RNA, 16 nt, Human
auauguucaacuggag

SEQ ID NO: 2859192 - RNA, 14 nt, Human
uucagcuaagcuag

SEQ ID NO: 2859193 - RNA, 20 nt, Human
uucagcuaagcuaggaauga

SEQ ID NO: 2859194 - RNA, 13 nt, Human
uucagcuaaggga

SEQ ID NO: 2859195 - RNA, 18 nt, Human
uucagcuaagggaagaca

SEQ ID NO: 2859196 - RNA, 20 nt, Human
uucagcuaagggaagacauu

SEQ ID NO: 2859197 - RNA, 21 nt, Human
uucagcuaagggaagacauuu

SEQ ID NO: 2859198 - RNA, 23 nt, Human
uucagcuaagggaagacauuucu

SEQ ID NO: 2859199 - RNA, 19 nt, Human
uucagcuagcuuuuaggaa

SEQ ID NO: 2859200 - RNA, 20 nt, Human
uucagcuagcuuuuaggaaa

SEQ ID NO: 2859201 - RNA, 16 nt, Human
uucagcauucccuccc

SEQ ID NO: 2859202 - RNA, 17 nt, Human
uucagcauucccuccca

SEQ ID NO: 2859203 - RNA, 22 nt, Human
uucagauuuugauaacuguuua

SEQ ID NO: 2859204 - RNA, 23 nt, Human
uucagauuuugauaacuguuuau

SEQ ID NO: 2859205 - RNA, 13 nt, Human
uucagcacuuguc

SEQ ID NO: 2859206 - RNA, 15 nt, Human
uucagcacuugucuc

SEQ ID NO: 2859207 - RNA, 17 nt, Human
uucagcacuugucucau

SEQ ID NO: 2859208 - RNA, 19 nt, Human
uucagcacuugucucauuu

SEQ ID NO: 2859209 - RNA, 20 nt, Human
uucagcacuugucucauuuu

SEQ ID NO: 2859210 - RNA, 21 nt, Human
uucagcacuugucucauuuua

SEQ ID NO: 2859211 - RNA, 16 nt, Human
uucagguaacaggcag

SEQ ID NO: 2859212 - RNA, 15 nt, Human
uucagguaacaggca

SEQ ID NO: 2859213 - RNA, 22 nt, Human
uucaggguuggccccugcccgg

SEQ ID NO: 2859214 - RNA, 19 nt, Human
uucaggguuggccccugcc

SEQ ID NO: 2859215 - RNA, 17 nt, Human
uucaggguuggccccug

SEQ ID NO: 2859216 - RNA, 16 nt, Human
uucaggguuggccccu

SEQ ID NO: 2859217 - RNA, 14 nt, Human
uucaggguuggccc

SEQ ID NO: 2859218 - RNA, 14 nt, Human
uucagcucacgcuu

SEQ ID NO: 2859219 - RNA, 16 nt, Human
uucagcucacgcuuca

SEQ ID NO: 2859220 - RNA, 19 nt, Human
uucagcucacgcuucacag

SEQ ID NO: 2859221 - RNA, 20 nt, Human
uucagcucacgcuucacagu

SEQ ID NO: 2859222 - RNA, 18 nt, Human
uucagauauuauugcuuu

SEQ ID NO: 2859223 - RNA, 14 nt, Human
uucagauucccaga

SEQ ID NO: 2859224 - RNA, 22 nt, Human
uucagauucccagagcaaaaua

SEQ ID NO: 2859225 - RNA, 21 nt, Human
uucagauucccagagcaaaau

SEQ ID NO: 2859226 - RNA, 11 nt, Human
uucagaagacc

SEQ ID NO: 2859227 - RNA, 15 nt, Human
uucagauauauauca

SEQ ID NO: 2859228 - RNA, 19 nt, Human
uucagaaccucuuccccag

SEQ ID NO: 2859229 - RNA, 18 nt, Human
uucagaaccucuucccca

SEQ ID NO: 2859230 - RNA, 17 nt, Human
uucagaaccucuucccc

SEQ ID NO: 2859231 - RNA, 16 nt, Human
uucagaaccucuuccc

SEQ ID NO: 2859232 - RNA, 18 nt, Human
uucagaaaacgggaagcg

SEQ ID NO: 2859233 - RNA, 22 nt, Human
uucacuuuugcaagguuccaca

SEQ ID NO: 2859234 - RNA, 13 nt, Human
uucagaaauugga

SEQ ID NO: 2859235 - RNA, 21 nt, Human
uucagaaauuggaacagaaug

SEQ ID NO: 2859236 - RNA, 22 nt, Human
uucagaacaacugcaaagaaag

SEQ ID NO: 2859237 - RNA, 15 nt, Human
uucagaaccucuucc

SEQ ID NO: 2859238 - RNA, 12 nt, Human
uucagaaccucu

SEQ ID NO: 2859239 - RNA, 16 nt, Human
uucagaaccauccaua

SEQ ID NO: 2859240 - RNA, 20 nt, Human
uucagaaauuggaacagaau

SEQ ID NO: 2859241 - RNA, 21 nt, Human
uucacuugaugauacaaugaa

SEQ ID NO: 2859242 - RNA, 20 nt, Human
uucacuucgggcuguguaaa

SEQ ID NO: 2859243 - RNA, 14 nt, Human
uucaucaagacugg

SEQ ID NO: 2859244 - RNA, 17 nt, Human
uucaguccaauaggugu

SEQ ID NO: 2859245 - RNA, 13 nt, Human
uucaucagcauuu

SEQ ID NO: 2859246 - RNA, 12 nt, Human
auauauggacau

SEQ ID NO: 2859247 - RNA, 14 nt, Human
auauauggacaugg

SEQ ID NO: 2859248 - RNA, 15 nt, Human
auauauggacauggc

SEQ ID NO: 2859249 - RNA, 14 nt, Human
auauaugccuuuuu

SEQ ID NO: 2859250 - RNA, 16 nt, Human
auauaugccuuuuucc

SEQ ID NO: 2859251 - RNA, 17 nt, Human
auauaugccuuuuuccu

SEQ ID NO: 2859252 - RNA, 18 nt, Human
auauaugccuuuuuccua

SEQ ID NO: 2859253 - RNA, 15 nt, Human
auauauggcauuugc

SEQ ID NO: 2859254 - RNA, 16 nt, Human
auauauggcauuugca

SEQ ID NO: 2859255 - RNA, 17 nt, Human
auauauggcauuugcag

SEQ ID NO: 2859256 - RNA, 22 nt, Human
auauauguuuuaagaggcaggg

SEQ ID NO: 2859257 - RNA, 21 nt, Human
auauauguuuuaagaggcagg

SEQ ID NO: 2859258 - RNA, 16 nt, Human
auauauuuaaugauaa

SEQ ID NO: 2859259 - RNA, 13 nt, Human
auauauuuauaac

SEQ ID NO: 2859260 - RNA, 12 nt, Human
auauauuuauaa

SEQ ID NO: 2859261 - RNA, 10 nt, Human
auauauuuau

SEQ ID NO: 2859262 - RNA, 23 nt, Human
auauauuuauaacucaucauaaa

SEQ ID NO: 2859263 - RNA, 21 nt, Human
auauauuuauaacucaucaua

SEQ ID NO: 2859264 - RNA, 16 nt, Human
auauauuuauaacuca

SEQ ID NO: 2859265 - RNA, 15 nt, Human
auauauuuauaacuc

SEQ ID NO: 2859266 - RNA, 14 nt, Human
auauauuuauaacu

SEQ ID NO: 2859267 - RNA, 14 nt, Human
auauauuuauuuaa

SEQ ID NO: 2859268 - RNA, 15 nt, Human
auauauuuauuuaaa

SEQ ID NO: 2859269 - RNA, 16 nt, Human
auauauuuauuuaaag

SEQ ID NO: 2859270 - RNA, 19 nt, Human
auauauuuauuuaaagcau

SEQ ID NO: 2859271 - RNA, 19 nt, Human
uucagguuuuguaaagaug

SEQ ID NO: 2859272 - RNA, 15 nt, Human
uucagguuuuguaaa

SEQ ID NO: 2859273 - RNA, 24 nt, Human
uucagguuaucgaaauaacaaugu

SEQ ID NO: 2859274 - RNA, 15 nt, Human
uucagguuguuggug

SEQ ID NO: 2859275 - RNA, 22 nt, Human
uucagguuaucgaaauaacaau

SEQ ID NO: 2859276 - RNA, 12 nt, Human
uucaguccugcu

SEQ ID NO: 2859277 - RNA, 16 nt, Human
uucaguccugcuccag

SEQ ID NO: 2859278 - RNA, 18 nt, Human
uucaguccugcuccagaa

SEQ ID NO: 2859279 - RNA, 22 nt, Human
uucaguccugggagacccaugu

SEQ ID NO: 2859280 - RNA, 16 nt, Human
uucaguccuguaguuu

SEQ ID NO: 2859281 - RNA, 20 nt, Human
uucagucagaaaacuuuaaa

SEQ ID NO: 2859282 - RNA, 21 nt, Human
uucaguauuuuggagaaauua

SEQ ID NO: 2859283 - RNA, 19 nt, Human
uucaguauuuuggagaaau

SEQ ID NO: 2859284 - RNA, 20 nt, Human
uucaguauuuuggagaaauu

SEQ ID NO: 2859285 - RNA, 18 nt, Human
uucaguauuuuggagaaa

SEQ ID NO: 2859286 - RNA, 19 nt, Human
uucaguaaacauaaagcca

SEQ ID NO: 2859287 - RNA, 17 nt, Human
uucagguaacaggcaga

SEQ ID NO: 2859288 - RNA, 21 nt, Human
uucaggguuuucugagggaaa

SEQ ID NO: 2859289 - RNA, 14 nt, Human
uucagguacuaaau

SEQ ID NO: 2859290 - RNA, 16 nt, Human
uucagguauguugccu

SEQ ID NO: 2859291 - RNA, 19 nt, Human
uucagguuaucgaaauaac

SEQ ID NO: 2859292 - RNA, 20 nt, Human
uucagguuaucgaaauaaca

SEQ ID NO: 2859293 - RNA, 21 nt, Human
uucagguuaucgaaauaacaa

SEQ ID NO: 2859294 - RNA, 21 nt, Human
uucaggugacaugugaaaccu

SEQ ID NO: 2859295 - RNA, 22 nt, Human
uucaggugacaugugaaaccuu

SEQ ID NO: 2859296 - RNA, 23 nt, Human
uucaggugacaugugaaaccuuu

SEQ ID NO: 2859297 - RNA, 17 nt, Human
uucaggugcagaggaag

SEQ ID NO: 2859298 - RNA, 18 nt, Human
uucaggugcagaggaagu

SEQ ID NO: 2859299 - RNA, 13 nt, Human
uucaggugacaug

SEQ ID NO: 2859300 - RNA, 14 nt, Human
uucaggugacaugu

SEQ ID NO: 2859301 - RNA, 14 nt, Human
uucaggugaaaaug

SEQ ID NO: 2859302 - RNA, 15 nt, Human
uucaggugaaaaugu

SEQ ID NO: 2859303 - RNA, 16 nt, Human
uucaggugacauguga

SEQ ID NO: 2859304 - RNA, 17 nt, Human
uucaggugacaugugaa

SEQ ID NO: 2859305 - RNA, 18 nt, Human
uucaggugacaugugaaa

SEQ ID NO: 2859306 - RNA, 19 nt, Human
uucaggugacaugugaaac

SEQ ID NO: 2859307 - RNA, 17 nt, Human
uucauaguaacuucuua

SEQ ID NO: 2859308 - RNA, 20 nt, Human
uucagucugaaugcugccac

SEQ ID NO: 2859309 - RNA, 14 nt, Human
uucagucuugccuu

SEQ ID NO: 2859310 - RNA, 14 nt, Human
uucagugauaacuc

SEQ ID NO: 2859311 - RNA, 21 nt, Human
uucagugauaacuccuaagag

SEQ ID NO: 2859312 - RNA, 20 nt, Human
uucauaucuauuuauuaaau

SEQ ID NO: 2859313 - RNA, 20 nt, Human
uucauaugacauucaugccu

SEQ ID NO: 2859314 - RNA, 21 nt, Human
uucauauaugaggacuugugu

SEQ ID NO: 2859315 - RNA, 18 nt, Human
uucauauaugaggacuug

SEQ ID NO: 2859316 - RNA, 19 nt, Human
uucaucaaauggaagacac

SEQ ID NO: 2859317 - RNA, 16 nt, Human
uucaucaaauggaaga

SEQ ID NO: 2859318 - RNA, 23 nt, Human
uucauaugacauucaugccuggc

SEQ ID NO: 2859319 - RNA, 13 nt, Human
auauguacuguuu

SEQ ID NO: 2859320 - RNA, 23 nt, Human
auauggguuagauguugccaugu

SEQ ID NO: 2859321 - RNA, 22 nt, Human
auaugggguauuggacauagau

SEQ ID NO: 2859322 - RNA, 16 nt, Human
auauggggaauauauu

SEQ ID NO: 2859323 - RNA, 14 nt, Human
auaugggacugagc

SEQ ID NO: 2859324 - RNA, 19 nt, Human
auauguaguauaaagaaaa

SEQ ID NO: 2859325 - RNA, 18 nt, Human
auauguaguauaaagaaa

SEQ ID NO: 2859326 - RNA, 16 nt, Human
auauguagaaggcaca

SEQ ID NO: 2859327 - RNA, 13 nt, Human
auauguagacuau

SEQ ID NO: 2859328 - RNA, 16 nt, Human
auauguagacuauaua

SEQ ID NO: 2859329 - RNA, 17 nt, Human
auauguagacuauauac

SEQ ID NO: 2859330 - RNA, 18 nt, Human
auauguagacuauauaca

SEQ ID NO: 2859331 - RNA, 19 nt, Human
auauguagacuauauacau

SEQ ID NO: 2859332 - RNA, 20 nt, Human
auauguagacuauauacaug

SEQ ID NO: 2859333 - RNA, 21 nt, Human
auauguagacuauauacaugu

SEQ ID NO: 2859334 - RNA, 23 nt, Human
auauguagacuauauacaugugu

SEQ ID NO: 2859335 - RNA, 13 nt, Human
uucauuaaagcau

SEQ ID NO: 2859336 - RNA, 18 nt, Human
uucauggaauggacaucc

SEQ ID NO: 2859337 - RNA, 19 nt, Human
uucauggaauggacauccu

SEQ ID NO: 2859338 - RNA, 20 nt, Human
uucauggaauggacauccug

SEQ ID NO: 2859339 - RNA, 22 nt, Human
uucauggaauggacauccugua

SEQ ID NO: 2859340 - RNA, 14 nt, Human
uucauuaaauguuu

SEQ ID NO: 2859341 - RNA, 15 nt, Human
uucauuaaauguuug

SEQ ID NO: 2859342 - RNA, 13 nt, Human
auauguguauaua

SEQ ID NO: 2859343 - RNA, 15 nt, Human
auauguguauauaua

SEQ ID NO: 2859344 - RNA, 16 nt, Human
auauguguauauauac

SEQ ID NO: 2859345 - RNA, 18 nt, Human
auauguguauauauacau

SEQ ID NO: 2859346 - RNA, 19 nt, Human
auauguguauauauacaua

SEQ ID NO: 2859347 - RNA, 20 nt, Human
auauguguauauauacauac

SEQ ID NO: 2859348 - RNA, 21 nt, Human
auauguguauauauacauaca

SEQ ID NO: 2859349 - RNA, 22 nt, Human
auauguguauauauacauacac

SEQ ID NO: 2859350 - RNA, 22 nt, Human
auauguguauguacguuuguau

SEQ ID NO: 2859351 - RNA, 12 nt, Human
auauguguaugu

SEQ ID NO: 2859352 - RNA, 14 nt, Human
auauguguauguac

SEQ ID NO: 2859353 - RNA, 16 nt, Human
auauguguauguacgu

SEQ ID NO: 2859354 - RNA, 13 nt, Human
auauggccacagu

SEQ ID NO: 2859355 - RNA, 23 nt, Human
auauggccacaguagucuugaug

SEQ ID NO: 2859356 - RNA, 23 nt, Human
auaugggaacacuggcagacugu

SEQ ID NO: 2859357 - RNA, 21 nt, Human
auaugagcuuccuucugugaa

SEQ ID NO: 2859358 - RNA, 20 nt, Human
auaugacucacaugaugcau

SEQ ID NO: 2859359 - RNA, 13 nt, Human
auaugacucacau

SEQ ID NO: 2859360 - RNA, 19 nt, Human
auaugacauucaugccugg

SEQ ID NO: 2859361 - RNA, 22 nt, Human
auaugagcuuccuucugugaaa

SEQ ID NO: 2859362 - RNA, 13 nt, Human
auaugagaagaau

SEQ ID NO: 2859363 - RNA, 15 nt, Human
auaugagaagaauag

SEQ ID NO: 2859364 - RNA, 23 nt, Human
auaugagaaggugccucaagaau

SEQ ID NO: 2859365 - RNA, 12 nt, Human
auaugauuuaua

SEQ ID NO: 2859366 - RNA, 13 nt, Human
auaugauuuauag

SEQ ID NO: 2859367 - RNA, 14 nt, Human
auaugauuuauagu

SEQ ID NO: 2859368 - RNA, 17 nt, Human
auaugauuucacuagaa

SEQ ID NO: 2859369 - RNA, 18 nt, Human
auaugauuucacuagaaa

SEQ ID NO: 2859370 - RNA, 23 nt, Human
auaugauuucacuagaaaagcug

SEQ ID NO: 2859371 - RNA, 16 nt, Human
auaugauuuuuuaaaa

SEQ ID NO: 2859372 - RNA, 17 nt, Human
auaugauuuuuuaaaag

SEQ ID NO: 2859373 - RNA, 18 nt, Human
auaugauuuuuuaaaaga

SEQ ID NO: 2859374 - RNA, 19 nt, Human
auaugauuuuuuaaaagaa

SEQ ID NO: 2859375 - RNA, 22 nt, Human
auaugauuuuuuaaaagaaauu

SEQ ID NO: 2859376 - RNA, 22 nt, Human
auauauuuuuaaaaaaugaaau

SEQ ID NO: 2859377 - RNA, 21 nt, Human
auauauuuuaccauacauuua

SEQ ID NO: 2859378 - RNA, 18 nt, Human
auaugaacccuuuguuuc

SEQ ID NO: 2859379 - RNA, 19 nt, Human
auaugaacccuuuguuucu

SEQ ID NO: 2859380 - RNA, 23 nt, Human
auaugaaguaucuaaaaguguca

SEQ ID NO: 2859381 - RNA, 19 nt, Human
auaugaaguuacuuucuua

SEQ ID NO: 2859382 - RNA, 13 nt, Human
auaugaaucugcu

SEQ ID NO: 2859383 - RNA, 17 nt, Human
auaugaauuuaaauaua

SEQ ID NO: 2859384 - RNA, 21 nt, Human
auaugaauuuaaauauaauuc

SEQ ID NO: 2859385 - RNA, 14 nt, Human
uucauuauguaaaa

SEQ ID NO: 2859386 - RNA, 17 nt, Human
uucauuauguaaaaugu

SEQ ID NO: 2859387 - RNA, 22 nt, Human
uucauuauuaguacugcucuug

SEQ ID NO: 2859388 - RNA, 14 nt, Human
uucauuagcuguga

SEQ ID NO: 2859389 - RNA, 13 nt, Human
uucauuagagcag

SEQ ID NO: 2859390 - RNA, 16 nt, Human
uucauuaauucuauaa

SEQ ID NO: 2859391 - RNA, 20 nt, Human
uucauuacaauggaaacaau

SEQ ID NO: 2859392 - RNA, 13 nt, Human
uucauuaccuuuu

SEQ ID NO: 2859393 - RNA, 21 nt, Human
uucauuaccuuuuuugauaaa

SEQ ID NO: 2859394 - RNA, 21 nt, Human
uucauuacuugauuaagauuu

SEQ ID NO: 2859395 - RNA, 15 nt, Human
uucauucaauauuga

SEQ ID NO: 2859396 - RNA, 16 nt, Human
uucauucaauauugac

SEQ ID NO: 2859397 - RNA, 17 nt, Human
uucauucaauauugaca

SEQ ID NO: 2859398 - RNA, 18 nt, Human
uucauucaauauugacau

SEQ ID NO: 2859399 - RNA, 19 nt, Human
uucauucaauauugacauu

SEQ ID NO: 2859400 - RNA, 21 nt, Human
uucauucaauauugacauuug

SEQ ID NO: 2859401 - RNA, 17 nt, Human
uucauucugugaucauu

SEQ ID NO: 2859402 - RNA, 18 nt, Human
uucauugauuuccugugu

SEQ ID NO: 2859403 - RNA, 20 nt, Human
uucauugauuuccuguguca

SEQ ID NO: 2859404 - RNA, 17 nt, Human
uucauugagaguuuugu

SEQ ID NO: 2859405 - RNA, 19 nt, Human
uucauugagaguuuugucu

SEQ ID NO: 2859406 - RNA, 22 nt, Human
uucauugagaguuuugucuuga

SEQ ID NO: 2859407 - RNA, 13 nt, Human
uuccaagaaagau

SEQ ID NO: 2859408 - RNA, 21 nt, Human
uuccaagaaagaugaauacau

SEQ ID NO: 2859409 - RNA, 23 nt, Human
uuccaagaaagaugaauacauuu

SEQ ID NO: 2859410 - RNA, 23 nt, Human
uuccaagaauagcaucuguacaa

SEQ ID NO: 2859411 - RNA, 22 nt, Human
uuccaacuguauauauucccaa

SEQ ID NO: 2859412 - RNA, 22 nt, Human
uucauuggucuaauuuauucaa

SEQ ID NO: 2859413 - RNA, 16 nt, Human
uucauugguuaauuuu

SEQ ID NO: 2859414 - RNA, 17 nt, Human
uucauugguuaauuuuu

SEQ ID NO: 2859415 - RNA, 18 nt, Human
uucauugccuguguaugg

SEQ ID NO: 2859416 - RNA, 19 nt, Human
uucauugcacuuugauuag

SEQ ID NO: 2859417 - RNA, 15 nt, Human
uuccaagacucuaga

SEQ ID NO: 2859418 - RNA, 16 nt, Human
uuccaagacucuagag

SEQ ID NO: 2859419 - RNA, 17 nt, Human
uuccaagacucuagagu

SEQ ID NO: 2859420 - RNA, 18 nt, Human
uuccacaaaaucugucca

SEQ ID NO: 2859421 - RNA, 11 nt, Human
uuccacaaaau

SEQ ID NO: 2859422 - RNA, 21 nt, Human
uuccaauuuucuggaauacau

SEQ ID NO: 2859423 - RNA, 21 nt, Human
uuccaagacucuagaguccaa

SEQ ID NO: 2859424 - RNA, 14 nt, Human
uuccagggcaauca

SEQ ID NO: 2859425 - RNA, 15 nt, Human
uuccaggggaaccug

SEQ ID NO: 2859426 - RNA, 14 nt, Human
uuccaggggaaccu

SEQ ID NO: 2859427 - RNA, 18 nt, Human
uuccaggggaaccugcca

SEQ ID NO: 2859428 - RNA, 17 nt, Human
uuccaggggaaccugcc

SEQ ID NO: 2859429 - RNA, 19 nt, Human
uuccacguguuuuauuccu

SEQ ID NO: 2859430 - RNA, 20 nt, Human
uuccacagaguaagacauug

SEQ ID NO: 2859431 - RNA, 12 nt, Human
uuccacagauug

SEQ ID NO: 2859432 - RNA, 18 nt, Human
uuccacagauuguuucua

SEQ ID NO: 2859433 - RNA, 19 nt, Human
uuccacagauuguuucuau

SEQ ID NO: 2859434 - RNA, 15 nt, Human
uuccacaugcucuga

SEQ ID NO: 2859435 - RNA, 16 nt, Human
uuccacaugcucugag

SEQ ID NO: 2859436 - RNA, 16 nt, Human
uuccacaguugccacc

SEQ ID NO: 2859437 - RNA, 17 nt, Human
uuccacaguugccacca

SEQ ID NO: 2859438 - RNA, 18 nt, Human
uuccacaguugccaccac

SEQ ID NO: 2859439 - RNA, 21 nt, Human
uuccacaguugccaccaccuc

SEQ ID NO: 2859440 - RNA, 15 nt, Human
uuccaccuucccaug

SEQ ID NO: 2859441 - RNA, 21 nt, Human
auggccucuuacuaauguaaa

SEQ ID NO: 2859442 - RNA, 22 nt, Human
auggccucuuacuaauguaaaa

SEQ ID NO: 2859443 - RNA, 17 nt, Human
auggacggugcuccagg

SEQ ID NO: 2859444 - RNA, 19 nt, Human
auggccugagacuuucuuu

SEQ ID NO: 2859445 - RNA, 12 nt, Human
auggaauuuaua

SEQ ID NO: 2859446 - RNA, 21 nt, Human
auggaauuuauaauucaguau

SEQ ID NO: 2859447 - RNA, 13 nt, Human
auggaauuucaua

SEQ ID NO: 2859448 - RNA, 19 nt, Human
auggaauugauuugcauug

SEQ ID NO: 2859449 - RNA, 18 nt, Human
auggaauugauuugcauu

SEQ ID NO: 2859450 - RNA, 15 nt, Human
auggaccacuguuuc

SEQ ID NO: 2859451 - RNA, 16 nt, Human
auggaccacuguuucu

SEQ ID NO: 2859452 - RNA, 18 nt, Human
auggaccacuguuucuug

SEQ ID NO: 2859453 - RNA, 21 nt, Human
auggaccacuguuucuugcuu

SEQ ID NO: 2859454 - RNA, 22 nt, Human
auggaccacuguuucuugcuug

SEQ ID NO: 2859455 - RNA, 13 nt, Human
auggacauggugg

SEQ ID NO: 2859456 - RNA, 14 nt, Human
auggacaugguggc

SEQ ID NO: 2859457 - RNA, 14 nt, Human
auggaccugucacg

SEQ ID NO: 2859458 - RNA, 15 nt, Human
auggaccuucuagaa

SEQ ID NO: 2859459 - RNA, 21 nt, Human
auggccucagcugccucacuu

SEQ ID NO: 2859460 - RNA, 19 nt, Human
auggccucagcugccucac

SEQ ID NO: 2859461 - RNA, 18 nt, Human
auggccucagcugccuca

SEQ ID NO: 2859462 - RNA, 17 nt, Human
auggccucagcugccuc

SEQ ID NO: 2859463 - RNA, 16 nt, Human
auggccucagcugccu

SEQ ID NO: 2859464 - RNA, 13 nt, Human
auggacggugcuc

SEQ ID NO: 2859465 - RNA, 15 nt, Human
auggacggugcucca

SEQ ID NO: 2859466 - RNA, 15 nt, Human
auggccucagcugcc

SEQ ID NO: 2859467 - RNA, 24 nt, Human
augggagcuccucuccuggaggau

SEQ ID NO: 2859468 - RNA, 18 nt, Human
augggcacaaagggccca

SEQ ID NO: 2859469 - RNA, 20 nt, Human
augggcacaaagggcccaga

SEQ ID NO: 2859470 - RNA, 15 nt, Human
augggccuccugugu

SEQ ID NO: 2859471 - RNA, 16 nt, Human
augggccacugaaauc

SEQ ID NO: 2859472 - RNA, 19 nt, Human
augggccacugaaaucugu

SEQ ID NO: 2859473 - RNA, 23 nt, Human
augggccacugaaaucugucaag

SEQ ID NO: 2859474 - RNA, 12 nt, Human
augggccagccc

SEQ ID NO: 2859475 - RNA, 15 nt, Human
augggccagccccuc

SEQ ID NO: 2859476 - RNA, 20 nt, Human
augggccagccccuccaucu

SEQ ID NO: 2859477 - RNA, 22 nt, Human
augggccagccccuccaucugu

SEQ ID NO: 2859478 - RNA, 17 nt, Human
augggcaucuaugggag

SEQ ID NO: 2859479 - RNA, 14 nt, Human
augggcauugacaa

SEQ ID NO: 2859480 - RNA, 16 nt, Human
augggcauugacaaau

SEQ ID NO: 2859481 - RNA, 21 nt, Human
augggcaacccccagccugcu

SEQ ID NO: 2859482 - RNA, 19 nt, Human
augggcaacccccagccug

SEQ ID NO: 2859483 - RNA, 18 nt, Human
augggcaacccccagccu

SEQ ID NO: 2859484 - RNA, 14 nt, Human
augggagcuccucu

SEQ ID NO: 2859485 - RNA, 15 nt, Human
augggagcuccucuc

SEQ ID NO: 2859486 - RNA, 19 nt, Human
augggagcuccucuccugg

SEQ ID NO: 2859487 - RNA, 20 nt, Human
augggagcuccucuccugga

SEQ ID NO: 2859488 - RNA, 21 nt, Human
augggagcuccucuccuggag

SEQ ID NO: 2859489 - RNA, 22 nt, Human
augggagcuccucuccuggagg

SEQ ID NO: 2859490 - RNA, 23 nt, Human
augggagcuccucuccuggagga

SEQ ID NO: 2859491 - RNA, 22 nt, Human
augggagccccagggucuuccc

SEQ ID NO: 2859492 - RNA, 13 nt, Human
augggagccccag

SEQ ID NO: 2859493 - RNA, 23 nt, Human
augggagaguagauggugaaauu

SEQ ID NO: 2859494 - RNA, 19 nt, Human
augggagagugucaaccag

SEQ ID NO: 2859495 - RNA, 23 nt, Human
augggagagugucaaccagacag

SEQ ID NO: 2859496 - RNA, 20 nt, Human
augggagcaguccaugcaug

SEQ ID NO: 2859497 - RNA, 22 nt, Human
augggagcaguccaugcaugac

SEQ ID NO: 2859498 - RNA, 15 nt, Human
augggacuggccucu

SEQ ID NO: 2859499 - RNA, 13 nt, Human
uuucgauaaacaa

SEQ ID NO: 2859500 - RNA, 20 nt, Human
uuucgauaaacaacaaggug

SEQ ID NO: 2859501 - RNA, 22 nt, Human
uuucgauucguuaagagagcaa

SEQ ID NO: 2859502 - RNA, 19 nt, Human
uuucgccguugaagaggaa

SEQ ID NO: 2859503 - RNA, 15 nt, Human
uuucgugagccccau

SEQ ID NO: 2859504 - RNA, 18 nt, Human
uuucgugagccccaucuu

SEQ ID NO: 2859505 - RNA, 13 nt, Human
uuucguaugaaaa

SEQ ID NO: 2859506 - RNA, 14 nt, Human
uuucguaugaaaau

SEQ ID NO: 2859507 - RNA, 19 nt, Human
uuucguccacagcuuccug

SEQ ID NO: 2859508 - RNA, 20 nt, Human
uuucguccacagcuuccugu

SEQ ID NO: 2859509 - RNA, 23 nt, Human
uuucguccacagcuuccuguccc

SEQ ID NO: 2859510 - RNA, 14 nt, Human
uuucguuucuguau

SEQ ID NO: 2859511 - RNA, 21 nt, Human
uuucuaaaaucuuauaguucu

SEQ ID NO: 2859512 - RNA, 12 nt, Human
uuucuaaaaucu

SEQ ID NO: 2859513 - RNA, 14 nt, Human
uuucuaaaaaacag

SEQ ID NO: 2859514 - RNA, 15 nt, Human
uuucuaaaaagauua

SEQ ID NO: 2859515 - RNA, 20 nt, Human
uuucuaaaaagauuagcaag

SEQ ID NO: 2859516 - RNA, 12 nt, Human
uuucuaaaagaa

SEQ ID NO: 2859517 - RNA, 15 nt, Human
uuucuaaaagaauau

SEQ ID NO: 2859518 - RNA, 20 nt, Human
uuucuaaaagaauauucaga

SEQ ID NO: 2859519 - RNA, 13 nt, Human
uuucuaaaagacu

SEQ ID NO: 2859520 - RNA, 23 nt, Human
uuuccuuuaaaaaaauuuaagug

SEQ ID NO: 2859521 - RNA, 19 nt, Human
uuuccuuuauauuuaguga

SEQ ID NO: 2859522 - RNA, 16 nt, Human
uuuccuuuccccagcc

SEQ ID NO: 2859523 - RNA, 17 nt, Human
uuuccuuuccccagccc

SEQ ID NO: 2859524 - RNA, 21 nt, Human
uuuccuuuaaaaaaauuuaag

SEQ ID NO: 2859525 - RNA, 22 nt, Human
uuuccuuuaaaaaaauuuaagu

SEQ ID NO: 2859526 - RNA, 13 nt, Human
uuuccuugugcaa

SEQ ID NO: 2859527 - RNA, 15 nt, Human
uuuccuugugcaaaa

SEQ ID NO: 2859528 - RNA, 18 nt, Human
uuuccuuguggcagagga

SEQ ID NO: 2859529 - RNA, 21 nt, Human
uuuccuuguggcagaggaugu

SEQ ID NO: 2859530 - RNA, 16 nt, Human
uuuccuuguuuaucag

SEQ ID NO: 2859531 - RNA, 19 nt, Human
uuuccuuguuuaucagaua

SEQ ID NO: 2859532 - RNA, 16 nt, Human
uuuccuuggcuggugc

SEQ ID NO: 2859533 - RNA, 21 nt, Human
uuuccuuuucuauuccuucug

SEQ ID NO: 2859534 - RNA, 21 nt, Human
uuuccuuugugguuuuaugga

SEQ ID NO: 2859535 - RNA, 16 nt, Human
uuuccuuuuucugauu

SEQ ID NO: 2859536 - RNA, 17 nt, Human
uuuccuuuuucugauua

SEQ ID NO: 2859537 - RNA, 21 nt, Human
uuuccuuuuaaaacacuucca

SEQ ID NO: 2859538 - RNA, 9 nt, Human
uuuccuuug

SEQ ID NO: 2859539 - RNA, 13 nt, Human
uuuccuuugcucu

SEQ ID NO: 2859540 - RNA, 20 nt, Human
uuuccuuuccccagcccagg

SEQ ID NO: 2859541 - RNA, 17 nt, Human
uuuccuuuuuuguuauu

SEQ ID NO: 2859542 - RNA, 16 nt, Human
uuuccuuuuuuguuau

SEQ ID NO: 2859543 - RNA, 13 nt, Human
uuuccuucagugc

SEQ ID NO: 2859544 - RNA, 13 nt, Human
uuuccuuaccuuu

SEQ ID NO: 2859545 - RNA, 14 nt, Human
uuuccuuauuugcu

SEQ ID NO: 2859546 - RNA, 12 nt, Human
uuuccuuccuaa

SEQ ID NO: 2859547 - RNA, 19 nt, Human
uuuccuucaagccagcaac

SEQ ID NO: 2859548 - RNA, 15 nt, Human
uuuccuuccaucccu

SEQ ID NO: 2859549 - RNA, 14 nt, Human
uuuccuuccauccc

SEQ ID NO: 2859550 - RNA, 19 nt, Human
uuuccuuccaucccuaccc

SEQ ID NO: 2859551 - RNA, 12 nt, Human
uuuccugugucu

SEQ ID NO: 2859552 - RNA, 17 nt, Human
augggccuccugugugu

SEQ ID NO: 2859553 - RNA, 22 nt, Human
uuuccugugucagcgccuggcc

SEQ ID NO: 2859554 - RNA, 16 nt, Human
uuuccuguuucugaaa

SEQ ID NO: 2859555 - RNA, 17 nt, Human
uuuccuguuucugaaaa

SEQ ID NO: 2859556 - RNA, 20 nt, Human
uuuccuguuucugaaaagaa

SEQ ID NO: 2859557 - RNA, 19 nt, Human
uuuccuuaaauuaucuaaa

SEQ ID NO: 2859558 - RNA, 15 nt, Human
augggcuuucucuuu

SEQ ID NO: 2859559 - RNA, 19 nt, Human
augggcuucacuguauaaa

SEQ ID NO: 2859560 - RNA, 20 nt, Human
augggcuucacuguauaaau

SEQ ID NO: 2859561 - RNA, 16 nt, Human
augggcuuagagcagu

SEQ ID NO: 2859562 - RNA, 15 nt, Human
augggcuucacugua

SEQ ID NO: 2859563 - RNA, 15 nt, Human
auggggaaaaaaauc

SEQ ID NO: 2859564 - RNA, 17 nt, Human
auggggaaaaaaaucau

SEQ ID NO: 2859565 - RNA, 20 nt, Human
auggggaaaaaaaucaucua

SEQ ID NO: 2859566 - RNA, 22 nt, Human
auggggaaucuaagagagcugc

SEQ ID NO: 2859567 - RNA, 16 nt, Human
auggggagaggaacuc

SEQ ID NO: 2859568 - RNA, 17 nt, Human
auggggaggcaagugug

SEQ ID NO: 2859569 - RNA, 19 nt, Human
uuugaaagugaauaaacuu

SEQ ID NO: 2859570 - RNA, 21 nt, Human
uuugaaagugaauaaacuuca

SEQ ID NO: 2859571 - RNA, 20 nt, Human
uuugaaauagucugugugaa

SEQ ID NO: 2859572 - RNA, 19 nt, Human
uuugaaauagucuguguga

SEQ ID NO: 2859573 - RNA, 13 nt, Human
uuugaaauaccuc

SEQ ID NO: 2859574 - RNA, 15 nt, Human
uuugaaauaccucau

SEQ ID NO: 2859575 - RNA, 18 nt, Human
uuugaaauaccucauguu

SEQ ID NO: 2859576 - RNA, 19 nt, Human
uuugaaauaccucauguuu

SEQ ID NO: 2859577 - RNA, 20 nt, Human
uuugaaauaccucauguuua

SEQ ID NO: 2859578 - RNA, 23 nt, Human
uuugaaagacuuccaaagaaugu

SEQ ID NO: 2859579 - RNA, 15 nt, Human
uuugaaaccugcucu

SEQ ID NO: 2859580 - RNA, 22 nt, Human
uuugaaagggaucaucaugcag

SEQ ID NO: 2859581 - RNA, 13 nt, Human
uuucuuuguggcu

SEQ ID NO: 2859582 - RNA, 16 nt, Human
uuucuuuguuaucaaa

SEQ ID NO: 2859583 - RNA, 15 nt, Human
uuucuuuguguagcu

SEQ ID NO: 2859584 - RNA, 13 nt, Human
uuucuuucaacuu

SEQ ID NO: 2859585 - RNA, 19 nt, Human
uuucuuucaacuugcaucc

SEQ ID NO: 2859586 - RNA, 18 nt, Human
uuucuuuauauuuaucca

SEQ ID NO: 2859587 - RNA, 20 nt, Human
uuucuuuauauuuauccacu

SEQ ID NO: 2859588 - RNA, 23 nt, Human
uuucuuuaucaccuggcuuguuu

SEQ ID NO: 2859589 - RNA, 15 nt, Human
uuucuuuagagaacu

SEQ ID NO: 2859590 - RNA, 16 nt, Human
uuucuuuagagaacug

SEQ ID NO: 2859591 - RNA, 18 nt, Human
uuucuuuagagaacugaa

SEQ ID NO: 2859592 - RNA, 19 nt, Human
uuucuuuagagaacugaaa

SEQ ID NO: 2859593 - RNA, 20 nt, Human
uuucuuuagagaacugaaaa

SEQ ID NO: 2859594 - RNA, 14 nt, Human
uuucuuuuguaaua

SEQ ID NO: 2859595 - RNA, 13 nt, Human
uuugaaaagcuau

SEQ ID NO: 2859596 - RNA, 14 nt, Human
uuugaaaagcuauu

SEQ ID NO: 2859597 - RNA, 15 nt, Human
uuugaaaagcuauua

SEQ ID NO: 2859598 - RNA, 18 nt, Human
uuugaaaagcuauuagcc

SEQ ID NO: 2859599 - RNA, 19 nt, Human
uuugaaaagcuauuagcca

SEQ ID NO: 2859600 - RNA, 13 nt, Human
uuugaaaagcuuc

SEQ ID NO: 2859601 - RNA, 16 nt, Human
uuugaaaagcuucuua

SEQ ID NO: 2859602 - RNA, 17 nt, Human
uuugaaaagcuucuuaa

SEQ ID NO: 2859603 - RNA, 22 nt, Human
uuugaaaagcuucuuaauuaau

SEQ ID NO: 2859604 - RNA, 23 nt, Human
uuugaaaagcuucuuaauuaauu

SEQ ID NO: 2859605 - RNA, 16 nt, Human
uuucuuuuguaaaugu

SEQ ID NO: 2859606 - RNA, 14 nt, Human
uuucuuuucacaua

SEQ ID NO: 2859607 - RNA, 15 nt, Human
uuucuuuucuuuuua

SEQ ID NO: 2859608 - RNA, 16 nt, Human
uuucuuuugaauuguu

SEQ ID NO: 2859609 - RNA, 15 nt, Human
uuucuuuucuuccug

SEQ ID NO: 2859610 - RNA, 20 nt, Human
uuucuggaauacaugaaaua

SEQ ID NO: 2859611 - RNA, 18 nt, Human
uuucuggaauacaugaaa

SEQ ID NO: 2859612 - RNA, 19 nt, Human
uuucugcuggaaacagacu

SEQ ID NO: 2859613 - RNA, 22 nt, Human
uuucugcuuucuuugauucucc

SEQ ID NO: 2859614 - RNA, 13 nt, Human
uuucuuuaaagau

SEQ ID NO: 2859615 - RNA, 14 nt, Human
uuucuuuaaagaug

SEQ ID NO: 2859616 - RNA, 15 nt, Human
uuucuuuaaaaaaca

SEQ ID NO: 2859617 - RNA, 13 nt, Human
uuucuuguuuauu

SEQ ID NO: 2859618 - RNA, 13 nt, Human
uuucuuguuucuc

SEQ ID NO: 2859619 - RNA, 17 nt, Human
uuucuggccaaaagcag

SEQ ID NO: 2859620 - RNA, 21 nt, Human
uuucuggccaaaagcaguaaa

SEQ ID NO: 2859621 - RNA, 11 nt, Human
uuucuggaguc

SEQ ID NO: 2859622 - RNA, 21 nt, Human
uuucuggaauacaugaaauau

SEQ ID NO: 2859623 - RNA, 12 nt, Human
uuucuccagcug

SEQ ID NO: 2859624 - RNA, 15 nt, Human
uuucuccagugcugu

SEQ ID NO: 2859625 - RNA, 22 nt, Human
uuucucauuugccaauaauaau

SEQ ID NO: 2859626 - RNA, 13 nt, Human
uuucuccagaacc

SEQ ID NO: 2859627 - RNA, 11 nt, Human
uuucuccagcu

SEQ ID NO: 2859628 - RNA, 21 nt, Human
uuucuccagcucagaacccag

SEQ ID NO: 2859629 - RNA, 20 nt, Human
uuucucauuuguuuuucuca

SEQ ID NO: 2859630 - RNA, 14 nt, Human
uuucucauucuugu

SEQ ID NO: 2859631 - RNA, 16 nt, Human
uuucucauucuuguuu

SEQ ID NO: 2859632 - RNA, 16 nt, Human
uuucugccagggagcu

SEQ ID NO: 2859633 - RNA, 22 nt, Human
uuucugcaugaauaucauacaa

SEQ ID NO: 2859634 - RNA, 13 nt, Human
uuucugcauaugu

SEQ ID NO: 2859635 - RNA, 17 nt, Human
uuucugcauauguugaa

SEQ ID NO: 2859636 - RNA, 22 nt, Human
uuucucaacaaagcacaguguu

SEQ ID NO: 2859637 - RNA, 22 nt, Human
uuucucaaaguuuugaaaagcu

SEQ ID NO: 2859638 - RNA, 13 nt, Human
uuucucaaaucuu

SEQ ID NO: 2859639 - RNA, 13 nt, Human
uuucucaaaguuu

SEQ ID NO: 2859640 - RNA, 14 nt, Human
uuucucaaaguuuu

SEQ ID NO: 2859641 - RNA, 15 nt, Human
uuucucaaaguuuug

SEQ ID NO: 2859642 - RNA, 16 nt, Human
uuucucaaaguuuuga

SEQ ID NO: 2859643 - RNA, 18 nt, Human
uuucucaaaguuuugaaa

SEQ ID NO: 2859644 - RNA, 16 nt, Human
uuucucaguuuguaua

SEQ ID NO: 2859645 - RNA, 18 nt, Human
uuucucaugaaucugcaa

SEQ ID NO: 2859646 - RNA, 19 nt, Human
uuucucauguguuugcaua

SEQ ID NO: 2859647 - RNA, 23 nt, Human
uuucucagccgcuucugacugcu

SEQ ID NO: 2859648 - RNA, 20 nt, Human
uuucucagauccuuguuuca

SEQ ID NO: 2859649 - RNA, 23 nt, Human
uuucucagauccuuguuucaaac

SEQ ID NO: 2859650 - RNA, 17 nt, Human
uuucucagauccuuguu

SEQ ID NO: 2859651 - RNA, 20 nt, Human
uuucuaugcugcuuuuauau

SEQ ID NO: 2859652 - RNA, 14 nt, Human
uuucuauuugacuu

SEQ ID NO: 2859653 - RNA, 16 nt, Human
uuucuauuugacuugu

SEQ ID NO: 2859654 - RNA, 14 nt, Human
uuucuauuccaaag

SEQ ID NO: 2859655 - RNA, 14 nt, Human
uuucuauuccuucu

SEQ ID NO: 2859656 - RNA, 18 nt, Human
uuucuauuccuucuggcc

SEQ ID NO: 2859657 - RNA, 19 nt, Human
uuucuauuccuucuggccu

SEQ ID NO: 2859658 - RNA, 13 nt, Human
uuucuauuccaaa

SEQ ID NO: 2859659 - RNA, 17 nt, Human
uuucuauuuaugccuug

SEQ ID NO: 2859660 - RNA, 13 nt, Human
uuucucaaaagca

SEQ ID NO: 2859661 - RNA, 14 nt, Human
uuucucaaaagcau

SEQ ID NO: 2859662 - RNA, 16 nt, Human
uuucucaaaagcauuu

SEQ ID NO: 2859663 - RNA, 19 nt, Human
uuucucaaaagcauuuauc

SEQ ID NO: 2859664 - RNA, 22 nt, Human
uuucucaaaagcauuuaucauu

SEQ ID NO: 2859665 - RNA, 16 nt, Human
uuucuaucuaaaugau

SEQ ID NO: 2859666 - RNA, 13 nt, Human
uuucuauguacua

SEQ ID NO: 2859667 - RNA, 18 nt, Human
uuucuauguacuaguacu

SEQ ID NO: 2859668 - RNA, 22 nt, Human
uuucuauguacuaguacugugu

SEQ ID NO: 2859669 - RNA, 23 nt, Human
uuucuauguacuaguacugugua

SEQ ID NO: 2859670 - RNA, 20 nt, Human
uuucuagggcugggaaacac

SEQ ID NO: 2859671 - RNA, 21 nt, Human
uuucuaugaguggaaaaagcc

SEQ ID NO: 2859672 - RNA, 20 nt, Human
uuucuauuaaauaguuauau

SEQ ID NO: 2859673 - RNA, 13 nt, Human
uuucuauacaaau

SEQ ID NO: 2859674 - RNA, 14 nt, Human
uuucuauacaaaua

SEQ ID NO: 2859675 - RNA, 23 nt, Human
uuucuaguggucuuuguaagagu

SEQ ID NO: 2859676 - RNA, 20 nt, Human
uuucuaguggucuuuguaag

SEQ ID NO: 2859677 - RNA, 21 nt, Human
uuucuaguggucuuuguaaga

SEQ ID NO: 2859678 - RNA, 14 nt, Human
uuucuaguggucuu

SEQ ID NO: 2859679 - RNA, 17 nt, Human
uuucuaguggucuuugu

SEQ ID NO: 2859680 - RNA, 18 nt, Human
uuucuaguggucuuugua

SEQ ID NO: 2859681 - RNA, 19 nt, Human
uuucuaguggucuuuguaa

SEQ ID NO: 2859682 - RNA, 19 nt, Human
uuucuaguuugcucauacu

SEQ ID NO: 2859683 - RNA, 15 nt, Human
uuucuauaacagaua

SEQ ID NO: 2859684 - RNA, 16 nt, Human
uuucuauaacagauau

SEQ ID NO: 2859685 - RNA, 20 nt, Human
uuucuaguacacuuuuauga

SEQ ID NO: 2859686 - RNA, 15 nt, Human
uuucuaguccaaaau

SEQ ID NO: 2859687 - RNA, 22 nt, Human
uuucuaaacguaagcacuguuu

SEQ ID NO: 2859688 - RNA, 12 nt, Human
augcggccaaga

SEQ ID NO: 2859689 - RNA, 23 nt, Human
augcgcaggcuggcccugcccug

SEQ ID NO: 2859690 - RNA, 13 nt, Human
augccuaauaaac

SEQ ID NO: 2859691 - RNA, 18 nt, Human
uuuaaaggcuuuuuggug

SEQ ID NO: 2859692 - RNA, 18 nt, Human
augccuaguuuuuaguaa

SEQ ID NO: 2859693 - RNA, 19 nt, Human
uuuaaaggcccagccccua

SEQ ID NO: 2859694 - RNA, 23 nt, Human
uuuaaaggcccagccccuagaaa

SEQ ID NO: 2859695 - RNA, 16 nt, Human
uuuaaagcuuacucug

SEQ ID NO: 2859696 - RNA, 18 nt, Human
uuuaaagcuuacucuguc

SEQ ID NO: 2859697 - RNA, 15 nt, Human
uuuaaagcauugcug

SEQ ID NO: 2859698 - RNA, 20 nt, Human
uuuaaagcauugcuguuaug

SEQ ID NO: 2859699 - RNA, 16 nt, Human
uuuaaagcauugcuuu

SEQ ID NO: 2859700 - RNA, 13 nt, Human
uuuacuaaacaua

SEQ ID NO: 2859701 - RNA, 14 nt, Human
uuuacuaaacauau

SEQ ID NO: 2859702 - RNA, 17 nt, Human
uuuacggacacccccuc

SEQ ID NO: 2859703 - RNA, 13 nt, Human
uuuacggacaccc

SEQ ID NO: 2859704 - RNA, 18 nt, Human
uuuacgcuuugauucaua

SEQ ID NO: 2859705 - RNA, 13 nt, Human
uuuacgcuuugau

SEQ ID NO: 2859706 - RNA, 15 nt, Human
uuuaccugucacauu

SEQ ID NO: 2859707 - RNA, 20 nt, Human
uuuaccugucacauugcauu

SEQ ID NO: 2859708 - RNA, 21 nt, Human
uuuaccugucacauugcauuc

SEQ ID NO: 2859709 - RNA, 20 nt, Human
uuuacuaagccacaagaaau

SEQ ID NO: 2859710 - RNA, 21 nt, Human
uuuacuaagccacaagaaauu

SEQ ID NO: 2859711 - RNA, 22 nt, Human
uuuacuaagccacaagaaauuu

SEQ ID NO: 2859712 - RNA, 19 nt, Human
uuuacuaauuuucuagauu

SEQ ID NO: 2859713 - RNA, 21 nt, Human
uuuaccugugcguuacuaauu

SEQ ID NO: 2859714 - RNA, 16 nt, Human
augcuaauuuaaagag

SEQ ID NO: 2859715 - RNA, 17 nt, Human
augcuaauuuaaagaga

SEQ ID NO: 2859716 - RNA, 18 nt, Human
augcuaauuuaaagagac

SEQ ID NO: 2859717 - RNA, 17 nt, Human
augcuaauauuaaaagu

SEQ ID NO: 2859718 - RNA, 19 nt, Human
augcuaauauuaaaaguca

SEQ ID NO: 2859719 - RNA, 13 nt, Human
uuuauuaaauuug

SEQ ID NO: 2859720 - RNA, 20 nt, Human
uuuauuaaauuuguugacaa

SEQ ID NO: 2859721 - RNA, 21 nt, Human
uuuauuaaauuuguugacaaa

SEQ ID NO: 2859722 - RNA, 19 nt, Human
uuuauuaaauaaaaucaau

SEQ ID NO: 2859723 - RNA, 18 nt, Human
uuuaugucuauuuaagcc

SEQ ID NO: 2859724 - RNA, 14 nt, Human
uuuauaucuggaau

SEQ ID NO: 2859725 - RNA, 16 nt, Human
uuuauaucuggaauga

SEQ ID NO: 2859726 - RNA, 23 nt, Human
uuuauaucuggaaugagccuguu

SEQ ID NO: 2859727 - RNA, 16 nt, Human
uuuauaucuguaugua

SEQ ID NO: 2859728 - RNA, 19 nt, Human
uuuauguaguaauugacau

SEQ ID NO: 2859729 - RNA, 14 nt, Human
uuuauguagcacau

SEQ ID NO: 2859730 - RNA, 13 nt, Human
uuuauguaaugaa

SEQ ID NO: 2859731 - RNA, 19 nt, Human
uuuauguaaugaaguaaag

SEQ ID NO: 2859732 - RNA, 20 nt, Human
uuuauguaaugaaguaaagc

SEQ ID NO: 2859733 - RNA, 22 nt, Human
uuuauguaaugaaguaaagcca

SEQ ID NO: 2859734 - RNA, 21 nt, Human
uuuaugguuucccccuucuac

SEQ ID NO: 2859735 - RNA, 17 nt, Human
uuuauaucccauuuuua

SEQ ID NO: 2859736 - RNA, 16 nt, Human
uuuauauauuuauaac

SEQ ID NO: 2859737 - RNA, 15 nt, Human
uuuauauauuuauaa

SEQ ID NO: 2859738 - RNA, 13 nt, Human
uuuauauauuuau

SEQ ID NO: 2859739 - RNA, 12 nt, Human
uuuauauauuua

SEQ ID NO: 2859740 - RNA, 21 nt, Human
uuuauauauacaguaacuuua

SEQ ID NO: 2859741 - RNA, 14 nt, Human
uuuauauaugaaaa

SEQ ID NO: 2859742 - RNA, 16 nt, Human
uuuauauaugaaaacu

SEQ ID NO: 2859743 - RNA, 17 nt, Human
uuuauauaugaaaacua

SEQ ID NO: 2859744 - RNA, 15 nt, Human
uuuauauauggacau

SEQ ID NO: 2859745 - RNA, 22 nt, Human
uuuacuacuucucucuguauuu

SEQ ID NO: 2859746 - RNA, 14 nt, Human
uuuacuacagcuau

SEQ ID NO: 2859747 - RNA, 21 nt, Human
uuuacuacagcuaugaagaaa

SEQ ID NO: 2859748 - RNA, 13 nt, Human
uuuacuacaguuu

SEQ ID NO: 2859749 - RNA, 17 nt, Human
uuuacuaccaaugccaa

SEQ ID NO: 2859750 - RNA, 15 nt, Human
uuuacuaugccugug

SEQ ID NO: 2859751 - RNA, 13 nt, Human
uuuacuauauaua

SEQ ID NO: 2859752 - RNA, 14 nt, Human
uuuacuauauauau

SEQ ID NO: 2859753 - RNA, 15 nt, Human
uuuacuauauauaua

SEQ ID NO: 2859754 - RNA, 13 nt, Human
uuuacucauugaa

SEQ ID NO: 2859755 - RNA, 14 nt, Human
uuuacucauugaaa

SEQ ID NO: 2859756 - RNA, 15 nt, Human
uuuacucauugaaau

SEQ ID NO: 2859757 - RNA, 16 nt, Human
uuuacucauugaaaug

SEQ ID NO: 2859758 - RNA, 17 nt, Human
uuuacucauugaaaugu

SEQ ID NO: 2859759 - RNA, 18 nt, Human
uuuacucauugaaauguc

SEQ ID NO: 2859760 - RNA, 15 nt, Human
uuuauauauacagua

SEQ ID NO: 2859761 - RNA, 13 nt, Human
uuuauauauacag

SEQ ID NO: 2859762 - RNA, 21 nt, Human
uuuaguaccugaaaaguaacu

SEQ ID NO: 2859763 - RNA, 14 nt, Human
uuuaguaaucugua

SEQ ID NO: 2859764 - RNA, 17 nt, Human
uuuaguaaucuguacau

SEQ ID NO: 2859765 - RNA, 19 nt, Human
uuuaguaaucuguacauuu

SEQ ID NO: 2859766 - RNA, 12 nt, Human
uuuaguaaaugu

SEQ ID NO: 2859767 - RNA, 16 nt, Human
uuuaguaaauguuauc

SEQ ID NO: 2859768 - RNA, 17 nt, Human
uuuaguaaauguuaucu

SEQ ID NO: 2859769 - RNA, 17 nt, Human
uuuaguaacaucauuuu

SEQ ID NO: 2859770 - RNA, 21 nt, Human
uuuaggugaauuaauuaaaca

SEQ ID NO: 2859771 - RNA, 22 nt, Human
uuuaggugaauuaauuaaacau

SEQ ID NO: 2859772 - RNA, 11 nt, Human
uuuagguucua

SEQ ID NO: 2859773 - RNA, 12 nt, Human
uuuagguucuaa

SEQ ID NO: 2859774 - RNA, 13 nt, Human
uuuagguucuaaa

SEQ ID NO: 2859775 - RNA, 14 nt, Human
uuuagguucuaaag

SEQ ID NO: 2859776 - RNA, 22 nt, Human
uuuagguuuuuguuuguuuccu

SEQ ID NO: 2859777 - RNA, 23 nt, Human
uuuagguucuuugcugcauucug

SEQ ID NO: 2859778 - RNA, 15 nt, Human
uuuagguucuaaagu

SEQ ID NO: 2859779 - RNA, 16 nt, Human
uuuagguucuaaaguu

SEQ ID NO: 2859780 - RNA, 18 nt, Human
uuuagguucuaaaguucu

SEQ ID NO: 2859781 - RNA, 23 nt, Human
uuuagguucuaaaguucuaagau

SEQ ID NO: 2859782 - RNA, 20 nt, Human
uuuagcuaggauuugaacac

SEQ ID NO: 2859783 - RNA, 21 nt, Human
uuuagcuaggauuugaacacu

SEQ ID NO: 2859784 - RNA, 14 nt, Human
uuuaggucuuugua

SEQ ID NO: 2859785 - RNA, 17 nt, Human
uuuaggucuuuguaaga

SEQ ID NO: 2859786 - RNA, 17 nt, Human
uuuagguacuauucuga

SEQ ID NO: 2859787 - RNA, 23 nt, Human
uuuagcugaugaacuuauucugu

SEQ ID NO: 2859788 - RNA, 16 nt, Human
uuuaggguaaaaauug

SEQ ID NO: 2859789 - RNA, 14 nt, Human
uuuaggguacuaaa

SEQ ID NO: 2859790 - RNA, 20 nt, Human
uuuaggguacuaaauuuaaa

SEQ ID NO: 2859791 - RNA, 22 nt, Human
uuuaggguacuaaauuuaaauu

SEQ ID NO: 2859792 - RNA, 21 nt, Human
uuuagcugaugaacuuauucu

SEQ ID NO: 2859793 - RNA, 17 nt, Human
auggaauugauuugcau

SEQ ID NO: 2859794 - RNA, 16 nt, Human
uuucccagguucuguu

SEQ ID NO: 2859795 - RNA, 17 nt, Human
uuucauaucuacagaua

SEQ ID NO: 2859796 - RNA, 16 nt, Human
uuuccaguuaaggacc

SEQ ID NO: 2859797 - RNA, 14 nt, Human
uuuccagucucuug

SEQ ID NO: 2859798 - RNA, 18 nt, Human
uuuccagucucuuguaca

SEQ ID NO: 2859799 - RNA, 19 nt, Human
uuuccauagcaacaggaaa

SEQ ID NO: 2859800 - RNA, 12 nt, Human
uuuccauauguu

SEQ ID NO: 2859801 - RNA, 15 nt, Human
uuucauaugcuguau

SEQ ID NO: 2859802 - RNA, 12 nt, Human
uuucauaacuua

SEQ ID NO: 2859803 - RNA, 18 nt, Human
uuucauaacuuauugcug

SEQ ID NO: 2859804 - RNA, 20 nt, Human
uuucauaacuuauugcugau

SEQ ID NO: 2859805 - RNA, 22 nt, Human
uuucauaacuuauugcugauuu

SEQ ID NO: 2859806 - RNA, 24 nt, Human
uuucacucuuauugcccacgcugg

SEQ ID NO: 2859807 - RNA, 24 nt, Human
uuucacugcuggcugccuuagaac

SEQ ID NO: 2859808 - RNA, 16 nt, Human
uuucaccuagauuuuu

SEQ ID NO: 2859809 - RNA, 17 nt, Human
uuucaccuccuucaauu

SEQ ID NO: 2859810 - RNA, 24 nt, Human
uuucacuguagaaugauuucaugc

SEQ ID NO: 2859811 - RNA, 22 nt, Human
uuucagaaaauauuauguguuu

SEQ ID NO: 2859812 - RNA, 14 nt, Human
uuucacuuauaccu

SEQ ID NO: 2859813 - RNA, 15 nt, Human
uuucacuuauaccug

SEQ ID NO: 2859814 - RNA, 20 nt, Human
uuucacuucgggcuguguaa

SEQ ID NO: 2859815 - RNA, 20 nt, Human
uuucacucuccuaugccuuu

SEQ ID NO: 2859816 - RNA, 21 nt, Human
uuucacccuuaacccaaggag

SEQ ID NO: 2859817 - RNA, 22 nt, Human
uuucacccuuaacccaaggagc

SEQ ID NO: 2859818 - RNA, 22 nt, Human
uuucaccccacccuuccccucc

SEQ ID NO: 2859819 - RNA, 15 nt, Human
uuuauuuuuuuaagu

SEQ ID NO: 2859820 - RNA, 15 nt, Human
uuucacauuguuugc

SEQ ID NO: 2859821 - RNA, 19 nt, Human
uuucacauuguuugcugcu

SEQ ID NO: 2859822 - RNA, 17 nt, Human
uuucaccagauuugcua

SEQ ID NO: 2859823 - RNA, 21 nt, Human
uuucaccaugauggccaggcu

SEQ ID NO: 2859824 - RNA, 16 nt, Human
uuuauuuuuugggaaa

SEQ ID NO: 2859825 - RNA, 14 nt, Human
augcuguauauguu

SEQ ID NO: 2859826 - RNA, 18 nt, Human
augcuguaggugguaugu

SEQ ID NO: 2859827 - RNA, 17 nt, Human
augcuuagauguuccag

SEQ ID NO: 2859828 - RNA, 20 nt, Human
augcuuagagggauuucuuu

SEQ ID NO: 2859829 - RNA, 21 nt, Human
augcugugagucuuugguucu

SEQ ID NO: 2859830 - RNA, 22 nt, Human
augcugugagucuuugguucua

SEQ ID NO: 2859831 - RNA, 15 nt, Human
augcuuaauuucuaa

SEQ ID NO: 2859832 - RNA, 16 nt, Human
augcuuaauuucuaaa

SEQ ID NO: 2859833 - RNA, 19 nt, Human
augcuuaauuucuaaagau

SEQ ID NO: 2859834 - RNA, 13 nt, Human
uuuauuagaugaa

SEQ ID NO: 2859835 - RNA, 14 nt, Human
uuuauuagaugaau

SEQ ID NO: 2859836 - RNA, 14 nt, Human
uuuauuauaaacug

SEQ ID NO: 2859837 - RNA, 19 nt, Human
uuuauuauaaacuguaugc

SEQ ID NO: 2859838 - RNA, 22 nt, Human
augcuggcuguuggcugggggc

SEQ ID NO: 2859839 - RNA, 19 nt, Human
augcuguauauccuuucua

SEQ ID NO: 2859840 - RNA, 23 nt, Human
augcuguacaucuauuuuggauu

SEQ ID NO: 2859841 - RNA, 22 nt, Human
augcuguacaucuauuuuggau

SEQ ID NO: 2859842 - RNA, 22 nt, Human
augcuggggcaagucccugacu

SEQ ID NO: 2859843 - RNA, 23 nt, Human
augcugggaagacgccugagcuc

SEQ ID NO: 2859844 - RNA, 18 nt, Human
uuuauuuuacacagaaac

SEQ ID NO: 2859845 - RNA, 13 nt, Human
uuuauuuuacaca

SEQ ID NO: 2859846 - RNA, 13 nt, Human
auggaauaaaagg

SEQ ID NO: 2859847 - RNA, 17 nt, Human
auggaaguaaagccuca

SEQ ID NO: 2859848 - RNA, 15 nt, Human
uuuauuuuccuaaag

SEQ ID NO: 2859849 - RNA, 12 nt, Human
uuuauuuuccua

SEQ ID NO: 2859850 - RNA, 14 nt, Human
uuuauuuuacuauu

SEQ ID NO: 2859851 - RNA, 17 nt, Human
uuuauuuuacuauugga

SEQ ID NO: 2859852 - RNA, 21 nt, Human
uuuauuuuacacagaaacacu

SEQ ID NO: 2859853 - RNA, 12 nt, Human
uuuauuuuauga

SEQ ID NO: 2859854 - RNA, 15 nt, Human
uuuauuuuaugagaa

SEQ ID NO: 2859855 - RNA, 20 nt, Human
uuuauuuuaugagaaaugua

SEQ ID NO: 2859856 - RNA, 16 nt, Human
uuuauuuuauguuuag

SEQ ID NO: 2859857 - RNA, 21 nt, Human
uuuauuuucuuuuguaaaugu

SEQ ID NO: 2859858 - RNA, 19 nt, Human
uuuauuuugaaaagcuucu

SEQ ID NO: 2859859 - RNA, 16 nt, Human
uuuauuuucuuuugaa

SEQ ID NO: 2859860 - RNA, 10 nt, Human
uuuauuuucu

SEQ ID NO: 2859861 - RNA, 17 nt, Human
uuuauuuuuuaaguauu

SEQ ID NO: 2859862 - RNA, 15 nt, Human
uuuauuuuuuacauu

SEQ ID NO: 2859863 - RNA, 14 nt, Human
uuuauuuuuuagug

SEQ ID NO: 2859864 - RNA, 16 nt, Human
uuuauuuuuuagugca

SEQ ID NO: 2859865 - RNA, 13 nt, Human
uuuauuuuuuggg

SEQ ID NO: 2859866 - RNA, 14 nt, Human
uuuauuuuuuaagu

SEQ ID NO: 2859867 - RNA, 22 nt, Human
uuuauuuugugcucauuuaagu

SEQ ID NO: 2859868 - RNA, 12 nt, Human
uuuauuuugugg

SEQ ID NO: 2859869 - RNA, 14 nt, Human
uuuauuuuguggga

SEQ ID NO: 2859870 - RNA, 16 nt, Human
auggaaggguuugugg

SEQ ID NO: 2859871 - RNA, 19 nt, Human
augcuuaucaucuaaagau

SEQ ID NO: 2859872 - RNA, 15 nt, Human
augcuuaugacaaug

SEQ ID NO: 2859873 - RNA, 19 nt, Human
augcuuacggccaucucuu

SEQ ID NO: 2859874 - RNA, 18 nt, Human
uugucacacacuuuggcu

SEQ ID NO: 2859875 - RNA, 21 nt, Human
augaguuuuugauagcuuuau

SEQ ID NO: 2859876 - RNA, 14 nt, Human
augauaacagaacu

SEQ ID NO: 2859877 - RNA, 18 nt, Human
augagucuguuguguguc

SEQ ID NO: 2859878 - RNA, 17 nt, Human
augagucuagauguuua

SEQ ID NO: 2859879 - RNA, 12 nt, Human
augagucuagau

SEQ ID NO: 2859880 - RNA, 13 nt, Human
augagucuagaug

SEQ ID NO: 2859881 - RNA, 19 nt, Human
augagucuguuguguguca

SEQ ID NO: 2859882 - RNA, 15 nt, Human
augaguggaaaaagc

SEQ ID NO: 2859883 - RNA, 16 nt, Human
augagugcgugcucag

SEQ ID NO: 2859884 - RNA, 17 nt, Human
augagugcgugcucagu

SEQ ID NO: 2859885 - RNA, 13 nt, Human
augaguuuuugau

SEQ ID NO: 2859886 - RNA, 20 nt, Human
augaguuuuugauagcuuua

SEQ ID NO: 2859887 - RNA, 19 nt, Human
augaguuuuugauagcuuu

SEQ ID NO: 2859888 - RNA, 13 nt, Human
augagugugaagg

SEQ ID NO: 2859889 - RNA, 18 nt, Human
augagccucagcauccug

SEQ ID NO: 2859890 - RNA, 17 nt, Human
augagccucagcauccu

SEQ ID NO: 2859891 - RNA, 15 nt, Human
augaggucccaggca

SEQ ID NO: 2859892 - RNA, 14 nt, Human
augaggucccaggc

SEQ ID NO: 2859893 - RNA, 20 nt, Human
augagccgcugugagccccu

SEQ ID NO: 2859894 - RNA, 23 nt, Human
augagccgcugugagccccuggu

SEQ ID NO: 2859895 - RNA, 21 nt, Human
augaguccuugaaaauauuuu

SEQ ID NO: 2859896 - RNA, 18 nt, Human
augaguccuugaaaauau

SEQ ID NO: 2859897 - RNA, 20 nt, Human
augaguccuugaaaauauuu

SEQ ID NO: 2859898 - RNA, 16 nt, Human
augaguccuugaaaau

SEQ ID NO: 2859899 - RNA, 16 nt, Human
augaggucugggcuag

SEQ ID NO: 2859900 - RNA, 13 nt, Human
augaggucuguuu

SEQ ID NO: 2859901 - RNA, 14 nt, Human
augaggucuguuua

SEQ ID NO: 2859902 - RNA, 15 nt, Human
augaggucuguuuaa

SEQ ID NO: 2859903 - RNA, 20 nt, Human
augaggucccaggcagagaa

SEQ ID NO: 2859904 - RNA, 19 nt, Human
augaggucccaggcagaga

SEQ ID NO: 2859905 - RNA, 18 nt, Human
augaggucccaggcagag

SEQ ID NO: 2859906 - RNA, 17 nt, Human
augaggucccaggcaga

SEQ ID NO: 2859907 - RNA, 16 nt, Human
augaggucccaggcag

SEQ ID NO: 2859908 - RNA, 19 nt, Human
uugucaucuuucuucuauu

SEQ ID NO: 2859909 - RNA, 21 nt, Human
uugucaucuuucuucuauuuu

SEQ ID NO: 2859910 - RNA, 12 nt, Human
uugucaugguua

SEQ ID NO: 2859911 - RNA, 18 nt, Human
uugucaugguuacaaacu

SEQ ID NO: 2859912 - RNA, 13 nt, Human
uugucauguggcu

SEQ ID NO: 2859913 - RNA, 16 nt, Human
uugucacugacacaaa

SEQ ID NO: 2859914 - RNA, 19 nt, Human
uugucacugacacaaagga

SEQ ID NO: 2859915 - RNA, 22 nt, Human
uugucacugacacaaaggaagu

SEQ ID NO: 2859916 - RNA, 17 nt, Human
uugucacugcuuuuggc

SEQ ID NO: 2859917 - RNA, 14 nt, Human
uugucacuugcaug

SEQ ID NO: 2859918 - RNA, 15 nt, Human
uugucacuugcaugu

SEQ ID NO: 2859919 - RNA, 16 nt, Human
uugucacuugcauguc

SEQ ID NO: 2859920 - RNA, 22 nt, Human
uugucacaugaaacauuugcaa

SEQ ID NO: 2859921 - RNA, 16 nt, Human
uugucacaucagauaa

SEQ ID NO: 2859922 - RNA, 22 nt, Human
uugucauuguaaacaaacucuu

SEQ ID NO: 2859923 - RNA, 15 nt, Human
uuguccccguggucu

SEQ ID NO: 2859924 - RNA, 16 nt, Human
uuguccgcuggguggu

SEQ ID NO: 2859925 - RNA, 18 nt, Human
uuguccguguucauacau

SEQ ID NO: 2859926 - RNA, 12 nt, Human
uuguccccugcu

SEQ ID NO: 2859927 - RNA, 13 nt, Human
uuguccccugcuu

SEQ ID NO: 2859928 - RNA, 17 nt, Human
uuguccucaguccauuu

SEQ ID NO: 2859929 - RNA, 15 nt, Human
uuguccucauuucuc

SEQ ID NO: 2859930 - RNA, 20 nt, Human
uuguccuuuaaaaaagaaaa

SEQ ID NO: 2859931 - RNA, 15 nt, Human
uuguccuuucccuuc

SEQ ID NO: 2859932 - RNA, 19 nt, Human
uuguccugaugcuuuuguc

SEQ ID NO: 2859933 - RNA, 23 nt, Human
uuguccugaugcuuuugucuaau

SEQ ID NO: 2859934 - RNA, 22 nt, Human
uugucgaaaagagucuuccaau

SEQ ID NO: 2859935 - RNA, 23 nt, Human
uugucgaaaagagucuuccaauu

SEQ ID NO: 2859936 - RNA, 16 nt, Human
uuguccuuuugucuuc

SEQ ID NO: 2859937 - RNA, 17 nt, Human
uuguccuuuugucuucu

SEQ ID NO: 2859938 - RNA, 20 nt, Human
uuguccugccugcaauauuu

SEQ ID NO: 2859939 - RNA, 17 nt, Human
uuguccuuucccuucag

SEQ ID NO: 2859940 - RNA, 18 nt, Human
augacauaacagugcagg

SEQ ID NO: 2859941 - RNA, 20 nt, Human
augacauaacagugcagggc

SEQ ID NO: 2859942 - RNA, 18 nt, Human
augacaucacuuguacaa

SEQ ID NO: 2859943 - RNA, 14 nt, Human
augacaucacuugu

SEQ ID NO: 2859944 - RNA, 13 nt, Human
augacaucuuuuu

SEQ ID NO: 2859945 - RNA, 14 nt, Human
augacaucuuuuua

SEQ ID NO: 2859946 - RNA, 15 nt, Human
augacaucuuuuuaa

SEQ ID NO: 2859947 - RNA, 19 nt, Human
augacaucuuuuuaaagcu

SEQ ID NO: 2859948 - RNA, 20 nt, Human
augacaucuuuuuaaagcuu

SEQ ID NO: 2859949 - RNA, 21 nt, Human
augacaucuuuuuaaagcuua

SEQ ID NO: 2859950 - RNA, 20 nt, Human
augacaucacuuguacaaaa

SEQ ID NO: 2859951 - RNA, 19 nt, Human
augacaucacuuguacaaa

SEQ ID NO: 2859952 - RNA, 16 nt, Human
augacaucucaggggc

SEQ ID NO: 2859953 - RNA, 13 nt, Human
augacauauuuuu

SEQ ID NO: 2859954 - RNA, 18 nt, Human
augacaucucaggggcca

SEQ ID NO: 2859955 - RNA, 22 nt, Human
augacaugaggaaaauaaugua

SEQ ID NO: 2859956 - RNA, 14 nt, Human
augacaugcacuga

SEQ ID NO: 2859957 - RNA, 15 nt, Human
augacaugcacugac

SEQ ID NO: 2859958 - RNA, 16 nt, Human
augacaugcacugacc

SEQ ID NO: 2859959 - RNA, 17 nt, Human
augacaugcacugaccc

SEQ ID NO: 2859960 - RNA, 18 nt, Human
augacaugcacugacccu

SEQ ID NO: 2859961 - RNA, 19 nt, Human
augacaugcacugacccuu

SEQ ID NO: 2859962 - RNA, 22 nt, Human
augacaugcacugacccuucca

SEQ ID NO: 2859963 - RNA, 23 nt, Human
augacaugcacugacccuuccag

SEQ ID NO: 2859964 - RNA, 13 nt, Human
augagagcccaga

SEQ ID NO: 2859965 - RNA, 14 nt, Human
augagagcccagag

SEQ ID NO: 2859966 - RNA, 16 nt, Human
augagagcccagaggu

SEQ ID NO: 2859967 - RNA, 18 nt, Human
augagagcccagagguaa

SEQ ID NO: 2859968 - RNA, 20 nt, Human
augagagcccagagguaaca

SEQ ID NO: 2859969 - RNA, 15 nt, Human
augacauguuauaua

SEQ ID NO: 2859970 - RNA, 16 nt, Human
augacauucaugccug

SEQ ID NO: 2859971 - RNA, 17 nt, Human
augacauguuauauauu

SEQ ID NO: 2859972 - RNA, 23 nt, Human
augacauguuauauauuuuuugu

SEQ ID NO: 2859973 - RNA, 22 nt, Human
augagagcccagagguaacaga

SEQ ID NO: 2859974 - RNA, 12 nt, Human
augagaugugug

SEQ ID NO: 2859975 - RNA, 19 nt, Human
augagaugcguuguuacag

SEQ ID NO: 2859976 - RNA, 12 nt, Human
augagaugcugg

SEQ ID NO: 2859977 - RNA, 13 nt, Human
augagauccuuua

SEQ ID NO: 2859978 - RNA, 17 nt, Human
augagaucugaaugugg

SEQ ID NO: 2859979 - RNA, 16 nt, Human
augagccucagcaucc

SEQ ID NO: 2859980 - RNA, 15 nt, Human
augagccucagcauc

SEQ ID NO: 2859981 - RNA, 12 nt, Human
augagccucagc

SEQ ID NO: 2859982 - RNA, 21 nt, Human
augagcauuggauacagcagu

SEQ ID NO: 2859983 - RNA, 23 nt, Human
augagcauuggauacagcaguag

SEQ ID NO: 2859984 - RNA, 14 nt, Human
augagcaucccagg

SEQ ID NO: 2859985 - RNA, 14 nt, Human
augagcagaaggaa

SEQ ID NO: 2859986 - RNA, 15 nt, Human
augagcaucccagga

SEQ ID NO: 2859987 - RNA, 16 nt, Human
augagcauccugagcc

SEQ ID NO: 2859988 - RNA, 17 nt, Human
augagcauccugagccc

SEQ ID NO: 2859989 - RNA, 18 nt, Human
augagcauccugagcccc

SEQ ID NO: 2859990 - RNA, 20 nt, Human
augagcauccugagccccgc

SEQ ID NO: 2859991 - RNA, 13 nt, Human
augagcaccucca

SEQ ID NO: 2859992 - RNA, 14 nt, Human
augagcaccuccau

SEQ ID NO: 2859993 - RNA, 18 nt, Human
augagccaccgcgcccag

SEQ ID NO: 2859994 - RNA, 18 nt, Human
augagcauggagcuggcc

SEQ ID NO: 2859995 - RNA, 15 nt, Human
augagcauggagcug

SEQ ID NO: 2859996 - RNA, 17 nt, Human
augagcauggagcuggc

SEQ ID NO: 2859997 - RNA, 21 nt, Human
augagccaccgcgcccagccu

SEQ ID NO: 2859998 - RNA, 11 nt, Human
augagcccaga

SEQ ID NO: 2859999 - RNA, 12 nt, Human
augagcccagag

SEQ ID NO: 2860000 - RNA, 14 nt, Human
augagcccagagaa

SEQ ID NO: 2860001 - RNA, 16 nt, Human
augagcccagagaaca

SEQ ID NO: 2860002 - RNA, 17 nt, Human
augagcccagagaacag

SEQ ID NO: 2860003 - RNA, 18 nt, Human
augagcccagagaacagc

SEQ ID NO: 2860004 - RNA, 14 nt, Human
augagcccuaaaaa

SEQ ID NO: 2860005 - RNA, 14 nt, Human
augagaugugugga

SEQ ID NO: 2860006 - RNA, 22 nt, Human
augagauguguggacuguggca

SEQ ID NO: 2860007 - RNA, 22 nt, Human
augagauuguuuuaucaugaca

SEQ ID NO: 2860008 - RNA, 18 nt, Human
augagauuguuuuaucau

SEQ ID NO: 2860009 - RNA, 19 nt, Human
uugugaagaaaaauaaagu

SEQ ID NO: 2860010 - RNA, 19 nt, Human
uugugaagaacuauuuuau

SEQ ID NO: 2860011 - RNA, 22 nt, Human
uugugaagaacuauuuuauucu

SEQ ID NO: 2860012 - RNA, 13 nt, Human
uugugaaggcagg

SEQ ID NO: 2860013 - RNA, 13 nt, Human
uugugaagcccug

SEQ ID NO: 2860014 - RNA, 14 nt, Human
uugugaagcccugu

SEQ ID NO: 2860015 - RNA, 11 nt, Human
uugugaacaga

SEQ ID NO: 2860016 - RNA, 13 nt, Human
uugugaacucauu

SEQ ID NO: 2860017 - RNA, 13 nt, Human
uuguguguacuca

SEQ ID NO: 2860018 - RNA, 21 nt, Human
uugugaaguuagguucuuaaa

SEQ ID NO: 2860019 - RNA, 14 nt, Human
uugugaaggccaug

SEQ ID NO: 2860020 - RNA, 22 nt, Human
uugugaaggccaugauauuuug

SEQ ID NO: 2860021 - RNA, 14 nt, Human
uuguucccucuccc

SEQ ID NO: 2860022 - RNA, 20 nt, Human
uuguugauaaauuccacugg

SEQ ID NO: 2860023 - RNA, 15 nt, Human
uugugugucaugcca

SEQ ID NO: 2860024 - RNA, 13 nt, Human
uugugugucuuaa

SEQ ID NO: 2860025 - RNA, 19 nt, Human
uugugugucuuaauuauua

SEQ ID NO: 2860026 - RNA, 19 nt, Human
uuguuccccaucaucugug

SEQ ID NO: 2860027 - RNA, 17 nt, Human
augaucugccucuaaaa

SEQ ID NO: 2860028 - RNA, 19 nt, Human
augaucugccucuaaaagc

SEQ ID NO: 2860029 - RNA, 22 nt, Human
augaucucuucuuuuggcuucc

SEQ ID NO: 2860030 - RNA, 15 nt, Human
augauccuaaugaau

SEQ ID NO: 2860031 - RNA, 20 nt, Human
augaucaguggacagucugc

SEQ ID NO: 2860032 - RNA, 13 nt, Human
augaucaguguug

SEQ ID NO: 2860033 - RNA, 23 nt, Human
augaucacggcucacugcagccu

SEQ ID NO: 2860034 - RNA, 22 nt, Human
augaucacuaauacuaauucau

SEQ ID NO: 2860035 - RNA, 21 nt, Human
augaucagcaucugugauggg

SEQ ID NO: 2860036 - RNA, 20 nt, Human
augaucaauuauaguuucug

SEQ ID NO: 2860037 - RNA, 15 nt, Human
augaucacggcucac

SEQ ID NO: 2860038 - RNA, 17 nt, Human
augaucaauccuuuauu

SEQ ID NO: 2860039 - RNA, 18 nt, Human
augaucaauccuuuauua

SEQ ID NO: 2860040 - RNA, 19 nt, Human
augaucacggcucacugca

SEQ ID NO: 2860041 - RNA, 18 nt, Human
augaucacggcucacugc

SEQ ID NO: 2860042 - RNA, 14 nt, Human
uuguugcaaagguc

SEQ ID NO: 2860043 - RNA, 17 nt, Human
uuguugcauguuugaaa

SEQ ID NO: 2860044 - RNA, 18 nt, Human
uuguugcucccugugaca

SEQ ID NO: 2860045 - RNA, 22 nt, Human
uuguugcucccugugacaaaau

SEQ ID NO: 2860046 - RNA, 20 nt, Human
uuguugcuggcuuguuguaa

SEQ ID NO: 2860047 - RNA, 21 nt, Human
uuguugauaaauuccacugga

SEQ ID NO: 2860048 - RNA, 21 nt, Human
uuguugaugggcacuugagaa

SEQ ID NO: 2860049 - RNA, 23 nt, Human
uuguugaugggcacuugagaacu

SEQ ID NO: 2860050 - RNA, 13 nt, Human
augaucaaaaaua

SEQ ID NO: 2860051 - RNA, 15 nt, Human
augaucaaaaauaau

SEQ ID NO: 2860052 - RNA, 13 nt, Human
uuguuggaaugaa

SEQ ID NO: 2860053 - RNA, 14 nt, Human
uuguugcuucuugu

SEQ ID NO: 2860054 - RNA, 18 nt, Human
uuguugcuucuugugaag

SEQ ID NO: 2860055 - RNA, 12 nt, Human
uuguugcuuugu

SEQ ID NO: 2860056 - RNA, 13 nt, Human
uuuaaaaaaagaa

SEQ ID NO: 2860057 - RNA, 15 nt, Human
uuuaaaaaaagaaaa

SEQ ID NO: 2860058 - RNA, 22 nt, Human
uuuaaaaaaagaaaaugaaaaa

SEQ ID NO: 2860059 - RNA, 19 nt, Human
uuguuuuuuuuuuccacuu

SEQ ID NO: 2860060 - RNA, 14 nt, Human
uuguuuuuuugcca

SEQ ID NO: 2860061 - RNA, 22 nt, Human
uuuaaaaaaaaaaguuacagaa

SEQ ID NO: 2860062 - RNA, 19 nt, Human
uuuaaaaaagcaacagaaa

SEQ ID NO: 2860063 - RNA, 14 nt, Human
uuuaaacuuauaaa

SEQ ID NO: 2860064 - RNA, 18 nt, Human
uuuaaaaaauauuuauua

SEQ ID NO: 2860065 - RNA, 19 nt, Human
uuuaaaaaauauuuauuaa

SEQ ID NO: 2860066 - RNA, 22 nt, Human
uuuaaaaaauauuuauuaaaua

SEQ ID NO: 2860067 - RNA, 19 nt, Human
uuuaaaaaaugaaaauaag

SEQ ID NO: 2860068 - RNA, 20 nt, Human
uuuaaaaaaugaaauccuuu

SEQ ID NO: 2860069 - RNA, 20 nt, Human
uuuaaaaaauaacuaccaag

SEQ ID NO: 2860070 - RNA, 17 nt, Human
uuuaaaaaauuaaucug

SEQ ID NO: 2860071 - RNA, 12 nt, Human
uuguuuuucauu

SEQ ID NO: 2860072 - RNA, 13 nt, Human
uuguuuuucauuc

SEQ ID NO: 2860073 - RNA, 17 nt, Human
uuguuuuuagaaucauu

SEQ ID NO: 2860074 - RNA, 13 nt, Human
uuguuuuucucac

SEQ ID NO: 2860075 - RNA, 14 nt, Human
uuguuuuucuuucu

SEQ ID NO: 2860076 - RNA, 15 nt, Human
uuguuuuucuuucua

SEQ ID NO: 2860077 - RNA, 17 nt, Human
uuguuuuuucaaaauag

SEQ ID NO: 2860078 - RNA, 21 nt, Human
uuguuuuuucaaaauagaaaa

SEQ ID NO: 2860079 - RNA, 18 nt, Human
uuguuuuuuuuuuccacu

SEQ ID NO: 2860080 - RNA, 15 nt, Human
augcaauaaaauuau

SEQ ID NO: 2860081 - RNA, 15 nt, Human
augcaccuugugucu

SEQ ID NO: 2860082 - RNA, 16 nt, Human
augcaccuugugucug

SEQ ID NO: 2860083 - RNA, 18 nt, Human
augcaccuugugucugua

SEQ ID NO: 2860084 - RNA, 18 nt, Human
uuguuuugggggucaggc

SEQ ID NO: 2860085 - RNA, 10 nt, Human
uuguuuuguu

SEQ ID NO: 2860086 - RNA, 14 nt, Human
uuguuuuguuuuaa

SEQ ID NO: 2860087 - RNA, 13 nt, Human
uuguuuuguuuua

SEQ ID NO: 2860088 - RNA, 13 nt, Human
uuguuuuguauug

SEQ ID NO: 2860089 - RNA, 14 nt, Human
uuguuuuguuuguc

SEQ ID NO: 2860090 - RNA, 22 nt, Human
augcaaggaccaggacucccuc

SEQ ID NO: 2860091 - RNA, 21 nt, Human
augcaaggcacuguacuaggc

SEQ ID NO: 2860092 - RNA, 18 nt, Human
uuggaaagaagaaagacu

SEQ ID NO: 2860093 - RNA, 20 nt, Human
augaacauuagaaaaauagc

SEQ ID NO: 2860094 - RNA, 10 nt, Human
augaacauuc

SEQ ID NO: 2860095 - RNA, 12 nt, Human
augaacauucca

SEQ ID NO: 2860096 - RNA, 13 nt, Human
augaacauuccaa

SEQ ID NO: 2860097 - RNA, 20 nt, Human
augaaccacaucuugcucug

SEQ ID NO: 2860098 - RNA, 13 nt, Human
augaaccacaucu

SEQ ID NO: 2860099 - RNA, 17 nt, Human
uugggguacccacugcu

SEQ ID NO: 2860100 - RNA, 19 nt, Human
uugggcuggaacagauuca

SEQ ID NO: 2860101 - RNA, 14 nt, Human
uugggcuucagccu

SEQ ID NO: 2860102 - RNA, 18 nt, Human
uugggcagcaauuuaaau

SEQ ID NO: 2860103 - RNA, 19 nt, Human
uugggcagcaauuuaaaug

SEQ ID NO: 2860104 - RNA, 17 nt, Human
uugggcaugugggcuuc

SEQ ID NO: 2860105 - RNA, 22 nt, Human
uugggccaaauccgcucucuuc

SEQ ID NO: 2860106 - RNA, 14 nt, Human
uuguaacuuauauu

SEQ ID NO: 2860107 - RNA, 17 nt, Human
uuguaacuuauauugaa

SEQ ID NO: 2860108 - RNA, 18 nt, Human
uuguaacuuauauugaag

SEQ ID NO: 2860109 - RNA, 19 nt, Human
uuguaacuuauauugaaga

SEQ ID NO: 2860110 - RNA, 13 nt, Human
uuguaacuuaugu

SEQ ID NO: 2860111 - RNA, 17 nt, Human
uuguaacuuauguagau

SEQ ID NO: 2860112 - RNA, 18 nt, Human
uuguaacuuauguagaua

SEQ ID NO: 2860113 - RNA, 20 nt, Human
uuguaacuaggcucagagau

SEQ ID NO: 2860114 - RNA, 15 nt, Human
uuguaaaaaaaaaug

SEQ ID NO: 2860115 - RNA, 16 nt, Human
uuguaaaaaaaaaugc

SEQ ID NO: 2860116 - RNA, 17 nt, Human
uuguaaaaaaaaaugcc

SEQ ID NO: 2860117 - RNA, 19 nt, Human
uuguaaaaaaaaaugccuu

SEQ ID NO: 2860118 - RNA, 20 nt, Human
uuguaaaaaaaaaugccuuu

SEQ ID NO: 2860119 - RNA, 21 nt, Human
uuguaaaaaaaaaugccuuug

SEQ ID NO: 2860120 - RNA, 22 nt, Human
uuguaaaaaaaaaugccuuuga

SEQ ID NO: 2860121 - RNA, 23 nt, Human
uuguaaaaaaaaaugccuuugag

SEQ ID NO: 2860122 - RNA, 12 nt, Human
uuguaaaaagaa

SEQ ID NO: 2860123 - RNA, 13 nt, Human
uuguaaaaagaaa

SEQ ID NO: 2860124 - RNA, 14 nt, Human
uuguaaaaagaaaa

SEQ ID NO: 2860125 - RNA, 20 nt, Human
uugguucauuaauucuauaa

SEQ ID NO: 2860126 - RNA, 14 nt, Human
uugguucauuaauu

SEQ ID NO: 2860127 - RNA, 22 nt, Human
uugggguacccacugcucuggu

SEQ ID NO: 2860128 - RNA, 20 nt, Human
uuggggaaaccuagagaaga

SEQ ID NO: 2860129 - RNA, 13 nt, Human
uuggggugacagu

SEQ ID NO: 2860130 - RNA, 18 nt, Human
uugguuaauuuuuacaug

SEQ ID NO: 2860131 - RNA, 13 nt, Human
uuggggucucuuu

SEQ ID NO: 2860132 - RNA, 22 nt, Human
uuggggucucuuuuguaaauua

SEQ ID NO: 2860133 - RNA, 14 nt, Human
uuggggucugaccc

SEQ ID NO: 2860134 - RNA, 15 nt, Human
uuggggucugacccc

SEQ ID NO: 2860135 - RNA, 13 nt, Human
uuguauaaaugua

SEQ ID NO: 2860136 - RNA, 17 nt, Human
uuguauaaauguauaua

SEQ ID NO: 2860137 - RNA, 19 nt, Human
uuguauaaauguauauaca

SEQ ID NO: 2860138 - RNA, 22 nt, Human
uuguauaaauguauauacacau

SEQ ID NO: 2860139 - RNA, 14 nt, Human
uuguaguuguuuua

SEQ ID NO: 2860140 - RNA, 13 nt, Human
uuguaguuuaccu

SEQ ID NO: 2860141 - RNA, 17 nt, Human
uuguaguuuaccucuuu

SEQ ID NO: 2860142 - RNA, 14 nt, Human
uuguauaacuucuu

SEQ ID NO: 2860143 - RNA, 11 nt, Human
uuguauauauc

SEQ ID NO: 2860144 - RNA, 13 nt, Human
uuguauauaucug

SEQ ID NO: 2860145 - RNA, 19 nt, Human
uuguauauaucugcuucag

SEQ ID NO: 2860146 - RNA, 14 nt, Human
uuguaauuaugauu

SEQ ID NO: 2860147 - RNA, 15 nt, Human
uuguaauuaugauuu

SEQ ID NO: 2860148 - RNA, 17 nt, Human
uuguaauuaugauuugg

SEQ ID NO: 2860149 - RNA, 17 nt, Human
uuguaaugugugaaaaa

SEQ ID NO: 2860150 - RNA, 21 nt, Human
uuguaaugugugaaaaagaug

SEQ ID NO: 2860151 - RNA, 15 nt, Human
uuguaagucaguguu

SEQ ID NO: 2860152 - RNA, 19 nt, Human
uuguaagucaguguugaga

SEQ ID NO: 2860153 - RNA, 20 nt, Human
uuguaagucaguguugagau

SEQ ID NO: 2860154 - RNA, 21 nt, Human
uuguaagucaguguugagaug

SEQ ID NO: 2860155 - RNA, 16 nt, Human
uuguaagugagugugc

SEQ ID NO: 2860156 - RNA, 18 nt, Human
uuguaagugagugugcug

SEQ ID NO: 2860157 - RNA, 19 nt, Human
uuguaagugagugugcugc

SEQ ID NO: 2860158 - RNA, 17 nt, Human
uuguaagugcuacauaa

SEQ ID NO: 2860159 - RNA, 21 nt, Human
uuguaagugcuacauaaauug

SEQ ID NO: 2860160 - RNA, 14 nt, Human
uuguaaggcuuuga

SEQ ID NO: 2860161 - RNA, 18 nt, Human
uuguaaugaauuccuaga

SEQ ID NO: 2860162 - RNA, 22 nt, Human
uuguaaugaauuccuagaauua

SEQ ID NO: 2860163 - RNA, 13 nt, Human
uuguaaugcugca

SEQ ID NO: 2860164 - RNA, 14 nt, Human
uuguaaugcugcac

SEQ ID NO: 2860165 - RNA, 16 nt, Human
uuguaaugcugcacuu

SEQ ID NO: 2860166 - RNA, 21 nt, Human
uuguaaugcugcacuuccugu

SEQ ID NO: 2860167 - RNA, 20 nt, Human
uuguauauuacacauuugua

SEQ ID NO: 2860168 - RNA, 17 nt, Human
augaauucuuaugcuua

SEQ ID NO: 2860169 - RNA, 16 nt, Human
augaauuccuagaauu

SEQ ID NO: 2860170 - RNA, 16 nt, Human
uuguauaacuaacagc

SEQ ID NO: 2860171 - RNA, 23 nt, Human
augaauuauccuauuucaguacu

SEQ ID NO: 2860172 - RNA, 14 nt, Human
augacaacagaagc

SEQ ID NO: 2860173 - RNA, 19 nt, Human
augacaacagaagcuucag

SEQ ID NO: 2860174 - RNA, 13 nt, Human
augacaagauggu

SEQ ID NO: 2860175 - RNA, 14 nt, Human
augacaagauggua

SEQ ID NO: 2860176 - RNA, 17 nt, Human
augacaagaugguacaa

SEQ ID NO: 2860177 - RNA, 13 nt, Human
augacaagcauuu

SEQ ID NO: 2860178 - RNA, 12 nt, Human
augacacugacc

SEQ ID NO: 2860179 - RNA, 16 nt, Human
augacagguaaauuaa

SEQ ID NO: 2860180 - RNA, 17 nt, Human
augacaggccugaagau

SEQ ID NO: 2860181 - RNA, 19 nt, Human
augacaggccugaagauau

SEQ ID NO: 2860182 - RNA, 22 nt, Human
augacaggccugaagauauuac

SEQ ID NO: 2860183 - RNA, 23 nt, Human
augacaggccugaagauauuacu

SEQ ID NO: 2860184 - RNA, 24 nt, Human
augacaggccugaagauauuacua

SEQ ID NO: 2860185 - RNA, 18 nt, Human
augacagccucuauccua

SEQ ID NO: 2860186 - RNA, 16 nt, Human
augacacuagaaaacu

SEQ ID NO: 2860187 - RNA, 21 nt, Human
augacacuagaaaacuugacu

SEQ ID NO: 2860188 - RNA, 22 nt, Human
uugcuaucuggaggccuuccag

SEQ ID NO: 2860189 - RNA, 23 nt, Human
uugcuaucuggaggccuuccagc

SEQ ID NO: 2860190 - RNA, 16 nt, Human
uugcuaucggggaagc

SEQ ID NO: 2860191 - RNA, 18 nt, Human
uugcuaucggggaagcca

SEQ ID NO: 2860192 - RNA, 20 nt, Human
uugcuaucggggaagccaga

SEQ ID NO: 2860193 - RNA, 19 nt, Human
uugcugaagggcauucuuu

SEQ ID NO: 2860194 - RNA, 21 nt, Human
uugcugaagggcauucuuucc

SEQ ID NO: 2860195 - RNA, 15 nt, Human
uugcucccuucagcc

SEQ ID NO: 2860196 - RNA, 17 nt, Human
uugcucccuucagcccc

SEQ ID NO: 2860197 - RNA, 19 nt, Human
uugcucccuucagccccca

SEQ ID NO: 2860198 - RNA, 16 nt, Human
uugcuagcuaugugac

SEQ ID NO: 2860199 - RNA, 19 nt, Human
uugcuagcuaugugaccuu

SEQ ID NO: 2860200 - RNA, 13 nt, Human
uugcuaguauuug

SEQ ID NO: 2860201 - RNA, 15 nt, Human
uugcuaguauuugaa

SEQ ID NO: 2860202 - RNA, 16 nt, Human
uugcuaguauuugaau

SEQ ID NO: 2860203 - RNA, 17 nt, Human
uugcuaguauuugaauu

SEQ ID NO: 2860204 - RNA, 18 nt, Human
uugcuaguauuugaauua

SEQ ID NO: 2860205 - RNA, 23 nt, Human
uugcuagauaaaagcugaaguua

SEQ ID NO: 2860206 - RNA, 18 nt, Human
uugcuagcaguaaaagau

SEQ ID NO: 2860207 - RNA, 23 nt, Human
uugcuagcaguaaaagaugaagu

SEQ ID NO: 2860208 - RNA, 21 nt, Human
uugcuacccugaguucaucca

SEQ ID NO: 2860209 - RNA, 19 nt, Human
uugcuagaaugggaagggu

SEQ ID NO: 2860210 - RNA, 18 nt, Human
uugcuagacucuagacaa

SEQ ID NO: 2860211 - RNA, 20 nt, Human
uugcuacuacuuaccuacca

SEQ ID NO: 2860212 - RNA, 15 nt, Human
aucuaauaccucugu

SEQ ID NO: 2860213 - RNA, 13 nt, Human
aucuaaguuauaa

SEQ ID NO: 2860214 - RNA, 17 nt, Human
aucuaauaccucugugu

SEQ ID NO: 2860215 - RNA, 14 nt, Human
uugcuaauugcugu

SEQ ID NO: 2860216 - RNA, 18 nt, Human
uugcuaauugcuguugaa

SEQ ID NO: 2860217 - RNA, 21 nt, Human
uugcuaauugcuguugaaagc

SEQ ID NO: 2860218 - RNA, 15 nt, Human
uugcuaauuuucuca

SEQ ID NO: 2860219 - RNA, 17 nt, Human
uugcuaauuuucucaaa

SEQ ID NO: 2860220 - RNA, 23 nt, Human
uugcuaauuuucucaaaagcauu

SEQ ID NO: 2860221 - RNA, 16 nt, Human
uugcuaauuaaaaagu

SEQ ID NO: 2860222 - RNA, 16 nt, Human
uugcuaaucaaagcca

SEQ ID NO: 2860223 - RNA, 18 nt, Human
uugcuaaucaaagccagg

SEQ ID NO: 2860224 - RNA, 21 nt, Human
uugcuaaucaaagccaggguc

SEQ ID NO: 2860225 - RNA, 22 nt, Human
uugcuaaucaaagccagggucu

SEQ ID NO: 2860226 - RNA, 19 nt, Human
aucuaaguuauaagacucu

SEQ ID NO: 2860227 - RNA, 22 nt, Human
uugcugaccucagcgguugcca

SEQ ID NO: 2860228 - RNA, 22 nt, Human
uugcugagccucugcuccccag

SEQ ID NO: 2860229 - RNA, 17 nt, Human
uugcugagcuguuuaua

SEQ ID NO: 2860230 - RNA, 24 nt, Human
uugcugagcuguuuauagagaaug

SEQ ID NO: 2860231 - RNA, 14 nt, Human
uugcugagccucug

SEQ ID NO: 2860232 - RNA, 15 nt, Human
uugcugagccucugc

SEQ ID NO: 2860233 - RNA, 13 nt, Human
uugcuuguuacau

SEQ ID NO: 2860234 - RNA, 19 nt, Human
uugcuuguuauauuaagca

SEQ ID NO: 2860235 - RNA, 21 nt, Human
uugcuuguuauauuaagcaga

SEQ ID NO: 2860236 - RNA, 16 nt, Human
uugcuuggacuauuau

SEQ ID NO: 2860237 - RNA, 15 nt, Human
uugcuuguaccucug

SEQ ID NO: 2860238 - RNA, 18 nt, Human
uugcuuguaccucuggcu

SEQ ID NO: 2860239 - RNA, 19 nt, Human
uugcuuuuucacagucacu

SEQ ID NO: 2860240 - RNA, 22 nt, Human
uuggaaacauuuuuuaaaacaa

SEQ ID NO: 2860241 - RNA, 15 nt, Human
uugcuuuuucaccag

SEQ ID NO: 2860242 - RNA, 13 nt, Human
uugcuuuuuugua

SEQ ID NO: 2860243 - RNA, 19 nt, Human
uugcuuuuuuguauugguu

SEQ ID NO: 2860244 - RNA, 15 nt, Human
uugcuuuuuuaaaua

SEQ ID NO: 2860245 - RNA, 12 nt, Human
uugcuuuuaauu

SEQ ID NO: 2860246 - RNA, 14 nt, Human
uugcuuuuaauuaa

SEQ ID NO: 2860247 - RNA, 15 nt, Human
uugcuuuuauuuuga

SEQ ID NO: 2860248 - RNA, 17 nt, Human
uugcuuuuauuuugaaa

SEQ ID NO: 2860249 - RNA, 15 nt, Human
uugcuuuucccucuu

SEQ ID NO: 2860250 - RNA, 16 nt, Human
uugcuuuucccucuuu

SEQ ID NO: 2860251 - RNA, 21 nt, Human
uugcuuuucccucuuuucuua

SEQ ID NO: 2860252 - RNA, 18 nt, Human
uugcuuuugaaggaauac

SEQ ID NO: 2860253 - RNA, 21 nt, Human
uugcuuuugaaggaauacaau

SEQ ID NO: 2860254 - RNA, 23 nt, Human
uugcuuuugaaggaauacaauau

SEQ ID NO: 2860255 - RNA, 14 nt, Human
augaaaugagguca

SEQ ID NO: 2860256 - RNA, 18 nt, Human
augaaaucuuacagcugg

SEQ ID NO: 2860257 - RNA, 13 nt, Human
augaaagauuaaa

SEQ ID NO: 2860258 - RNA, 18 nt, Human
augaaagauuaaacagau

SEQ ID NO: 2860259 - RNA, 19 nt, Human
augaaagauuaaacagaug

SEQ ID NO: 2860260 - RNA, 12 nt, Human
augaaagaugau

SEQ ID NO: 2860261 - RNA, 13 nt, Human
augaaauauugcu

SEQ ID NO: 2860262 - RNA, 17 nt, Human
augaaauauugcuguau

SEQ ID NO: 2860263 - RNA, 13 nt, Human
augaaauauuuuu

SEQ ID NO: 2860264 - RNA, 19 nt, Human
augaaauccuugacuggac

SEQ ID NO: 2860265 - RNA, 16 nt, Human
augaaauccuuuuccu

SEQ ID NO: 2860266 - RNA, 19 nt, Human
augaaagauggcugugccu

SEQ ID NO: 2860267 - RNA, 20 nt, Human
augaaagauggcugugccuc

SEQ ID NO: 2860268 - RNA, 23 nt, Human
augaaagauggcugugccucugc

SEQ ID NO: 2860269 - RNA, 11 nt, Human
aucuuuccugu

SEQ ID NO: 2860270 - RNA, 12 nt, Human
aucuuuccuguc

SEQ ID NO: 2860271 - RNA, 14 nt, Human
aucuuugugauaau

SEQ ID NO: 2860272 - RNA, 17 nt, Human
aucuuugugauaauuua

SEQ ID NO: 2860273 - RNA, 17 nt, Human
aucuuucgauaaacaac

SEQ ID NO: 2860274 - RNA, 16 nt, Human
aucuuucuaugcugcu

SEQ ID NO: 2860275 - RNA, 21 nt, Human
aucuuucuaugcugcuuuuau

SEQ ID NO: 2860276 - RNA, 16 nt, Human
aucuuucuauuccaaa

SEQ ID NO: 2860277 - RNA, 22 nt, Human
aucuuucuccuugaauaucuuu

SEQ ID NO: 2860278 - RNA, 11 nt, Human
aucuuuuacau

SEQ ID NO: 2860279 - RNA, 15 nt, Human
aucuuuuauguuuga

SEQ ID NO: 2860280 - RNA, 16 nt, Human
aucuuuuauguuugaa

SEQ ID NO: 2860281 - RNA, 17 nt, Human
aucuuuuauguuugaau

SEQ ID NO: 2860282 - RNA, 18 nt, Human
aucuuuuauguuugaaua

SEQ ID NO: 2860283 - RNA, 20 nt, Human
aucuuuuauguuugaauaug

SEQ ID NO: 2860284 - RNA, 21 nt, Human
aucuuuuauguuugaauaugg

SEQ ID NO: 2860285 - RNA, 21 nt, Human
aucuuuguuaagguccugaaa

SEQ ID NO: 2860286 - RNA, 14 nt, Human
aucuuuuaaagaaa

SEQ ID NO: 2860287 - RNA, 17 nt, Human
aucuuuuaaaguguuac

SEQ ID NO: 2860288 - RNA, 18 nt, Human
aucuuuuaaaguguuacu

SEQ ID NO: 2860289 - RNA, 20 nt, Human
aucuuuuaaaguguuacuuu

SEQ ID NO: 2860290 - RNA, 22 nt, Human
aucuuuuaaaguguuacuuuuu

SEQ ID NO: 2860291 - RNA, 22 nt, Human
aucuuuuacaacugccucgaaa

SEQ ID NO: 2860292 - RNA, 14 nt, Human
uuggcugcagggag

SEQ ID NO: 2860293 - RNA, 13 nt, Human
uuggcugcaggga

SEQ ID NO: 2860294 - RNA, 22 nt, Human
uuggcuaggaccccuccaugug

SEQ ID NO: 2860295 - RNA, 22 nt, Human
uuggccugucucauccccaggg

SEQ ID NO: 2860296 - RNA, 22 nt, Human
uuggccuucagaaccauccaua

SEQ ID NO: 2860297 - RNA, 21 nt, Human
uuggccuuggcuuuucuagcc

SEQ ID NO: 2860298 - RNA, 15 nt, Human
uuggcgcuauuacaa

SEQ ID NO: 2860299 - RNA, 16 nt, Human
uuggcgcuauuacaaa

SEQ ID NO: 2860300 - RNA, 17 nt, Human
uuggcgcuauuacaaau

SEQ ID NO: 2860301 - RNA, 18 nt, Human
uuggcgcuauuacaaaua

SEQ ID NO: 2860302 - RNA, 22 nt, Human
uuggaccuuacgaucaggcaca

SEQ ID NO: 2860303 - RNA, 14 nt, Human
uuggccuggaguuu

SEQ ID NO: 2860304 - RNA, 16 nt, Human
uuggccugucucaucc

SEQ ID NO: 2860305 - RNA, 23 nt, Human
uuggccugucucauccccagggg

SEQ ID NO: 2860306 - RNA, 17 nt, Human
uuggacggcugggcaca

SEQ ID NO: 2860307 - RNA, 17 nt, Human
uuggacuaaaugccuag

SEQ ID NO: 2860308 - RNA, 23 nt, Human
uuggacuaaaugccuaguuuuua

SEQ ID NO: 2860309 - RNA, 21 nt, Human
uuggacggccugaugcucccu

SEQ ID NO: 2860310 - RNA, 13 nt, Human
uuggacggccuga

SEQ ID NO: 2860311 - RNA, 20 nt, Human
auuuagagaacuguggccgu

SEQ ID NO: 2860312 - RNA, 16 nt, Human
auuuagagaugcugua

SEQ ID NO: 2860313 - RNA, 22 nt, Human
auuuagagaugcuguaacuuaa

SEQ ID NO: 2860314 - RNA, 14 nt, Human
auuuaguaguguaa

SEQ ID NO: 2860315 - RNA, 18 nt, Human
auuuagauuguuaaaaua

SEQ ID NO: 2860316 - RNA, 17 nt, Human
auuuagauugaaaacuu

SEQ ID NO: 2860317 - RNA, 14 nt, Human
auuuagauuguaaa

SEQ ID NO: 2860318 - RNA, 15 nt, Human
auuuagauuguaaac

SEQ ID NO: 2860319 - RNA, 13 nt, Human
auuuagucucuuu

SEQ ID NO: 2860320 - RNA, 16 nt, Human
auuuagucucuuuauu

SEQ ID NO: 2860321 - RNA, 21 nt, Human
auuuagucucuuuauuccuag

SEQ ID NO: 2860322 - RNA, 22 nt, Human
auuuagucucuuuauuccuagu

SEQ ID NO: 2860323 - RNA, 21 nt, Human
auuuaguauugaauacuuaca

SEQ ID NO: 2860324 - RNA, 15 nt, Human
auuuagugaacuacg

SEQ ID NO: 2860325 - RNA, 21 nt, Human
auuuagugaguuauuccuuga

SEQ ID NO: 2860326 - RNA, 18 nt, Human
auuuagugaucuuagcau

SEQ ID NO: 2860327 - RNA, 19 nt, Human
auuuagugaucuuagcaua

SEQ ID NO: 2860328 - RNA, 12 nt, Human
auuuauuaauau

SEQ ID NO: 2860329 - RNA, 14 nt, Human
auuuauuaauauuu

SEQ ID NO: 2860330 - RNA, 15 nt, Human
auuuauuaauauuua

SEQ ID NO: 2860331 - RNA, 23 nt, Human
auuuauuaauauuuaacauuauu

SEQ ID NO: 2860332 - RNA, 20 nt, Human
auuuaguuuuuguaauuuau

SEQ ID NO: 2860333 - RNA, 19 nt, Human
auuuaguuuuuguaauuua

SEQ ID NO: 2860334 - RNA, 19 nt, Human
auuuagaccccauacaagu

SEQ ID NO: 2860335 - RNA, 14 nt, Human
auuuagaaguguca

SEQ ID NO: 2860336 - RNA, 18 nt, Human
auuuagaagugucauguu

SEQ ID NO: 2860337 - RNA, 19 nt, Human
auuuagaagugucauguuu

SEQ ID NO: 2860338 - RNA, 14 nt, Human
auuuagaacuguau

SEQ ID NO: 2860339 - RNA, 21 nt, Human
auuuagaaaauagagcuuuua

SEQ ID NO: 2860340 - RNA, 22 nt, Human
auuuagaaaauagagcuuuuaa

SEQ ID NO: 2860341 - RNA, 18 nt, Human
auuuagaaacuaauugac

SEQ ID NO: 2860342 - RNA, 22 nt, Human
auuuagaaacuaauugacuuua

SEQ ID NO: 2860343 - RNA, 20 nt, Human
auuuacuggacauaacauuu

SEQ ID NO: 2860344 - RNA, 19 nt, Human
auuuaaauuuuacccuuua

SEQ ID NO: 2860345 - RNA, 13 nt, Human
auuuaacaagauc

SEQ ID NO: 2860346 - RNA, 23 nt, Human
auuuaaauguuaugacuauguaa

SEQ ID NO: 2860347 - RNA, 15 nt, Human
auuuaaauuuaaaga

SEQ ID NO: 2860348 - RNA, 16 nt, Human
auuuaaauuuaaagau

SEQ ID NO: 2860349 - RNA, 17 nt, Human
auuuaaauuuaaagaua

SEQ ID NO: 2860350 - RNA, 18 nt, Human
auuuaaauuuaaagauau

SEQ ID NO: 2860351 - RNA, 19 nt, Human
auuuaaaaaugagugugaa

SEQ ID NO: 2860352 - RNA, 21 nt, Human
auuuaaaaaugagugugaagg

SEQ ID NO: 2860353 - RNA, 12 nt, Human
auuuaaaaaugu

SEQ ID NO: 2860354 - RNA, 13 nt, Human
auuuaaaaauguc

SEQ ID NO: 2860355 - RNA, 14 nt, Human
auuuaaaaaugucu

SEQ ID NO: 2860356 - RNA, 15 nt, Human
auuuaaaaaugucuu

SEQ ID NO: 2860357 - RNA, 16 nt, Human
auuuaaaaaugucuug

SEQ ID NO: 2860358 - RNA, 18 nt, Human
auuuaaaaaugucuugcu

SEQ ID NO: 2860359 - RNA, 15 nt, Human
auuuaaaaaauaacu

SEQ ID NO: 2860360 - RNA, 13 nt, Human
auuuaaaaaauaa

SEQ ID NO: 2860361 - RNA, 16 nt, Human
auuuaaaaaaaucaca

SEQ ID NO: 2860362 - RNA, 21 nt, Human
auuuaaaaaaaucacaaaaau

SEQ ID NO: 2860363 - RNA, 14 nt, Human
auuuaaaaacugga

SEQ ID NO: 2860364 - RNA, 15 nt, Human
auuuaaaaacuggaa

SEQ ID NO: 2860365 - RNA, 16 nt, Human
auuuaaaaacuggaac

SEQ ID NO: 2860366 - RNA, 14 nt, Human
auuuauucugcuca

SEQ ID NO: 2860367 - RNA, 14 nt, Human
auuuauuuauuauu

SEQ ID NO: 2860368 - RNA, 14 nt, Human
auuuauuuauuuaa

SEQ ID NO: 2860369 - RNA, 13 nt, Human
auuuauuuacaga

SEQ ID NO: 2860370 - RNA, 23 nt, Human
auuuauuuacagaugaauguauu

SEQ ID NO: 2860371 - RNA, 18 nt, Human
auuuauuuauguacuuuu

SEQ ID NO: 2860372 - RNA, 16 nt, Human
auuuauuuauguacuu

SEQ ID NO: 2860373 - RNA, 15 nt, Human
auuuauuuauguacu

SEQ ID NO: 2860374 - RNA, 13 nt, Human
auuuauuuauuau

SEQ ID NO: 2860375 - RNA, 13 nt, Human
auuuauucugcuc

SEQ ID NO: 2860376 - RNA, 17 nt, Human
auuuauuuaaugugagu

SEQ ID NO: 2860377 - RNA, 21 nt, Human
auuuauuuaaugugaguuugg

SEQ ID NO: 2860378 - RNA, 18 nt, Human
auuuauucagcuucauuu

SEQ ID NO: 2860379 - RNA, 20 nt, Human
auuuauucagcuucauuugu

SEQ ID NO: 2860380 - RNA, 11 nt, Human
auuuauuauuu

SEQ ID NO: 2860381 - RNA, 13 nt, Human
auuuauuauuuau

SEQ ID NO: 2860382 - RNA, 15 nt, Human
auuuauuauugaaau

SEQ ID NO: 2860383 - RNA, 16 nt, Human
auuuauuauugaaauu

SEQ ID NO: 2860384 - RNA, 17 nt, Human
auuuauuauugaaauug

SEQ ID NO: 2860385 - RNA, 19 nt, Human
auuuauuauuuauuuauua

SEQ ID NO: 2860386 - RNA, 19 nt, Human
auuucauuguaugaugugu

SEQ ID NO: 2860387 - RNA, 20 nt, Human
auuucauuguaugauguguu

SEQ ID NO: 2860388 - RNA, 12 nt, Human
auuucauuguau

SEQ ID NO: 2860389 - RNA, 14 nt, Human
auuucauuguauga

SEQ ID NO: 2860390 - RNA, 15 nt, Human
auuucauuguaugau

SEQ ID NO: 2860391 - RNA, 17 nt, Human
auuucauuguaugaugu

SEQ ID NO: 2860392 - RNA, 14 nt, Human
auuucauugccugu

SEQ ID NO: 2860393 - RNA, 17 nt, Human
auuucauugccugugua

SEQ ID NO: 2860394 - RNA, 18 nt, Human
auuucauugccuguguau

SEQ ID NO: 2860395 - RNA, 14 nt, Human
auuucauugguuaa

SEQ ID NO: 2860396 - RNA, 19 nt, Human
auuucauugguuaauuuuu

SEQ ID NO: 2860397 - RNA, 13 nt, Human
auuucaagaaaaa

SEQ ID NO: 2860398 - RNA, 19 nt, Human
auuucaagaaaaaauaaau

SEQ ID NO: 2860399 - RNA, 20 nt, Human
auuucaagaaaaaauaaaug

SEQ ID NO: 2860400 - RNA, 21 nt, Human
auuucaagaaaaaauaaaugg

SEQ ID NO: 2860401 - RNA, 22 nt, Human
auuucaagaaaaaauaaaugga

SEQ ID NO: 2860402 - RNA, 23 nt, Human
auuucaagaaaaaauaaauggaa

SEQ ID NO: 2860403 - RNA, 16 nt, Human
auuucaaacggccuca

SEQ ID NO: 2860404 - RNA, 16 nt, Human
auuucaaaaugcuuuu

SEQ ID NO: 2860405 - RNA, 13 nt, Human
auuucaaaaugcu

SEQ ID NO: 2860406 - RNA, 13 nt, Human
auuucaaaagaca

SEQ ID NO: 2860407 - RNA, 14 nt, Human
auuucaaaagacau

SEQ ID NO: 2860408 - RNA, 16 nt, Human
auuucaaaagacaugu

SEQ ID NO: 2860409 - RNA, 17 nt, Human
auuucaaaagacauguu

SEQ ID NO: 2860410 - RNA, 18 nt, Human
auuucaaaagacauguug

SEQ ID NO: 2860411 - RNA, 21 nt, Human
auuucaaaagacauguuguaa

SEQ ID NO: 2860412 - RNA, 21 nt, Human
auuucaaaaugcuuuuuauua

SEQ ID NO: 2860413 - RNA, 15 nt, Human
auuucaaaaugcuuu

SEQ ID NO: 2860414 - RNA, 14 nt, Human
auuucaaaaugcuu

SEQ ID NO: 2860415 - RNA, 21 nt, Human
auuucauuguaugauguguug

SEQ ID NO: 2860416 - RNA, 22 nt, Human
auuucauuugugccagaaugcu

SEQ ID NO: 2860417 - RNA, 14 nt, Human
auuuccagccaggg

SEQ ID NO: 2860418 - RNA, 18 nt, Human
auuuccagccagggcugc

SEQ ID NO: 2860419 - RNA, 21 nt, Human
auuuccagcuuucuccccgcu

SEQ ID NO: 2860420 - RNA, 22 nt, Human
auuuccagcuuucuccccgcua

SEQ ID NO: 2860421 - RNA, 14 nt, Human
auuuccagggauau

SEQ ID NO: 2860422 - RNA, 17 nt, Human
auuuccagccagggcug

SEQ ID NO: 2860423 - RNA, 20 nt, Human
auuuccagugaaaucaguua

SEQ ID NO: 2860424 - RNA, 21 nt, Human
auuucccauuugugccagagg

SEQ ID NO: 2860425 - RNA, 22 nt, Human
auuucccauuugugccagagga

SEQ ID NO: 2860426 - RNA, 21 nt, Human
auuuccaguguucuaugaaca

SEQ ID NO: 2860427 - RNA, 22 nt, Human
auuuccaguguucuaugaacaa

SEQ ID NO: 2860428 - RNA, 13 nt, Human
auuugaacacugg

SEQ ID NO: 2860429 - RNA, 22 nt, Human
auuugaacacuggcuaaagaua

SEQ ID NO: 2860430 - RNA, 18 nt, Human
auuugaacacuuggugcu

SEQ ID NO: 2860431 - RNA, 16 nt, Human
auuugaagaacaugug

SEQ ID NO: 2860432 - RNA, 22 nt, Human
auuugaaaacauaaucugcaaa

SEQ ID NO: 2860433 - RNA, 14 nt, Human
auuugaaaaaaacu

SEQ ID NO: 2860434 - RNA, 16 nt, Human
auuugaaaaaaacuuc

SEQ ID NO: 2860435 - RNA, 22 nt, Human
auuugaaaaaaacuucauucuc

SEQ ID NO: 2860436 - RNA, 22 nt, Human
auuucuuuuguaauaaacuauu

SEQ ID NO: 2860437 - RNA, 21 nt, Human
auuucuuuuguaauaaacuau

SEQ ID NO: 2860438 - RNA, 23 nt, Human
auuucccuugaaauuuuaaacua

SEQ ID NO: 2860439 - RNA, 13 nt, Human
auuucccuucuug

SEQ ID NO: 2860440 - RNA, 16 nt, Human
auuucccuucuugcau

SEQ ID NO: 2860441 - RNA, 23 nt, Human
auuucccuucuugcauccuuccu

SEQ ID NO: 2860442 - RNA, 16 nt, Human
auuucuagccugcacu

SEQ ID NO: 2860443 - RNA, 19 nt, Human
auuucuagccugcacuuug

SEQ ID NO: 2860444 - RNA, 23 nt, Human
auuucuagccugcacuuugaugu

SEQ ID NO: 2860445 - RNA, 18 nt, Human
auuucuaccauuucagag

SEQ ID NO: 2860446 - RNA, 17 nt, Human
auuucuaccauuucaga

SEQ ID NO: 2860447 - RNA, 19 nt, Human
auuucuacacagugggaac

SEQ ID NO: 2860448 - RNA, 20 nt, Human
auuucuaccaaggcauauca

SEQ ID NO: 2860449 - RNA, 22 nt, Human
auuuccgcacuucagaauucca

SEQ ID NO: 2860450 - RNA, 23 nt, Human
auuuccgcacuucagaauuccau

SEQ ID NO: 2860451 - RNA, 13 nt, Human
auugacauuugua

SEQ ID NO: 2860452 - RNA, 17 nt, Human
auugacauuuguaguug

SEQ ID NO: 2860453 - RNA, 18 nt, Human
auugacauuuguaguuga

SEQ ID NO: 2860454 - RNA, 14 nt, Human
auugaccaucugcu

SEQ ID NO: 2860455 - RNA, 15 nt, Human
auugaccaucugcuu

SEQ ID NO: 2860456 - RNA, 16 nt, Human
auugaaaaacucuuua

SEQ ID NO: 2860457 - RNA, 17 nt, Human
auugaaaaacucuuuau

SEQ ID NO: 2860458 - RNA, 18 nt, Human
auugaaaacuuuucucag

SEQ ID NO: 2860459 - RNA, 13 nt, Human
auucuuuuucuga

SEQ ID NO: 2860460 - RNA, 15 nt, Human
auucuuuuucugauu

SEQ ID NO: 2860461 - RNA, 15 nt, Human
auugaaaaucuugug

SEQ ID NO: 2860462 - RNA, 14 nt, Human
auugaaaaugaaug

SEQ ID NO: 2860463 - RNA, 12 nt, Human
auugaaacacuu

SEQ ID NO: 2860464 - RNA, 21 nt, Human
auugggagcuugggaauggau

SEQ ID NO: 2860465 - RNA, 20 nt, Human
auugggaguccaggcacagg

SEQ ID NO: 2860466 - RNA, 22 nt, Human
auugggaguccaggcacaggau

SEQ ID NO: 2860467 - RNA, 21 nt, Human
auuggguaucaagacauagca

SEQ ID NO: 2860468 - RNA, 22 nt, Human
auuggguaucaagacauagcau

SEQ ID NO: 2860469 - RNA, 19 nt, Human
auugggggggccaaaagga

SEQ ID NO: 2860470 - RNA, 22 nt, Human
auugggggggccaaaaggaaaa

SEQ ID NO: 2860471 - RNA, 23 nt, Human
auugggggggccaaaaggaaaaa

SEQ ID NO: 2860472 - RNA, 21 nt, Human
auugggggucaccggccgaug

SEQ ID NO: 2860473 - RNA, 18 nt, Human
auugggcggcucugaagc

SEQ ID NO: 2860474 - RNA, 15 nt, Human
auugggucuauucca

SEQ ID NO: 2860475 - RNA, 16 nt, Human
auugggucuauuccag

SEQ ID NO: 2860476 - RNA, 17 nt, Human
auugggucuauuccagc

SEQ ID NO: 2860477 - RNA, 18 nt, Human
auugggucuauuccagcu

SEQ ID NO: 2860478 - RNA, 19 nt, Human
auugggucuauuccagcuc

SEQ ID NO: 2860479 - RNA, 20 nt, Human
auugggucuauuccagcuca

SEQ ID NO: 2860480 - RNA, 21 nt, Human
auugggucuauuccagcucau

SEQ ID NO: 2860481 - RNA, 14 nt, Human
auuggucuaauuua

SEQ ID NO: 2860482 - RNA, 18 nt, Human
auuggucuaauuuauuca

SEQ ID NO: 2860483 - RNA, 20 nt, Human
auucugugaucuuuuaaagu

SEQ ID NO: 2860484 - RNA, 17 nt, Human
auucuguggaacaagcc

SEQ ID NO: 2860485 - RNA, 20 nt, Human
auucuguaucuuucauccuu

SEQ ID NO: 2860486 - RNA, 13 nt, Human
auucuuaaaaugc

SEQ ID NO: 2860487 - RNA, 17 nt, Human
auucuuaaaaugcaaua

SEQ ID NO: 2860488 - RNA, 18 nt, Human
auucuuaaaaugcaauau

SEQ ID NO: 2860489 - RNA, 20 nt, Human
auucuuaaaaugcaauauuu

SEQ ID NO: 2860490 - RNA, 22 nt, Human
auucuuaaaaugcaauauuugu

SEQ ID NO: 2860491 - RNA, 18 nt, Human
auucuguuuuagguuaaa

SEQ ID NO: 2860492 - RNA, 22 nt, Human
auucugcaagcacaucugcauu

SEQ ID NO: 2860493 - RNA, 19 nt, Human
auucugcaagcacaucugc

SEQ ID NO: 2860494 - RNA, 19 nt, Human
auucugauuuggaaaaaga

SEQ ID NO: 2860495 - RNA, 16 nt, Human
auucugcccaaaaaua

SEQ ID NO: 2860496 - RNA, 23 nt, Human
auucugcaguaaaucuuuuacaa

SEQ ID NO: 2860497 - RNA, 19 nt, Human
auucugcauugcuagauaa

SEQ ID NO: 2860498 - RNA, 22 nt, Human
auucugcauugcuagauaaaag

SEQ ID NO: 2860499 - RNA, 21 nt, Human
auucugcaguaaaucuuuuac

SEQ ID NO: 2860500 - RNA, 20 nt, Human
auucugcaguaaaucuuuua

SEQ ID NO: 2860501 - RNA, 18 nt, Human
auucugcaguaaaucuuu

SEQ ID NO: 2860502 - RNA, 17 nt, Human
auucugcaguaaaucuu

SEQ ID NO: 2860503 - RNA, 14 nt, Human
auucuggcugaaaa

SEQ ID NO: 2860504 - RNA, 21 nt, Human
auucuggauuuugucaagcag

SEQ ID NO: 2860505 - RNA, 14 nt, Human
auucuggccagacu

SEQ ID NO: 2860506 - RNA, 19 nt, Human
auucuggccagacucgaug

SEQ ID NO: 2860507 - RNA, 15 nt, Human
auucuggagauacug

SEQ ID NO: 2860508 - RNA, 18 nt, Human
auucuggacagucagcuc

SEQ ID NO: 2860509 - RNA, 20 nt, Human
auucuggacagucagcucuu

SEQ ID NO: 2860510 - RNA, 22 nt, Human
auucuggacagucagcucuuca

SEQ ID NO: 2860511 - RNA, 18 nt, Human
auucugcccaaaaauaug

SEQ ID NO: 2860512 - RNA, 13 nt, Human
auucugcuugaga

SEQ ID NO: 2860513 - RNA, 17 nt, Human
auucugcuugagaauau

SEQ ID NO: 2860514 - RNA, 19 nt, Human
auucuuacacugccuguau

SEQ ID NO: 2860515 - RNA, 20 nt, Human
auucuuacacugccuguaua

SEQ ID NO: 2860516 - RNA, 22 nt, Human
auucuuacacugccuguauacu

SEQ ID NO: 2860517 - RNA, 23 nt, Human
auucuuacacugccuguauacuu

SEQ ID NO: 2860518 - RNA, 22 nt, Human
auucuuauguagcaggaaauaa

SEQ ID NO: 2860519 - RNA, 15 nt, Human
auucuuauacacauu

SEQ ID NO: 2860520 - RNA, 14 nt, Human
auucuuaugcuuau

SEQ ID NO: 2860521 - RNA, 21 nt, Human
auucuucaagagacccuucaa

SEQ ID NO: 2860522 - RNA, 15 nt, Human
auucuuauuuugugg

SEQ ID NO: 2860523 - RNA, 16 nt, Human
auucuuauuuuuccua

SEQ ID NO: 2860524 - RNA, 12 nt, Human
auucuucuagag

SEQ ID NO: 2860525 - RNA, 20 nt, Human
auucuucagcguaaaauggu

SEQ ID NO: 2860526 - RNA, 22 nt, Human
auucuucaggcuuccugcaauu

SEQ ID NO: 2860527 - RNA, 20 nt, Human
auucuucaguugguuguguc

SEQ ID NO: 2860528 - RNA, 23 nt, Human
auucuucaguugguugugucuuu

SEQ ID NO: 2860529 - RNA, 21 nt, Human
auucuuccaagcugagagucu

SEQ ID NO: 2860530 - RNA, 14 nt, Human
auucuucuagaguu

SEQ ID NO: 2860531 - RNA, 13 nt, Human
auucuucuagagu

SEQ ID NO: 2860532 - RNA, 23 nt, Human
auucuuacccuguacauauguaa

SEQ ID NO: 2860533 - RNA, 10 nt, Human
auucuuccuu

SEQ ID NO: 2860534 - RNA, 19 nt, Human
auucuuuuccaaaauaaaa

SEQ ID NO: 2860535 - RNA, 20 nt, Human
auucuuuucugcaaaauaga

SEQ ID NO: 2860536 - RNA, 15 nt, Human
auucuuuugaauugu

SEQ ID NO: 2860537 - RNA, 16 nt, Human
auucuuuugaauuguu

SEQ ID NO: 2860538 - RNA, 12 nt, Human
auucuuuugcca

SEQ ID NO: 2860539 - RNA, 14 nt, Human
auucuuuugccaag

SEQ ID NO: 2860540 - RNA, 14 nt, Human
auucuuuuaacuuc

SEQ ID NO: 2860541 - RNA, 17 nt, Human
auucuuuuaacuucuuu

SEQ ID NO: 2860542 - RNA, 22 nt, Human
auucuuuggaguugucacauca

SEQ ID NO: 2860543 - RNA, 17 nt, Human
auuggucuccucucagc

SEQ ID NO: 2860544 - RNA, 14 nt, Human
auuggucuccucuc

SEQ ID NO: 2860545 - RNA, 16 nt, Human
auugguggcuuuccuu

SEQ ID NO: 2860546 - RNA, 18 nt, Human
auuggugggauuuuuugu

SEQ ID NO: 2860547 - RNA, 17 nt, Human
auuggugguucucagca

SEQ ID NO: 2860548 - RNA, 12 nt, Human
auuguauugcug

SEQ ID NO: 2860549 - RNA, 14 nt, Human
auuguauugcuguc

SEQ ID NO: 2860550 - RNA, 14 nt, Human
auugugauguauau

SEQ ID NO: 2860551 - RNA, 19 nt, Human
auugugauguauauuccuu

SEQ ID NO: 2860552 - RNA, 16 nt, Human
auugugagccaccacg

SEQ ID NO: 2860553 - RNA, 14 nt, Human
auugugaacucauu

SEQ ID NO: 2860554 - RNA, 15 nt, Human
auugugaacucauug

SEQ ID NO: 2860555 - RNA, 17 nt, Human
auugugaacucauugcu

SEQ ID NO: 2860556 - RNA, 15 nt, Human
auuguguauauucau

SEQ ID NO: 2860557 - RNA, 14 nt, Human
auuguggugccaca

SEQ ID NO: 2860558 - RNA, 18 nt, Human
auuguggugugagcuuca

SEQ ID NO: 2860559 - RNA, 18 nt, Human
auugguguugucauugua

SEQ ID NO: 2860560 - RNA, 12 nt, Human
auuguggugcca

SEQ ID NO: 2860561 - RNA, 18 nt, Human
auugugguaggccuuuua

SEQ ID NO: 2860562 - RNA, 21 nt, Human
auugugguaggccuuuuaaca

SEQ ID NO: 2860563 - RNA, 22 nt, Human
auugugguaggccuuuuaacau

SEQ ID NO: 2860564 - RNA, 23 nt, Human
auugugguaggccuuuuaacauu

SEQ ID NO: 2860565 - RNA, 16 nt, Human
auugugccaauaugua

SEQ ID NO: 2860566 - RNA, 17 nt, Human
auugugccaauauguau

SEQ ID NO: 2860567 - RNA, 15 nt, Human
auugugcaaauggaa

SEQ ID NO: 2860568 - RNA, 14 nt, Human
auuuuaaaaaauga

SEQ ID NO: 2860569 - RNA, 16 nt, Human
auuuuaaaaaaugaaa

SEQ ID NO: 2860570 - RNA, 19 nt, Human
auuuuaaaaaaugaaaaua

SEQ ID NO: 2860571 - RNA, 23 nt, Human
auuuuaaaaaaugaaaauaagug

SEQ ID NO: 2860572 - RNA, 15 nt, Human
auuuguuuuucauuc

SEQ ID NO: 2860573 - RNA, 16 nt, Human
auuuguuuuucauuca

SEQ ID NO: 2860574 - RNA, 14 nt, Human
auuuguuuuucuca

SEQ ID NO: 2860575 - RNA, 15 nt, Human
auuuguuuuucucac

SEQ ID NO: 2860576 - RNA, 15 nt, Human
auuugugagauuccu

SEQ ID NO: 2860577 - RNA, 15 nt, Human
auuuguuuucauggu

SEQ ID NO: 2860578 - RNA, 14 nt, Human
auuuguuuucaugg

SEQ ID NO: 2860579 - RNA, 17 nt, Human
auuugaaguguaccugu

SEQ ID NO: 2860580 - RNA, 22 nt, Human
auuugaaguguaccuguguaca

SEQ ID NO: 2860581 - RNA, 16 nt, Human
auuuuaaaaacauaga

SEQ ID NO: 2860582 - RNA, 17 nt, Human
auuuuaaacaaaauaga

SEQ ID NO: 2860583 - RNA, 13 nt, Human
auuuuaaugugau

SEQ ID NO: 2860584 - RNA, 14 nt, Human
auuuuaaugugaug

SEQ ID NO: 2860585 - RNA, 16 nt, Human
auuuuaaugugaugau

SEQ ID NO: 2860586 - RNA, 18 nt, Human
auuuuaaugugaugaugu

SEQ ID NO: 2860587 - RNA, 22 nt, Human
auuuuaaugugaugauguaauu

SEQ ID NO: 2860588 - RNA, 24 nt, Human
auuuuaaugugaugauguaauuga

SEQ ID NO: 2860589 - RNA, 22 nt, Human
auuuuaaugcaguugcuuacua

SEQ ID NO: 2860590 - RNA, 19 nt, Human
auuuuaauggauuguuaau

SEQ ID NO: 2860591 - RNA, 20 nt, Human
auuuuaauggauuguuaauu

SEQ ID NO: 2860592 - RNA, 23 nt, Human
auuuuaauggauuguuaauuuca

SEQ ID NO: 2860593 - RNA, 22 nt, Human
auuuuaauguaaagauuugcuu

SEQ ID NO: 2860594 - RNA, 14 nt, Human
auuuuaaacuagau

SEQ ID NO: 2860595 - RNA, 16 nt, Human
auuuuaaacuagauga

SEQ ID NO: 2860596 - RNA, 17 nt, Human
auuuuaaacuagaugac

SEQ ID NO: 2860597 - RNA, 18 nt, Human
auuuuaaacuagaugacc

SEQ ID NO: 2860598 - RNA, 20 nt, Human
auuuuaaacuagaugaccuc

SEQ ID NO: 2860599 - RNA, 21 nt, Human
auuuuaaacuagaugaccuca

SEQ ID NO: 2860600 - RNA, 23 nt, Human
auuuuaaacuagaugaccucauu

SEQ ID NO: 2860601 - RNA, 22 nt, Human
auuuuaaacaaagguugagaug

SEQ ID NO: 2860602 - RNA, 13 nt, Human
auuuuaaacaaag

SEQ ID NO: 2860603 - RNA, 13 nt, Human
auuuuaauuguca

SEQ ID NO: 2860604 - RNA, 14 nt, Human
auuuuaauugucau

SEQ ID NO: 2860605 - RNA, 15 nt, Human
auuuuaauugucaug

SEQ ID NO: 2860606 - RNA, 15 nt, Human
auuuuaauuuaguaa

SEQ ID NO: 2860607 - RNA, 19 nt, Human
auuuuaauuuaguaaaugu

SEQ ID NO: 2860608 - RNA, 20 nt, Human
auuuuaauuuaguaaauguu

SEQ ID NO: 2860609 - RNA, 21 nt, Human
auuuuaauuuaguaaauguua

SEQ ID NO: 2860610 - RNA, 12 nt, Human
auuuuacauuaa

SEQ ID NO: 2860611 - RNA, 15 nt, Human
auuuuaccucuuauu

SEQ ID NO: 2860612 - RNA, 15 nt, Human
auuuuacauuaaauu

SEQ ID NO: 2860613 - RNA, 16 nt, Human
auuuuaccagcagaag

SEQ ID NO: 2860614 - RNA, 17 nt, Human
auuuuacuuuuuccugg

SEQ ID NO: 2860615 - RNA, 16 nt, Human
auuuuacuuuuuccug

SEQ ID NO: 2860616 - RNA, 18 nt, Human
auuuuaccucuuauugca

SEQ ID NO: 2860617 - RNA, 12 nt, Human
auuuucagugau

SEQ ID NO: 2860618 - RNA, 12 nt, Human
auuuucaguauu

SEQ ID NO: 2860619 - RNA, 14 nt, Human
auuuucaguauuuu

SEQ ID NO: 2860620 - RNA, 14 nt, Human
auuuucauaacuua

SEQ ID NO: 2860621 - RNA, 15 nt, Human
auuuucauaacuuau

SEQ ID NO: 2860622 - RNA, 19 nt, Human
auuuucauaacuuauugcu

SEQ ID NO: 2860623 - RNA, 21 nt, Human
auuuucauaacuuauugcuga

SEQ ID NO: 2860624 - RNA, 22 nt, Human
auuuucauaacuuauugcugau

SEQ ID NO: 2860625 - RNA, 23 nt, Human
auuuucauaacuuauugcugauu

SEQ ID NO: 2860626 - RNA, 17 nt, Human
auuuucagaaaauauua

SEQ ID NO: 2860627 - RNA, 14 nt, Human
auuuucagaaaaua

SEQ ID NO: 2860628 - RNA, 20 nt, Human
auuuucagguaguacuaaga

SEQ ID NO: 2860629 - RNA, 18 nt, Human
auuuucaguaauguuauu

SEQ ID NO: 2860630 - RNA, 22 nt, Human
auuuucaguaauguuauuuucu

SEQ ID NO: 2860631 - RNA, 16 nt, Human
auuuuccuacaggcag

SEQ ID NO: 2860632 - RNA, 17 nt, Human
auuuuccagggcaauca

SEQ ID NO: 2860633 - RNA, 22 nt, Human
auuuuccagggcaaucaauguu

SEQ ID NO: 2860634 - RNA, 17 nt, Human
auuuucauguauaugug

SEQ ID NO: 2860635 - RNA, 18 nt, Human
auuuucauguauaugugu

SEQ ID NO: 2860636 - RNA, 11 nt, Human
auuuucauguu

SEQ ID NO: 2860637 - RNA, 15 nt, Human
auuuucauuacaaug

SEQ ID NO: 2860638 - RNA, 16 nt, Human
auuuucauuacaaugg

SEQ ID NO: 2860639 - RNA, 18 nt, Human
auuuuauucaagaaugcc

SEQ ID NO: 2860640 - RNA, 19 nt, Human
auuuuagaacaauuuucuu

SEQ ID NO: 2860641 - RNA, 22 nt, Human
auuuucaaaagcauuaauuuuu

SEQ ID NO: 2860642 - RNA, 16 nt, Human
auuuuagaauaaauuc

SEQ ID NO: 2860643 - RNA, 21 nt, Human
auuuuagaaaccccucuguag

SEQ ID NO: 2860644 - RNA, 22 nt, Human
auuuuagauggaauaagagaaa

SEQ ID NO: 2860645 - RNA, 13 nt, Human
auuuucacuguag

SEQ ID NO: 2860646 - RNA, 22 nt, Human
auuuucaccccacccuuccccu

SEQ ID NO: 2860647 - RNA, 16 nt, Human
auuuucacccucugua

SEQ ID NO: 2860648 - RNA, 18 nt, Human
auuuucacccucuguacc

SEQ ID NO: 2860649 - RNA, 22 nt, Human
auuuucacauucccaucuguca

SEQ ID NO: 2860650 - RNA, 16 nt, Human
auuuucaccccacccu

SEQ ID NO: 2860651 - RNA, 15 nt, Human
auuuucaccccaccc

SEQ ID NO: 2860652 - RNA, 15 nt, Human
auuuucaaguagcug

SEQ ID NO: 2860653 - RNA, 15 nt, Human
auuuucacaauguca

SEQ ID NO: 2860654 - RNA, 20 nt, Human
auuuucacaaugucaguauu

SEQ ID NO: 2860655 - RNA, 18 nt, Human
auuuucaacgcagcccug

SEQ ID NO: 2860656 - RNA, 22 nt, Human
auuuucaaagcuuuuuccagag

SEQ ID NO: 2860657 - RNA, 13 nt, Human
auuuucaagaaac

SEQ ID NO: 2860658 - RNA, 20 nt, Human
auuuucaacgcagcccugcu

SEQ ID NO: 2860659 - RNA, 20 nt, Human
auuuucaagcagcaucuucu

SEQ ID NO: 2860660 - RNA, 21 nt, Human
auuuucaagcagcaucuucug

SEQ ID NO: 2860661 - RNA, 23 nt, Human
auuuucaagaaacugaggaauuu

SEQ ID NO: 2860662 - RNA, 22 nt, Human
auuuucaagaaacugaggaauu

SEQ ID NO: 2860663 - RNA, 17 nt, Human
auuuucaagaaacugag

SEQ ID NO: 2860664 - RNA, 16 nt, Human
auuuucaagaaacuga

SEQ ID NO: 2860665 - RNA, 14 nt, Human
auuuucaagaaacu

SEQ ID NO: 2860666 - RNA, 13 nt, Human
uuuucauuuucca

SEQ ID NO: 2860667 - RNA, 14 nt, Human
uuuucauuuuccaa

SEQ ID NO: 2860668 - RNA, 15 nt, Human
uuuucauuuuccaau

SEQ ID NO: 2860669 - RNA, 17 nt, Human
uuuucauuuuccaauac

SEQ ID NO: 2860670 - RNA, 12 nt, Human
uuuucuccagcu

SEQ ID NO: 2860671 - RNA, 13 nt, Human
uuuucuccagcuc

SEQ ID NO: 2860672 - RNA, 15 nt, Human
uuuuccaaaauaauu

SEQ ID NO: 2860673 - RNA, 16 nt, Human
uuuucaguuccaagaa

SEQ ID NO: 2860674 - RNA, 19 nt, Human
uuuucauauugugccaaua

SEQ ID NO: 2860675 - RNA, 13 nt, Human
uuuucauccccuu

SEQ ID NO: 2860676 - RNA, 15 nt, Human
uuuucaucuguuguu

SEQ ID NO: 2860677 - RNA, 19 nt, Human
uuuucuccucccaggaacu

SEQ ID NO: 2860678 - RNA, 14 nt, Human
uuuucuccucccag

SEQ ID NO: 2860679 - RNA, 13 nt, Human
uuuucuccuccca

SEQ ID NO: 2860680 - RNA, 13 nt, Human
uuuucugacuaau

SEQ ID NO: 2860681 - RNA, 23 nt, Human
uuuucuggggaaagacacugccu

SEQ ID NO: 2860682 - RNA, 21 nt, Human
uuuucuggguaggacuuuggu

SEQ ID NO: 2860683 - RNA, 13 nt, Human
uuuuauuaauuua

SEQ ID NO: 2860684 - RNA, 23 nt, Human
uuuuagguucuaaaguucuaaga

SEQ ID NO: 2860685 - RNA, 14 nt, Human
uuuuagguucuaaa

SEQ ID NO: 2860686 - RNA, 15 nt, Human
uuuuagguucuaaag

SEQ ID NO: 2860687 - RNA, 16 nt, Human
uuuuagguucuaaagu

SEQ ID NO: 2860688 - RNA, 18 nt, Human
uuuuagguucuaaaguuc

SEQ ID NO: 2860689 - RNA, 15 nt, Human
uuuuagguagaaaaa

SEQ ID NO: 2860690 - RNA, 23 nt, Human
uuuuaggucaagggcuuacuauu

SEQ ID NO: 2860691 - RNA, 12 nt, Human
uuuuagguucua

SEQ ID NO: 2860692 - RNA, 13 nt, Human
uuuuagguucuaa

SEQ ID NO: 2860693 - RNA, 20 nt, Human
uuuuaggccaaaaaaaugua

SEQ ID NO: 2860694 - RNA, 15 nt, Human
uuuuaggcacucuua

SEQ ID NO: 2860695 - RNA, 17 nt, Human
uuuuaggcacucuuaaa

SEQ ID NO: 2860696 - RNA, 14 nt, Human
uuuuauuuauaugu

SEQ ID NO: 2860697 - RNA, 15 nt, Human
uuuuauuuaugaagu

SEQ ID NO: 2860698 - RNA, 23 nt, Human
uuuuauuucagauuuugauaacu

SEQ ID NO: 2860699 - RNA, 14 nt, Human
uuuuauuucauugg

SEQ ID NO: 2860700 - RNA, 22 nt, Human
uuuuauuucauugguuaauuuu

SEQ ID NO: 2860701 - RNA, 14 nt, Human
uuuuauuuccauca

SEQ ID NO: 2860702 - RNA, 12 nt, Human
uuuuauuguuuu

SEQ ID NO: 2860703 - RNA, 14 nt, Human
uuuuauuguuuuca

SEQ ID NO: 2860704 - RNA, 15 nt, Human
uuuuauuguuuucua

SEQ ID NO: 2860705 - RNA, 11 nt, Human
uuuuauuuuac

SEQ ID NO: 2860706 - RNA, 15 nt, Human
uuuuauuuuacuauu

SEQ ID NO: 2860707 - RNA, 16 nt, Human
uuuucaguuguuuguu

SEQ ID NO: 2860708 - RNA, 22 nt, Human
uuuucaguuguuuguuuuugcu

SEQ ID NO: 2860709 - RNA, 20 nt, Human
uuuuauuuucacccucugua

SEQ ID NO: 2860710 - RNA, 14 nt, Human
uuuuauuuuauguu

SEQ ID NO: 2860711 - RNA, 16 nt, Human
uuuuauuuuauguuua

SEQ ID NO: 2860712 - RNA, 13 nt, Human
uuuucauauugug

SEQ ID NO: 2860713 - RNA, 14 nt, Human
uuuucauauugugc

SEQ ID NO: 2860714 - RNA, 16 nt, Human
uuuucauauugugcca

SEQ ID NO: 2860715 - RNA, 18 nt, Human
uuuucauacuuuuaccuu

SEQ ID NO: 2860716 - RNA, 13 nt, Human
uuuucauaacuua

SEQ ID NO: 2860717 - RNA, 15 nt, Human
uuuucauaacuuauu

SEQ ID NO: 2860718 - RNA, 21 nt, Human
uuuucauaacuuauugcugau

SEQ ID NO: 2860719 - RNA, 20 nt, Human
uuuucaguuucaauucagug

SEQ ID NO: 2860720 - RNA, 16 nt, Human
auguuuuccagcuccu

SEQ ID NO: 2860721 - RNA, 22 nt, Human
auguuuugguagauuaaauaua

SEQ ID NO: 2860722 - RNA, 20 nt, Human
auguuuaugcaaggaaggaa

SEQ ID NO: 2860723 - RNA, 18 nt, Human
auguuuaugcaaggaagg

SEQ ID NO: 2860724 - RNA, 22 nt, Human
auguuuaugcaaggaaggaaag

SEQ ID NO: 2860725 - RNA, 19 nt, Human
auguuuauaacuauucagu

SEQ ID NO: 2860726 - RNA, 15 nt, Human
auguuuauagcauuc

SEQ ID NO: 2860727 - RNA, 13 nt, Human
auguuuaugaaaa

SEQ ID NO: 2860728 - RNA, 15 nt, Human
auguuuaugaaaaua

SEQ ID NO: 2860729 - RNA, 18 nt, Human
auguuuaugaaaauaaau

SEQ ID NO: 2860730 - RNA, 19 nt, Human
auguuuaugaaaauaaaua

SEQ ID NO: 2860731 - RNA, 20 nt, Human
uuuucugucagaugagaaca

SEQ ID NO: 2860732 - RNA, 11 nt, Human
uuuucuguacu

SEQ ID NO: 2860733 - RNA, 14 nt, Human
uuuucuguagucau

SEQ ID NO: 2860734 - RNA, 16 nt, Human
uuuucuguagucauuu

SEQ ID NO: 2860735 - RNA, 18 nt, Human
uuuucuguagucauuuac

SEQ ID NO: 2860736 - RNA, 14 nt, Human
uuuucugguucuaa

SEQ ID NO: 2860737 - RNA, 15 nt, Human
uuuucugguucuaac

SEQ ID NO: 2860738 - RNA, 17 nt, Human
uuuucugguucuaacau

SEQ ID NO: 2860739 - RNA, 22 nt, Human
auguuguguuucuguucaccuu

SEQ ID NO: 2860740 - RNA, 17 nt, Human
auguuguuaaaauuaug

SEQ ID NO: 2860741 - RNA, 23 nt, Human
auguuguuagagaaaaaugcuuu

SEQ ID NO: 2860742 - RNA, 16 nt, Human
auguuguuaugcuauu

SEQ ID NO: 2860743 - RNA, 17 nt, Human
auguuguuaugcuauua

SEQ ID NO: 2860744 - RNA, 15 nt, Human
uuuucuguguaacca

SEQ ID NO: 2860745 - RNA, 21 nt, Human
uuuucuguguaaccauuuuau

SEQ ID NO: 2860746 - RNA, 22 nt, Human
uuuucuguguaaccauuuuaua

SEQ ID NO: 2860747 - RNA, 23 nt, Human
auguuguuuccuaauaucaaaug

SEQ ID NO: 2860748 - RNA, 21 nt, Human
auguuguguuucuguucaccu

SEQ ID NO: 2860749 - RNA, 16 nt, Human
auguuuuuaaaaguuu

SEQ ID NO: 2860750 - RNA, 18 nt, Human
auguuuuuaaaaguuuca

SEQ ID NO: 2860751 - RNA, 11 nt, Human
auguuuuggug

SEQ ID NO: 2860752 - RNA, 22 nt, Human
auuaaaacagcugcauuagaaa

SEQ ID NO: 2860753 - RNA, 13 nt, Human
auuaaaacauugg

SEQ ID NO: 2860754 - RNA, 14 nt, Human
auuaaaacauugga

SEQ ID NO: 2860755 - RNA, 14 nt, Human
auguuuugugacua

SEQ ID NO: 2860756 - RNA, 17 nt, Human
auguuuugugacuauau

SEQ ID NO: 2860757 - RNA, 14 nt, Human
auguuuuguauaca

SEQ ID NO: 2860758 - RNA, 15 nt, Human
auguuuuguauacaa

SEQ ID NO: 2860759 - RNA, 16 nt, Human
auguuuuguauacaaa

SEQ ID NO: 2860760 - RNA, 20 nt, Human
auguuuuguauacaaauaua

SEQ ID NO: 2860761 - RNA, 22 nt, Human
auguuuuguauacaaauauauu

SEQ ID NO: 2860762 - RNA, 21 nt, Human
auguuuugugacuauauagag

SEQ ID NO: 2860763 - RNA, 15 nt, Human
auguuuugugcauuu

SEQ ID NO: 2860764 - RNA, 16 nt, Human
auguuuugugcauuug

SEQ ID NO: 2860765 - RNA, 22 nt, Human
auguuuugugcauuuguaaaug

SEQ ID NO: 2860766 - RNA, 23 nt, Human
auguuuugugcauuuguaaaugc

SEQ ID NO: 2860767 - RNA, 19 nt, Human
auguuuugugacuauauag

SEQ ID NO: 2860768 - RNA, 13 nt, Human
auuaaaacucagc

SEQ ID NO: 2860769 - RNA, 15 nt, Human
auuaaaacucagccu

SEQ ID NO: 2860770 - RNA, 20 nt, Human
auuaaaacauuggauuaucc

SEQ ID NO: 2860771 - RNA, 13 nt, Human
auuaaaacuucuu

SEQ ID NO: 2860772 - RNA, 14 nt, Human
auuaaaacuucuua

SEQ ID NO: 2860773 - RNA, 20 nt, Human
auuaaaacuucuuaaauauc

SEQ ID NO: 2860774 - RNA, 21 nt, Human
auuaaaacuucuuaaauaucu

SEQ ID NO: 2860775 - RNA, 22 nt, Human
auuaaaacuucuuaaauaucuu

SEQ ID NO: 2860776 - RNA, 12 nt, Human
auuaaaacugcu

SEQ ID NO: 2860777 - RNA, 13 nt, Human
auuaaaacugcuu

SEQ ID NO: 2860778 - RNA, 14 nt, Human
auuaaaacugcuuu

SEQ ID NO: 2860779 - RNA, 16 nt, Human
auuaaaacugcuuuuu

SEQ ID NO: 2860780 - RNA, 12 nt, Human
auuaaacuuaug

SEQ ID NO: 2860781 - RNA, 13 nt, Human
auuaaacuuauga

SEQ ID NO: 2860782 - RNA, 14 nt, Human
auuaaacuuaugaa

SEQ ID NO: 2860783 - RNA, 15 nt, Human
auuaaacuuaugaau

SEQ ID NO: 2860784 - RNA, 16 nt, Human
auuaaacuuaugaaug

SEQ ID NO: 2860785 - RNA, 17 nt, Human
auuaaacuuaugaaugu

SEQ ID NO: 2860786 - RNA, 19 nt, Human
auuaaacugcgaagucaag

SEQ ID NO: 2860787 - RNA, 12 nt, Human
auuaaaccuguc

SEQ ID NO: 2860788 - RNA, 16 nt, Human
auuaaaccugucucca

SEQ ID NO: 2860789 - RNA, 20 nt, Human
auuaaaccugucuccacugu

SEQ ID NO: 2860790 - RNA, 22 nt, Human
auuaaaccugucuccacugugc

SEQ ID NO: 2860791 - RNA, 12 nt, Human
auguugcccagg

SEQ ID NO: 2860792 - RNA, 17 nt, Human
auguugcccaggcaggu

SEQ ID NO: 2860793 - RNA, 16 nt, Human
auguugcccaggcagg

SEQ ID NO: 2860794 - RNA, 16 nt, Human
auguugccauguguuu

SEQ ID NO: 2860795 - RNA, 20 nt, Human
auguugcccaggcaggucuu

SEQ ID NO: 2860796 - RNA, 18 nt, Human
auguugccauguguuuua

SEQ ID NO: 2860797 - RNA, 21 nt, Human
uuuuagcugaugaacuuauuc

SEQ ID NO: 2860798 - RNA, 22 nt, Human
uuuuagcugguggcaauaaaua

SEQ ID NO: 2860799 - RNA, 20 nt, Human
uuuuagcugaugaacuuauu

SEQ ID NO: 2860800 - RNA, 20 nt, Human
uuuuaggaaaaucacuuugu

SEQ ID NO: 2860801 - RNA, 12 nt, Human
uuuuaggaaagg

SEQ ID NO: 2860802 - RNA, 20 nt, Human
uuuuaggagcuaaggcucua

SEQ ID NO: 2860803 - RNA, 23 nt, Human
uuuuaggagcuaaggcucuauga

SEQ ID NO: 2860804 - RNA, 13 nt, Human
auguuaaggaaac

SEQ ID NO: 2860805 - RNA, 17 nt, Human
auguuaaggaaacucuu

SEQ ID NO: 2860806 - RNA, 21 nt, Human
auguuaagcagcuaaauuuuc

SEQ ID NO: 2860807 - RNA, 23 nt, Human
auguuaagcagcuaaauuuucug

SEQ ID NO: 2860808 - RNA, 13 nt, Human
auguguugugaua

SEQ ID NO: 2860809 - RNA, 14 nt, Human
auguguugugauag

SEQ ID NO: 2860810 - RNA, 15 nt, Human
auguguuuacuuuaa

SEQ ID NO: 2860811 - RNA, 14 nt, Human
auguguugaaaacc

SEQ ID NO: 2860812 - RNA, 16 nt, Human
auguguugaaaaccaa

SEQ ID NO: 2860813 - RNA, 18 nt, Human
auguguugaaaaccaaaa

SEQ ID NO: 2860814 - RNA, 22 nt, Human
auguguugaaaaccaaaaugac

SEQ ID NO: 2860815 - RNA, 14 nt, Human
auguguugaaacug

SEQ ID NO: 2860816 - RNA, 20 nt, Human
auguguucucggagugugua

SEQ ID NO: 2860817 - RNA, 22 nt, Human
auguguucccuuugucuuucaa

SEQ ID NO: 2860818 - RNA, 16 nt, Human
auguguuggacaaaug

SEQ ID NO: 2860819 - RNA, 17 nt, Human
auguguuggacaaaugu

SEQ ID NO: 2860820 - RNA, 20 nt, Human
auguguuggacaaaugugaa

SEQ ID NO: 2860821 - RNA, 22 nt, Human
auguguuggacaaaugugaaga

SEQ ID NO: 2860822 - RNA, 18 nt, Human
auguuaggaaaauuucac

SEQ ID NO: 2860823 - RNA, 20 nt, Human
auguuagcuccaaagcauuu

SEQ ID NO: 2860824 - RNA, 23 nt, Human
auguuagaggaucccucucugga

SEQ ID NO: 2860825 - RNA, 22 nt, Human
auguuagacucaugguguguua

SEQ ID NO: 2860826 - RNA, 24 nt, Human
auguuagacucaugguguguuaca

SEQ ID NO: 2860827 - RNA, 15 nt, Human
auguuagagacuuuu

SEQ ID NO: 2860828 - RNA, 12 nt, Human
auguuagagcac

SEQ ID NO: 2860829 - RNA, 23 nt, Human
auguucagaagguugcucuagau

SEQ ID NO: 2860830 - RNA, 19 nt, Human
auguuaggaaaauuucaca

SEQ ID NO: 2860831 - RNA, 12 nt, Human
augugugugugu

SEQ ID NO: 2860832 - RNA, 13 nt, Human
auguuaauuucau

SEQ ID NO: 2860833 - RNA, 14 nt, Human
auguuacuauuuuc

SEQ ID NO: 2860834 - RNA, 21 nt, Human
auguuacuauuuucuacaauu

SEQ ID NO: 2860835 - RNA, 23 nt, Human
auguuacuauuuucuacaauuaa

SEQ ID NO: 2860836 - RNA, 23 nt, Human
auguuaaggaaacucuuaucuca

SEQ ID NO: 2860837 - RNA, 18 nt, Human
auguuaaggaaacucuua

SEQ ID NO: 2860838 - RNA, 19 nt, Human
auguuaaggaaacucuuau

SEQ ID NO: 2860839 - RNA, 14 nt, Human
augugccugggugg

SEQ ID NO: 2860840 - RNA, 22 nt, Human
augugccagguuuuuggucuga

SEQ ID NO: 2860841 - RNA, 22 nt, Human
augugccccuucgcagcugaag

SEQ ID NO: 2860842 - RNA, 13 nt, Human
augugcccuccug

SEQ ID NO: 2860843 - RNA, 16 nt, Human
augugcccuccugagg

SEQ ID NO: 2860844 - RNA, 17 nt, Human
augugcccuccugaggg

SEQ ID NO: 2860845 - RNA, 18 nt, Human
augugcccuccugaggga

SEQ ID NO: 2860846 - RNA, 22 nt, Human
augugcccuccugagggaggac

SEQ ID NO: 2860847 - RNA, 12 nt, Human
uuuuaauaaacu

SEQ ID NO: 2860848 - RNA, 13 nt, Human
uuuuaauaaacua

SEQ ID NO: 2860849 - RNA, 15 nt, Human
uuuuaauaaacuacu

SEQ ID NO: 2860850 - RNA, 19 nt, Human
uuuuaauaaacuacucuuu

SEQ ID NO: 2860851 - RNA, 21 nt, Human
uuuuaauaaacuacucuuuga

SEQ ID NO: 2860852 - RNA, 21 nt, Human
auggggaggcaaguguggggg

SEQ ID NO: 2860853 - RNA, 16 nt, Human
uuuuaaguuguuugca

SEQ ID NO: 2860854 - RNA, 18 nt, Human
uuuuaaguuguuugcaug

SEQ ID NO: 2860855 - RNA, 12 nt, Human
auguggagccag

SEQ ID NO: 2860856 - RNA, 13 nt, Human
auguggagccagg

SEQ ID NO: 2860857 - RNA, 14 nt, Human
auguggagccaggc

SEQ ID NO: 2860858 - RNA, 15 nt, Human
auguggagccaggcg

SEQ ID NO: 2860859 - RNA, 16 nt, Human
auguggagccaggcgu

SEQ ID NO: 2860860 - RNA, 18 nt, Human
auguggccccugaacaag

SEQ ID NO: 2860861 - RNA, 18 nt, Human
auguggcaaggaaaaaca

SEQ ID NO: 2860862 - RNA, 17 nt, Human
auguggaauauaaagau

SEQ ID NO: 2860863 - RNA, 15 nt, Human
auguggaauauaaag

SEQ ID NO: 2860864 - RNA, 15 nt, Human
auguggaagaaaaug

SEQ ID NO: 2860865 - RNA, 21 nt, Human
auguggaagaaaaugguuuau

SEQ ID NO: 2860866 - RNA, 16 nt, Human
auguggccgaggacuu

SEQ ID NO: 2860867 - RNA, 17 nt, Human
auguggccgaggacuuu

SEQ ID NO: 2860868 - RNA, 18 nt, Human
auguggccgaggacuuug

SEQ ID NO: 2860869 - RNA, 19 nt, Human
auguggccuaaaaaugcaa

SEQ ID NO: 2860870 - RNA, 22 nt, Human
auguggccccugaacaagaauu

SEQ ID NO: 2860871 - RNA, 20 nt, Human
auguggccccugaacaagaa

SEQ ID NO: 2860872 - RNA, 12 nt, Human
augugugugugc

SEQ ID NO: 2860873 - RNA, 13 nt, Human
uuuuuauacaaaa

SEQ ID NO: 2860874 - RNA, 14 nt, Human
uuuuuagacaccuu

SEQ ID NO: 2860875 - RNA, 20 nt, Human
uuuuuauaaaaauaaauaga

SEQ ID NO: 2860876 - RNA, 23 nt, Human
uuuuuaguauuuauuuauguacu

SEQ ID NO: 2860877 - RNA, 21 nt, Human
uuuuuagugcauccaguuaac

SEQ ID NO: 2860878 - RNA, 13 nt, Human
uuuuuaguaaucu

SEQ ID NO: 2860879 - RNA, 15 nt, Human
uuuuuaguaaucugu

SEQ ID NO: 2860880 - RNA, 16 nt, Human
uuuuuaguaaucugua

SEQ ID NO: 2860881 - RNA, 20 nt, Human
uuuuuaguaaucuguacauu

SEQ ID NO: 2860882 - RNA, 20 nt, Human
uuuuuauacaaaccuaccaa

SEQ ID NO: 2860883 - RNA, 18 nt, Human
uuuuguuuggcaaggaaa

SEQ ID NO: 2860884 - RNA, 19 nt, Human
uuuuguuuggcaaggaaag

SEQ ID NO: 2860885 - RNA, 12 nt, Human
uuuuuacauuuu

SEQ ID NO: 2860886 - RNA, 12 nt, Human
uuuuguuugucu

SEQ ID NO: 2860887 - RNA, 14 nt, Human
uuuuguuugucucu

SEQ ID NO: 2860888 - RNA, 17 nt, Human
uuuuguuugucucuccu

SEQ ID NO: 2860889 - RNA, 20 nt, Human
uuuuguuugucucuccuuuu

SEQ ID NO: 2860890 - RNA, 14 nt, Human
uuuuguuuguuucu

SEQ ID NO: 2860891 - RNA, 16 nt, Human
uuuuguuuguuucuuu

SEQ ID NO: 2860892 - RNA, 21 nt, Human
uuuuguuuguuucuuuguguu

SEQ ID NO: 2860893 - RNA, 18 nt, Human
uuuuguuuguuuguuuau

SEQ ID NO: 2860894 - RNA, 22 nt, Human
uuuuuagacagagucucacugu

SEQ ID NO: 2860895 - RNA, 18 nt, Human
uuuuuacuguguuuuaua

SEQ ID NO: 2860896 - RNA, 11 nt, Human
uuuuuacugug

SEQ ID NO: 2860897 - RNA, 13 nt, Human
uuuuuacuguguu

SEQ ID NO: 2860898 - RNA, 17 nt, Human
uuuuuacucauugaaau

SEQ ID NO: 2860899 - RNA, 18 nt, Human
uuuuuacucauugaaaug

SEQ ID NO: 2860900 - RNA, 21 nt, Human
uuuuuacucauugaaauguca

SEQ ID NO: 2860901 - RNA, 23 nt, Human
uuuuuacucauugaaaugucacg

SEQ ID NO: 2860902 - RNA, 15 nt, Human
uuuuuaccugucaca

SEQ ID NO: 2860903 - RNA, 17 nt, Human
uuuuuaccugucacauu

SEQ ID NO: 2860904 - RNA, 21 nt, Human
uuuuuaccugucacauugcau

SEQ ID NO: 2860905 - RNA, 16 nt, Human
uuuugugauuuagaac

SEQ ID NO: 2860906 - RNA, 14 nt, Human
uuuuguuugaugca

SEQ ID NO: 2860907 - RNA, 20 nt, Human
uuuuguuugaugcaggcacu

SEQ ID NO: 2860908 - RNA, 16 nt, Human
uuuuguuuauuucauu

SEQ ID NO: 2860909 - RNA, 20 nt, Human
uuuugccauacaucaguuau

SEQ ID NO: 2860910 - RNA, 20 nt, Human
uuuuguuccaaugucaaugu

SEQ ID NO: 2860911 - RNA, 18 nt, Human
uuuuguuaucagucaaua

SEQ ID NO: 2860912 - RNA, 19 nt, Human
uuuugugauuuagaacugu

SEQ ID NO: 2860913 - RNA, 21 nt, Human
uuuugugcaaaagcuucaaau

SEQ ID NO: 2860914 - RNA, 22 nt, Human
uuuugugcaaaagcuucaaauu

SEQ ID NO: 2860915 - RNA, 17 nt, Human
uuuugccuucauuaccu

SEQ ID NO: 2860916 - RNA, 13 nt, Human
uuuugccuucauu

SEQ ID NO: 2860917 - RNA, 23 nt, Human
uuuugcuggaauuccuaacuuuu

SEQ ID NO: 2860918 - RNA, 21 nt, Human
uuuugugaugucccaacuugu

SEQ ID NO: 2860919 - RNA, 15 nt, Human
auuaagauuuuacaa

SEQ ID NO: 2860920 - RNA, 18 nt, Human
auuaagauuuuacaaaag

SEQ ID NO: 2860921 - RNA, 15 nt, Human
auuaagauuauuuua

SEQ ID NO: 2860922 - RNA, 16 nt, Human
uuuugaggcuucuguu

SEQ ID NO: 2860923 - RNA, 23 nt, Human
uuuugagguaaagauauggagaa

SEQ ID NO: 2860924 - RNA, 21 nt, Human
uuuugaguacggcuauagccu

SEQ ID NO: 2860925 - RNA, 16 nt, Human
uuuugaguagauauua

SEQ ID NO: 2860926 - RNA, 18 nt, Human
uuuugaguagauauuacu

SEQ ID NO: 2860927 - RNA, 19 nt, Human
uuuugaguagauauuacuu

SEQ ID NO: 2860928 - RNA, 22 nt, Human
uuuugaguagauauuacuuuau

SEQ ID NO: 2860929 - RNA, 23 nt, Human
uuuugaguagauauuacuuuauc

SEQ ID NO: 2860930 - RNA, 17 nt, Human
uuuugagacagaaucuc

SEQ ID NO: 2860931 - RNA, 17 nt, Human
uuuugagaacguaaaga

SEQ ID NO: 2860932 - RNA, 18 nt, Human
uuuugagaacguaaagaa

SEQ ID NO: 2860933 - RNA, 19 nt, Human
uuuugagaacguaaagaac

SEQ ID NO: 2860934 - RNA, 15 nt, Human
uuuugaggagcccca

SEQ ID NO: 2860935 - RNA, 14 nt, Human
uuuugaguucuaca

SEQ ID NO: 2860936 - RNA, 14 nt, Human
uuuugagugugugu

SEQ ID NO: 2860937 - RNA, 18 nt, Human
uuuugagugugugugugc

SEQ ID NO: 2860938 - RNA, 20 nt, Human
uuuugauaaaguuucucaga

SEQ ID NO: 2860939 - RNA, 19 nt, Human
uuuugauaaaguuucucag

SEQ ID NO: 2860940 - RNA, 21 nt, Human
uuuugauaaaguuucucagau

SEQ ID NO: 2860941 - RNA, 13 nt, Human
uuuugauaacaau

SEQ ID NO: 2860942 - RNA, 13 nt, Human
uuuugauaacugu

SEQ ID NO: 2860943 - RNA, 14 nt, Human
uuuugauaacuguu

SEQ ID NO: 2860944 - RNA, 18 nt, Human
uuuugauaauaaauugaa

SEQ ID NO: 2860945 - RNA, 18 nt, Human
uuuugauaauaauauugu

SEQ ID NO: 2860946 - RNA, 20 nt, Human
uuuugauaauaauauuguuu

SEQ ID NO: 2860947 - RNA, 17 nt, Human
uuuugauccaagcuggu

SEQ ID NO: 2860948 - RNA, 16 nt, Human
uuuugauaugaguaua

SEQ ID NO: 2860949 - RNA, 15 nt, Human
uuuugauagcuuuau

SEQ ID NO: 2860950 - RNA, 23 nt, Human
uuuugccauguuggccaggcugg

SEQ ID NO: 2860951 - RNA, 15 nt, Human
uuuugccucuuuucu

SEQ ID NO: 2860952 - RNA, 19 nt, Human
uuuugcauuugaauaaagc

SEQ ID NO: 2860953 - RNA, 22 nt, Human
uuuugccacuaauuuuaguauu

SEQ ID NO: 2860954 - RNA, 12 nt, Human
uuuugcacuuuu

SEQ ID NO: 2860955 - RNA, 13 nt, Human
uuuugcagaagag

SEQ ID NO: 2860956 - RNA, 21 nt, Human
uuuugcagcccagacaaaugu

SEQ ID NO: 2860957 - RNA, 15 nt, Human
uuuugauuuaugcau

SEQ ID NO: 2860958 - RNA, 20 nt, Human
uuuugauuuguacugaaaaa

SEQ ID NO: 2860959 - RNA, 12 nt, Human
uuuugauuaugu

SEQ ID NO: 2860960 - RNA, 22 nt, Human
uuuugauguuuguggccucaga

SEQ ID NO: 2860961 - RNA, 20 nt, Human
uuuugauguuuguggccuca

SEQ ID NO: 2860962 - RNA, 15 nt, Human
uuuugaugcagcauu

SEQ ID NO: 2860963 - RNA, 17 nt, Human
uuuugaugcagcauuug

SEQ ID NO: 2860964 - RNA, 20 nt, Human
uuuugaugcagcauuugaua

SEQ ID NO: 2860965 - RNA, 21 nt, Human
uuuugaugcagcauuugauaa

SEQ ID NO: 2860966 - RNA, 15 nt, Human
uuuugauguuugugg

SEQ ID NO: 2860967 - RNA, 20 nt, Human
uuuugaugacuggcauuuua

SEQ ID NO: 2860968 - RNA, 13 nt, Human
uuuugcaaauaua

SEQ ID NO: 2860969 - RNA, 18 nt, Human
uuuugcaaauauaaacau

SEQ ID NO: 2860970 - RNA, 19 nt, Human
uuuugcaaauauaaacauc

SEQ ID NO: 2860971 - RNA, 20 nt, Human
uuuugcaaauauaaacaucu

SEQ ID NO: 2860972 - RNA, 21 nt, Human
uuuugauuuguacugaaaaau

SEQ ID NO: 2860973 - RNA, 17 nt, Human
uuuugcaagguuccaca

SEQ ID NO: 2860974 - RNA, 21 nt, Human
uuuugcaagguuccacagagu

SEQ ID NO: 2860975 - RNA, 10 nt, Human
uuuugcacag

SEQ ID NO: 2860976 - RNA, 17 nt, Human
uuuugcaauggcuauau

SEQ ID NO: 2860977 - RNA, 23 nt, Human
auuaccagucuuuaaaggcccag

SEQ ID NO: 2860978 - RNA, 21 nt, Human
auuaccaguggcguuguugca

SEQ ID NO: 2860979 - RNA, 18 nt, Human
auuacccccuccuucaga

SEQ ID NO: 2860980 - RNA, 19 nt, Human
auuacccccuccuucagac

SEQ ID NO: 2860981 - RNA, 13 nt, Human
auuacccccuccu

SEQ ID NO: 2860982 - RNA, 15 nt, Human
auuaccauggagaca

SEQ ID NO: 2860983 - RNA, 13 nt, Human
auuaccauggaga

SEQ ID NO: 2860984 - RNA, 16 nt, Human
auuacauguaaaacau

SEQ ID NO: 2860985 - RNA, 19 nt, Human
auuacauguaaaacauuau

SEQ ID NO: 2860986 - RNA, 13 nt, Human
auuaauacuaaaa

SEQ ID NO: 2860987 - RNA, 16 nt, Human
auuaauacuaaaauau

SEQ ID NO: 2860988 - RNA, 20 nt, Human
auuaauacuaaaauaugucu

SEQ ID NO: 2860989 - RNA, 16 nt, Human
auuaauaaaaaaugga

SEQ ID NO: 2860990 - RNA, 22 nt, Human
auuaauaaaaaauggaaagaau

SEQ ID NO: 2860991 - RNA, 19 nt, Human
auuaauaaaaaauggaaag

SEQ ID NO: 2860992 - RNA, 13 nt, Human
auuaauaaauaga

SEQ ID NO: 2860993 - RNA, 17 nt, Human
auuaauaaauagagcaa

SEQ ID NO: 2860994 - RNA, 20 nt, Human
uuuuuguagagccagggucu

SEQ ID NO: 2860995 - RNA, 19 nt, Human
uuuuuguagagccaggguc

SEQ ID NO: 2860996 - RNA, 13 nt, Human
uuuuugucuuuuc

SEQ ID NO: 2860997 - RNA, 20 nt, Human
uuuuugugaaaaugucaaag

SEQ ID NO: 2860998 - RNA, 13 nt, Human
uuuuugugaagac

SEQ ID NO: 2860999 - RNA, 21 nt, Human
uuuuugugaagacggcacggu

SEQ ID NO: 2861000 - RNA, 12 nt, Human
uuuuugucauca

SEQ ID NO: 2861001 - RNA, 21 nt, Human
uuuuugucccccaacuugaga

SEQ ID NO: 2861002 - RNA, 13 nt, Human
uuuuugucucaau

SEQ ID NO: 2861003 - RNA, 17 nt, Human
uuuuugucaacauugug

SEQ ID NO: 2861004 - RNA, 12 nt, Human
uuuuuaugugau

SEQ ID NO: 2861005 - RNA, 16 nt, Human
uuuuuaugugaucaau

SEQ ID NO: 2861006 - RNA, 13 nt, Human
uuuuuaugaggca

SEQ ID NO: 2861007 - RNA, 20 nt, Human
uuuuuaugaggcaaccugau

SEQ ID NO: 2861008 - RNA, 14 nt, Human
uuuuuauuaauuua

SEQ ID NO: 2861009 - RNA, 13 nt, Human
uuuuuguaauuua

SEQ ID NO: 2861010 - RNA, 12 nt, Human
uuuuuauugcua

SEQ ID NO: 2861011 - RNA, 18 nt, Human
uuuuuauugcuaguauuu

SEQ ID NO: 2861012 - RNA, 22 nt, Human
uuuuuauugcuaguauuugaau

SEQ ID NO: 2861013 - RNA, 23 nt, Human
uuuuuauugaaucuauuuaagua

SEQ ID NO: 2861014 - RNA, 14 nt, Human
auuagaauuauuua

SEQ ID NO: 2861015 - RNA, 13 nt, Human
auuagugauauuu

SEQ ID NO: 2861016 - RNA, 16 nt, Human
auuagugauauuucuc

SEQ ID NO: 2861017 - RNA, 23 nt, Human
auuagugauauuucucuaguagu

SEQ ID NO: 2861018 - RNA, 19 nt, Human
auuacuuaucauccacauu

SEQ ID NO: 2861019 - RNA, 19 nt, Human
auuacccagcuaaauaauc

SEQ ID NO: 2861020 - RNA, 12 nt, Human
auuacuaauuuu

SEQ ID NO: 2861021 - RNA, 15 nt, Human
auuacuaauuuuaca

SEQ ID NO: 2861022 - RNA, 19 nt, Human
auuacuaauuuuacacauu

SEQ ID NO: 2861023 - RNA, 20 nt, Human
auuacuaauuuuacacauua

SEQ ID NO: 2861024 - RNA, 20 nt, Human
auuaccuuuuuugauaaagu

SEQ ID NO: 2861025 - RNA, 15 nt, Human
auuacgauaaggaag

SEQ ID NO: 2861026 - RNA, 17 nt, Human
auuacgauaaggaagaa

SEQ ID NO: 2861027 - RNA, 19 nt, Human
auuacgauaaggaagaaac

SEQ ID NO: 2861028 - RNA, 20 nt, Human
auuacgauaaggaagaaaca

SEQ ID NO: 2861029 - RNA, 20 nt, Human
auuacccccuccuucagaca

SEQ ID NO: 2861030 - RNA, 21 nt, Human
auuacccccuccuucagacac

SEQ ID NO: 2861031 - RNA, 22 nt, Human
auuaccuuuuaccagcuuuuaa

SEQ ID NO: 2861032 - RNA, 23 nt, Human
auuaccuuuuaccagcuuuuaac

SEQ ID NO: 2861033 - RNA, 14 nt, Human
auuacuccuauuuu

SEQ ID NO: 2861034 - RNA, 16 nt, Human
auuacuccuauuuuug

SEQ ID NO: 2861035 - RNA, 19 nt, Human
auuacuccuauuuuuguaa

SEQ ID NO: 2861036 - RNA, 20 nt, Human
auuacuccuauuuuuguaaa

SEQ ID NO: 2861037 - RNA, 21 nt, Human
auuacuccuauuuuuguaaac

SEQ ID NO: 2861038 - RNA, 18 nt, Human
auuacuaugacugcuccc

SEQ ID NO: 2861039 - RNA, 12 nt, Human
auuacuuaaaaa

SEQ ID NO: 2861040 - RNA, 15 nt, Human
auuacuuaucaucca

SEQ ID NO: 2861041 - RNA, 15 nt, Human
auuacuuauuuuuga

SEQ ID NO: 2861042 - RNA, 23 nt, Human
auuacuuaucauccacauuguuu

SEQ ID NO: 2861043 - RNA, 15 nt, Human
auuacuuaucccugc

SEQ ID NO: 2861044 - RNA, 18 nt, Human
auuacuuaucccugccca

SEQ ID NO: 2861045 - RNA, 19 nt, Human
auuacuuaucccugcccau

SEQ ID NO: 2861046 - RNA, 22 nt, Human
auuacuuaucccugcccauuuc

SEQ ID NO: 2861047 - RNA, 19 nt, Human
auuacuuauuuuugacagu

SEQ ID NO: 2861048 - RNA, 22 nt, Human
auuacuucacuauacaaacaaa

SEQ ID NO: 2861049 - RNA, 18 nt, Human
auuacuuauuuuugacag

SEQ ID NO: 2861050 - RNA, 17 nt, Human
auuacuuauuuuugaca

SEQ ID NO: 2861051 - RNA, 16 nt, Human
auuacuuauuuuugac

SEQ ID NO: 2861052 - RNA, 16 nt, Human
auuagugccagaauuu

SEQ ID NO: 2861053 - RNA, 18 nt, Human
auuagugccagaauuuua

SEQ ID NO: 2861054 - RNA, 19 nt, Human
auuagugccagaauuuuag

SEQ ID NO: 2861055 - RNA, 21 nt, Human
auuagugccagaauuuuagga

SEQ ID NO: 2861056 - RNA, 22 nt, Human
auuagugccagaauuuuaggaa

SEQ ID NO: 2861057 - RNA, 15 nt, Human
auuauaguuucaagc

SEQ ID NO: 2861058 - RNA, 16 nt, Human
auuauaguuucugagg

SEQ ID NO: 2861059 - RNA, 19 nt, Human
auuauaguuucugaggcuu

SEQ ID NO: 2861060 - RNA, 15 nt, Human
auuauaucaaaguau

SEQ ID NO: 2861061 - RNA, 18 nt, Human
auuauaucaaaguauuug

SEQ ID NO: 2861062 - RNA, 13 nt, Human
auucuccugccuc

SEQ ID NO: 2861063 - RNA, 14 nt, Human
auucuccugccuca

SEQ ID NO: 2861064 - RNA, 11 nt, Human
auucuccugcc

SEQ ID NO: 2861065 - RNA, 12 nt, Human
auucuccugccu

SEQ ID NO: 2861066 - RNA, 17 nt, Human
auucuccugccucagcc

SEQ ID NO: 2861067 - RNA, 15 nt, Human
auucuccugccucag

SEQ ID NO: 2861068 - RNA, 19 nt, Human
auucuccugccucagccuc

SEQ ID NO: 2861069 - RNA, 20 nt, Human
auucuccugccucagccucc

SEQ ID NO: 2861070 - RNA, 15 nt, Human
auucuccuggaugcu

SEQ ID NO: 2861071 - RNA, 19 nt, Human
auucuccuggaugcuuaga

SEQ ID NO: 2861072 - RNA, 22 nt, Human
auucuccugccuguagcaguga

SEQ ID NO: 2861073 - RNA, 13 nt, Human
auucuccugccuu

SEQ ID NO: 2861074 - RNA, 18 nt, Human
auucuccugccucagccu

SEQ ID NO: 2861075 - RNA, 21 nt, Human
auucucagggucucugcugcc

SEQ ID NO: 2861076 - RNA, 19 nt, Human
auucucagggucucugcug

SEQ ID NO: 2861077 - RNA, 20 nt, Human
auucucagggucucugcugc

SEQ ID NO: 2861078 - RNA, 16 nt, Human
auucucauaauuccua

SEQ ID NO: 2861079 - RNA, 17 nt, Human
auucucauaauuccuac

SEQ ID NO: 2861080 - RNA, 18 nt, Human
auucucauaauuccuaca

SEQ ID NO: 2861081 - RNA, 19 nt, Human
auucucauaauuccuacag

SEQ ID NO: 2861082 - RNA, 22 nt, Human
auucucauaauuccuacagcac

SEQ ID NO: 2861083 - RNA, 13 nt, Human
auucucaucugca

SEQ ID NO: 2861084 - RNA, 15 nt, Human
auucucaucugcacc

SEQ ID NO: 2861085 - RNA, 20 nt, Human
auucucaucugcacccuucu

SEQ ID NO: 2861086 - RNA, 21 nt, Human
auucucaucugcacccuucuu

SEQ ID NO: 2861087 - RNA, 22 nt, Human
auucucaucugcacccuucuuu

SEQ ID NO: 2861088 - RNA, 15 nt, Human
auucucaugccucag

SEQ ID NO: 2861089 - RNA, 14 nt, Human
auucucaugccuca

SEQ ID NO: 2861090 - RNA, 19 nt, Human
auucucaaaguuuccuaau

SEQ ID NO: 2861091 - RNA, 16 nt, Human
auucuauuuuagaaua

SEQ ID NO: 2861092 - RNA, 18 nt, Human
auucuauuuuagaauaaa

SEQ ID NO: 2861093 - RNA, 22 nt, Human
auucuauuuauauguacaugag

SEQ ID NO: 2861094 - RNA, 16 nt, Human
auucucagggucucug

SEQ ID NO: 2861095 - RNA, 13 nt, Human
auucucaggcacc

SEQ ID NO: 2861096 - RNA, 17 nt, Human
auucucagggucucugc

SEQ ID NO: 2861097 - RNA, 18 nt, Human
auucucagggucucugcu

SEQ ID NO: 2861098 - RNA, 22 nt, Human
auucucagggucucugcugccg

SEQ ID NO: 2861099 - RNA, 14 nt, Human
auucucagugccaa

SEQ ID NO: 2861100 - RNA, 15 nt, Human
auucucagugccaac

SEQ ID NO: 2861101 - RNA, 19 nt, Human
auucucagugccaacugug

SEQ ID NO: 2861102 - RNA, 22 nt, Human
auucucagugccaacuguggcu

SEQ ID NO: 2861103 - RNA, 24 nt, Human
auucucagugccaacuguggcugg

SEQ ID NO: 2861104 - RNA, 15 nt, Human
auucuauaaggccau

SEQ ID NO: 2861105 - RNA, 22 nt, Human
auucuaaaaugugauguucuaa

SEQ ID NO: 2861106 - RNA, 23 nt, Human
auucuaaaaugugauguucuaag

SEQ ID NO: 2861107 - RNA, 17 nt, Human
auucuaaacagacucau

SEQ ID NO: 2861108 - RNA, 19 nt, Human
auucuaaagagcacuuacu

SEQ ID NO: 2861109 - RNA, 23 nt, Human
auucuaaagagcacuuacuguaa

SEQ ID NO: 2861110 - RNA, 20 nt, Human
auucuaaaaugugauguucu

SEQ ID NO: 2861111 - RNA, 14 nt, Human
auucuaaagauucu

SEQ ID NO: 2861112 - RNA, 15 nt, Human
auucuaaagauucua

SEQ ID NO: 2861113 - RNA, 17 nt, Human
auucuaaagauucuaua

SEQ ID NO: 2861114 - RNA, 18 nt, Human
auucuaaagauucuauag

SEQ ID NO: 2861115 - RNA, 19 nt, Human
auucuaaagauucuauagu

SEQ ID NO: 2861116 - RNA, 20 nt, Human
auucuaaagauucuauaguu

SEQ ID NO: 2861117 - RNA, 22 nt, Human
auucuaaagauucuauaguucu

SEQ ID NO: 2861118 - RNA, 14 nt, Human
auucuaaaggucca

SEQ ID NO: 2861119 - RNA, 20 nt, Human
auucuauuuauauguacaug

SEQ ID NO: 2861120 - RNA, 14 nt, Human
auucuauuaacuuu

SEQ ID NO: 2861121 - RNA, 13 nt, Human
auucuauugccuu

SEQ ID NO: 2861122 - RNA, 18 nt, Human
auucuauugccuucuuug

SEQ ID NO: 2861123 - RNA, 19 nt, Human
auucuauugccuucuuuga

SEQ ID NO: 2861124 - RNA, 20 nt, Human
auucuauugccuucuuugaa

SEQ ID NO: 2861125 - RNA, 21 nt, Human
auucuauugccuucuuugaag

SEQ ID NO: 2861126 - RNA, 22 nt, Human
auucuauugccuucuuugaaga

SEQ ID NO: 2861127 - RNA, 23 nt, Human
auucuauugccuucuuugaagaa

SEQ ID NO: 2861128 - RNA, 15 nt, Human
auucuauuaaagugc

SEQ ID NO: 2861129 - RNA, 13 nt, Human
auucuauguguca

SEQ ID NO: 2861130 - RNA, 14 nt, Human
auucuaugugucau

SEQ ID NO: 2861131 - RNA, 23 nt, Human
auucuaugugucaucaauagugu

SEQ ID NO: 2861132 - RNA, 13 nt, Human
auucuauaugaau

SEQ ID NO: 2861133 - RNA, 14 nt, Human
auucuauaugaauu

SEQ ID NO: 2861134 - RNA, 16 nt, Human
auucuauaguucuaga

SEQ ID NO: 2861135 - RNA, 17 nt, Human
auucuauaguucuagac

SEQ ID NO: 2861136 - RNA, 16 nt, Human
auucccucucaucuca

SEQ ID NO: 2861137 - RNA, 13 nt, Human
auucuauaguucu

SEQ ID NO: 2861138 - RNA, 14 nt, Human
auucuauaguucua

SEQ ID NO: 2861139 - RNA, 15 nt, Human
auucuauaguucuag

SEQ ID NO: 2861140 - RNA, 23 nt, Human
auucuauaugaauuuaaauauaa

SEQ ID NO: 2861141 - RNA, 15 nt, Human
auucuauaugaauuu

SEQ ID NO: 2861142 - RNA, 16 nt, Human
auucuauaugaauuua

SEQ ID NO: 2861143 - RNA, 17 nt, Human
auucuauaugaauuuaa

SEQ ID NO: 2861144 - RNA, 19 nt, Human
auucuauaugaauuuaaau

SEQ ID NO: 2861145 - RNA, 15 nt, Human
auucccaagcucugc

SEQ ID NO: 2861146 - RNA, 14 nt, Human
auucccaagcucug

SEQ ID NO: 2861147 - RNA, 16 nt, Human
auucccaagcucugcu

SEQ ID NO: 2861148 - RNA, 14 nt, Human
auucuaaaaccauu

SEQ ID NO: 2861149 - RNA, 13 nt, Human
auuccagcucauu

SEQ ID NO: 2861150 - RNA, 16 nt, Human
auuccagcucauucau

SEQ ID NO: 2861151 - RNA, 19 nt, Human
auuccagcucauucauuuu

SEQ ID NO: 2861152 - RNA, 21 nt, Human
auuccagcucauucauuuuau

SEQ ID NO: 2861153 - RNA, 22 nt, Human
auuccaagaauagcaucuguac

SEQ ID NO: 2861154 - RNA, 18 nt, Human
auuccaaagucucuaauu

SEQ ID NO: 2861155 - RNA, 19 nt, Human
auuccaaagucucuaauuc

SEQ ID NO: 2861156 - RNA, 20 nt, Human
auuccaaaugucuuuuagaa

SEQ ID NO: 2861157 - RNA, 14 nt, Human
auuccaacagugag

SEQ ID NO: 2861158 - RNA, 15 nt, Human
auuccaacagugagu

SEQ ID NO: 2861159 - RNA, 14 nt, Human
auucccaagaaaug

SEQ ID NO: 2861160 - RNA, 15 nt, Human
auucccaagaaaugc

SEQ ID NO: 2861161 - RNA, 16 nt, Human
auucccaagaaaugcu

SEQ ID NO: 2861162 - RNA, 13 nt, Human
auuccauauuuau

SEQ ID NO: 2861163 - RNA, 17 nt, Human
auuccauauuuauucaa

SEQ ID NO: 2861164 - RNA, 15 nt, Human
auuccauccauaaau

SEQ ID NO: 2861165 - RNA, 16 nt, Human
auuccauauauccuuu

SEQ ID NO: 2861166 - RNA, 21 nt, Human
auuccauaucuugcgaaucca

SEQ ID NO: 2861167 - RNA, 22 nt, Human
auuccauaucuugcgaauccaa

SEQ ID NO: 2861168 - RNA, 23 nt, Human
auuccauaucuugcgaauccaag

SEQ ID NO: 2861169 - RNA, 20 nt, Human
auucagguauguugccuuua

SEQ ID NO: 2861170 - RNA, 18 nt, Human
auucagguauguugccuu

SEQ ID NO: 2861171 - RNA, 12 nt, Human
auucagucuugc

SEQ ID NO: 2861172 - RNA, 15 nt, Human
auucagucuugccuu

SEQ ID NO: 2861173 - RNA, 16 nt, Human
auucagucuugccuua

SEQ ID NO: 2861174 - RNA, 17 nt, Human
auucagucuugccuuac

SEQ ID NO: 2861175 - RNA, 16 nt, Human
auuccaaagucucuaa

SEQ ID NO: 2861176 - RNA, 15 nt, Human
auuccaaagcuuuau

SEQ ID NO: 2861177 - RNA, 21 nt, Human
auuccaaagcuuuauuaccag

SEQ ID NO: 2861178 - RNA, 23 nt, Human
auuccaaagcuuuauuaccagug

SEQ ID NO: 2861179 - RNA, 14 nt, Human
auuccaaaggggac

SEQ ID NO: 2861180 - RNA, 23 nt, Human
auucagguauguugccuuuaugg

SEQ ID NO: 2861181 - RNA, 18 nt, Human
auucaggugaaaauguuc

SEQ ID NO: 2861182 - RNA, 19 nt, Human
auucaggugaaaauguuca

SEQ ID NO: 2861183 - RNA, 17 nt, Human
auucaggugcagaggaa

SEQ ID NO: 2861184 - RNA, 18 nt, Human
auucaggugcagaggaag

SEQ ID NO: 2861185 - RNA, 13 nt, Human
auucaguauguuu

SEQ ID NO: 2861186 - RNA, 14 nt, Human
auucaguauguuuu

SEQ ID NO: 2861187 - RNA, 16 nt, Human
auucaguauguuuuac

SEQ ID NO: 2861188 - RNA, 22 nt, Human
auucaguauguuuuacacugua

SEQ ID NO: 2861189 - RNA, 18 nt, Human
auucagagaaaggcaagg

SEQ ID NO: 2861190 - RNA, 20 nt, Human
auucagagaaaggcaaggga

SEQ ID NO: 2861191 - RNA, 14 nt, Human
auucagagaauauc

SEQ ID NO: 2861192 - RNA, 16 nt, Human
auucagagaauaucaa

SEQ ID NO: 2861193 - RNA, 14 nt, Human
auucagagagcagc

SEQ ID NO: 2861194 - RNA, 13 nt, Human
auuauauagguug

SEQ ID NO: 2861195 - RNA, 20 nt, Human
auuauauagguugugcaaau

SEQ ID NO: 2861196 - RNA, 23 nt, Human
auuauauagguugugcaaauuaa

SEQ ID NO: 2861197 - RNA, 12 nt, Human
auuauauauaua

SEQ ID NO: 2861198 - RNA, 14 nt, Human
auuauauauauaau

SEQ ID NO: 2861199 - RNA, 16 nt, Human
auuauauauauaauau

SEQ ID NO: 2861200 - RNA, 17 nt, Human
auuauauauauaauaua

SEQ ID NO: 2861201 - RNA, 21 nt, Human
aagauuggugggauuuuuugu

SEQ ID NO: 2861202 - RNA, 21 nt, Human
aagauuguaauuaaaaugaua

SEQ ID NO: 2861203 - RNA, 14 nt, Human
aagauuguauugcu

SEQ ID NO: 2861204 - RNA, 16 nt, Human
aagauuguauugcugu

SEQ ID NO: 2861205 - RNA, 16 nt, Human
aagauugcuuaaaaua

SEQ ID NO: 2861206 - RNA, 20 nt, Human
aagauugugggggaaaaaua

SEQ ID NO: 2861207 - RNA, 18 nt, Human
aagauuuaucaaaucagu

SEQ ID NO: 2861208 - RNA, 16 nt, Human
aagauuuccuugugca

SEQ ID NO: 2861209 - RNA, 17 nt, Human
aagauuuccuugugcaa

SEQ ID NO: 2861210 - RNA, 17 nt, Human
aagauuucuaaauaaaa

SEQ ID NO: 2861211 - RNA, 18 nt, Human
aagauuucuaaauaaaag

SEQ ID NO: 2861212 - RNA, 14 nt, Human
aagauuuaucaaau

SEQ ID NO: 2861213 - RNA, 17 nt, Human
aagauuuaucaaaucag

SEQ ID NO: 2861214 - RNA, 12 nt, Human
aagauuuaagca

SEQ ID NO: 2861215 - RNA, 21 nt, Human
aagauuuaagcacaaacuuua

SEQ ID NO: 2861216 - RNA, 13 nt, Human
aagauuuagaaaa

SEQ ID NO: 2861217 - RNA, 21 nt, Human
aagauuuagaaaaaaguuuac

SEQ ID NO: 2861218 - RNA, 17 nt, Human
aagauuuggaauaaagu

SEQ ID NO: 2861219 - RNA, 12 nt, Human
aagaacauaaag

SEQ ID NO: 2861220 - RNA, 21 nt, Human
aagaacaauuguccauggucu

SEQ ID NO: 2861221 - RNA, 14 nt, Human
aagaacaagaauuu

SEQ ID NO: 2861222 - RNA, 16 nt, Human
aagaaauuugauuucu

SEQ ID NO: 2861223 - RNA, 16 nt, Human
aagaaauuuacuauau

SEQ ID NO: 2861224 - RNA, 15 nt, Human
aagaaauuuauuacu

SEQ ID NO: 2861225 - RNA, 18 nt, Human
aagaaauuuauuacuugu

SEQ ID NO: 2861226 - RNA, 13 nt, Human
aagaaauugcaau

SEQ ID NO: 2861227 - RNA, 16 nt, Human
aagaaauugcaauaac

SEQ ID NO: 2861228 - RNA, 14 nt, Human
aagaaauuucaggu

SEQ ID NO: 2861229 - RNA, 23 nt, Human
aagaaaugauguuggagaaggga

SEQ ID NO: 2861230 - RNA, 15 nt, Human
aagaaaugauguugg

SEQ ID NO: 2861231 - RNA, 20 nt, Human
aagaaaugcauaugucacua

SEQ ID NO: 2861232 - RNA, 18 nt, Human
aagaaauggauucuauuu

SEQ ID NO: 2861233 - RNA, 13 nt, Human
aagaaaugucuua

SEQ ID NO: 2861234 - RNA, 12 nt, Human
aagaaauguacc

SEQ ID NO: 2861235 - RNA, 16 nt, Human
aagaaauguaguugau

SEQ ID NO: 2861236 - RNA, 21 nt, Human
aagaaauguaguugauguauc

SEQ ID NO: 2861237 - RNA, 15 nt, Human
aagaaauuauaaaga

SEQ ID NO: 2861238 - RNA, 17 nt, Human
aagaaauuauaaagaua

SEQ ID NO: 2861239 - RNA, 13 nt, Human
aagccacuugaaa

SEQ ID NO: 2861240 - RNA, 18 nt, Human
aagccacuugaaauguua

SEQ ID NO: 2861241 - RNA, 16 nt, Human
aagcagggaauuucua

SEQ ID NO: 2861242 - RNA, 17 nt, Human
aagcagggaauuucuau

SEQ ID NO: 2861243 - RNA, 22 nt, Human
aagcagggaauuucuaucuaaa

SEQ ID NO: 2861244 - RNA, 21 nt, Human
aagccagcugcagcugggcug

SEQ ID NO: 2861245 - RNA, 17 nt, Human
aagcagcucuccccuca

SEQ ID NO: 2861246 - RNA, 13 nt, Human
aagcagcucuccc

SEQ ID NO: 2861247 - RNA, 14 nt, Human
aagcagcucucccc

SEQ ID NO: 2861248 - RNA, 21 nt, Human
aagcagcuuuaaacaaauuca

SEQ ID NO: 2861249 - RNA, 16 nt, Human
aagcagcuuuaaacaa

SEQ ID NO: 2861250 - RNA, 17 nt, Human
aagcagcuuuaaacaaa

SEQ ID NO: 2861251 - RNA, 23 nt, Human
aagcaggacuuugaggcaagugu

SEQ ID NO: 2861252 - RNA, 18 nt, Human
aagcaggagacgacaggc

SEQ ID NO: 2861253 - RNA, 16 nt, Human
aagcaggcuacacuga

SEQ ID NO: 2861254 - RNA, 22 nt, Human
aagcaggcuacacugacacugg

SEQ ID NO: 2861255 - RNA, 18 nt, Human
aagcaggcgcugugcuau

SEQ ID NO: 2861256 - RNA, 16 nt, Human
aagccauguauaaaug

SEQ ID NO: 2861257 - RNA, 18 nt, Human
aagccauguauaaaugug

SEQ ID NO: 2861258 - RNA, 20 nt, Human
aagccauguauaaaugugau

SEQ ID NO: 2861259 - RNA, 21 nt, Human
aagccauguauaaaugugaua

SEQ ID NO: 2861260 - RNA, 21 nt, Human
aagcgugcacaaggauugaaa

SEQ ID NO: 2861261 - RNA, 23 nt, Human
aagcgugcacaaggauugaaaau

SEQ ID NO: 2861262 - RNA, 11 nt, Human
aagcugcagcu

SEQ ID NO: 2861263 - RNA, 12 nt, Human
aagcugcagcuu

SEQ ID NO: 2861264 - RNA, 13 nt, Human
aagcugcagcuuc

SEQ ID NO: 2861265 - RNA, 14 nt, Human
aagcugcagcuucc

SEQ ID NO: 2861266 - RNA, 15 nt, Human
aagcugcagcuuccu

SEQ ID NO: 2861267 - RNA, 16 nt, Human
aagcugcagcuuccug

SEQ ID NO: 2861268 - RNA, 17 nt, Human
aagcugcagcuuccugu

SEQ ID NO: 2861269 - RNA, 18 nt, Human
aagcugcagcuuccuguc

SEQ ID NO: 2861270 - RNA, 14 nt, Human
aagcugccuguagu

SEQ ID NO: 2861271 - RNA, 17 nt, Human
aagcuaagaugggugga

SEQ ID NO: 2861272 - RNA, 18 nt, Human
aaggacauugcggacagc

SEQ ID NO: 2861273 - RNA, 13 nt, Human
aaggaccaggacu

SEQ ID NO: 2861274 - RNA, 12 nt, Human
aaggaccaggac

SEQ ID NO: 2861275 - RNA, 14 nt, Human
aaggaccagcccuu

SEQ ID NO: 2861276 - RNA, 20 nt, Human
aaggaccagcccuugaggga

SEQ ID NO: 2861277 - RNA, 14 nt, Human
aagcuggccugaga

SEQ ID NO: 2861278 - RNA, 12 nt, Human
aagcuggcuggg

SEQ ID NO: 2861279 - RNA, 15 nt, Human
aagcuggcuggggug

SEQ ID NO: 2861280 - RNA, 20 nt, Human
aagcuggcugggguggccug

SEQ ID NO: 2861281 - RNA, 23 nt, Human
aagcuggcugggguggccugugu

SEQ ID NO: 2861282 - RNA, 15 nt, Human
aaggacauucuugua

SEQ ID NO: 2861283 - RNA, 21 nt, Human
aagcuggccgaggguccuggc

SEQ ID NO: 2861284 - RNA, 22 nt, Human
aagcuggccgaggguccuggcu

SEQ ID NO: 2861285 - RNA, 12 nt, Human
aagcuggccucu

SEQ ID NO: 2861286 - RNA, 22 nt, Human
aagcuggccucuaccacaaggg

SEQ ID NO: 2861287 - RNA, 13 nt, Human
aagcuggccugag

SEQ ID NO: 2861288 - RNA, 21 nt, Human
aagcugccuguaguuaggaaa

SEQ ID NO: 2861289 - RNA, 19 nt, Human
aagcugccuguaguuagga

SEQ ID NO: 2861290 - RNA, 16 nt, Human
aagcugccuguaguua

SEQ ID NO: 2861291 - RNA, 15 nt, Human
aagcugccuguaguu

SEQ ID NO: 2861292 - RNA, 22 nt, Human
aagcugccuguaguuaggaaau

SEQ ID NO: 2861293 - RNA, 16 nt, Human
aagcugcuccaggccu

SEQ ID NO: 2861294 - RNA, 17 nt, Human
aagcugcuccaggccug

SEQ ID NO: 2861295 - RNA, 15 nt, Human
aaggauuuuuuaaag

SEQ ID NO: 2861296 - RNA, 21 nt, Human
aaggauuuuuuaaaguuuuuu

SEQ ID NO: 2861297 - RNA, 13 nt, Human
aaggacugaggga

SEQ ID NO: 2861298 - RNA, 17 nt, Human
aaggacugagggacucu

SEQ ID NO: 2861299 - RNA, 23 nt, Human
aaggacugcgggacuugggucuc

SEQ ID NO: 2861300 - RNA, 14 nt, Human
aaggacuguaaucu

SEQ ID NO: 2861301 - RNA, 23 nt, Human
aaggacucugguuucucauucuu

SEQ ID NO: 2861302 - RNA, 20 nt, Human
aaggacuaggguccugggga

SEQ ID NO: 2861303 - RNA, 18 nt, Human
aaggacuaggguccuggg

SEQ ID NO: 2861304 - RNA, 18 nt, Human
aaggacccggaggggccu

SEQ ID NO: 2861305 - RNA, 15 nt, Human
aaggacuaggguccu

SEQ ID NO: 2861306 - RNA, 14 nt, Human
aaggcaaaaaugua

SEQ ID NO: 2861307 - RNA, 15 nt, Human
aaggcaaguuaagag

SEQ ID NO: 2861308 - RNA, 17 nt, Human
aaggcaaguuaagagaa

SEQ ID NO: 2861309 - RNA, 19 nt, Human
aaggcaaguuaagagaaac

SEQ ID NO: 2861310 - RNA, 21 nt, Human
aaggcaaguuaagagaaacuu

SEQ ID NO: 2861311 - RNA, 22 nt, Human
aaggcaaugccauccucaaaca

SEQ ID NO: 2861312 - RNA, 15 nt, Human
aaggcacaauauggg

SEQ ID NO: 2861313 - RNA, 14 nt, Human
aauaaucuuugggu

SEQ ID NO: 2861314 - RNA, 15 nt, Human
aauaaucacauugac

SEQ ID NO: 2861315 - RNA, 17 nt, Human
aauaaucacauugacuu

SEQ ID NO: 2861316 - RNA, 21 nt, Human
aauaauaaaagauucaccuga

SEQ ID NO: 2861317 - RNA, 13 nt, Human
aauaauauuguuu

SEQ ID NO: 2861318 - RNA, 16 nt, Human
aauaauauuguuuuuc

SEQ ID NO: 2861319 - RNA, 17 nt, Human
aauaauauuguuuuucu

SEQ ID NO: 2861320 - RNA, 21 nt, Human
aauaauauuguuuuucuuucu

SEQ ID NO: 2861321 - RNA, 22 nt, Human
aauaauauuguuuuucuuucua

SEQ ID NO: 2861322 - RNA, 16 nt, Human
aauaauguaauuguaa

SEQ ID NO: 2861323 - RNA, 19 nt, Human
aauaauguacaucuggccu

SEQ ID NO: 2861324 - RNA, 11 nt, Human
aauaaugcugc

SEQ ID NO: 2861325 - RNA, 12 nt, Human
aauaaugcugca

SEQ ID NO: 2861326 - RNA, 14 nt, Human
aauaaugcuucaga

SEQ ID NO: 2861327 - RNA, 16 nt, Human
aauaaugagcuauuaa

SEQ ID NO: 2861328 - RNA, 20 nt, Human
aauaaugagcuauuaaaacu

SEQ ID NO: 2861329 - RNA, 21 nt, Human
aauaaugagcuauuaaaacuc

SEQ ID NO: 2861330 - RNA, 22 nt, Human
aauaaugagcuauuaaaacuca

SEQ ID NO: 2861331 - RNA, 23 nt, Human
aauaaugcauccagcaguacaau

SEQ ID NO: 2861332 - RNA, 20 nt, Human
aauaaugggcuuagagcagu

SEQ ID NO: 2861333 - RNA, 18 nt, Human
aauaauggguuucuuuca

SEQ ID NO: 2861334 - RNA, 19 nt, Human
aauaaugggcuuagagcag

SEQ ID NO: 2861335 - RNA, 15 nt, Human
aauaauggaaaaaaa

SEQ ID NO: 2861336 - RNA, 22 nt, Human
aauaauggaaaaaaaaaaaaga

SEQ ID NO: 2861337 - RNA, 23 nt, Human
aauaauggaaaaaaaaaaaagag

SEQ ID NO: 2861338 - RNA, 14 nt, Human
aaguuguucaacua

SEQ ID NO: 2861339 - RNA, 18 nt, Human
aaguugugccuuuuauag

SEQ ID NO: 2861340 - RNA, 16 nt, Human
aaguuguggauuucag

SEQ ID NO: 2861341 - RNA, 18 nt, Human
aaguuguggauuucaguu

SEQ ID NO: 2861342 - RNA, 19 nt, Human
aaguuguggauuucaguuu

SEQ ID NO: 2861343 - RNA, 19 nt, Human
aaguugugccuuuuauagc

SEQ ID NO: 2861344 - RNA, 20 nt, Human
aaguugugccuuuuauagcu

SEQ ID NO: 2861345 - RNA, 20 nt, Human
aaguggguuauucuggaguu

SEQ ID NO: 2861346 - RNA, 19 nt, Human
aauaaaaugaggacauguu

SEQ ID NO: 2861347 - RNA, 13 nt, Human
aauaaaauguuua

SEQ ID NO: 2861348 - RNA, 14 nt, Human
aauaaaauuauuug

SEQ ID NO: 2861349 - RNA, 16 nt, Human
aauaaaauuauuugca

SEQ ID NO: 2861350 - RNA, 17 nt, Human
aauaaaauuauuugcag

SEQ ID NO: 2861351 - RNA, 19 nt, Human
aauaaaauuauuugcaggu

SEQ ID NO: 2861352 - RNA, 23 nt, Human
aauaaaauuaaagcugaaaacug

SEQ ID NO: 2861353 - RNA, 14 nt, Human
aauaaacuacucuu

SEQ ID NO: 2861354 - RNA, 17 nt, Human
aauaaacuacucuuuga

SEQ ID NO: 2861355 - RNA, 19 nt, Human
aauaaacuacucuuugauu

SEQ ID NO: 2861356 - RNA, 20 nt, Human
aauaaacuacucuuugauuu

SEQ ID NO: 2861357 - RNA, 17 nt, Human
aauaagugguuauuucu

SEQ ID NO: 2861358 - RNA, 15 nt, Human
aauaaacucuaaaca

SEQ ID NO: 2861359 - RNA, 17 nt, Human
aauaaacuguguuuacu

SEQ ID NO: 2861360 - RNA, 16 nt, Human
aauaaacuuaacuuua

SEQ ID NO: 2861361 - RNA, 22 nt, Human
aagugcugggauuacaggugug

SEQ ID NO: 2861362 - RNA, 14 nt, Human
aagucucugugaau

SEQ ID NO: 2861363 - RNA, 12 nt, Human
aagucucuguga

SEQ ID NO: 2861364 - RNA, 11 nt, Human
aagucucugug

SEQ ID NO: 2861365 - RNA, 21 nt, Human
aagucucugcuggcccagcca

SEQ ID NO: 2861366 - RNA, 16 nt, Human
aagucucugcuggccc

SEQ ID NO: 2861367 - RNA, 17 nt, Human
aagucucuagguucuga

SEQ ID NO: 2861368 - RNA, 15 nt, Human
aagucucuaauucua

SEQ ID NO: 2861369 - RNA, 18 nt, Human
aagucucuaauucuauua

SEQ ID NO: 2861370 - RNA, 15 nt, Human
aagucucugcuggcc

SEQ ID NO: 2861371 - RNA, 19 nt, Human
aagucucccuucuguuucu

SEQ ID NO: 2861372 - RNA, 19 nt, Human
aagucccugacucucugug

SEQ ID NO: 2861373 - RNA, 22 nt, Human
aagucccccaagaccuaagggu

SEQ ID NO: 2861374 - RNA, 13 nt, Human
aaguauguaaaca

SEQ ID NO: 2861375 - RNA, 17 nt, Human
aaguaugagggaaaaug

SEQ ID NO: 2861376 - RNA, 21 nt, Human
aaguaugagggaaaaugagua

SEQ ID NO: 2861377 - RNA, 18 nt, Human
aaguaucuuuuuucaaaa

SEQ ID NO: 2861378 - RNA, 18 nt, Human
aaguauguguaaaaugug

SEQ ID NO: 2861379 - RNA, 21 nt, Human
aaguauguaaacaggagacag

SEQ ID NO: 2861380 - RNA, 12 nt, Human
aaguauguaaag

SEQ ID NO: 2861381 - RNA, 22 nt, Human
aaguauguaaaguauguaaaca

SEQ ID NO: 2861382 - RNA, 11 nt, Human
aaguacuucuu

SEQ ID NO: 2861383 - RNA, 14 nt, Human
aaguacuugagugu

SEQ ID NO: 2861384 - RNA, 21 nt, Human
aaguacuugaguguaauguuu

SEQ ID NO: 2861385 - RNA, 22 nt, Human
aaguacuugaguguaauguuug

SEQ ID NO: 2861386 - RNA, 22 nt, Human
aaguauagccuauggcagaaaa

SEQ ID NO: 2861387 - RNA, 18 nt, Human
aaguauauaaauuggcuu

SEQ ID NO: 2861388 - RNA, 13 nt, Human
aaguauagagaga

SEQ ID NO: 2861389 - RNA, 14 nt, Human
aaguauagagagaa

SEQ ID NO: 2861390 - RNA, 17 nt, Human
aaguauagagagaaguu

SEQ ID NO: 2861391 - RNA, 23 nt, Human
aaguauagagagaaguucauaca

SEQ ID NO: 2861392 - RNA, 23 nt, Human
aaguauaucauguaaagaaaugu

SEQ ID NO: 2861393 - RNA, 16 nt, Human
aaguauauauagaauc

SEQ ID NO: 2861394 - RNA, 11 nt, Human
aaguauauaua

SEQ ID NO: 2861395 - RNA, 17 nt, Human
aagguucuucaucccuu

SEQ ID NO: 2861396 - RNA, 19 nt, Human
aagguucuucaucccuuuc

SEQ ID NO: 2861397 - RNA, 20 nt, Human
aagguucuucaucccuuucc

SEQ ID NO: 2861398 - RNA, 16 nt, Human
aagguguuuucugugu

SEQ ID NO: 2861399 - RNA, 17 nt, Human
aagguguuuucugugua

SEQ ID NO: 2861400 - RNA, 18 nt, Human
aagguguuuucuguguaa

SEQ ID NO: 2861401 - RNA, 19 nt, Human
aagguguuuucuguguaac

SEQ ID NO: 2861402 - RNA, 20 nt, Human
aagguuuaaagagucuagau

SEQ ID NO: 2861403 - RNA, 21 nt, Human
aagguuuaaagagucuagauu

SEQ ID NO: 2861404 - RNA, 16 nt, Human
aagguugggcagggug

SEQ ID NO: 2861405 - RNA, 21 nt, Human
aagguugcauacugagccaag

SEQ ID NO: 2861406 - RNA, 18 nt, Human
aaggugggcugagcccug

SEQ ID NO: 2861407 - RNA, 22 nt, Human
aagguggauuuuguuuaaaaaa

SEQ ID NO: 2861408 - RNA, 14 nt, Human
aagguggauuuugu

SEQ ID NO: 2861409 - RNA, 16 nt, Human
aaggugggcugagccc

SEQ ID NO: 2861410 - RNA, 16 nt, Human
aagguggaccuuuuaa

SEQ ID NO: 2861411 - RNA, 19 nt, Human
aagguggaccuuuuaaagu

SEQ ID NO: 2861412 - RNA, 22 nt, Human
aagguggaccuuuuaaaguguu

SEQ ID NO: 2861413 - RNA, 23 nt, Human
aagguggaccuuuuaaaguguuu

SEQ ID NO: 2861414 - RNA, 15 nt, Human
aaggugcuggaggug

SEQ ID NO: 2861415 - RNA, 20 nt, Human
aaggugcuggaggugggagc

SEQ ID NO: 2861416 - RNA, 18 nt, Human
aaugauaaguaaaugcua

SEQ ID NO: 2861417 - RNA, 21 nt, Human
aaugauaaguaaaugcuaggu

SEQ ID NO: 2861418 - RNA, 13 nt, Human
aaugaacauucca

SEQ ID NO: 2861419 - RNA, 20 nt, Human
aaugaucugccucuaaaagc

SEQ ID NO: 2861420 - RNA, 23 nt, Human
aaugaaccacaucuugcucugcu

SEQ ID NO: 2861421 - RNA, 17 nt, Human
aaugaaccacaucuugc

SEQ ID NO: 2861422 - RNA, 16 nt, Human
aaugaaccacaucuug

SEQ ID NO: 2861423 - RNA, 15 nt, Human
aaucuggaagaaaaa

SEQ ID NO: 2861424 - RNA, 14 nt, Human
aaucccaaaaguca

SEQ ID NO: 2861425 - RNA, 14 nt, Human
aaucugcucacuuu

SEQ ID NO: 2861426 - RNA, 20 nt, Human
aaucugcucacuuuaaaccu

SEQ ID NO: 2861427 - RNA, 12 nt, Human
aaucucauuugg

SEQ ID NO: 2861428 - RNA, 23 nt, Human
aaucucauagguugccaauaaua

SEQ ID NO: 2861429 - RNA, 19 nt, Human
aaucugcaauucaaaaguu

SEQ ID NO: 2861430 - RNA, 15 nt, Human
aaucugcaauucaaa

SEQ ID NO: 2861431 - RNA, 18 nt, Human
aauccaggguggugguga

SEQ ID NO: 2861432 - RNA, 16 nt, Human
aaucccaaauuugauu

SEQ ID NO: 2861433 - RNA, 11 nt, Human
aaucccaaauu

SEQ ID NO: 2861434 - RNA, 19 nt, Human
aauccagguacgcacagac

SEQ ID NO: 2861435 - RNA, 20 nt, Human
aauccagguacgcacagaca

SEQ ID NO: 2861436 - RNA, 21 nt, Human
aauccagguacgcacagacag

SEQ ID NO: 2861437 - RNA, 22 nt, Human
aauccagguacgcacagacagg

SEQ ID NO: 2861438 - RNA, 18 nt, Human
aaucccaaauuugauuga

SEQ ID NO: 2861439 - RNA, 16 nt, Human
aaucucauaccucuga

SEQ ID NO: 2861440 - RNA, 18 nt, Human
aaucucauaccucugacc

SEQ ID NO: 2861441 - RNA, 19 nt, Human
aaucucauaccucugacca

SEQ ID NO: 2861442 - RNA, 22 nt, Human
aaucucauaccucugaccaaca

SEQ ID NO: 2861443 - RNA, 13 nt, Human
aaucugauuuuua

SEQ ID NO: 2861444 - RNA, 23 nt, Human
aaucugauuuuuaugaugaugaa

SEQ ID NO: 2861445 - RNA, 15 nt, Human
aaugaugaguauuag

SEQ ID NO: 2861446 - RNA, 12 nt, Human
aaugaugauaac

SEQ ID NO: 2861447 - RNA, 16 nt, Human
aaugaucucuucuuuu

SEQ ID NO: 2861448 - RNA, 21 nt, Human
aaugaugaucaauuauaguuu

SEQ ID NO: 2861449 - RNA, 23 nt, Human
aaugaugaucaauuauaguuucu

SEQ ID NO: 2861450 - RNA, 15 nt, Human
aaucacaauuuuuaa

SEQ ID NO: 2861451 - RNA, 17 nt, Human
aaucacaauuuuuaaug

SEQ ID NO: 2861452 - RNA, 16 nt, Human
aaucaauuuuuaggaa

SEQ ID NO: 2861453 - RNA, 14 nt, Human
aaucacaaaaauuu

SEQ ID NO: 2861454 - RNA, 15 nt, Human
aaucacaguuggccu

SEQ ID NO: 2861455 - RNA, 14 nt, Human
aauauuauguguuu

SEQ ID NO: 2861456 - RNA, 16 nt, Human
aaucaacacuaccagc

SEQ ID NO: 2861457 - RNA, 12 nt, Human
aaucaacagaag

SEQ ID NO: 2861458 - RNA, 13 nt, Human
aaucaacagaagc

SEQ ID NO: 2861459 - RNA, 14 nt, Human
aaucaacagaagca

SEQ ID NO: 2861460 - RNA, 15 nt, Human
aaucaacagaagcau

SEQ ID NO: 2861461 - RNA, 16 nt, Human
aaucaacagaagcauu

SEQ ID NO: 2861462 - RNA, 16 nt, Human
aauauucacugggcca

SEQ ID NO: 2861463 - RNA, 17 nt, Human
aauauucacugggccaa

SEQ ID NO: 2861464 - RNA, 15 nt, Human
aauauucagaaucuu

SEQ ID NO: 2861465 - RNA, 21 nt, Human
aauauucagaaucuuuguuaa

SEQ ID NO: 2861466 - RNA, 14 nt, Human
aauauguauuguaa

SEQ ID NO: 2861467 - RNA, 15 nt, Human
aauauguauuguaaa

SEQ ID NO: 2861468 - RNA, 16 nt, Human
aauaugguugauaguu

SEQ ID NO: 2861469 - RNA, 14 nt, Human
aauauggauuuguu

SEQ ID NO: 2861470 - RNA, 13 nt, Human
aauauaggucucu

SEQ ID NO: 2861471 - RNA, 23 nt, Human
aauauaggucucuucucccagaa

SEQ ID NO: 2861472 - RNA, 15 nt, Human
aauauaguuccuaag

SEQ ID NO: 2861473 - RNA, 18 nt, Human
aauauaguuccuaagaag

SEQ ID NO: 2861474 - RNA, 20 nt, Human
aauauaguuccuaagaagcu

SEQ ID NO: 2861475 - RNA, 21 nt, Human
aauauaguuccuaagaagcuu

SEQ ID NO: 2861476 - RNA, 12 nt, Human
aauauauaaaaa

SEQ ID NO: 2861477 - RNA, 17 nt, Human
aauauggacacuuaaua

SEQ ID NO: 2861478 - RNA, 17 nt, Human
aauauggacucaguuuu

SEQ ID NO: 2861479 - RNA, 21 nt, Human
aauauggacacuuaauacuac

SEQ ID NO: 2861480 - RNA, 13 nt, Human
aauauaauucugu

SEQ ID NO: 2861481 - RNA, 15 nt, Human
aauauaauucuguaa

SEQ ID NO: 2861482 - RNA, 16 nt, Human
aauauaauucuguaaa

SEQ ID NO: 2861483 - RNA, 19 nt, Human
aauauaauggaagagaaau

SEQ ID NO: 2861484 - RNA, 23 nt, Human
aauauaauggaagagaaaucuca

SEQ ID NO: 2861485 - RNA, 13 nt, Human
aauauaagauuuu

SEQ ID NO: 2861486 - RNA, 21 nt, Human
aauauaacuuaaaaauguaaa

SEQ ID NO: 2861487 - RNA, 14 nt, Human
aaugggaacauuua

SEQ ID NO: 2861488 - RNA, 15 nt, Human
aaugggaacauuuau

SEQ ID NO: 2861489 - RNA, 23 nt, Human
aaugggaacauuuauuuuaugag

SEQ ID NO: 2861490 - RNA, 21 nt, Human
aauggcuuauccagcugguga

SEQ ID NO: 2861491 - RNA, 22 nt, Human
aauggcuuauccagcuggugag

SEQ ID NO: 2861492 - RNA, 20 nt, Human
aaugggccacugaaaucugu

SEQ ID NO: 2861493 - RNA, 15 nt, Human
aaugggcucuuccaa

SEQ ID NO: 2861494 - RNA, 20 nt, Human
aaugggcucuuccaacaagg

SEQ ID NO: 2861495 - RNA, 17 nt, Human
aaugggcuuagagcagu

SEQ ID NO: 2861496 - RNA, 16 nt, Human
aaugguauaaauuuca

SEQ ID NO: 2861497 - RNA, 23 nt, Human
aaugguaguaaucacaguuggcc

SEQ ID NO: 2861498 - RNA, 18 nt, Human
aaugguaggcauuuccua

SEQ ID NO: 2861499 - RNA, 17 nt, Human
aaugguaggcauuuccu

SEQ ID NO: 2861500 - RNA, 16 nt, Human
aauggucgcccaggag

SEQ ID NO: 2861501 - RNA, 18 nt, Human
aauggucuaaaaauaaac

SEQ ID NO: 2861502 - RNA, 15 nt, Human
aauggucgcccagga

SEQ ID NO: 2861503 - RNA, 22 nt, Human
aauggucuuucuaaugugugaa

SEQ ID NO: 2861504 - RNA, 22 nt, Human
aauggugaaaauaaaauaaagc

SEQ ID NO: 2861505 - RNA, 19 nt, Human
aaugguacaugucuuccau

SEQ ID NO: 2861506 - RNA, 22 nt, Human
aaugguggggaacuauaaagaa

SEQ ID NO: 2861507 - RNA, 17 nt, Human
aauggugcuuaaguucc

SEQ ID NO: 2861508 - RNA, 16 nt, Human
aaugguggcuucagcu

SEQ ID NO: 2861509 - RNA, 17 nt, Human
aaugguggcuucagcuc

SEQ ID NO: 2861510 - RNA, 19 nt, Human
aaugguggcuucagcucca

SEQ ID NO: 2861511 - RNA, 20 nt, Human
aaugguggcuucagcuccag

SEQ ID NO: 2861512 - RNA, 21 nt, Human
aaugguggcuucagcuccagc

SEQ ID NO: 2861513 - RNA, 23 nt, Human
aaugguggcuucagcuccagccc

SEQ ID NO: 2861514 - RNA, 15 nt, Human
aaugguggcuucuuu

SEQ ID NO: 2861515 - RNA, 22 nt, Human
aaugguggcuucuuuucuuugu

SEQ ID NO: 2861516 - RNA, 23 nt, Human
aaugguggcuucuuuucuuugua

SEQ ID NO: 2861517 - RNA, 18 nt, Human
aauggugacuuaauccgu

SEQ ID NO: 2861518 - RNA, 16 nt, Human
aauggugaucacucca

SEQ ID NO: 2861519 - RNA, 15 nt, Human
aaugguccugacuuu

SEQ ID NO: 2861520 - RNA, 13 nt, Human
aaugucaguauuu

SEQ ID NO: 2861521 - RNA, 16 nt, Human
aaugucaguauuucag

SEQ ID NO: 2861522 - RNA, 20 nt, Human
aaugucucuuuaaugucaca

SEQ ID NO: 2861523 - RNA, 14 nt, Human
aaugucuguaaaua

SEQ ID NO: 2861524 - RNA, 15 nt, Human
aaugucugcagcccu

SEQ ID NO: 2861525 - RNA, 21 nt, Human
aaugucugcagcccugagaaa

SEQ ID NO: 2861526 - RNA, 15 nt, Human
aaugucugcugagga

SEQ ID NO: 2861527 - RNA, 16 nt, Human
aaugucugcugaggag

SEQ ID NO: 2861528 - RNA, 13 nt, Human
aaugucuccuccc

SEQ ID NO: 2861529 - RNA, 18 nt, Human
aaugucuaaaugcugaaa

SEQ ID NO: 2861530 - RNA, 18 nt, Human
aauguuugccucugccuc

SEQ ID NO: 2861531 - RNA, 17 nt, Human
aaugucuugcuguugac

SEQ ID NO: 2861532 - RNA, 19 nt, Human
aaugucuugcuguugacau

SEQ ID NO: 2861533 - RNA, 22 nt, Human
aaugucuugcuguugacauauu

SEQ ID NO: 2861534 - RNA, 23 nt, Human
aaugucuugcuguugacauauuu

SEQ ID NO: 2861535 - RNA, 21 nt, Human
aaugucuucauuucauuguau

SEQ ID NO: 2861536 - RNA, 17 nt, Human
aaugucuucauuucauu

SEQ ID NO: 2861537 - RNA, 18 nt, Human
aaugucuuaauuuuugaa

SEQ ID NO: 2861538 - RNA, 15 nt, Human
aaugucuucaaggcu

SEQ ID NO: 2861539 - RNA, 18 nt, Human
aaugucuucaaggcuuca

SEQ ID NO: 2861540 - RNA, 19 nt, Human
aaugucuucaaggcuucag

SEQ ID NO: 2861541 - RNA, 12 nt, Human
aaugucuucaua

SEQ ID NO: 2861542 - RNA, 19 nt, Human
aauguuugccucugccucu

SEQ ID NO: 2861543 - RNA, 19 nt, Human
aauguuugucucaguugga

SEQ ID NO: 2861544 - RNA, 20 nt, Human
aauguuugucucaguuggaa

SEQ ID NO: 2861545 - RNA, 22 nt, Human
aauguuugucucaguuggaaau

SEQ ID NO: 2861546 - RNA, 20 nt, Human
aauguuuuacugugaaacug

SEQ ID NO: 2861547 - RNA, 22 nt, Human
aauguuuuacugugaaacuggc

SEQ ID NO: 2861548 - RNA, 13 nt, Human
aauguuuucuuug

SEQ ID NO: 2861549 - RNA, 16 nt, Human
aauguuuucuuugcaa

SEQ ID NO: 2861550 - RNA, 17 nt, Human
aauguuuucuuugcaaa

SEQ ID NO: 2861551 - RNA, 19 nt, Human
aauguuuucuuugcaaagu

SEQ ID NO: 2861552 - RNA, 22 nt, Human
aauguuuucuuugcaaaguauu

SEQ ID NO: 2861553 - RNA, 18 nt, Human
aauguuuguuaaaaauaa

SEQ ID NO: 2861554 - RNA, 19 nt, Human
aauguuuguuaaaaauaaa

SEQ ID NO: 2861555 - RNA, 14 nt, Human
aauguuuuaaaugu

SEQ ID NO: 2861556 - RNA, 15 nt, Human
aauguuuuaaaugua

SEQ ID NO: 2861557 - RNA, 16 nt, Human
aauguuuuaaauguac

SEQ ID NO: 2861558 - RNA, 17 nt, Human
aauguuuuaaauguaca

SEQ ID NO: 2861559 - RNA, 19 nt, Human
aauguuuuaaauguacaga

SEQ ID NO: 2861560 - RNA, 14 nt, Human
aauuaaaacuucuu

SEQ ID NO: 2861561 - RNA, 15 nt, Human
aauuaaaacuucuua

SEQ ID NO: 2861562 - RNA, 16 nt, Human
aauuaaaacuucuuaa

SEQ ID NO: 2861563 - RNA, 20 nt, Human
aauuaaaacuucuuaaauau

SEQ ID NO: 2861564 - RNA, 13 nt, Human
aauuaaaacacuu

SEQ ID NO: 2861565 - RNA, 14 nt, Human
aauuaaaacacuuu

SEQ ID NO: 2861566 - RNA, 16 nt, Human
aauuaaaacagcugca

SEQ ID NO: 2861567 - RNA, 10 nt, Human
aauuaaaacu

SEQ ID NO: 2861568 - RNA, 19 nt, Human
aauuaaaacuauucaugcu

SEQ ID NO: 2861569 - RNA, 20 nt, Human
aauuaaaaggauaguauuuu

SEQ ID NO: 2861570 - RNA, 22 nt, Human
aauuaaaaggauaguauuuuua

SEQ ID NO: 2861571 - RNA, 13 nt, Human
aauuaaaauggau

SEQ ID NO: 2861572 - RNA, 21 nt, Human
aauuaaaauggaugccuugaa

SEQ ID NO: 2861573 - RNA, 21 nt, Human
aauuaaaauugucccauuugc

SEQ ID NO: 2861574 - RNA, 12 nt, Human
aauuaaaaacua

SEQ ID NO: 2861575 - RNA, 17 nt, Human
aauuaaaaacuaguagu

SEQ ID NO: 2861576 - RNA, 21 nt, Human
aauuaaaaacuaguaguucuc

SEQ ID NO: 2861577 - RNA, 12 nt, Human
aauuaaaaagau

SEQ ID NO: 2861578 - RNA, 15 nt, Human
aauuaaaaagauucu

SEQ ID NO: 2861579 - RNA, 16 nt, Human
aauuaaaaagauucuu

SEQ ID NO: 2861580 - RNA, 19 nt, Human
aauuaaaaagauucuuuuu

SEQ ID NO: 2861581 - RNA, 21 nt, Human
aauuaaaaagauucuuuuucu

SEQ ID NO: 2861582 - RNA, 23 nt, Human
aauuaaaaagauucuuuuucuga

SEQ ID NO: 2861583 - RNA, 21 nt, Human
aauguuuuucugccagggagc

SEQ ID NO: 2861584 - RNA, 19 nt, Human
aauguuuuuucauguguuu

SEQ ID NO: 2861585 - RNA, 15 nt, Human
aauguuuuucugcca

SEQ ID NO: 2861586 - RNA, 22 nt, Human
aauuaaauuuugaguucuacau

SEQ ID NO: 2861587 - RNA, 14 nt, Human
aauuaaauuuugag

SEQ ID NO: 2861588 - RNA, 12 nt, Human
aauuaaaucugu

SEQ ID NO: 2861589 - RNA, 16 nt, Human
aaauauuuucuggguu

SEQ ID NO: 2861590 - RNA, 13 nt, Human
aaaucuugaaauu

SEQ ID NO: 2861591 - RNA, 13 nt, Human
aaaucuuggaagu

SEQ ID NO: 2861592 - RNA, 19 nt, Human
aaaucuuggaaguacauga

SEQ ID NO: 2861593 - RNA, 20 nt, Human
aaaucuuggaaguacaugaa

SEQ ID NO: 2861594 - RNA, 23 nt, Human
aaaucuuggaaguacaugaauac

SEQ ID NO: 2861595 - RNA, 16 nt, Human
aaaucuuggcaauauu

SEQ ID NO: 2861596 - RNA, 14 nt, Human
aaaucuucuccaga

SEQ ID NO: 2861597 - RNA, 15 nt, Human
aaaucuucuccagau

SEQ ID NO: 2861598 - RNA, 17 nt, Human
aaaucaagcaagccucu

SEQ ID NO: 2861599 - RNA, 21 nt, Human
aaaucaagcagguuagagaaa

SEQ ID NO: 2861600 - RNA, 12 nt, Human
aaaucaaguauu

SEQ ID NO: 2861601 - RNA, 16 nt, Human
aaaucaacagaagcau

SEQ ID NO: 2861602 - RNA, 17 nt, Human
aaaucaacagaagcauu

SEQ ID NO: 2861603 - RNA, 18 nt, Human
aaaucaacagaagcauuu

SEQ ID NO: 2861604 - RNA, 19 nt, Human
aaaucaacagaagcauuug

SEQ ID NO: 2861605 - RNA, 22 nt, Human
aaaucaacagaagcauuuguau

SEQ ID NO: 2861606 - RNA, 16 nt, Human
aaaucaacuuaacaug

SEQ ID NO: 2861607 - RNA, 20 nt, Human
aaauggaacgcuaaugaaac

SEQ ID NO: 2861608 - RNA, 20 nt, Human
aaauggaaaguaacucauuu

SEQ ID NO: 2861609 - RNA, 15 nt, Human
aaauggaagacacau

SEQ ID NO: 2861610 - RNA, 18 nt, Human
aaauggaagacacauuga

SEQ ID NO: 2861611 - RNA, 20 nt, Human
aaaugcuuuuuauuucugca

SEQ ID NO: 2861612 - RNA, 18 nt, Human
aaaugcuuuuuauuucug

SEQ ID NO: 2861613 - RNA, 20 nt, Human
aaaucuugugcuagaauacu

SEQ ID NO: 2861614 - RNA, 19 nt, Human
aaauggacugguuugagau

SEQ ID NO: 2861615 - RNA, 19 nt, Human
aaauggccauuugcuuuuu

SEQ ID NO: 2861616 - RNA, 23 nt, Human
aaauggccauuugcuuuuucacc

SEQ ID NO: 2861617 - RNA, 22 nt, Human
aaauggccauuugcuuuuucac

SEQ ID NO: 2861618 - RNA, 21 nt, Human
aaauggcgucuggaaguccaa

SEQ ID NO: 2861619 - RNA, 16 nt, Human
aaauggccauuugcuu

SEQ ID NO: 2861620 - RNA, 14 nt, Human
aaauauaagauuuu

SEQ ID NO: 2861621 - RNA, 14 nt, Human
aaauauaagccuuu

SEQ ID NO: 2861622 - RNA, 22 nt, Human
aaauauaagccuuuuauacuga

SEQ ID NO: 2861623 - RNA, 11 nt, Human
aaauauaauuc

SEQ ID NO: 2861624 - RNA, 12 nt, Human
aaauauaauucu

SEQ ID NO: 2861625 - RNA, 13 nt, Human
aaauauaauucug

SEQ ID NO: 2861626 - RNA, 16 nt, Human
aaauauaauucuguaa

SEQ ID NO: 2861627 - RNA, 19 nt, Human
aaauauaauucuguaaaug

SEQ ID NO: 2861628 - RNA, 17 nt, Human
aaauauaauucuguaaa

SEQ ID NO: 2861629 - RNA, 18 nt, Human
aaauauaauucuguaaau

SEQ ID NO: 2861630 - RNA, 15 nt, Human
aaauagugaauuaua

SEQ ID NO: 2861631 - RNA, 19 nt, Human
aaauagugacauaauauau

SEQ ID NO: 2861632 - RNA, 21 nt, Human
aaauagugacauaauauauuc

SEQ ID NO: 2861633 - RNA, 22 nt, Human
aaauagugacauaauauauucu

SEQ ID NO: 2861634 - RNA, 20 nt, Human
aaauagugcagaaucucaua

SEQ ID NO: 2861635 - RNA, 21 nt, Human
aaauagugcagaaucucauag

SEQ ID NO: 2861636 - RNA, 16 nt, Human
aaauagucuaguguag

SEQ ID NO: 2861637 - RNA, 11 nt, Human
aaauagagcaa

SEQ ID NO: 2861638 - RNA, 15 nt, Human
aaauagagcuuuuaa

SEQ ID NO: 2861639 - RNA, 13 nt, Human
aaauauaaacaaa

SEQ ID NO: 2861640 - RNA, 12 nt, Human
aaauaguuuguu

SEQ ID NO: 2861641 - RNA, 11 nt, Human
aaauauaaaac

SEQ ID NO: 2861642 - RNA, 16 nt, Human
aaauauaaaacaaaua

SEQ ID NO: 2861643 - RNA, 15 nt, Human
aaauaguauuugcau

SEQ ID NO: 2861644 - RNA, 23 nt, Human
aaauauaaacaaagauucaugau

SEQ ID NO: 2861645 - RNA, 12 nt, Human
aaauauaaacau

SEQ ID NO: 2861646 - RNA, 13 nt, Human
aaauauaaacauc

SEQ ID NO: 2861647 - RNA, 22 nt, Human
aaauauaaacaaagauucauga

SEQ ID NO: 2861648 - RNA, 12 nt, Human
aaauauaaaaua

SEQ ID NO: 2861649 - RNA, 13 nt, Human
aaauauaaaucuu

SEQ ID NO: 2861650 - RNA, 14 nt, Human
aaauaguauuugag

SEQ ID NO: 2861651 - RNA, 13 nt, Human
aaauaguaaaaau

SEQ ID NO: 2861652 - RNA, 16 nt, Human
aaauaguaaaaauaaa

SEQ ID NO: 2861653 - RNA, 19 nt, Human
aaauagacauauuaacaug

SEQ ID NO: 2861654 - RNA, 14 nt, Human
aaauagaaauaagu

SEQ ID NO: 2861655 - RNA, 14 nt, Human
aaauacuuuuccuu

SEQ ID NO: 2861656 - RNA, 15 nt, Human
aaauacuuuuccuua

SEQ ID NO: 2861657 - RNA, 19 nt, Human
aaauacuuuuccuuaccuu

SEQ ID NO: 2861658 - RNA, 16 nt, Human
aaauacuuuuucuaau

SEQ ID NO: 2861659 - RNA, 18 nt, Human
aaauacuuuuucuaauga

SEQ ID NO: 2861660 - RNA, 18 nt, Human
aaauagaaaaguagacaa

SEQ ID NO: 2861661 - RNA, 14 nt, Human
aaauagaaaaguua

SEQ ID NO: 2861662 - RNA, 15 nt, Human
aaauagaaaaguuau

SEQ ID NO: 2861663 - RNA, 16 nt, Human
aaauagaaaaguuauu

SEQ ID NO: 2861664 - RNA, 17 nt, Human
aaauagaaaaguuauua

SEQ ID NO: 2861665 - RNA, 14 nt, Human
aaauacuuagcaaa

SEQ ID NO: 2861666 - RNA, 16 nt, Human
aaauacuuagcaaaaa

SEQ ID NO: 2861667 - RNA, 22 nt, Human
aaauacuguuuuuaacaacuau

SEQ ID NO: 2861668 - RNA, 14 nt, Human
aaauacugugugga

SEQ ID NO: 2861669 - RNA, 13 nt, Human
aaauacuguuggu

SEQ ID NO: 2861670 - RNA, 14 nt, Human
aaauacuguuggug

SEQ ID NO: 2861671 - RNA, 13 nt, Human
aaauaaaguauau

SEQ ID NO: 2861672 - RNA, 23 nt, Human
aaauaaaggaugugauuguggaa

SEQ ID NO: 2861673 - RNA, 14 nt, Human
aaauaaacucuaaa

SEQ ID NO: 2861674 - RNA, 14 nt, Human
aaauaaacuguugc

SEQ ID NO: 2861675 - RNA, 11 nt, Human
aaauaaacuuu

SEQ ID NO: 2861676 - RNA, 12 nt, Human
aaauaaacuuuu

SEQ ID NO: 2861677 - RNA, 13 nt, Human
aaauaaacuuuuu

SEQ ID NO: 2861678 - RNA, 17 nt, Human
aaauaaacuuuuuuuca

SEQ ID NO: 2861679 - RNA, 18 nt, Human
aaauaaacuuuuuuucaa

SEQ ID NO: 2861680 - RNA, 19 nt, Human
aaauaaacuuuuuuucaau
